United States Patent 11,001,841 (CCCTC-BINDING FACTOR (CTCF) RNA INTERACTOME) - sequence listing, part 6

SEQ ID NO: 13082 - DNA, 1023 bp, Homo sapiens
gacatagaaaatcccaaagctgtgtctgtgtgataacgcatataattttgttatttaagaattaaaagattataaatgtataaattttattttaatcatttgaaagttgggatggttgaaaatatataggagtaatgatagtattacctagccagtatttgagtagattctttaaatatctttgattgattaggctagaagtacaaatagtcatccatcatggcagagtttagaaaattgggctttagacaaatgagtttgcagaaaattcaactttcgctccatagctgcatgattcttattaccttgttaagcttgatacttttgattaagaacattttttgccagatttgattttctctgcaaaggttaatttgattgaaaaaatgaaattattttgaggaaagaagtaaaggctagtattattttagtgtctactttctgattctgttgatttttggatggtgaagtggttggttttatattgtacactctattctgggatgagatccatgtttaaaacatacatatgcctatgtcttgtttgtcccagtcatatctttatttgtgtccacttttaaattttccttttcggccggatgtggtggcccatgcctgttatcccaacactttgctgggaaccgaggtggcaaggttgcttgagtccagagttcaagaccagcctgggcaacatgttgagaccctgtctctacaaaaaatacacaaatgagccaggggtggtggcatgtgctggtgatccaagctactagggaggctgaggcagtatatgattgcttgagcctgggaagttgaggcttcagtgaaccatgttggcgccactgcactccagcctgggcaacagagtgaaacgctgtttcaaaaaaaggacaaaagaaagaaaaaagaaagttctcttcaacagaaggctgtacttgcatatagtatatagtcatctggagcttgggaatttttttgactaggttgcatcaattgcaaataatgctgtgacattcaaactttaat

SEQ ID NO: 13083 - DNA, 1025 bp, Homo sapiens
tggttttgaactcctgacctcaggtggcctgcctgcctcagcctcccaaagtgctgggattatatgtgtgagccactgcgacgggcccttttttttttttttttttttttaagatcaggtatattttaaatgttgggatgttgtgttttatctcacagttctgtgtgttcataacattggtaggggttgagggagggtgtccatgttagtttagtctctcattttccagaaataatattgtcctaactggttggttgtatttaggaagggtgctgatttggtatatattaattttctaatcattaatgaattctgtaattattttccaggagttttttatgttgtttctcttaggttttccagaaatagaattgtgttatccaaaaaaacagtgatgctttgcctttatagattagccttgaagtttttaaaatctcatttctttcttttgttagttccagttaatttctccagtagacattcctgtgttgttccttacttttatttgaattgggtacttttgagaatcatttttcaaatgccctaaagcagttaatttatcatatattacttttaaatatctcagtttgcatgttcactttagaagttacagtgtaattattgtatactgatgtcatcagaatgtcatttcaagagtaaatgacaaaaaaaaatacaaaaaatgaaatacgaaagtgaaatattcttaatttagaatatttaaaatacaaattttcatccttctagattgttgttatgctgatcttctatgtattactatatttgctgtagtgctctgttgattgagtgtcagttaatatcagggtgttccagtaaccattggtagccctttccctgctgtatatggaaagattgaaattatacaagaatatttatgtgtgaaacatgaaatttctaatgaagaagaagaaacttctattacagtgtatctgatgtacctcattattaaaagaagacctttagttttattatatcaaatggtttcctgaaacccttttagcgta

SEQ ID NO: 13084 - DNA, 1029 bp, Homo sapiens
tttactttactgtgcaccagaatatttttatctcctgaaacttaatgaagtatgggttcttaagcaggagaggatggtaattattaggcctatttgtgagactactgtgtgccagacagtatactaattaaatactttacatgtcttactttatttctcacaaacatcctgtgacatattattttcatttccattttacatatgaggaatactgaagttgacaggttaagtaacttaaccttcaggaccaatggctggtaaacagctgactgattccagacttaaaactaggttgttctaactgtaccacaatatttcttaaagcgtattaaagtatctttccttagcttactctgtataaatgaaatatgatataatttagtaaaatttcataaataatacagtaggaatacatttgccataaagatctcaaaatgcctgcttgtaatcagaaattcagcatcgtctagtgagtgttgtctcttgattgctaaagaattaaaagaaatatgtctggctgttacaccttaagatggatctttccaggtaaggtgggaaggaacttacttgtcataacctttgaaatattcatcttggaatttttcttaactgtttaatattgtatttgaggctttagccaggttttgcaaaagtttaaaaagaaaaaaaaatggaaggcacaaagaccggaaaggagaaaataaacctaccatctataaatcatgtgactgcagattagacattatttgaaataacaaactgtagaaaatggctggatgtaagattaatacatcagttgcatttctgtaggccagtacccagttaacttcaaaatataattaaaagcaaatgctacttaaaatggttttgcaatatcagtatgtaggaataaataacaacaaaagataggtaagatttcagcaggggagatttatttattacgcagtattaaataatataaatgaaatactgtagattagtagaggttactcatgattaggaagacagaacaagtaagatgtcaatttt

SEQ ID NO: 13085 - DNA, 1084 bp, Homo sapiens
catctagcactattgtaaagaagggtttgagaatggaaatgggtaagtgcagtcctacttcacttttctttctcatttccatagtagtgaaaatgtagagaagagacatgtttactgtttctccattggctgttacagttttccagaggaatgaaatgtaatatttaagaatgaacttgacttgcatgaattaaaatgttttcaaaattttgtgtgctaagatgacggcagccaaaacagctatgtttgggttatcttgttttttaaattgcatgttggacatccaagtaattcctcttttatcttgggtaggtatttgttgactgaccaaaacaggatgcgaagtgtaaatgacatcatgcccatgattggtgctcgattttatactcaattggatgctgctcaaatgagaaatgatgtcatagaggaagaccttgcaaaggtaaagagtgtaaattttttttttttttttttttttttgagacagagtcttgctttgtcacccaggctggagtgcagtggtgctatctcggcttactgtaacctctgcctcctgggttcaagcgagtctcctgcctcagcctcccaagtagctgggattacaggtgtacgccaccacaccccgctatttttgtattgttagtagagacggggtttcaccatgttggccaggctggtcttgagctcctgagctcaagtgatccgcccgcctcagcctcccaaagtgctgggattacaggcgtgagccattgcacctggccagtaaagagtgtaattaaaagaatgtacacacaacttgcatctgtgtatataaatagacacaaaataatcattgtactaaatataatgccttatttgctaagatttcagatatttttgtcggcactgaatgtttggtattttaatttcttatgtcctctggacaacactgttcttttcattcatggctttgctacagtcatgtgacaaaaatcttggtttttcatgtgagttacttttccaattcctatggacagctccataatcttcttgagtaccattatgaaatgaaatggacatattgtgtttgtttaaaagtataacc

SEQ ID NO: 13086 - DNA, 1030 bp, Homo sapiens
atcatagccttttattttagagacttgtttaaagatattcagtttatttgcacattctttgctttggaaatacttagattttgcacaagttcttattagataattttctattcatgtttatgcctaattcaagaattggctatcggctgggtgcaatgggtcacacctctaatccaagcacgttgtgggggctgaggtgggaggatggcttgagcccaggagtacaagaccagtatgggcaacatagtgagaaccttttctacaaaaaattaaaaagcaattagctgggcatagtggtacatgtctgcagtcccagctacttaggaggctgaggcaggaggatggcttgaacctaggaggtccatgctgcagtgagctgtgatggtgttactgtacttgagcctgggagacaaagtaagaccctgtctcaaaaaaaaaaaaaaaaaaaaaaaacaaagaactgattattattttttgaacatttctcaaactgggaaggtttagcgttgcaaacctgggcttatactccatgaaaataatacccattttgaaatattaaggaagtttacaattgtacagtgtttcttgatttgagggataatcttcctcagaggaaatttgtacaagctgaatttattgagaatagtagcaaattttcccttgattaagtgtggtaaatgtgagtatatcctgaccactgttaccacgatctggcagtaatagtactgcgatagcaatttcatacactggacatcattaactacctcatgaaactgcctacaagacttaccaggcactatacttgcaatgtgtgagtaagttcaaataagttcttgccaccttaattccagcagggggaggagtcatatggaatggtcagtagcatcattgaagatgagtattatacaaaataaatttaacttcttttgctttgaacatgtagcacaccctgggcctgactactatattaatattccttgtgcaccattttactatttatattgccggggggagaggcatttctgaaatg

SEQ ID NO: 13087 - DNA, 1035 bp, Homo sapiens
ttaacctgttccactggtctgtgtgtttgtttttgtaccagtaccatgatgttttggttactatattcttgtagtatagtttgaagttgaatagtgttatgcctccagctttgttctttttgcttaggattgctttggctattggggctcttttttggttccatatgaatttgagaatacgtttttctagttctgtgaaaaatggcattgatagtttgataggaataacattgaatctgtaattgctttgggcactatggccattttaacaatgttgattgtttctatccaagagcatggaattttttccatttctttgtgtcatctattatttctttcagcaatgttttgcagtttttgtagagatttttcacctccctggttagctgtattcctaggtattttattctttttgtggctatcatgttcttgatttggttcttagctcaaatgttattggtgtatatggtactgggttttatatattaattttgtattctgaaaatttactgaggacgtttatcatttctaggagccttctgaaggagtctttagggttttctaggtatagaatcatatcatcagtgaagtgggataatttgacttcctctcttcctatttggatgcctttatttatttctcttgcctgattactctggctaggacttccagcactatgttgaataggaatggtgagagtggacatccttatcttgttccagttcttaatgagaatgctttcagcttttgcccattcagtatgatgttggctgtgggtttgtcatagatggttcttattagtttgagatatgttccttaaatgccttgtttgttagaggtttttaacatgaaaggatgttgaattttattgaaagcttttgctgtgtctatgagattattatgtggtttgtagtgttagttctgtttatgtggtcgatcacaattactgttttgcatatgttgaaccaaccttacatcccaagaataaagcctacttgattgtggtggattagctttttgatgtgctgctaaatt

SEQ ID NO: 13088 - DNA, 1038 bp, Homo sapiens
gttgttactcctaactccatatgacttctacataaaaccatgatagatgctagtataaatctgtccaaacatggattataacacagtgtgatttaattggtcctagactatatccattaggattgggttcaggcatgaataacaaaatcccgaaacaatggtagcttaaggcagctgttcatttctctcttacataagagtcagaaggtgagcgctgaggagcagctgtggttctgctccccgtcctcggggacccaggctccttacagccactgtcctatgaccgcaaggtggaggaccatgatgccccccgaccacggtgcagtgtgacacttggtgtgacagtcatcacatctatattccaggtggcaggctggaagaaggaatgaacaaagaagcagagaaagtgggtctgctctctctggggggaagtgtccaggaactgcacttgactatacatctctttggccagaactaagtcacaagtcaaatttagccacaatggagctggagaaatgtgctttttttctcgttggtgaccttgcccagatattattttattactatggaagaaggggagaatgtgactagcaccctatgtcataggtcctcaattgcctcaacacttagatggggatagtagtcctgtcgtatgtaagtatgaggtaggtgagggcaaaggatctagcagaatgtttggaagaatagtgggtgctcagtgtgtgttaattcccttaaatttcagattagattctgctgtttcctctctcgcccagctttaaagaagctgactcaaaattaagaaaccaagaaaccagcagaaaaaataacgaaccttgggatcacaaaaagaatgtacgttttctgattcataaaaatatctgttctaagcacaccaactaaaagacagagtttgtcagattggataaaaaaagaaaagcaagacttggctacatgctgcctaaaataaacctgcttcaaatataaagacacaaataagttaacagtgaaaggatgaaaaaaatatatactatacta

SEQ ID NO: 13089 - DNA, 1083 bp, Homo sapiens
cttggttgcgtaaagatgttcgtttttattgccatttgatttgcgagaggagaaaatacatttcaaggtttttttctttttttttaaccttttggaggtccttgttagctattagcatatagtagttactctctcatctctttggtttatctttgcaactgatgggaaaagttatgaatttctaatgtacctggaagagtattttggaaattggttagtccaaaaccagtatatatactctgaactaaagagagtatagaatcttgtaaattctaaaagatccttttagaagctctaaatcgcttttagaattatagtaatttgtaccgactggtacggcttttatatagcagctcattaaattctgtaatactccacattttattgtatttgacagtttatgagactgtctcatacacttttaattctcagaactttgcaagatttgtattcctatttcatgaataagaaaataaattgatttcagagggtttgggaacataagatcctgatacagtggcagagctgtggttggaatacagacttctaatttcagatctgtttattccagcaaaaaattagcagttcatcagaattacctggagtgcttttaataaatttctgagtatcacccccagatgctgattcaatagagttggcccagaattctgtggttttgtaacatttgaggatgagtctgatcatcatcagccaggtttggaaaatactagactaaatcacatggttgttaatagatacttatgctgggtataatttgaagtaaagtaatcccaggcgtgtctacaaatataaatttctttatgtttatattcagtaattttttttatgagtgtcactgtttggcactgttgcagatacaatgttaggatacaataataaaacaaaaatttcttgcccttaaggaagttatgtcatagagtgggaaagacagtgaacaagtatgtgtttttctgtcaggtgataaaaagtgctgtggagaaaaataaggcagtagggactggaatgccaaagtagggggagtttgcaattttaaataggatggtgaggggaacgcttcaatga

SEQ ID NO: 13090 - DNA, 1103 bp, Homo sapiens
cctgtaggatctgacatggtctctaggtagataacatccaaatggaattggattataggatacccatttggtgtcctctggagaattgcttggtgtggggaaaaagcccccacacatctggtcacaaaagtgtgctgggaggatagaatatgtgaaaattgtcataatcaaaatggagtcacttgtgttaaaaaagaaaaaaaaatcctgactggccaggcacagtggctgacaactgtaatcccaacactttgggaggctgaggcaggaggattgcttgatcccaggaattggagaccagcccatgcaacatagtgtggccttgtctctacaaaaaaaaaaatttaaattagctgggcatggtggtgtgagtctgtagccccagctacccgggagggggactacgggtgcacggcaccatgcccaggaggtccaggctgcagtgagctgtgattgtgccactgcattccagtcaggatgacagagtgtgagaccctgtctctattaaaagaaaaaaaaaagacaaatagatccaggaaaggctatgaagagagagctttcatgcataaataccaaaatatctcaaaagactctgcaaaaaccacacccttgcacaaaggccatcatgaaatacttctgaaatacacagaaaatacatcatgaaataaatacacagaaaatacttctgcaaggacatctgcccagcaactgcctggtccatctgtggacgggtgtcatccttgttattgatccttgtagccaagggtaattatctcaaaacaagtatgtgatcctccttattttcctttaaaaaccttttgtcttcccttacctccctgaacacacacagtttactatggcatgtgtattcccattggaatactttattcctgaataaatgtcactttctttttagaagcttctcttttctttttatttagattgataagtagaaaggaaaaaaagcttttttccctttggactagttgaaggcagttgcagtattctgggggagagggtggtggcagaggtgttgaggcatggttggagtttatttatactttgaaggtaaagccaacaggatttgctgaaagattgggata

SEQ ID NO: 13091 - DNA, 1115 bp, Homo sapiens
acacagaaattactctgtgcacttttaatttgaaaatacttttaaaatgtgtagtataatgtagtgtctgtcccaaaagagtaacattcattatagtgtttctttacgttgttgaaaattttaaattcacttaacattagatttttattaaagcaaaaatatgttttccttattagcttacccttttgtaactcagattaaacccttgattgttcaaattaacctgaaaaaaattattcttttggaggccaaacttttgattaagtagttgtttgtctctaattttttcaaatttatgtgtataaatataacctgtcatcaaatcaatgctaacattctatacatgtttttcatgatatgaaaactataaaacatgaagttatttgaatttgtgtagtttttatcattttatttttactttccagtgcatctatcctttgggctctaaatcacttaataacctaatttctcctgatttggaagaatgtcacactccacataagcctcagaaaaggaagagcttagaaagcagctataaggattcacttcttttagcaaattccaaaaagactagaaattatattgctattgacggtggaaaagttttgaacagcaaacataatggagaagtatatgacgaaacctcgtcaaacttacctgatagtagtggtcaacagaatccaattaggacagctgattccttggagcggaatgagattttggaagctgatactgttgacatggctactacaaaagatcctgctacagttgatgtctctggaactggcagaccttcccctcaaaatgaaggatgtacatctaaactggaaatgccactggagagcaaatgtacatcatttccccaggctttatgtgtccagtggaaaaatgcttatgctctctgttggttagactgtatcctgtcagctttggtgcactcggaagagttaaagaacaccgtgactggactgtgctcgaaggaggaatctatattctggcggttgcttacaaaatataatcaagcaaatacacttctatataccagtcaattgagtggtgttaaaggttggtactaatattttatttttatttacttatttattcatctggagtca

SEQ ID NO: 13092 - DNA, 1023 bp, Homo sapiens
tgcctgggtgatagaatgagactctgtctcaaaaaaaaaaaaaaaaaaaaaaaagtaaagtaaatgtggctcaacatgttgctgtcagttggaacatttgtttctgatcgtgtcttccacccacaaattgaatgctttttccatcttaacacttatcaggcactgtggccataacttgagcagttgagatgcaacagcaaaattagcacaaatttctttttctttcttcgcagtttcatggataagagatttgttcttagatctcagcaacctcagcatatgatttttttctttaagttgagaactttgacctttttacttagagaagcattttacagcttctctttggcatatctgaattgccagcattactatgctcgtgctttggggccattattaagtcaaataagggttgcttgaacacaagcactgcaataccatggcaatagatcgcatcaccaagatggctgctaagtgaaccacaggcaggagtgtagacagcatggacacattagacgaagggaagattcacgttgccagtggaacacagcaggacagcaagagagttcatgatgctactcagaatggcatgaaatttaaagcttataaattgtttctggaattttccgcttaatattttcagaccacggttgagttcaggtaactgaaaccataggaagcaaaacacggatgaagagggaccacttcgtattgcctaatttagtttgttttgatcttctgggacctttttttcttgttgtaaaaatttatggggctgtttatagttgtggctcattgatttttcattgctacataatacttccattttgtaaatataacagaatattcatctacctgtcagtggacagtggggtttttttgccattataaatgctgctgctgtgaccatttggggggcaagtctcctggggcacagtatgagtttcccttctgtataacaaaggaatggaaaattatagactttcgtgtccaaatttacaagataatgacaattgttttcca

SEQ ID NO: 13093 - DNA, 1049 bp, Homo sapiens
tctgcatgcaccactgttcctggtgtttccctgtacagtagtcaaactcatgaagaaattttagcggaattattgtctcctacacctgtttcaacagagctgtcagaaaatggggaaggtgactttaggtatttgggaatgggagatagtcatatcccaccaccagtaccaagtgaattcaatgatgtttcccagaacacacatctgagacaggaccataattattgtagccccaccaagaaaaatccatgtgaagttcagccagactctctgacaaataatgcctgcgttagaacattaaacttggagagtccgatgaagactgatattttcgatgagtttttttcctcctcagcattaaatgctttagcaaatgacacattagacctacctcatttcgatgaatatctgtttgagaattattgaattaatgcttgttaacttttttcatataatatttattattattagaagaacttacaatgtgttcaggtagtgtttatacactggacttgtgtaattacttgtgtaataaccatgaacaaaatgcaaggtttaacctttggttctgcccatgaagcatgtaatctttcttacacattaaaatcactgaatgtgttctcctttttggtttcattttgttcttgtgagagtatgaggatttcaaaatgttaaagatgaaaagtggcgtctagtttctgacagtttgtacagttggatgcattacatttttagatttgaagttttggttatgttagtgttatgagtgatctttgtggtggttttcttcccctggaaacctgttgctcgtggcgctttgcccacggtgcccgagttcttgtcctgtgtccagatatgcagacaaatgaagggtgaagaagaagaagaggagctttatttagtgttagaacagctcagaaggagacccacagtgagcagctcccctgtgtcggcgggcaggtcgtccctcaagtgttcagctctcagcagagaaaaggccctggagagggtgactcctctcagctctcagcagagaagcagccctggag

SEQ ID NO: 13094 - DNA, 1082 bp, Homo sapiens
tcaggagaaagatttggccagaagatggtagatttgagagtcagcagcatacataggtagtggctagaagcttgaaggtgctgcttccaggggaagccatgggccctgcgggaagaccagtgtctaggggctgggcagagtcggagcagactgaagggccatacgaagggatacagagaggaggggcagtgtgggatgctggctacctgaggactggcccgtcaaattgccatcagtaatgcgacattctctggagaggcctcagagagactggtctcagactgcctgactaattgggactgtggcctgcgcactgacctcaggatgcatcccactcagtgtgcttcgttgttgctggcaccaccactgttattattttttaattgtaataaaaaacacctaaaatgcacgtcttaagtgtacaactcagcagtgtcaagtggaatcatgttgtgtaacagatctccagagcttttttatcttgtgaaactaaaatctgtatgcattgaacaactccccattcctccctaccccaacccctggctaccaccattctacttgctgtttctgtgaatttgatttttctggatttctcgaagagtggagtcataggtatttgtccttttgcgactggcttctgtcacttactaatgccttcaggatttatgacagactctgtgttgttgcaggtaacctcagtccactgtgatggacattttcatctgtagacacctatttccttggatgctcatttggcatttcacgtatgcacccccaaggtgtactttgtccttcagtgtatctgttctgccttcaggctccagagggaggtgggacctgttccctattcctttttgcatcccgcatagcacgtagtggattgccaaacacacacagcattagaacctgtatttccattgattcattgtccttagcttttgaagcttaggaaatagctacatttctttaaagtatttgactttttagtgctttattctatgcatctatttagctttatcacgcttatacttaatttttattgtcctttatttgcagttttctgtttagacagcctgttgagt

SEQ ID NO: 13095 - DNA, 1051 bp, Homo sapiens
ctctgtattatatagacaaccaagaaggccagtccaggaatgttgattccctttgtgtcctttccttgactttacggcccacattgtaggtagcgtaacaacttacagttacttaggtgtttcttctgtcctagtccccaggacaactggttacctaaagatagctcatgagacacactttcttagactgtttccaaccaaaattttatttggcctaacaattccacatcagttttgagttcacactgcctaatatttcctggcagtccatccatttgatcaattaaaacaatactttcatttttggagaaattttcattaactaccaataagatgatttcttcaaatatatgtcattccaggacactgtttctggttttctccattgtttttccaccagcaaaccttatcgagatttccttcagcaggtggctctgttgactgattcacaagtgggactgaaaaagttagcctggaagtgggactgaaaaagttagctaggaagtgggactgaaaaagtcagctaggaagtagaattgaaaaagtcagctaggtattgagttgaaaggaccctcagtcatttgcacatctgtagcctaggtggttgtgtcattagaactgtgctattgggggcatgacttaacttcttttttttttttgaaacggagtctcgctctgtcgcccaggctggagtacagtggcgcagtctcgctcactgcaagttccacccccgggttcacgccattctcctgcctcagcctcccgagtagctgggactgcaggtgcccgccaccacacccgcctaatatttttgtgtttttagtagagacggggtttcaccgtgttagccaggatggcctcgatctcctgacctcatgttttgcccgccttggcctcccaacctcgtgatccgcccacctcagcctcccaaagtactgggattacaggcatgagccaccacacccggcccaataattctaaaaattaggaaagctaagtaccaaacttcgtgttttccaggaactgaatatttaatgaggaaacatttcat

SEQ ID NO: 13096 - DNA, 1030 bp, Homo sapiens
gccgaatgttaattcccaagatgggggaaatgtctccaggtcatgtcagagaccttcgcagcagctccttcccctgctcccctacctccgcatcacaggcccagaggcccaggaggaaaaagtggtttgtttcgtgggctggactcagggtccccatgctgtgtgcagtctggggacttggtgctgtgcatcccagccactccagccgtgtctaaaagaggccaaagtacagcttgggctgtgacttcagagagtggaagccccaagccttggcagcttccatgtggtgttgagcctgcgggtacacagaagttaagaattaaggtttgagaacctctgcctagatttcagaagatgtatggaaatgcctggatgcccaggcaagtttgctgcaggatagcggccctcatggagaacctatgctagtggggaagggaaatatgaggtcagagcccccacacagagtccctactggggcaccacctagtggagctgtgaaaagagggccactgtcctccagaccacagaatggtagatctactgacagcttgcaccatgcatctggaagagccgcagacactcaatgtcagcctgtgaaagcagccaggagggaggctgtactctgcaaagccacaggagaagggctgccaaagaccatgggaacccacctcttgcatcagtgttacctggatgtgagacatggagtcaaaggagatccttttggaactttaagatttgactgtaccactggattttggacttgaatggggcctgtggcctcttcattttggccaatttctcctattcagaatggctgtatttacccaatgcctatacccccattgtatctaggaagaactaacttgcttttgattttacaggctcataggtggaagggatttgtcttgtctcagatgagacactggactatggacttttgaactaatgtggaaatgagttaagacttttggggactgttgggaaagcatgattggttttgaaatgtgaggacatgatatttgagaggggg

SEQ ID NO: 13097 - DNA, 1113 bp, Homo sapiens
tgatgactgtgtattctccaagctgtgatacagcagtttttttttattgtcacagggaaataaatggtaccagaagtccctttcctgttctgtctcttcattgtaatggaagtttcagttgggcatgagcctggagagatgtgactgtctacagttctatttgtatatataaaaagaagactgaaagtcttttgacatggatattgtgaatggtatgaacttttaaaccatattattgatgatgaaaattatttcctgggaactcagtaggaataataccgtattaaggaataatactgtacataaaacatcatgaaaccctagatatgaaatcccctgaagtctgtaatcatggtggttatgttttgtctattcttttgctgtttgtgcctcataaaaagagaatgaggtcttctgctagagcttcgtattgctttggaagttcatctgtgttttatttctccctgaagccctatctttatggcttacttgtaacatgaaagtagtagatgctgccagaaaatagtgtcctcaatattttaaaacaatgttgacatgttttgttcaagtcagcaagctctatgtgagtctcaggaagtgaattaaatttggaccttatgttttactcttgttttttttttttttttaaatgttacttaatgactctctcctgactcaggagagaaaccccttgtggaaggacagcatggtgatcaggcaatttctctgggttcccaaagaatgacatttgaacacagtattttgaaacagctctagttttcaaattatatctttaatatatagtaatgtaacatattcagtattaatgtataaaaagcactctaattatataattcagtttttgtaaaggtatttgcataaaatttaatatgtcttaaactaattttggtaaattacttcttttttttctttttaataaaaactgttactcattaactttgcttataatgctttttatagcccagcacagaatttaaagccataccaccaaaagtacctgtgtgtgttaatatgtttttcttgtagcatagattgactatttgcaatagtattagtatttaccatttttccaaattagcaactaccagacct

SEQ ID NO: 13098 - DNA, 1070 bp, Homo sapiens
gaagccctaaggctcaacatactcagtgtaaccttggctgagaggatgcaccatgaggcaagcggctaattgcacctgcatgcacctgcacgcgcatgcctggcctcacaagtttgagaggtgaggatgtctgcccacatacctgaatggagactcagcctcttaattatatggtggtgcttatttacaaaagtgcagtaattaaaaagcaataaaacaaactctataactatgactggctgttttgcaaggtgttagaagaaaggtaattccataagcgtttccaggtaaagctttccatatttttttaaatggcacattgtggggaaaatgtaattatatatatattagtcccctccaaagaattcacaggccaataaatagatcagtcgctggctagtgagatgtactagctttcattcgatgttcattttggtgttctcctctttatcggcacgtctactctgtcatgctgccctttgatttgaatggaggtgggaattaaaatggccttgatgtctggaaataaaatgtcctatgtagacctgaatatggaggctttcctgtccccttggatgtctgtcctgttgctcttccctgctcttatccagcctttccccagctgtctagtggttctcacggctgcggccccttgttaatcatggccacagcctccacatgcccttctcagtttaacctggaatgctccagtggtgtcctcacagtcaaaggctgctccccagctcccttttgcctctgagtgtcagtggtagccactcaggaccctctttgagctcctcgttcatcctctctcatgtttttctgctccagccaaccaagcttaatctactcactctcctctgtatttaactaacatgctcccaaattcatgcctgtacacccatcagtctcctaataaggcctcgcttacctagaatgtaaaaatggcagggccaaatgggcttcagatctcttgctcctgcacttgcatggcttcggacagttaagtaatcactctcagtttcctcatctgtaaaatgtacgcaaaaataatgggtacctcataggag

SEQ ID NO: 13099 - DNA, 1048 bp, Homo sapiens
gtgttggagaatcaaaacagtaaggatttaaaaggacataatcaacaataaaaagaacagactgattctcatattggtgctaaagaatttgggttccctagggttggagggagaagataacctcttgagtactcatcttggcaaaggagaaaatgacatggcttcccccagaattaatctgtcccaccgtttatatgcctcctcatggatgatttatcctatgagcattgagaggccaatactctgtaagtcccaggtgatgcaatgtgtctcataagtacccagccatccacctggagcttgccttttccaggcctgcagataagagccatctctagaacctcagacctcactatttacatctgcagtcttacatcttggtttctgttatagaacaaagatcccaagatggctcgagttgcactggaatctctctacagattactttgggtttacatgattcgaattaaatgtgaaagcaacacagctactcagaggtaagatttggcttgtgtcaatggtaaccatatcactcagccactgcagagggtgtttcttttattactacctatgctaactcaactagaagctattcaaagctgacagtttctaaaagatctaagtcctaaggaacattttcaggctttccatagtcattggctcaacacccattacaaaagctccagcctctaccaggatcaacaagttccacttccagagttgcatttgccactttaacaaaaaagcagctgtaattttccaactgctcttagttttccagaaaaacttttcatagagtaattatgctaatggaaagaggtgaggtggtttgttttctttttctgaattctctctgattcttagataagatgaaatatctgccattttcccttaaagaactggagctcagccaatcttgcttgttttctcttttcccccttatctttcagccgacttataaccatcatcacaacacttttccccaaagggtcccgcggtgtggtaccaagggacatgcctctgaacatctttgtgaaaatcatccagt

SEQ ID NO: 13100 - DNA, 1052 bp, Homo sapiens
cagttttggaggccaagaattccaaggttaaggtgctggcagatttatgtctggtgagggcctttttcctggttcacaggcagcagtctttttgctgtgtcctcacttgacataagagacaagggaactctctggggtctttcttatgagagcactaatctcattcacagggctccccacctcatgacctaatcacctcctaaaggccccacctccaaataccaccaccttgggggttaagatttaaatatgaattggaggttgcggggatacaaacattcagtctatagcatgagggaaatgcaaataaaagccacaggagacaaaattatataccatataattccatttatatagacctcaaaaactgcccatactaacaagtagtgctagaagtcaagatagtggtttctcctgggtaggaaagacaggctggtgtttaagagagtgcccaggggagggttcagtggtgctggtaatattctggtttttgacctggtggtgatcataggagggtgttaaaatgactcatgatatacataggaactgtatactatttctgtgtattttatacctcaatataagtttctaaagtacaataaaagcttgattcttctctcaagtctaactttttaatgactttttttgttttgtttgtttgtttatttgttttgttttgttttgtttttgagacggagtctcgctctgtccccccggctggagtgcagtggctggagtgcagtggcgcgatctcggctcactgcaacctccacctcccgggttcatgccattctcccgcctcagcctcctgagtagctgggactacaggcgcccgccaccacgcctggctaattttttgtatttttagtagagacatgttattttaagtcatttgcaataatatcgtcagcttttatctgctgctaattacttaaagcgagttgggggaaactaggttgaagatgtttgaccatccagttagaatatcactcccacctaggcccaaaccctgtaagtaaaaaaacatgaagaagccagaatcttgccttttc

SEQ ID NO: 13101 - DNA, 1046 bp, Homo sapiens
aatacatgtgatcactgatgaaatgcaattaagaactggttagtagaaaattcagagggtcaagaaatttaacagagcagttgaactcatttgcctttatcgttgagattagatcatctttcaggctgttagtatatggaccctgtttttaaaaattgtggttttgtttttttcaatgtgaaagaattaagaaaattgttacttttctaattccttttctgtgccttgcttttctgttcacaccagtattaacagcaatgaaattttttcaattttattttccaataaaaattactttgagttttttttatggtagctagctacttccttgacctagatactaattttgattgagttggtaactattattaaaaaaacaacttaggtctaatttatcttgagctaaaaaatgtaataactgaaaaatagagcatatttaggattctttctgctttaaatttgacattcagttattttcatgtaatttgtgttttgagcactaccttttaattaatttatttatttttattttttagagactgtctcattctgttacctagtctggagtgcactagtgtgatctcagctcaccgtagcctcaccctcctgggctcaagcagtccttgcacctcaccctcctgagtaactggcaccacaggcatacaccaccacacccagctaatttttatttttcatagagtcatggtctcactatgttgcccaggctagtctcgaactcctgggctcaagcagtcttcctgcctcagcctcccaaaagtgctgagattacaggcatgagccactgtgcccaaacactacctttttaacttagtgaaaaatatttagtgaatgtgattgatggtactttaattttgtcactttgtgtttttatgtttaggtttattgcattcttctgtgaaaagaagctgttcacagaatgattctgaagaaccaactttgtccttaactagctcttttgggacaattctgaggaaatgttctagaaatgaaacatgttctaataatacagtaatctctcaggatct

SEQ ID NO: 13102 - DNA, 1049 bp, Homo sapiens
agtctctttgctctaaagcatagcaagagtgacctttgctccagttcccaataagatcctcatctccatctgagaccacctcaggctggacttcactggccacatcactgtcagaattttggtcaaaaccattcaacaagtctctagggagttccagactttcccacatcttcctgtcttcttctgagccctccaaactcttccaatctctgcctgttgtctagttccaaagtcacttccacattttcaggttatcggtatagcagtcccccactcctggtaacaattatctgtattagttcatcctcatactgctataaaaaatacctgagactgggtaatttgtaaaggaaaaaggtttaattgattcacagttccacatggctggggaggcctcaggaaacttacaatcatagtggaagatgaaggagaagcaagtaccttcttcacaaggtggcaggaaagagagtacagggagaactctcacttttaagccatcagatcttgtgagaactccctcactatcatggaacagcatgggagaaactgcccccgtgatccagttacctcccaccaggtccgtccctcgacacgtgaggattaccgttcaagatgagatttgggtgaggacacagagccaaatcgtatgaagctccttatcatttaagttttattgtgacattgcagtaattcagtcacatcttcaggctttacttctaattctagttctcttgctattttcaccatatatgcagttacttcctccactgaagtcttgaaccccccaaagtcatccatgagggttggaatcaacttctggtaaacttgttaatgttgatattttgacttcccatgaaacactagtgttcttaatggtatttagaatggtgaatcctttctggaaggttttcaattcactttacccatatctatcagagaaatcactatggcagctattctttataagacatgtttcttttttttttttttgagatggagtttcgcacttgttgcccaggctggagtgcaatggcgtgatcttggctcac

SEQ ID NO: 13103 - DNA, 1032 bp, Homo sapiens
gttgtcccctttgtgcctcagttttacctacaacacagaaacaatgatattacctaccccatggactgttgtgaagattaaatgaattagtacatttactacacatagatctatttctcaaaataatgagcattcagatattagccatctgtaatgtagttggtgatgattatgattattagagtacatttataattggaggatcatttttgccgtagggaaatagaattattaatagtttgaggcacctgagaatattatgtgagaaactgattacattaaccacacccttaagatgagctctaattttgttgtatttgtcctgtttaaagccatctagttacaatagatggaacttttttgttctgattgctttttattccaatatcttaaatggtcacagggttatttcagtgaagagcagttaagagccttgaataatcacaggcaaatgttgaatgataagaaacaagctcagatccagttggaaattaggaaggccatggaatctgctgaacaaaaggaacaaggtttatcaagggatgtcacaaccgtgtggaagttgcgtattgtaagctattcaaaaaaagaaaaagattcaggtaagtatgtaaatgctttgtttttatcagttttattaacttaaaaaatgaccttactaacaaaatgattataaatccagataaagtataaagttagtttatatcagagaagcaaaatccactactaatgcccacaaagagataatataaaagaggatctgtatttattttgaaacaaacatttaaatgataatcacttcttccattgcatctttctcatctttctccaaacagttatactgagtatttggcgtccatcatcagatttatattctctgttaacagaaggaaagagatacagaatttatcatcttgcaacttcaaaatctaaaagtaaatctgaaagagctaacatacagttagcagcgacaaaaaaaactcagtatcaacaactaccggtacaaacctttcattgtaatttttcagtttt

SEQ ID NO: 13104 - DNA, 1055 bp, Homo sapiens
tgttggaagtcttgtgaatatttctctgagactattattatttaaagttctccagtagagattgattgagcttagttgagtttgtcccttttgtaactttttcttgatgtgtgtacaaagtaaacacaagtttataagtggacaggtttgtgaatttttacatgcttatgtaaccagcattcagatcaagagacaacatcaccgacaccacagaaccacctccgttgtgccccctatcaattattattaccccaagggtagccactatcctgattttgtgatagcatgttttgtctattttataacttgatataaattgactcatatctatatatagtttgttgtatctgacttattttgttcaacatcatgtttatgaggtttgtctatcttgttgcatgtagtagagtaagcagggatactcctggtacttttgttatgaaattcttatacattattttcagttactcatcagatagtttttcatcaattgcaaaattatattatccaaagctgaattgagatttgtgggaatcagaattttgatagagtgattaggaagatccctggtatacaaaagtgaaatgtatacctatcataatttattatataaagcatgtgtattgaatcatcaagaatagatggctcctactgggatcgattgtactttattatattttgccttttctataatttttagttgtgtcgtttttataatgagtgaagagaaagtctgtaccctttagagacacttattgaacttctagtcatcatggtgtaatgaagagtgtgtgaattttggaattacatctggaattaaattccagctgtatcaaatacaagtattttcaccatgtgagctctggacatgttgcttctcttaataagcatggatataaaatatctcatggttgctggaaatataaatcatagaaagtacatataagtaacttatatagtccctggcaataggtgctctgtgaattttagttttaatctttattatgtgattagtgcaataattcatcaatccagagtagacttttgttttcaga

SEQ ID NO: 13105 - DNA, 1530 bp, Homo sapiens
tttattttcagcctgaataagaaattaacctttgatgtcatgaaattctcttcccataaaattgataaataggaaggacaaacaagttctttttaaaaccaaaaaagaaagaatagcaaaatagaatttgttcttctttcttcatggctaggtagtctggtctgattcatagacctaaaaaagtcacataaaaacaacccaagaagtaaaagtaagcagaaaagacatagaaatatgaaatcctccactctgtactttcagtatagaaagctaaagcctaattaagccagttgtgtgttaactgtcacagaagagattagggcagcttgtgtggtataaagaatccttgactccttctccgctgagactcaggaaaccattgaggatacatggcagggtatgcttttggttaattttttatgtttttggaagattttatatagaaagaaacttgacagttatgccatgcatctttgccaatttcagtagtaatatgataaatgatctgagtgtggaaactagttagagctagctatatggtagggaaaaattgtttaaatttggattttccttgtgtttgtgtgtgcttttaattggattttaattagtgttgtaaaccgtgtagatatgtacacatcagaatgtaaaagaagacaaaggattaggaagaggtagtttttcatcaaaaataaaaaattacatatttcaaacatagaattgccttctatgaaaatgtaagaaggctgtatctatgggatgatgttttcttccatatgtactaaggtgaacaagctattatccctcacccttgggagattaagacattgtattagggtcttctagagaaacagccaatattgagtgagtgtatgtatatacagacacacatatacatatatgtgtgtatattcacacatagtgtatgtatacacacacacagagacacatgtatatgtatgagagggaatttattaggggaattgacttatgagattacagagtctgagaagtccgagagtaggctgtctgcaagctggagaaccagggaagccaatggtgttactctcagaggcagaaggcaaggcttgagaacctagcaggggactgggctattggtgcaatttctggagtccaaaggcaggaaaacctggagttctgctgtccaaggataggagatgaatgtcccagcccagaggagagtgaattcactttcctttgcctttttgttctattgggccttccagcctatttggatgatgcctgcccatactgagggcagatctttccactcagtctacaagccaatctcctctgcaaacatcattgcagacacacccaagacacgttgctttaccagctatctaggtatcccttaatgcagtcaagttgacacataaaattaaccatccagaaatatgcacaaataatataggatagaatataatcagtattataatggggagcagagtatatttgaaaagtagaatgtttattgaaatgtttcagtctgttttattgtatacaagatgg

SEQ ID NO: 13106 - DNA, 1035 bp, Homo sapiens
gttcttaaaatattgaagaacattagtcttataatctagtcaaagtcaagacctgttcaaatccaaatgtctaaaataagtttagaattgtccttaaactaagaaactagtaattgttcctggagacagacattttcatagatgcttccaacctatgtaggaactatgctgtagaaattctagcttcaggccgagcacaggccaaggtgggcagatcacctgaggtcaggagatcaagaccatgctgaccaatatgaaaccccgtctcgactaaaaatacaaaaattagctgggtgtgatggcatgcgcctataatcccagctactcaggaggctgaggcaggagaattgcttgaacctgggaggcagaggttgcagtgagctgagattgtgccattgcactccagcctggtcaacaagagcgaaactctttatctcaaaaaaaaaaaaaaaataaataaataaatgaataaaacagcagatattttaccagtttcatcctttttgggagacatcccacttggagctttctgatttcctactcaaatttgcagtgcttagacagcttgctctgagcttctgctctacagcattgaccttagggccatccattcttcctcccatctttgctctccccttccatcctcctcccttctttttccctcctttcctcttcgtctgtgagtgtgtgtgtgtgtgtgtgtgtgtgtgtgtgtctgtttctacacctcccctttctccttccctttttctctggatgttcctttttctttagcatccttttcttgtgttgctaatacagtattttctctgagagtgtcaatggtaggtagttttttggggaatttttctttttcttccaaaatgtctgtatctgctatttgtttttttcaccttatatttgcttttgtctttttttccatgttaaaggctttcctcaaatgattggcaatccgaggccgtctgctcatgattaagagtgggggggctaaatcaaaagctgtttggaaagccctgagtatatgctttcctcaaa

SEQ ID NO: 13107 - DNA, 1030 bp, Homo sapiens
ctgtctaggttatcttaagtctgtaatgttcagtttagattctcctttcctgggagaaagctttgattggtattttagaagatgcatgagtgtgggggataaacatggcatgtctttctgatgcatcagttagatagtccctggtatattatggcatagaataaacaattcatatgaatttaaggtatgatgggaagtttcaaaggaatttcatcaggactatccataatattctttagtttcctctgtgatttagggctgaaacaaaaaaaagtcggaagcagtgctttaattgacacagggaagtcgagaagcatggaatacttaccttaacagcagtgcaattttgtctgtgttccagtatttcccataattgcaaattgagctgttatcctgggataatcatagttcaagattttataatcagaagaataaatcttcatttcttacatggcactgcttacttctctatgtatatctcttcttctagttcttggagagaagatggaataggtggttctgatactggcgtagtcataggtggttgctttcacctctacctcatcacttctggcttacccattagtctggttagttgtgattggggtaccatgcttttatatggagaagaattgcctatgggtcttttccttagaaagagactgggagtaaagctagctcgcaattagagtttcaggtataatttctgttattcctttctgttcatgtgtactttattctagaaactgctgataaatagaacaaaggcattattattattttctttttttctttttttttttgagatggagcctcactctgttgcccatgctggagtgtagtgtggtgtgatctcagctcactgcaaccttcacctcccaggttcaagcgattctcctgcctcagcttcctgagtagctgggattacaggcacacgcccccatgcccggctaattttttgtagagacagggttttgccatgttggccaggttggtcttgaactcctgacctcaggtgatatcacctgcc

SEQ ID NO: 13108 - DNA, 1111 bp, Homo sapiens
tcctgtcataacatgtgatgtacccatagctcaagtgactggttcttatccttgtaagagttttaacaaatttggagataaattacacagagaaaaaggacttactacctttagtcctaactctcattcctatgctacttagccaggtgatgaagcaactgtagcctgagttgggagctttgatgttaattttttaaagaagtgttcagtcatccgggagatgctaactatacttttgtttaaatagcaaagccagagagaatttttcttattcaaagatgaattaacagaatacagataagcaagttaacaaacacaaaacctatgtaaatatcttagcattccaaagtaactgataagcaatacttaaataactgtcttagttatttaagctgccaaggaaggtaaacagcaaatgacatgagagaaaaaagataacaaaaatgaagtaatacatgaaaaagagctaaggatattgactatagaatataatttaatataagtagcaaggagcagaataaacaatgtggaagatggaatcagtaagctagagatttggcttgaggaaatctgcatagaatatagagaaattggagagaaaaaatggagttaaagggaatgaattgcagatagtgaaaaaccataattgacatctttggagaagacagtagaataatgggaaatggaaaatattcaagaaaataataataaatttgttctgaatgatttaaaatatgaatctggaggtgaagactcatttttggaaaatatactggtgcagtttgctaaattttcagggattgcaaaagtgatttcacaaatatcaagaaaaactagttatatcggggaacctgccccgataatcatgtaggttcttttctatttttcctaagcggcggccggcttgagaaataaagggacagagtacaaaagagagaaattttaaagctgggcatccaggggagacatcacaaattggtaggatccgtgatgccccacaagccacaaaaaccagcaagtttttattagagattttcaaaaggggagggagtgtgtgaataggtgtgggtgacagacatcaagtacttaacagggtaatagaatatcacaa

SEQ ID NO: 13109 - DNA, 1032 bp, Homo sapiens
aacttcttggtccctcagtttccttacccacggaagtaggaggtaataattatgtgtacctggctcatctagctgttatgatataactaaataagttagtatacctaaagcatttaaaacactacttagcacataataattagaagcattgatgataatggtggttattatgtcagtgttagttaaaatttaacgtttgtcctctgtgtaaaccaagtgccatttggtgcccctccttggtaatacaaaataggagaatagctctgtgctccttaatatatctaaagactttaataagaaaacatacaaagatgactgccagctgccttctgcctttccatcttgtatgttttgcttatactgtattctccttgtatgttttgcttatactgtattctttgcatagaatgttaacagaagcacatccttctcaaacaaaacatataaaaaaaaacttggtaagctattcattctgtatctgtttactttcttttattctaattaatctattctgttttcatgtctctgttcccctaatttatatatgccaatgtttaggagttacaaataataagtatgttttcatttaaaatttttactgaatttgaaataattttgtattgatcagctcagcctggtaaagaaattttcctcagtgttaatacatttggccttataaatcaatttattaattatattattttatatttcttatttggccaattatattcagctatataaactttcatcagagaggcaaagttctttggtggtttacaacattcaggcagattgaagacacactacacaggttcaaactgaggttctaccatttatcagctgcttttatttatcagcaagttatttaacttctacgtgtcttagattcttcatctgtaaaatgaggataacaatagtatctccttatagagtttatgtaaggattatatgtattaaaatttcgaatgtaattggaataatacccagtatataatgtcacttatgctgtgttttgtggaacccatatgacat

SEQ ID NO: 13110 - DNA, 1042 bp, Homo sapiens
gggagtgctattgtgaagctggcacaagaaccctgttaccatgaaatcatcacattagaacaatatcagctatgtgcattagctatcaacgtaaggaaatggctgtgtacaactactttttgaaggtctttgacttttaggaaggaaaaacatccactgtgatacatagattaaaatcttgaatgtgtatggtttgtttgtttctgaaaaatttatgcatgagaaacatttcagagttctgaaactgtcatttgagttttgggttgctaacatagtacagttgatcttcttctttgtaatagttttgttctataatgttatcacaggcattcagttagcagatactgaacagttgctcttaggagaactcacagaatagattccttcaagcccctggccacaacattttcatcatccagttaatatacagccttgttttatgtatgtttctgtttaaagactatttattatatatagttgtctcaactgaactcacagccaacagcactgtaactcatacctgaacaaagcttatctagcacacacattttctctgtaaggaatatcagagccttcttgtgctttggaacgccagacagcagttcatcgctatgcttgtgctttgaaacaccagacagtacttcatcatgaaataacaaaaacatcaaccacaaaactgtgaaaaatgtggcactgaatagacctcaaaaaggacactgtttacgtatgaaagctgaaacaagaaggcacagtgttgccttctttgacattagctgggaatgtgcacatctggctacttacattttttgctgctttgtgtatttactttgcaaatgacccaaaaattgcttcaagtattaattttggtgttacaaataaattttaacgagtatgcaaattcctaaatatagaatccacaaataaggaagactgactgtatgtgttcagttcctgaaaggaaaacaacagtatcgaaatttatacttttataaagacatgacatagaactaatttcaggttagaagcattccttattactcag

SEQ ID NO: 13111 - DNA, 1906 bp, Homo sapiens
caccaagactgttgggaatcttttttattgttggtaaatttccctaattacagttatgatcatgtcattcctctgttaaaatatttagggggttgatgcttgtaaaaacaactgcacgtattttacaacctggtgtttgagcccctctaatattttaacccaaatgtacgcttaaaaatcttgttgagcacactctcctttacttaacctcatttcatgtagctgaacagctttttttcttttttgtgccttgtactttgctgcctttaattttctctttactctcccatttccacacatccaacctaaccctttctgcaagtcagtgctcagacacaaccttctttacaaaacttgctctgagtcttttattttatctgcagtcctctgatacgtacaggactatgctttgcgctttagtacatgtactttatttcttgaggctctttaaatgcagtattgtatctgggaggctgctgttatgtatttgaacagaaagtacatttggagaaatttaataaaacaatatgaattttaacataatttaataattacttagatattttagaacttggaattcagttcatgaaagatttactctgtacttctgtgtgctgtacattgttctaagttctggaaatacaaagatgagtaagtcatggttatagcccaaagaagctaacaatctcttaggagaacagaaaatagagatgtatcaataatacaatgagatacacaaactaattacatggtattaatggtagttttgagatactttgtactagaaaaggctactaaaagtgaatttacttaagctgcagactaaaattaattttatagtcagtagtgaataaaagctttgattggaactttatctgggggggcggggacatttgtagtattagacaccatctgtttttttcttatgtttaaccaattatatccagtgtttgcttttttgagggtacatttttttcagataaaattgtattactctattctttacttcacatttaacttttgtaataccagtcaaaaggataatcatctttgcagaaaaatatttgaagacttcctcagttcccagtagcgctttttatacttatttattcacatgattctcttgaagtacctatgtgtgtgtcatcattcctgttaattttctcttcttcagttgttatttatgttagtggagttgcctatgatttcacagttctctaacatcactttgatgactttttgaaaacctgctacttgtgtgatgcttcaaggattgacattgcaattaatttgtcttgtattgttgcatcctgaatgattagtcagagagggacaaaaacctggacttgattgggattttaatgaatggcctgttcatttgtgaatacgcttgtgatatgtggatttttacttacccagtttgtaattgggtattttcatagtaaatctataacggagactcctctcctctgtgggactgatactgagggcggggtgagttaatgttaactttgtttcgtggagtatgagggtagataactttctgtgaaaactagactgcttcttccccttccctccctacagctaattcccccctcctccccccaaaatggagtcttgctctgtcacccaggctggagtgcagtggtgtgatctcggctcactgtaacctctgcctcccgggtttaagcgattctcctgcctcagcctcccaagtagctgggattacaggtgcctgccaccacacctggctaattattgtattttcagtagaaacagggcttcaccatgttggccaggctggtctcgaactcctgacctcaggtgatccacttgccttggcctcccaaagtgttggaatttcaggcgtgagccactgcgcccggcctccctctgtgtgtgtgtg

SEQ ID NO: 13112 - DNA, 1050 bp, Homo sapiens
gggactgtttctaatagtccgaagtaagaaaggcctgaatctcagagttacagaatcctaatctcatggatgatagggtctgttcattagtcagtcctttattttaaaaagttttctaggagattctgatagtcaggtttgggagttcccgctttctagcatttagttttgtatcttgcatgtgctgtcacgtatataagttatacaaaattagtgtcaggcgaatagtaaacttttcagcatatatatatttatatatatatatatatatataaaagatacacaatattttgtgtatctacccatgaaactccaagttttacacatatataaaaaattgggtgtatctactcatgaactgggagtttcatgggtagacacataaaatatttgttacttaaaaagtagtttggttctacctagagcagttcagtttgactagggaaaaatgccttgttcttttttttcaggtgcagtgtggtgactttcctcatctgttagtgtacggaccatcaggtgctggaaaaaagacaagaattatgtgtattctacgtgaactttatggtgttggagtggaaaaattgagaattgaacatcagaccatcacagtaagcatttcactttgaggccctgaaagtaatttatagcggggactttcagtcttggtcatgtatgtccccccaactcagttgcttcctaatgtatgatttaaataagaattccacaggtagtcttggggcacaggatttgagagctactgatatggatctgttataaccagagcaaagccatttatgttagataggaaataagagcaacagagggtttggggtaaaatgtagagggtgagattaatttcagattacctaataagacaatgtcttagctgaaattagaactcaggtttccagacttcatttttctgagagcagtagtggggatggaaagaaagagaatgattttgagaaaaatgttaaacatggtatcaagtgacttggtaaagagtgggcaactgactgactgggaaaggaggcctgcaactctgggaag

SEQ ID NO: 13113 - DNA, 1333 bp, Homo sapiens
ccatggactgggcaggggtgggggatggtttcaggatgaaattgttccacctcagattattaagcattagattttcatttggagcgtagatcccttgcataagcagttcacaatacggttcacgctcctatcagaagctaataacatcactggtccgacaggaggtggaactcaggccataatgctggcctatccgctgctcactcctgctgtgcagcccggttcctaaccgcacggaccagtggttggggactcctgttttaggacataagcacacttctgtttaacttcttgtgttctctttttgtcatgtagatatccttttactgcagatcaagaaatccctgagacagattgggaggtgtatctgagggagactgcaaatgctattgtcagtcagcaaactccacaaaggtaccagtataaaatgatgacagtaaagctttcattatcaggatatcataggacacatattaactattttatgctaatgtcattttgaattataattaaatcctgaatctatgtattaactttttaaggaaaatgtagcatttaacttcagaaatttagtggttcagaatagttggtgtgtgatattatggcttttattaagctgtaatatcatggcttacatgtgatcatgtaaaagtggaatttatattaattttaattttccttttaggatctcagattacttaacattaacatacaacacaaagctagagataatgtgcgtagctttctagtaaaggacaatgtaaaactttgtaatcaatgatgcatcatgtgctagaaagacaccagactataagtcagacttctagttcttgtcctgaactcctagctaagtgttcttgatcaggtaacttcattttagagttttatcttcatttgtatattgaagatattattattgcctcaccaagggtacttttgcatttgttgtgaagagcaaaagagttattaatggtttgaaaactaaaaaaccctgtgcttatagatgaccatgcgttctactaaggatagcattgtgtatataccatttttactcaggaagtattttttgacacatttgctcaaaattgcttccgttacttctgtaggtctattatttgtaggttgaccattctgaaaatacctcagctgctagttgtttgacttatggcagcttcgattgagaaacacagtttgctttcctccaaataaaaaatgacaatgttaaggcccactaactttggagagtatgaagaaggttcctcagacttggctaaagcacagtctcatatccttgttgggtttctgaactgagaaatgatctttggaccttaca

SEQ ID NO: 13114 - DNA, 1079 bp, Homo sapiens
actcagaggtttgaatgttcctattcgcttagcctggttgcgtgcttacctgtaaacctttgtgccgccccttttatgacagggacagctctgtatccctgccacattgcttttttactgtgcaatctaggcagtggcattgtattatatttcatgcgtatattatcttgtgtcacctatgtaattgactttttaatcttttcatgaccatttcctggatgtttcaggtatctgtctggagaaaagaaaaacatattacttgacatgtcattaaagtttgttaaattccatggtgtgaataagctcaacccgcgctcttcatgaagtctcaatttctatctggtattttcatggtgttttgatataattaggaaccctgaatatagacgtctcattttaaaagagttctgaaaatgttctgtttcaaaaatgaactgaagttaggagaagcctccatatgtttatcctaagtatggtaaactatttaagaaacagttattatttcttactggattgtttgttaattcataaagttaggtcataaagttgttaattctgtattggattgtttgttaattcataaagtaaaaccatacagtgggaatttggaaaaattacctcttattttcttcacaaaataccaattattttgttttatgtaggctccttgaagttcgtggaaggctgtatgagcttctaactcattgtattcctcctgagataataatgaaggtaacccaatttcagatcttgaactttttacagctataaaatttggacgctgggtgtgtgatcatagggctttttgcagtatcaagatatcacctctttctctccagcgcattaattgcacgtatttactgaacctctatggtgtgccaggcactattagaggaatgctgaagaaaagaagggagggcctgcctaaagtgaagttatattctagtggtgtgaaaaggagaacaaataaagaagagaatttcagagtgttgtaagtgctgtaaaggaaataccaaggtgcagggatgataatggagggtggggctacaaagaaaaaagtgaagttccacccatccgtt

SEQ ID NO: 13115 - DNA, 1049 bp, Homo sapiens
gaactattaatcatcctctgagttaaataattgctcctatactattgaagtatgtagttttgtacataacttagagactttagagtctaagaaaatgatcttaatttactttaagcattggttattcaagtattcattgttgatcctcctattctcttccgtctaatctctcacctgctaaaggagatttacacattagaaagcaaagattattttcatttatccagatgaccattttctgccacaggtaacatgattgtttgacacaccattatatttaattctagtttctctcaatgaataattgtatttttgtaggaaatgtaagatttcattctgaaacataattattggtatggacaaaattgcagataccatttctgttgaggctgcagatttccaacttttatttcagtggttcagattagtattaggtcggtactaagaaataagcatgttttcactaatttaagtacttgagactcttgaagaaaattcagaatgaagttctggagaaaggtatgttactgtagtaattactctttgaacaggttttgtgttttgtcattagctctgccctttttaattaaatattttggttcatggaccaaagggtttacttgacaaatttgtgtgacagactccgaacaattcctttactacgaagtataatttataaaataaaatatacccattttaagggtacagtttgatttttgaccagtgaaactatgatcccaatcaaggtatagatgccgtcaccccaaaaagttccctccatatccctttgcagtcagttcatccctaccctggcccagatgatcactgatcttgtcattatagatgagttttgccagttcaagaatttaatggaatcagatattgtaagcattcttgtgtaatacttcattctctctcattattgagattcatccatattgttgaatgtttcactagttaatgtttattgttcaatatttttgtatatacttttaaagcctattcacttgctgatggatctttggtttgtttccaggtttggttattat

SEQ ID NO: 13116 - DNA, 1041 bp, Homo sapiens
acaattacagttgatccttgaactacagaagtctgaactgtgtgtatccatttatacgtagtttttttttcaataaacaaaaaatttttttgagacttaatttgaaaatactcatggaaaaatgcataacctagaaatatcttttaaaattttaaaaaggtacatcataaatgcctaaaatatgtgtagctactagtctgtttcatcatttactgtgataaaatatatacaaatctagtacaaaaagttaaaatttatcaaaactttcacaaactcagaccatacatggtgccattcacagccaagagaaatgtaaacaaatgtaaaattcaggggtcctcagccccctgtggcctgttaggaactggggccacacagcaggaggtgagcaaccagtgagcaccagagactattaccacctgagctccaccacctgtcagatcagcaacagcattagattctcataggagtgggaactctgttgtgaactgtacatgtgagggatctagattgtgtactccttatgagactctaatgcctgatgatctgagatggaacagtttcatccttctccaccccttcctccagccttctggggtccatggataaattgtcttccacaaaactggtccctggtgctaaaaaggttggggagtgcagtattaaatcataactgcataaaattacagtacatactatgctgcctgaatacttctgtagccacctcctgttggtattgcagtgagcttaagtgttgtattcatttaaaatgccatgtggtacctttacagattgaggtctaaagctgtggttgccctcaatttcagacagtgtattcattttgaagtatcagtacagtactgtaggtgtaatttctcttccatatcactcaatattttctgtagcttatataataatacagtatataagacatatacaaaatgagttgactttatgttattggtaaggctttcagtcaacaatagactattggtaattacattttgggggagtcaaaagttatacaggggtttttgactg

SEQ ID NO: 13117 - DNA, 1157 bp, Homo sapiens
aaaaaaaaaaaaagaaaaatccagaaataatttgtaagtttcaaattgcatgccattctgagtaatgtaatacgatctaatcttccaccatcctactccatcccacctaagatgtgaaccctctttgtccagtggatccagactgtatctgctacttgcgtgttagtaatcaaccaaagataacaaggcaactcttaacgtaggagtgcttttctgtgtaactcccttctttccagatctctgcccaacataggcagccacctcagcctctctgaattctgctccttttcctcaactcactgttatcacagttctctacctgggtttttccttcctaccctgcagccaaatgtagggtgggaaggaaggtttttctttcccaccccgcagccactttcttccaggcagaaagccagaatgatggtatagagttgaccttactggttgctttatatattttgtccagttttttagttgtacagtgggagggcaagcccattaacagttagtggcagtataagtcttgaagctaggattctaacctaaggccctggtttccatgtgtgaatcagtgttttatgccattctttaaaaatctatgattttatgtttcatataaattaaaaatttgttcatgggatttgtagttgtgcagtatacatcacaacagaaacttgtagttttaagtgctgttttacactctgagatttatcagaattgagtaatagtacattaaatattatttccaaattatagcacttaatcacaaaacacattccttaaaaagtaaaacaaaaaaacaaaaaaaacctcaactcttggcagcaattttctttgtaccttgttcccaagtaaaacatagtcatctcatatttttcaaattgatgaacagatttctctagctatttgctcctgtttttttttttcctgtttacaatttctatggaaatttggagcattatcacaagatgttctctatcagtttgattatagtgtacaagatttacaataaattactttcctctctgcagctttgcaaaaatagtggtctccacaaacctcagctcctatctaaattgcagcctaatgccaatttacaaacactatatggtacctttgtggcttagtagcttatgctccttttgcagttgtttaat

SEQ ID NO: 13118 - DNA, 1217 bp, Homo sapiens
acacgactggcatctaattgttgtatcctctttctcttgttctgtcttctttcagttcttggattttttagttagttcagctgagagtagagggttaggaattggaagatggaatagcatgaacagtgatgctgaagtgagctcatgaagggtggatatgagagtgagtggaaacttgtgattatgttggggagtgtgactggaggtcaggggtgacctggagatctgtttggagagttatggggctgggagtaagttgaagagatcaccagtagtctcgagttttcaaactatagaatttttttctttagggtaatgagaagcctttggaaattattgagcagaaagtgatataatccaataaatggtatagattttagatactttatggagttatttgataggggatcacatttcaacatgagatttggaggggacaactcaaatatgattccaagaacctaacctgagctatggtgagttatgcaggaggaaggggagttctgtcttggacatatgatgttgcagaggcgattttgagatgtaaagagaggtaaagcctagggatgtattgatgaaaataatcgattgattgtagctcaaactgtagaaatagaagagagaagaagaaagagaacaaaattcattttggaatagtgaggaacagtcagaaactggacaaagatgcaaaattagaagaatgaagacatagaaacatagaaggaggatttctaaataggagtgttatcaccagcatcagttgttgctggagaggtttccagggatatagtggtttcacagtgcacagtaatcctcccaattcaaaacacctgaaagttctataaaaaatatgaaaaaaaatatttctataatgattgtggaaattgggaaagtaaggggaatttgttgcatggtgcctttgcctgagggagttgccttgtaagaagctgttgtttcctttgtgctcaccctctctagtgacagctctaggtctggaatgggaatgcatggattgagtgtgtgtgatggaggagttggtgcctgagaaattacaaaggcaaacctaggtggagaaagctggcataagaaaagagtaacaggactttgctaaattcttatgagcaaaatctacagggaaatgaattctgaggaagctctaccaaggagggaaaagcataattatagaccaatgtatttatcaatcaatcaatcaatta

SEQ ID NO: 13119 - DNA, 1027 bp, Homo sapiens
gttcccctaactacatcctccaagaggtcttagaaggaactgtcttcaccaacgctttcacaaatatattgttgaggtgagcacctttgagatgtggtccaggggttttttctgtaggcagagatgccaatgggaagtgctgcaggggcaatggtctcataaactcaatgggaagcacccagagacccaagcaagtactagcagttatttgggagaggtaacatggtgtgcttaccttcatggtcagctggaagggtgtgatccatacagtttggaggtggataattgatcatgagttctttgattggaagctcactatagctttcttaatgaattcaaataagaaataaaaccatctctaggtgttgcaaagagtcctgacttgagcttttgtaatggagagtcattatgcctcatacagttctcagccctgagccacatcaaaaagctggagccccttgagtaaaggcaggtctgagccccctcagaaaaggcccgatagaaagtcacaaggggatactctttatatttctactggtttttccttaaaagccttcttggtagtgatttaccatggtaactgggccctgggaaaaaggaaatacctaaatattctaagggaagattttccaatggctctaatctagactaatttctgaaattccactaaggcctaccaggaggaataggtatttaaaaagccagatgataattagggtccagtttagggtaaatagggtaaataatcatgtttttgaacatggttattcattcttgtacatatgtgtacatataaatatatatgtatacataagtgtgcatattctatacaattggaatagatttcctgagtaattggcaaatatcttcataagtttcctgatctacgaaggaaggactgttacagtaggaagggccaactggaagtttaagtgcaataaaagaaacaaggcaatgctaatactcttggagttcccagatctcatctcatccccatcactagaagcagttagctttatagaatagt

SEQ ID NO: 13120 - DNA, 1032 bp, Homo sapiens
ggaaaaggggaaggagaagtgggtgcttcaaatcctgcagggaaagtggggagagagacaaggacttcattattcagaccttttcacattgcgagagttaatcttttcctagcatatgtccggtgtcttaatatgctaaaataatgactatcaccttcttaacttcaagtcacatcctagaaggcctccattggattacttaagccttcagaggctgagcaagttgagcaagatggtcagcgtaaaaaacctgatgctgtacaaatctcggagaaagaagtataccagtctaacttgcttatccttgtttggtggttccacaaagggaacgagcaatccttgatcaaatggacaaaataccatgagtgagctactgtcagatttgctaagtacctagaatctagttcttaaaggtgtgctcggaatattttggattctgttttgattttggtgaaaatcctcataaaatctgacagattgaaagcaatgaacagctcagcttcataaaaaatcatttgcatggaactggtgaagggcaaagcattgcctggttgtcttcagctcacttccagtgccaggtgcctgggtgggcttgtttattcagaagaaatgaaacataaattggcaggatccctttaatccatttaattttctctggtgtgtacagaatggggacaggtgtgaaaagtgatctattttgttggaaaattcaaggcacatgacatctcaatgatggcaaaataagaaatagctgacatcatgtttctaaatatacaacattttgcaacagccacctggagcaaaaacagaaaggttgagaaggcagaataatgactttttgtctctggaaggcatccatgttcaacagtctgtcaggaagagagacaggtggggctggctcaccacctggggtgaaggctgctgcaggacttttattaaaattattgcacaggagtggagaagataaacactcagtgggtgcaatggaacagccggcccatatgtctggctagaactaaggtctttctctaa

SEQ ID NO: 13121 - DNA, 1035 bp, Homo sapiens
tgcatagtattccatggtgtatatgtgccacattttgttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcaccacactgacttccacaatggttgaactagtttacagtcccaccaacagtgtaaaagtgttcctatttctccacatcctctccagcacctgttgtttcctgactttttaatgattgccattctaacaggtgtgagatggtatctcattgtggttttgatttgcgtttctctgatggccagtgatggtgagcattttttcatgtgttttttggctgcataaatgtcttcttttgagaagtgtctgttcatgtcctttgcccactttttgatggtgttgtttggttttttcttgtaaatttgtttgagttcattgtagattctggatattagccctttgtcagatgagtaggttgcgaaaattttctcccattttgtaggttgcctgttcactctgatggtagtttcttttgctgtgcaggagctctttagtttaattagatgtcaattttggctttagttgccattgcttttggtgttttagacatgaagtccttgcccatgcctatgtcctgaatggtaatgcctaggttttcttctagggtttttatggttttaggtctaatgtttaagtctttaatccatcttgaattaatttttgtataaggtgtaaggaagggatccagtttcagctttctacatatggctagccagttttcccagcaccatttattaaatagggaatcctttccccatttcttgtttttctcaggtttgtcaaagatcagatagttgtagatacgcagcattatttctgagggctctgttctgttccattgatcgacatctctgttttggtaccagtaccatgct

SEQ ID NO: 13122 - DNA, 1039 bp, Homo sapiens
ttgccttgaatgaagcaggtaagctaagcttaactaagacaaaaattagaggaaagttgaagaaaggatccaagagagaacatcaaaggcagagctccaggagccagaataagggatgtgggtccctcatatgttaatagaaggtttcatccaactgaaactggagggccttaagacttaaagaaaggcagcctcagcctgaaaacatcttatatcctttctgctccaaataaaactgtaagcattccaaagctgggtattggtgccgtctcatttctgtttccctacttcattctatctctattttctttttgatatccccatcagtctttccacttaagatttgttacctcaccttatccaaacatctgagcctataattctcaagttagtgtttttgtgtctcccaactcccagccattaccaccaatcacactttcacttatgaacattttttctttactgtcaaacctcaggcagttccaaaatagcagtgtagaagcaagatgacctcactcccccagacaaaaaccaaaaacaaatagacagcaccaagattatcaccagcaatatctcagagctcaagtacaaaaaggagacagtccctggggccacagagaaatgaaaaatctctgagaaggctgtaaggtaattgaatttctatattggtaatgccccttctgtccagcaccaagtgcacaaagtatttccctccattcacaatttctacactcaaaaaagtgagatcaaggtggacaagcaggttttccaccatcttgggagccttggcaggagaactgtccctgccttaactcatggaaagcatttcaaatgccagaagggacaatatcactgaggacaggccgagagaagggaaggaggtggaactaccatccccagccctggaaactctgatctgtaacttgaaaaagggagatgccaaatcagagtggttgttcagcagcaccacaccattggaagtacattccacaggacccctgggcatgaacccttagccagccttcccacactgccagga

SEQ ID NO: 13123 - DNA, 1008 bp, Homo sapiens
aggcatgaaaatcacctgaactcaggaggcagaggttgcagtgagctgagattgcactgctgcactccagcctgggcaacagagtaagactttgtctcaaaaaaaaaaaaaaaaaaaaaaaaaaaaaaaagcaagtaacatataaagaggctctatcctctttttgtctagcaacagatttctcaatggaaactatataggccaacagggagtgaaactgcatttttaaagtgctgaatgaaaaaaacctctcatccaaaaatactgtatctagcaaagctatccttcaaatatgcaagagagataaaatcttattgagacaaaagctgggagaattcaccactagtagaactatcttaaaagaaattataagggagttcttcaacctgaaagaaaacaaaaaaattaatgtacaaaaagaaaaggaaaacaaaaataaaatttgaagatataaaacccatgggtaaaattaagtacatgtaaaaatccagaatactctaatactgtaactatagtgtgcaatccatttataactctagtttgaaactccaaagacaaatatatcaaaaacaataatagctataacaaccagttaagagatagacaatataaaaatatgtaaattgggacaagagtcaaaatgtgggggaatgaagttacattgtagatttttttttgtttctattctttgtttctattttttgtgtgatctaagataagtcatcaactctttaaaaataacttgttacatatatgaaatttttttgataagcctcatggtactcataacataaaaacctataatagagtcactaaaaataaatagcaatgaattaaaacatactgccagggaaaaaattacttaaccataaaggaaaagagtaagaaaaaaagaaaggagttagaaaacaaccagaaaataagcaataaaatggcagtagtaagttcttacttatcaatattaacacttaatgtaaatagaatgaattctccaattaaaaggcatag

SEQ ID NO: 13124 - DNA, 1064 bp, Homo sapiens
gtttctgaaacttttgttcctttgctcatcctgtcactcatgagcatgttctgattgactttgtgggaagaggacacagcattagcatttcacctggtctgttaggaacaaacaaaaaaaccaaccaatcaacaatgtcttaagaatacttgacaaaacttaaatctatggctgaatctacataattatgttagaatgacctggtaggggaaaatgtgctgggcctaaagtgttgtttcacagctcaagctgctgcatgaacagcatgggcaggtcccctgaatgacatgctgggagctatgtatggctccgggtccactgagctggtctcatcttccccttatgagagcgatggtatgacaggtgcagtgtgtgcacttgtatgggatgacgggttggggtgactgcaggtgaaggaggcaggaagaagcagaaagccttggtcttatgcatactgcccccaaggtgtggaagccacaggtggtcattattatgaaatctgggaagtgtaatcactgggcagatcataataacaggtaacccaggtggcaggtgagggttactatcaggtgggcacagtggctttgggagacaagaccgttaacccctagattggacttagaggagatcctaggggtggatttgtatggagtaattttcctagactaaattactatttagttataaccatggatgctattatgggttgaattttgtaccccccaaaatacataaaagttgcaaaccccagtacctgtgaatgtgactttatctggaaataaggtccttgaagatgaaattagttaaggtgaggctattaggataggacctaatccaatatgactgaaaaaaggggaaaatttgtccatagagttggaagcacacacagggaaaacagcacgtgaggataaaagcagagactggggtgatgcatctgcaagccccaaagaatataaaagattgctagcaaattaccagaagccaggagagagccctggaacagatttcccctcaaagtccttaaaaggaagcaatcctgccgacatcttgatctcggacttcct

SEQ ID NO: 13125 - DNA, 1048 bp, Homo sapiens
tgtttactatagggagagtgtgggatgatgtctggagtttcaggtaaggcttgatgtggcttctgggaagactgtggaaagctctgaatgtcaagtatgtttttaatccaccataatgttgacaccagccacttgaccttacttgcagagatgaataccatgagcatcctggctgccctctgcatcttggctgccctacccccatgattacctggcacttcccatttgcctccatgatctaggacatgcctggtattgcagagggcctccaaggccatactggcattcattatgactagttggtatttattcattactggttattaaatattttaaatgtcacttatattagttccacagaactattattttaaaaaattctgcatttaaatagctttggagatacaagaaagacataagattctgtgtctccagacatgcttgagagcctctttcaccccagttgctgctcagggacctagagatccacagagtgccctttggtaacactcctgatctgcttcagtgactttatttaaatgtctcttgtgttaaattcctcccacatgtaagccacctccaccctgtggtctctgctctccttctaaaacacaactatgattaggttatttccctgcttacaaactcgataacttctcatacctgcagaatacaggccaaactccttattaagggcttccaagactctttgcaaatggttacctctccacacgtcaacacctgttattcccagttcttccctcaaggcccctgtgacctagacacaaatgacgattttgaacacagcaaagacttcatagctcctggcttcctcttgattcccttgccatagacccctgatcttgcagaccccagcataaattgcattcttcctatgaaatcattctcaatctcctcactcccagtgagtctccccactctcagctctcatggcaatttgtttacatccagaacatttatctcaggcccagttgtacttatttattgttagccttgtccattttggtctccaccagacagtgatctc

SEQ ID NO: 13126 - DNA, 1230 bp, Homo sapiens
gggccgagatacaggactggcagtaacagtgggtaccacacatggctaataagagtgcagaggctgagggtatctgaagaagacactgatttttggccaaggtctggtgaatttgcactcgtggctgcagaaatcatcctggcgcaaaacaagctttaaatctttcatttgggggaaacgatcatgaaagtgcctagaaaataagttagcacatgatatgcttctttttttctttttatttacttgacttaaggcaaactgttgtagtaataaggaacattgttttccacttgctcatctccagtctcactttgattgtgtgtggacacactgccctggctctcacaagtagcccattagcagtcacatctttgtgcatctggggcccagactgctgttttctctgctgctaaacaactctatttccttccctaacctctacctcttccccagcatggaatgatggtccctgagtctttatttttgtcatgaattaaggattcttacctgactgtatttgctaactttacaaaatgagagaatagtgaccacctcaagtacatccgagaacaattctccaaattttaagaaagtaagaatatgcaatgtcaattagtggaaaactatacaaattatttgatttatcagaatagattttaaagatgaaaaaggctcagactaattaaaaatgagcaaaagtgtagacactgtactgaagaagaaataaaggtgccaaataaacatataaaaagttccccttcatttatcacttgcatatttcaaattaaaacaacgagatatcactatatacctttagaatagctaaaattaaaacaacagcagcaacaacaacaacaaaaccctgataatactaactgatggcaatgatgtggaacaagaggaactctcattcattgctagtgtaaatgagaagtggtacagccactttggaacacagtttggaagtttcttgtaaagctatacattgtcttaccatataatccagcaatgtaatgctactagatatttacttaactgatttgaaaacttaaaaacctcgtataaatgattatagcaacttcatttataatcacctcaaactgaaagtaaccaagacgtccttcaaaggtgaattgatgaacaaactgtagtatgctcatatagtggaaactattcaagaatgcaaagactgagctatcaaacctgccaaggtatggatgaatcttgaat

SEQ ID NO: 13127 - DNA, 1026 bp, Homo sapiens
tgaatattcagttggtgttactaagtgattccattccatcttaatcatctatttggggacactgcatactgcattggtcatgatttctatggtgttttttgctctcatttgtaaatagctttcagaaacctgaaatgaaattgcatttacttttcattttcctccttcagtctgagtcagcttgacttggaatcagcagtaccttctggcccttttaagcaaccttatttccacgatggagaaaaatgatcattctgcaggatactgtgcaacgtaaggggactgcacgggaagacaagagtgaggccactgtccccacactactcaaatgagctcatttccgccattcctttcagctaagaaaatgtgcaccagctcagttgcctcagattaaaatgcataagtataatttccttgcacatattttaatctgattagcattcagcctatggaagtccccattccttcccctgctctctaatagcttccctttctaaattgtgtcctctcttgtagaactcaggtgctcatattagctttgcacaattttagctgagaacagagggaaggaaatcaccagggtaacattggccgcccacactgcagtttgtgtgtgttttaagagaaataagaagcagatagactgttcctccttaatgtctgtaataggctaaaatttcccaagattctgtgtttttcttaagcaaatatgaaatttaaccggagccacaaaggaggggggcgttatttggttgtgaatgacctaagaggaacagactgcaaagcagtattacccaagaggagcagtgcaaagtcaacacaaatgctttctttcatgtggccctgggtatatctgaatgtaaagtttaggcagagttttttttgtttttttttttttgttgttctgaacagaggcatattaggaatgtttaaaatatctctatttcagatatttgaccccaagtcttctgtttagttatatatggaaacagagctcacctgagatataaaaagaagcggttgttg

SEQ ID NO: 13128 - DNA, 1037 bp, Homo sapiens
attcacaactatattctacttttcaaaaattattaatatatttctctaatgatggttatctaggttgcttccaatatctgacttccactagtaatggtatgttgaaaatcttatacatatctcctcatcagcttgtgagataatttgtctggatggaaatgttaagatgtaggatatacctggatggttatctgaatgactacacctgcttacactcctcagaatttccattgccctataaccttgctaatgcttggcaccatgcaacattctaaatttttccaatctcatgggtgtaaagtggtctctcattattttaatgtgcatttatttgcaaattaaaaggttgagtttaattgtgaaattgaatatttctacatgtttagccactaagatttttcctcagcttattaatatcccttttccatgtctctatttgattacttttctttatcatgttgatttgtagaagttctttgtatgaacaaattatttgatctatgttgatcttggatatctgtcagtctgttgtatatcttttaactttgccgatgatttccatggggcaaaagaaatactttcattcttgaattcaatggaaatgatgggatcctgttgtggcgggggccaaggggcagcaatgcactcatcaccataacaagatgggctggttaccataataaatagcagaactaaagcactaaccatagtagttttacccacagagattgtcagcattgcctaattattcatggtgtccttagacctgaaatagttggcttattaagggcttacttgattcgtgtaagtaaaaagctgcatgtatttatctggaagactgacttgaatcacgaaaggcagtcatgatccctcaattacaagaatcgagccagatgacaggtccagagtcccttaaatgaagaggagaccaagtccccttgaggagggacaacgcaacatagctaaaaattgatgctgtcattttgtagttttctccgaggggatctgtggccatttaccagggtggttatgcatta

SEQ ID NO: 13129 - DNA, 1033 bp, Homo sapiens
aacaaaggcctgcattcttttacttctaaggcaattctaagctccagcagtgtagctgctagaaggaaaatctgcgttatggaggctaataagtgagatcttctgagatatagtggtagtgaatgtgttcattttggccgacccaaggaattccattagcaaggacagggaattcttgttactctgaccaatgatatatggtttatgctttgaaattagttatcatggtgtttctttaaccttctccagtcttctaagtgcagttattgtttcttaatgttcttttaccattgtatattaattagaagttatagttaaattcattatatagctatataattggtcaggtttgaggtaccaccaagaagaatattgtcataacacaaaaatttcagacttgaggttagatgcagtaatttgtctttgtcttttttcaccctctggtaaggtggtaagtacactttctattgtgtctaagatagccatgttaaacatggatatttaagtagttatatgtatgaaaagaagtgagtgtctgagatgggtgggtagccaaggactctaatgttatagatttctgacggttttggctgcctagcatccattctttctgctgttaacattctcgattttttgatactcttttagggagtcattcttgatttttatggtctggggcttcactggactttatcctgctttcctggaccagacagagaaactgacgtctggcccaacagtaactggtattggttataaaatttagctgcatttctgagacagcttgataacttctttctgaagaaagaaaaaggtgctttcgctggggttgctgaaaatgttagaatgtaagtctagaattgattgcagtctgcaccatgaagtcagattctacttgagaacagagctgttaaagaggcacctaaaaccaagccatacattgctgatggcagctttggatcccctcaagtcagttttatctccagatgtttcagtgcatcattttgccttaagccagtttgagttgggtttc

SEQ ID NO: 13130 - DNA, 1880 bp, Homo sapiens
aaatgttaaatatgaaaaaatgtttattggaaaaaggaaatatggtattctgaattaataactttatgacataggcatttgtattcccatttgtatataagaaaaatgaagtttggtggaatttgaagctaagaactttgggcaatatggagcaagaggcttttataagagagtggcatgagtgaagtagtgtgcccattgcatgtagattcatctgattggatagagtagtgtcctcttatcctttcagtgtttcttatatttcttttcctgaaacgggacttgtcagagagcacagcctcttctgtagcgaagtatgtataagttgggaggtgcttctttctagccccaagttgtgcttgtttctcttaggtcttttataactgtaagctgatgtacttgactctctacatttatatttgtaggattaatgaataaatactattagaatccaatcagtttttgtgtcctggttttctgtaaataacttggcctttgtggtatgactaatctgaatccaaatcctggtctgtcttttcgtggctttgtgaccttcaactatgttacatatctctgagcctgtgttttttttttttttctctctctctctctctgtgtatgtgtgtgtacctgtatattctcacatatatgaaaatgaggtaaatgatgttatttttccttttatttccctcataagtggaaactgtatatatgagagaattctatatataacagatcattatattattgtttctgctactatactgcatgttcatttagcacatttattagtcaaaatgtggtccacagatgaggtttgcatattcatgaaatatttgctgttctaagaggagataaggaacttgtgccagaatgcaaatcatctgtgctaagtacactatttctttcaactaacctttcttttttttttttttttctcataacaagactttcttgatgaaggaagcagaatgtcgattcatattttacttctatctcctcattggctggcactctgagtagcctgaatgtagagtgctttgggaagatattttgaagaaagcttaattttatttatattacttttcatttttggtgttagaaaggtttgttattattagtgaaaaggttattaaatttgaacttggattctaatcgtgtctttgctactgattagttgggcaactgaattaaatcttctaggccttattttcctgacggaaaatgaaggttgggttagatatctgtggtttttgtaggctttaacatgttaataattatgttttttaagtactatttttttcttttacctttttttttttaaaaaagcaaaactgagacctcgtcaaagtagtagataagaagcactgcaatagaaacatactttaagaagcctctttttggaatagatgttttattaagctgtagtcaaccatatggcaaggatttgatgctaaggctataatgattgagactgtttttgtcttcaagtagtaatatcctgggaaagatagacaagtaaatacatacaaatgtaaatacataaatcggtagtgtgttagagatatggaccaaaaatgtgtgaaacaggaggctgtgaaagactctctagaacaaaggtaagcaaacattttctataaggatccaaatattttagcctttgtgggccacatggtgtctattacaactactcaccctgcagttgtagtggaaaggcagccatgtaaataaaaatacatcatttttcaacaccaattctctggcactaattaagtgtcctaaaattcaatcctgatactacatagagttagtgcaaacctcttaaattagaggcagaatccttcaattctgacactaattgaaagttagtacagactcca

SEQ ID NO: 13131 - DNA, 1050 bp, Homo sapiens
tacatggattataagagatacacacacattcactctatatatgttatatagattatatatttataatatatataacacacacacacacacacacgttttaaaagcatacacaaatgcagggatactgatcgagcaagcatttaatagctgtatcctttaggaaatagaggggaaggggttgagatggggaggtgtgaaggtcaagtggaaaattttgctttatctttatagataaatgcttttacattaaaaatgccatcacatattattgtttttttaaaaacctaaagaagtttaagcagatataccaaaaatatcaatagcaattaaatttgtttttttactttccttttttgtttttgttttttagtgtaattttgaatttcaaaaaagaaaaagccttgagaaacacttggcagcaatgataacatagttggtttttttttgttgttgttgttgttgttaagagaggaggtcttagtatgtttctgaggttgaacttgaactcctggactcaggtgatcctctcatctcagcctcctgagtagttgggactataggtgcttgtcaatgtgtctgatttgtggcgtagttcttaaatcttttcaaacttctattaaaaataataactagggtaactgaaggaagaaacaaatgctgggtaggatacagagaaaagggaactcttatacatggttggtaggaatgtacattaatacaaccattatggacaacagtatggaagtttctcaaataactgaaaatagaactaccatatgatccagcagtcccactacataggatatatccaaatgaaagaaaatcaacatatgaaagagatacttgcactcccatgtttattgcagcgctattcacagtactcaaaaggtggaatcaacctaagtgtccatcagcagatgaatggataaagaaaatatggtatatgtgcacaatggaatactattcggctataaaaacaagtggaatcctgtcatttgtagcaacatggatggaatggaggtcattatgttaagtgaaatgagctaggta

SEQ ID NO: 13132 - DNA, 1044 bp, Homo sapiens
gactttccacagttcatttagccatgtactttttgggagggcatctagttgtttctactttatggctattacaaataaagctgctattaacaattatgtacaggttttgttgtagctatgtttccgtttccctaggataaattcccagtagtgaaattacttgataatatgctaactgtatgtttagttttgtaatatactgccaaactattttcagagtgattgtaccattttatatccttacaagcaatttatgacagatccacttttttttttttgcatccacaccagcacttgctgttactactgttttctgttttaactgttctgatatatatgcagggataactctttgtgccatccatagatcctctttgatcaaatgcgtgttcatgttttctgcccattttctgattcaatggccagcttctttactgttgatttctgttacattctagatgagtcctttatcagatatgtggtttacaaatactttcttccagtctgtagcttatattttcaactttttaacatgatctttctcagagcaaaagtttttatttttatgaagtccaatttattaatgttatcttgaatggatcctgcttttggggtcatgtctaaaaacttttagccaggctctaggtcctgaatattttctgctatgttatcttctaaaagttttatattttacatttaaactatgattaattatgagttaatttttataaaagatatgaaatatcttataggtggaggttcatgttttttggcctgttgataaccagttgctctgacattgtttgctaaaaaggttgttcatcctccatttaattgcttttgtatcttttttgagaataacttgttgataatcatttagggctgtttctgggttctcgcttatgcttcatgatctatgtgtctatcaactcaccagtgctacagggtcttgaattattatagcaagtcttaaaattagagagtgattcctcccactttatttttgtttgttcaagaaaaaatttaaggtattgtaattccttt

SEQ ID NO: 13133 - DNA, 1033 bp, Homo sapiens
aaaaactacacagttatgattcagtttattatatttaatttgtaaaggacaacagtagttttctcatgcttatgaggaaatatattctttcataatataaggcataatagtcattgtcagtaaaatagagatgagatttgaatatggttatcttttggcataataaaatactgaagtgggacactgtttataataaacatgtgatgattacataatgatgtctgtactttacatgcagtgctactctgttggcattcctggttgaactacttaaaagttcagtagccatgcaagaacagatgctgggtggaaaaggctttttagtcattggctacttacttgaaaaggtaagtgatatgtgttgatggttttattgtgtagcttcacagttggacagctgttaatcactaatttttttttctgtaatttcactttccattgactgtgtagagattatactatttgctaattcacaaacgtcttagatttaagtgtagacatggaattaactgggtatcggaagtgtaattaagaaattttgaataaaaaaatctaaataaaaaatttacatctatatctattcaagcaataagtatcatttctcttaagttttctaagtagtaccccctttatttctactctcactttctaaggtgtcacttacccatggtcaactgcagttcaaaaatagcatggaataaaccatttataactttctaaattgtgtgctgttctgaggagagtgatgaaatctcatgctgtccctcttcatcaagccctggacatgaatcctccttttgttcagctttttcatgctgtatacactgtctctccattagttatttagtagctatctcagttctcggactgaaaatcgtatttattatccactaggggtcttggaactatcgcgtcaggataaggagggagtactgtagttgtttctttgctatcttttcacttagacttttttttttttttttttgagacagtgtctcactctgtctcccacagtggagtgcagtggcatgat

SEQ ID NO: 13134 - DNA, 1028 bp, Homo sapiens
tgtgatttagtatgtcagtgagtgtataatgaggtcctaggtgaacctccatcaaatccagtgccatactgggtgcagttagccttagctatcttggctctcatcctggcttttcagggtcttgtcaacccctagtttctgaagctatttcaacagtttccttttgctagtcatgcgaaactgctgcctggagttttttgttctcctgcaaccacccttattattcctgtttcatttccccttccccttcagagatgtccatctcttattcttatgggctgatgagggagaaggtcggtcttctttatctacttcctgctgattagagatgttggccctgcctggcaagggtatggaaatctttggctgcctggcctgagggttctaagggtgagtcatcaggagactctgaatccaaagcagggattggaatcattgcatgaccatcattttgacatggaactgttgtaatgtaaaagacacaaaatttacaaggaggttaaacaagtaaggacaaagattcatagtaataagagagctattaaaggtcgaaggaaggaggaaccatgtcacagttggtaggtatcctttgatggagtcccagatggtttgagcagtgggattatattgaaattatgtagccaggtagcctgttagtaaatcttttgaactttcagttcaactaatcctgaattgttaatataagaacaacaggtgtggtttattactgtgcaaacccctctttgttcagccagaacataaagcctcttgttgtttccttgaccattcaagtagttcatgctttggcacggttagagcttcatacagtagcttagcaatgagcctaaatcatgggatcaaaatcttgcaaattcctgtcatacccaggaaagttttgagttgcttcttcggttgtagaggcctgacctttaagatagcttccttttgttcgatggacatggtgtagtttcttgggcttaggatgtaccccagatattttacttccagtttagaagtctgggccctgg

SEQ ID NO: 13135 - DNA, 1059 bp, Homo sapiens
acagttttccaatctagaatgctatgattctttttattactagtgttttataagtcacgaattaaatatctatagatgagttagcgatcttgattatttttaccctagagttttatcgtacatgtaaagtacctagtagtttcagtttattctaaaatggataagaaattgttatgcattctaatttgacagccatctcattttgatactaagttaaattaccatgtattttccctattattcatcatacatctataggaaagaaaaatcaaagcatatatttttattaatgggaatgaagattttagaaaagaaatatcaatttaaaatctttataaattacaaaacaaaactagtataagtacatatatgtggttctgtctaaatatctttgtgaaatgatcttaagtttaggatgtcatttttataactaaagacatttaaaactaatgttgattttaaaatgggcttttcctttattcaaggataattgataggtaaagtaaccgaatttggtaaccagctctggtgatatatggaattagttgaacatttattttatttataaaatatggtaaatatactaaatttatgttcacttgtagtatgtatgtatatgtattatatttccaaatttccaaattttaaacaagacttaaatcttctacttttttaaagacggaattggaaaatattgaagtgacacaaggcatgtcagctgagacagcagtaactttcctcagccggctgatggctatggttgatgtacttgtgtttgcaagctctctaaattttagtgagattgaagctgagaaaaacatgtcttctggaggtttaatgcgacagtgcctaagattaggtaagtctgttaaaacaatagtgcatgtcaaataattatctacagagcagctttataaagcactatggtacataaaatattaatgatataagttgatgattatataatatggagattatcttgagatacagagattatttttataattaatcagaattactaaattttaaaaaattatgccttcacattggagatttcac

SEQ ID NO: 13136 - DNA, 1026 bp, Homo sapiens
cttcagagatgcattcgttattgctagtattgtttgcatgttgcagtaatacagaattgtcatggatcttcagtggaccatgtggcaggttgttacatgctggctcaaatttgattccatgattttctccacagttgtggtcataccatctatccctcatccaagtttgaaccatggattccttgccaagttaattcctgagcagagctttggccactcattttacaaaggtaatactgacctcatctcctgacctgtttgggtattcttatttcatgaattgttttaaaataaatattcatgatatacttgtttataaataagtatatacctcaggtttcatggagatatgatatgttgtatttatacctagctattgagagcgaagtatagcttttatatttgtattttattacatttctttaagtatcatctataaattaaggatacctaattatatgtatattaatatgcatagtggtagcactcaggagagatctcaggagagtcacagtttagtagtgggactaaatgagcctaatataaaggctactctagaataaaccttaaaaacatgccttgaaagcatcaaactgatctatacgttatttaacttccagttagaacaaagccccaacactgtaaaggaatgcgaaaagtccatatgaaaaaccataaaattaaatattagacatccaacaaaaattattaaacatgcaaagaaggagaaaaatgtgatgcataagcaaaagaaaaaaaatcagtgaatagaaacagattttgagacaacagaaatggcagaactatcagatacggacattatagaagccattacatgtatattcaagatgtttttcaatgtaatggaaaaagttaacatattgaagagagaaatggaagatataaagaaaaaaatgacaattttagagatgaaaaatacaatagccaaaatgataatatctctgtgtaggagtaacatgagattactgacttcagaacaaaggatttataagaggtagaattctg

SEQ ID NO: 13137 - DNA, 1094 bp, Homo sapiens
caaaacatatttatttgaataaaagtcattgaaatatcaaaattactacttcctttttgaaatcattcttttatcagcctcaataaaaataaaattgagatgtttttagtactatgtaaatattttgatgagctatttgaaaatattctaatatttgatttctagaaacttctaattgtgttttgtaatctagagatcaacatttatattgaagtttcaactatctagttagaaagttaaacattttaatatccattgtaagtcaaatagttgagcagaaaagcaaaatattatgtagttggtggcaaaagtcttttgatgtggtagcttgtgaacaccaaatcagattttatttccttaggtattttgtttgctagtgaaatgcttatattccagtctaatatagcttgagaagtttaaactttttgtatagctgttaatgtaacatgtcatatataacgatacttagacattatattaatggaaagtcaaaacactagaccatatctgtaaattagctaaattcacactaagtgttagatatgattgtatgacttctgataattaaactctataaaaattagcccatgctagtaaccatgacactgttttgtttttgttgttgttaaagtttttgtttctgcatttacattttctgtcctcttgtcgctataactatttaaactatttaattctctcctgatactttgctgcaattgttttctctcaaaaaatgtacaatccatagatacaaatgtatgttaaaatatattcagtggtatctctaatagtgaaaataactgcctcagtcatcttatcttctcattctagatttgtaggttattttatcaacttccaaaattttggctattgcctcagtttgaatgatcccaaaatgtacggctattcttcttttgacctacagatataaatatcttagagattctgtagactaaaagtgattcaaaatttagttaattattttcctgaagaaatctcattttcttcctttctcagttagtgacgtattaccactctttttcttaacctagatatttcagaaatacccttagtcttctcctccttctcattta

SEQ ID NO: 13138 - DNA, 1055 bp, Homo sapiens
tatatctgttgcagcaggattataattcatcttcaacctcatgtttgttattttcaatccttcatttctttgcaggagtgttgtggtgcctgtaaagaaaccacctccaggtagtttagctgtaaccactgtgggagccactactgctggaagtgggctgccaacaggcagtacctctaatatatttgctgctactggagctacaccaaaaagtatgattaatacaacaggtattgtacttacatatttttgtgatactcatctttttatgttttctgtatcatttttctgcttatttgatcttaaaaattaaaataccctaatcatttaagattatcttaatttttaagaaggttatattttatgttatgacttttagaatttgtctgtagttgtagagtgcattttttagtggtcattttagaggacagtattggttttgagtcttctcaaaacagtgctgtttattttcagagtgaaatcagattactgaaagatatttggggagcagaagcaaaggataatttgaacactgaagtttgatatgtaaaaatcagtaaaatgtatcaagaatatcaagatgtactaaaaatgttagtgacagaaagtagatttggggacatgattggttgagttctaatatatattctttgctaaatcccctaagggaggcagagctcccctaagaaccttgacgatatgcaagcgcctcaacttgataaaaagtgcatgtgaataagaaccattgtttgacgttgaattaattcatatacatagattataacttgatccaattcattgcccaacaaattcctaatgaatctaggaacaaaaaatttcaaatcaattacaaatattaaaagtctgcctaaaataaccttttttttttgtaaatttccagaaatgttcctgttgattattagctaaataaatccttacccaaatctttgtgattccattttaggtatttatacagcgcaagatgatccctgacttttcttccctgactatagtagtcttctcttctccaaactgtatagccttgaacttttcca

SEQ ID NO: 13139 - DNA, 1058 bp, Homo sapiens
ttcaaagaaatagaaagtagaatgttatttgccagtgactgggggtgatgggaaataggagttgtttaatggggtatagagtttcagttttgcaagatgaaaaacctctggagatgtgaatatatttaacactactgaactgtgtgctttaaaatggttaagactaatttttatattatgtgtattttactacaattttaattaaagtgaaaagtttacccatagactggaaaggtatatgtctaacaatgataatcaacaaatgttgatatctagattacacaaagaaactcctaccaatgaataagaaaagcacaattctatagaaaaaatgggcaaaagaataaaaatctgttaatttgtggatgggttaaatacaagcagtcagtaaacatgtaaaaaaaagtcaacctcatttgcaatctcataaatggttaataaagccaaaatgaaacaatttcactcccatccaataagtataaaatttatacttaaaatccatttattaggaaaggtgtagagttttctagtgggagtctaaattgatgaaaccactttgaggaataattttgcattatcatgtaaagttgaatttgtaaatgtacattgactcagcaatttcattcttgggaatataccatggaataatttttgcatgtgtacacaagaagatacagatgtaaaatgcttattaaaaacagtgactttacccaagacatactgagaacaacctaaatgtatattaaaagaaaattgtataattaaatggtatactatgcagtagtgaaatgggatttcacaaaaatgatatttaccataaaagcttaacacatggataaggatactgtatcttctttagggacacattcataagtgataaaaatataaatgccaatcaagatgataaatttacagtagttattacatctaggggaatggtatcagtgctgtaactctaacgttcatgggggatgcatgtggacatcagaatggaagcaggtgtaagggttccacagaagaaaacatggctgccaaagctcagcctggccttagccatt

SEQ ID NO: 13140 - DNA, 1034 bp, Homo sapiens
ttgcttaccagctcttgtgctctcagaatgttacccacctgcccacggggcagtccatgctcctccacctgctctagtgctacctgcacctccgcgggccaactgggccacagctctgatgattgttaacaccagccttccttctgctcccaccccagaaatcactgtgaaattttgtgattggtttcaagtgaaggaaataaaagtaaaatcactccagatctctaaatactctatcaaatgaagcactttcatttttctcacatccatctacttttttatccacttctgtattagtccattttcatactgctataaagaactgcccaagactgggtagttcataaaggaaagaggtttaattgattcacagttccaaatggctggggaggcctcaggaaacttaacaatcatggtggaagggaaagcaaggtaccttcttcacaaagctgcaggaaggaggatcgccaagcaaagggggaagaaccccttatgaaaccatcagatctcatgagaagtcactgtcccgtgaacagcatgggagaaatcacccccatgattcagtcagctctgccaggtccctctcttgacacttggggattatgaggattacaattcaaaatgagatttgggtggaaacacaaagcctaaccatatcaactcccctgccaaaaattccaaagtatatatgcagactggctttaagccccaattcggggcctgctggagctctggcctaggcactggcaattgtcataacaaaggtagggcagtgtgtgatcgactggggagcacagttgtcagcctgagtaatgtgtagcctctatcctgtccttgatggttgattaaagatttgaggatgatggatatgtagctgaaccgagaaggcaggcctcagttttactagctgtccctgcacagatgcagctgaagagaggtgctaaccaaggtcagagaggaagtggtctgtggtctgtctcttaccctaagagtggttctctctaacagtgtgaccagccaaagcaggtgtttgt

SEQ ID NO: 13141 - DNA, 1049 bp, Homo sapiens
gacagaaattatgcaagccagaagataatggaacatctttaaagtgctaaaatgatagactgccaacctgttattcttaattcagtgaaaatattcttcaaaaatgaaggtgagataaagactttttcagacaacaaaagctgaggaaatttattgccagcagatctgtattgtaacactgttaagaaaatggttttcaagcagagggttaaagataccagatggaaacatggacacatacaaatgaaaaaaggagtacaagaaatggtttctgtgtgaatattcaggtgctcctcaacttatgatggggttacatacccataaactctttttatgtaaaaaataacataagttgaaccatcacaagttggaggtcatctgtatattaaacattgttttctcatttttagtcgatgcagaaaatgcatctgttaatattcaatacctagtcataataaaatctcagaaaaataggacctgaagtgaaaaaaagctgaactaattggtatctaggaaaaaacaacttatgacatatttgacagtaaaagaccaagtaagattgggcaagagttttatgtctcattactttaacattttactgaatattctaactagtacagtaaatatgggggatgcatattccctcttactacatggaagtggtcaatattatagagaagtcaacagaaggaagattaggaacagaccacatgatgtcatcgttagaatctttgatttggagacagacctcagaagagtagtggaaacgaatatagaactgtagggtgtaaaatgtttgaataacaaactgagtaaacagaccattcgttggagaaatttgacaatgaaacaaaagaggaaaattggtggaggtttgtgtaactgttgaagattttattcatggaagggaaagctatgtttgtttggatatagaggaaaaagaaccattggagatgtaaaaatgaagattgacagagataagagaaataatgcagaaaagctgtcatgagttaagaaaggacttagaagaaatagagaagtttgctctg

SEQ ID NO: 13142 - DNA, 1034 bp, Homo sapiens
gctttaagatttgtttcattgctatcataaattcttagaccttactcctatggaaaagggcgatagaaatagaaatttttagacctgactcctatggaaaggggcaataagaagcataaattcttgtcataggtattgcacttttccataggagtcaggcctaaaaattcatcggtagcttaggataaccaatggagaagatgccctttgttacacttttcctataggatacatttttcttctcattccgtttttttctttatacttatgcatttttgtttgccacccaatactgtgtactgttgtctacctaggatgtaaagggattggacttctcaactaaatatggtaaaaaaaaaattatctttgccacttttacaactgtcattcacaaattattaaacatgctttaaaaaccacatgcaatcctaacattttctgaggaggaaaatatactttatcttgtgaagaatattttatagtcccttttctgtctctcatttagtaggtgaaaaaaataaacttctgttttcttcattgaccacaacaatgagagtccacaatatgtttttttttttttaattttactttaagttctgggatacatgtgcagaacatgcaggtttgttacataggtatacatgtgccatcgtggtttgctgcacctgtcaacccgtcatctaggttttaagctccgcatgcattaggtatttgtcctaatgctccccctcctctttccccaaccccccaacaggccccagtgtgtgatgttcccctacctgtgtccatgtgttctcattgttcaactcccacttatgagtgagaacatgcagtgtttcattttctgtttctgcgttagtttgctgaggataatagtttccagcttcattcatgttgctgcaaaggacgtgaactcgttcttttttatggctgcatagtattccgtggtgtatatgtgccacattttctttatccagtctatcattgatgggcatttgggttggttccacatctttgctattgtaaatagtgct

SEQ ID NO: 13143 - DNA, 1046 bp, Homo sapiens
tagaatatcagtctttaatttgtccttatgggaatgaagataaaaatctttaagtagaaattattataaatgtttatcctacttaacagctacacttttgaatacaattcatcaatcatagctggagaaagcaattgtgcagttgtctacaattaacaggacaaaaacagttgataaatgtgcatctgaattaaagtactccctgggaccggctgaaattatacactggatcatttaaaggaatctaacaaaggatctttataattaaaacaaagcaaggttaatgggatgtaaaattgcctgtaatatcttggcaataatgattggaatttgaattattaaaatatgcattgaagaataaggcaaataggaagtacttatttaaaatacagaatttgagtgatctttttaaataaattaatcatttgcctgaaataaacctttgtcactcttttaaaagaatatagaatttaatttttgaatattcatcagaaaagaacagataatatttatgtttagcactgaatttaagctagagctctcaagattctgattttttgttttgtcctttagaataggggaaaatatacaccatgcatttcttaggtttttaagaggagaagcatattgcatccaagtataattttttagtgattgtatggcaccaatttgaatgtattctttaatttaacaaatgctagttaatattttaaccaacaagcattggtttgcttgagtttatttctcttatgtctttgatttggcaaaaactgtatttaaaaataaaacaaaccaaaaaaaacttccaaatctgtaaaataagaaactatttcctaaagtagatattctggtttaatttggagccaataatctctggaagctactggaaaacagaagtttcttttccatgtgttttcttataaaatctgacctatgccaggttttctttaacattcttttttaattattattattttctaatattatactttaagttctagatacatgggcagaacatgcaggtttgttacataggtatacacgtg

SEQ ID NO: 13144 - DNA, 1030 bp, Homo sapiens
aatcctatctgttgatacctactttagtttaaagtaaaatatataaatcaattactactatgtaattcgttatcttatataggtcctttcaatctatattaataataaagctttcttcccaggtaaattccagctatttctaatttactatcactcacattattttacattaaacttcaactgtggtcaacccaaatttgatcaataaaatagtaatcatcttataaagaaacctaaatatactcctgtctcagcctttttgtgactggtctgtgctattctgattttggtgtataatacaggacataaaggaataaaatacctgtcagatttgtcacttttcattgtttgaatttcttctctatctctattctgtcccacttgagatcatgccaataaaatattttttattttgaaattgcaatctcatccatcttcacacaatcaaaaattatttgtttttatttcatttattataaatatctttactattattgatactactattgttcgtttgttacttcttgaaacaatctatactccagatattttaagtggctgtctgaacgatttttaacatttaacaagactattatttttaatacacagtacctgccacttaggcttgaagattaaaaacatgcaaatgtaagtaggtgttagttattattatgtcattccttgttacgtatttaccaaatgaggcaatttgttaatgatataaaaatattaaaatatctaaattatacctaaaatctaatatatattaactcagttcagtatatttttttctttcagatgctaaggttagaaagtgtggctaacaagaatcctctattctagcctctgaccaattaacaaatacaaccaaaccatctaaggcacacatcagtgctccgaagtgtttgcctgcattttcttgtagtcattttatagctttgggttttaacatttaggcctttaatacatctttagttcctttttttatatagtgagagataggagtccggtttcatgctgcagatggata

SEQ ID NO: 13145 - DNA, 1025 bp, Homo sapiens
catggttgatagtgtgtttcagactgtttctttactaatatgtttgtctactcattctccctattaaaagagagatgttaaaatattctaatatgattgtgagattatttattcctatgattctgtcaattttgcatcatatattttaggctctgttattgactaagtacacatttgtgaatattatgtttcttcaataattgaactctttctcattattaaatatccctccttatttctggtaatggtacttgttttaaagcaaactttgtctgataataatatacatagctactctggcatcttatgcttattatttatatgcttttctattcatttattttccactcatctgtgtctatgttttttagtgcattttgtgaacacacaacatatagttgagtattgctttcttttttgagacagggtcttgctatggtgcccagtctggcctcagactcctgggctgagatgaacctcctgcctcagcctcccaagtagctggggttgtaggtgcatgccactgcacctagtgggtattgctttttaatctgttttgatctctgccttccaattagaatgtttagtttattagtgttgattataattattgatgtgattggatttagctctaaaattttaatatttatttgtttctgtgtgtctactctgtttatttctgctttgtgctctattctccctttcattctttttttgaattatatgaatatttttagaatttcattttaatttatatattacatttttcctatgtatttttgcagcatatttttagttgttgtctagggattattttatacatccttaaatttcagtttacatagagttaatagtgtatcactttatgtaaaacatagaaaccttgaaaccatatagattcatttgtagcttatcagacagggtcttagtcaccttgcgccattgctagggactgcagttgaactcaatccaaatgctcagaaatgggtaactcaccaattcctccaaattttcctcacctccaa

SEQ ID NO: 13146 - DNA, 1079 bp, Homo sapiens
atgtccataaagcgaaaacagatagaattgaaaaaagaaatattaaattatccaataatagttggaaacttcaataccccgctttcaataatgaagacaataactagatgtaagattgacaaggacatatgctcctcaatttacaagggtgttgcatcctgacaaacccatcataaattgaggagtgtattttatatgtatcatttttgcaccactgtaaagtcaaaaaatcataagtcaaaccatcataagtcagggcacatctgtaaatagaagactcaaacaacactataaaccaaccagacctaatacacatctgcagaacactcccaagaacagcaaaatttcttagtgcacatggaacattctccaggataaaccatatgtcaggccataacacaagcctcaataaatttaaaaggattaaaataatacaaagattttttgacacaatggaattaaaaatctttctacagttgacaaactgaacagcaaatactttggatgataggcaagattcataaatgatatagaaaccatgccatgtgacttgaaagaactgaggctagtgtacccaactaaggagtctaatttggatggtagagatggggatgaagtaggatataatagtttcctctaagaagcctgtcgtttatagcaaggagaatattaatatgtatacatgaccttccagaggacacaagtaagataattgggtggaagttacagcacaaaataaggaagaatattataactgtacttttcagttcagtaagatataggcagtattgtacttccctttttaaaaaaacaaggtctcattatgttgcccaggcctgacacaaactcctgggtttaagggatcctcccacctcagcctcccaagtagttgagagtgactagagtcacatgccactgtgcctggctctactttcatatattgtgttccttaaattggatttttaaagtcctatgtagaaaagccaaacaaggccaggtgtgggggctcactcatataatcccaatactttgattggctgaggcaggaggttagcttgagcccaggggtttgagacccg

SEQ ID NO: 13147 - DNA, 1047 bp, Homo sapiens
aaaaagtctgtgctttgtaaaagcccaagctgtaggggcccttcttgttggtttaaaccagggccttgttttgacaaattttgatctgtgcagtttttagattttctgacacatttttgtttccttcccctttggcctgcactttgtgctctctgccttgttgctgcttcaaaatcctaacatagtcttcccaagagaaaaagaaccaccgttattgagggcttaaaagaaacaatagtgtaatacttcataaaatagcaatacttaatctatttccatggtgatctgcacaatggaggaaaaacaatcttgggacttgtgataagccaattacaagaaaggttaagagtttttttagtgccagaaacatgccatctacatgaaaacataggatcattactaacagtctacactgtcaaatacactgctctttagaactgccagaaatttaagctgtcttcatttttgagcttttaggaagctgacagagttttctgcctgtgttcataggcttcgacgtcagaaagagaaattacggaagactgtagaatacttgctaattaaaaccagaaataaattcaaaaatcagatttagaaatatgcttctttgtcaatgatagggcccctttaagactaacgatttgccaaaaatggagtgcatttgaaacatacatttctacagagtcatgatttatcattctcaaccccaaattcaaacttttagaactgcagaattggaaagaaaaaaaaaaatcttcagccaagaaattattattctgggttgcacctgtaattaaaaagtagctattgacatctgtgccttagagacttgccgtagtcttcctactatcatagttgctgatagctgctttccattaagagaaacattttatcttaatttttagtagatagaacatgcccaaatagaacatatctgaccatatttgtctaaataatcttagtgttgctgttagctatatttcctttcacatgtaaagatacaaaatataataatgtttgtatctcatatgctttgtcattggtgta

SEQ ID NO: 13148 - DNA, 1037 bp, Homo sapiens
gagcagtactcattacactcaattagtgacagccccaatttttattctataatatttatcaatacacttggcccttagaaatgctcagcagctagaccattaggcttctgcttgaagagttgatttggagcaattaaataagcctttaggatttaatggcaggaaagtcactcagggaggacctacctcaaggagaagctcaaagcattttgcttcagctcatcaaacagagctctggagcattgcgaaaacgattttaaaaatggcaagacaaaaaaagtagaaaactatggaataatgttttgcttcaggtgtagctaatccaaactgccacaaaggaaaattggggcactggtggtgtgggatgagagggttcagtagtcaggagacaatcttttgttgaaatgatcttttatattgcttgaattcttaccatgcatatatgaccttttcagaaatgttgttcttactacaaactaaaacaaaatcttgttagaaattgatgtctaggcatggtggctcatgcctgtaatcccagcattttgggaagctgaggaggtggatcacctgaggtcaggaatttgagaccagcctggccaacatggtgaaaccccttctctactaataatacaaaaaaaaaaaaaaaaaagtagccgagcatggtggcacgtgcctgtaatcccagctactcaggaggctgaggcacaagaatcacttgaacccaggaggcggaggttgcagtgagctgagattgcaccactgcacttcagcctgggcaacaaagtgaaactgtgtctcaaaaaaaaaaaaggaaagaaattgagatgtatagacaacttgtgcttacagtaattgctcctttgctttctatttttctaaaaaatttcaaaaagtgttttacttgtgaatctttatttacatatatgtaacacttatgtgtagtgagatttacaggccttggagtttacaggccatcctggggtccaaaatatatacttccctgctggagatacaccaagaaagtataatctaaaaac

SEQ ID NO: 13149 - DNA, 1052 bp, Homo sapiens
tcagaggttctctggggacccttccctgtctgcctaggcatttggctctctcatgcctctatcaataggaggcaggaattgatgggtttatttctagcaaccaaaatggcaagccttctcacatgatcttggaaaaggaagtaagaattttgaacagaaatctcttaaatagctgacatacaggcatagcaagttgaacaagatattgatcagaaccagagtagcaaccatataataaactgcaggtactgcctgtattttgtgataagctgcttacctgagacctcttgatgaacagcaggcaaagtttatcaacattccaaacacctgaatgataggcacaactacaggtttggctactgtttccatgtgttagataaccaaaaagccccaaagcacagtggctcaaataacaacctttttttttttctttttcctcacaatgttgtgggtcggctgaacttagctgagagtttcttctggtagtcttgcttggggtatctcatgaggccgcattcagatgggagtgtggctgtgactggacagtcaagatgacctcccatcctccagagctggaggcttcaaaccaaaggcccctgtgcaaatccaacccatgctcagtttttgtactgccatgagcagtaatttttacatttgcagtaattaaaccgcttttacattttttaatagttgaaaaagaattcaaaacaaaaatattttgtgatatgtgaaaattatatgaaattcaaatttcattgtccacaaagttttattggaacataatcatgaccaagcttattcacttatgtattatttacagctgcttttgcactacagtggtagcactgagtggttgtgacaatcacagaaaccacatggcccacaaagccaaaaatatttactatctgggcctttagagattctgctggccccttctccagagcctctgtccatagtcatctcttttttttttttttttttttttgagacagagttttgctcttgtcgcccaggctggagtacaatggtgcgatcttggctcactgcaaact

SEQ ID NO: 13150 - DNA, 1028 bp, Homo sapiens
ttaatgtggcccaacacaaatttgtaaactttcttaaaacattgagtaattttttgattttttttttcactcatcagctattgttaatgttagtgtgttttatatgtggcccaaaacagttcttccaatgtggcccagggaagccaaaagacaacctgttctagagcattaaaaaaaaattaagaaacaccgcatgttctcactcataagtgagagctgaacaatgagaacacatggacatagggaggggaacatcacacaccagggcctgtcagtgagtcgggggctaggggaggaataagattaggagaaatacctgatgtaggtgacgggttgatgggtgcagcaaaccaccgtggcacgtgtacacctatgtaacaaaactgcacgttctgcacatggaccccagaacttaaagtataataaaaaaaattaagagtgatatagtagagatgcttttgtgctcgtaaaatggaacaataaaaaaattccagtaaaactaatgactgtcatgccgaactgtctaatatacaatagaaaataatttagaaaatctggtacgttttgattgacattgctatgcctttagcttagatttgttggttttaaaggaaactataaactcagtttcagggatacatgttaagcaacttcagatttaaactgtttacaactgctagcttttgtgtatggttttcatttgacattataaatttccactctgcatgggaatcacctggaattcattccagatgggtgattctcaaagacactttcagttagttagaagtctaaaactgtctgacttctagtctctgctagagtgtgttctatttttttaagttctagtaagcattttcctgaagtaatagtagccaactctttatttctagtgactgagaatttcattcagaggcgatgggtgatttaatttttaggaatggaaagctttgctaatgaattaagttaaaatattttcacacagtggtccaattgaaatgtaaatataatacacataatatgtaaca

SEQ ID NO: 13151 - DNA, 1059 bp, Homo sapiens
atcaccttatagatttttggtggctatttcccctgcaagactgaattcatgaggacaatgaccaatgtttaattttctattttcagtatttatatagtcagtccttagtatatagtagactttcaataagagtttgctgcataaaaactattcttacaacaatcttgtaggataggtactatttttatagaaactgagactcagagagtccaagtgagttacgaaattcacacagcagcaattgcatgcatgccgaaggattctattcatagttatgactccaagttcaaggatttcttctaaaggcagccaatgctagaaatgtgcttcccgctgagactcagtgttgtttatagtttttaattgatttgtgactttgaaattaatggaaatattatttatatttttcccatttgaggtataattttttgacagttttattgagatgtaattcacatactatgcatttcactcatttattactttttaatatattcacagatatgtgcaacatcaccgtagtcaatttcaggccatttgtatcaactcaaaaagaaacttagtatccattaactaacccccacccccagctaccactccccaggtaaattcttaaggcgtaagggtaattcaaatatttgtgtgctgtaagtttaatgtccctttcacagcctttactagtaactgtttaagtgttgtcagcaggttaattattcctagttaaaaaacatttaaaggtaactttccaattaaataatttagaaggtgaaacttcaagactgagtgttgtcaatgtgtgtataatggttataatattttcatgccacttactcaggcataaagaagtaatattttttatgtttgaaataactcatctgaatttctatttcagttcctcatggcagaacacatagtcttggtgcattctgggtaaacacagtaattttgcaattaaacccagtaacattagttgtaactctacaggatagcattgggaagcagtgactgctggttgttgccatctgtccagtttgtcatctgtttaggtgcaacttgctc

SEQ ID NO: 13152 - DNA, 1023 bp, Homo sapiens
accaaattagtatacttcaagagaaaccgaatgcaataatgtgatttttttcagtaaattcttctgaagtacaatattgtgtcactgcttaatttcttaaatgtccagagttgtcagataggttttaacttatatggtacctcctggggagctgtgaggaaaatgattttcaggttggttcctggctttaaggaaacagtacaggaactgaatgattaatgcccattttgtgttgggggatgccttgtctggcctcattcctaacagtggtgccatatagattatattgtacacaccactttggataacatataaattttgatatgaatttaattttttttgagatgggggtctcactgtgttgtctaggctggtcttgaagtcctgggctcaagcaatcctcccatttcagcctctccagtagctgggactacaggcacacaccaccacgcctcactattaattctaatacgatcttgtagatgaactgtaatgaaacaatgagagctaggagaatgatttgaggaatgaataacttcaatattttgctaaatgaaatcataaacaaaatattgatcattttctttactcattacagaacccttgttaacccactgctctgggcagggcacaaatcctgtttgcttcatggcgttccttcatgctctcactgaactgtggtcttttgtgcaatagaccaccatggcaatgtgtttgtatctttcactgacacttttcacattatatcttttattacttatttatccttgttcctcattattttgttttcttatattaattaatttttaagttcataaaagttgtatatatttatggcatataacatgatgctttgaaatatgtatacattatggaatggctaaattgagctaactaacataagtattacttcatatatcatttatttgtggtgagaacacttaaaatctattgtcttaccaatttccaagtatacattacattgttattagcaatagttaccatgttgtataatagatgtct

SEQ ID NO: 13153 - DNA, 1087 bp, Homo sapiens
aaatgtaaaaactcaattgaagaaagagaaagaaacagtaactttctccccagacacccgatagtctcagattatgccacagtttctgggttttaattactattcaaagttcaagtacagttatcacaagaatggagatttttcccagtagctctgactccgaataaacaggaagtatagtatcagaaatctggcatgagaacctggtcttgtgaaacttctcatcctaagtacttgaaacttttcatgcttcttgctaaatcttcacaagtgtgcccataattctgtattacctaactagtttgaactctagaatattagttccaaaaccatatacagaacagatgaaagctagatattacaagactaaaagctgttgcaacaaaatcttcctgacaaatggagctgtcagtttgtgtgactacagggagaaacagagtgggactatgaagtgctaaagtattgtaggactgcatttgcctcttttagttactccaaatgcaaatcactcttgccctgggaaaagtggtatagttggaggacatagttacagtaaaacaaatttggactcatttttttctatgaacctcaagtttaaccacactaaaccctctttatcagagattccatgaaaggtcatattgttttatttctttattatggccatgaacttcctaattaaattcagaatcatagcaagagctccctagcttgtgaaagtctaaatttgctgacatcttaatgtcttaagtacccagccaactgttagtcttgcatcctatgaatggtttcgtgagttggagcttcttagtccttcccctacttctgactttgaatcagcaaaatgggcaacttttacattttatgttttggatggcaatccaggcacattgtaggggtcagtaattcttgctggctatgccattttagaagtatactgtctaaaactagtagttttagtagaagaacatattgtcaaggggaataggtgcactccctcttcctttacatgggattcaagggctcctgttctgacattagatgattcaggtgttgtgccccatgctagttgctttaatctgtgatc

SEQ ID NO: 13154 - DNA, 1038 bp, Homo sapiens
tagaaattaattccaactggtgattctatgctttcctgtaactaaaacattgaaaataagacttatctgaccacacaagcctaaagtaatacagaaatttcttagagttactagtgcactatagcttggccatgcagcaaagtttagtagaaatgattgatgtattgttttgtcacctcagagtcaacaataattgctgacatttataaagtatcttttattgcaaaatatggcaacataccagaatctctgggacacagctaaggcagtgtttagagggaagtttatagcactaaatgcccacatcaaaaagttagaaagatctaaaattgacaacctaaagtctcaactaaaagaactacagaagcaagagcaaaccaaccccaaaaccagtagaagacaggaaataaccaaaattagagctcaactgaaggagttgagctctaaaacaccatacaaaagatcaacaaattcaggagttgattatttgaaaaaaattaataagatagatggacttctagctagaatattgaagaaaacagagaaaatccaaataaacgcaattagaaatgacaaaaggggacattacaactgaccccacagaaatacaaatactcatcagagactactatgaacacctctatgcacacaaactagaacatctagaggaaattaataaattcctggacacatacatcctcccaagattgaaccaggaaaaagtgaattcttgaacagaccaataacaagctctgaaattgaatcagtaataaatagcctagaaaccaaaaagaagcctaggacaagacaaattaacagctgaattttaccagctgtacaaagagagctggtagtattcctacagatacaattataaaaaaattgaggagaagggactcctcccaaactcattctatgagttctgcatcattctaataccaaacctggctgagacaccacaacaacaaaaacaatagcaacaaaaacttcaggccaataaccttgatgaacatagatgtaaaaatcctcaacaaaata

SEQ ID NO: 13155 - DNA, 1013 bp, Homo sapiens
tataggtatgtgatttttattctttagcttgtgaagtgagggattacattaatttatttttgattgttgaactagccttgcatacctgggataaattccacttggttatagtatataattatttgtatgcattgttggatactatttgctaaaattctgctgaggacttttgcacctaagttcatgtgagatattggtctatagttttcttttcttgtaatgtctttggttttggtattatgataatgctgatcacatagaatgagttaggaagaaattcctctgcttctatcttctgaaaagagattatattttccttaaatgtttggtagattttagcagtgagcccatctagtcctactagtttctgtttagaaaggttattaattattgtttcaatttctttaatacatatagacttattcagattatctatttctttttgtgtgagttttggaagatcgtgtatttcaaggaattgctgcattttatctaagttataaattttgtgggcatagaattgttcataatatttttgttgactgtgagctaaagctttctttgttcatttcttgtatctaaagtactcttcaatgtcatccttggcctgagcttctttgccatagtccttaactactacagaactgcaaccaatcactttaaaaagttttctctctttgtcagttatgcagaggacaacccatattcttagtttcttgtcatcaactttaattatgttgattttgtgtttagcagaaaggacatccaccaacttgacatacataggctcactgcagttggatgcaagcatacaaagacgggcttagtgcttgtttaaggcttggcagctctgtgaattccatgtactgggctcctgtggatgaggatagtcttcagcactttttgcaaagcagtattaatgtccattatacctttagcagcaatgccttcatcgaccatggtggtgggttatggatgaagccaaatattgaatgcacctgagcctccacctc

SEQ ID NO: 13156 - DNA, 1022 bp, Homo sapiens
ttgattgatattggctgctttttcaagaaatgagatgtgttaaaaaatgaatcagctaatatatgagcagaagtgaagggggattgagagtccgtaaattcatggattgtttttgaattttatataaatgaaattatacaatgtgtattttgtgtctggcttcctttgttcagcattatgtttgagattcattcatcttgttctgtgtaactgcatttatttagttttactaaaatatattatttaattatatgaatatatctcaatgttttatccactctactgtcaatggatatttatgttgttttttagttttgactactgtaaataatgtcattgagaacctttttgtacatgtcccatctatgggacagttatctaggaatagaattactgggtcatagaatgtgtgcattgtcaatgccaatctattttccaaaatgtttgtatcagttcatacttccattggcattgtatgtaagttcttcttacttcacatctttgtcaacatttactcttatcagccttttaaatatttttccatttagtggatgtgtgatggcttagtttgaattttcttgattaataataaagttgaatacctcttcccatgtttattggccttgaattatgtctgctgtgaagtacctgctcaagacttttgttttctagagtcttcttgcattccttggcttgtggtctcacattattttggcctctgcttctgtcatcgtatctctgaaactgaccttcctgtgtccctcttataaagccccttgtaataacaacattggcccacctggataattcaggataatctacccatctcaagatgtttaacttaattacattggtgaagtttcttttgctatagaaggtagaatagtcacagattctggggatatgaacatctttggggggcactattcagctatatcctttgtggcttattcaccttgctatgtgctcaagaaagctagactcctgccaataatagtgaataaaattaaaagtccattgtc

SEQ ID NO: 13157 - DNA, 1049 bp, Homo sapiens
tgaaacaaatataatggaaacacaacataccaaaacttatgggatacagcaaaagcagttctcagagtaaagtttatagtgataagcaactacatcaaaaaagtagaaaaacttcataaataacctaacaatgcaccttaaagaaaacagtatggagattctttaaagaattaaagtagatctaccatttgatccagcaatcccactactggatatctacccagaggaaaataagtcattctatgaaaaagacgcttgcacatgcatgtttattgaagcacagttcgcaattgcagaaatatggaattagcccaaatgcccatcagtcaatgagtgaataaaataatgtggtatatatatcatggaatactactcagctataaaaagtaacaaaacaatgccattcgcagtaatctggatggagttggagaccattattctaagtgaagtaactcaggaatggaaaagcaaacattgtatgttcttataagtgggagctaagctatgaggagacaaaggtataagaatgatacaatggacttggggacttggagggaagagtgggagggggttaagggataaaagactacacactgggtgcaatgtacactgctcaggtgatgggggcaccaatatctcagtaatcactactaaagaacttatccatgtaatcaaacaccacctgttcccccaaaaactattgaaataaaaaaagaaaagtgaaaaataaaaacgaaataaaggtaaaattaggagaaaaaaaaactagaaaagcaagagcaaaccaaaccccaaattagtagaagaaaaaagaaatagaaatcagagcagaaataaatgaaactgaaaagaaaacattagaaacgattaatgaaacacaaagttggtttcttaaaaaagataaacaaaattgacaaggctttcgctagattaagaaagagagaagacccaaataaaatcagaaatgaaaaaggagacattacaactgataccacataaattgaaaggattgctagaggctactatgagcaatcatgggtgccaataaa

SEQ ID NO: 13158 - DNA, 1051 bp, Homo sapiens
aatatacataaatgggctaaattgagcaattaaaagatggccaattatcaggtaagatgaagtaaaaattaccgtcatatgctattatcaggaaacacacctaaaaaaattaaaaagttgatgtaaaaactggaaaaagattcttcaggaaaaaagaagattgaataattacattaatgtcaaaaaaaaaaaactttaaggttaaaaagactgacaagatatacagagcgatactacttagtgataaacattttaatttgccataactgcaacaattctaatcatgtgcacttaagaaaatatcttcaaagtgtataaattaaaaattaacagaaacatctagaaaaataaaaatctattgtagcgggggatttcaatatactatatctcaatgttgataggttatacaaacaaattttcacaaggatatagaattggcaaatacaattcaaaaacatttaataggcacatatagaatgaaaaaacaaattgtggcatatttacatagtcaaatattatacagcagtgaacgagacagaactaaggactatatgtaacaagatggtgacagtaagaactgtaagattaagtgaagaaaagacaagtaagaaaagaccacattgttatactattttataaagctctaaaacagacaaagctaaaaatattgcctagggatacatacatatgcgatggagttatattttttaaaaagtaatagattaaatggcatagcaactttggaaaacaggttagcattttcttatatagttaaacatatacttatcatattaaccaggaattccacctctaggaataagaaatgaaaacataagagtaatgaaaacgtatccagtacaaagacttgtattcaatactcatagcaactttattcataatagcccacaatggaaacaacccaaatcgtcatcaactggtaaacagacaaacaatttatggtatatccacacaatggaatgctactcagcaataaaaaggtactatggtacacacacaaacagggatgaatctcaagatcattacggtaagt

SEQ ID NO: 13159 - DNA, 1034 bp, Homo sapiens
ttgcattaaaagatgttttcatttttgatttgtttttattggcttgtctgtggacactcaccaacttaatatacagatagaaacttattttaatgagcatcagtatgacatctaggtatattgtaaggacatttccaagtctccgatttaaaagtgaattgaactccaagggtttagaagttctccaattgatgcagagttttaggaaaatgaatctcagattcttaactacatatacactgcaaaaatactttgtaaaatactgttgcctagtttgtaaactatgacattgccagttcgttagtttttaaacaaatggctatcctttatatgtttttatttttttccaccccccaaaaacattagtaaagaaagggtaaaaatgatacccattttcatcctttaatagtattttggagttgtggaatgagggcagccaagaaatctattcacatttctattactgaaaactggtaccatatgctgttcctgttataatgattcttatagtcagagatctgtagactgagtgaggagcctgggcatatacatgagaataatggtagctggtattgagacacttaagaacaatacaataatatggtggacaaatagagaagtttcagtgagaaatgttagcttgtaagtctcctctgctttgaaagattgttttctgttttcactcattgtaatttatgttaccttagggatcttattttttaaaagaagttttaaaaacctcttactgtgtcttaaagtgttttcttaaggtataaagtaaatttctgttttgattttttttattggaaagttcatacagattgaccctgggactaagtcattaagaaaaaaaaaatatatttattcatgatctttaaaatacttgccgttatatgagtcagttaacaaaatcactcatccctctccaaaatgttatttcacattttacttagcccactttaaatgatggtagaaaaatcacttcattattggcattttgacataatgaacttcatgcattttcattaatttgg

SEQ ID NO: 13160 - DNA, 1050 bp, Homo sapiens
ttaatgcaaccattgaaaattataagaatttaatgaatttttatgagaatttttatgaaaactaaaaaggtgctgatttttaaatgttttttaaaatgcaacattatatcacattatattctatatactcatattttactagtcttgattccaaaattgcaatttcatagaatctttatcatagttttcaaattttctatatgagcatgtggactgtcagtaaaatttgttgttttgaaaagtttctagttttttaaaacatgtttgaattttctgtttcataagaaacaatttttttcatccaaaattattagaaatatctataatgcaactttttggacatgacacttgaaaaagtagcttgatctgttagaaatggcacccaaatgtgacttcggagacttagggttcctgttgtaggtgcgtcattagttagctatgtgacatgatgcaaatccctcttttttattctgcaaaatggaagtagttaatacctgtccttcctctctgatcaagtgatttcgagtaaaaacattatttcctgaaattttctgttgaagttaaaagtgctaaacaggtacgttgtaacccaaatcaaaacgttttggttcagaatcttttgaaaagtttatagtcacagaaaaataattttcttaactacattaataaaaaatagcttaacacacaatcctgccctgtacttcactgatttatggcaagtcagccaatccatcagtgctcaaagctccttgtattgtcaggaatcactaacattatttgtcactcattcagaattaaactgccaactagtagcatttgttttgtgtctgatagattcttcatgcagaaagaataagtaaaatgagatgggacacaaatctgagtatagcattgtcattactttttgctgcacagattacttgcaagaaatattctagtctggggcataacagaatccacaaattccagatttaagaagtagatctatataagctttatttaatatttgttatattttttagttactcattgtgtgtcctttataatgca

SEQ ID NO: 13161 - DNA, 1171 bp, Homo sapiens
agcagtcatgaaaaattcaagtggagataataattaaagaagtagattaattccctaaagcagagaaggaactttaaaaaaaaaactgtaagaaatgggcaaatgggcatatagacaggaaagccgagaaagcatagtcaagtgaaccagcggtgtaattaaatagttctttgtaacctgtttcataaaatatgcaaatgcatgagacattctatatgttgctctgactatatatttttaccgtttatagatttcatgatcctttggctgcatggagaaaatgggacagggcctgctaagttcaacatacctcacagtgttacacttgattcagctggtcgggtacaaatacagcgtcattgtgtctgggactttgtgtctgaatatgtttgtgtgtgtgtgtgtgtgtgtgtgtgtgtgtgtgtgtgtctgggcatgtatatatagattgtggtatacatgtgtgtctgggcatgtggatacatgtgtgttagtgggtatgtctgggtaattactctggggctgggtgtgcacacatactttcttacaagtgtttgagtcctatagtgagggggttccccaaacatttagaaaggagcaaaatggatttcctgtaccatttaaaaggatagaaggcacaaataatggatctgaacataaagttacctgaaagaaaaagttgccctcttactgggaaaactccactaaaagtgtttgaatatcttttcacttctcaagaaaaaaatgtgctgatctaaagtggagtgggagaggttaaccttggaagtctgaaaaagagtcacctaggcaaactcttgttctcactaactccacattgtttagggaacagaaagctttagccaacaaatttcaatcagtttctctcttttctaccctactcactactatctcttttgcatttactcaatttctaagcatagatctcacttctttgaggttaccttttcacaacgaaaccgccaccaaaaaatttgtatattagtttctcctgctcttttcctatagcagcctgtacttcgtatcatagtaactatcatgctatattataatcatttgtctgtctcccctaatagatgtcaggctgttgaaagtgcttactgaatctcttttgctttatttctttgtgcctagtacacagtagtcatattta

SEQ ID NO: 13162 - DNA, 1034 bp, Homo sapiens
tttactcgttggtgtatttatttttatacattttatcatttgtagattcctgaatgcgccaccatagtcacgatatagtacacagttccatcaccacaaatagtgtcctgttggtgggtggacagtgtgagaaaagttgcagactaagcccatgtgggagatggttgactctgcaaagcagccagctctgtgaggaaaggcagtgttaaatttctttatcagaattaagcctgtgccttcaccataaaattagattgcattttataacagttcttttgaaagaaaagtttcctagaaaaacacattccctgttagagaccttgacattaatttttctctaagttaatgctgaacacaaaaacaagcattactttaattgaaaattgtgattaaaactaagaggataacagatcaataatcctgtatgcaaagcctttttaaacttttcctgttctcagttaaatctttttgttttaatttttagtgtaataggtattacagttgtttgcaactaatcgttgatttgattgtctctgtttctcctaaactgtgagctccttgagaaaaatgacaatttcttattctcctttttgtatttgcagtgcctgctattttacagattcaataaataatttttgagtaaatgaatatggaaagcaactataatgttaggaaaggaacataaaactgaaaaataagcattgtattggagcttgtaatatggggctctaaataatgtatataggagacaatattagaacattgtgcttctgttcatgtgttctcaaaactatttaagcaaggtttatgtttattattttagtaagcctgtggaagtgttttggcctgatatgcttttgggaagtgaaaatttatgacattctggtatcccaagagctatagatatgatgtgccaagtgaacgtttgtgtgaatgtattttaggaaaattgcaaggcagaaattatgataacaggtctctgggggctggcagggagttgttttttcattttaaaatatctttttaacaagaaa

SEQ ID NO: 13163 - DNA, 1035 bp, Homo sapiens
gcttgattttcctacttttactaagtccattgctttatcccttattactgctgcctctgctttagtcccaaatcccagcattgtttcttaggaggggtaaaagtttttactttttgattgaattttcaatgagctgaagttatctcttaaatatttttttcttgtttgaaagcaatgttgcttgaccgaatatctaaaggagctttaagtgctttttaagtacttggttgtctcagaaattgcgtgaatagtctgatatagccactagaaacaaccccaaccattttttatataacttgtttcttctagatataccttagatgaatttggaacagccagaagaagtacagttgttcgtggatttattgatgcgctcacaagagggggccccggaggtacacctagaccaattgaaatgcattctcatgaccctttgaggtatagtaatcagacagcagaagaggagttgatgtttttccaaaggaaatcttcattaacatttagttttcattaggtatgtaggagatatgttggcttggctccatcaagctactgcttctgaaaaggaacaccttgaagctctcttaaagcatgtaactacacaaggtgggtccaccaattgtattgctaatgcctaaatatagaaaataacacaagcatctctgtttctgttcttgttgccatcttcttcacttagataaacaccttgatggtacaataagcatcctgattactctttctcttctctagattctccctcattctgctaatagactttctcttccatcacctttgtcctgtcactcaactgttcagttttatagtgaaacctagtgacctttcatatcaaacctagactcctctgtgtcacttttaagaaatttctggaatatttagcatacattttctcaaatcctctgcatgacactttaaaggtacagggtgatattatcttaattttatctgtgtgtaaacaggctgagtgacttgttttaggtctttaagctactaattctttcatttctgctacccagc

SEQ ID NO: 13164 - DNA, 1110 bp, Homo sapiens
ttttctcccttccacaagcacataaattctctctccgcgccatgctgccagtgccagggattaggggaaggatggtgtaggcaattcaagactatctttcttatcctctttagtgcctctttccttaatatgatgttaaaaccaagtactatgattgctcacctaatttttggttcttaggaaggtgattttttgtgtggatagatttggcgttcctgcttgggggacgatctctggaggcttctatttgctcatctttctcctaattgtggaattttaaacacataaaacatacgacaacaaaagtgcaaaagatgcagtgggagggaagtggaagtttggtgttttaatattgtaaggatattaagttatccatgaaatatataatattgattggaggtagactgtaaaccttcccacaaccattgaaacaaataaagttatttagcataccaatagataagaacaaatagaatttttaaaaagtaattgtatcaaaagaaggtgaaaaaggagggtaaaagaacaaatgagacaagtatgaaacaagtagcaggaagatagacttaattgcagcctaataagtaactgtactaaatgtgaaagtactacagatttgaactaaaagacaaaattgttagactggatgaaaaagcatggtacaactatctgctatctataaaaagtccattttaaatataaaggtggagatagtttaaaaggatgacaaaagatataccatgcaagcactaatcctaaagctggagtagctatattactataagaaaaattagactacagacagataataataccagagataaaacgtgacattttataataggattaatacatgaagtaaatatagtagtatatctgtgcatttaatagcagagctgcaaataacatgaaatataagcttacaggattgatgaggagtagctgtatcaagaaatacagttagatatttctgcatagtcctctcagtaattgatacaaaaaaataggaaattaacatgatgcttcatagttgaacagtactaccaatctttacctaatagaaatatttaaaatactacacacaaactatagaaaatacacattgttttt

SEQ ID NO: 13165 - DNA, 1029 bp, Homo sapiens
cacactgaagtattaatagtgcatgtttttcagtgggggactatgggcaatattttcctcctttcctttaggtttttttgtggcgttttattttgtcatgtcacgatgtatcttggctttggctgttgtaacagaatactacagattgagtggcttaaacaaacatttctcacagttctatggtctgaaaagtctaatatcaaggttccagcagatctggtgtctgatgagggcttgttcttaatttgaacatagccgtcttctcactgtgtcctcatatggcagagagtgagcgagctctctggcctcttcttctaagggactaatcccatcacaatggccctatcctcatgacctcatctacacctgattactcccaaaggccccatctcctaacaccatcaccttggggggataaaattcagtccatagcgctgtgtgtaatcaaaagaatatggttgttgcagtcaggaagacctgggttcacatcctagcactgccacttagtagctgtgtgactggccacattatgtcatctctaagtgtcacttcccatagggaactggggtgctgctgtctgcttcatagggttgtgggatccttagatgaaacagcacatgcaagtttccttcctttcatcattttttttttttttttgagacggagtctcactctgttgcccaggctagagtacagtggcacaatctcaggtcactgcaagctctgcctcctgggttcacgccattctcctgcctcagcctcctgagtagctgggactacaggcacccaccactacgcccggctaatttttttttttttttgtatttttagtagagacagggtttcaccatgttagccaggatggtctcgatctcctgacttcgtgatccgcccgcctcggcctcccagagtgctgggattacagttgtgagccacggcgcccggccctttcatcatttttttagacatggaggtctctctttgtttcccaagctggaatgcagtggctgttcacagatgcagtcatag

SEQ ID NO: 13166 - DNA, 1050 bp, Homo sapiens
tgtatactgagtgcaagcaggctatcaattttaataatagtccataccatgtatgtgtttctgtcagcagaatgtacatgttgtacaaaacctccaggttccttaagctttttgctgtccatgaatcctctgtggcaactgtaatcacagagccagaagccagagggccagggatatgagaggctgacaaacatcaggggacatctggggaggagatccctgtcatgtctcttgtgccatggagctattatggctggtcttccatttgctttttctttaagtgaaaaccatttttctactttgcttttctctccatacttaaatggtcagtagctactgagtggtgctttatctgaataggcctggatcgaagtaaaatagaaatgggactggctttccacaggaagtaaactgcttcagagcccacagtcccctgctcagtgtccggaaagaagtcagtcatccctgttggcagtaaatcttcccacaggccgtccattagagatttaactagatatgttcaatagaaagagtctgaggcaagtggaaatgaggaacggaaacttaggttgggagaatattttttttttattcattctgtttgcttaattcagagtacagtttgtgctatttcatatctgtactccaggcagaaatataacttgaaaatactgtgtctaaagaaatttcagtgttctatcattaaattatttacttaatatttgagtctgatgaatttcattgaagttctttacatccatgttgggaaacaactgtcaggaatgttaaagagttatgtatagtagtgtttcaaggcagtggttttattgcaacaagcattgttttctgtcagcaagacacctcatgtaaaataatttcaccataggtaaggtgacaaaaatatttctatgctctgaagttatggaacttggctcactagaattactttctccctccacctctttccctctattttaaaaaatagttaaactgtctgcttttaagttttggatgattccattccaagttactaaattctacttaagaaaa

SEQ ID NO: 13167 - DNA, 1041 bp, Homo sapiens
attgttgaattgtatcagttctttacatattctagacacatgtcccttatcagatatatgatttgcaaatattttctcccggtgtgtgagttgtttttttacttttttttcactcacattatgtatgttgatgttatgatttgaagcacaaaagtttcattttggttaagtctaatttcttttgttgaactactgattgttttttaagaaataaatgccctgtacatcaagctgtatacagagtgtactctgaaataggtcgaattaaaagaagtcctgattatggagattttcagtgagctgttaggtcaactcgtggttaattctctgggaatgagcctttttgggcttcaaatctgttcttttctctccagtggctgctaagctctactttccacaactactataaatgtgaagctattgagtttcaaggcttccatggaactggggagaggtgtataggattagagcaagttaaaacactataggctttccgttcttactgagattcagctgtttttcttaggtaaacattccttggaatgtggcaagcttttgttaatttccacaattctaataagtttatgtcaacagcttttgctaatgtcctcattgcttttatggaggagcagattctcggtgtgacattactgtaccatttggaatgtctactgatatacacgataacttggataaatctcaagagaattatgctgagtgaaaacatgatctcaaaagattaaatacagtatgattccatttatataacttttttttctttgagatagggtcttgctctgtcgcccaggctgcagtgcagcagcacagtcatagctcactgtaacctcaaactcctgggctcaagtgatccttctgtctcgacctcccgagtagctagaattacagccaccacacctggctaattaaaaaatttttttgtagagatgtggtcttgctatgttgcccaggctggtttgaaactcctgaccacacatgatcctgctgcctcaaccttccaaagcactgggattacaggcataa

SEQ ID NO: 13168 - DNA, 1044 bp, Homo sapiens
ttaaaacagtggaatcctgattttttctttttttttttttttttttttactttctgtgagcttatgaggccattctgcacattatcaaaatgaaatcattatgcagtaaccttatatatataaatccaattttttcctttgtagaagaaaaccaaaataattttacaaactacatttaacttagaatataaagaactgactagtgtaaaattttgaaaatctaccactttattttgaaggaaagtacacatccttcaaaaccccgctaacaattcctagttcagttttctattatacaaatcaaaaagttaaattccttgtggcactaaccaaaacttaaaaattaacagaagactgaattaattaaaaaaaaagcatactaactaatcaaaacaatccactgtgcaatgaatatttgaacaatgaaaaaaacctaccaagcatcctaatcaattatatagttcttgcttccatattttaattctggactttcaggatggtaaattattaaacaggtcgatttcatggactgtctaaaccttgtagtatttcaaaatattaccctttctaaaccaaatctgtggtcctaatcaactttttttccaagaaaaagaaacgatatgtgtttaaaatacattccgtagcagtagaaacatcttagtgtctcaaaatactatttacaaagaaccctgctgatcctgtgcatttcgctgaggtgctacttgcacccagacttcatcatctgaaaaagaacttgaacttcctgactcagagtccagctcactgaatccatctaagtcccattcagtactagactcactccgtgcatcatcttcctcagtaataaaactctgaccaggttcaaggcaggaaggataaacacgagcacaaaggcaaataaagccagagtcaaactgcaaaaggcctaacatggtacctatattaatccactgatcttccctagtatcatactcatacactgtcactcggttctttttccattgtggggttgtagaagtgatgagaagcaacttttggtcatga

SEQ ID NO: 13169 - DNA, 1048 bp, Homo sapiens
tttcactaccacaagaatagtatggaggaaactgccccatgattcaattatctcccaccgggtacctcctataacacgtgggaattatgggagctacaattcaagatgagatttgggtgaggacacagccaaaccacatcagcatattcctacagtgtaaaagtactcagaagtaagaaagaaacaacctctgatatataataatgtgaatggttctcaaaaattttatgttgagcaaaagaagccagatacacaagagtagacactgtatgaccatttgtgtgaagttccagaacactgaaaataagctttgatgaataaaaatcataatagaggcttcctctcttgtgtaaggggtagtggggaggtggcaaattgctagactgactagaaaggaacatgaggaaatgtctagggctgatgcaaatgttttcttctagaccgggctggtggttacatgggtgaatgcaattgctaaactcaataaactgtactcttcacatctgtgcattttgcgtactgtaattatcctctcaggaacagccacttcataattgttggctttaaataaaattgcagaattctttaccaggaagtcattatgaagatagttcagtcataaagcaaggttcttctcctctagaggtgtttgggtcaacattggtccaattcatacaaattatatcaacagatgtggtcttccatacccctggaacttgagtgcctctgggtaatcttcaaggatttcagcatgctggagtctttcagatttgtaaagtatctgagtgcctaacattatattcaaatattttccatttttgccacaaccatattaaaaacatactccttattatctgtggtccctcaagttttcttgtaatttacataattctctacaatagaatccacatttttcctggcacgaagataaagctgtttttgtttggtcattatgtctcactcatcaacaaaacatggttttaattcttcagaaatctttaacttcaactctcttcatgaatgttttcaacagcggcatctactgggg

SEQ ID NO: 13170 - DNA, 1094 bp, Homo sapiens
tctaaggccaggggaaatttccagtgtaactggaatatagagcaggagataaggctgatgtcaagaaatctgcacaaggacattgagaaacaataaaaatgtgaaacaatacattatatggtagtctgtgcttattagctcgataaataaaagtaagaaagttacctaacagaagaagtcataatgagaataccaggtgatctcacagaatccaaggataggaatgtggaatgtgcagggtcacgactaccacccgtggaatgagactgagccttgggaataaataaatgtagggactcatatcatcagggttctttctgtctatttctcatttttgcttttctctgtgtatcaatttcattctcttctcactgaagatgctttctcttggtggctgaaaatgtggcctctaacctcttacatgctttatatattgcagtttcagccaccaagagagagaataatcctctccatctctgatcttaaaatcctgggaagaaactcactggctaggacttatttgggtgtccactccaaacaaatccacttttgtcctgggtcaggatcacgatcatgtaagaatgcagcagctctgtcagaaactgtggatgtggtacgaagggcaagttctagaataagggaggaaagctaggcaaaaagttccaaaaacgctcacattctttcctatctaccccttccatttgtccaacagctgttgccctggggttaagatccttatcacttttccagcttcatctatgatttggttcctaagttattcactcttttttttttttttttctgagacagagtcttgctctgtcgcccaggctggagtgcggtggtgcgatcttggctcactacaagttccacctcccgggttcatgccattctcctgcctcaacctccccagtagctgggactacaggtgcccaccaccatgcccggctaatttttttttgtatttttagtagagatggggtttcaccgtgttagccaggatggtctcgattcctgacctcgtgatctgcccacctcggcctcccaaagtgcggggattacaggcgtgagccaccgtgcccagccaattattc

SEQ ID NO: 13171 - DNA, 1044 bp, Homo sapiens
agttaaaaattgtaatcaatatatagaattctgtatataaagagtacatatatatacacaaaatgtatttttgatagaaaaaaattataagaaagtcacaaagtggctgggcactgtggcttatacctgtaatcccagcactttgggaggccaaggcaggcagatcacgaggtcaagagattgagaccatcctggccaacatggtgaaaccccgtctctactaaaaatacaaaaattagctgggcgtggtggtacgtgcctgtaattccagctactagggaggctgaggcaggagaattgcttgaacccaggaggcagaggttgcagtaagccaagattgtgccactgccctccagcctggcaacagagtgagactccatctcaaaaaaaaaaaaaaaagaaagaaagaaagaaacggataaagttgtgttctttattatgaaaaaaattttttgtctattttggaggttaattaaacattgtttcaaaatatagaacagataggaaagaaccggtaagtaggagagtgatatgtgaagaaagtatagatatgaaaacgtatttttggtaagaaaggttaaaaagaaaagataataatgttatatgagaaaaaactttatatggtaaatttgtgtcctaaggtaaaatttaagagagcaaaagtataggataaagcagaaatttcaagcatattgtctatggtacatattgtcagagtacgttgtgataaggtttgtgaaaagaaaatttatgaaaggaaatttgcatgtgatcaggttggctataattaaaggaaattacttataagtctttctaaagattgagctttgatattaaattatactaatacaaaactaaaattttggttccctatgttagaataaagcaagtttttcatcaactatcaatttgcttttagtaaaattcagaggttctgaatttttaattctgaaatctgtatcttttaaaacttctcagacttatatctcggaagttcaacttttactgtaccttgctgcatgtgatttgcaggtcacatgtgat

SEQ ID NO: 13172 - DNA, 1050 bp, Homo sapiens
gcccggtatggtagtttacacctgcagtcccagctatccaggatgttgaggcaggaggatcccttgaacctaagagttgaggctgcagtgagccatgattatgctactgcactccagcctgggcaagagagcaagactttttctcaaaaaacaaaacaaaaaaaactggtttttaaaacattcttaattcattaattatttaaaaattagagacaaggtcttgctatgttaccaaggctagtcttgaactcctaggctccagtgatcttcccacctcaccctcccaaagttctgggattacaggcatgagccactacgcctggccataactgtttaactggaatatctatgtgcagctgctgtactagattatttgtgggtttgatatttacaaatttgataaactaataaggcttttataatggaaacctaaacataaaagtagcttttaaaaattattggttagtaaatattttaaaaacgtgagaagggttgccataaatcagtctttctgtagttgagacctcttcagatttgcatcttcaactctctcctggacatctccatgtgcttagtccacttcgtatcctagaatcagtatgtccaacatggaattctcttacttacttatgagaaggaggccactaggttctaacagttttctttaaatacattatttatatacttcttacttttgccctctactgccatataagccctcataccccatgcctagatttttgcagccactttaagggctctgctgaacttactataataataatggcaccactcttcaaagcgtgtatttttttcttcagctgtgtttagcagcttagatgtggttggagttaaaatcagttatctttaggaatgaggcatagaaattaagaatattggcaaaacaatggctgctaaagtggattgtgaagtaaattaagttaaaagagagctaggcttggtattacgtgtcttagtcctggctacttgagaggctgatgtagaaggattgcttgagcccaggagtttagtccagcctgggcaacatag

SEQ ID NO: 13173 - DNA, 1030 bp, Homo sapiens
ttggcattatcaaaagcagtaagatcttcctcaagaaacatgatgcatcttgagaatgcaaggtgaaagttttgaaaaagcctttccactttttaggtaaaagggcttcatacctacagaacaataaggaaattttctaacacctgaaaatattaagcactctaaaaataatgaagggataaagctgcttttcaaaataatcagttcatcatgttccattatgcactggctgaagggtagagagagggaaggaaataatccagagtattaaacatagaatactaattatattttgctccattatttagaacggatttccagtgaataagaaacagtctattcttgctgtttacactgattattttaggaattcatgtaaatatggacatcatgttttggggacatcatgctaatgtatctagatgagaattattcaggtaacctgttttgtgagcagtaatactaaacaggcacataataattgatggaaaaaatgagatggataaataataagtaatctggggatatggtatgtgactgagcagttgggtagctgtgtaggcttcttgtttaggtgatgtattcacacagttgcaaattaggtaaaaagagtttataagtgaagtctttttcttgtctgtcccctggcaactaagtttactttcctgaagacatccattgtgatcagctgatggtgtattcttctacaaatacattgtgcatgtgtgagccaaaatatgtgtgggagatttgtttaaggtcaccccccccactgtgctttttgcaaaagtgcagtaacatggattgatggattgctgcgcacctgggttttcttttcacttaacctcgtatttggagattagtcctggatcagcacttcaagagcttccccattctttttcatacctgcacaatctaatcaaatttgtcaatatgatctgaatagactgagaaagttgaccaaggaggagttcagagtggcttctgccatgaagataaaaggcttgtttcctcagcgggtgattgcaag

SEQ ID NO: 13174 - DNA, 1035 bp, Homo sapiens
gcccatggctcagtctaatgtctaacataaatttactttacttttattgttggtctcactcactgagatgttaagttctatttaaaaaaaaattttttttttttaaattttaatcactgctatatcctcaatacctagaacagtacctggcatgtagtaagtgcttgacacattattgtggaatgaatgaatgaatgaatgagtgttgaagtaaatgacaagttgatttgggaaaacatttgtaaacaccagcttagtgtttaaaaagatcttttggctatcacttgaatatagtgctggtagtctgctgcagagtgctttatgcatatctgcagggttttgagctgtagactgagtgtgctagtcagtgagagattaggaaagatatttgatattgtgctaaattcagaatggatagttgataacttttacttaaaactatgactttttgggtttataaattggataggagcataattgcttctgagggagctttatttttatttagaaaatcattttaagaattgtttgcgtgaaccaaagaataacaaagtacgcttttgtttctaggtgaaagatttagagaactaatggataagttcctgagggttaacttcagtaaaggctgcccacccttgtttactactttgaaatctttatattacaatacagaaaaggtaaaatttggtatttattcagatttgctatagtcttttttactaaactgtagaaagatgtccatgtaaataatgtgctattacttaatcattttctttgtttcagtaatgttaccttactttcagtcatgtactgaaattacatgcctgtagtataagtaatatcaaagtaaagggtttatgaaagcactaagattataaaggttgtttatttttaataggtatacttttttttagtaggattttaaatttgacattgttaccaaaggtatatatttattttgtgattattattttatggtacagttatggatttttaaattagttatgcatgcttttaaagttagagcttggataa

SEQ ID NO: 13175 - DNA, 1033 bp, Homo sapiens
atgttaaaaaaaacaaaaaaacccaaaaaacccttacaattccttaatgtctgttgtatggtctatttgactgcagtgtttctgttgtcagttttttgagagatagtgattgatttctgtgtaaacatgtacccggtgcctgccaataatttctctagattatttaacattgggtaaaattcttttgttctttttggtgagggtgacagagaagaaaggttagatgaaatgccagaaataaaaagaaatcttatgtatgtgaattagagtacttcttttataacagtattgcagcagctactgactacagtggacattaaaggatttgtttctcttaagctatcacggggctttcacagggtgttgttcataggcataggctttttactttttaaaaattcttctaatattgatccaaagttgccattacaaaaatgctaaactttttttttggtattttatataaagcatgaaaattatgtttttgaataaggcactgagaatacactaattcatacaggaaccatctctttagtgttaattttaaagcaagcaacaggaatgctatattattagaaatgccagaacaccaagtgtgtttgcaaaatgaattaaactgcagaaaattgagctccagttatctgaatttagtatagtgagaaaaaatttgcaagtctaagaactgtttctcaaataattttggccacatgtatctgtgatttactcatgagaccattttatttattttattttttaatatttatttttcaattaaattttgtaagttttgtgtttgactttttttgtagtttcaaaaaaattatttcaatagattttggggagtaggtggtgtttggttacacagataagttctttagtggtgatttctgagatttttggtacacccatcgcctgagcagtgtgcactgcaccccaggaagccattttaaaaactgcacatttctaagcagcagtaagacctgtttttagtagttagctggatttttaactttcgaggaaggatttcaaggag

SEQ ID NO: 13176 - DNA, 2017 bp, Homo sapiens
gagatataattaatatatcataaaatttacctattaaaagtatacagttcaatgtatattcacagagttgtgcaatcatcactgcaatgtaatgttttgtcatcccccaaagagactccatatcctttagctgtaattctctcacaaccttcacgtccctctcagctataggcaaccattagcctactttctgtctatggatttcccagtctggaccttttatataaatggacttatctaatatatagtctttttgggtctggcttcttttacttaatatttttatccgcaattgtagcatgaatcagtacttcattcccttttatgaccatgtaacattccattttatggatataccacattgattgtttctaccttttggttattttgaataatgctgctgtgaactttggtgtacaagtttttgtgtagacatgcttccatttctcttaggtgtgtatctgggaatggaattgctgagtcaaatggtaactctatgtttaaacttttaaggaactgtcagactctttttccaaagttcctccaccattttacattctcacaagcagtatatgagggttctgatttctgcacatcctcattaacacttgttattattgatgatagccatcatagtgggtgtgaaatggtaatttcttgaggttttgctttgcatttcctgattaccgttggtattatcttttatgtgcttattggcctttgtatatgttctttggggaaatgtcattaattttctttgcccatttttagattgggttatttctctttttattgttcagtttaaggaagttttgtttttgtggggtttttttaggttttttcgttgtttgtgtttttgaggcaaggtctcactcttgtcacccaggctggagtacagtggtgcgatctcacctcactgcaaccttgacctcctgggctcaggtgatcctcccacctccacttcctgagtatctgggactacaggcatgcgctaccgtgcctggctcattttttatagagacagggtttcaccatttgcccaggctggtcttaaattcctggactcaagcaatctgttcgcctcacccttccaaagtgttgggattacaggcgtgagccagcacgccgggccagaagttttaaaaatatattctagatacaagtctctcatcagatacattatgtgaaaatattttctgttctgctacgggttgtcttttcattttcttaatggtgtcatttgatgcactaaaaatttttaatttggatgaagtccagcttatcttttttttccttttgttactcatgctttctggtcttatctaaaaaccatttccaagtccaacgtcatgaagatttataaacatgtttacttgtaagagtttgcattgaggcattcactctgagttcattttgtatatggtgtggtaggagtccagattcattcttttgtgtgtgactatccagttttccagcaccattcgttgaagagactcttctttccctgttgaacgatcttggcagccttgtctaaaaaagattaaccataaatgcgagggttcacctctggactctcaagtctgttccactgatgtgtatgactgtctttattgttttctattattcttttatgagattgttattcaggtgcagccacaataggagacactggagaggctcaggaaaaaacacagtttatcacacaggtcctagagacgaggcatgctgtgccatgccatgctgggccacttggggaagacgctagggtggttaggagggaggggaaggattaggctactgccttcatcgaggtttccttagggtagggcagggcgaacagtttagtttgaataattttggcatactttagactggcggggtggtctcgttgcctggcacctggctctgggatgattaggtagaggagtagtgcctcttggggtataagggccagatagaggagatatggctctggattttgaatagcttgcatattaaagacatactcctagctggg

SEQ ID NO: 13177 - DNA, 1051 bp, Homo sapiens
tagtttgtgagtgtcaggctcttaagtgaagacgttcaatgagtcaacatccaggtttgcctaggctggtacactttgattccattgaagttggacatcagtgctcgtgtgctttgaatatgaatatttgtattttcataaagttggggaaaataatacgtaaagcattggtgtgtgttttaattaaataataaagtttgtaaagtacttggtttgaatatgttcaagaaatggtaattttcccttactctctaaattagatggtaagtcccacccttctcacacctcatctctgtagttacttttattttattgtcattgttcttggacagtttacctctgtaactagccccttcagcaccaaaattatcactagtaattgtgcttatatcagaacctaattcagcaattttggtccttgctggtaaagtagtgtacttaatttagtaactttcatattgcagtgacattttaaacctgtgatttgtctcttcattgcgaaaaaaatgtgtatcggttatgatgttgtgggactttgtctttaaggttaatgaagagttcttttaactcttacataagaaaagctggtcaccaaggacatactttaggaaattataacagttatggtattatcttaggttagattttattaacaaagataaaaagcttcttccatcttgatctaatgtagctgttagaagaaagtaaaccaggagaaggtggctgaacttggaaaatttttcacattgtaagaaaaatgtggggccataaaatttaaggtggccatttatgtttttgttgcgatctcagatacttaagtggattggctttcttgactttaaaataatggaggcaaaacaccattttaaagaagaatagctattacatattaatttgtcatattacacactacctaattaaatataaatggtaagtaaacttgagcgaaataagtcttatacttgagtaaaacttcttagattaactttcatagaaaatttagaaaattgttcacttaattactgaatgagaagtaaccataaggccaggg

SEQ ID NO: 13178 - DNA, 1100 bp, Homo sapiens
aagtcatcgcagtgccatgtcacacaaaacctcataacataatatctgatacccagtccgcattcacatttcccccattatccaaaagaagtctttgtgtttggtttatttgagtatagatccagttaaggttcacaccaaataattggttgttatatctccataagttgatggttatgtctcattattttaatctagaacaataactctcccctccctttcaaaaaaacagtcatttgttgaaaggtcatttgtcttacatatcccatattctagatttggttgattgcctttctcatggtatcatttgctgtatttcactgtcattcatacttgtaagttatagttaggtttacttgctggattagattcaggttctgtttaaatacgggtggtgctttgtgcttcctgttgtgtcatgtcaggaagcttgagacattctggttttctctcttttttgatgttaagattgataaagattcagatgttgtcagcctgttatactcattaaaaaggtccatgacggcgtgggggcacggtggctccacacctgtgatcccaacacttttggggatgctgaggcagaaagatctcttgaagccaggatttggaggccagcctgggcaacaaagtgagaccctgtccctacaaaaaattaaaatattagccacgttcggtggttctcacctgtagtcccagctacttgtgaagctgaggcatgaggatcactggagcctaggagttccaggctacagttagttatgatcatgccactgcactccagtgttggtgatagaacaagacaaaaattcctcattggcctctcagcaattgaagatcattgcctagatcccttgttgattctaataatttctgcattcgttagctggaatttttcttataaagaactttccttcatcaaatacttggttcccttgaaatatagtttatataagaggaacagagtagaagcttaactcattgcctttattttattatttgtgttttaatgtgtgctatagtatgtttgcatgtcatttgatcagctatgctaggaaacctgtttgttttgatgtagtgtgggtatattcactctttcc

SEQ ID NO: 13179 - DNA, 1030 bp, Homo sapiens
tagaaatgtgtttcgtataaatagggtgactaggttgatggaatgattaatgcttcttaatttttaatatctaaattttctaatctaaaattcttaatgatatcattggaaggatttaggagtaattacaagcttcagatttattataataggtatctacatgagttaccttatgcctgtgtcttaaatattttaataaggacacggacacctctcagaaataaaactttgcagtttaccttctaaatagaaggttagtgaattgcgaaataagttcaaataagggttaggtctttattctgctttgaagaagtcattcaagagttcttttgttgaaggcagtttcagtcaggatacatactgctttgagctcttagtaattggatttgaaaaattagaattctagaataagctagtgtagtatcttttctgttttcatcccccccccataagattttagggtttatattttaaggttttgtagtccaacccaatctgatgtttgaaacttgacttttattaaaacaaacagaacaaccttcttcaaaatattagatttaaacttgtgttcagaataacattttaatctattttatctttcaagaattgagttttctttctttccatttttttcttttactattagactgctggtgattggattatcattattttagaatactgacttagatatgaaacagggcaacgatacatatatttctaactctttgataagacctaggacttctgatagatacaaactataggaagatcataactttatcttctattgtatcttaatctttatcaaattgataacatgctttataacaacagattctctattaagtaaattgagttgctaattttcctagttgacctagttattattttttaaatccagaggtttttgttgcctttctctgtataagctcttactagtcacatccgggaactctgagaggtagtgggaaggagaatctggtctagaagagagggcctaataaggagttccttaaaaaaataaaaa

SEQ ID NO: 13180 - DNA, 1049 bp, Homo sapiens
cccaacatgaagataaggatgatgatccacttccacttaatgagtagcaaatatattttctcttccttatgactttcttagtattttattttctatagcttactttattataagaatacagtatacaatacatgtaacatacacaatatgtgttaatcagctgttcatgttattggtaaggcttccagtcaacagtaggctattagtagtgaagttgggagagtcagaagttacacatagattttcaactgcactgggggtgggtcagctcccctaatgctcatgttgttcatgggtcaactgtattataagcattttaaattttattaccatctccttactatttgatgccattttttttgtctccttactttaaatgtttatagcagataggggattgtcattacatgatgtaccatctctttaagtctgtggaataactttatgtatttttttgtttttaataaaatgatcttgattttgtaaccagaaaaaaagctatttctgttttgaaaagtattgattgtgtactttgaatttatttacagatgatttttaaatgttttcttgttatttggttttataaagaaagctgtctaaattactttagacatatgttaatataaaattttaggggaaatttgacttgttctgatgttttttaaataattttcctttctgtttcaaaataggtagaaaatccattagaggaagccgttaagttccttatacctcttaagaaccttgttgctgataacattgacactcatctgttagcatttgaaatatattttagaaaaggtaataaatagtttgagttcagtttttaatctttaattatatttgtgaccatattcagtgtaatctttgtcagatctatttttgtttcttagattttcattttagccttctacaaaggctcttttccttggctactcgaaacttaggtgggtaataaattagaatagtactatcaaatccagtgtaagaatagtttgaacaaccatacaaattgtctacctgaagcaatttttatgatttttcaagct

SEQ ID NO: 13181 - DNA, 1031 bp, Homo sapiens
tcgaaagaaaactgagagatggctctaaattgaattgaatcatgtcaaacaacaaatttgttgggagtaccactgtattttataggtttcatgcgctcgttgtaatagctaagattatatgcttatggagactacaagtaaatttaaaaagcacattatttgtgattttctatctgactttctaataaaaacatttagcacatacattttgccatgagagatcatttttgactatgaaatcaaatattgcttgaatttcaaaagtgtattgaatgtcagaaattcagcattttacaatttctcctatgttagagtgcatgtaagttcatcaacattttcatatatgaacacttgagatcagggtataagattctgagaccagtgagcttcaacctcataccccgcctcctgcaactggactgttcatgtatgtcacagacttcattatttacgtcttttatcacatatactgattcttggggaagaaagtgagagcaatagggggaatttatagaatgagaactactaaatttaacgttggttcccagtcttcaattatgattcagatgagaattaaggaaggatctttagaaaaagacaaatactttctgtgtctccgcacaggtgtgtaagatgggagcacctggaggagaggtaggccctaagattagctcaaagccatcttttttttttttttttttttttttttttttgagatggagtttcactcttgttgcccaggctggagtgcaatggtgtgatctcggctcactgcagcctccacctcccaggttcaagcgattctcctgcccctgcctcagcctcccgagtagctgggattacaggcatgcgccaccacacccagctaattttttatttttagtaaagatggggtttctccatgttggtcaggctggtctcgaactcccgacctcaggtgatctgcccaccttggcttcccaaagtgctaggattacaggggtgagccacggcctcagccccagtcatttttaagacagcacaagcagttc

SEQ ID NO: 13182 - DNA, 1041 bp, Homo sapiens
cttaaacgatatttgttgaatgaaaaagggaatggttctagttttgagaaattcttttatatattttagctgttatgataatgttcatccttctctttgctatctatttggtaagaggaatgaaattttagagcagtgtcctgctcgatataccctcaagattttagagcagggtatgcagtgtattaattctttgttttctttgccatttattaaaatagtgtgtattttgtgcaggagatcaacaattagtagaatgcagtcctttcttatagtgggggagacagctatatgtacagatatacagatggtctttgacttttgatggtttgacttaagatttttcaaatttacggtggcaaaagcaatacatatttagtggaaaacatactttgaatgcccatacaactattctgtttttcactttcagtacagtactcgataaattatatgagatatccaacactgtattataaaataggcttcatgttagatgattttgtccaactgtagacaaaatgtgagtgttctgagcacatgtaaagtaggcaaagctaagccgtgatatttggcaggttaggcgtattaaatgcattttcagcttatgatatttttagctttctatgggtttaagaggatgtaatgccattgtaagttgaggagcatctgtatatggtatacaaccatgcatgcaaatatatatggtaatggatacatgctgtcacagaaacaaacatagcgggcactcttgagcagatatggaaggcttccagagagggtcacattgagctgagtattgaaatgtggttaatgacagtcgtgcaccaggaaaaggatagcattctagcatgactgaactgcacaatggctttggcatttcctcctagtactctgctatgaagcgtccactgaattcatggaacttagttctcatagaaattatcttgatgtttttgttagactgtctacaacaggaaagatgaactagaaaatttactgagttgtttatactcttattatgatcaaataagtgtttttgaa

SEQ ID NO: 13183 - DNA, 1064 bp, Homo sapiens
taggagaagagagagagacagaaaaagcatttgaggaagtaatggccacaatttccctaaatttgatgaaaattataaattcacaaaatccaagaagctccatcagcttcaatcagaagaatcatgaacaaaacaacctgatagcacatcagaatcaacttgcaggaaaccaggagtaaggagaaaatcctaaaagcagccagaggaacaaagacagattttatgtagaacaaagattaaaaattaatagcagatttctcaacagaaactatgacagatagaagacaatagagcgacagttttaaatggctaaaagaaaaaaccatcaacctagaattatatgctcagtgaaaaatatctttcaaaagtgaaggcaaaataaataattttggacaaacaaaaactgtgagaatttatcaccaggagaccttcactggaagaaattttaaaggaagctatctaggccaaataaaaatagtaccagatgaaaatttgcaagttcagagaggaatgaagagcactagaaataattagaatatgggtaaatacaaaagacattttctgattattttccaaattagaggataatcaactttttaaagtaaaactaataatgttttctggggcttataaacttgtgaaatagcagtagaacaaaggaggggagtttgaggaaatggatgtttaccattgtaagagtctcatactgtaaccgaagagaaaatattatttgagtgcacattgtgataaattaaagatggatatagtaaaccttagagaaaccactttaaaaaatagaaacactaaaaaaaagagcatgagtaataagccaaaaatgttgataaattgaatcctagaaaatactgagttaatccaaaagaaggcaagaaaaaagaaagaagagatgagaccaatattaaacagcaaaattgtagatttaaacctaattatattgataatcacattaattgtaagttttctaaacacttccttttgaatgccttgttgggctggataaatcaatacaatccaattatttgctctacaagaatctcactttaaat

SEQ ID NO: 13184 - DNA, 1050 bp, Homo sapiens
cgcctgtgtccgtcactgtttaatcaaactagtcattttgttggtaacccctgttatcagcattttttaactcttttctctcaactttgttagatccccaaataagactcatccagtggaaagttgtagccccagatgccggcaactgggagcccaataaacaggaaatccagggaactctgaatatttaatatgtaaaatttgtgtaaccctcctgttttcaataatatattcttgccctcagttatttttgggtcttctattccagacattctctgctggaccctctccagaataaacctccagccttattcctgggtgggggaggcagttgcagctttccagaggtgaagaaatagggagtgaggtgcagggggtgtgtaaggggaggaaggagcacttagtgattctaaaatacattttcacccaatccttgttagcttcatcttatcctggcatccagaggtacatggtactgccagtttttgagacatttgaggattgtttgttcaagtgagttgattttcaaccctatatctgtcttctggttgtgctaagtcaattctcagccatccatctgctttatatcttacaaaatcttccagttcttgtcttctctcccattttgttttccttatagttttacacatttttagaagtctcttttttattgggaatgagtagagctaaaagcctacactcattaaggtgtttttaattaggaatttgagaaattaaaactttacacaggtgaaaaaataattaatattataaattgaaaattaggccagggcacggtgcctcatgcctgtaatcccagtactttgggaggccaaggtgggcagatcactggaggccagaagttcaagaccagcctggccaacatggcgaaaccctgtctctactaaaaatacaaaaattagctgggcatggtggcacatgcctgtggtcccagctactcgggaggctgaggcatgagaatgacttgaactcgggatgcagaggttccagcgagccaagatcatgccactgcacttcagcctgagcaac

SEQ ID NO: 13185 - DNA, 1025 bp, Homo sapiens
gtaaagttcctccgtcgctttaaacagttgctaaatccggctcaggtgtttgatttaatgaatggaggtcctcatttagggtaactgattattgataaatcttatttgaatacaatgtaggactaggtgttaaatgtgtttggtttttcagctcatgaaaattacagattcctctagatccctccctcgtttttaaagctctaattataagttttaacacaaccttttggatagttatacaactgtcttgtataaattcctaatttctcaattccaaaatttgtttagaaaatgttttagaatatattctacatcaaacaatactaacaatttctttagctccaagaaagatcaacttgcgtaaatatagaaatataaagtaatattagaaaatgatttgcatggaaggctgatattgatttacatacaatataaataatcgattattaaaccaaagtacagggactctcatggctgtcaagggcagttcttcaaggatctcagactcagttcacataaatgacaaagaaatactttattgatgattcttttcagctttctggatgtcatataacttaaaatctgtaagataaaatgaactaagtggtattttcactgagggaaaatataccttttggcactttcaatacatttttagggtatgcatatgatttttcttaagaggcgatattatgtcttctgaaccaggggccttcaaacctctatgtaacatacttacagcaactcagcttttctcttgggttccaccattaccttaaagcatgaacacggaagtagaagtggggatttttgataccagtgcctgaaaaggcattttgtgtttcgtaatgtgatactttcctctgtcttctctatttctctcctttcttctctcttggtgcctctgttcacttttgccccctgagtcttccttcctgcttccattgcctttatcttgctaagtctcaggcccttctggtcacatggatgttggtcttcttcatttatacccagcttcctcctta

SEQ ID NO: 13186 - DNA, 1106 bp, Homo sapiens
gttgagatttgattcaatttaaaccttttaactttttttctgattacctaaggaaattccttatgatttttaagttcattgtaatctggttttcagttttgcttatttcaggttttcatatttagttggtgctgttcacgcactggttacatcattaagtgtctggaacattcctaggttccaattttggaagagttagctggcagagtctccacggtaatttttctaacatgcgtgacagcatgcaaaacatcccatagaccaggtatccctagacatagagtaaactgaaattattttataaacagtatatttactttcaaatgttacttgggtgaatctttctgttaaacatagtttagaagatacacataaatattatatgtttaaagtcagtttattccatggatttaagttaatttccaaaaagttttgttcaaaaataatttcaccatttcattcttttcctataggaatgaacattactgtgctaaggagccagtgtgatgctgcttcccagacggttactggtcatcatttagaaacccatgatttaaagattctcattagctctggacagcagaagtcattggctaaaccctcaacttcctcagtgaatgtcctgggacataaagaactaccttctgtgaaaacttcagtcacaacatcaatttcagagccttggacccaaaggagtttctataggtcatctaatgcttcagataaagatagtgatttacagaaaacatttttttcgtcttctcctgcctactcatctgaatcagaatgttcaagtccaagtcctgttattttcttggatgaagagggatatcaaaaaagcttaaaagcaaaacttgagctgcctaaaattcctgtgatgaaagatgatatagaggattcagactcagaagtaagtgaattttttgatagttttgatcagtttgatgaactagaacaaactttagagacttgcctgtttaacaaagatcccgtcatagggaagtcatcgcagaggaaagggcacaaacatggaaagtcatgtatgaatcctcaaaaattcaagtttgatcgtccagctctcccagctaatgttagaaagccaactc

SEQ ID NO: 13187 - DNA, 1032 bp, Homo sapiens
ggaaagggttcttagcatattgctggtttcaggcatgtgtggaaaggacctgtggaccatcagttgaacttagcccctggaaatggcaaactaggtgtgggagggaaggcaactcttggaaaagggaatgaggtagcataaggaaaggaaatggcttttcacctgatagaacacttcatctcgaagagttttgttcgatgcttggattaacctggaaatattaatatttttgtaaagtatattttgtcatagtttattatggtgctatataaaccaccaatatttcttaaaatctaggtccaaaaagacagtgtttaaaactggtagaagcaagtgggggcaatgtcacaaatcatgatttggcccttttctataactttatctagaaaaggatactaacatttagtttcttctctcattttgagaaacacaggcttctatgatttcagtggggttgacagtgttgcctaggaaatcctggcgttaaaatgggagattgaggtgtgggtagaggctttaagcattaagaggacttgtagtcagttgaacaactctgtgctgaatattatctaatttgatgagaaaaaggagtcgtcttaccggtttctgtccttggttctgtcctccttagcattatttattaatgatgtggaatactcatttgtggatgattcaacacaggctgaaaaaagaatctcattaacagaacaaaggttaaaaagaccaaatcaagctgaggttaaaataattatgtttaacatggataaatgcatttaggctcagaaaattaatgattaatatttgaacttaagtggggagcaaacctggcttgatggcattttgtcagaaaaagacctgtgtttccattgaccaaagttgtaatgtgacttaatgtaatgctgcgtggcattaaggttctggcacagagaaaaagcggggctcatccaggattggtggtgtgctcgttgcatatacagtgtccagggtctcacctccagagatgaagatttatgaagtcagtgaagggtcctg

SEQ ID NO: 13188 - DNA, 1042 bp, Homo sapiens
caaaggtagatgctattaataagcattgtgtgtgttcctatgaaaaaattgaattattctctgtatttaattgatttgtaattgtacctaatgattaatatatctgtttctctgataatccagtttcatttgtatgagcagctgtcataattaaaagccgataaaagtttaaacaagatgcttactatgtgccaagtaccttattagtcaagattttcagtttacagtcttaaggtttttgttccataattttctttatcagaactttccttttggggtggtagaaatattcgaattgtggtgttggttgcattcaacttggagaacatactaaaaaccattgactaggacactttgggtgaattgtatgttatgtgagttttatctcaataaagctgtttttaaaaaggttaagcatatatatgttacacaaaattaaagtagtttttcagaatttaacttacagatctttcaaaacttaagagcttttacagaacttagtagaaaaagaaatgaacaaaagcatgtcgtgagtggtgacaacaggatttatttaaacctgtatttatttatttatttatttgttgttttgttgttgaaacattaacattctttaacttagaaagccatgtttccattgaggctagagtgtgtattccagaaaaatgccacactatatgttgtggaaggaaaatccacatccttttattgagtttgacgttgtctttattattttatgtcctaattgagggtgtggcagttgtatttagttaggtgaagaatttcctgtagaaactcagcctctgcatgtccatgcagactatttgcttggtgaggtttgtggagctctgtctccagcgatcccaaagtgtcattctctggaggagatgtgtttataaaggggaagaagggaaaatgtttaatttgggtaaaggggtagcggtttagaggggaagaccttgttataactaggaaacggtatttaattgtaaacagcaggattcttaagtttcagctaatattgaaaataaaaataaaagct

SEQ ID NO: 13189 - DNA, 1067 bp, Homo sapiens
attattatacaatccaatacattcccttctgtcaggcctgctcctcctctggttatgatcaatgacatcgctcctgtcctagctgccttgggttggttagtgttgaccagagcgcaaatctatcaagtgagaagagggaaacagagccgtttagtagaatgtgtaagtcagtgaagcaggaaaacatacatagattagcacatgagtgtgggaatgcaagcacaaaaccatggaaggctggtactctcttcagagtgagataagccaagaggacttttttttttttctctagcctgataagtaggcttaaattcttcacaaacagtagacttcagaaatagtatttccaggtgccctcagttgtggtaatttagttcatcataatatgttgatgtatattttaatgaactgtgttcagttttattctttccaagattataaagcacattgcctcatacatagaagcaggcaataagtgatatgttgaattgaattcaactgcactgcagagctgtggtccagcgccatcaaaaatcaaagaactagatagtttctctcaatggccctttcactcaaatttatctgtacaagtcagttgatttcattagtattaaatttcatgaaatgactggggataggtgtgcattttgattttctccagtttttgggaaacttctaggccatccctagctgcgtgaccttagcctgtgtttttttgtttgtttaactctggaagcctcatatttctcctctttgaaacaagggtaacaaaattggtagcacaagagggttgtatatgtattttttttctttttttttttttttttgagatggagtcttgctctgtcacccagggtggagtgcagtggcatgatctcagctcactgcaacctctgcttcccgggttcaagcgattctcctacctcagcctcctgagtagctgagactacagatgcaagccaccatgccagctaatttttgtatttttagtagggacagggtttcaccatgttggccaggctggtctcgaactcctaaccttaagtgatccgtccatctcagcctcc

SEQ ID NO: 13190 - DNA, 1027 bp, Homo sapiens
gagaccggcgcgcacaagccagcagccactagctctcccacaaggccgagcgcggccaaagggcagccccgcccgctccgcctcccccagctctattggctagtgcacctgccactcagccgcgcgccggactccggcttcgggcctggaggagggatcccaagcctcctcggctcggctcggctcggctcggctcggctcggctcggctcggctcggctcggctcggctcggctcggctcggctcggctcggctcggctcggctcggctcggctcggctcggctcggctcggctcggctcggctcggctcggctcggctcggctcggctcggctcggctcggctcgcttgtccttgaggtttactgtgtttggcatcgcagttccgacggcagccgccgtttcgcgacccacggcggacttgcataaacactttctagttggaatctcaccctgtgaggtgggcaaggtagtgatattcctgtttgacgccgacagaaataagagagattgactctcagaaccatgtggcgggattttaaaggaggatcttaacagtggctcggacagacccgtgttttctgctcctagcattaactacgtcgttaaacccttctgaatttatttcgtctgtgaaatggggaaaagatagccaccttgcataactggtgaagaattcgtaaactgacagcagaatctagtaagaggactggcccgtggtcggctcttaatggtgtgtatggggctatgaacattcccaggtcttctgacctctagtctgggactctttctgctaaactagggattcttagaggtccagagacttcgggagatccaggggcatcttcaagggggtccctgagttctaaactgcagaggaacactcttaagagagataataaatatttccaccacatctgttatggataatatatattttgtcatctatttgccagagactgttgtaagtgcttgtatacattaagtcacttaatctttacagtgaacactaaggtacatcctattat

SEQ ID NO: 13191 - DNA, 1570 bp, Homo sapiens
ttaggtgttttgcatatattaactgatataatcttcacaacagtcctgtgaggttgaaactattattaacctcattttacaaagcaagagtgtaataggaaggttaagtaacttatccaaatcacacagctagtaagtggccaacctggaattcaaagcacagagtctgcctccaaagcaagagtctggcccctttataccatccaacttgatgtcgtcattttgcttttctttagccacactggcctttttattcctcaagcacatcaggcttgctccctgcataggagttgtgcactggctgttcctctgtcatctcatcatttaagtctccattcaaatgtctttttctcagagagatttttgccttaccactgtctttaaaattaccctcccacatatacagtgtcacctttttcctattttcatagtagcatttacactatctgaattgatcttaattcttttaatgtttgtttctctagaagtatttacttaataactgttgttggatggatggttgctgactattgagtattggctagtatagtggttaaggatataggctttgaaatcagactcctgggttcatgtcacagccccactacttagttgtatgaagttaggcaagtcacttaacaattcttggcctcagtttctccatatgtaaaatagaaataatatctcccttataggattgttatcagaattaaatagaataatgtgtatgtctcttaaaacaattcataacacctaagaactcaaaccatgttatttgttatttatttattacacttaagtttttgtagtaacaaatattactattactataatattgaatgaatggcatacccagaatactctttggaaaatcatgtttccaggccctcctccaggccaactgggttagaatatctgagaaaagggcccatgaatcttttaaaaatacatagattttagggagtctgataaatatccaaccttgggaactatgatagtaggcttttagcatcactatttaggatcaacctggacagttgtgtctgtgtgacatcatcagtgacatcatgacactgcagtgacaccatatagtaatttgtaattttgctgagatgtaaagtgagagcaagtcattctgataagtggacctagaagacccttaccactctccctaacatccccattacagtgcagcctcattctcttccctgtatctctgttggcaagcagtaaaacttagagtgactctaattttatttctgcttggaaaatcatctcaaaaagaaaactaaccaagaaatatggggatgccaggaaagattttttttttttaagtagtggttctaccgtaaactgtaagaaaaaaaaaaatcatgaagccattggggtttttttttgtttgtttgtttgtttttttgttttttttggcaggtgcaccaaccaatgcaaaaactgcacattatcaaggaaattacatgctattgctatatctataagttcgggtttataagttcagatattaacaaagcttttgtgaatctcatgaaagagattgtgtaagacatgattt

SEQ ID NO: 13192 - DNA, 1047 bp, Homo sapiens
cccagtgcccatttgtgctaatgacgttggccagggacgccaatttactaccctgaccctgtccttcaaatattgtctctctctccttggctagggttggacatgttctgacacctttcgtctctttgaaccccatttttccgttctgataatctttttcttcagttatgctgaccatgtctttaaatacattgctaacgttttagctcatcccaccctacgttttaatccctcagatgcagacatcgcggacagccacgcccactcaagaaatttccgaaacagaaagtttgtctgcaacagcgcgccgtactgacgtagcagtgcgcaggcgcagtcccggctcctggcggcgtgttcctcttttcctcggttcccagtgttctggcaggtaaggaacgccggctcttcgcctctcagcgcggcttgtcctttgttccggacgcccgctcctcagccctgcggctcctggggtcgctgctgcatcccgcacgcctccaccggctgcagacccatggccgagcgcggggaactcgacttgaccggcgccaaacagaacacaggagtgtggctagtcaaggtaatgttcgcgagtctcccacttgcgctcctcctaacacaagtatagtttaagtaacttgagcctatcccgctccgtgcgcctcttaaagttcttttacggctatctcgttagagcttcacacattttgagaggcaggagtcattgttgtatctgtttgcagacgaggaattagtttagggacgcaaagtgtctttcagccagttactactctgaatctgcctggactagatctctttctcacggctttcctggaatcttgtcttggtgtccccagatttggacggtgcattttatcccagactgaagaattccttgtatcttcccttggtgaaactggttttagccatgagcctgcgtgaggtagttgaatgtctactttctgtacagttttctcggccagaaagtaggactggtccctgcctactcttaaaagtgttctcttaggttgatggtccttaatgaag

SEQ ID NO: 13193 - DNA, 1041 bp, Homo sapiens
aattttaagctgggtggaatctaaagggatttgtattttagatagatcattctggccatagtataaagattagaagctgggagataagcttgaagcagatataataatccaggttcaaaatgtctgaatgactaaacaaggtggttctagtcagaagggagatgagagtctcttttgaggatagctggaggtagagccaataggacttaatgaacttacttcagacttctttggttgtggaatgggagattcttctggttggtggtggctcttgtggcccagctgtgaatatcccagattggctccctgctgtcctgtgcattgcaaggaaagtttacactgatgagaggagagggacagggaagtttttgtagtccccgtgtccattataatttaatcccatttggcagtttacataagagactcgaagcagaaaatacataaaattgtaagaacggtaccaaggtataaattatcaaaatagcaaactaatttaagtcatgaattattttatttacaattacccaacattatcactaaggtgaggctcaaaattttttttgtttttttttttttaaactgtgaacaacatgggtttgaaattatttttaaatatttacttatttatttatttatttttagagacaggatctcactatgttgcccaggctgatctcaaactcctaggctcaagtgatcctcctacctcagcctcccaaagtgctgggattataggcatgagccaccatacctggccaagctcaaaaaaaaaaaattttttttttttttttgagagacggagttttgctctcgttgcccaggctagagtgcaatggtgcaatctcagctcaccgcaacctccgcctcctgggttcaaatgatgctcctgcctcagcctcccaagtagctggtattccaggcatgtgccaccattcccggccaattttgtatttttaggagagacgggtttctccatgttggtcaggttggtcttgaactcctgacctcaggtgatccgcccacctcggcctcccaaagtgc

SEQ ID NO: 13194 - DNA, 1047 bp, Homo sapiens
ccaagtaatttaatatttactatctgtaatcccttcagtagccctgccagataaggatataatacatttacttgttaattccaagccctaaaatttcctcattgccacttagattcacttctaatagattgacgtatacttactattgcagtcctctgaaaagcatcttactcccaaaatattgaaacttcctataaaggtgctgttttaaagctaggcttcttcatatctttttcatattagtaaatcagctcaaccctcaccctattacttcacctggcctttctcctggccttctgtctgccttccaagctgcgtcttctgctggcacttcttttttttttttttttttttttttaacttgactttgggccaagtatgtgtgctctcactcacgggcagtctcagtaactctactgctcttcctgcttcttgctgtgaaaacttttttcctcctttcaccctgcaaatgtcagcctccgtctccccctttcaaaaatgaaatacacatgtttagaaaatacacattcttttgtagaacctatcctttaaaaaataacaaattgcaatcaaatgcacaaaagatagatgaatgctggagtgatatatttatgtttttaaatgacttctacattgacagttgctggtggaaacatttgttgtttagtgtttttgtagttgtttaattccattgataacaagattagcaaggcagtattagggcttttgcttagacatgaaaatagtccacatgtattaaattaggcagaattatagtatttgttaatataggactcagcctttttctttgtgatctaattgtctaacaaaggtgtcatttattcatttgcttaaagaatatttattgagttgctattatgtgagaaatgctgtacttagaaatgagataaatggaggatttattgactaaaacttacagatttctcttccaaatctgccagcagtttagattgagagtttggcattttttcgtttagttaggtcttaccagtgttcatcctgtaaaatacttggaggatgtatatg

SEQ ID NO: 13195 - DNA, 1060 bp, Homo sapiens
gatactatttaataaccttttctttatttttctcaaaatgtctttcagatccactgttagtcacttttggtttcttaatgttcactcttttgactcttacaaacattccaagctcatgactcttgtaatgaggaagagaaaagtattttatggttttagttgaagtgatcacttttgatgaaattctgtgtagaagagtaccattgacagtatgaagcatatagacaacttaagtttttctttttaaatgtttaaaatttctcaaaatacttggcgtatgaccaaagtactttgaattttgtttatctaaatctataagtattcaataattttaaacttgtctttcctcggggaaaaagttaccatttgattgatagtgaagtagaatataaaaggtaattaagtcctctgaaatactttttattgtttttgaaaggacatatagaaaattattgctgaaatagataaaagttgtaataggttgacttttgtttgggggcagctactttgaattgactgctgtggattgcttgattctgagcttttaaagcaaaaactgtttatagaattactttcagcttttcccttatcattctataatgtcctcagatactattttccagtagatacttattgttcttattgactggaagaaatcaatgaggatttctaaattattacaaaatcctgaaaaaactactactaatagacatttttattctttcattttagtgagcttttggagaaactgtgtgtgtcattgtatgatgtcttcaggccattgatcattcatgttattcacttagagactctgtcggaactttgtgggattcttaaaaatgaggtgcttgaagatcatgtgcagaacaatggtaaatgagtagaaatgatcattttaagttatatcactggctcaatgaatttgaaaaaaaaataagtgcttcttccctcaccccactaaatagataaatttaatatttttgaagcttggcttgatgccttaccccttcttgaatgaagttgcaccttattctgtcactaaagacacaatcagataggg

SEQ ID NO: 13196 - DNA, 1090 bp, Homo sapiens
ctaagtatttggcctgagggaatgtaatgctattctaaggcttaggagtagaggctcatatgaaaacatttggcttagattattttctaccaaacttcaaaaagtgttgatacttttttatcgttctagaattccattgtactaaatgttgcttgaaacaaactcttaagtaggacttgggatggtagtggttatagtagaaagcaagaactttgtgtcaaggcagctgagccctagatcctgcaactgcgtctgccaccttctgactgaagttaaggttatcaggagagaaaacaagatcatatgtgtatctgtaaagtgcttgctgcagaaatgttattttgtagtacagtttgacaaatttgaggtgaagattttgctttagcacaaagtctaaattaaggcattttaaaggaagtataattccaggtttgtagctaagcttaaaagtgttttttttttttttctgatgggaccaatttatgctaaaaactcagacttatatatagaaaatattcattttctttcaagtaatttgattattacgagtttattcttaatattccctctgaagtgttgttaatttcttcagtaacactataaacttaaattttttttcttgatctagtgcatgtaatggagtttgatctgtaagtttaattcctgctctcaaggaggtataacctaaagggaaattaagatagaaaaataggtaaacatgaaactgtatacagcaatgttattgtgagacgatgggtctttgttcattgtgtaggaatttttaaaaagatggggcttcacttgactagccttaaaaaaatgaggctgattggggaaaacttttgaagcaaatgctctttgaggtttgacttaaagataagtaaactatctggatagtaaatagagattaatatactagtttatatttgtttttaacataaaaatacttgtgcgaaacctaaatctatgttatgaaattggttaaattctggagcaatcagtgcaacagtaggcagccattactattaaaacaaaactgttggatatgggaaaatgaccagaatgtagatttagtggggaaaaaagttca

SEQ ID NO: 13197 - DNA, 1032 bp, Homo sapiens
ttgggatcttcctagatgtttgtttttcttccttctgctgtttgcttttttccctcagtccctctgctggagggggacctaacacaggtgtgggatgaaactgagcaggagccttctagctcagtgtgtcttgaatttcctttccactgttcttgccaaatgggcagaaagtggcccccatcttagtttttctaatcttctggcttctcatgtggacttgcttttgacagctgacccctgcagtgtggtatgtatagctttggcacacgatgtgttcctctgttattcttccctatttttgatgtttatgccatacagcgtgaggagtagcatcaatatttctgatctggttcagtcagcttagctctgatttaactactttatctctgcaggcaatggtggcaattcaaagacagcaccatcaacacactgcttggcttgcccttcctctggattgccttcattttgcttttccaagtcatttacctcatgtcccttctcctccctgttctgtaggattctactgaccccactctcatttcatctgggcccccagcctgtcaaaacaaacagcctccctatcagccctttcttgcagatgtcagcactgaatcatacatgaccttaagccatctttgcattatttccttatggcattttttgttttattgccttcctctgatactttccctatgtttaacctttttgctccttcactggcctgtgagatttggctagacgggacttttcctgatttttgtatggcttccatgcccaggacagaaaatgctagaaaaacattgatggattactctctttcctctttcctacacttggtctctgcatttttcatccatcatcttggatctaccctgaagttatcccctacttgtgcatagtttgctgatctgctcagattttcctgtgagagctgatttttctcacatagcctctttttacttctcagtgtcatccactgtattagtctgctaggggcaccatgacaatattcctcagactgggtggcttaga

SEQ ID NO: 13198 - DNA, 1035 bp, Homo sapiens
tctcttttctcatgtaactactatccttggttcctaggacagtgtctgcccatggtagcagcttagtaaatatttgagccgagtaagtgaataaatggctggatgaatgaatggaatgcatgaaggctggactctgtgctgggtgcttcctagacaggagtgaacaaaacttggtgcctgctgggtatatgcccaaaggaaagaaaatcagtacagcaaagagatatctgcacccccatgtttgttgcagcactgttgacaatagccaagatttgaaagcatcctaagtgtccatcaacagatgaatggataaagaaaatgtggtacatatgcacaatggagtactattcagccataaaaagaatgagatcctgtcatttgcaaccacatggatagaactggacatcattatattaagtgaaataagccgggcacagaaagacaaacttcgcatgttctcacttatttgtaggagctaaaaattaaaacagttgaactcatggacatagacatagagagtagaatgatggttaccagaggatgggaagtggagggatgggaaggaggtggggatggttaataggtatgaaaaatagaatgaatgaaggaacaagatctagtatatgatagcacaacagggtgactatagtcaaatatatatatatatatatatattttttttttttttgagatggagtcttactctattccccagactggagcgcagtggcatgatctcagctcactgcaacctccacctgcctcgttcaagcctcccaagtagctgggattacaggcacacaccaccatgcccggctaatttttgtatttttagtagagacggggtttcgccatgttggccaggctggtctcgaactcctgacctcacctcaggtgatccgcctgcctcggcctcccaaagtgctggaattacaggccactgtgcctgaccatatagtcaataataatttaattgtaatttaaatataattttacagtaacctaaagagtataattatcctttgtaacacaaag

SEQ ID NO: 13199 - DNA, 1046 bp, Homo sapiens
gcatttggtccttggaattctgctactcataagaatgcatttctagagccgggcgtggtggctcacgcctgtaatcccagcactttgggaggccgaggcaggcggatcacgaggtcaggagatcaagaccattctcgctaacacggtgaaaccacgtctctactaaaaatacaaaaaattagccaggcatagtggtgggcgcctgtagtcccagctactcgtgaatctgggaggcggagctttcagtgagcagagatcatgccactgcactccagcctgggcgacagagcgagactgcatctcaaaaaaaaaaaaaaaaaaacaaaaaaacgcatttctataacctgcaccgattttgtagaaattagtgtgatctgaagctagttgtcctgaatatgctttatgtaaatatgtgtggctcactcaagtaattttcattctttagattacatctctcgatctttttggatgtaactggatttgctggagttaagaaagaacgttgtcattccccctgcccacccccaccttcctcggctattgatgtaataaatgtaattacggtactaagaaatcctttccagctgaaggaacaaaccacaaagtctgtgctttaaatctttgtaattttttctttccgtttaaaatctaagccatatattcagatttgggcgtgctttttgcaggtgtctatttttagagctttccctgttttgtaatttcccagttctcagtcatgagtattggggaaaaatgcacattaaaattggtttttacttttgttttattttaaaatttgttttgagttttataactttaaaagcctcgtgcattcttttcacagcttccagccccaggaacatggcaatggaacatgtttattgccagtctagcatctagaaaaagctaactcctggatgacacaaagtaaatgattgcaaaaagaaagagagagaggaagaaaggatgacaggcaggggaaagatcagggggtctgaccacagaggtggcgcattttactgaattaagcatgatagttgttgccc

SEQ ID NO: 13200 - DNA, 1049 bp, Homo sapiens
gcctctcaagtagctggggttacaggcatcagccaccacgcccggctaatttttatatttttagtagagacagggtttcaccatgtcgaacaggctggacttgaactcctgacctcaggtgatccaccagccttggcctcccaaagtgctgggattacaggcgtgaaccaccgcgcctggccctgtccagtgtttttaagtgcaagaaggctgtgatgtgccttatagggaaaaatacatgtgttagctaagctttcttcaggcatgggctttagtgctgttggctgtgagtttagtgtcaatgaaccaacaacttagatcaaataagccattttttttttaaaaaacagaaacacacataaaatgacgttataagttggttgatgaaaattttgtgaccagaggcttgcaggaacctaaccctgtgtttcccccagaagctaaggattagtatttcctatggcggtgttcaaggcaacttcatagacagaactaccatcatgaataacaaggatcactgtgtgggctgagtgcggtggctcatgcctgtaatcccagcactttgggaggccgaggcaggcagatcacctgaggtaaggagttcaagactagcctggccaacatgatgaaaccctgtctctactaaaaatacaaaaattagccggtcaaggtggcgggcacccaataaaatgacaatagagtttaaactccatggtttctgaggcattttctgagtaaattggcatacagcgtatgtactctttcctctagaagttccagaaacaacactatttctttatgtgcaaaatggcctcttttgagcagccctggggcagttttgtctggccctcttgcagccagggtgccccagtttagtgtacaattggtataaaaataggcaacacaggaacttgcttgtctcgggggaaaagacgcttgcagatttatagaaattttacatttgtatgcatgatattctgtaggttcaagaaaaaacaattcaatttcaagataacattctacagggtaaataaaatttaatttcaata

SEQ ID NO: 13201 - DNA, 1034 bp, Homo sapiens
ttaaccttatgtgtgtgtgtgtgtgtgtgtgtgtgtgtgtataagtcgttctaaagtacttaaccttctgaaatcttattttgaccatgtagaacacagttcgaccttttttcaatctcatcattatcaacactgttttgtgaacatgggtcattgtggttttaattcatgggtgcccttgggctattctgagtctataggacttgcccttagttacattaacactcccacatgacaaaactcatgagtgcatggggaactttttgatatccttcctcattgtcagttgtcactttttgctactttcagaggtgatatttatagcatttccccccttctgtgttgttcctacccacaggattttaacttacagagatgactgaatgatgacacagaggggacaagtccattgaaataagtcttgttttgttttgttttgttttgttttttgggacagggtctcactctgtcgcccatgctggagtacagtggcacaatctcagctcactgtagcctttgtctcccaggttcaagctattctcccgcctcagcctcctgagtagttggacttacaggcgtgggccactacgctcggccaatttttgtatttttagtagagatggggtttcaccatgttggccaggctggtctcgaactcctgacctcaagtgatcctcctgcctcggctggtgtgctaggattacaggtgtgagccacagcacctggcagaaagaaatttttttttattactcacatttcctaagagaagagggcattccatgccacacagggccaggaggagaagcacctatttgggtgaagaggaagagatgggagtcaggggaaagccgaggccagagcctttactgggtttttatggaaaaggcaaggcagactggaggaatcagcttggggttggctaggcgctgggatggtctttagttgtcagttcctggccctgagagatttagggcaggggaaatgtgggctgggtaactgagagttagataaggaggtggctcagctagatcaca

SEQ ID NO: 13202 - DNA, 1049 bp, Homo sapiens
gtccaaactccttcccaggcctatccacagctacccagtggcctatccccaggcaaccagtgttaccagtttcttgcatatccttctgcatactaccaatacaaaagcatgttattctgtagccccagctacttgtgaggctgaggtggtaggatcactcgagccgaggagctggaggtagcagtcagctgagattgtgccactgaactccagcctaggtgacagtaagaacctgtctcaaaaaaaaaaaaaagcatataattttgttcttcttgtttttatgctgatgaggacatgctatgtccactgttccatggtatgtgcctttatattcagttattcactaaaaaaatgagaagtatagagtaaaatgaaagtctgtagtattctccactagaaacaggtgtggggttcaagggagagtgtgtattaattattgcaaaacttctggttaggtcattaatcagaacgggagccatgcagtggtgaagggccctggctatgatctgaaacatttttctgaagcagtgttgagttctgtaactgaagtccatggggacttgctattggcataactatatgtggaaaattttgctttttgagtaggacattcccatgcttcacatttaatttgaattttggtatgactgtactaagttaacatagcttttcgcattttacagagacattgagtaaatcattgactaaagataattaactcctttatatcacatgctgaaatgttatgggggacatatcattacctttcttggcttatggaagagatgtaatctaattcattgagtctgactgtgtttaagctattgttttgggtgtcatcgttggctcttagaacagggactgggccttagtccttttccttgctcatacctggcctcctcctagaagaccctgcttttcatgttttatgcctcagaaccaagatgtttggggtcccaaagtagggatgtgtatgagcacattttttgatactttcatctttctcttactctctaacatgcgttccgctagtgtcatgtaaatacagt

SEQ ID NO: 13203 - DNA, 1022 bp, Homo sapiens
agtattatggagtgtcactgtaagtggattttagaagtttgatccaacatttattgatcccttactttatacttggcactccacctggcagtgggaggatggaatgaataagacatggtccctcccacccaggagctcataggtttaaaggggaatgtaaacccatgagcaaatgacttacagtgacatgctatctaaaggaccacacaagaagaagtggtcagtctccctgggcattagatcagagtgggagaggtgggggaagcctcgtgaaagatttcacgaaagaggttgaggcttgaattaagtctttaaaaatgagtcagtgggacaagaggacaatattggggactggcatatcaggcagggaaggagcatgaacaagtttgggaattatgaaatactgaaaactgccagaagcagtaacatggctggagtgtaggttgtgaggagggacattcagagaaaaagtgctggagaaatggacagacctcatcatagatactggccttactgcccagtttggactttatagttgttgaggagcctctgcaagtgtttaagctggtgaacagcatgatggcatttgcactctggccgctctgtgaaggatgcatccaaggcggagactgatgtatggaaaccagtcaggagatcatgatagcacccagctaagagagagcactggtctacactgcaggagtagctgggggtgtgtgggggagtgaagagcccagcacggctcccagagccaagaggaagagtgggattcagggagatcctaaggatatagaagattataaatgtcaaggcctccatttctcatgtgtcaagaggggattccaatcaaggcttaattgagtatttgcttcctaaagcaaagaagacaagaattgcttgtgaagtgtatggcaaggtggtcagctgtaagatttctagcctgtggtgaagaactccattttaaataaatagtgcatccaaacattgcattaatattctagttcttcactgcaaaatgtgag

SEQ ID NO: 13204 - DNA, 1043 bp, Homo sapiens
atatctttggaattttgctaaatttttaagatgagaggtgggtagaaagagaagggaatacagaaaagattatattcaacagaatgaaatgcacacatcttgcctttggcctttccttgtcttatattacagcctcctttcctaagtacacctccaagaaatttattttttagagtgataagtgttccaaattatcttacatagcttcctattttcacttggtttggcaaagattttaccatctatgatcaggtgatcttacttcccatttagatgacattgtggggttcagggatcacacctcattctttttctttggctgctgccattgattgatttagcatttgtcactgagagattaaaaacatctttttatcaagataaacaggaaagtgtggagctctatgaatatttgttgaatgaatgaaatgcatgcctaatttctgccagtttctaaacaatctgtgcatatgtccaaaagtaaacaaggacagactctgaaaaccatacctcaagaacttaggagcaagccacaatctcctgaaatgtgttttgtggaggttcctgatttttgagatttggaaagctatttcctaagtagcaacagtaaaatggagacataggaaaataaaccaggctccatatttcagaatcataggttttctgaataaacgtcatcagctactgtgggaaaggaagccctcagagagaactaatccaattattaaagccgaagctttcttccaaaaatcacacagagcagttctttttaactactacagttgtttagcatttttatatatgtgatgcagcttcctcagcctaaaacagagaaataaaacaggcacccgtattagttcattcttgtgttgctataaagaaatgcccgagggtcgataatttataaagaaaagaggtttagttggcttacagttctgcaggctgtacacaaagcatgtgaccagcaactgctactggcaagggcctcagggttgaaggtgaagggagtgcctcctgtcacatggtgacagccagagcaagaa

SEQ ID NO: 13205 - DNA, 1021 bp, Homo sapiens
cacatgaacgcatagcaagaactgcatagacccttcttgaggtatccacccccaaaacccaaacactttccaccaggccccacctccagcattggggattacatttcaacatgagatttggaggggacatacatccaaactgtgtatcagtacctgacaagatttcagcttaaaacagagagaagaaaacacagagaagcccataagtgttagctccatgaattttcacaatgtgaacacacccgtataaccagcttccagttcaagaaacagaactttaccagcaccccagaaagccccaccccgaccccaagaataacctcttcctaattttaaataccatggattagttttgcattttttgaacttacataagtggaattgacctttgtatctggcaacttatattcaatatgatatttgtgagaatcacaggatgttgttttattacatagcattctccttatctacattgataacacttctcttgagttaaacagtgcactgtatctttttagccttctgacgaagacactgttagcctcaatgtgccaatgtcaaacatcatggaagaagaacagatcatcaaggaggactcgtgccatcgccttagccccgttaaaggtctgagaataaaaatgtggagaaagtgcttgtttttcagtttcaaatgttatgtttaaaataacctgtgcacagatagggcagtgataatctttctagagtatgtcctatgtaccaggtactgtgttcttctgggaagttgagctgatttaaaatttaaaagtcaaagatggatactctaatcatctccattttataggtgagaaaaccaagactcagagagtttaagtaacttgccattggtcacatagctgatgtgtgtgtagtactacttcctacggtacatagtagaactaatctcattctgaagacttagataaaattctttttttttttttttttttgacatggagtctcgctctgtctcccaggctggatggagtgcagtggcgtgatc

SEQ ID NO: 13206 - DNA, 1063 bp, Homo sapiens
tgtcaattttctcaacttccatagagcatcagaatgtgaattcaagaatcttagaactaatttagaaagaaaatactgagatgtgagaaggagaatgcatgttcaaaggcacaaattgaaattaaaatattgtagttaggcgagcacaggacttttgattacaccgagcggactcaagtctttgtatccaaagtattctatttgtaaatcatatttaatttctagaaatctgaaatattgaaatagcttctaaagaggtccataggaaatgtatgtcagggtagaataaaaattacacattctttcttattcagcattgtttaaatcatcatgattgaaacttctgtaacttcagtacaccatgcagccttctatgtggtatggatttctaacattggagttctctgcccaaaattttctgagggactttccctccctacctcaatctgaaagtctgtgggatgggggagccaaggctctgaacagctctttcatccatcttatgtgcaaggataaaaatctctaggaagaaaaaaaaaatcaagtttaagtctgccctgggctttgtatcattaaaaagttaattaaaactcttgctgtagtcattctccgatgcatagaacattatttaccttcttgattggtgtctaaaaggtgttttccttcatagggaagggcatgtgttttctcagctcatttcagaggatgccccgctgttagttactattcttggaagtcgtaacttcaagaacctgaagccagccatgagcccttcagctacttccaatcttgccagccttcctaaaaggtgtccttgctcatctccaaagggctaactttttagatagtctgccagtgacagtctagaaggcagaatgtttccaccacaccctcaaatatgtaatcatcacttagttcttaactcaggcttacaaaaaactttatgccaacaaaaacattaacttgtgcttatttttaatacatacaacaattctagagccttatttgaaataaattatctgaatttaatgaaagggttgagtgtaaataaaaacttagaatg

SEQ ID NO: 13207 - DNA, 1704 bp, Homo sapiens
gttcatttagcctttgattttcactgatattaactagcaaactgctttaagtcagctcaaaggattatatagtaactatatctgcatttggagcaatgtgatcagtttgcatttaaaaggaaaaaaaagaattttatcttagccagaatgtccctggattcaggggtgtctttgtataatatgagagggccttgttccaaggtcaaggcagcctccttattttacatgctgtttgccaaatcttgtttcttagcttggggagatgatggacttagcttcctcaagataaatttctagtttattaagatgcaaacagctctcatagatggctactacgaagaaaatcttatttttctgaacattttcatgaatccaggggacttgaaaatatggaagacccacatagttagaagaatatatttataaagattccttgctgctaagtcagatcagatttgctaacaggaagcattctttacatgacagtatcttgagttatgtgagttttttttcctcctgactttgtgttgattggtgaaatgcagggtatgtggaagttatctaattaacctcagttgtatatgaataacccacagatgtactgaattacttttggtgctatcttgtactcttcaatctgtaacacaataaaatccctttgtacgatgtctaatgagcaccctgagccataaattgcttaataaacacattttgggtgattattccaagtttttatcagcccattgatacatgtattcatgagctctcagcattcccatccagctctgcagtgcattgaggcttctctttaatggtcaccactgtggtggtttttcccttctttctggggagaaaatgggaaaaaaaaaaagaaaacttactgggttgccaccttaaaataatatcaataaaaactgagtaggacactcatgtaagagtagatttaattttcagtgttgatatagttcaattaaaacatgttaaagacaaattaaaagacatttatattttaattctggcatccaaagtattctttggacgcactttgattttttttgtgtcattaatttgtctgtactctgctgcgctgcacttcttgggatttattggatgatgttttttcattagtagtatggtaactagcagaacacaattaatttagtcctttaggcaaaaatttgaatgaactgttctgtccattgccaacccattaatttctaatcagaatattaagcttctctgtggtttttctccaaggtacccgtgcaccagcccatatgctaactggatgcctgcggatgcctgcccttgcagcttgactggggatacctggctgacctccttagagtctgagaagtagtcagggatgtcactgagtggtttattgtgctgaccaaatctcctcctcacaagaaagaccgttttttcagtactcccttccaatgttagataaaaggagccaagtatctatttacattttattttgaaatagccatttgtattctctttctccagtttctccaactggtggcaactctccactcagtgtcaggaattccaaaatttgtgacacctaatttctaatcatctttcctatttatggatttctggtttgttatttttagggagagacacttatgaaatggggctggtggaaaggggccccgcagaactacaatgtatgataatcgagtataaatttca

SEQ ID NO: 13208 - DNA, 1110 bp, Homo sapiens
taatttatctgggtgtaaaattctaggttagcattcatttttctctcagcattttgatggcattgctccattatcttctaatgtgatgccattctgattccttgtttgtacatgactttttttccccctttggttgtctacaggctggtgattttctccttatatcttttttttcttttttcttttatgctttcagctttcaacatttttattgacatgacttgtctgctgtcattcattttcattctttgtggcttaaggtttatttgttttatccctttactgtcgctttattgagctttcaggaggaagtaaacaaacatttcactggaaatcaatattagaacttcaacttagctatcttgatagctttttaaagatttgttagaatatttccttttacattaaaaattgacttaatgataattaataatggataataatggaaaccatctgaattaccattagcattaatttaagatcagacaggatggtctagaaagattgatgaggcatcctctgatcgtcctcttcaaagttccaagattgtctccttcatgaggaattttagaggcaactcattaccaactttgtagttttgctttgtggcattattactccaactaacttaaaaaagtttcatttttgtaattaatatgttgcctttttcatttatgttgaaatgcttatgtgctggtgtgccttagttattttcctttattgttttaagttcacatgtatgtgattttaatactttttgctaccatcctttgtaatttgttgaacaacagagaaaagccctattaattttgacaacatattaaaagtaatattactgcctttgtaatagttcacacatgtagggcttattagtgtgggtcaatttaagtaaaccttttacaacagtagaaattcatgctgtgggccgggcatggtggctcacgtctataattccagcactttgggaggctgaggcaggagaattgcttaagaacagcctgggcaacatagtgagacctccacctccacaaaaaaatttaaaaattagccatgtgtggtggtgcacatctgtagtcccagctacttgggaggctgaggtaggaggatcac

SEQ ID NO: 13209 - DNA, 1796 bp, Homo sapiens
tattcttaaaaaccgttctatgagacagtctttctcaaccagcgtttctcatttgaaccacagaacacaaaatcatttaaatgactgtttttctaatgttctaaggatggtagtattcaagatacatatgagaaaatttaatctttacaaacaatggacagataaccttagagggcatttgagcttataagtggggaagttaaattgcttaattatataataagtatttgcagttaatttgaataggtattattacttattatagaaatataccctcgatgagcattttatttactggtagcaatattttttcctctcccattcccacttccaactttatccagccaaattctgaatttgttgaaatgcaagtgatttatacattctaaagccaattcattttaatgatacaaattattcttaaaaatccagttgctgcctgtttttgcaagtattactgtaactacactgtatctttttcttcccagaaacttacagcctatttagatcttaacctggataagtgctatgtgatccctctgaacacttccattgttatgccacccagaaacctactggagttacttattaacatcaaggtataagaatgttgactgtttttgatgaatgatgccttcatagtgttctggaattccctgttgagaaattagccctataggagcccattttatcagactgtagttaagaattttacaaagaggaactaatactcatggtttttgtttttaatgttttatatcttgaaattgaaataaatttctcaaataatgttttaagttttcctaaagagccagggagtaaatattagccaactacttaattctggtgccatagacaatacgtaaaacagatgaacatgactatattccaaaaaaaattctacttataaaaacaagccgggggcggtggctcatgcctgtaatcccaggactttgggagacctaggtgggaggattgcttgaggccaggaatttgagaccagcctggacaacatagtgagaacataaacaaacagatggtgggtagtagtttggcaacctgttccataccataatgtgtaagaattttgtcttgtttctctagtctactcagtgtatgttctgagatagtcatgtcatgtattcttttctgaatgtaggctggaacctatttgcctcagtcctatctgattcatgagcacatggttattactgatcgcattgaaaacattgatcacctgggtttctttatttatcgactgtgtcatgacaaggaaacttacaaactgcaacgcagagaaactattaaaggtaatactttttaaatattaaagtgttgggcagaaaagttcattgcattaaactagatttaggtgaagcctagtcattgttaccaatatacctgccatgagtgaggtaatattgtgtcgttatataatatttccaggtttctatagaattatcttaattccatttagtaagtccactcttttcaggtggagagaaaaggtcaatgtgaaatgtcattgccttgagatgatggtacctcattttccatctagttagtcaccctgtccaacttcccatcctaccactttggttgagccatactgaaagggtttttattatccagagggtgtcttgggaccagctcttcagctgtgttttcagggatctggattctaagcaggctgtttgccttttggatcatattgggaataatcactgtcagggtagttggaaaggaatttgggtgaagaactaagagcattgatacaactaatgttgtagctttgc

SEQ ID NO: 13210 - DNA, 1049 bp, Homo sapiens
tggttaatagatttccaccactagactgctcaatacgttagtagggcacctgacacatagttgcagctcttatttattgaatgaatgaatgattccttcccgtaccaccctagtcttgcccactgtcatttttattctgggtattatatttcccaaccagttgtctgactttctcctcagatctcatccccatgggtctgagtgagttgccttgaatataagattcagtgatggtgtcctgctgcacttaagagaaaatccttttttcaagccctaaaatcctgccctcactagacttctctcaccatttctctgtttgcatcctagccttttagttttggcctcatataagcttgcagccctgcctgaaacagttgtctctgtccccactctaccccctgccctccacaaagaaaagttaactcttactcatctttcagatctcagactaaaagtttcctcagagatgccaccatagctctctatttctcatacctttcatgatacttcatcacctgtcttcatgaagtcctcctctagactattagcaaaatgctcatactgtgtcctcagtatttggcacataataggttttcttgacactgaaggaaggaataaacatctggtaactatagctagaaaaaaaggaaatacggtatctacttcactaaaaccaaagggggtttttttgggcagacaatcttcattattcagatggaaattaatgtttgttgaatgaatgagctacatttcatggattaactccatgaaatggagttcagctagtaagggttatactttgaggctatttcatcttgatgggcttgttgttcaaagttagagcctcattttaagtaaaatgttctgtgggggccatattaagattttcatatgacagaagtgtatatatatccacaaatgtttcaagccaagattatgtcttcttccataatgccaccttcttctaggatagtatttttgggccagatggttttccacatttaaaacataccaacattcttttaaggcccagtgattatcaaaaggga

SEQ ID NO: 13211 - DNA, 1031 bp, Homo sapiens
agaatacttggaaaacacagaaaggcataaataaaatatgaatcgaccaaaatgtcaacagtggagagaatcacttttcatattttagaatgtttctttcctttgggtattgtttcacattgagtagaatattatatatatgtgtgtgtgtgtgtgtgtgtgtgtgtgtgtgtgtgtgtgtgtggcttttaaaatttacctaattgtgactttctaaatttttttctattctttaaacttgtttacaacctttttaattcatatctggtagcttattttaatatgatcctaaatacaatgttgctttagagtttttttggtacaatattatttaggcccctgaaaaactggaaacaactgatattcacagctgaagttaaacaatacatattaaacatatctaaacataaaatgttataaatataaaataaaatgtgataaagaataatggcaatattggcaagtgcttctaatgttaaacaaatgaagcaggatatactctgattatgactgtgtgtaaggaagaaacctagaccactaacgcatagaatgaaatgactggagagaagtttaccacaatgttaacccaagttttatatgagtaacttacatttgtaaggaggatgtattacctttctagtaaacaaagcaagcaaaaacttctttaagccaactttaatgagtattctatacatataagtactttaagatctataatcatcagggtttttttttttctagatatagaatttggggactcattggtaggagtgatttggggtacagttctgattttttttcctgctatagtaatttcgactggatgcttccaagttgtttgctctgctgtctgagataaggaatctgcttggatatttgtttctgttgtaagaagcaggaattacatagtggacaaagcattacattgtatatgtttaagggtgaagggtaactatagtggtgattttggtcagagaaaaaaccatagaaggcaatgtccgaatagggtttacaggaaaaatagaaattca

SEQ ID NO: 13212 - DNA, 1044 bp, Homo sapiens
atttcaaaaattttataccttttatgaattctcttggacttgtaacatctaatggacttccagaggtaatctgaaaggaaatttaataaaatattaatgttttgagactgtggagggaggataattgtctaactttcttagatcaatttactgtgtatcacattttttttttgcccaagaagaatctagccaagtagaattgtggtgaaactaacttttgtatagtaacaaaaagcttttgagtatataatcaaatgtattagcatcattttgtgatttatactagaaatcaatctttattgaattttttccaaaatcaaagtatagacttttaaacttctaaataccattaaatagctaaattttaatagctaaatataaaccattaaatttgctttggtaagcctcattaagcgtaggaaccatgattaatgccatcaacattattggcattactacattgtggaacatctcttttgaggatttttaagaactgcttaattgaaaatacaaatgtatttgttgaaatgactgtgactattgcagaagtgttttaccttagtgatattccatccatctacctgttttgtttcgcattttgctacaaatgtctttccaatgagaacagaataactgagagctttgcatggtaagacgaaatatgtggagaaaaggatgctgtgatagatgatgaagaacaaaaccagtgttttagaagacatagtattagtcactatgaccaaaaggcatgaaataaaatagctagactgctagttctgtaacctgaattgatagctagtttttgaattaatttattaattcaacaaatattttttgaatgcttaatatatgtcaggcacgtgctagatactatggatacagagatttcactctcagtcactatccttaaagtgctagtgggagaggctgacaaagaaatagagcattacaggagtctacaagagtgtgaaaaaagtattcacagggttctgtgatatctcaaaggagagctacctaatccaaactagggctgataggttttgt

SEQ ID NO: 13213 - DNA, 1110 bp, Homo sapiens
ttcaagaccagcttggccaacatggcgaaaccccgtctctactaaaaatacaaaaattagccgggcatggtagcaggtacctataatcccagctactcgggaggctgaggcaggaaagttgcttgaaccccgggggcagaggtggcagtgagccgagattgtgccactgcactccagcctgggcgaaagagcgaaactccatctcaaaaaaaaaaaaaaaaaaaagattaaaagtaaagcatatatgggatgtttggaaaatcttggcagttaaacagttattataatacctatttttatcttaggtactgttttgtagcattggctatctttgtctacataaaattctaataaatattttctatgcacgaaatagacctaaaatcaaagttgaacaaatgttgcaattttctgtacctcacttttagatagaccttatttatattgcatgcgaactcagtgtatattacaaaattaaatgtatattatacaaaaattctttaatgaaatctgtgcctctgtgtgctgagagatgtaatgacatgtaaaggataattgtcagtgacttttttctttcaaggttgaaaatctttctaaacgatacgaagaaatttatcttaaaaataaagatctagatgcaagattatttttggatcatgataaaactcttcagactgattctatagacaggtattgcacatggtatatttgattgatttgctttagatataggttgatactgatataggtagattatatagtctttagcttagtgacctttagatatcatttataacaaattactttcaaatgtctttatacaaagaaaagtttaacagtattttaagcatataacttatctacaaatatagatttaatgtgaattgtgtgtcctataacagttacctttttgcagttaactgaatataattttttaaaatgtgcaccaaaagataatggctaaagtaattagtttcttcaaatagtggtctctaccttatttctatcctttcatatactattgcctgcctggtttatttaaaaaagtttatacaaaagtgtagtctctgttattatcatgtagaaacctaaaattggaatggttgagag

SEQ ID NO: 13214 - DNA, 1073 bp, Homo sapiens
tggagaaaaagtgacaagccccaaatctggaaaagagtatgattgatttacaataggagacgtggaagtcataagcctctgaatttaaatattaaatgtagtatctctggcagatgaaactatagaggacttttatttagtcatatatttttagtgtttgagtcttatattacatttttaatcataaaaaccttgagtggtagtggataactttgtgaagataagttatgccacacaaacaggatactgtgtatttttcctgtgagaataattgacattatagagaagggatatggcatagatacatttgcgttttcacagacttttttttaaaatttgaaatataacacatattaagaaaagtatatatctcaagtgacagtttggtgaatttgtcacaaattgaacacatccgtgtaaacaacacccagataaaggcccagagcaagctttcatagtcttttgattctgtgtcataataaaaaattctcgttaaaactgtagattgataggaacatattcacacagagttgttgactgagggaaatttcaaatgaggtgctgcttacttctctcctgccaataatttaatgaaagaaagaacatcatcttatttttaatggttgtgtggggaactgggttcagcatttttgcttgacagccttgagataaaataaatccataaggaaaaagcccacttctgtttcttttcatcccagagagattaatgggcaatatatgagtgtaagatactggaaaagtctgttgagaaacctagtgaaatctcattctctgaaaagttgggggattacaggtgctatcgaatgcatcatacctaagggttagatgaaatgacttccaagagtttggccctattaaatctgttaagaggtttataatgccagcaggtgatgaaatgaaatttggatgccttagtttcagtattttcagaatttatcatattttttcaataaatgtttataaatcaaagtatgtcagatgctttattccctatatgatctgtctttcctggactattctggactcttcctattgatctctcatttgctacc

SEQ ID NO: 13215 - DNA, 1075 bp, Homo sapiens
aattccatactggtttctagtaaaggtctctgtcactgtactacattatttctgtgaaatcattcatgctgtttttactacctctataatatatagtcaggcatatgggacagtataaagggagcaatacaaatagtaagttaattttattctaagtgaaagcataatatgtatgtgtattttttatcctgagtaacaagggaagtgttttgcctaggagctaataagtaacaagaaagggaaaagtaacatttgttgactagctcctttgtgcagtgcactgtgactattggtctggcttattcctcaggaagaaggattaaaagaagactttacaaaaatgagcaaactatattataaaagtaaatgctagtatgcatatatgtttcattcatgcaactcctagaaatgagaatttactataagtgttttcagaatccacaataatttaggttgaaattaggtatttggatcaactttcaagggaaggggtgacaatgaggtgaaatagacatctagattgttttcgtagactgaaacattggacctgaggtttttgttgttgttttactctttctctgtttttagtaaaagattccaggtatgcctaaagtcatcttctatacgaatgcaaaaatgtaacgacaaagaagggaaaataaaagaaggcaatatcttaggaataaatattttatagtgacattatttttctgctagtgaactaataatctacaaaaattttaagatagataagcagaaagaatacaaacaaaaaaagatagtaatttaactcatatgaataatcatccactgaaatgtagcaaggatatgctacatatgaaatgtaattagatgattgcttaaagatctaggaatataagctcaatgtaataaaataactttcttcatcattgttaaggattaataaggcattaaatgggttttcatgtgggtcctcatatgttaaaaaggacaacaataagaaaatctaaagaaactgagataacttataaatcaatgcaggtattctgtgttaaatgcttatgtaagcctgagttcttcatccagatctgtt

SEQ ID NO: 13216 - DNA, 1052 bp, Homo sapiens
gaaaatttcggccaatatccttgatgaatatcgacgtgaaaaccctcaataaaatactggcaaactgaatccatagcacatcaaaaagcttatccaccacaaacaagtcggcttcatccctgggatgcaaggctggttcaacatatgcaaatcaataaacgtaatccatcacataaacagaaccaaagataaaaaccacatgattatgtcaatagatgcagaaaaggccattgatgaaattcaacactgcttcatgctaaaaactctcaataaacttcatattgatggaatgtatctcaaaataataagagctatttatggcagacccacagccaatatcatactgaatcagcaaaagctggaagcattccctttgaaaactggcacaagacaaggatgccctctctcaccactcctattcaacatagtattggaagttctgttcagggcagttagaaaagaggaagaaataaagcgtattcaagtaggaagagaggaaattaaattgtctctgtttgcagagacaatgattgtctatttagaaaaccccattatctcagcccaaaatctccttaagctgataagcaacttcagcaaagtctcaggatacaaaattaatgtgcagaaatcacaagtattcctatacaacaataatagacaaacagagagccaaatcatgagtgaactcccattcacaaatgctacaaagagaataaaatacctaggcatacaacacacaagggatgtgaaggacatcttcaagaactacaaacttcactgctcaaggaaataaagaggacacaaacaaatggaagaacattccatgttcatggataggaagaatcaatcttgtgaaaatggccataccactcaaagtaatttatagattcaatgctatccctatcgagctaccattgacttcctttataaaattagaaaaaactactttaaatttcatatggaaccaaaaaagcccatatagccaagacaatcctaagcaaaaagaagaaagctggaggcatcatgctacctgacttcaaactatactacaa

SEQ ID NO: 13217 - DNA, 1073 bp, Homo sapiens
ctcttaaaggaaaaaaaaaatgacatgaccttgagcaaataatttagcttctctattgtatatttgtaaaaggagagtattaaattagacctatagaattcttttcagctcttagctttctatctaattcagtctccccactaattttcaatgacaagaaagaacatatattattgtttcaattttacagaccaagaaactaaaattcagagaagttgtgacttgcttaggattacaaagtgattattggtggagaatgacgaagtcaaaactaaaaactgggtcctcacaagaagtacccaacccagttccttatacatgtttgtataatgaaagaatacaacttagtgagtgcatgcataaaggataatagaaagcactgtgacctagagatccagaatccttgatttctaaattttgaccttaccttgggcaaactctgccctgaactttaagatggatatgacatgcccttttgaccttatgaagagttttcagaataaaatgaaatgaaaacatattctgaatgtaaacctctaaaaagatactattatagatgacatcacctataatatcttaactttatagaaataaaggttatgttgtgggaaatcatggaacaataagatttgttttgttttcttgaccagataggatgcctgtgctctgtcagataaagaagtgatcatgtgatgcatttggtatgccttttttagcactgctaatgtacagccaatttaaatcaaatagacataggctttgcttataaaaaccacatatatttctaagttagtttgcttggtggttaacacattgcatattgcattagtcttaatatcctctaatgttggagctagcactggatcctagaaattcagaataaaagtccaccttacccctgttacaactagccattcatcttctttggtatatagtttagctctccttccagtcactcaagtacaacttaggaaactaaaaccatagctgattattgctggagcaggaactcgaatcctagtttcttgacttctagtcaaatgttctcgtagtaacaggtagctttcaccctt

SEQ ID NO: 13218 - DNA, 1047 bp, Homo sapiens
ctcctaatctgagttagttgtctcttctgattttcatggcaccctgtgtattcttttattctggtacttagcactttgtattgctattttttatttacttatctgttttttttttcattagactgtaaactatagcataaaagttcaaaacaaaggctctgaaatcaaacagtttggaactgtgtcctggatccaccacttattcatgtgactggacaatttactccttgtctacctttcttcacttataaaatggcatttaaaaaataattaccttctttctagagtttgttgtgagaattaaataatataagtaatgtggttggtgctatgtctggcattcaataaatgttatctgttaagctctttgagggtagaattattgattgcttatcatgtgccatgtatcataccaaactttttatataggttattttattttcacaacaactctatgtagtgggtactactatgaatgtgctatttctcttagcatctctagatgaatggatcagtgaatgaatgatagatggaattgtggccagtggaactaattgtaggggtaaacagcaacctagaaacatggttaaaagcatgacaatgggcaaagaaagagtgaaagaggcagtaagcaaaggaacgtgactcccatactagtatagcagctaacggcacaagttttagaaacaggtagacttgggtttgaatcactgctccatcacttatcagccatataatatggggcaaaatttataatttctataaaatacacatatctactttatggacgtattttgaagattaaatgagataatatatgtaaaatatttagcatagaacctagcatatagtagatattcaataaatattaactagtactattattaaattaagataatcatgaagacagaattttggtagtgaggtagtgagagaaataaaatagaatcatgaagtataaggtaatgactttgaatcattaatcatagttatcgaaatcaggcatgatagaaagattacggttgttaatcttccttatagtgcaat

SEQ ID NO: 13219 - DNA, 1027 bp, Homo sapiens
accctgtcagaaataagcaagaaaaaggaagacactgtgaagctataaaagcttggtcagctatagctagcacaggaaggtgggggagagagaccaaagaaacaaagactgtggttgtctaatggccagaacagatgctataggtgcttgccatgtttgaatgtttttttgttggataaaatagcaaacttatcaaaaaatgaaaacaaatggtataatgctacttttaaaataacaacagaataaaactatatagttttaaaaacaggattcagatttagatctagagacactcagactctgcctctaccagataaagtctgaagaaaaatggttaagcaatttgttaaagagaaactctgtccatttagtgttgctgtaacagaataactgaggctgagttaattcataaattagaggggtgtatttggctcatggttctggtggctggaagcttcaagattgggcagatgcatctgctggggacctggggctgcttcaagtcatggtggaaagccaaagtggggcagacgtgcacaaagagatcatgtggtgagaaaccaaggtcgctgaaatccctttgattttttagacagagtctcactctgtcaccaggctagagtgcagtggtgccaatctcagctcactgcaacctccgcctgccaggttcaagtgattctcttgcctcagcctcccgagtagctgggattacaggtgcccgccacttcacctggctaattttttgtatttttaatagagatggggtttcaccatgttggccaggctagtcttgaactcctgaccttatgattcgcccgccttggcttcccaaagtgctgcgattgcaggtgtgagccaccacacccggcctgaaaccccttttataacaactcagtcttgggaactaattcagtcccaagagaaccagaacccactcttgctggagggcattaatctattcacaatggatctgcccccaggacccatacacttcccaccagtccctaaggcctcccaacaccaccac

SEQ ID NO: 13220 - DNA, 1781 bp, Homo sapiens
cttaccaaaaagccaaccatgctagcaccctgatcttggacatcttggcctccgtaactgttaaaaattatgtctgttgtttaaagcaaccagactatgttattttgctgtagtagcctaagttcagtaagacggtaattggtgctaagaaatgggtgactgctataacaagtacctaaaaatgtgggagtagctttggaactgtgtaatgagtagaggctggaaaagttttgaggtgtgtgcattaaaaaaaaaaaaaatgctgagattgctgcaaccagactgctaggggcaattccagtgagggctcacagagaaaaaaggagagctggagagaaagcctccatcttcaaggaggacacataaataatcatgaacagaatgtcatttgaaaacatgggtgataggccattctgatgaggtctcagatggaaatgaggagcatgatttggacaatggagaaaaggcaatccttgtaataaagtggcaaagaatttgactgaattatgctcatgttccagtgttttctagaaggcagaacttgtgaactgttaaattgggtgtttaggtaaagagatttctaagccaagtgttgaaggagcagtttgttttctcttcactgcttattcaggttgagcatccctaaattaaaaatccgaaatataaaaagctcaaaaatctgaaactttctgagctttggcatgatgctacaagtggaaaattccatcatgtgatgggttgcagttaaaacagtcaaaactttgtctcatgcacaaaattatttaaaatactatgtaaaattaccttctggctatgtaagatgtatgtaaaacataaatgaatttcgtgtttagacttgagtttcatccctaagatatttcattatgagtaagcaaatattccaaaatctgaaaaaaatgtgaaatcttaaacacttttggtcccaagcattttggataagggatactcaacctgtagtaaaatgtaagaagagagaaatgaattgaagaaagagaaatgaattgaagcaaaaaggcaccagaacttaaagatctggaaaattctcagcatgtccatattacagaaatgagaaagaacatttggaagagaacatcaaaggggtggctggctgaccgtttgctaagaagattagcatgggtgtaaaccatggacctaatagccatctcaaccgaagccaggaatagagactgaattatattagaaacactgccagctgagattaaaggaaatagagaacatgggatagaatgaaggaagactgtgaacatgcatgatcatttcagaaaagggagaaggactccaaaggcaattcagaggtcatcagggctgctacgcccactacagatccaaagtgcatgggcccaaagggcaaggctgcttccacctcagctttaaagggcaggactgccccgcagcagagcctcatgggaaggtccctgtgagagtgctgcatggtcagggctccaccaagcggaagggacaggtcacctcactgagccatgggagtgatgctgccatttcagtatctggaaggcaggaccatcaccccagtggatatggaaagcagagcattgaatcaaagatgatgattctcaagccttaagatctaacagtatttgccttggtaggttttggacttgcttgggacatgtcacccctttctttaatctgatttctaccttttggagtgggaatgtctgtcctgtgcctgtcccacgattgtcttttgcaaatacataacatatctggtttcacaaaag

SEQ ID NO: 13221 - DNA, 1051 bp, Homo sapiens
aaatacacaatccctgaaaagctgatagatttttttccccagcccaggtctttatttaaaatgttgtggttgcactgatttcactattcccacagtaatcctaaaaagggataggaataataagctttcacaagtacttattatgggccaggcaatgtgcttcattctcataactatcttatatggtaggtattttaacagtaggtgaggaaacaaacactaaaaacataataaatgttaatgaggaagggaaggaacagtttaggtgcccattatgtaataaacattgtgctaagagctttatgatctcatttaattctttcaacaattctatgaggtaggtacacctgcccttattttgcagatgaagcaaaatgagtttcagaaagtcttaaataacttgctcagcatcacacaaagcttgtgctcctaactgttactcatactgcctccttggaaaacttaaaaacaagaaagtcagattttcttactttataaacttagtatctatagtaggcaattatgatttgctgacaagataaagggctactattgaaaaattagtagcaattggcttgggttctaaatttttctgttctgtgtaaacatggcagaaagtgttgtgtcctggttttaattttttacgtgctcttatcccagcaatttcattccacaaacttgcttttcatggtcaaatttaagtctgttaagattttctactcacaaaaatagtagatgtggcaggtattcatttactttttgaggttgtccaagtgtcttcagttatcatttgttgcctcaggccagtcactagtttcaacttgttgataatctaatgtataaaagaatctattaagcagttaattacagtacattgatagagttgcatattctgttaaggggaagacagcaggctgaaataactccatgatgccatctcaagacttttctctccttcccccagaaggaaattgcagaattttcttgaaatcttgaaggcaccatggctatcatgtaacagtaatggtgtagatggctatagagaaaggat

SEQ ID NO: 13222 - DNA, 1047 bp, Homo sapiens
ttatatttttttctttaaaataattgtaagtggaaaacattttaagtctgactttttgatagaactggctttagaaagaaagatttaattattgccaacccacacatgtgtataagttcaatgagctacatggcacccatgtgcaggtaatgacactttttagtaggattggtaagagaattaagaacagatctacttataagccattctgaaataaatgagaacacaaatccttagttgcatatgtatacactgtatatacatatatgcagacattgtctataaatgtgtatatgtgggataatacctcattatattttaagaatctcctgtatgtcaggcagtatgctgacatacagaatatacagaatttacctttgtagaaaagtcactacagtttacagttaaattaaaagctgcatacctattaagtaatagagtagaatttgaatgtagaataatctgactcaaaattcatttatcttttctgtcaaaatgactttatttctgtagaaacaattatgaagacaaatgagcctaaacaggaaaaaaaattttctgattaccacatattataccatgtattctgttttgtattttaattggctgtaactgtctcccttactgattcatccttgtatccccagctcttcaaagagtgcctaacatatagtagttacccattaattgtttgccaaataaatgaattaaacgagcaattggttgactcttctcagttgtttgtctatatgctggtatcaagcatatattcttacttaggttgagttattatccatcatggaactaaaatccaaattcaaattcgttagtttgataatattcttatcttttatttgcaaatcttaatttctattttgacttcagctgaaatgttatatcagcctgtcagtctacagattgacaagatctagccaagtatagataaagcttaatgcaaagttcatatgatcaagttaatttaatagcactttaatgtataatttagacatttgtgaattgataggatattcaaatgaaatgaatttc

SEQ ID NO: 13223 - DNA, 1031 bp, Homo sapiens
gaaatcatgattgtatttaaaaatttgctctttatacttccccttttaatatgaaaacatcagtttaattagagtcgctcaaaatagtagctttgaaacattaatgagtcatgtttgtaaaaatgaattataacagatcatccattcataaattcagcccatttcaatttaagtgaatgactatgattcattccgagtacattgtgtaatagtctcaggatgtcccagagagctattaaatgttacttttcaagagaaagtgtgttatataagacttatttaagagaaaattgcaatatttttgttagaaaggaaaatatagggaaattcagttgtcatcaattcttcatgttcctaataagcaaaatatcactgttatagttagtctcttggaagtataaaatctaagccagtttagtgagtgctattaaaataagcaacaaaaatattgattaaaaaaattttttaatgactgatgacaaaaggaaattaggatccagaaagatgagtatgtgaaatatcttatattagcttttgaataaatgttcacaaaccttttgcattctggcacttttgatatcgtttagtgactaaaatggacataaaaggatctaagccttcttttgagctggcctcacaaaatgctattttattacgtaggtagaaatatgaatataaaatgtttgttttgtgtgccattctctcttcctgttttcccttttaggaaaaaagccacttactaatagtagataagagctaggaaatgaggctagagaagcaaattgacttggaatagggaaaaaatggaaagattagataattttaaagacaagaaaaatgaatttggatgttttacaagagtcaaaaatttacagtcaaaagagctagagaagattttcactttaggcagattttaagctaattcctaagaattatgtatctaaggcagtttccatttagtttgattttaaaagctgccttttgaatatctaataccaattataaaataaatatgtgtaagtaaaataaaa

SEQ ID NO: 13224 - DNA, 1045 bp, Homo sapiens
tagaagggaatgaggtaagaagtaagaagtctagatcatataagactcttacttatcttcatatcctcaatgccaagtatatagcctgtcatatagtaggagctcagtaaatatttgtaaattagataatcatccgagttgaggttctgtaatctttagaccaaaagccacagagataatcttcctatagcatttctttggtcataaagagcctgtagccggcttgtacactcaatgaagtctagatttcttgacatttaaggctttacacggttctgtcctggtttgcctttgcaccattttcttgatactttcaattatgtccatttttgtagccgaacatttctcacatgcttacttggtgtttccttaatgctgttatctaaggaatgttattcatttctccatttctgccttttaaaattctacccatccttgagggcctacctagatcatgttattgaaccacttcttggttataatacatatcacctaatataattatgtactgttagcccttcatatccttaggttccaaatctatggattcaaccaaccacagattgaaaatatttgaaaaaaaaaattgcatctatactgaacacgtacagactttcttgtcacatttcttaatacaatataactatttacacagcatttacattatattaggtatgataaataatctagagatgatttaaagtacacccgagggtgttgtaggttataagcaagtactacaccgttttatatcagaggcttgagcattagaaaattttggtatccacagaaagtcctggaaccaatcccccatgcataccaagggacaactgcatatgtatttttactcctacaggattttaggttccttaagataggaactgccttttaattatttttgtgttcttgtggtaactcaaatgtagtaagtgtcccataaatagttgtcacataaattaatgaattttaacaataatcttcctggaaggattatgtgaggttagtgggctactattattaatcttaatttaagatgaagattatc

SEQ ID NO: 13225 - DNA, 1017 bp, Homo sapiens
tgatcttcaccccataccaccagactctcccctcctgcattattgtgatcaggttagaaatagcccccacaaaatttcaaaacatcccctagaatggggtaccactcctgttagcattggtttgcagtgagatgtaactgttcctcttgattttaattatctgtccttgctttgagagcaagctcagggctagccttacttttgaaagcttttaaaaatgtggggcttactacttgttctgtagcttgttagtttctagttcttctgaggatattagatacttttgtagtcaaaaagtactgttaacacatgtaagtcaagcagctgtgtatatatacatatattcatgtgtgataaaaaagtatgactaattttatttcgtgtcacttacagtagtattttatttgtggatatgctcagaccctttcctttggtagagcagttgaggtagcagcccattgttgtttatataggttaagatttctgtaggtgactgttctttatttcgaagataattaaaatagaattttgaaatgtctgcctttaacaatatcctaacatccctatataagatgtaggtggtggtacctcagattacccacacaggtttcccaggcttgaacccttctagaaatgaccctatatacacacacagtaatcaacatggttggaaaaagatatcattgtcactgttattggaggatagtattatatacctcagagtcgggaggattaaacaggtaacatctaaatcgcccatagtataatgtctggaacataatgagcgtaataactattgttatttaatattaaaaatgaagaaaagtcactaaaagtagtttagtgacttgaatatctggtcttttgactctgctacctcacctaatctaaaagcattcctatggtggttaacatgggagatagcagttgagagaggtatcttattaactgacattgtttagaattgccagagcatggtgatgacaaaaagctcactaaagatggtctttttctgtc

SEQ ID NO: 13226 - DNA, 1041 bp, Homo sapiens
ctatcaaagatcgtcaccccatttctaccactggtagtcttctatggagattgtagggtccatacctgcagagtttcctttattaaagccagagatttaacattggctaaaagatggtacttaattcaagaagctgtacaaagatacctgctctctggtgttttaattctgcatttgatgatctatatcatataaaagatgtgctgtatctcagccttctcttgagatccatgacttttagtatacacttgctaatatgtaactgtcaagaaggaattgatgcgaatttatctttttacagtaatgtacatggtatataataatcagccatttcttgtagggaaaaggaaatggagaattttgtcagtgttacatgggctcacagaaacaatttaaaattactaaactttcaccagcaatgggctgtaaattcagactatcggccagaaatgactatggtacaaggtaaggtgtactttataaaagaatgtaaatatttttagattatcaagtcaacgtcaattgtataattatttactgtccaaattattcattaaaaattctgcttagtttatctctttgttgatatagttaagatgtgttaccagtctagcaaaagctataagagagttagttacataggaaccacaggaaacattaaacttacaactttccaagattttcagatataaattagatttttatatgtgacaaagagatttttcttttgctcctcagcatatgtgatgacagtattttgtttaaagtcaggtgaactgtaagaacatctaaaatacccaatttaaatagaaaggccaagtatctttcaagagtcattgaaattatttttgttctagagatagctctgctcaccttaggggcaggtgcgtttaattacacaactgagaacttacattttctattttatataaatggcattatatgaaagtgtgtttaaaagttacaacatttacaccaatacacgagtgttattgtttccataaggtaatgtgtatattttttcattgactcgataaatta

SEQ ID NO: 13227 - DNA, 1054 bp, Homo sapiens
actgcacccggccctgaaacaattttatagtaaatgattatgatcgttcctggcctctgagatccttgagggcagagattatgtttcagtcttttccagattcctgacacagggcctgcacgctaaatgaatacagttcagtttttcactgtgtgatctcagttagattctgtgattaattatctagtccctttgctaatcactgttgctaatctttgctaatctttgaattagaaagaacctaatttcattcaggttctttctgtgcctctttcacatcttcatgtacatgttgtactattcctatataatgtgccatatactgccacactaaatcatgtattttaattacagtgttaactctgaatatttgtaacagtcattctaatgccaactagggctatttattcacattatattccatataagcaatgccacatacctcccacagctgttaatcctttaatattttaagaattttgaattttgcttttctacttttcactgaatatattagaaacaatttccaaatctgatggactcagaatactagtaacagtttttcccaagatttacttttctgtgttgtttgtatcttagccaggtattcaacaatgaaatattcatggtgcttgtacataaccactctctatcagaaatacttatacatttaaaataacatatggaataattttgtatactagtatatcaccagtaagaacattacacagaacaaacgtgatcatttcctaaaatctgtatcgatgaatgttagcctttgttcttggcagaattttatgtaatctttgtagccttatctctacaaagagattatttgccttgtacaggtttttggtatagccatttatctttaatatatgttattattactggacaaattaattgtttaaatttttttcctcccctttctagcatacatttggggtagtgcaagaaggcttactggaaacaggtctaattagtgtttggttgaaagataatagaataaagattctattagatataaattctattatagaacttccaacttaat

SEQ ID NO: 13228 - DNA, 1041 bp, Homo sapiens
tctgtgacttgtcagggtggaaaaaaatgtatgtaaataagtatagatgtgataagctttaataaagagcaggggaatttagagaaactgtaccaagcattaaatgtattatttttagtaaccagaaattccttctattgatgtaattaagattttatagtgtttgagaggccaaggcaggaggaccacttgaagccaggagttcaagaccagcctgggaaacatagcaagaccctgtctctccaaaaagaaactaaaaaattagccagttgtggtggtgcacacctgtagtcccaagctgctagagaggctgaagcgggagaatcacttgagcctaggagttcaaggctgcagtgagctatgcttgcaccactgcactccagcctgggtgacagagtgagacactgtttcaaatagaaaaaaaactgcatatagtactttactctcagatatgagtgtttctgttgaccaggaattttaccattcctggttctctgatgcggaggtggccttgtgaaaggacacagtttctgctgagctgaacacgctttagtgtaatctgatgaagaacttctatgctggttgcggtattggtggaaagtgttttattttgcagaaaaagcacaaattccacagagggcaacagttatccattcactccatagctatctattgctgcatgacagactaccccctaaaacttagtggcccatgccactattttattttgcatgattctgtgagccaggaatttgggcaagattcagcagaacagctctactccctgtggcactggctggggtcatggacggttgtgtgccactggtgggtcagttgagaggggggcccagccggcacagggacagtgaggctggaccatccaaggggcttctttcaggtttctggtgcctcagcttggatggctgaaacagctggcagctggccagggctctccagcagggtggccagacctctatgaggtggcaagggctctgaaagtgaatgctccacaaggatgggcccagtgtgtcccccttgcat

SEQ ID NO: 13229 - DNA, 1032 bp, Homo sapiens
aaatacaaaagttagcgtggcgtggtgggacgcccttgtagtcccagctagtcgggagtctgaggtgggaggatcacctgagtgcagggaggtcgaggctgcagtgagccaagattgcgccactgcactccagcctgggcaacagagtgagaccccttctcaaaaaagaaaaactatgaattgtatatgaagtgagcaatacctaatccagtagaaaagttaaaaggaattaactagatttgtatatagcatggatgggtctcaaaaacattatattgaacaacaaaaaaagcaagttatagaataatacctatagtaaattttttataatgaaaaatacacaatatattgtttgtagatacatgtgtatataaaagcataaaggatgccacactaaatctcttgagagtttagttatatctatgttttactttttaactttttttaagaagaccatatatatgtggtgtatatgtggtgtgtatattttgaattatatatacagggaagagaactagacaaaatgctgacaactaattctggatggtggaaatatgggtgtttattattatctgtatttttctgtactttttaaactttgcacacaaaatcacatgggaaagaacaattatagattttcatatctgtaaacagaatccaaattaatgaatttgttgattgttgtcgttgttcttttctcttgcaaacagcagccaccattctgatgtgtattaattaatacagaaaatacagaagagaatcatagaggaaaagaccttaaagtcacttgttcagcaaaggagactaagatccagagattttaaccagctcaccagcagtcatttacctagttacacagctagagtccccaagttccttactttgtatcaaattatggttccctatcaagttagttagtcatctgaatagaggggaaagtacatgaagttttatggttgcaagcttcctgcctcgcaacagtatgaaaaaaggattcaataatagtaggcagatacccggcatcaatctccc

SEQ ID NO: 13230 - DNA, 1839 bp, Homo sapiens
tagaataacagcacctggccgggtgcagtggctcaggcctgtaatcgcagcactttgggaggctgaggtgggcggatcacctgaggtcaggagctcgagaccagcctggccaaaatggtaaaaccctgtctctactaaaaatacaaaaaattagctgggcatggtggcaagtgcctgtaataccagctacttgggaggctaaggcaggagaatcacttgaacccaggaggcggaggttccagtgagccaagatcacaccattgcactccagcctgggtgacaagagcaaaactctgtcccaaaaaaaaaaaaaaaaaaggcaggaaagagtccaggctaaactatggtatggagaagagaatgaaggaaaaggaaaaagtttttcttagtgctctgaactagcgaggtaatgagtgacctggtttatatttctgagaatttcaccttagtctgacaaccctttgtgaactttctgagtaagtgaacttaccaagctagtgaacattctgtactagctctattttgccttgtcaggatctctgctagaaatatcttggaaattttaactactgtttattctaggataatgccagaaaaggttggttacttactgtcttatatggacacataggtaacttttatattgtttgcaagagccacataacaattattttagatactatatgtaatatattaattttcatttttagaggtattgaaatctgatatttcttactttgtcctgttttgatcatatatatgccagaggtgctatgtgtaatacattaattttcatttttagagattatatctgaaatctgatctctgtatcttactttgtcctgttttgatcatataagtcaccgggacagtctctaaaagaatgaagagtaataacacattgatacagagtatttaaaataaaaactttgtaaatacttttcatataccttttaaaatagctatacaaatgaggagagaaactagtatgtataagtggtttgtcagaggttacagactgagagccagacaagtatgtcagtctcctcacaggtctggattcagagacttccagtaatacattaaaaaaaaaaatttatgaaagatgaaaccataggctgggcatgatggcttatgcttgtaatcccagcactttgggaggccaaggcaggaagatacttgtggccaggagtttgagtccagcctggccaacatggcgaaaccccgtctctattaaaaacataaaaatgagcctgacgtggtggcaggcacctgtaatctcagctacttgggaggatgaggcaggagaattgcttgaacccaggaagaggaggctgcagtgagacgagatcgcaccattgcactccagcctgggtgacagagcaagactgtctcaaaaaaacaaaaacaaaaacaaaccatactacagcagattaaacttcttatgaggcttatatttagctaatgttttcaaagttttactttctaaactcaatatggttttttaataattggctctttagtttttccacccattttattgtgaaaatgttcaaacagagaaaactcaagaagaatattaaagtattcttacatcctctacctagattttaatagttgttaattagacccttacttagtttcaagaaaacatttattaatggatctctcttttttttttttctttttgagatggagtctcactctgtcatctaggctggagtgcagtggtgcgatcttgactcactgcaacctctgccgcctgggttcaagtgattttcctgcctcagcctcccgagtagctgggattacaggtgtctgccactgctcccggctaat

SEQ ID NO: 13231 - DNA, 1018 bp, Homo sapiens
ttacagtgtttacagaacaaccttcagcgccgacctggaatggtaactttttccctcctcagatgaccttacttccactgcctccacaaagaccttcttaccatgacctggttttccagtgtggttctgacagcactactgataaccaaactggagtcaggtattttgtactttgcagtatttctcttgtataccagtttgtgatgttttctctaaaaacttgaagttcctcaggcctgtaacttctggaaaagatgattattcaaaataatgttttggggtaaccagtggagttgggtagaatgaccaaataattattttccaaactgggatactttttagagtgaaaggggctattattaggtgggacaaaaggaataaatgaagactgcccagaaaaaactgagactatggacattcaaatcatgggagaaaataattttgtagattatgttccattgctaatgaatttgacttagaaaagaattgccttatttttaagagattgtttcagtggttcacataaaggctcgctcactggtttctcttgagttccttacacactatataagttgttctttcagttttatgattcaactactgtttttccttcagctgactttatttttaaacacccttaaagacagatatatctcatggcaaatttggtatcctgttacagccttggctcttaaacaactcaaaatattgggataggctgtcagtatgttaaggatagttgctcctgagtcaattcttcacttactccctctgttgttcttggctggatcctaacgctgatttccactctgctgtcacaaacatttttccccccgtaaaatgtcttaatgctgtcctaccattattttaccaactgtgaaagctggctttaatttttaggaggaaaagaaaagcctgcatgtgttctttattggtatcatttaaaatatacttttttttttttttttggtaaaggtaggcgtattttaagatattttcttaacttgagcagtagcca

SEQ ID NO: 13232 - DNA, 1367 bp, Homo sapiens
gggtactggagtccatcgtatccagtttgtgtgtgtgtgtgtgtgtgtgtgtgtgtgtgtgtgtatcccgctagtctagcccagcgtttattaatggtcaatataagccacagtgtttgcatagccctcacaaaatgggtcatgttttcggttcctttgatctgcagcgacggaaaagttttgctttgcatattctcttttttgcacatcgagtttagtgacggtgctctcctcacaagttacaagttccctcccctttcaaacagttatagggatctatttttacagggacccaaagagttaggagaaatccagcatgtgctaaggctcaccttcactttttttttttccacacaaggattaacattaacgatgtaatgagttaaaacagactttaataccactaagcatggatttccccattaaccttggcaattatgtcacttcaaagaaggaagtatcaataacgaaattcttttgaattaaataaaattatggaaattgtccatctgaggtctgggcgcagaagaaggaggtttcggtattttaaagaagaactcttattggtggataattattaatatgaaatgaaatttgtaaagctagccctatcagggtacctatatatataggtgcttgatgagtatttagtctccctcacaccattttctaattcccatccttgaaaattttggcaggaaatacagacttcccagtggctaaaaaattatgctgaaacttctcttgtggttcaggtaacctccacttacttaaaaacacacacacacacacacacacacacacacacacaaaatttatccagggaactttaatagcttattaaaccttaatggaactatctaggcaaaataaaaataatggtgattacgtattctaaatccaaaacacattaaattaactcgaattttttgatggttccaataggtaactattaccacctgatttcgtttacgagtttccacagtaaaaacgaaatttgtcagcactcgtttgcttctagcatttctgctacagcaggcttcgccggcagactgatctttctagaccttgtctctttcagagcgccaattttatattgaggctattcagttctccacttttaagagagacgggtgcacttttttttcctttaaaaatcaaatgagaaaatggagaaagagtttgtagcactcacgggtggagaaaacccatctgcctgatccttttgtcccggtgcggagtcgctggagaggagagtctcctggagccgcttcgcggatcccactgggtcacctggtcctggcttattttctttgaggcccattctcggggagtaaatagacagtagcgagtttcctggcaacttt

SEQ ID NO: 13233 - DNA, 1050 bp, Homo sapiens
ggttttgattttcatttctctgatgattagtgattttgagcattttttttcatgtagctgttggccatttgtaagtcttcttttgagaaatgtctattaagatattttgcccatttttaaatagaaaaatcctctacttttgacttttcccttaaccttcacctaaaacctctcaatttgagatttaggtccaaggcaaagaaaccatgttttcctgcttatgtctccatctttttaacgtcttcttacccatcaccatgagcttttcttttcccttctgtttggtagaaaatagttttaagttatttcattctccttcctgaggagttgctttttccctttctctgaggccatattggtgaaaaggctgcagagaacctgattcataggggagaatgaattaaaaatacattttaatgtatataaaaaactatcaccatcacgcttgtaactatgagtcaccttgtccacccttccactcctcactactccagggttccacagacctgagagtagggactgtggtgaagaatgactggcagatatacagcaactgaaaaggcaccacgcttttatctcagttgcattaccctttgtatatcagcacttaaaaagggatcttttaaataacatccttgaatccttttgggtggtagaagtaaaattggggctaagcaagaatgaaatggacttttagaagttaaaataggatgttgtatgggcaaatgtatgaggtaggaaaataatgttgtcactgctttgctatctccattttcaacagctctctcagtgcctctggcatctccttcttttgctatgtaccagccctgtcacctagtccctcccactattaatcattaatgacttaagatgttaccacctccttaattgtatttaaaagttaaaaaaaaacatgcttttattctttcccattacaaataacaattcatattccttttagaaaaatacagataaacataataaaagtcacttacaatccattgccttgaaacaactattactaccctagtatacatcttttattaaaca

SEQ ID NO: 13234 - DNA, 1068 bp, Homo sapiens
tgtcgggatcctgtggtgtgatgtctgggagagtaccctgaacttagtacttaaagtattaagactatgtcataatgtctcattcttagaccctgtcgagtatgtgtagggccggaaaatgtccttcaggcttctttgagttgggtctggatcctgaaccactaggttttaatccttgtcctcatcagagggacagacagtattgagtgacccaggggacaaagtcaaaatggctgtgggcactggcaagagaggaggctctcaaataaggaaacaatggcatgaaaaagttttaacattatatatatatatatatatatagttaatacacatgcttgtatgtttttgtgtatgttcatgtgtgtatgtgtatgtatataaaagcatcaaaattgatatatatcatagggaaaaccaaaacttggtaagatttcattttacccgttttacagtctaaaccttaaaactgcttgcaattttaattatcaatgaggaatggacataataatctgttcagtgctcaggggctctgaagcccttaaattcttgatgtaggaactctccctccaacccagagtgccagggttttgcttgccacctcttctgatctgtccttaccttctccgtgttttccattggtgaagatacatctatgtctcagctcaagccctgctcccattgcattggaacagtgtgtagctgtgcacactgtccacacttaagaaagggtgatgccagactcaaaaagccttggggaagagaaagctcatcccctttagatgaaagaaatcctggagtgaggccaggtggaatattctcaagtcattcctgatgtgtcatttgtctacagcagagcaaattatggctgccttttatgggcatttgaaaggccaaaggcagcgatccactctgagtatataccccaaagaattgaaagcagggtcttgaagagatatttacatagtcatgttcacagtagcattattcacaatagccaagaatgttgattgcaacccaacccaaatgttcattgacagatgagtggataaaatatggtatgtacatatt

SEQ ID NO: 13235 - DNA, 1042 bp, Homo sapiens
gtatttgtgaacaaacacagagtttctaccattcactgggcactattaggtactaggtgtccggggatatttctattgctgttcttagctctattgttggtttacttggccagtggttgctagctttgccagtgtgtgtgtgtttgtgtgtgtgtgttacttatcacaagtttcgttagcttgacaaagagctgtgtatattcatttacatgacaaatactttttttggattagcaactctaataagtacagggtatttagaaactgtgtgtgtgtttttctacctgcagtcgtagtcttaagtatgtttcttaatagctattgaacataagtttaatattagctggatgaataaagtattagttactgtattctcttaaaaatagacgtagctttgttacagcacagaaaactgagctgacctcttactagattggctaaaatgaattctgattaaacattttgtaatggtttataaagttcgcttctctacagtatattaaaagatttgtttaaatgttgactgtaagtttggtaaaaatgacaaagcggtaaaaatgacatttggtaaaaatgacaaggcttacactttttgatgatgttcattttccccaaaagtacagctaaagctttatccattataatgagagttcagaaaaggcaaatgaccacctctttttttaaaccaatatgtctttgtgcagtaattttcttgtggcaagtggcataatctgggcgaaggtagtgataaaactcagatatatttcaagaaagcgagtaaacacactaatgacaatattcgtatattacatgcatctgctgcttatgtacttaaaaaaactaaataggaaaatcttactcatctctgtagaaaaacagggtagagattacaacttggggacttcgtgatattttgtctgtgtgcagtttgtcagaaggcaatttatctaaagctggaaaaggatatggtttggctgactaaactgtgtagtgatacgagtgatacgtaatgataaaaatgcttaggggaattttcggggcg

SEQ ID NO: 13236 - DNA, 1046 bp, Homo sapiens
gatgagccccaagttgaggcaattcagctcagatggaagtggtaatcttgcaagaaacccaatttggagttgtcgggcttagaagtgattagggctctgagaaatagatttttcttttttcacttcctctgccattttattctctcaaatatgacattgattagaatgccagtgtttgaggtgatgacaagagagtgtttttggaatagggactggaatttccagcacacacattgagttgattctactgttatatttgaatagcactaataaattgggaaaacatggtgcagaccacacacaactgttggaatgtcctccactgatgtaaagattatatgattatattccccagacccttgcatttaaatacaccctactcttcttgcccagtctgtccattggcctttaaggaaataccaatcttgtaatcactctcagcttatgatgtttctcggcctcttcaatggcatgtgggaattagtgtttcctgggtgaaggttaatttgggggaagagtctagataactcagtggctttaggactcatttgttgggaccagaggtcccacatttgcccttgaccttatgggatctgtgggttgtcttttccctttgttgtgggactgccatccaagaacctgttctctgtatctatagcatggagctgtcctccagagtgctctttagaaagagctccaataattgggaattatgcaaatttagaaaagggtatttcaagtctattttcagtcatttcccaagatatttaaaagtatagtatagagaaaaatcgttttgcatttcatataggcttgggatagcccattgtcaaaattcagtgcatgtcacaatgtaattcactggaggaaaatatgctatcaacaggatttccaagcaaaaagcctggcactaattattgccctctctttagtgtctttaactgccagatctaacatgtgttaaccttatacagcatagttgtaacaccaaaggttagtctctcattcatacaaaatttgtgtgagcttaggaattcaccactaag

SEQ ID NO: 13237 - DNA, 1034 bp, Homo sapiens
attgtcacatataactacataaagggcattgaattatcttacttatatttttaataagatgatttttagtattgctcatcaactcttccccttcccctcaaacaggcttgagactgttcactagtatatagggtaatctgtgccttgaaagaaagaagatgtgatatctgttttctactacactgatttgaatctgttttctccaaactgcgacccaatctagcagaatgtaaggagcctatattggcatactaagaccactgccctcccatttttattgaaaaaggccaagaatgaaaaagcaagctgtcttagtctgagagacagacatcagggtgggattaaatgtgcaaggattttgttaggggaaatacctgtctgggagaaaatgggtagggagcagaaagagctgttagactatggaacaagtctatctcacaaatggagagagggaaggaaggttaggtggaagtgtcctagaccattgtgcagcctaaggaagcttcagcaaggttgttatggagtctgtgaaccaaagttggctgtcagaggagtcccttgtgtcccaggaacaggcttgcccaccacatccagtcattggctaggagcagcctgtggctgggagcagccagtatggacgtggtacaaatgtgatggtggatctcagagtgcagcagctgaagaccttggtcaattaccttccctgtagctggatatttgcaaggcacattctaatggcagcttagtttgcttttgctagaaattaaagaggccgggcacggtgcctcacgcctgtaatcccagcactttgggaggctgaggtaggcagattacctgaggtcaggagtttgagaccagcctggccaacatggtgaaaccccatctctactaaaaatacaaaaattagccgggcatggtggcacacacctgtaatcccagctactcgggaggctgaggcaggaaaatcgtttgagcttgggagacagaggttgcagtgagctgagatcatgccactgtaccccagcctggccgac

SEQ ID NO: 13238 - DNA, 1022 bp, Homo sapiens
aagttcaatgaattctcaatggttgaacattttggctgtttatttattttttgctactgtaatcagttctgtggtaaatcaccttgaaggtaaatatttgcacacatttgtaattatctctcaggataaagtcctagaaggggaattgtcaggtcacagcatatgcacggttttaaggattagaatacttatggaaattactcttcaaaaggtctaggctaatttacatatcaatccagcagcctctcgtagacaagctttgttttctatagcttctttttgggcttttcccctgtcctgtagaaccttctggattttagtgttgattgtcccacccttttgatttcagagcattagccttctctctaagctttttaatgctttgcaatgagattactagttctataattttcagtgctggctctggctgctttgtctcagaataccactgcaattttctgttttttcttttcttttttttttttttttttgccaatggatctattgaactgcctagtgagcagtgcagggggagaaaggtgaacccagtttcatttgcatcccatgtggctttggcagcagtagcatcgaattaaactcaagccccggaagatgtgcttcctttggaaaatgaaagacctacaaagttcaaggagcccattcgtggcaagtaaattaagagcgtaaacccaaagaatgtctgcagtttacagcttggtattacacggttgcttctgattggtataatctgtcattgctgtgatgtgtttagagacaactcagattacactcctgatacactagctagggccaaccacctgtggccctagtcaacgatcaaagatagttaccacaaatgctatttgaggaaataatggcttagagtggaataaaaactgcagtgctgcttttattgtgtaacttttcatcttatgtgcttagcggaacagggcatgagaatcctatttattggcagtaagactctttcttttacccttggtgtcacaagggcatttggggaa

SEQ ID NO: 13239 - DNA, 1041 bp, Homo sapiens
ttaaaaatgttcaatatcattattccttaggggcagattaaaaccacactgagatagcactacacatctgttagaataaagactgaccatagcaagtcgagggcaggaagcaactggaactctcatgtactgctgatggatgtgtaaaatggtacaatcattctagaaaatagctagtttctttaaaagctaaacatatagatagcaaataacccagtcattttacaggtatttactgaagagcaatcaaagtatgggtctatacaaggactgaacatgattattcatagaagctttattttaatagtcaaaaactagaaacaacccatatgtccatcagtgtccatcaatagatgaatggataaataaacggtggtatagctatacaatgggatacttatcaataaaataaatgaactattagcacatgcaacatgagtgaaattcaatgtaattatactgatagaagcagataaaaatgacatactgtatgattttatttatacacaaatctagaaaattcagatatttatagtgacagaaagcagataagtagttgcctggggatagggggagtggagagtagtcgaagaaaaggatttcaaaggggctagaaaaacgtcttgggatgatggatatgttcataatcttgattgtggtgacagttttataggtatatgtatatgtatgacgtcaaacttatcagattgtacttatataaaataagtacattattttatatcatttacacctcaataaaggtgctaatagcaagtaaataggggatattcattgaaaggcaggtgatgatagggtaaaacaatttagctttgaagccaggatgcctgggttactaattttttcttctcctcactggttgtatcactttggactggttaactcttctgggcctttttttctatgtctaaaatggagaaaactattccaacttctgtgggttcttgtgagcattaagttggtttattaatataaagcacttatggtactccctggtatgtaagaagtatttaacaaatgtta

SEQ ID NO: 13240 - DNA, 1030 bp, Homo sapiens
atttatatacagtgagttatttaatccctgcaacaacccatgggtaggtactattatttttccttctttatagataagaacattgaggcacaaaaatgctaaattacagagtgggatcaatgtgttgctcgcttagaaaatgagtcaagttccatatgtgtgagtaaatgtgaacattcccacttccttgtcacttggttttctttctcaagtttggtgtgtttgctctgtgttcacaggatattgttaacttcttagtcctttgaagaaaaatcaaattttttcttaagaagagacttttgaaactcacaatatgaattcaagaagcaaaaaagaaaatcgaatttcacaaatgggataccaatagcttggaaaaatccattgcttttgcagggtttgttattgagggaaccctgcctttcccagcatccttaacatttcttcctcaaataaaaggtaataaaatgcaaccaactgactcattttctaagtgaatgacatatttactctactctttaagtttaaactctaaccaattccccaatccttagttcccatgaaatgtaatgttctcttcctaaaatgtttggccaagttggggaaggtgggcatggcagtgtgagcctgtagccaggttccaaggttcgcttgaggttaggaggttgagactagcctgggcaatatggcaagactctgtatccacaaaaaaaaaaaaaaaaattaaaaattaaatgtttggtcttctacaacctggctttccacttctcattcccaatcatgctctgggaccacctctttcctgtgctgaggaaggctaaggaagcactgtgttctttgaacacagtgctcaatccatcctgcattgatgcctttgctatgacagtttcctctggtctcttcctcctctgagtctagcttgagggccacttccgaacagctgcagagttgagctgctcctcggtacacttcactgttgaaccaacctgggccacaggtgttgcagtgaggttgtcttcagagcctcacccta

SEQ ID NO: 13241 - DNA, 1046 bp, Homo sapiens
tttttttttgaggcagagtctcactctgtcacccaggctgtagtgcagtggcgtgatcttggctcactgcaagctccgccttctgggttcacgcctcagcctcctgagtaggagtagctgggactacagtgcccgccaccatgcccggctaatttttttgtttctgtattttaagtagagacggggtttcactgtgttagccaggatggtctcgaactcctgacctcgtgatctgcccccatcagcctcccaaagtgctggaattacaggcgtgagccaccacacctggcaggcttacatcatttttattagactctacacagaactcatcctgaggctcggccctctcattctttcccaaagcagaattatttgccctcaatattaaagaaaattagaggatcattgattccaaggacggtactgggccggtggaggatgtgggtttccctgcagtgtctcactgccctacctcccttgtcctccccgagcagcataaaggtctcaacccctcttcgtgctcttcattgtcattgtagattattggttccagaatggaatgtcctctccttttctctttctgtttgtaaatcaaaaattccttttgtcttccaaagtaactttgagcatgcagcaattgtatctctaaacagccccatcagggacattctgtattttgttggagttgatccaaaggtcctgatagatgaacttcgaattgtcttttaatggtcctcagaaaagttttattaggtacatggtggacctggggaaacttgttgggacttgtaggttatataattcttttagcttcattgctaggatgcttgggacttttaaccatgacttcattgctcttgaatatgggtttcatgcatctggttgcttggctgttttcagaaagtaggggtaacagtcccatcaatgtatcatcttttccatgattagaaaagaaacctgagaatgctttcctagcaagtatgtagacacagtttcctccaacacctgttctttcaagtcatgagacatttgaaaataaccacaca

SEQ ID NO: 13242 - DNA, 1031 bp, Homo sapiens
tgtctggtcttcatgctttggtgcttctttatgggcaaggtgatttttttgtctgtttctttctttcttaaattactgagttactttccctttaggttttctacttcttcttgagttagttttgggaaattgtaatatttttccaggaaactttccatgatctttaagttcttacatatttactggcaagtttgttaatggtattctcttacagtttgccaaatatttactgctacaatgtgaatgtttgtgtccaaaactcctatgttgaaaccaaatccacagtgctatagaataagaagtggggcctttaggaggtgattaggtcactagggcagaatcctcctgaatggaattagtgctcttataaaagagatggaagggagcttcttagcccttctaccatatgagggcacagcaagaagatgccatatgtaaagcagaaagcagtctttaccagacactaaatctgcaggcaccttgatgctggacttcccagtctccagaactgtaagcaacaaatttttgtttataaattgcccagtttatggtattttgtcacagcagcctgaatagactaaaacatttactatatctatacttagtctctcttcatttctaatattgtttattttgcacacacactctctctttcttctactctcttttaccaaagacttatctattcaaagaaagagcaattttgttgatactgtcttttctttctcttctgtttaattaatttcctcttttaccacattttattccttttccctcctctgagtttctttctttcttttttttttttttttttttgagacagggtctcattctatcacccaggctggagtgcagtggtgcaattacagctcactgcagccttgacctccttgggctcagatgatcctcccacctcagcctccagagtaactgggattacaggtgtgcatcaccgtgccttgctaatttttgtatgttttgtagagatgagcttttgccatgttgcccaggctggtctcaaactccagggg

SEQ ID NO: 13243 - DNA, 1048 bp, Homo sapiens
aagcaggtactattcagacagtgaaggaaatcatgactgggttgtttttgcttgtttgtcatcctgtttcccaggaagataatggaaatgatatgtggccagttaatcatcagtgaggtggagtttccatgaggcttctgcagggttgtaactacaccagaaccttcaccagaagccccactcctcaattacgggctatttcagttctaggttcctcactgcggaacagaaatatctgcccagagttagcattaggacctagcaaactacacctggtccatagattgccctgacctagtgtgttctttcagaggattgtccacattcaaacactgaagcaattttattttgtagctaagacttcttaatgtgtgggaacaaagttcaaaggtgggtagctctggaggaattcgttctcagaactcccatgcagattgcagagctgtaatggtattatttattgtgccaagcatcttttcagaacctgccactagactgtaagctccacaagggcagggactgtgctgttttatttatttctgtgtttcctgcacccggcatagagtagcacaatagaattttgttcaggttgggcgcagtggctcatgcctataatctcaacactttgggaggctgaggctggaggatcttgagcccaggagttcaagaccagcctgggcaacatagtgagaccatgtctctacaaaaacaaaaaaaaagtaattgagtgcagtggtgcatgcctgtagttacagctacttgggaggctgaggtgaaaggatcacttgagcccgggtgttcaagcttgcagttagctatgatcataccattgtactccagcctgggcaacagagcaaaacctcatcgcaaaaaaaaaaaaaaaaaaaaaaaaaagagttttgttcaatgtgtggtgggaacttggaattcagagtcacatgatggaaggtacaaacacagcattatagtaatgagactgaaagcaagactgtattgtgaaatacataaaaacatcaatactacagcaactgtccttgcagggagaaag

SEQ ID NO: 13244 - DNA, 1148 bp, Homo sapiens
gtattttaatttactaaggctgggatgaccataattgcctaacaattcaatgcaacggaatgggctacttcagcactttttactgcatttttccatataatatctaaaagtcaccctgcgacacacacaggctatgtttatgaaagcaaggctttaacccttgcatttttctaggtttgaataattttcttaataaggcaaaaaatgtttgcaaatttgcaccatgatgtcagcacgtcattgtgaaggaggtaggactggcctgcacttcagggatgaagtcctgtccatttggtgtttgcaaaccttgaggatcctcgtggaagcccagtaactccaaagacccttgtttcttcccaagtttctgtctcctttcaggcaagggcaaacatatctgctttgctaggccagtctttagtttaatcttagagtctcaaaaacaaacagtggtaaggtctggataacatagttatccatttctgcgtttgcccagatgaaactttaaaaatgctaaaaataccagggcaatttctgttaattgctctggattatcaggctggagaaatggattgggcgggtatattctagtctattaaatcttgtgctaactttactgatatcgtctcttggactctggcagcctattctgcttttcagcattctccagggatgctcccagcgtgttggaaaccaaactccctgtctgcagagacagccctaacaccaaaacttttgctttactagagaagccagaagagaaaaataatgctgttgcatcctctctgactcagttgactcactttatgacttttattgtcggatcccaaacttgatggctgacctgactgaggtcaccagccccatagggctattttaaaactttgaaaatcacaaggcattttcagttcttgccacttatgagtttgtgcaactattctgatgagtgatccttgaagatacattgcctcgaaatatgaaggtgtgccaagctctagcaaaactgaaaaaaaaagtgtcatttcagaatgaccagaatcagtagacattgtttattacccttatcctccacacctgatgttaaaaacaaagactaggagcacccatgcctgccaggtcagtttatttgtgaacattgaggaatgtctaaa

SEQ ID NO: 13245 - DNA, 1050 bp, Homo sapiens
caaataaaaaaatacatttatactgtcttgtatatgtagttactttttctaatgctctttattttctttatttgaatttgagtcactgtctagtgttctttgactttagtgtgaaggactatctttagtatttattttattttatttttttttgagatggagtttcactcttgtcacccaggctggagtgcaatggtgtgatctcagctcactacaacctctgcctccagggttgaagcgattctcctgcctcagcttcctcagtagctagaattacaggcatgtgccaccatgcctggctaatttttgtatttttagtaggatggggtttctccatgttggtcaggctggtcttgaactcctgacctcgggtgatccacgcgcctcggcctcccaaagtgctgcgatcacagacatgagccactatgactggcctatcttgagtatttcttgtagagcagcctgctagtgataaatcctctcagctgtttattaggaatgtcttaacttcactattttgaagaatacttttgctggatataaaattctaggtcgacatcttggttgacattttttttttttaacacttagagtatataattccattgcttctggcttccatggtttctgatgagaaattatttgttatttttattgagaatccattgacctgatgagtagtttctttctttcaggtttcaagattctttctttgtccttcaacagttttattatgatgtatctagttgtagatctctttgactttatcatacttggagttcgttgagcttcttggatatatagtataacattttccttccaatttggaaagttttcagtcattatttttaattttttccccctttctctttatccttgacgtctgagactacatttatgcatgtttttaggcttgattatctctgagtctctgcttattttttttaattctctttatttctattacctagagtggataatctcaatggacctgtcttaaaatttactgattcttttgtctgcttgctgaaatctgctgttgagccctta

SEQ ID NO: 13246 - DNA, 1114 bp, Homo sapiens
taagtcaagaacttgacaattctgtcttagcctttacttcctgcttatacaaagcttcaagtttagccagaactgagagcacagggcattgtctgtttttcctgacaatacgcatagtcctgaacttgcacatggctccacatatgcatgtagccttttagattcccaggaatatgtcagcttttcaaagttccccatgaacatctcagattttcctttgaagccttttggttagtctattgtttgtatcaactgtgtctcacttcttcagggagctgcaatattcaacagattgttttcaacaaatgctccagaggaaaaggctgtttgcattagatgacttttgaagcagatcttataaggacaaccttttaagtagggtcttccagggaacttccagaaaggtcaaataattttaattttctgggaatggggattcaaagaagctccaaccttgttttgccctttccagtgactacaatgcttttgcttttcattgtgattgtgggttgtttattttatatctactgtagagctggagaaggtagagtggattggaataggacaagttaaaatgccacaaaactctctgtacttactgagattcagccatttttctgaataaacactctctggattgctgcaagcttttggttcctttccagacttctgaaaaagttaactctgacaatttttgctggttttctcattgcttttatgggggagaggattttcagaagtcattacttcatcattttcactgacatcacttcaagttctatttttttaatgaattttttaaagaattctgaaattccctcttaatcacacctaaatgagccactgtttattgaacttatattgaactaataagaacagaatttagtttaactcacctggcaaccttgatgaaaagtggagtcagctgagccattactccttctctaaacaatgctgactgaatgcaatgtcactttgatagacattacagtcaaacaaatgctcaacactatttagttgtctgtatttgatactatgttgagtgctgaataggtggagtgaaaagattattattctcagtttctggtagcaccacctgctctagtcaagacca

SEQ ID NO: 13247 - DNA, 1084 bp, Homo sapiens
attattttatcttctaatatttgttttcttattctctacttcatttttaaagttctgttttatttactgtcttagctcatttgtgctgctataataaaatatcacagactggctaatttataaagaacaaaaatatattttctcaaagctccggagctgggaagtccgagatcaaggtgctggcaggttcattgtctggtgaagctgctctctgtttccaagatggcatcgtgatggtgcatcctctggaggggagaaatgctctgtcctcacatggcagaaggcaaaaaggcaaatatgacaaattgtcttcctcaagttttttttataaggacctcttaccccatttataaaggaggagcccttatagcctcatcacctcttaagggcctcacctcttaatactgtcacattagcaacacctgaataatggaagggacatattgaaataggaaatgccacattaatttgtcttgtattccagttttgatatctaagactatttcttcaattgttttctaaattatttttaatggtagtttagctattaagtcaaagaggaaatgagagggctctgtaatccctaaaaagctttttggcttttcttcctggaagtctcagaaaatatctcattgattctgattgagtttgtgctcatctatgatatgtacttatctctgtgccaattattctggtcagcgtgatgagagataagacaatccagctcagcataaaacatatgattgataatggtggatgcatagtttcccaaagactgtttcaagtgtggtttcaatggagaaagaaaggaatggattctggatcctaaccagaaatgtccactagagtaaacatctattttccttttttattttattaagaatgtcataatgaagagctaagggctgctacattatctcaacaaaaactactaacgatacagaagttaatgacaaaaataatcttatatttgcctattaatttagtcttcaaactcattttcttatttgaccataccattcatgaaataattaggacttatatattgttttcatcttgcagatatggaaactgaggctcatag

SEQ ID NO: 13248 - DNA, 1033 bp, Homo sapiens
gtaatagaacctctctaggaggcactgttgaggagactgagtgaggcacacataggaagtgctctgtaagagttagctgtgcatcctcccggcatgaggtcattgcctctttgcaacaagcacagcaattcttcatgttgactaaagcctgagtctcttttattttcaaaatatattctcccaccacttctcaatattatctctgaaaagaatattttaaaagagtaatgcacaagaaacagttgttcactttagttctttcatcttaaaaactataggaacaataggccaagagagaattacaactcaatttaacaaaaatcttataataacacatacacaattataaactttaaaaggtttgggggctcattgactcttctgaggcatcctttgttcagtgatactgaacagtgaggaactttttctgaagtggccgcctggcttgttttgaggtgaagtaagaaggtgtgatgaagatcccagctcacaccagcagatgactgctgctgtttcagggctctctgatactgtctcagctatggagatggcactttttggaccacaccaaagattctcaaactttattgtctaaaactccatttgcattcagccaagacccatgtttccatgagatcatctctcattagatcacattatttatgaaatccacttttagaagaaatggatccagaagcatttcttggccacatcagggtcttcagtcgagtggcagagtcaagacatctggcctcactcttccctgtgaaactggctgaaaacaactaaaataccttttgaaaattagaaatgaaaatatacatcaaacttgaaaatagcccagctcctggtaagtgcagtcgggtcaaacttggttaagggaggcggctggaagcagatccgtgcctctgcagagctcaggtaacatggagcctgccggaagtaggcctgtcattcaaaggagggaagctattatccttgtggaacagccaggtttgagtgggaaggtgagctttggggacatccctgagcc

SEQ ID NO: 13249 - DNA, 1076 bp, Homo sapiens
ctgataatgcccaaaaggatgattacatgctggaaaattcttcctattttgagaacacatgttgaacatgtgatagatgcaaagatccaattgattatttctctttgtgtatatgatgttgccctgattgccctcaaactgttttacattagagaggtttgctttctataacagacataccagatcccttgaaggggtagggtatcattgatgttgtgccatcaaaagacatatgcctaatggggaagagagtgaatgagggcacacagtggtgagaacctgtcatgtgtgctagatatcattaaagtctcacaattgaatattttaaaaaaagtaaatactgcattctgctccataataatatgcatattatataaagataaaaaattgctttttaaataacttgccatcacaaaaatgggcacaacaggaagctgcatcatgtttgaggtgcagctttcagtcctttatgacatagcacttaatatccctcagttaggagacatacgcagtgggctatcaggactgcttcatcacatagtgctctaacatatttctggaataacttgaaagcatttctgaataatttaaattatctttcattttcaaattgattcagaagatctcctttttcctgtcatttggaaacatcttgaatttggaatcttgcgtcgagtttgataggggctgggtgggagaagggcagacaagaagaagaaagtgtatctttcctgccctcaactttcctggaagcttttcttggtctgtttattgctgtcttggagttcaggcagccctgaccttatgaacatagttagaacctgtagcgtcagtcatccatggtgtcatttgtggcagaaaaaaatataggatgacttgcctttacaatttattaataatggctgctagctttgtgcttactttttaaaatgttctctacctcccttgtcctcaaatcacaccttcttttcctgatcctatattcttttatctaaaattattttttctcttgaaattagaacttatttttttaataccttccttcttaacctatgtgatttcttttctttccaaac

SEQ ID NO: 13250 - DNA, 1099 bp, Homo sapiens
ccaatctcatgttgaattgtactctcataattcccatgtgttgggagagggacctggtgggagataattgaatcatgggggcggtttctcccatgctgttctcatagtagtgaataaaccttacgagacctgatggttttataaggagcaacacctttcatttggttctcattttctctcttgccaccggtatgtaagaagtgcctttcaccttctgccatgattgtgaggcttcgctagctacgtggaactgtaagtccattaaacctttttcttttgtaaattgcctagtcttgggtatgtctttattagcagtgtgaaaacaaactaatacacatatatacataatattttacatatttatgggataaatgtgatattttgttacatatatagagtgtgtaatgatcaaggcagggtatttggggtattcatcaccctgattatcatttctatgtgttaggaaaatttcaagttctgtcttctaattactttgaaatatacaatatgttgttgctaattatagccaccccactctgctgttgaacattagaactcagcatcagtgaatttttgaacagatcttcaccaaggttatggatcactgtggatgcaaccttgagaactgacctcagggaggcaaggatgggtgcaggataggaggctctcctgataggaggctgctccaataatccaagtaagacttgatgtgcttcattgccatagggttgtgttactggaaaggggtcccaatccataccccaagagagagttcttgaatctcatgcaagaaagaatttggggcaagcccacagattaaagtgaaagcaagtttattaggaaagtaaaggaataaagtaaagcaagtttattaggaaagtaaaggaataaagaatggctactccataggcagagcagtggcttaggctgctcaactgagtatacttatagttatttcttgattatacgctaaacaaggggtggattattcacgaggtttctggggaagggttgggtaattccggaactgagggtttcttccctttttagaccatatagggtaaattcctgatgttggtatggcatttataagctgtca

SEQ ID NO: 13251 - DNA, 1186 bp, Homo sapiens
caagagatactgatgctgctggtccggaaaccactgcccccaccccaggaaccactgcagtaaagactttgggaactagattgggatataagaatgacaagcctcatgtttggccctctttgtggtgggccagaatttatatggtcaaggaagtgcatgtaagtgcagagtgtgaggctcatcttcccagatgtagttgtcgtcttttccagaagatgagaaatcagcctgcttagttacccattcgggagttggaaacgatatgcccttggctgagggagcaccatactccagtaaagctgggcccttaataaagaaaacaaagattattaaacatttttcaaaagtatttggcggaggcggcttgtattcggttttagaaaacttgggatctgaagaacttactttgtgtactgaaaagtgagcacatgaacccacaggccaacagaactttaaagggatttatccgtgagacaagggtaaagatgcctaaccttgcaatgatacttttttccaacatttaattcatgctgttcatcgagttgcctgccacagcactgtgttatatcttgaaggatatatttaaatgtttgatttaggtatctttgcctctagttttcagtttgtttggagaagctggctatctcagataaacaaatctggaacttggaagagatactgtgagatatgcagacttgggacgttggttttcataggctggtgaagacagaaccatttcccatttcagcaaggcaagcatttcttttagtttgggatggtcttaaatgtttctgtaaaatggcctgggaatactagcctgtttgcagttttaatttctataagaggccattactttactttttggaaagtagtataagtttccatccctctttttctgccctaaaagtaaatgtttgagtcatatttttaatgtttttcttaagtccatttttcttgttaatgctactaagttgggatgtacccaggtgtgagaggtcacctgattcattgcgtttagaagactgcatttattgctgttgggggctgaacaattaattgggttcatctccaaggaaatgttaattgggaaaccctaacattgtgtattgaaaaaaaaaaaaagaagaaaaatcatttcaggcctgttaaaacaaaactcatttgggttcacttaggctgattaaaa

SEQ ID NO: 13252 - DNA, 1034 bp, Homo sapiens
tcatcctttttgtaatctgcaggaggtcttctccattttgccacacctgtggatcctctatttctgcttctccactacctcataaaggctgataaggaggtgagtttccagctcggagcatccacagtgaggaaacagaatcaactatttttgtttgatctcctctctctccttttaatgatccaaaggtggattctaccttcagatctattatagtgactagagaaaacatgaatcatatgggccagtgcaggacagagcactactgcacaggccagagaagcagcaccttactcttgatccagtctgaccctggcttgcttgtgacctctgacttgcctgactcactgtgctgtgcaccttactgcttgacaaagcctgacagctaacactcctttatcattaagtattccttacacttgaaatacaaaacaggtatttaaaaattgaccacatgtcttaaagagtctcttctttagtgagagactgtggaataggtaaactggagcgggtccaatagaagctcattaatggtgatgtgctagttgagacttaaggaatcccagatggataaaatttacctttggaatagaaataaagacacagcttactaatagtaataattttagccagaagttctgtaatattttggtctcaggatacatttacaattaaaattattaagggttccaaagagcttatgtttctgtgggttctagcaatactcttagaaattaaaactgagagatttaaaaattatttatttaaaagttaaaaataataaggccattacatgttaacataaataacacatttttattgaaacaaacaaccaaatttaatgaggcgtgtggcattgttttacatttttgcaaatctctttagtgtttggcttaactagaagacaactggattcttatatctgattctgcattcagtctgtttccatatgttattttggtaggattatatgaaaaatatgcggccccatacatctttgtagttagaaaaggaagaaataatgttacagcctt

SEQ ID NO: 13253 - DNA, 1096 bp, Homo sapiens
aattcttcccttaataagctgcagcctgtgaatctcaaaataatggaagttttaaaaacagaaagaaaaagatttttatttttatttttttatttttatttttttaagacaaggtcttgctctgttgcccaggatggaatgcagtggcacaatcacggctcactgcagcctcaatctctggggctcaagcaatcttcctacctcagcctcctgagtagctaagaccacaggcacaagccaccacacctggctaattttttcattttttttggagagatgagggggtctctctatgttacccaagctggtcttgaactcctgggctcaagggaacctcccgcctcagcctcctaaagtgccgagattataggtgtgagtcaccatgcccattctcaaaaagatttttaaatggggggaaaaatacgtaagattctcaaatgcctcatccttaagaagatattggaaaatcaaatatctaaaaattaaatatataaaacctaagcgggctttattgcaagaattcataattggttgagcatttaccataatttaccatatttatgcattacaaaattgtatgattatctcaaaagacacagaaaaggtatttgataaaattcagtcatgatatatattatcagcaaatgaagaataaaagggaacttccaagggcatctatggcaaacttaaacagctaacatcatcttcattgtaaaagactgaacacaatcttcccccaagactggatacaagagaaggatgcctgctcttaccacttctattcaccatgtggtggatgtcctagcatgtgcaataagacaagaaaaagacatacagattggaaagtcagtagtacaactgtctttattcatagacaatattgtcatgtatgaaaaaatccaaaagaatctacaaaagaagttactagaattgataagcaaagtttcaggatacaagttcaatatacaaatattagttgtgtttctatatactgacattgaacaattggataatggaataaaaacataccatttatactaccattaaaaataacattctagtgctaaatgtaacacaatatgttcaagaccaatat

SEQ ID NO: 13254 - DNA, 1082 bp, Homo sapiens
aatatatagataaatggaatagaatagagaatctagaaataaacccacacttatatggtcaattgattttttttttccaaaagtgtgaagataattcagtgggaaaaaggatagtctttacaacaaatgttgatggaagaatttggtatacatatgaaaaataacgttgattcttacctcatacagaaaaattaattcaaaatggatcactatgttaaattcaaaaatgaaaattattgagcttctagaagaaagcataggataaaatccttgttgtcttgggaggcaaagatttcttaggacacaaaacccactaactgtaaaaaaattataaattgtattttatcaaaagtattctcttttgtttttgaaaaatgccattaagaaaaaaggagattgtgagttgtgggacagttggaacttacctacctggctgtccacggcttaaaatgatatagccacttgacaatttcttacaactcaggaattctactactccctggtacaaagtaaggaactactgctagctgcaacaaaatggatgaatctcacagaaataatgttgagcaaaagaaattggacacaaaaagtatatactatatcatttcatttctatggtgttccagaataaagcaagaattgccctataatgatggatgagtggtgacctgtgatctgggtagccatgggagaattgactacataagggttccagggaactttgggggatgatgcttacatgactgcatacatttttccaaactcctcgatttgtacatttaaaatgggtgtgtccattgtgtgaacatgaacattgcgtgaacacctaaataaaattcatttttaaaacaatatttactgatccagcactagaagctaagcctcctgatttctaacacagtatttatttttacttgcccctttcccccaaaataatattggctccttttctctctatacttcctacctcccatgggatggagagatggaatgtgggaggcaaggccagtgtgagcactggctctgaggtttaggcctcgatattcaggagagtggtgtaggaggaagatgaaccactgggt

SEQ ID NO: 13255 - DNA, 1033 bp, Homo sapiens
cctaaattttgctatgtattcatagagtgatagggtgggaaaggagggaggaagctctacaggtaattttttgtcaaccctgctgcccagaagcagaaattatgatgataaaaattaataatttcaccattcagcattcaccctggcaaatggcattttggtaacagtccttacttagttttatacatgcattataaatacatatgtggcctttaacattggcattataatactcagttctgggctttttatttaacattaaattgtgaaaatgttcacatatcattaaacattctttgaaaaaatattcatgtttttatgatattcagtcatgggtgtttgtttcaccatatggaatgtaatttaatcatttccctatatttggacatataggttacttctgatttttttattttttgtttttattgaagtgatagacattcttatttacagtctgtatctccaatcatttcattagacacaattttgaactaagactaagagcttggagaacatgaattctttcataattgaaatatatatagctaaagtgcttttcaaaaatggagaaagttgtgcttccaaacattattgccaatgagtatttatcttgcatttttgacgacattgagtattgcttttattcttgaacattgttgcctgtcaaattaggctacatttctttaactagaaaggttctttttccaaatgcttatggcccatttgcatttttgcaaattgttggttcctgtcgcttgcctgtttttatgttgagatagtaatgtttctctgttgctttgtatgagctcattctaaattaaggctattaacacttttcatgaaatataggatacaaacttgttttaactttttcatttgattttttaacagtgttaaatttttctgagtgttaagtacagaaattgtttccctttatgatttttccattgtttttatgcttaggaaggccttgcccatctcaagataagttaactttcacttagattttaaaaatactaactgccctttgagt

SEQ ID NO: 13256 - DNA, 1023 bp, Homo sapiens
taaggcagctatcctgctggtctgggatgctttgcaacacaagtcatcttttgaatatcatagggttgtccttggtttcccatggagcaaatgaataaaatcagatggtaaattggtgtgaattattcatcatgtggtaatacaaggctgtaattcctacctctgacaattgcggcctgtgtcagttccattgtttgtgttattgtactttatgcaccctccagaattatctaccccctccccagtgtaaaccattggttggaacattctgcttcttagaaggcagcagttttgtcttctgcctcttttaacatattctgtctcttaggtctgaattctgaatagaaatcagaactttttcactcccttatgaagcatgttagtgggggatgcttaccttccttaatgaaacttgagacatgcagtcttctttgatttccatatatgattaataaatgttacattcataacaatttttctctcttattttcattaacagaaaaatagcaaaatgactgcagctcagaaggctttggctaaagttgacaagagtggaatgaaaagtattgataccttttttggggtaaaaaataaaaaaaaaattggaaaggtttgaaactttgaaaataaaatctagcaaaaatatttgctttttacatgtttcagtttgtccttcctgactgttaatgactacctttggttgggggaaggaagaggccaatttcatgttctcttaaacatttctttgcatttggtttttgtgttcctgaacaaaatatgggaaagtgtctaacttcatggctatggccttttggagtctcatctgacataatgaaaagtaatcacttgaagagaattaacatatagcatcatgattttctcaataaactgatgtgtgacaatgttagagtgtatgactgctttttaatgcaactttgcattcagtaggtttagtaataatattttcaatatactgagagaaactggattacaaaactgtgaggtaaattgttactttaaaaa

SEQ ID NO: 13257 - DNA, 1049 bp, Homo sapiens
aaattctcaacaaacttgtcataaaatatattttttgaatattcagcatttgaggtatggtttagtgggtttatacaatttaaatggcttatataattatttgaaatgaaaagaaaacctagtcagccagaaccaatttggcaatttttccatggtatgaaggcaaatcaattaaggccaaaacgttgaatgtgggagagatagtaagtgacttgtatgagggattactgcataataacgtaacgcacaccttactggattctccatatatatttacattaccagagaacagtggccctagggatgtttaagcactgcttataatggaaaaagtcagcttgagaagtaaacgtatatcagactacaggtaattcctcatcttgaagccatgcaacacctgcaaatctggatttatacaaaagttgctaatgtgtttcataaagatttagcatgagtaacagactcttggtgcatttaaaatatgtgagttccagaaagtagatttgcatacaccttttcaacagcacatttcactggaatggatgaggggcttctgaagaccactccactacctgaatttatttggatcactgaggaagagcatttgttgggattacagaattataggccattagacatcatgggtaggtagtcttaagatccttcaactttcaaaaaccacagtctaaggactatattcaaatgacaagagccgcactgtatactgctttctgcagtgaccatgctgggtcacgcatcctatgtttctcatttttaaatgatttggaacattttagccagcattttgatcacacagattaataatgctgttctccccaaaacgggaaactttacctgaaacgctctcctgaacaaacaccagtgcactgccagcctcacatgattgcatgggagctttaattaacgctggagcccagcaaccttggcttttcctgcctgttatctgctactgtcacaccgtgaatggtatttgaatctcacctccctctcacctcagtaagagtatgtttgtttacagccccaacctc

SEQ ID NO: 13258 - DNA, 1039 bp, Homo sapiens
tacagcagcaaatggaaattaatatatttgtttatttaatttttattactttaaaagaaatacatggttattggccaggaattcaaatagaatcaaatggtagaaagtaaaatcccctatttttcctcatgaactattcctgcatcctataggttaccactcttaacattttcatatgcattcatttcttcagaaatagtcacgtttggctgggtgtggtggctcacgcctgtaatcccaacactttgggaggccaaggcaggcagatcacctgagatcaggaatttgagaccagcctgaccaatatggtgaaaccctgtctctactaaaaatacaaaaattagctgggtgtggtggcgcatgcctgtaatccagctacttgggtggctgaggcaggacaatcgcttgcacctgggacatggaggttgcagtgagacgagctcgcaccactgcattccagcctgggtgacagagcgagactgtcttaaaaaaagaaaaagaaaaagaaacaatcacattttattttctcatttttggacaagtaagattatatcagatatgcatattttgttcttcaacttgcttatttaattaaatatatttttgaacatattttcaatcagaataaattgatctacctcattcagtaccacaatgtattttaccatttctctattagggggcatttaggttatttccagggcattttttcttttcgcctttttctgttatcaacaatgcttaaatgaactctcttctacaaatatcattggctgtcatctacagatgtaattgcaagcagtggaattgctacttgaatgttgttgtgtgtgtgtgggtatgtgtgtgcatgtgctgaagtgagagtagggggaagtgtatcttcctattcaactctttgcctatatgttatttttaacttaaaaaaattgtgaaatatacagaaaagcacatatgacataaatgtatgcttcaatgcactattgaaaagtgaacactcatataatcaccattcacgtcaagaaattgaatattgtta

SEQ ID NO: 13259 - DNA, 1023 bp, Homo sapiens
agatggtcaagtgggcagctaaatgataaggttgttcctggctagtcactagccccttgaggctgcaatcgagttttgcttcatatgctcatacttacatcttcataaattgtgacatatttaaaattcattttaacaggaatggcaaaataagagtaaagacagtgttatagaaataatcttgtcatttgaacacaagaataatttttccatgtatcctgtacttatgtgtgtatgtactttacacaattgtaatcacagtgtattttttctttagattttttttcagctaacaattttccatgagattattagattctaattctgcacacatgttatgggattatgagacccggcatcttaatattgtatagaaattgtgccaacatagtttactggtcaagggcaataaaactgactttcttagggcagtgcattaaatatcatttgattgctgttttcaggagtgtactcttgggaatctggttttattttgtagctaagtagaaagaagatagtctgttatacaggtggaagtttttgggggaaattctactagtttttattttctgaatatatcatgatagaaaattagaaaaaaagtaaatatgcagtttagaaggtctttttgttgttttattcagggcccttttataaagaatgaaaaatatgttactaagtgatatgttcacttagtggctgtcagtagaacttgaaattcttttttagtttaaaaataatctaagttggttgtttgaaaatgggactgtgtgtttgaatgatgtctttgaaccttctccagtgtttcctatgtgaccttgggtaaaacatctaatcatacccgtgaaaagtaggaataaaaaatatttgatgctgattgtgattatgataataggtagttcatgatctacatggcttctgtgaatatgaagggagacatataaaaactgtgctgggctctttagaacaactattaaatatttcagtattgggtaaattgtcaaaagaccccctatttagtgg

SEQ ID NO: 13260 - DNA, 1026 bp, Homo sapiens
ttggtttaatgagctgctgccaccatcttgtaattcttaatcaagttttttaaagggactctgtattttcattttgcactagtccctccaattatatgtttggacctgacagacatatgttgctgctaggactggtgagaaaggaaatgaggccatcccactaactgtagtatttatagatggcagatcctggtggttgtgaaaagtgggggctttgtgcacttgtaagagcatttgcagtgcagtacatggtaacactcatccatgaaataatgaccagtttgaaatgctttctagtataaacgctacagtgatgtcagctgaaacatgaatgttagaaggtatctgttcattcttcgtaacccctaacgtgtaaacctgggatgttccctcacctagcttttaactgaaaggtggttatattttgaatccctaaatcaagaagtcccagagcagctttattatcaaacttggaatccagcattcatcactgtgtttcactcttctatgttggaatattaacagcactggagtcccataaattatgtatttgttgctgaatgttgctgccagctatgagtggcaaagcagttccttatgtagcttattttggttttacaagatcattgatgtgtatcaagatggctcaacaaatgaaatgtagttcaaatcatagagttacgagtctgtgcaactagattgatttttcttgcccttgagtgtcacagtggtggcactctatactttaaaaagtgtgaaataacaaccaggagagatagggaaaacccaattggcttttaaaaaaatgaatacatgtcaaagattttatattaggcattaattaataattaattaactggcaaagtaagtggttactgcagtccaaaggaaaatccaaagagtagacacatacataggcaatggagaatgtgaaaatgaatttgttagcagacgcacagctggcttctcccatgggcagggtggagtgtgggattaggtgtgtcttaactggacaagatttgtttg

SEQ ID NO: 13261 - DNA, 1046 bp, Homo sapiens
tgttacccaggctggtcataaactactgtgttcaaacaatcctctcacctcagcctcccaaagtgctgggagagctactcaggaggctgatgcaggaggattgcttgagcccaggagtttacagttgtaatgagctatgatcatgccactgcactccagcctaggcatcagagcaagacactcatctgaaaaaaaaaaaaaaaaaaaagtggtgacaatgaatttaaactcctctttcagcgagcctaactccgaaaggaatggtattatttagagaacatgggggcaatggtttttggttattgtttttaatgggagagagttgggcatgtttatatgctgaggaaaggaggtagtagatattcaaaacaggagacaggtggaataaccaataggagccaggtcactgaaaagaggctgggttttagagcacctgcagagcatgggctttcagcaggaagagggacagtttttcctaagaaaaagaagatagggagagagaaggagagaaggactcatggatatagagaagttatggagctagaaaactgattctgcagaacgcgtactatctctgtgaaggaggaggcacagtcacacgatgagtgtgtgtggatgggagtgagctgagggatgagggtttggaatcactgatacactgggaaggaagctgaccaggcttaggattgccagtcatcatggaggaccccactaaaactggagaccataaatttgggtggaccagtaagtgcaactcccacttactgttaccattcctgagatatgtgctttacacagatctttcctttgtctttgttcctctactaaactatgctgtgtctaggtataaatttattttcgttgttgctgcttgataattgttttatttcccagatatgatgattactggcttcaaataattatagaaagttcacagctggaattgatttgcatattgttttctcatattcttttcttctggaactccttttcatatacatttgacttcatgcctcttaacttctctgtcacattttccatcatgt

SEQ ID NO: 13262 - DNA, 1027 bp, Homo sapiens
tttcgtttttggtttttttgtttttgtttttgttttttttttttgagatggagtctcactctctcgcccaggctagagtgcagtggcatgatctcggctcactgcaagctccgcttcctgggttcacgccattctcctgcctcagcctcccgagtaactgggactacaggcgcctgccaccacgcccggctcatttttttgtgtttttagtagagacggggtttcaccgtgttagccaggatggtcttgatctcctgacctcgtgatctgcccgtctaggcctcccaaagtgctgggattacaggcgtgagccatcgtgcccagccaagacagccatttttcaatcttaattgtaagtggtctgagaagcatggtttaagagccactcttactttaaaatacagtatgaaaatttaatcgcgacttggatacctagttaatgtcagagaaaataaaacttacatggatctgctttcttcattaaaaaaattaagcctattgaagagatgcgacacacgattgtagatattctaacaatgaagagtcaagaaaaagctaatttaggtaagttttagttattttatttccttcatgtgaactgtagtttttttttgttgttgttttttaacttttattttaagatcaggagtacgtgtgcaggatgtgcaggtttgttacaaaggtaaatgtgtgtcatgggggtttgttgtacagattattttatcacccaggtattaagcctagtatccattatttttcctgatcctctccctcctccaacccatgtgccccagtgtgtgttgttctttagctgtccatgtgttctcatcacttaactcccacatgcagtatttagttttctgttcctgtgtttgcgaaggataatggcctccagctccatccatgttcctgcaaaggacatgatctcattcctttttatagctgcatagtattccatggtgtatatgtacattttctttatccagtctatcattgatgggcatctggattgattctatgtctttgc

SEQ ID NO: 13263 - DNA, 2057 bp, Homo sapiens
gatataccatcccctctcctctcaacctaggtttagtgcacctgttttgtgctccctgtttttttccctatgcaatatttgatgcatttgattgtactatgtagttgtttgtcctgtcttttgcatatgtaaactcagtagataaggacagtgtctgatgttcctgaccattgagtctcctgtgctaatgcaatgcctgacacatatttggcacttaaatatttgttgaattaatctatattcttttctctccttcagcttccacttaaaactcagtcactatcatgcaactaaaacttctcttagtaaaaatttttaataattttcctaataattaaattcagaggtttttttttccagctcaatggattcaccaggatgtctcacaagtatttccagcctaacatgttttattttgaactctttgtctgccctcactgctttcccatgcccagtatccctttcccatacccaacatccctttctcccaaaaaagaaaagaaaaaactcttctctggcatttatgactcttaagaaatgttggataagacgctcctaatacatttgcacactcattcctacacagtcatgtattcatttgttaataagttctgacttgggtgggtgtggtggctcacgcctataatcccaacaccagaagtccaaggtggaagaatcgcttgaggtctagaattcgagaccatccttggcaacatagtgagaccccatctctacaaaaagtaaaaattagctgggtatggtggtacacacctttaggcccagctacttgggaggctttggcaggaggatcacttgaacctgggaagttgaggctgcagtgagctaagattatgccactgcactccatcctaggtgacagaacggcagacaccctgtctctaaaaaaaaaaaaaaaatgttctcagaaatatttctcagattggacccttcctttcctatctgatctcttcctaacttacttaggctattacaacaaccttgtcttcttgccatcacagattgttacttttcattctctgccattctagacagtcctttacattgaccaaatttaattatgtctgtctctggtgaattttttttaccaaacttctttcatataaagctcattacaatctagctctctggtgaattttttttaccaaacttctttcatataaagctcattacaatctagctcttgtttacctatctaagctcaatacctcctgctcccactcctaaccttgttccttaccctatattctaaacacactggctctttaatgttatgttaatttaatagatcattttcttttatgtgccatatgaaggttgtcttccttggtcttgatcaagtactcatttttaagacccagcctaaatctcgcttgtgaagcattccctaaccatctccctataccacaggcaaagttagttgtttctttttgtgggttttaataatcctttgttcttatttcatatatagcatttatttcattttataatagtatttgttatatagttggcagcagtatttgctgaggaaaaggaatggttcagagatggcaatcgtgttcttttattttgaaaatgtggccaactaggaacaactttaatgtcttctgattttgttcttaaaattcagccaaaagcttaatctataaatgtattttctataggagaaaatatggagaagtcttgtgcaagcaaggaagaagtcaaagaagtcagtattgaagatacaggtgttgatgtagatccagaaaaactggaaatggagagtaaacttcatagaaatttgctatttcaagattgtgaaaaagagcaagacaacaaaacaaaagatccaacccatgatgttaaaacccccaatacagaaacgaggacaagttgcttaattaaatataatgtgtctactacgccatacttgcaaaggtaaacttttaaaatgtaccatgatttgttttcatgcttggagataataaataacggcatttaaaaatctttgagatagcttcagattacagctaccatttattaatatagaaatttca

SEQ ID NO: 13264 - DNA, 1049 bp, Homo sapiens
cggcttactgcaacctccacctcctgggttcaagcgattctcctgcctcagcctcccaagtagctgggattactggtgcctgccactgtgcccagctaattttgtacttttagtagagaggggggtttctccatgttggcctggctggtcttgaactcctgacctcaggtcatccacccgccttggcctcccaaaatgctgggattacaggtgtgagccaccgatcctggctgtagctgagatttctaatgcacttgacctttttattatttcagtttcaataacaaaatatcagatatgaaaattgccagatgtgctacagctagaattaatataaggccagagcatcagattcagtttgaccaaggctatgacaattatcctggcctggagaagactgctgatcttagaaacaggtatcaggctttgtagtctgctgggttttgtttgtatagtttggttttaccttgactgtagatttaccttattgtgggtgtgtatgattgctgttggatatgtgagcattatgaatgcatttacatctgtgttcttactctctgtataccacttcctagagagggaaccatgtgctggagttagccagtcctgcatttttctataccttaaatcaaaataggccatgcttcatatctacccatgatgaatagggttcctttgatttagaataaatagagctgactgaattctgaacaagtgagtattttgtaagaaacattatttttcattttaaatatcaatgcctaatactgtgtattcatttaccctttatatctctatacatgcttatcttttgttacaccttagagaaatgacccaccatcaacgaaaagaaagaaaggcgtaggctgggcatggtggctcacgcctgtaatcccagcaatttagagggccgaggcaggcggatcacgaggtcgggagttcaagaccaacctggctaacatggtgaaaccccatctctactaaaaatacaaaaattagccggacgtggtggtgagctcctgcaatcccagctactcaggaggctgagg

SEQ ID NO: 13265 - DNA, 1027 bp, Homo sapiens
ctgtatttttctctcgttttgtgtgttctcttctgtttttgttgaccctgtctcaaaaaaaaaaaaaaaaaaaaaatcaaaactatcccttgggaatacataatgtttgtatatggaaaccctcatgcctttcttgctacctgtaggataaagtccaaaatccttagcttaacattcaaatttctccatcaaactgggttcctaggccaactatttcagagttaatgttgttcttgtttttttttttttttttttgtttttttttttttgagatagtgtctcgctctgttacccagtctagagtgcaatggcacaatcttggctcactgcaactgtcacctcccagggttcaagcagtcctctcacttggctcactgcaactgtcacctcccagggttcaagcaatcctctcacttcagcctcctgagttgctgggaccacaggcctgcaccatgcctggctaatagatgtgtgtatttttgtagaaaggggttttcaccatgttttcctgtctggtctccaactcctgggctcaagggattcacccctccttggcctcccaaagtggtgggattacaggcgtgagccattgcacccagctgatgtttttcttaaaatgcaaattctttggttacaccccatacctactgaatttgtatctcatgggaaagctgtacagtttgtatttttaactagtattgtttatttcttgctactcagagtggtcccaaattagcatctacatcactggaaacattttagaaaaatagaactccaggccctgctccagacctaatgaatcagaataatatagacattcaagttagaaaagtactaggtaatcttaatgtacacttggaagtttaagaataactgatctggccccaacctgtcattttaagtttgtccctcaatgttgctctacatttattcattcaaccaacatgtattgggtaaggtatcaaggatgtcttcacatagtcatggaactcttagtacaaagttgacagaatataatgtctgccct

SEQ ID NO: 13266 - DNA, 1039 bp, Homo sapiens
aactttttttttttttttgcaataagtctcgctcttgtcctccaggcttgagtgcaatggctcaatctcggctcactgcaacctctgcttcccggattcaaacgattctcctgcctctgcctcccaagtagctgggattaaggtgcctgccaccatgcccggctaatttttgtattttttagtagagatgaggtttcaccaagttggccaggctggtctcgaactcctgacctcaggtgatctgcccgcctcggcctcccaaagcgctgggattacaggcgtgagccactgtgcccggctgaaaacatttattaataacttcttaagcatttgtctgtccttcctcccaagatttcaataaactgatgccaagaatttatggagaaaattataaaaactttactaaaagacatacgaataactgaatgaaacaagcaattatgttcatggactggaagaggcaatacaagggaaatatatcatttctcctcaaacgaatctgcaaaatcaaagtgaacaatttgttgttgttgttgagactcacactgttacgtaggctggagtgcagtaacacgataagagtctcaacctcctgggctcaagcgatcctcctgcctcagcctcccaagtagctgaggcacgcgccaccatgcttggctaatgttttttatttatttattttttgtagagacgaggtctcaccatcttgcccaggctggtcttgaactcctgggctcaagtgatttttctgccttggcttcccaaagtgttgggattacaggcgtgagccactgcacccagcctgcacaaatcttgtgcataacttgataaaattttatgtttgaatacactgctgtgattaccagccagatcaagatatgtaacatttcccgcatccgagatttcttcatgctcctgttccccaccctccctgacaaccaggaggttcccttatgatacctctcatctaagtggaatcaatcatgatgtactccgtctggcttttttttttttttaccacaacttatgtatataagct

SEQ ID NO: 13267 - DNA, 1034 bp, Homo sapiens
taaaccccaagaccatggagaaaatgtctctccaggccatgtcagagatcttcacagtagcccctctcatcacaggcctggaggtccaggaggaaaaagtggcttcgtgggctgggcccagggtccctgtgctgtgtgcagcctagggacttggtgccctgtgtcccagccactccagccttggctgaaaggggccaacatatagcttgggctgtggcttcagagggtggaagccacaagccttggcagcttccatgtggtgttgagcctgtgggggcacaaagtcaagaattcaggtttgagaatctctacctagatttcagaggatgtatggaaatgcctggatgcccaggcaaaagtttgctgctgggatagagccctcatggagaacctctgttagtgtagtgcagaagggaaatgtggggttggagcccccacacagagtccctactggggcactgcctagtagagctgtgagaagaaggccactgtcctccagacttcagaatggtagagccactgacagcttgcactgtgcacctggaaaagctgcagacattcaacaccagcctgtgaaagcagctgggaggaaggctgtatcctgtaaagccacaagggcagagctgtccaagaccatggaaacccacctcttgcatcagtgtgacctggatgtgagacctggagtcaaaagagatgattttggagctttaaaatttgactgtcccactagatttcagacttgcctgggccctgtaacccctttgttttggccaacctcacccatttggaacagctgtatttacccaatacctgtaccctcattgtctctaggaagtaactagcttgcttttgattgtacaggctcataggtggaagggacttgccttgtctcagatgagactttggactgtggactttgggttaatactgaaatgagttaagactttggtggactgttcggaaggcatgattggttttgaaatgtgagggcatgagatttggaggggccagggttggaatgatgtggtttggct

SEQ ID NO: 13268 - DNA, 1053 bp, Homo sapiens
tcttccgggaactaccatgtccagagatttattgagttttaaataagagccatgaaaagatcagatttgccaagtttacaaagatagttctggcctttatttcaaggataggtgaagagatcaaggctcaagcaaagacaatttacggaaaaacattctttagagacaaacttcatcaatatatctttttcttaaggaaaagtgaagaaagggagaactctggttggccgtcagtgtccttgacttgtctccttcccctatttaaaaatagaatcagttaataatgtttattagtgttaatgttggacattttaaaataccctttgcttaagaattaataactttgttggatggctcaaaaattgtgttttggaagttgataaggtattgattttagatttaacatggtacaatatcaaatcatggcaaaaatgatccactttatgatttcactgactcttttcaataattaaggtttctctaagtgtaaagtgtaaagatttttagaggaagatgtggaagtactcataatatagttcttagtctaaatttctaatgagattttttttttaactaaggaagttttaagaacagatttacaaaacagtgattattgaaagatggtgatacttgctcttacctttcccatgatcagttgagctgatatggtcaactactaattccattcttagtgctatttccaaagcagtatgtgaatgaagctgtatttaaaacattcatttaccaagtagatatttattaagcaagacttttttctccaaaatctgagtttccttttttaagaaaatattttacgaatgccttttcttgttgttgtaatgtttagcacatgtatgactgtgttcatgtgcacatttgtttgcattagtcttacttatagctactgtttctttgggctgtctgctacagtctggcttgtgcttcttccacactgctgaaatgcttttgctaaagtaccagtgaccttccagttgtgagatatctttcaaatttttccttactggctctgttactttggacggtttatgtcta

SEQ ID NO: 13269 - DNA, 1056 bp, Homo sapiens
aatagctacatgtggctggaggattgtattggacagcataggctagatatttgtcaatgcctaggctaaaaatatgggataccaaaataaacagaattatgagctataataaccataacatgcctgtgatttaatttaaatgtccttattttaatggcattaacaaaagccaaataaaaagttcatcctgaattagcagcttatctatacttgttaacagtttcggacttgcttcaacttggaattttttttcgtaagtgaaaattagatgaaattttagattatcttttccaattatgttctctaggcctaaatttataataacaaaattactccttttttaggcaaaatactgataaatatggagtagaaatttttcaacttaggaacatgcttgcttaggaaatgtagtgtaaatatttgtctatcatttcacatttctctttgctgaaaatataaattaatatgcacagaaagattttacttaaaagcctatttttaaaacagcctttttcccctaaggtatgatactacttaaagatgtagaagttgccactttagttaaatttacttttcagacacgtaagcagattttactgttatttctcaactttgctctaagtatatttgttttatttttatctttgattgaaatttggccaacacatataatacagcattagatttaatatcgaagttaaagtttttattttaaaaaggaaaatgtgaaaatatgtcaattacaactcatacttcttcaactttttagttttggtggtattgtatgcttcatgtataccaggagagggagcactttaaacttgatgtctctgaacagaaaacactcttttgttgttgtgttgagacggagtctcgctctgtcatccaggctgcagtgcaatggcttgatctcggctcactgcaacttccatttcccggattcaagtgattcttctgcctcagcctcccaagtagctgggattacaggtgcatgccaccatacccagctaatttttgtatttttagtagagacggggattcaccatgttggcctgg

SEQ ID NO: 13270 - DNA, 1066 bp, Homo sapiens
tgagcaggcatttatcaggtgttccagccctttaatccagtgctggaggtacaaaggtaaatgaggtttagatttcagcctcttagtagctcatatgctaattaagtaggcacgtaggcatacaaatattgtaagacatatataaactgagaggtctaagagtctcaaaaattacttctgcctggggtaaccaggagtggggttaaaatatgagtaggtattttaaggtgcagggagggaatagcacatgcagagacacagtgttctgacaacagaaagagtgagaagttacatttggtggagcttaggtgatttagaacagtgggtatgcgagaggaaatgtggtaggttgaggccttgtatgaccttttcagtgatttcccttcttttttcttctttcatctggtgtctgcctctggtaaatgaggccccctcctcagaagatatgtttgtcgaaaatgttgatttctatatacaaagggagatttgttgacattgtgattatattctcttctttttgaagagtaggattcgtacttttgtgtagaaacagcttttcaaattcctatgacgaattcagtcacaccccttgcaagggagctcacagatgactgagaagaaagacttgccatgtaatggctcattctctgattttatggctgtatatttctctgaggaataaaaacacaaggtcagccctgagtgtcactgcccaatctgcccagtgctgtctactgtcatcccttgttgaatttattgcagcttgaaaactgaaaaaattaatcgtcgtatgctcttcactcatcattgaagcagcatgcctacttttggtgccgtaaaaatggcagctgacaaaatagttcttacaggtaaacaatttggaagacattatacaaaataagtttatagttatcttagaaggaaggtgaaacaactctctagatgggataaaccaggtgctaatacggatgtgttaccttacatgggctttgcatttctctgcggtgcttgtttctacttttctgtcctacctcctgccctgccccttgctagtttttattattat

SEQ ID NO: 13271 - DNA, 1058 bp, Homo sapiens
aaaacaaaaaaacaaaaaatccaattaaaaattgataaaagacctgaatagacatttctcaaaagaagacatacacatggccaacaggcatatgaaaaaatgctcagcatcactaaaactacaatgagagatcatctcacacagttagaatgcctattatcaaaaagacagaagataactgctatagtttggatatttgaccctctaaaccctatattggaatttgatccccagtgttggaggtggggcctagtgggaagtatttaggtcatggaggggcagagccctcattaatggcttggtgccatccttgcagtgagtgagttctttattacttcctgtgggcgctggttgttaaaaagagcctggcacctccctcttttctcttttgctgctcttttcatgtgatctgcatatacccctttgccttctgccatgagtggaagcaacctgaaaccctcaccagaattggatgctgatgccatgctgcttgtacagtctgcagaactatgagccaaataaacctttctttataaattacccagcctcaggtattcctttatagcaacacaaatagactaagacaatagcaaatgctgttgaggatgcagagaaaggggaatgctcaaacaccactgatcggaatgtaaattagtgcaaccaccatggaaaacggtatggcggttcctaaggaaactaaaaatagaaataccatatgatacagcagtctgactgctggatatatattcaaaagaaaggaagtcagcatattgaggaagcatctgcactcccatttttattgtagcactattcacaatacccacgatatggaatcaacctaagtgtgcatcattggttgaatggataaagaaaacatatgtatgtatgtatatgtgtgtgtatacacatacacacacacacatacacacacacacacatacactggaatattattccgccataaaaaagaatgaaatcttgtcatttgcaacaacagggatagaactggagagcattgtattaagtgaaataaaccaggcacagaaagacaaatattg

SEQ ID NO: 13272 - DNA, 1025 bp, Homo sapiens
ttttatcatctgtaaatgcaaaatatatattatttccgtttgacagataaggaaataggtttgtatattaatatttgtattaaagcaaaaataacataaggttatttctaaatggtttttgacccacaagtctagtgcctcgtatataaatacctgtttatcaacaagagagccatatctgactttatctaagtagctaaattactcagatacatgtattttcatttaatggatcaatttgtccattagtagtttttttaaccctggcagaaaaatatttttatagtaatcctaacctgagtttcatgatgaaatactgaaaataactcatggttattaatgatttaatgccagtagtataatggtagctttgttgaggtttaagagggaggttaatactggggtctggaatctactcagttaatcccccagctctaccctgtgctagttgtgtgaccttgtcaagcctctttagcttccttatctgtgaaatagggatgttataactgtactctgaggtaagctcatttggttttttaattatgtgagaaattttactaaactagaaatttttttcttttttgtatttgtaaggactagtttgggctttgcatgcattttacatgggactaaacagggcaatctttgcagttgtattgttggtgtgtgtggcactttttcttagaattctcatgatttgttcatttataacagcactagtcttatgctttatgctaactttttaaaaattggcttttctcagttttcttttaaaaggggctttgaaacaccaaaaaattagttgtttgaacactgggcatcataaatatgtttattttgagcttagtcttcaatttaatatgtgttgtatctataaagattttaatgagaacaggaaaacaattgtatatatttgaataattatacaaattataattgaaagaaaaataccatgccagattaaaactaatgttaattcttgtgatcattttttctgggatctggtgtttttatttagcataatg

SEQ ID NO: 13273 - DNA, 1027 bp, Homo sapiens
cttacgtggcttcttctctccttccttttgctgttccagggtggccatagctgatgagcacatttcttattccttactgtagctcttctattcagaggtgtttggtcctgaagtgatcattttctttctacagtcagtgacttttcctatttctcccttaagagtcctcattgctttatccttgattttaggtctgtataaacttagctggacaataaatttatcaggtgtacagctcatttagtgattctgttctgaactacagcaatactttcatattcttcctacttatttgtgaatatttatcctttattatgtcatttattaacctattttctttctctgcagtcaacttagaaatcttttataaaatatttgaaatattttacagaaagaagcaggatagaatcactaaatcttttggagattctggtatttcttttctcctacttttataatcaagtggttgttgacgttttatgaatttgcgtaggttactataacagacatctctggatcatgcacattatgatcagcctttcttctttatctgcataaataattaacttagttgagagaaatatctcctcgaaatatagaggccaccagcttaacatatctcaacctatttctattttaaaaaatatttgtgtgcatatagatgtaaaaaaaccctgaagaaatatagtctgtgttgctgtcagtacatgcaatgtagagttcatatagaattctcttagcccctgagagtattgaaagtgttaatgttggggtctttgagtactttttaaaaattttggtaagaggaaactgtaacaagttttaagtcaaaaatgtacaaaattatcaaaaaacaaaacattcactgtaccaataagaaggtaactgtaactgataagtcatactagaaaaattaaagggctgcaaagctgcagggaaatggttagagaggccttagcacaattacactatggattgtggaatttttaattttttaacttgtgcactatatatgtgcactacaatt

SEQ ID NO: 13274 - DNA, 1027 bp, Homo sapiens
ttttgtatttttagtagagacggggtttcaccgtgttagccaggatggtctcgatctcctgaccttgtgatcctcccgccttggcctcccaaagtgctgccacaggcgtgagccaccgcgcccggccgaaagactgattctttttatctctcatttctgctttctctggaaccagcttcattctacagcaggctacctaccccatgcggccacaagatggcttccagcaactcccagagcctaggggtggggttggggctgcttccagaaatgcactcagaagagaacaacttttctcgttagaccgcatttagctcttttgggctacttttctatctgtgaaccattaactccagcaaggcctagagattacctcaggcctgatctatgtgccccacgcttggcaatgggactggattggaggcagaggatatgcatctgaaagtcaagatacttgccaagaggagagggagaggtgttggtgatgcaaccagaatatccattacagtaaaccaattgtcagagctacaaactcttcgtttaatagtcttcctatagtctcagtcttgtggagccagaagtgaacaaataaatagaagaaagaagggaggcagaggaggaaggaagaagagaaagagaagccagagtgaacaattaaaaacagaagaaggaaggaggaggaagggagggaggaagaagagagagggaacactgggcaaaataattgataaaatgtgctttgaaggagaggtcctcaggcattccctcagggcctattatgtacattttcattattagcccacagatgttaatagttgggtctagcagtggtgttttggtttttgtttttgtcaggcctcccatgctgtgcatcataattaactagaagtgggtgagtctgggcagtgctatttttttaaagatctccaaatgattctaatgtgtgtcttaggttgagaaacagaggaagcccatggcagttttgatgcgtttgacagctgataataagggaagaggcagcagaact

SEQ ID NO: 13275 - DNA, 1050 bp, Homo sapiens
atgttttctatctttattttacacctgtaacctcaacatcaatgaattcttatgtcgacttatgtcaatcagaggcctcttaataacctctctacatgcaatattttactcctatttccttctaagtctgtcaccactacaactaccttactttgggtccatctttctcatgcaggttattgcaagagcatattcatctgtgtccttatctgatgcctaaatctcttgtcaaagcacatactgcaagattattcatgtcaagattccagttagataaatatacaaatttctttaaaattattctgtggtttctagattttaggataattttcaaatgtctttactgaacaaatcaaatctcttgactctttttcttgctctgtgttctactgtctcatatgcaatctctacttaagccattctaattaatatccagtttttggggtcctggtgttaacttaatgcttcgtccttctacctgctatgttttcttaagggaatattctgacccctcttctctgctgaagaatcttcttgatggactttgggacttacctcaaaagtaatcaacctcttctgagaaaatttcccaggtctgataggctaattcaaaagtcagttctttcctttgctttcacagcacttgggcatacatttatgagatggttaacaaaccacattgcaatcactggtttttacttttccccccgtagactatgggttcaatgtgattaaggactatgttgtttatttctgcactctgagcacaaaaaatatagtgtctgatacataggagatgatctcaagtattttgaatgaatgattaaatgagagaaaagttctgaggtgtggtttagcaactaacccgttaaaagctcaatgaataggtagttgtgagtatagggtgatcataagatcacataattcaaggcagggcaacatgcacctatttcttttagtctgttgacaacttgacaatactaatgctactacttcttttctctcctctctatatcttagtgaatcttaaaatattaaagtatataaatg

SEQ ID NO: 13276 - DNA, 1333 bp, Homo sapiens
caacatcatgcttgttgactttgttagaactgacattctcaccagtttgatacttgcgggtacgtaacaaaggtgcagaatacaataatgtaggttttattttaaaaataaagaaaatttgttgccccctcaacggcgcggagaccaggggcgacacgcggcccagggctggcaagttcagggcgggcggctggggactgacgcgtggcggtgggatgtgaggtgggggcgggacctggcctggtgcctggaggggaggagtccaggcggcgcctcggacttttgctcccacaagccctgcctcgaaggcggggaagctgggccaggagcagcccagagcgtctgagttgccgcccagccagggctcctgcgctccccagaacggtgggacgcgggggtcggcagcctccagctgaacatggcgccctggacgctgtctcgctgctgccactgcgtcatgggctgggtgccggtgctcctcatcaccttcgtggtcatctggtcctactacgcgtacgtggtggagctgtgcgtgtttactatttttggaaatgaagaaaatggaaagaccgtgttttaccttgtggctttccctctgttttttttatgtttgtatggtcctattggatgacaattttcacatctcctgcttccccctccaaagaattctacttgtccaattctgaaaaggaacgttatggaaaagaattcagccaagaaagacaacaagaaattttgagaagagcagcaagagctttacctatctgtaccacgccagtttcaaaaactatcagatattgtgaaaaatgtcagctgattaaacctgatcgggcgcatcactgctcaacatgtgactcatgtattcttaagatggatcatcactgtccttgggtgaataactgtgtgggattttctaattacaaattcttcctgctgtttttattgtattccctattatattgccttttcgtggctgcctacagttttagagtactttataaaattttggacgaatgaactgacagatacgcgtgcaaaattccacgtactttttcttttctttgtgtctgcaatgttcttcatcagcgtcctctcacttttcagctaccactgctggctagttggaaaaaataggacaacaatagaatcattctctgcacccacattttcatgtggacctgatggaaatggtttctctcttagatacaataaaaattggagacaagtctttggtgatgaaaagaaatattggctactttcaatattttcaagcttgggtgatggttgcagtttccaactcgccttgtagggatgggtccagaacaagcttctg

SEQ ID NO: 13277 - DNA, 1755 bp, Homo sapiens
cacagtgcttctgttcttactactaaatgatatattgtctgcaaaggtttataaagataatcttggtgtctcttagtacatagatttatcatatagaagaatggaaaagagtgggaaaatattataatttaatttaataatataattcaatgaatggttatggcttctaccaaggatagtcaatatattcttcacagagcatctcgtttcatccttagaaacaagcagtgtctttcagtatctcttcttacatattagccctctacttcaattcttcccatccttttcatgccaccatccacacagaaaattgtaactgaaaagcataccagtgtaagcaggtgagtcttggccatgtaggtgaccagtcctgaggtcccctctcctttgccaccctgcaaaggctcaacattcaggccacacctatacctatatgcatcatactggtgttcagtggtatgctggtcaggatgctctcccctgtatgacttcttagaatcttgtttgatctgactctagagtatttggccacagtgatttttacagtttccagcaatcacctgagtatttcatgttcttgaagtccctctgatgaagtagcaaaaggtttctgaatgcagtaatcctagttcagagcttacttgctatttgctaagcttgttatgtgctgccattttgaccatgataagatgaagagaaccattgataagatgaaggccattttgttatcctcaaaatggctactgttcaagctgggatatgtgggttgacactgtagtttattttctcatacttctcccacttgaaaaatctacttaatttctgaaatgtatacattctcatataagctttattaagccatgagcaagtctatatgtgaaaaaaattcacaccatggaatactatgcagccacaaaaagcatgagatcgcgtcctttgcatggacatggatgcagctggaggccattattcttagcaaactaatacaggaacagaaaaccaaacccctcatgttctcacttataagtgggagctaaatgatgagagcatgtggacatatagaggggaacagcacacactggggcctggtggagggtgagaggagggagatcaggaaaaataactgatggattctagacttaatacctggatgattaaataatctgtacaacaaaccccagtgacacaagttacctgtgtaacctgcatttgtacccctgaacttaaaataaaagttaaagaaaaaattctgagacaaaataattttaaattgtaaaaaaaaatatgtcttaccaatttactgatggaaggcaaggattctttcctgtaatggaataaagaagtggtcctagaaagctaactgctgagtccttggcaagtatatgctttgtgcttggacccaaaattttatattaaatcttgtagctgagaagtttatataacagtaattgcagattgtatcaaagtgaaaaaaaaattcatttggaaaaaatgttatattgtcagtgttttatttcagagttaatatttttgactgtttagaactgtgaactatcctcatctattttacagtaaaagttgattctaaaattattgccatgataaacttgttataattgaagagaaaaactttggacaatttttagatgtatgttgaattaaatacttcttaatttgtattaagggacaaagtttatcaaatttatattgttaaaagcaatttaatatcaatgtaagtcttttgaaataaagtat

SEQ ID NO: 13278 - DNA, 1030 bp, Homo sapiens
atatatttaattgtaagtttacataattttatttttaatattggttttaacaactggtgcacagaattcttgaaaatttaataatcagatcttgagagccagaacaaacaagccagcttcagtgccgtcattcatactggcctacttgcatgtctctgtcttaatatattccttcccttttcatccttttttttgtaaccccatcaaaaaaacctgggaaagaaatttaaaatactttgtctatgattaatcctcttagtttagtttgcaagtttcaaatttaactggttgatttgaagtattaagattcctctttatatatactttaaatttcttccatttttcctttggtcatttgtattaaaatttttgcatacagttataaagttagtatatgacatgtttaataattacttggaaaaacacaggtaccgtctcacattttgggtggaatttatgcctaattgtatgactttaattttcctagtttttcactaaagatgtcatcgtaccctctccttggactgatcatgaagggaaacagctttcacaatgtcattccagtaaatgtgagtgtactaaaaatgatatgaataaaaatcaaaaaagtcggtgaatataaagcaacatatcatgaagtgccagtatatctgctttgtaagaagcttgctttaaaattctggataacatagaatttaactccttttagggttagaattaaaaatttgactaaaatttattgaattgttttttagctgttatactctgaatttaactttttcttcatgactattgtgaatgtcagttataatgatggttatagaggatccatagatgaagaaatagttggtattgaatatagagatgagttgttaatgactttagcagtattttgaaggttaatattttagataaaaccgtaaattgtgttgccttttgctaatttgctgatttcttataaaggtaaagaaaggatgaagacttaatatgacctctgggacagtgtattattgctgagtatctgcaaaat

SEQ ID NO: 13279 - DNA, 1050 bp, Homo sapiens
attttttaaaaatattaataccaagtgatatgagaagagtaaatttattttaattatgacagataaggcatattttatattcacattaactgatatttgtatggagtaggaaaaggtaagagcagaaaagaaattagcctgctctagagaaatcaatcctgctagagtcaggcaggattcatcactgtttcatgtggatccagtcccccaaaacatgcaaggtctggtatagtatttgcattctaaaaataaaatcatttttgtttttcctttatgtgatttaggggggataaaaagagtttagagcactggttttttttttgagatggggtctcactctgtcacccaggctggagtgcagtggtgtgatcttggctcagtgcaacctccaccttctgggttcaagcaattctcctgcctcagcctcctgagtagctgggactacaggtgtgcgtcaccacacctggctaatttttgtatttttgtagagataggatttagctatgttggccaggctggtctcgaactcatgacctcagttgatccgcccacctcagcctcccaaagtgctgggattataggcatgagccaccgcgcctggccttagagttcttttatgtatgcatttttgtgcttttcttttagaaacatgatttatagcaacatttttcatgaaattatacatttccaattttgcaatgtctctgacaacaggaaaacctgattcatttaacagatacgtatacttcataattagcactttggaaaggcatttgttccattcattgttgtgttctttgagctgagaattttgaaggaacttctttagaagttctgactttagtcagaaggggatagcaataacatctaacactaacgtagcattactatgtgccaagtcctattctgagacctttacatgttttactttgttgaatttttacagcaatcctgtgaggtatgtgtactgttatccctgttttacagatgaggaaactgagggtcagagaggttaagtaaattacctaaagtttctatacaactagtaag

SEQ ID NO: 13280 - DNA, 1158 bp, Homo sapiens
tctggagcaacttttgattctccaatttctaaaaatctttttttttttaaatctccttttttgaatttttgggcaatttcctccagtttatataataacctttctattgagttttttattttctacacttttgaaatgcgttcggtactaattttaaaagtctgcaatgtggctggcaaggctggtctttctactctccagcttgtttccttcattctctgtttaggtcccactagctttccaaagttttaaaaagccacgttttctcttgttacagggcctttttgcacatgctatgtagcatttctatcccattttacttagttaactcctatttatttttttcattgacaacttattgattacatcctcaagccttcccagatcacattagccaggccagacctcattatatgctttcatgattccatgcacattttgcattctttccaatcagaccactaatgcagcagtcatgcatgtttttatccccagtgcttattaaaaagaacccgtcacgtaatagccgctcattaaatatttgtgtaacaaaaacagaacgaatacgtaggttaagttcaaccagagggatggtatttactgagagtaacggggagccaggatttggaactctgaggaagaattgagagggatcaggtaaaggaagtacagcccctgaaggagactgaaaagaaccagccaaagaggagaaagggacacttagaaagcacagtgtcatgaagcattttaagcaggaaagaatggttagcattgccaaaataggagcaagcaacattgggcttgaaaaggggctaatggactaataagaaaagtaattaataactgaacagcctcaaggtgaatggaaggaaggttaaagaagaagtaatgaaataacgtgtgtagataactctggagtttagttgtgaagggaaagaaaatgatacctagagaagagcatcaaagtcagatctttttgtagtttgcttttttactttgtttttacttaacccatttatgcctaaggttgcaattttttgaatttttgcaatcagaccttggcgatgaccttgaacaacagggtataagtaactcccacatgcttagtgttccagtaatggaacacagaagaaacagcatacagcatttaaatgaaga

SEQ ID NO: 13281 - DNA, 1917 bp, Homo sapiens
gttgtgaatgaggccgacttgagtgcaaaagagtgtggatcttagacatgttgagtttgagagatctgttagatgtacagtcaaaggtatgtggatatacaggtgtgaactttagaagataagcattcaagagtcatcagcataaagacgatatttaaagccaggatgagattaccaaaggagagtgagtgtagggaagagaaggaagaccacagcttgagctccagggcacttcaacattgaaatgtgggagagagaaggaggagttaccagtgaaatagggaaattaagagaattttatgtccaggaaatcaaagggcaaaagtttgtcaaggaaaagagagtgatcagctgtttcaaatgctgttgataggtacagttagatgaagactaagaattgacattgtatttaacaaggtcattgaaaaccttgtcaagagtagttctggaggagggatagggtcagcagtttgattacagtgtttgagagtgaatggaggaaataaactggacatagagtatagacaactctttctgagtaatactactgtatagaggaacaaagagagttggcaattacaggaaacatggagccagggaaggcttgttttttttttgtttttttgttttgttttttgttttttgtttttttccttaagagagatgacagctgttgtatttaaaatcacattgtaaccataaaaattttctcattgtcgacaacggtagaaggacattcatgtaattgttaaccaacagtgtaggtagtactgttggatacccagttatagttatgtttaaggctccccactttagtgctatccgtgtaataaaaagagtcatgtatatttggggtattgccaatagtatgtgtttctgtgattatgatatttggggaaactactagaacagaggggtgtttgttgattgaattactcctgattagttctgtgggactttcttaatatctaaatagtggtttaaagaataataatttagtaaagtgagataatttatctcttaatagctagagttttaattatgtcacaaaaagttgagtttcgatttaaaaaacaactgaagaatatatttataagtgagtaaggaagatagagaatgttatgaccactagaggagggtttacaaaaagatctgggttatttaaatgaggctgggggaggttgaagaggtgattggacactgtcaggttactgaggttcaattgtcatcagtgagaaccattgtctctagacttttaaaactaatcacaaacccctaatttatgaaagtgctaaatgaaattgtcagtttttcatttgaagttttctgttttttcttctgttacttggaatgttcttatctgagtgttttttgcccagtggtatttcatgtttctttcctcttcagtctgtgggctgcatatatatacttattgttggcctgaagcagacaataaaaacagagaaatgcccatcatatccaaaggaagtagcaagaaaatttcgacttttccaatggtgtcattaattttaagtttcttgacccaaaagagtaaattttcctcttaactatagtgggagaaaaaataatatattttcctcacccattgcaaggtttatggctgagactccaataataaaagagtaataagagaaaagcataacaaatttatgtataatttatatgtataatttaatataaattttatgtgacatgggaaccttcagaaatgaagactaaaagacccagggaaaatgtatttttgtggattgtcatgcataagtatgattggaagacaaaagtgtatgatctgatggtaatcaactgggagaatttagcaaggcttgtttgttcacattcttcttgggctgtctgtgacattccttcccattaggtatagggcaggacgcctgtcac

SEQ ID NO: 13282 - DNA, 1268 bp, Homo sapiens
ggtccatgatatatagctgcaaccaccataaagttactaaattttttcttttttgagccagagtcacactcttgtcacctaggctgcagtgcagtggtacagtctcggctcactggaacctttgcctcccgggttcaagcgattctcctgcctcagcctcccaagtagctgggattacaggcacccaccaccacactcagctaatttttgtttgtttgttttttgagatggagtctcgctttgtcgcccaggctggcatgcagtggcacgatctcggttcactgcaagctccgccttctgggtttacgccattctcctgcctcaacctcccgagtagctgggactacaggcacacgccacgacgcctggctaattttttgtatttttagtagagacggggtttcaccatgttagccaggatggtctcgatctcctgacctcgtcatccgcccgccttgacctcccaaagtgttgggattacaggtatgagccaccacacctggcctgaagttactaacttttaataagacatgatccaaatttttcatatgacattattcaaaagatcttcataaagtgattcaacaaatattttattcttcaactcatacttatttaaggttggatattttaagataaacaacattagtcttattaatgactttatgtaattttaaagttggatacaatataagctttggggaaaaaaacatgactagatggtattcacccaagaattttaagggacttaaaggatgaacctgaaactgcagcacatgtataatattgctatcaaacagagcacttgaagtaggtgtaattgcttgaaagctggtaaattgcctgcctgagtctagaaactaaagacctccacacttaaaactgataaagcactcttttatgcttactgagcttgtgtaatgcatgaagattaggatcagtgaatacttaggcaagttaaatacttccccttatgggggaaggtcaacagagtggtacaaatggacaaattatatttcacatatatataaagagaaaatagagaacaaattatatagactttcaaaaagccattgacaggttttaaattctagcttttaaaaattggcaggcttttaaaaaattacagtgaataacataacattaaatttaagactttattttcatgtatacaattcagtaaagaatactcacattgtgcaacagatctctagtacttttgtatgttgcaacactgaaaactacccactagacactgattctccctc

SEQ ID NO: 13283 - DNA, 1064 bp, Homo sapiens
catttttattgtatttgtcttatcaaatacctctccatctatccatctgccagtcacatttaattttatgggaaaatgctgaacttttttttccatttgtcagtaatttcttccttttcattactgagtggtattacattgaatggctctagttatttaccatttaatgggcatttgagttatttccgattcagagactttacaaacaaagctctgagaacatttgagtatggttttttgtgtggacatgttttttctcttgagtaagtacttaagtgtggaattttttacttctagaatttcagtttggttatttattatagcttttatttctctatttgtttacttattatgaacatattttcctttacaccactgagaattgttaaaataggagctttaaaattcttgtctgctaattccaaacactgggtcaccttggagttgatctctgttgattgtcttttcttttagaaatgggtcacatgttcctctttcttcagatgtcaagtaacttaaaattgtttagaccatcgagtaagtgtagatgagaacattgtgagtattatgttgttgagactctgcattttatgtacctctaaacggtggtgatgttcttgttttagcaggaaattacttggttgtactcaaacagcatactctgtctattgggcaggtgttcaaatttcagttcaattttttttggtattattggggctgctcagagtctgtcctacacatatgttgtttagagggtagccagatacttaagcagaaattacccagagaattcagtttcccctctctggctatctctgaaatttcctcctcatttagagcagctgcagttcccataaataccaaagattttctcatgcaccttgatccatccaacctggcacagaatgggactggcctcaggctaagggctactaaacaaaaacaaaaaataccaggaaactcacctaaatgctgaaaatgatagcaataatgacaactccatagtggtttactaagagaaactaaggtatttgttaggcatatctctgagttttgagaccagc

SEQ ID NO: 13284 - DNA, 1077 bp, Homo sapiens
ggaaagaaattaatacagtcaagcttgaaaagtaagatggcatcactgtggatactttttgtttctacatgtatgtaggtagtcaccttagagcaaactgttactttactgcaaaaggataaagaatatcttaatcgccaaaacatggagcttagtgttcgctgtgctcatgaagaggatcgccttgaaagacttcaagctcaactggaagaaagcaaaaaggctagagaagagatgtatgaaaaatatgtagcatccaggcaagatttgcattatttcccacgtaaatagataccaattaacagattttctttgagggaactcttggctttggggaagatttagtgatttttttaaggtctattctatatgataatactaagataataccttattttattttattttattttattttttgattttgacatttctgctttctgtttgcatacatttaagtggtgtaattttcccatgtgcctttattttaaaactttgtcatttggttttaggtacgtttcttgaatacagtaatgagctgatgtatccattaggataatttgggttgcaaataatgcagaagggtttaaaaaatgaagtgagatatgtttgcttttttttttttttttttataaattatactttacgttctggggtacatgtgcagaatatgcagttttgttacataggtatacacatgccatggtggtttgctgcacccatcaacccgtcacctacattagatatttctcctaatgttatccctcccctagccccccactccccgacaggcgccggtgtgtgatgttcccctccctgtgtccacgtgttctcattgttcaactcccgcttatgagtgagaacatacggtgtttggttttctgttcttgtgatagtttgctgagaatgatggtttccagcttcatccatgtccctgcaaaggacatgaactcatcctttttaatggctgcatagcatatatattccatggtacatatgtgccacattttctctatccagtctgttattgaaggacatttgggtcggttccaagtctttgctattgtgaacagtgct

SEQ ID NO: 13285 - DNA, 1020 bp, Homo sapiens
acttcataaatgaagaactgccccttttgactaaaactactattaaaagtaaaacttcagacacattaaatttaaagtttaattgagcaatgaacaattcgcaaatcaggcagcttccagaatcacagcagattcagagagactccaggggtccctcatggtcagaacaaatttatagacaaaaaaagtaaagtggcatacagaaatcagaagtgagatacagaaacagctggatttgttataggttggtgtttaacttatttgaacactcagcagtgtatgaatggttgaagtatggctgctggggttggcccagactcagctgttgttacaggcacatacccccaagttaggttttctatcttgtctgcctattaagttaggttgcagtttgtcaatacggactcaaatatagaagtacggagtccttcttaaggccatatttagtttgcattaacactatgaactaaggaaggaaaggaaattgggggaatgaatatatagcatatataaaagcctgaaagtaggacaaaaaggacaaaatgaagctttttgaacaaactaattcggtatggctgaaggatagactgagaggcagggagttaaaagagatgaaacagaagcaggaaatgggcccaaagaatgcatttggaccattatgtaagacctgtggggaacaattgaaagattttaagaagaggcatgaattgatctgattttatatcaaaagatcactgtaatgtagagaatagattggaatggcataagcctgttagacagagagggtctacttttagaggttatttccattatccagatgagaggtgataatggaactggattagtatcagtaaagatgagagaaatgggccaggttggaaaagtatttaggagacagagccgacaggactcagtgactagattggattggttggatgagaactcgttaaggatgtcagcaaggtttctgaattaaacagctgcataaatagtgatatagtttttaaaacattagaaaat

SEQ ID NO: 13286 - DNA, 1033 bp, Homo sapiens
tggtgctctacaaaagataatagaggtattcatgatgctcttgatgcagtacagaatctggaaattgaaatagctttacaattgtttgaaagggggtaggcagtagagaaaaagagattgaaaagatgcttttaagtgcaacaattagtattgctttagtgattttattttcctgccgaatcaataaaaaccatcttgaccacaatttatcttccaaaagtactcaagaagaaactttaatgatataaacttgaaatttatgtagaatcttagagtgatattaaacaactttgaatcttgaatctatttacaaaggttagttgagtatatgtattgtattacaatggtgaatttaactagtgtacagaggttccagtcatcattttaaaagtgtatgtcctcattagtgcttaagcaaacaaacaaacttcttttgttcatatcttaccaggtatctgtataatgttttaagttcttccatggaaaaatttaatagtaattactttgtcttttcagttagataattcttgaagtatatggctctgcagataactctctcagcatcttctcaaatattttaaattaatttttattatcagttatcttttattgttaactatattctttactccttagatgtttacaacgtgtgttcactgcttcattaataatacttaaaaatttcaagctctgtagggtgttccagatatgaagcaaggtaagttcaggttgcataggaatttagatatacctttgtggtgtaattcgttgtgtgttaggagaggctggtaaagtaagattgggccagattttaaaggttctgttgtcagtggggaatttccagaggttttatagtaggaaagaaacatgacttactcattttttataactacggttgcaatgcggggtggattatagttgaagaaagcctagaagcagggagatcacgtaggaggctgttgcacagcttaggtgatgaaaataagtagaaagagaaaatgatggatgaatttaaagaatacgtaggagaatt

SEQ ID NO: 13287 - DNA, 1054 bp, Homo sapiens
ccaccgcgcctggcctaatttctgatcttttacagatgtggcagccctgaccaagctcaaaagtgcttatctgagatcacacagctttttactagagatgtttctctgctgtgccccagatttcactccacttagccctcagattagtagaaggaaccctaagctgctaaagcccctccaacagtcttctctgttttccctaggatgccattaaaaatagtatcactttcattttatacaataaaaactttgaggaaacattgctgtaattatcaacctttaaattaacatcacgttttaatttacattttcatatttaggtagcatagtaagcatagttactatttattgagtacctattatgcgtcaagcattgtactcaacactttacatacgttgtagaaaaagaaacacattttatgaagtttaggtattaataaccgtattttacaagtaaggtaattgagacatcaactgtgacttgcctgtgattattataaacatttgttggtaaaaactagatacatctgactctgcaatgcagtgcacactcccatttaactggtcagtgctatgtaaactgatcaaagatttcctatcaaaactacaattttgaagttaatttacttaaaatagaaattctgtctttttttattattatactttaggttctgggatacatgtgcagaacgtgcaggtttgttacataggtatacacatgccatggtggtttgctgcacccatcaacccgtcatctacattaggtatttctcctaatgctctccgtcccctagcccttcaccccaacaggccccagtgtatgatgtttccctccctgtttccatgtgttctcattgttcaactcccacttatgagtgagaacattcagtgtttcggttttctgttcctgtgttagtttgctgagaatgatggagaaactctgtcttttaagagaatttgcaaacgacattccatgcttgagggctgagtatggatcattagagctttataaaagcatctgtaattttatttacacacacacacacacacacac

SEQ ID NO: 13288 - DNA, 1047 bp, Homo sapiens
tggtcactcgcatagttatgctggcctcctgttcttttacctgtaggtgtgctcctacctcaggtcctttgtattcagtttccactgcataaccatctactcctgatgatacacctgttcttgtggtcttttctgactttgttctatgttgtctttgtttttaatctatcaacatactacatatttatttactttgggtttttttcctactagaatgtgatctccatgagagtaggagttttcatgtatcgttcagtcctggactcccaggtaccagtgcctggtacgcagtaaacactcaatatacgtaatatttattgaatgaaagaatgaattggtactactttttagaaattaggtggctgttggtttagatgaaaacctactcaaaggtttataatggatttgatcaggactgagtgtcgtttgaagatatatagtagttactcagttaaccatctaccagattcattctgtttcattttgatatgttaccttttatcctgtcagctactttgtaaatcttaacacattaatggatttaagcaaatattttgcattttggtacttcaattttttataatttttcaaccataatttgggttcaatgtttatctactttgtgcttaagttttcatatctagaaacaaacaaaaatctgcttgagcaccaattgtcttcagtccattttatgctgctataacaggatacctgagactggataatttataatgaacagaagtttattggctcacaggtctggaggctgggaagtccaatatctacgtactggcatctggcaagagccttctcactacattatcatatggcataaggcaagaaggtaggagacagagcaagggggagccaaactcacccttttataatggcaccattcccactctcatggcctaatcaccattatcaggtcccacttcttaatactgttagaatggaagttaaatttcaacatgagttttggaggacaaaaacttttaaaccaaggcaccaactataataaaaggttaggaaagtgtagcattttca

SEQ ID NO: 13289 - DNA, 1048 bp, Homo sapiens
ccagtatgttatacttagtaaacagtatatgaagcataatatgtgtgaagttgaacatcagtaggtatatttttgttctcaaatatacacatcaaaaacaacacaatttaaaactatactgtattaatttcatagggttgcaatgataaattgccaaaacttggtggcaaaacaacagaaatttattctccattctagaggccagaactctgaaactaagatgttgacatggctttactgtctcctaaggctctaggggtaatcctttgcttgcttcttccagcttctgggggcctccaggcattccttggcttccttggcttgtaaccgtatcactctagtctctgcctctgtcttcatgtggctttctcctttgtgtgcctcttatatggatatatctgattgcatgtacggcacactcagataattcaggacaggtctctcatctcaagatgcttaacttaatcacatctacaaagactctttttccaaataaggtaatagtcacagcttttgggagttaggacatggacttctcttttttggcagggttgggggcaccattcaacctaccacatataccttttaattcatgtgaattatatttacttgagttcttcaataaaggtaacattttattttgaaatgatttaactaaaattttctaattttaggagttactgaaattctatgatatttctatggactatctttcaacctactagctgttgaacaaaatcataccttagagattctagaatctgccatttgatctatgacatacatttattatgacttaaaagtcttcctgtgtgacttttaataacattctttaagaacatcatgacagtgacattaagattaaagaaacagtagttatacatttttaacagatacagtataaaaacctagctttagacaagctatgttagcttcatttaggccatttaattgctagcaattaaattttgctctactgtgtttgagatcctttagatttgggatgctcttataatgactatttcatgttttattttcgttccttatt

SEQ ID NO: 13290 - DNA, 1060 bp, Homo sapiens
ccatggtgggaggatcactagaggctacgagtttgaaaccaggctgggcaacatagtgagaccccagctctcccaaaaagtaaaaaaaaaaaaaaaaaaaaaaagatgaaactacttcttccccattattgtctgtaccctaactaaatattaagcattccacttgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaagtagaaataccatttgacccagccatcccattactgggtatatacccaaaggactataattcatgctgctataaagacacatgcacacgtatgtttatcacggcattattcacaatagcaaagacttggaaccaacccaaatgtccaacaatggtagactggattgagaaagtgtggcacgtgtacaccatgggatactatgcagccataaaaaatgatgagttcatgtcctttgtagggacatggatgaaattggaaatcatcattctcagtaaactattgcaaggacaaaaaaccaagcactgcatgttctcactcatggatgggaattgaacaatgagagcacatggacacaggaaggggaacatcacactctggggactgttgtggggtggggggagggggaagggatagcattaggagatatacgtaatgctaaatgacgagttaatgggtgcagcacaccagcatggcacatatatacatgtgtaactaacctgcacattgtgcacatgtaccctaaaacttaaagtataataataataataaaaaataaataataaaaaaataaaaaataaagcattccacttataagaaagttattagctctgatcgcctctctttattcttatgtatgagttttcattccacaagttttagacactgtttataaagtataaggtataccaaggcatagctaaaggttgtggctacttaaccccccacctc

SEQ ID NO: 13291 - DNA, 1031 bp, Homo sapiens
ataccaaggtatgtagacattttctggaacttttaaactttctcattttataaacagctgtagaaaataaaaatataattataacataatatgtgtttactgagtgcctaacataagattatatttactatctatttgtttgaacatcccaagatagaatttaacagaaatactaacaagtaattatttggtccattaagtctaatgagagaaataagaggtggggaaatagtgatttagttcttattatgtgatttagttcttattatgtcttctatttatgtcttctttacttctgttttgtatgccctcatgataaactttattacattcttgtaggtaggctagtgagtcacgcatagattcctaaaattgtgtataaaatttgtaataattttaacttgttacagaactcagatagagcctgtcatatcacactacttttgctcccttttttgcatttcttttttgtaagtatttttagaatgttgtcatgtctccttctaccaccttagccattatccacactgtatattttttggaagtttaatcttttttgtagtttggacatacctaacctataatcattttggcttctcttttcttcactctctgtaatttgttttcatcttttacggacacctaaacctggaaacaataatcttaattcactggttttttcatacttcagaagagactgcccctcatcaaattagtatttaatattttaatgttttctatcctggcttgaacctatttagcattctaattttataacacctaaaaacctcatggttactatgactccattcattcactcagtaagcattaagagttagtaatattctggatataccattatctcattaagagcttataatatgccagaatatttactagatcctaggaatccaaagatggattagacaagattcctgcactgaagtaacttgtattttaattgtacagtgtgttgttgtgagcattttacttttgttagctcacattatcatccagaactcaacatgccc

SEQ ID NO: 13292 - DNA, 1051 bp, Homo sapiens
aataattcccgtctcaaggggtttctaatctactgagagaggtgaacataataacaaataattagagtagcaagataaatgctataagcaaaaaatatgcagttctcagtggaaatacaaaagagatcattaattaatcccacctttaaaggaggtgaggcatatctaagagaggagatgacactgcaattagtcttttcttttttcttttttttttttttgagacggagtttcactcttgttgcccaggctggattgcaacggtgtgatctcagctcacctcaacctctgcctcccggtttcaagcgattcttctgcctcagcctccgggtagctgggattacaggcatgcgccaccacacccagctcattttgtatttttagtagagacggggtttctccatgttggttaggcggtctcaaactcccgacctcaggtgatctgcccgcctcgacctcccaaaatgctgggattacagacgtgagccactgtgcccagccttggaatgagtcttgaagtacaaataaaaattcatttgagggtactgtgttataatctttgatctttaatttctgttttccttttttcttgttttcccctcttgttatcttcctgtcttatccctaacgttaataaatattttaaattaacatttcaccattggctgtgatgtttgctacagtacattatttgtgttcaaaagtcagataaccatggcattcttataaaaatgggtttaaacttcagttgaagttgaatttgaatctaggtagggttctaattattttaggcacatttttgcataaggactgtatttacttgtaggccaaatgtaagaaaaacttatttctttcctatcattgtcctatttcccatttccaaggtcaatgtctgataactgcaatagattttaaatttatcttcaatttcttcactggagtcaaagtaatctttgtaacattcaaattttcatatcatatgctggctttaatgacttttattgtcttcattaagacaataaagtcaaatttctttacatgacttcatgat

SEQ ID NO: 13293 - DNA, 1058 bp, Homo sapiens
atatatctttatatttcttttcattaaatcttaatataatctcttatatccttaataatacaatcttaataaatctgagtataatcttttaatgaaagattttatattatcttttgttcttttctgtgtatgtgtgtttgtactacattagtgggctaaatgggtcttttagggcaactgagaactttaataccatttctaatatatgtgtgtatatatatatatacacatatatatatatatacatatatatatacacacacatatatatacatatatatacatatatatacatatatatatatatatatacatatatatatgaggaaatgtgttttactgttcttacaactgacttagaggtgagtttttaaaatgtgaaccccatatatactggagaccaattgtaccatgttgtcttctacattattatcattatgcatcataaatgacatcaacagtcatactaatactcacggtccttcccgtcaccatcaattctcagaaagtttttctcagtaaaattgtactataaactagtaatcaaagcactgtagagtatatttgtaagcaatttgaagataccttagatactttccttctatttagagttgattttccttacttggaatctcccagtcaaaatcagggaaattcctttttgaagaaagtagtcctggtgttaaggcttaagcactagcataccaagaatttcttttttttgagatgaagtcttgctcttgtcccccaggctggagtgtgatggcaccatctcagctcattgcaacctccgcctcccaggttcaagcgattctcctgcctcagcctcctcagttgctgggattacaggcgcctgccaccacgcccagctaatttttgtatttttagtagagacagggtttcaccatgttggccaggctggtcttgaactcctgacctcaggtgatctgcctgcctcagtctcccaaagtgctgggattataggcgtgagccacctcacccggcaagaatttcttgagtcagtgttttatgacttatgatatttttattggtaagcg

SEQ ID NO: 13294 - DNA, 1034 bp, Homo sapiens
gctcctttcacttagcataatgttttcagggttcgtattttgccatctatcagtgctcagttcctttttatgactgaataatattccattttgcagattaactacattttgtttatccatcagttaatggatttttgtctgttttgaatagtgctgctgtgaacatttcatgttcaaattttttgtttgaacacctgttttcaattctcgttaagtggaattcaagatgaaatggtaattctatgattcacttttcaagaaactgcaaaactgtttttcgtagtgactatgccattttacattcccaccagccatttcaggggttccaatttttccacatcctcaccaatgcttatttttcatttttttaactctagccatcctggcaattacaaagtagtatcttctaatgattttgctttgcatttctctaattaggttaataatgttaactatcattttgggttcttattggccatttatatatcttctttagaaagatgtctgttcgagtcatttgcccacttttgaattgggttgtctttctgttgttgagttgtaagagttctttatatattctggacactagacctttatccaatacatgatttgcgaatattttctcccattctgtgtgggttgtctttcctccacttgttagtgtccttcaaggcacaaaagtctttaattttgataaaatctactttatcttaggtgtcttgtgcttcacctttggttttgtgggttttttattgaggtgaaattcacatgacataagattaaccattttaaagtaaaccgtttaatattcattcacagtgttgtacaatcactatctctatctagtcctaaaacatgttcatcaccccagaataaaaccttgtacccattaagcacttaatacccactcctctttgcccccaccctctgacaactgccaaatcactttatttctgtggatttacttcatctggatatgtttcatataaatggaatcatacaatatgtgacgttttgtgtctggtttctttcac

SEQ ID NO: 13295 - DNA, 1031 bp, Homo sapiens
gaaaatgaaaaaaatctgaaaatatgtcatgcaaaggggacacaaataccactagtcatggattagcaatatgaaatgagctttattggtataaagtaagtacttgaagtaataaaacatttatctctgccccttgagttgcctgacccattcttctgcctctaacaactgctaggagtgttcttccagcatccccagtgagctcagtctcttggaaagagtctgtggcacatacaactcacaggaccacacctcaacattataaaggaggagactcacatacctaccatgtggccctaaacaatctagatctgattaaatttcaaggtcaaccatatttctaagacttcaatgatgtaaaaaaaaaaaaaaaaaacccactgttttgtgtaccactgtgaggaagagtggaggatgctgctgattaaactgtgatacaatgctttgctattactttaatttttttcattttagacatactttcttttagactttaggcagtgatttttgtcctatattgcacaactctgtttctgtgtttttcttctgtttcaatgccgaatcccttgtgatctttttagatacttaaatgacaattgtactcagcctatgaaggactagccatactcaaaactcaattgaagtaataatatgaacagccaagaccaattttttcatgcatgggctttatcaacagcaattataagatgtatgctattttcatagaagagattaaaaacagtatgatttatagggttcctttgcctttcaaaatgtttgtctgtttgttgatattaaaaatcctttagtaggctgggcacagtgggtcacacctgtaatcccagcactttgggaggtcaaggcaggcagataacttgaggccaggagttcgagacctgcctgaccaacatgatgaaaccctgtctctactaaaaatacaaaaatcatccgggtgtggtggtgtgcacatatagtcccagctacttgggagtctgaggcaagagaattgcttgagcctgggaggcagaggt

SEQ ID NO: 13296 - DNA, 1034 bp, Homo sapiens
gttccccaaagtcttaactctttccaacattaacccaaaagtccaaggccaaagtcttatctgagacaaggcaagtcccttccgcctatgagcctgcaaaattaaaagcaagttagttacttcctagatacagtgggggtacaggcattgggtaaatacacccatttcaagtgggagaaactggccaaaatggaggggctacaggccccatgttaagtccaaaatccaacaggacagtcaaatcttaaagctccgaaatgacctcctttgactccacgtctcacatccaggtcacattgatgcaagaggtgggctcccacggtcttgggcagctctgcccttgtggctttgcatggttcagccctgctcccagctgctttcatgggctggcagtgtctacaacttttcaggcagacagtgcaaggtgttagtagatctacagttctggggtctggaagacggtggccgtcttctcacggctccactaggcagtgtcctagtgtggactttttgtgggtgctccaaccccacatttcccttccgcactgccctagcagaggttctccatgagggctctgcccctgcagcaaacttctgcctgaacatccaggagttttcatacatcctctgaaatctagtcagtggtttccaaacctcagttcttaacttctgtacccctacctgcatgcccaacaccacgtggaagctgccaaagcttgagacttgcaccatctgaagcaatggcctgagctgtacattggcccgagctgtacattggccccttctagtcatggctggagctgaagcagctgggatgcagggcaccatgtcccgaagctgcatagagcaggggggccctgggcctggccccaggaaaccatttttctctcctagggctccaggcctgtgattggaggggctgctgtgaaggtctctgacataccctggagacattttcaccattgtcttggcaattaacattttgctccttgttacataggcaaatttctgcaagaggctcaaatttctcccca

SEQ ID NO: 13297 - DNA, 1049 bp, Homo sapiens
ccaatcagcaaggaaaaaggcatcagacctatagatgctgcatgaatgtaggtattcaggcaaaaagcaatcagatatctctagtatggaagaatggttgtgaagcatatttctttgtggataattagtcacatttatttatcatttgtgtgtgtgcctgtgtacacacacatcagtgcacacatgcgtgtgcctttaatacaccttatttatcttcgggtcgtaggggagagggattcttttgtgttcacattctgggttatttttaataattgccttattttttgttattgggaagcagtaacaagtattgcctgaacatgattctggaaccagactcactggattcaaatctcagctttggcaattactagctatgtaaatttggaaaagttttttaacttctttggtttcagtgtcctcatttgtaaaatgttaagttccaaataaagcaactttcattgaaatatttcctcagaaaatgcaggggtttatttttttaaaaacagattgtgtcttataatatctaaggggtggaaaaacaggacagaagagaaaaggtaacgtttaaaaataggcaaagacaatctgaaagggctacgtacggtatgattccaactatgtaacatgctggaaaagacaaaactatggagtcagtaaaacagcagttgccaaaagttaggaagactccaccatgcctggctggtgtcgtgcattctatggggtttagacagatgcataatgacatgtgtctgtcattatattatcacacagagtagtttcactgccctaaaaatcccgtgttctgcctcccaggctcaagcaattctcatgcatcagccttccaagtagctgggactacaggcgtgcaccaccaaacctggctaattttagtatttttagtagagacggggtttcaccatattggccaggctggtcttgttggccatgttggccaggcctcaagtgagccgcttgcctcggcctccccaggtgcatgagccactgcatccagctttaatttcttttaatttctttctttcttttct

SEQ ID NO: 13298 - DNA, 1049 bp, Homo sapiens
tataggtacagaaagatttttgaaaactctattgaaggaattaaattctaataaattatgtttatttcaaacatggaattagcatcactttttattcagagatatgtacttttttcctgacaaatgaaaatcaactttggggatttagaagcctacaaacaggtttataaagaaatgtatctgtaacactaacagcattattatagtatttattatccagagtaaggcggttataggttttatgttaaagataccttttgaaagtaaggcttctggcccttaactttgtttataatactaaaacctttagccgggcatggtggtgcatgcctgtggtcctggcgactcaagaggctgaagtaggaggatcacttgagtctgggaggtcgaggctgcagtgagctgtggctctgcactctagcctaggcaacagagtgagatcctgtctcaaaaaaatatatgtatatattaaaacctaatatatgtaactactttcatgaaaaaattgaactaaaataattgagactgctgctgtatattttgtgcaactaaaataattgagactgctgctgttatgttttgtgcaattgaaattagatttggtatgttttaaacagctcattctagacagaagttaactgaaattcataaatgttcttagttattccctgccaccctttccccacacacacacttgaactgttctgcactttgaaacacaaagcaacttgtcagttcagtttattcagtcagggtcagttctgtgaaaacaaagccaaggcaattgtttgatttaattgactagacaaactggttatacaggttagtagaacttagttttatttttgtccagctgcatatttgaatgttcataaagtaacttagtaaaataataagattccagtgacattgtaatatattttaaagaataattaccaaagcaaagaaaaaaaacattctaaaacccaaactatagaagctattcatggtatttttttctttatggctccactttcactataatgaaatgtgttcccccaaaaaagtag

SEQ ID NO: 13299 - DNA, 1049 bp, Homo sapiens
ggtgttcttgaactcctgacctcaaatgatccgctggccttggcctcccaaagtgctgggattacaggcatgagccaccacacccaacctgagcatttgaaatgtggctactgttactgaggaactaaatttttaattctattaaaattaaattgtttaaattatctttaattttatttttaattttattaaaattaaagataattttaattgccctagtggccaatggctgtggtattgcacagtacagccagtttcctcatatgtgaaatgagagtggtgccgaggcagacagattgcctgagcccaggagttcgagaccagcctggacaacatggcaaaaccatgtttggttttgtctctacaaaaaatacagaaaaatttgccagtgtgatggcacgcttctgtagtcctggctactcaggaggctgaggtgggaggatgagttgagcctgggaggtggaggttgcaatgagcaactgcactccagcctgggtgacaaagcaaaactctgtctcaaaaaaaaaataaaaataaaaataatgagagtggtcctaacagcacccgattgatagggttgttctgaggaataaatgatataatcttcataatatacacagatataatagtgcctaaacattatattcaacagtgttcaataaatgtttgccattcttagtacttaccatacatgtaacaaatttttggttgaaaattatattaaaaatgagaaataacatttctcaaaatatgttgaatttcaacaaaaattaagactcccttaataacagcaacggttttcataaaggccatgtcatttatggaattaattaccaagaaaaattttgtactaaacatgagtcctttaatgttgtcttgtgtttcataaattaattgtgtgatattttagtacattctgaactgataattcacaggatatgaaatcttattcttaattgaagcaactaccttctaaagtgaaaagttattaatactttcagtagtttaattacaacacttgagatgttgctataggtgtaccctggtga

SEQ ID NO: 13300 - DNA, 1030 bp, Homo sapiens
gtgagtctccatctcaaaaaaaagaaaaagaaattatctgagatctggaatatgtgttaatatatatcagggggaaaatctggtaaggaaatagataaaacagtgttgacaaaacaatcctggtagttcctcaaacagttaaacatagagttacatacaacccagcagctctatgcccaggtatataaacaaaagaaattgaaacatatccacacaaaaatttacacacaaaacttttcactgtttcaaaatgtgtcagtgtttatgagtgcaacattattcatagtaaccaaaaagtggaaataacccagatgtccttcagctgatgagtaaacaaaatttggtatatccatgcagtggaatatgattttgccatgaaaggaaggaagtactgatagatggtacaacatggatgaactttaaaaacattatactaagtgaaagaagccagtcacaaaaaaagcagacggtatatgattccactgatgtgaactgtctagaactgggaattctacaaggacaaaaagtagattgattagtgacagcttagaattagagtgatgggggcatggcaggataggagggtatagttaaagcaatcagagtttcttaggttttggtttgtttttgttttttgtttcttttgagatgatggaaatattttaaaattgactggtaattgttgcatgtgtctgtgaatatactaaaaaccattgaattatacacttcaaatggatgaactgtgtggtatgtgaattatatctcaggaacgctatttgagaaagaaaatattgacaaaatgttgataattgaagttgcgcagtggaaagtggggactcagtattctatcccctccatttttgtgtcattgaaaatttccgtcataaaatgctttattaaaaaatgcccgaccaggcactgaggctcatgcctgtaatctcagcactttgggaggctgacacaggtggatcacttgaggtcaggagttcgagatcagactggccaatatggtgaaactccgtgtacacta

SEQ ID NO: 13301 - DNA, 1032 bp, Homo sapiens
aggcggagattgcagtgagccgagatcttgccactgcactccagcctggatgacagagcgagactccatctcaaaaaaaaaaagaaaagaaaaaccacaaaagtaacttaagaaaatataggaaaaaaacatggagaagaccacagaagaaaagattgacatattctgctacatcacaatcaaatgttcttcataacaaaaaaaaaaaagcggggggggggggtcataaacaaagtcaagtaagaggtaaactggaaaaattgccactcatattaaagacaaagggctaatttccctaacatataaagagctccttgaaatgtataagaaaatgaccactcagtagaaaaatgggccaaggcaatcaactgaaaaaaaaccttcaatatattaaaaaaaaaaaaaaactgctcaacttcactgtaaaaggaatgcaaaataaacatacacaaacccttatcagactggcaaaaatcctaaaaggtaacagaagcttacattttatcaattataaaactaaagctcattgaactagattaggcagcctaagtttaaacaataataatgtcaagaatagatgtgtcgtttgctaatagctttatactaaaatagtaccactacatgtgcttagccaggtgcagtggctcatgcctataatcccagcactttgggaggccaaggctggagaatcacttaaggccaggagtgagagaccagcctgagcaacatagtaagacctcatctctaccaaaaatttaaaaattagctgggtgtgggggaatgcccctgtagtcctagctactcaggaggctgaggcggtaggatggtttgaatgaactgtgatcacaccatagcactctagcatggacaacagagcaagaccctgtctctaaaaaaaaaaaaattgaagtggaattttcttggttcaaatttaccatcgatataagttggatcattatataagccaaacataataaaattgaaaatgtgttctaaatgttatttgggtacccactgtagctgtattatcct

SEQ ID NO: 13302 - DNA, 1035 bp, Homo sapiens
caaaaatcaggctgttgcttagaatcacaagtactacccctgatgcttgtaaagggtgatgttgcctgattagttaaaagcatattattgcattactgtagtagaattctcttttgtcttgcatagtagaaaggcttgaatagactcacatgaaactttatgcccagacttaaatagaactgaaaggcttctgtcacagcagacccaaacattcattcattcattgaaaaatgtttattgagcacttactttgtgccaagtactattccaagcagtagagatataaataattcctgcctctgtggatcttacattcatggatagagatagactataaaccgacaaacaaaaaaataaattgaataagatgtgaaaacatgacaaatgctatggagaaaatgtatgaggtaactgagaagtcctcgatttgcccactttgcaaaattaataaatggctagaacctgtgctttaaccactgtactatacggtgctcaaaccacaaaaatcaaagaaggcatgacatcgaacacctactgctggcgagacacttccctgcatgctgaagatacaacatgagataagataaatggtataaactaagagtataagagtcagcatctttaggaattgtgtcccactgctagttcagcagctttagcaaattgttcagtctctcacatacaggcctggagataactatttcaggacaagtatgtggccctatgaagtcatcaggaacctagattccctcttcctttctcttcaaccatccttagagtgtggcatctgttcttagaatcacaatatggttgctctggcctcagccatcatgtctgcattttaagcgggaagcgagaaaaagggaggaaaatagtctccctttccaaaggagtttttccctaagtcctacccaacatcttcagcttatatcccattggccagaacttagtcgtgtggccacacctagcagcaaggaaggctgataaatgttttatacagggtgaatctattgctttactgataaaatcagagtt

SEQ ID NO: 13303 - DNA, 1845 bp, Homo sapiens
tatcttaacaacaaataaaaagctgagctggaaaatcattaacttttcttttttttttttttttttttttttttttttgagacagagtttttcactctttgttgtccagggtggagtgcaatggtgtgatctcagctcactgcaacctccacctcccaggttcaagcgattctcctgcctcagcctcccaagtagatgggattacaggtgcctgccaccacacccggctaatttttgtatttttagtagagaagggtttcaccatgttggccaggctggtctcgaactcctgacctcaggtgatcccccccaccttggcctcccaaagtgctgggattacaggcgtgagccaccacacccagccaacttttcttaaatacataagagaagtgaggtcacaaagcaaactgctgcccccaaaattggacagataggccaatacagagaatgatgatgtatcagagcaaaaaatcccatggatgggaaccagtgctggggtaggaaaacctgaatgtaactgctagaagttaggtatggacaagtctgaaagttaaaaactccagtcatagaaggaacccccacactcttgtgaattttaactttagaagcttgacctagttcttacagtaaatattgggagaaaaatccccttccgtttccagcagtgggagggaaaaaagaacattttgaaatatgttagagaactcagttctcaacaaggtctcccttcaggagaagctattttaactagaagctaccctgctggggctttatcaaagcctaactgacctgggaaaaactcaatacccaatccagcccacctagccatcatggcccacctaagaagggaaaaaaaactgagaaacgtgtgtaaagttcatattccagaggcacactctaactgaaagactgagacctaatcataggaccataggatgacttccctacccccacaccttaccaccacattaccaaaggcccatttacggcagtttctttttcccagtacagtatgtccagttatcaggaaaaacttaaccaggtagactaaaaaccaaaaaacacagtttgaagagacagtgcaagcatcagaaccagagtcaattgtgccataaatgttggaattaacagacagagaacctaaaacaactatgattagtatgccaagggctgcaacagataaagtagacagcttgcaagaacagatgggcactgtgagcagaaagatgaaaatcctaagaaagaacccccccaaaaaggagaaatactagagatcaaaactgcttataacagaaacgacaaatgctggccgggtgcagtggctcacacctgtaatcccaatgctttgggaggccgaggcgagcagatcacctgagatcaggaggtcgagaccagcctgaccaacatggtgaaaccccatctctactaaaagtacaaaaactagctgggtgtagtggcaggcacctgtaatcccagctacttgggaggctgaggcaggagagttgcttgaacctgggaggccaaggttgcagtgagccgagattgtgccactgcactgcagcctggacaacaaagtgagactctgtctcagaaaaaaaaataaatgacaaatgcatttgataacctgattagtacagtggacattgctgaagaaagaatctctaaccttgagaatatttcaggccaggcacagtggttcatgcctataatcccagcactttgggagtgtgagaggatcacttgaacccaggagttcgagttccagaccaaccttggcaacataagagaccctgtctacacacacacacacaccaaaaaaaacaaaaaaaaacaaaaaaaacactt

SEQ ID NO: 13304 - DNA, 1050 bp, Homo sapiens
ttgagtaataaacccaagaagtactctggtaaatacttagaaattcataagatctaaaacacaataatttggatacagtaattatttaataaatatctattgagtgaatgaatatctattatctatatagatgagacaactgaaaagaagtcatgtccttgatttttttataattctctttgaaaataaaatcaattcgtaaaataattgcatccccagaaaatcttaagtataggctttgagcaagaaaacacagttttttctatcatatacctaccaggtgggagattatttatggcaaaagacaaagtcttcgcccttaagtatcctttctgaattaagaaaagcaattttttagtatagcttacataaaaaaacctcaatgtatatagttctctgagttgcctctcttgtcctccttgtaagcattttattggattttctttttctttttttaaacagactaaaaaagaagcacctgagtggtctaagaaacaaaagatgaagacctagtgttttggatgggaagcacctgtagaccattatatactcctgaagttctttttctgatggaaaacaaaattcagcttaatcgtgtactcagcattttttaaataacaatgtttatttgaactaatattaaattaacaaattcagtgtaatcaaaatgtgtaaagaacaatcaatatactttatttttttttctattttataaaataaatatatatgctatgctttaaattttggagctttcataaatgttcaatgcattttaagtgtgtggcttataaatattttggtatttttctatactacgtaaattctgagtttaaatgtcatacacaaatactaagacactttgcatttttaaaaattaagaatcatttgtgaagtccactacgaggtacttcaaaagcccagtaatggtggtcagataccatgtagatggatacagattgttgactcttttgaagttgtttttttcttatattttatattaccattaaccaataaaatctggcagaaagtctgctattccattggtaaagt

SEQ ID NO: 13305 - DNA, 1025 bp, Homo sapiens
cactgtgaagtttccctctaggtggggcagggagtgaaggaagggagtttcactgtaagggtggaaggatgctgtaagaaattatgtcatcgtggcagttcttgtactaacagctctttctcgagtgagctgagtggcggatagaccataaatatattctatagcgagtgcttctgcacgtggaaaagcaaactgcactgccttcctatggcataagccacgggcttgttaggagagtgatgaaagatagaaaacaaactacaagaatccattccagagggataaggaaactaggggtaggtcaaggttagtatctagagtctggataccctgtgtggttaaaaaaaaaaaaaagtacatcaagcattggggggaaaagatgcagattttaaaaattgttgacagatatggagtagaaatcttaaggcaacttcctagctatgaaaaggaaaaggagaaaagagaaaaacaggtttagaagagagaatcacttcattgtgtggacttggggtgcgtgtaaaagagcaaaaacatttgaaataatacaaagcatggatgataacggagatcactagaggagtgtgtgtgtgtacacacgcatgcgtttccaaactagttcatgtaattctatctccatatagaatttagatttaaagaaaagtaaggtgtggacggaagggaagaagatagggaaaagtacactaccttggcaaaggtgcggatttttaatgtttagacctttttcctctctacctctgtgtttgcagagatgtgaaaagtcagaaaatgtaaagatggcaaatttatttcatccttaattcaagaggaccatgtaaaagaatgtgtagcgagaaagtacggtcatagaatttgggggttgaaagtatctgtcgaatccaatactatgtggcttcaatcctgtttaaaaccaagatgattttgataaagaatgataacccatttccctaactatatataaaaacttcatttacttagtcttagataaccaaaagaaggatgaatta

SEQ ID NO: 13306 - DNA, 1033 bp, Homo sapiens
tgaatactgaaaaagcatagactaggaagcttgcaggaagtggagaaaggagcaggaagtagttcgaagtgctttagtgaactataaatagaaccaagtaagaatggatataatgtagaggagcccattgatctcctcagccccggactctttttttttttttttttttttttttttgagacggagtctggctctgtagcccaggctggagtgcagtggcgcaatctctgctcactgcaagctccgcctcccgggttcatgccattctcctgccttagcctcccgagtagctgggaatacaggcgccagccaccacgcccagctaatttttttgtatttttagtagagacggggtttcaccgtattagccaggatggtctcgatctcctgacctcgtgatccacccgcctcggcctcccagagtgctgggattacaggcgtgagccaccgcgcccggccctcagccccggactcttatagggcatgtgacttgttccaagaatgaacctaatctttgctgaacacattcttctaagaaagtttttataaatcactacgtttcttattaaacatacctagaaccttatttttgaccaatgatatcattagcaagtagattatcttctacaagcagagaaatgaagggataaggatagttgccctttaaacaggaaggtcttgtcttacaaaactcaaatgcatgtgagatgaatagcactgtttatatacgtgtcatggcttccactggttttgcaagacctcatttgatgatctaagtacatgtgatcattcttcagggagaaatgcctatggcaccttttttgtttgtttttaatttcaaaatttcagatgttagaccagcaaatactataatgtgttcttgaggtaagatatagtgatgcatttttaatatgatttttgtttcctctattccttttttctatcatctaaaacttattttgtaatgatgtacttaaaaagttatcagcttctttcgatataaagttattaattgtgaaaatgacattctcat

SEQ ID NO: 13307 - DNA, 1051 bp, Homo sapiens
aaattttattgtgtatatttgaagtttacaacatgatattgggttcatatacatagtaaaatagttacaatagtgaagcagattaatatatctatcatcacatagttactttttttgttacaagagcagctaaaatcttatttaacaaaaatttctaatgcaatatgattttattaactttagtcttctacttgtttttcctatacatctgctattttgtgtcctttgacctacatcacatcacatccctgctaacctctgtttcgttctctgtgtatttgagcttttccatgtatcagtgatattatacaatatttttctttctgtgtctggcttatttcacttagtataatgtccttcaggttcatccatgtagcaaatgttaggatctcccttttttaaagccgaataatatttctgtgtgtgtgtgtgtgtgtgtgtctatatctatgccaccttttctcccaaccaagtactaacaaggtccaaccctgcttaacttctgagatcagataggattgggtacattcagggtactatggtcatagactataccatgtttttatccatttagccatctatggacatttggtttgtttccatatcttggctatcctgagtaatgctgcagtgaacatggaagtgcagatatctttttttttttttgagatggagtctcgctctgttgcccaggctggagtgcagtggtgcgatctcggctcactgcaagctccgcctcctgggttcgcgccattctcccacctcagcctcccgagtagctgggactacaggtgcctgccaccacgcccggcttattttttgtatttttagtagagacggggtttcaccatgttagctgggatggtctcgatctcctgacctcgtgatccacccgccttggcctcccaaagtgctgggattacaggtgtgagccactacgcctggcctaaagtgcagatatctttacaaggtagagattcatctcctttacaaggtgattgtctcctttggatatgaattgctgggtcatatggtagtctattgttaattt

SEQ ID NO: 13308 - DNA, 1075 bp, Homo sapiens
tcatttgttttgagacagagtcttgctctgttgcccaggctgtagtgcagtggtgccatctcagctcactgcaacctttgcctcctgggttcaagcgattctcatggctcagtctctggagtagctgggattacaggcatgtgccaccacacctggctaatttttgtatcttcagtagagacggggtttcaccatgttagcctggctggtcttgaactcctgacctcagatgatccacccccttcagcctcccaaagtgctgggattacaggtgtgagctactgcgcccggccagtgatagtgttttgaatgtgttctttgtgatagtgcggtccagccagtaaatcataggcaaagaggctataaattttatttctctctgatatttatgtctcttggccttattttttttaattttttgatctaccataatttctttttttcctttagttgctttgtatcattttaggaatttttcctacacattacatcttgaaattatcaaatcttattttgctttgtcatcaggaacattaacaacagactaagctgtagaactgtaaacttttcagcataagaccttaacatactgaacctttccagttttttatcaatcgaacttacatgaataatgtccatttattctgatagtgttacttaaaatgtaatttagaagcacaataataaaattcatattttgagcacagatacatttgttgttagaagcagtctattatttttttcttccataggcaagagataaaagaagcagtttcttaactacttgtaggttttctatagacatcgtttgtttcttttattgcaggggatcaggaaaatgtttctgtaaaggactagatagtaaatattttcagctttgcaggcctttaagtgtctgttgcaactatttgactttgccttgtaaacagccatagacaatacataatgaaattttacttatgaaaagaggcagtgggccagatttggcctgtaggctgtcatttgctgaccccgctctattggaagcagaaagttatggaaaaactataaacaaaacaataaaatcatctttctc

SEQ ID NO: 13309 - DNA, 1050 bp, Homo sapiens
agaccttctctgaggcatagcctctgagcaaaagcctaaagctgagagtggaacaagagcattgaaaaagaaaacatcctacaacccaacttccactctaagcacaaggttatgccagataaattttaaaccaatggtattctcaaggtaatcatagcaacaataaaacccaaacagtaaactcttgactaggttggcttatccccatacactaagttgtagcagaagatgagacacgcccatttttaggcatacatattatttatcacagtctctatactcctagagaaggtgtctggcttttaaccaaaagcattcagcagagctagactcatatatgatctagatgtcaaactatcagacagggaatttaaaataattaaatgctcaagtggaaaagatggaaaacatgttctatcacatgggtaatatcagcagaattggaaactattaacataagaaagaatcaaatggaaatgccagtaatgaaaaatacggtactagagatgaagaatgccattaacagattcaccagtagactcaacaaagttgagaaaagaatcggtgaatgtgaagataaatcactggaaattacccaaacttactcacaaaggggaaaaaaatagtggaaaagagggggaaaaaccacacaaaacaaacagtgcatccaacagctgtgggacaatttcaagtgatgtaatatgtgaaaatggaatcccagaaggagaagagagatggaaagatatgatgggggtgggagtgggtgaggggtggggtcttgagacaaaaagtatttgaagggtaatggccaactattttccaaaaataattacagacatcaaaccacagcttcaggaatctcagagacactaggtaggatgaatacccttatcctccaaaaaacaaacacacatatatacctactgagatacattaaaattcaaagataaatggaaaatgttgctgaagaacaaagataaatggaaaatgttcaaggcagccacatgaaaaagacagagtagatactaagaattcataagaattacagca

SEQ ID NO: 13310 - DNA, 1074 bp, Homo sapiens
ttaggattactaaatcaaagatagcaactatgtactataaatttatagcacatataaaaataaaataagacaatagcacaaagggagggagggagaaattgggataatactgttgtgaggttcttatactacatatgtagtggtgtaatactgtttgaaggtactccgtaactaaagatatatcttgtaaatcctcaggcaattactgaaaagcttaaaaagtataaacaagaagcccacagtacagataaaatagaataataaaaataatgcaaaaagcagaaaagtaacagagcagatggaaaaaataaagaactgacaatgtagatttaaatccagccatataaaacatcacatgaagttaatgaaatgtcagtataaagactcaaatgtctataaaccctcaaattgaaagaaagatcagtttagtaaaaaagcaagacacaattatatgctgtttacaagaaagtcattttaaaaaacgtaagaagataacaatcaaaaggatgggaaaagatgaactatacaaacactaaccaaaagaaagctagagtagttatattgacatgaagttaagtagacttcagaacaagaaatattcccagtgttgaagaaggacattacataaggataaagaggttatctcaccaagaagacatagcatacacgtaacagaaagtatgtgtatgcagctaacaattagagcctctaaatgtatgaggcaaacactgttagaactgaaaagagaaatagacaaattcacaattatagttggagatgtcaacactcagaatcaataaaaagatacagaacattactaaaaaattgaagatttgaacaacattgtcaaacaacttgacccttttgatatttgtggaacacttcagaaatttggaatacaacagttgaatatacagtcttctcaagtgcacatgggttagttaccaggatagaccatattctggattaaaaaatcaaccttaaatttttttaaaaaatttaatttatacaaagaatgttttctattcatagtggagttaaactacaaatcaacaatagaaaaatatctggaaa

SEQ ID NO: 13311 - DNA, 1041 bp, Homo sapiens
ctgagcccaggagtttgaggctacagtgtgctatgattgcacctgtgaacagccactacacttctgcctgggtgacatggcaagacgtcatctcttaaaaaaaaaagaaaagaagacactatataacttttaagaaagaagtcatttcaaagttcaatttgctctctgtgggttcttgcattggtagattcaaccaactgtggattgaaagtattagaaaataaataccaatacaacaataaaaaacaaattttgaaaacaacataacaactatttacatagcatttatattgtattatgtatgataagtaatctagagatgatttaaagtatttggaattgtgtaggttatatgcaaatactataccatttaggtagagtatgtcaaggggcttgaacatctcaaaattttggtatgagatggggccggtgtcctggaaccagtcccccacagatatggagagatgactgtaactttatttttaaaaataaggctgtatgattgtagacattgtgcaagttaatttctataggatatctatatttaacagagaatggtggtagtctttaatgtattaattccctactctaataaattgtaaggttaaccaatgaaaaggactgagttatttctcttttgttatcaccctcccttttccttggggcctcatatagtttctggcatatgtaaaggggaagaagtacatattttaaaatagataaaatgactccttgtggatatagagtagagcattgggatttagaggtggatttggaactgattgaacaatcagattaaaaaaccattaactaataaattattgtctacctgaagtaacaggaatactttgaagcagttttagaaattttattttgaagtaacttaagatgtttgtagaagttacagaaatagtatacagagctcccatacatcctcccacagattacccagattcaattcatatttctgagccatttgaaaataagttgaagacatgatgccccattatctttaaaacttcggtgtgtattttctcaaaa

SEQ ID NO: 13312 - DNA, 1033 bp, Homo sapiens
atttacatagtttctcaaaatatgctgtgagaaacactaactttgcaggactcttaatgggtaagaaagatttgaagtcaagtatcttgaaaatattgggttaaacaatttttttgaaagttacaggtatatttggagggggggcaattatagaatgcctcagttttttcaaaaaatattccatgtattatgaacaacattttctaaacattttagggagcagcacttagagctagccttctttggcacacagtttaaggtggtagtcccttgtggaacagacagcttgaaaacttttcttgcttctctcttaggtttatgtgtaaacttctagttctcaactctattccctacaatactttgtttagtcactttcttaaaacttggcacttgtagaaaagattaatagtttactttgtgtgaaaactcgtggagacactaagtttgataagttgtgggttatttctgtatactgctgttaatgaccgtgatagcggggaaaatagaactaaaatgagaactagaactaaatgtttttgcttggtggacttttgagaacatcatctttcactgggtataatggtttgctttaaattactgaaacagatgagcttttataagccccataatacttaacctgaatattttcaatgttcatttgtgagtaaagcagaaattacctgtattctatggcaagtcgaagtttaagctatcttaaatgaaaactatctttgattccttataaaaatatttgaacgaatctgatttaaatttattttattccatctttgatttgtgtgcaagccttatttgataagctttatcactgggctgtgtataacatacaacctgcttatttaatgaaaatagtagagcttaaaaggtatttttagacattaatgtttgtctactactgtatctttcaaaagaagcattatagggcttatgattcctctgttggtgctggtaagaattggaaagaggcatatttccatcacttttttagaactttcctattcatagaaatttattt

SEQ ID NO: 13313 - DNA, 1047 bp, Homo sapiens
gaaaatattagttaatgctgggtttcagacttctcctctcctgtcaaggcatttgttaggtctttcctttcctgccaaaggctcagagtgttttcccccagcgtaggtgccatctgtctgctcagggactcttgtttctgcatgtggccgaggagcatgggtggcctggctgagaggcagtgaggctggttttctttctcaccctctcctcctctttgtgactgccttctgtggttgttgggcagctcccccatcttgctgtctctcattgtacctaaagtcaacatctttttcctgatttgtgctctttagtctctgaaccttagttaaaacttctctgtatgccttgagcagtagtctgtcttttcttttaatcattttgcttttaggggaccttaaaataaaaaaaaaaactatttacgaatacttactgtcatgcatgtcatacagtgggagaatacagaaaaagatgtgtaaaatctttatggagtttcctgacctcaataaagtttcaatctaggacggaagagaagatgagcagatgatgatgccataaggcagaatggtgtaactactgacttagtcttagaaaatccgtgtcacagaagttatgggggagaaagactccctttgggacagtcatgtttggggctgacaggggaaagacgtaattggaattgttaagatggagaaatgaaggctctgggttcttttgtctaggtaaaaccaaggattcaggtgtgagaatgaaggggcgaaggggctcgaaggtaggtaggaaggcctcactctgcaggcagaatggatctctggaaggttttgagcagtgtttgtttttgtgaggaagactgttttgatttttaaggaagaatacaggcaggcattgaagtgttagggtagtagaggagattaaggcagaacaatccataggagaatgttgagtgtcacatctgccagagaagcctagaaccagagtggagagaattacatggatttggagggacagagaaggttcattctgatgttgagtctgggacgttgggagaa

SEQ ID NO: 13314 - DNA, 1061 bp, Homo sapiens
aacttccatcttgctccttggatcacgggctctatcaagcagccctttggagatgtccatttggtaaagaaccaaggcttcctgttaacaatcagccctgatttgtcagccacatgagtgagccgccttggaaacagctcctccaagctccaggaaagccttgggatgactgtagtcatggctgacatctcaattacaacctaatgaagggtcccccaattcagaactattcagctaaggccactcctgaattaccttcagaaactaaatgaaatcataaacacctattcccttaagctgcttaatttggggataatgtattatgcaccaatagataactaatagggtactacagtgaacaaatacaaaccttgattatcttggtagatctttgtggcttccccatcctacctcagtggtaagaactgctgttcctgatcattaagctctctaagttaccctagcccactccaccccacacctgttatggctgctttataattgattcaaggataaggggtggaagggagattggagacaatatgaaaatcttaaagccatgtgtctgttcttgcctgcctctcaaagggccaattttagaacctttaatttgtagtgtctccctttattcatagtcatagaaaaatttaaagcttaaaggagctattagatacatttagggctcattgtttctgtgtgtgtgtgtgtgtgtgtgtgtgtgtgtgtgtgtgtgtgtgtgtgtgtatgttggtttgtctttgagaagccacttttggtcctgaaagtacagggtttacagatgtttagagcaggattttgacatgaagtattttatggaagttgggtaatgaaatatttgtgtgatgggttgggccagggagggttgggctcctcttcttttgcagagaaaaatgattgcccttgataatgggttacagattcacaaactgctcatttcagggatgaggaaaatggggccagaaatgttaactctctttccaaagccacacagttgtttagggacaaagttaacttggagtcctggtgactagtccaattag

SEQ ID NO: 13315 - DNA, 1048 bp, Homo sapiens
ttaaaaatatataatgtggagactcctttgggtcaaaattcttgtcctgtcattattgtagatcaaaggacttagtgttggttagatcagtggttctcaactgggggcagttttgccaaccaggggatgtttggccacttccggagatacttccagttgtcatagctgggtgagtgtgctacaggcatctaatgggtcagggatgctgctgaatacactttaatgcacgggatagcctccacaacaaagaattttcctactccaaatattaatagtactggagttgagaaactctagctttagatttagaatttcttgtttattccctccctgccagcaaaatagtcatgtggaaatgaaggatactgactatgacacctttgacactctactaaaatataacttttatatacagacataatttatgcatttctgtgttagtatgtttattgtctgtttaaatgggaaggtgcattgtaacttgtctgagagtgtggtaatatgtgtgagtactttgaaattattttgcatatctgtatgcattaaatttaacaaggtgtagcaaatgatttgattatttaaaatgctgtattataactgcccagactgaatctaccggtgcatagacttgttgttggccttgctgcaaactcaatctaatcatgacgcatactgagagcaaataggaaaggacagtcgatatcctctgtgctggcaaatgaggggaacttttttgttagtgggcagtggtgatagttgctgtatggagcccaagcagagttgtgtatgttgaaaatgagtggcaatagcagaagcaagtaaagagctgttgttaatgaatagtttcaataatccaggactccaactgtttttcagttttctagctatctgaagtttacaatttaattcacagtaataacttttcaccaatcagacagagctagagtattctttatatttctgtaaattatcctcttatgtgttctaattttctaataattattttactttgtaggaagcagtagttttaattttttcaagtgtgttt

SEQ ID NO: 13316 - DNA, 1097 bp, Homo sapiens
ccatttgagccagcagtcatctatccagtatctacctaaagggaaagaatatcaaaaagatacctgcagtcatgtttattgcaacactatttgtaagagcaaagatacagaattaacgtaagtgtccatcaatggatgattggataaagaaatgttgtggatatatatatatatatatacatacatacatacatatatatatatatatatgccatgtatatatatcggatatatatatatatatatatatatatatatatatatatatataacgttaagtcgtagtaagtgattgtgtctaagggccacaagtctttttgaagttagttcattcataaaatcgtgggaattacagaaccaggaaggacttatctcgatcaacatttgaacttctgtatagtcatttcccttgcctccaggtgcattgttcattgttctcttccttgtctcccactcctaagtcaataatttgacaatctcgtgtttgatccctttttatactctattgaaactgtaagaagaaagttggaattatatgatttgaaagctttttaaaaaacttcttggaatagcttttatgaatgactttgataacatacccattttttgctaccaataacttcgattgtgatttcaaaagaattttaatttctgaagactttaaaaaattgacataggttaggaggagataaatatagtgtaaaaaagttattagccttcaacagctctggagcacgttatcccacaattctaatcgaggtaatacatgggaacatctaatattagttcagagtgcttcatcatgcatgtcatacagttgatgtgagtgttcactgttttatttgaacttaccagaaagcctctgagagagagcctctctagggacactagtaaagctctaggttgattttcctatcaatttaaaaattgtagtgtgaattgttaatttgagaaatgtgcacttttaagaaatgttcctttgttaagaggtaaaaatcagaataccagagctggaaggtactaaggacataatctcattcagggcagtccttttgcatgtgagaaaagtgtcccagatgaggtgaggtggcgtttgc

SEQ ID NO: 13317 - DNA, 1104 bp, Homo sapiens
aaaagtgttcctatttctccacatcctctccagcacctgtagtttcctgactttttatgattgccattctaactggtgtgagatggtatctcattgtggttttgatttgcatttctctgatggccagtgatgatgagcattttttcatgtgttttttggctgcataaatatcttcttttgagaagtgtctgttcatatcctttgcccactttttgatggggttgtttgtttttttcttgtaaatttgtttgagttcattgtagattctggatattagccctttgtcagatgagtaggttgcaaaaattttctcccattttgcaagttgcctgtttactctgatggtagtttcttttgctgtacagaagctctttagtttaattagatcccatttgtcaactttgtcttaaactaattagaattaaaaagtttcatgtgaaaatttggtaacaaaattcagctgtgaactatgagcttcactgtcataaactgttggcattgattagctgtagatgaggattaaaagggagaattaggagtaggtgtttcattttcttcagccaaatgatcctcatatgctgtgaatagacttttaggtcagatcaactggggcttgaattataacaatataataaaggtgacttctggaaaattgcttaatctcattaagcttcagtctcacctctgtaaaatgtgaataacactgaatatagaactgcattggtgataaaattaagctgcatatgaaatgtgtagggcaatgctgtatagtacttgtgtttattttctgttgccgctataacaaatgaccacaaatgtagtgacttaaaacaacacaaacttactctcctacatgtctctagatgtcatgtctaaaatgagtcttaaggggctaaaaacaaggcatcagcagggttggtttcttcttgcagctccaggggagaatccacttctttctgtctcttctagggatagccaagcattccttggctcctggctgcatcactgctccaatctctgcctctgtggtcacaatcccttctcctctacaacagtcgagtctccctcttcctccctctcataaggacacttgtgattatgttt

SEQ ID NO: 13318 - DNA, 1060 bp, Homo sapiens
ttaaaaaccagggtccctgcatgctttccgtgtgccatgcaaaggcacattatccgctttccagctcatctgcatgatgcttaaacatttgctactctcaagtcataggaaagctgttttaacttgattaaaaatctctttgcagctttaagcatgttgaattgtaactttcagaaaaattttcatttgtaaattaaatataactttataatgtaagcagctctcagaaatagttgcttttcttaaaggaaataaaagtacccagagtacaagtatgtggtggaaatgtcaacatgtacaaccatttcagtggctggatgtgttccctgtagtgaggggtaaattatatgactgagttagagaagaagacagaaacctaaaaccaaagcttgaaaagctaaagatttttctggattagagctaacagcagcaaatgttttctatcccaagatagttgtttcggatagtacaatatttgttttaaaggctgttgtgcatgcagttcaatgccaaggtaactacacaaataaagcaagattgtctgtaaattgagactgaataatatatgacatgtcaaacagtgggaagtattataatatgaatgtgtcctcagaaaattcaagtgtgttttggaccacttgaagtcaaataagtcaaatttataacaaaggatttctctctagtctgtcagttaccactactttttctttttctttctttttttctttctcttttttttttttttttttaagagatggagtcttgctatgttgcccaggctggtcttgagctcctgggccgaagcattcctcctgccttggcctcccaaagtgttaggattacagatgtgagccatcatgccctgcctaccggtgcttttcttaagtagatctgctgcagtgaaaagaaaatagaaatttaaattggattaagtgtaggcttttaatctagaacttgtttcatatttatgctgggtgatatttctctgaacataatgtacgttgtcaagcttggcatacttacctggaaaagcattattgctcaacatgctgtcattgaa

SEQ ID NO: 13319 - DNA, 1050 bp, Homo sapiens
caaagtagggattgaactctgtttgtgaaatgaaagagactatgcatctgcgcgtaaccatcacaatcgtgtttctgttttggccttaccagtgaaacatgtttcgcagaacagccaggtttttggagtgagatgaaaacgaactggaaacagttcctgatctatctaactgtcacctaattacaagcatttagcattctttatgaagtgtgcaatgaggcagatactttctgggaaaacaaaaatggggtctatcttattaggtcaggtttttgagacagacacatgagataaaggcttggtacagaaacgctggctataaaaagcaaaattagggcaccttggcatccagttggagtgaatagtttcagtgatgtaataagatactctggcacattctgtctgctagaaagggtgtatagaaattcaggtgtgcccctgctgatgtgatttttctgtcaggaccttgcaaaatggaaagatcgtcgaaaaagttacacttcagatctgcagaagaaaaaagaagagagagaagaaattgaaaagcaggcacttgagaagtctaagagaagctctaagacgtttaaggaaatgctgcaggacaggtaataatgctgaatgcacctcggttgtaacagggttggagatgccagtgttataaatagatattttatgtaagtgtagtgtgacataggtgtccaccaatattcaactttagtcaaatatgcaaagaaacgtttaagattttggtctgcggtgaaaaaacaaagcattgttgaaatagtgacttagagtaatagtaacaaaataaatgaggacttaaaataggtgttcattatttcttcttacattgtgcattcacatgcagaattggatggtgttggctgtgtctgatgcaggaaatacactgctttttactcttaagtgaattaaggaatgagatggtccaataaaatcagctcactcttttaactaaattgtgtaaaatataacgaagttctttttcatgtttaatggtgcaattcattatattttaaagaaagtttttat

SEQ ID NO: 13320 - DNA, 1050 bp, Homo sapiens
ctcattagtaagaaggcttgaaaaatgtgacttgcagctgtcatgttgtgagtagtggcaagtaaaaaattgggatttggtagatgttgtaacatttgaaattctttttttttttttttttcctgttaggccaaactatgagatgctgcccagtttattaataaaagaaccctgaagcttcttcagaaatatccattgatcctactctaatacctagagctagggtttattttggcatctgtatcttccttttactaactttgaatttgaaagatgagtaacagatggaactgttacacctggagaaaaaaggatttactgactattgtttaaaaaaacattgtcacttagtatactggcatagagacagctaatgatagaagtttctgaaaggaattatttcatagaaatgaagacttatattgtatatttttcttccttgcccatgtgctgcaacacaggaagctctgattcggtggttcctgatgtaagtagcattcatttgtcatttggaataaggtgaacttggtgggactgaattagtacaccgtagcatgcttaccatgattttaggttgcataagaatttatcagagagttatccttccaagttgaaaaacttattttaaaattcaaagccagctctcccttggtacagtttaagcaaactgtgatatgaataatttatgtgtgcaaaagtggttcagtagatgacttaatgaagttatgttgttctctatttgcatctcttctctgataactggttagcttccagttccaaccatcagtgccccgagtcgctgggtgtgggatcaagaggaggagcggaagcggcaggagaggtggcagaaggagcaggaccgcctactgcaggtagctctggctcacgtggacgggtagaaactaggttggatttcacggcttttctccagtctgtcaaccagtattgagaaactaattttaaacgcaacaatctcacaactaacaaatatttttgcacacagtacattttccataaaacaattacttttccattttgaagatttccaga

SEQ ID NO: 13321 - DNA, 1023 bp, Homo sapiens
gaacctttaaatcataaaccctgccatgtcatcttgcttcaccacccataacactccaagtcacttcctgtcacatcagaaccccatccagcatccttgccaaggcctagaaggctgccatgagctacattaccttgtagtacctctactcttccccttactcactctgttccagccccattggcctcctgtttcttccttgaaaatacccaaggacttttgtattttctagttcatctgcttggagaagtcatcaaatgtttgtgtgtcttgtgttctcattttcttctagtttctgctcaaacatcacctccttagacttttctagaatacctgatttaaaatacaggccccttctcactctttctctctgtatactcttattttatattgtgcatttatttgtttatctgttagcctgcctgctgcagtaagatgtaagtgctataaagtcagtaagtttgttttgtgtactcctatagcccattcttagagtggtactggaatatggtggggactcagtatgtatttgtagaatgaatggcttgcaaatgtctgttggcaatagtgggtctattttctgtggttattcattgaaatacctttgtatgtttagtttttaacccaaagaccatttgcataaagaggctagaatgacattattttgatacccttttcttaaactcagggaagggcttaaagtctaatattttgacaacaaaatctttttctatcttttaggcctgttgattcctatgatataccaaagacagaagaagcatcttcaggttttcttcctggtgacaggtatgtagagcatgttattgtaatttaattgatgataatggcttcagacaatattccagagcttgcatcgatgatttgtagaactactttagccctttgtcatttgtggggtataaagaggaattgctggttgatctttgtatcagttagcttttgctgtgtaacaactattcgtgaacttaatgaattagcttatgattttatggtcagcatgtt

SEQ ID NO: 13322 - DNA, 1049 bp, Homo sapiens
tcaaaatatatcctgactccaacctgtttcagtcatttattgtatgacactaacctaagtcattcaggtatttatctataatttgttctttttcccaaaatattttattttttaaagcagttttagattaacagaaaaattgaccagaaactataggaatttcccatatattttgttctttttccatcttttccatttagtttaggtctttgatacttctgaaatttatttttgcacatggtgtgaggttgaattttaattttttttcctttgtcttttatatttagcaagttttcagttgccttcaatctgccaccaaggcactcatctataaccagtttttcaatggtattttagtgctcttgttacgtgatgatactgcaaacattgggaatccagtcacagagctagcagctggcttgtctcagtttctggttgtgaggctgtgtctttgttaccctgtcgcctgaggcatgagtgagcatgagtcttgtcccctatcttatgcaaaacccttttagtcctcattgatccctaggaatgcaatccccatgactactattgacaggaggccatgaaacctggacatgaggtccactatttttgttctgtatctgatctgctgaaatggccaattttgtctccttctttttatctgtttatattttatctgttcttgttgcttgtttcaactagaaaagttgggtgaagtcaggaactcagagctgtctagattgaaagtcaaagatgatcctttggcaatgtcctttgacaacaatgctttaatctaaacaattagtttcaaagatgatgtttccagttcctaaggtaggctgataatgtattgtgagccagaaataagcttacatgtcttcttatagcatgtagacagcatctctccaatctcatcaagagcacttgagagtacttggctgatttgagagagagaaacaaggtaacattttcttctacaactagtgttttcatatatgtccttgaaaatgttcttaatgatataaaaatgacctcaggataaatgactttggatt

SEQ ID NO: 13323 - DNA, 1023 bp, Homo sapiens
ggtcaggtttagtatgtaaattctgtttaatcttctgtggccagtggttccaatatagttttcaaagactttgttattttgtttgggtctatcctggaactcagggtttagggtgagacttgggcattgttttatactatagattattgtaaaaatattttttatgctaatttgcatctgttttgcatatacagtatgagggtgagcccagaacttgagccagttcacagataaaagtagggaatcctcttctccagttcttccttccgaggagtttctctgtgggtacattgctcctgtcctctggctaaaaagctgaaatttcactcagaattttagtttcctatactttcctgtagtttcgtatggctttaaccttcaggaaaaaattgcaagaaaaaagaaaaatgtaggaggaatcccccctactcctttagaacacagggcctcttggttcctctggccaaaaatgaacttggattttgttgttattgctgttttgggtgttcatgttgttccaacagcagtgcagctttgtgagtaggtaaggcttccaacagagctggcagaaagaagaatacaaaacaaacaaaaacacgtggtaaattatccctacccttttgtccacagagggcctatttcccaaagaagaatttatttcagaatttttataatttgtacctgctgtgcagttttgtatcctatgcagccctccaaaagataaagagcagagagaaaaaacaaaaacaatactgtaacctcacctccataatggttgttctttaagttttgacttacttttcaattcttttgctattgctgacttttcagagccctcatgtagttgctttccatatcttgcctagatatcttagttgtaatcatgggaggagataagattcagtgggcttacttcatcttgacagaaatcagaagtctgtgggaatgtttaaaatttttgagtaattttcttaatacatataagggaatatatattttctatttctgtaattttgttggtag

SEQ ID NO: 13324 - DNA, 1017 bp, Homo sapiens
cttatgcactgaaacagtgcaagttctttacctagtgggagctttctgaaactataagcccatgacacctgaaacctgcagaagtatagtcatttgagatgctgtgcactttgttgacagtgaaaatatatcatttcctgaaaagtgtcttttcataaagagagagaagctgtagaaactccatcactacagaagacaaagtaggttgttccttctcttacttgtctaaattcaaagacagcaggaaagggactccttgctccccagtgctgctccatgcattgcattattttaggcctgctctcaactacctaacaaaagacttacttgtttgaagttcatacctaaactatcctttctttattttgctatcctccgtggccagcgttcatgtacctcatttataactactgttagctcatagtattttttcccactctcttcctgttcttggtactagaactacatttgctggaactatctgacctgtgaacaatttactgttctttctattcaccctgccctacttacacacacattggaccacatatatatacctgtagagatataattgctcattcctgtatgtggtcagtattcaacaagtgttaatttcttgctctagatgatactggaatggtagtttggagatatccttagaagttcttgtgtactgactcatgctgtttaattctgtcagtgctgtgaaaccaaaaaaggcttccaatcaagttactaattgaaacttaacaaatgttaaactggaagcaagacattggaaggatgagaaggagacaaaagctaaaagaagtagacaaattatgaaggtattgaaacgtctaaaagataaataagcacactaaggctaaggcaagagtgatgtcaggaaaaatgcaaggaacaaaatggattgtgaaatccttcaaggtaaaaaaaaaacaactcaaaatataagacctggaagttaactggatatgtaaagaaaagcatgaggaggaatcaaccttggcttcaaat

SEQ ID NO: 13325 - DNA, 1052 bp, Homo sapiens
gctagtaactggcttgtgttctttaagcatactaacatcactaaatcttaggatttaggattgctgtaaagatgtaagttgtgtatgtttggcaggtcacattgaatggcagtgataatgattaatcaaagaacaaatgtcatccttgatcttgcctaatgtagtttatgtgccaaactttccagggttttgtagtcacctagattttaagctgatagcatagtgcttcagcggttcttctaaccggggtatgcaggaacatggctgcagacacgtttgggtaaacaggcaccttctgacttcttcattgtttcctgtagttctccctcttcccacaaagctgtcagcgcagtggaagaggttgcacttctccgagagaggacaggtttctgttaagatcaccaagtagctgtgctttaattagagccagacaagctttcaaggtcctttaagtatttgatgatcaactgaacacgtttctattcaaggagaaaacaccattcagtaagaagatggagtagatatcagataaaacaattcacgtttaatatgtaaatgtaccaattatgtgattcagtttcaactttcaagtacttcctgagaggttagtacattattattgagctctcacagaaagcttaatcatagatataattaacctgatccaaatgagtaaagtggaccttagaaaggctaagtgatctttctctggctatccagctagtagtaatgaagtcaggtcttgaaccccggttctgctgactgaattggatgcactatagtacaggcttttagcaccgaagtgtggtcctcagaccagtgcctgccaaccagatgttactggtctgtgaggaaataagtacagatactgacaggaagcttttataaacaatttattggagtgtttttgtttctgttgggtctaattaaaaaaattggagcttgtattttatgtgtctttggtcttattttgtctaggaattcatttttgctgggtttttttttttcaactgtagtcccacaacagtctgaaaataacccagtcaccagat

SEQ ID NO: 13326 - DNA, 1043 bp, Homo sapiens
ccaacagtgtaataaaaccaagaaataaacaaaaccaaaacaaaacagtgataataacgtgcctgatcctctttttcctctttttcttttcccacggcatttatcacttcctagcttgttaggtattgtatgtcagttgtttagtgtccatctcccacctggaatataagaatggcaaaaacatgaatctggccgggtgtggtggctcacgcctgtcatcccagcactttgggaggctgaggtgggcggatcaccggaggtcaggggtttaagatgagcctggccaacatggagaaacctcatctctactaaaaatagaaaaactagctgagtgtggtggcgggcacctgtaatcccagccactcaggaggctgagacaggagaattgcttgaatccgggaggcagaagttgcaccgagctgagattgagccactgcactccagcctgggcaacagagcaagactccatctcaaaaaaaaaaaaaaccaaaaaacaaaaacatgaatcttagtctgcttggttcaccaatcctaggctcctaaaccagtctgtaaatgtttcttccaaggatgaaagaatgtggcaaaacaggacttatgttttattacatggcgtagttacctggacttaacccaaaataaatctgtcctgaggaatagatagggacttagatgtcacagaagagggaagactcttaagaggcaaatgggaagatgatgagagaacacagtcataagttagtttatgagtcagaggacccatatcatacaaagaaccctgttcttttgtgattcaccaatttcttatgttccacagtgaatggtaaacctccatatagaaacaggggccatccaagctgggacagtctttcccctgggaatttggaattaataccggcagaaagagagtagtctgttccttgggtccttagacttgtaacacatcaacccaggagctataggtgatctttttaccacatggtctgcaaagcagagaaaggtgctctgcactgagaaagaagaagagaaaatagacgcataga

SEQ ID NO: 13327 - DNA, 1058 bp, Homo sapiens
acataattttattattacattttatgcatcaagattttgtttgcattgcaaatctttttgatgaagaaaatatcaacagggtttaatttttaaagtttaacccacttgttaatgcttgcaaagcactctgttcctttatcactgcagactatagtgtcccagtagtgtggtctcagaaataagagtgctgttcatttggttccctgatatgtttgcaggatggcaacttatttttatttcctgtgtttattaagaaacaactggagtgggtatatagtaccttattttaaaaatatttaaaactacaagttttacatgctcattgtaaaaaaactaaaacatagatgtaggtataaggtcacaaaaattatcttccttgtccccaatttattaccgtgactcagaattcaccctgttaatactctgcagctccttcaagataaaaaaatataattacaacaatcaatatacaaacatatacacatcagttttttttaacacttgcctttcattgaacatacattggacatttgtgtattcatgtgacatcacatctcccagtaacaaaggcatcattattagagtaacaatattaaggaacaagttactgttaactgtatcacctacagtttttcatgcattttttattgtgatttcatcctaatgggttgaacaaaatgtgtttgcttatttatttagaatagcacttcctgctaaaaatgtcataagttcaggaaagtttacaaatgtagattaatcactggatattttagctattcttttatgtaagtatatcttttctaataaaaccttagaatacattattttccttttattaacaacttggacaatatttgggttaagagttatgtgtgtaaggaaaatcatgactaacagaaccaatattttctttatgatagttcattagttaatgattaaccaggtctttgagatcatttttctgaataattatttaacctataagtagtatcttaaaaaaaacagctttaaagagaatggagtgttatgctctcccttttgacaaaaaagctttgatg

SEQ ID NO: 13328 - DNA, 1080 bp, Homo sapiens
tatctgtcttatcccattgctaatctgtttttattttgttttcaggagacttcttcaacttgatattccaaactcatttactgactcttttgtttttgctatgatagtttcatttcccaagcatgaataaactgtttttttcaatatccatgtgtatgtgtgtgcttgtgtgtgtgtgtgaatgtaacattttcttttagatgatataaattatattcgtcttgacattttcatctgttccctgcattgtttttctctttggttctctttactccctctacttttagtctcagtgtttcatgtaaaaggaatatttcacatatttggtgtcactggttgtctgttcatacccaaaggaggtgccgaagccgatctaaagctcttaatggatggagctccttggtgcagtttactagtgattggatgggtagccaggccacattcaagcatctctaggtcttctcttggattcatctttttctctatgcataaaccttctatactcctaggagatgtaagcaaggcagtcatttctaggaatataaagaaagaaatgggaccagaattctaacgagtcagcatgtggacttccatttaatgtttggttaagtaaggtacctcatttatccttcagctaagtttggtgtgcctgaagtcagggcttctctggatcagcttattcacatagcaaagtctctgatctcaggttgagatgaagaggggtggtaggactggctgtattggaggggatttgggattccagttgtcccttaggtagactttcaactggattcactgcttttagtgccatgatcatccctaccttctatgaaatgcggagtgggaatgagatatagtaccagacaataggaattggactatggagtatgaaagagaaatctccataagtgaacatggcatagtgggtcacttagaaactgaatgtgcctgtagaaatgagcactgcttttgaatatgctgtgaggcagtgtggacaaatgaaatatttgtatcacataggccctaagtaattgaagacaccttactgtggtgttcccctacaaacaaaaaaaggactct

SEQ ID NO: 13329 - DNA, 1014 bp, Homo sapiens
tgtatatatttttcccaattattaaaaaaatatgaaaacatttcttagctggtgaattattacaaaagcaggagtgggctggatttggggtactctcggccacagtttacccaccccggcattaagtcatttgcacactagatagatttacatacatataagcattatgtcatttgcacactagatacatttacatataaggttaggtttttttttcttttctaaaaagtaatcctaattggtggttgctattgagatattagactaagtgcttcattatccgattttcctttcattgatgtggagctcaggcagaatcgtgaggtcatgaggataggaactggcatactgcagttttgttcatgatgtaatttatttaaacttcctgtaaaagtttagagaacgagtttttcaaaaccaaaattagtcttttacttaatttgtatataaactcaaaacttcttttgctgtgacactaaatgtttttattccagagatccataatccataatcctgttgagataagaagtaaccaattaggttgtttactggagaaaattcttttttaaaaaattcaacttatattttataaaatatagtttaaaaaatagtcttacaactgttataagacaaatatcaaattgctgccccaatctctcatgccctttttatttcccagatatacttaagaaaagctatttgttttggttttactgtttacctctctttttaaattccatgtttatatggccattgctttgaattttttcattttaaacattatccattggcttttgactttggatggtgaagatttaattcttttacacctcacttctatattttttctctgcatgtcctttctatgtaaccttttactacctttaggggacatcagtatatattatgatagaaagttatattcaagccatgcaatattttatcatttctttttccatctaacttttttgtttttgagacagattcttgctctgtgcccaggctggagtgcag

SEQ ID NO: 13330 - DNA, 1049 bp, Homo sapiens
gttttgttcattgctgtgaccctttctgtgcctggaataactcccatcgcactgtaggtgttgtatgctagttgttgaaggagtgaatatggtggaagttttcaccttaatagttatgcctcatccctgctccactgtgattgagatggttgtccttatttctagggccttgcctagtaagtggggacatttagcagatttcacagggctattttagaaagatttctggaaatattggatgtgaaattacttcagaaatgtggagtactacatatacagaaacattcctaatgtacagattttcatttagaaattgaacataaaatacagggaatcctctttgcctggctacttatacttcatagaaaactaagtgtgtttttggcagagggtgggtatctgttttctctacctacaaatacaggtatttgttagggatcttacactgaaaaattttgtaagtgtagtttattattcaacatagaaaatctacaacaatctctttagttggttgtttttattttattttttattagatctgtgtgtattccatttctaactcgcccatctttctaacccccctctacccctttagaataaaaataacaaaactgcatagaactttcatgggtaggattagctcacttgatatcctaaattgaaataaggctaatctagggtctttggtaaattcacgcatgaggctgggatgttaaataaccaaataatgatcaaaggcttatctaagtaatttgaaacgcccaaaatgtggctcagttaatttggggccagttaataaaagcttatcttggcttaaggtacttgaatgtctataactattgaatcaggacaggtcacatttgagcagagtaggtgtacttttcacaaatagtggaggcctacacaattatatccttggctcatgtttcgctatgaccatctgtcatttcctctgggattagatactaaggaaatgtgaatagaaattaccccattcattgagtttttcttttatcttcatatggtaccagttcccaatcttattttag

SEQ ID NO: 13331 - DNA, 1035 bp, Homo sapiens
attcacttccatcaaacaccgtttgaaaaggattaggtttctgtgaatcctgtgctgggatactcttcacaggaaagtggagacatatcacagtttaggtccctttatggtagttttattttgcctaaaatgtctagttttcacaatacaagaaaaatggaatacaaaggcaatcttctggatatgacttctgactaattagcttaatggttgagagcagaggctctgaagtccagtagatcctgtgtttctcaactgtctaaggttcggtttccctaactaaaatgtggacaagatgatatctgtctcttaggaaacttaggtataatttcacaccaaaccatctggtacacattttctccacctaaatatattataaggaataaatgaaataatgaatgttacattgcatgtagcctggagtggatgtgctaaataaaggttgtcttctccccttttgtttttaaacttttattaacatatgattcagatgtcctagcctgcatttgttactatagaatattgagcaaaaaactgaaataagaatggtaactttgaagctaatctattaaatatttttctaaattatcaaaataatatagatagaaaataattgtaaactgttgattcattttaaaataattgagaataaactagaaatgtatattaatatttactgcttttgtagttcctacactgcctagatttaaagagatggttcataaaactttctgggatatttctgagattcatagaattaaaagaagcataactggaataacttgctaaatatcaaaatgactcaacttgtagaatctttaccaacttttttataattctacggtatggcaggggttactggaggcatgatgtagtccttattatcatgaggacctcccctggagcctgtgttgcctggatgcctagatctagctgtttggtggacaatgagtgtctcctttagtcctaaagattcctgagtctttgttcatagagtgatgagtcttgctgcctctttaatgtgagcaagctcat

SEQ ID NO: 13332 - DNA, 1027 bp, Homo sapiens
gcccttcattttataggttttgctactattataaatgtaataatgcccagcaactcagatagataaatgacataatgaatattatttaaggaatatatctgtaataaactgtttgtacctacagataccaccttgtcttcttttctgtaattacaactattaaagtatctcctcattttattttcttggaaccaccaccaaagcaagcatcaagaaatcctaatgtctagcaagcaaacggggaagactttctcttgtgagaactcagacatcatcacatttgtaaaggaaaggaggctgtgcttagaactggcttctgcatatagccaggcactccaaaatgtggctgatggacagaccaggagatctttgtcaaggattagaattttccatttctcagtgctgtctggaacctatattctgtttttctcctcctgtgtatattgtactctcaggcataatggactcttctgaaaataacacacatttcctaagtcggatagtggtagaaggttgctcacatgaatatcattttctcttctagttccatcaccgggacagcttcaacacagggtccacagcgtggggcatttcccagtgtctatccgacagcctcttaaagccacagcctatgtgagtccaaccgttcaaggcagcagtaacatgcctttatcaaacggcttacagctgtattccaacacaggaatccccacaccgaacaaagctgcagcttctgggataatgggtcgcagtgcactcccaagaccttcgttggcaataaatgggagtaacctgcctcgaagcaaaattgcacaacctgttagaaggtaagaatgtgtatttgcgtaacttcatttgcagtttggaactagaaactgctccagacacacgctgacttttcctttggctcactttaaccttagtaagacactaccctttatggcctgacttgtgctctcctccctttgaaaagtgatggatatccctgtgtgggtcaggtccccttctctctgatgtcattttcttc

SEQ ID NO: 13333 - DNA, 1030 bp, Homo sapiens
cagatacgggaaaggctatggctgggagaaggttcaaaaagccatggttcttgcggagatcaccaaagtgagttcaggtagataggagaggactcaggactgagatctagggcacttaggccctttatctcatgtgagttgctcaaaggagataccacggataacaacctggaactcatacaggaaagaggatgcttttttctccaatgtggaagggagttgtggtgttgggttaatacggacaacctagcatggtttacatttgtactagttagctagtgctgtgtaacaagttagcacaagacttagtggtttaaaacaatattatctcagtttctgtgggtctggcatctggctatggcttagctgggttctctggcttagtgtttcttacaaggatgcagtcatctcgagcatgcttgtggaagaacctgcttcaagttcacttttgtggttgttggaaaaacccatttccttgtgtgctgtcaacagaagctgctctcatagtctcttgttgtgtggacctctccttgcgcaggtcaaaaagtagcatcttgcttcatcagaatgatccaacaagatggaaattaaggccttttaaacgtaatcttgaaagtgaggtctcatcacttttgccctactctgttcatcagaagccagccagtaggtccagcccttattcatggggagagaatgacacaaaaatgtgaatgctggaggtgaggatgattgggaccatcttaattatagaagctgcctgtaaaacattgccattaactttaccagataatcccaaccaatttccaaaataactgtataatattacgtttttgccagcagtgtatgagaattccagtatatccttgctatacatccttgatattgttagtctttaactttttaatctgtgggtgtatagcaatgtctccttgtggttttaatttgcatttccctggttgccagtaagaccaataccttttccttttcattcatttattagatggattcctgttcagatcttttgcttatt

SEQ ID NO: 13334 - DNA, 1087 bp, Homo sapiens
gaagtaccatatccaccatggagacgattgtattcacctaataaacagtggatagactggaaggaaaatataggaggggcacgaagacaggaatatagatgaaagacttggttttaacagagctaagccaatttggtggtttgtgcttggcagattctgtttagtgcacatcacatccaagggttagagtgagtgagggctgtggtccactctcccacagtctcgcagactaagatgttacaggcaacggctttaccagatgcttaccatggcagaacatgagtcactgctttctgcttttgataccattttcctaatgcccccctgccctgcttaactgctaagtagcgcacattttacattttagtcatagaaacactcaatttcctgcactaatgattctattcctaagtataggtatgttagtttggtttgccccaaggcagatcctgagacaagggtaagtagcttcattggaaggtgcaggaaatatcataggtgggtggcgaattgaggaagaactgggaaaactggcaataaagaagacttattaagcacgttagcactgtgggcaactggaaaattctacaagaaaattctgagatataaatgcacacctcagggctagtctgctcaggagctgaggtatatatatacctcctcccatcagtcaaggttgaggatgttcctgaggggtgtgaatttccacccctcctgtgttgaagctgccatctcagcttttgagaaagctgtcagccccctgataatcccctccatagttgtctagaacttggtcacaaactatggtccatgagccagattccacccacagcctactcttttgttacaagctaagggtgatttttatatttttatagagttgttgaaaaaaatcatatgtaacagagactgtggcctgcaaagcctaaaatattcacttatggttttcagaaagagtttgccaatttcttggtgtacatggtcttgcagtaagaaataatctccaaatctcaggttaaaaacaactatttctccgttgtggtctatgtctgatagagggcagaagtgggcttgcttcatgtagtca

SEQ ID NO: 13335 - DNA, 1031 bp, Homo sapiens
gtcacgctctgtcagaatttattctctataaaaattccataaactcatctatgctaataatatattctattcttcctgacagtggtgctttttagcaagaacattctggagatattaataataactatattaaaaaacataatctcagtataaaaatctctagcactttgcagactagtaaatgggatattttaggacttatggggccttaagtctaaagttatctctatcagcagttttctctcagatagtttatttgatgacttaattaaatgagtcttcggaggtccatagcaatgcagatgattcctgtttatgacaatgcaaatgaattttgtctggtggaaagaataaatctctgtaagtctaattcttatttgaatgggttttaacatctttaactcctactgggtattctttgctatgtgagatacctcacattcaatctcaacccctagctcctagaattactgtgaatgtttggaaagctagtctgaaagtagttgagaacaattgtaaatcaacaagtagagattggagcagatggaggatcagacaaacttcttctgatagacatcttattgcctatatgctttgtttgttgaatctcctgtaaaagtgaacaatctgaaaagtcagccttgtgagagaggagagtgatactatctgccaggcaaacttgaaaagagaataaacagcacattcctcttcattaaagtacgtcacactgctgactttttgcatgtaagagtttacgaaagaaaatctggagccactaaaggctacttactcaaccaataccttgtaaccataacattcagctttttggaagaaagacagaagccaggatacaaatactttaaattttccaaagtctctctaaagagcaggtacaccagtcagtcctgaaggaaatgaatgattttttgtcagtttgtaagtgtataactcaggttttaaaaactgagtttcaaattttataagcacgaaaatgccatgtgtctagttgtattagaaaagaggttaggtgg

SEQ ID NO: 13336 - DNA, 1048 bp, Homo sapiens
aataagacagtaagccatgcgaagagcattctaggcagaggcaagagcatgtgcaaacgccctgaggtcaaaacaagcctggtgaactggaggtacagcaatgaggctactagctactaaagctggagaagactgacccagcccaaatgcatggaaaatgaagttgtagagggaagaatttgaatgctttttttgagggagttcattgcaaggtttgaagaagggaaatggcatgatctaacatatttttcaagagatcactgttgctgcccagtgtagaatagaatgtagggccaagaaaggaagcactgatgagaactagtggtgagctggatcctgtgcgccctgaggctgtgaagagcgggttataggctgtatatattttaagggtagaggtagctagcaggacttgctgatgggttggacacatgatgttggaagtcaggacactcacagaggtttaccatgtgcatggtgaagccatttactgaaatgggggagactcagtgcaccacaggtctgaaccagctttgaacccatgtagctttaaaagaactgccaattacccttagaaataagaataaaaattatccaactggtttcaaggattatgctagacccagcctggtacaacttattcagacaatattctgctattgattactcctcccttcaaaacatgaagcctaatttccctgcctttgaatgtggattggacttagtgatttgttttcaatgaatacaatgtgacaaaagtgatgatgtgtgatgtctgacactagttcctaaagaactggcttcctctctcttggaacacttattctgggggaggccagctgccatgtcatgaggacactcaagcacctctgtggagaaaccagatggcaaagaactgaggcctcttgaaaacatcaagcactaatttgccacgtctgtgaataagaggatcctccagctttagacaaacgtttggacaactgcatccccagccagtattttaaatgtaccttcttgagagaccctaagccagggccacccaactaagcca

SEQ ID NO: 13337 - DNA, 1036 bp, Homo sapiens
actttgttgaaagcactactgtaagcattgcaagatatacaaacaagtatgagatgtagtccttatcttcacagaaattacactcatgcttggaagcccagtcaaagaaacatggaaagctcaagagcaatatagaaaactttacaaatagtccctgactagttgtcaagttagcttttcacacattaggtgatcagtaaatgtttgctggggagaaggcagaggacagatcacgaaagaagggtggagaagaatggtgaagaaggtgagtgatgggattatagtgcagcttcccatcctataagagagtcaggcaaggctccatggagcaggtgtggtttagcataaacttaatggatgggtagggttgtattcaattgtattgaatgatgggcaggttttatcattgccaccaaattatgaagggccctgtgatggttaattttatgtgtcaacttggttgggccatgaaatgcccagattatatgtgactttgggggtgtatctgtgagggtgcttgtgagattaacatttgaataagtggcctcggtaggttgccacccccaatgtgggtgggaatcatcaaccccttaagagcccgaatataagaaaaggtggagaaaggaagaattcatcccttttgttctgcctcactacttgagtaggacatcccatctcctcttctacccttgaaccggtatttacaccattcattctcagactaaaactgaattacaccattggctttcctgggtccccagcttgcagaatgcagattgtggcaattcttagcctccatatgacatgagccaatgcctcataataaatctcctttttatatacagatagatagatgatagatagagggtagataaatatagggacataaatatacacatagatataggtatatatctctgatttgtttggtttctctggagaatcctgactaatgtagttcctattaaagaatttgcatttatcttataggcagaaagacatccttaatgtttgtagaatattgcactgtcagtaa

SEQ ID NO: 13338 - DNA, 1117 bp, Homo sapiens
agatttgtgtggagaatgtatggggctgaggtgggggtagccaagaaagatacaatggggagtggtagaagaaggaaacaattaggagaatattgtaatggtccatgtgagatgttggaagtttgaactagagtgttaatggtgttgatcttttcaaagttgttaaaaaaacaactattcagctctatcatttgaagatctgctttcagccaccattctttccttttctctttataggcaagcaagagttgtttgtactcattgtcccaggttcctctcttccatcactccagttcagtatgaactagcttctgtctctatcattttaccaaaacacttcttgccaaggttatcagtgacttgcttttcgctgacactgaccaaatgtagtatccacatttagtcttgtgttatttgatcaaatataacatttgacaacattgttcacatgtttttttcttgaaacacttttttccctgctatttttattgcatcacaatcttcttgggtttttccccctgatttttctgaatactgtaatgtatccttcttgaacttcaaccacacttcatatggatgtgccttggaattcctgttggtcttttttcaatctaaacatgatccccaacccatcttatctatttttactatttcaactcctatatccatgctgatgtttcccaaaggtcattacttggatgtcttctaggcatctcaaatcagtctctaaaactaaactcattatcttcactaaccaattttgcccctttcctgtgatatgtaactcatagaaagccaccatcatccaattgctcaagtcaaaaatctaagtatcatccttctccttttaccactatccaattaatatcccaatgaatatctattgagtcttcctcctaggcatacctagaatctactcattgtcattcaacccagatgatacactgcagccaaagaaatccattaaagccccctctaatcatgtaaacccttattggctccccatatcccaggctaaagtacaaatttattaattgtaatacttaattgaaattaactgtgttttatggtattaagcactgttctaaatgctttacatttatttattctcacaatt

SEQ ID NO: 13339 - DNA, 1057 bp, Homo sapiens
ccttactgaatagtacatgttctggatgagataatgtataatgagttttagttatactcatttcattttccactggaaagaagtgttgcaggctcttacctttccttactctctagttgtcaccttttcttgccagccttattcctttgatcgtctcttgtttgtttcttttgaatttatcagtatactttatctggcttatattcttaccacacctcttttacataatcaaggttacccaactgcatagtctgatagctacttttcagttctcatgttgcttgatttctctgttatactgacagtatgaatgttctttgaaactccgtccttattcctgatacagttaataagaagctttctacttctcttgactttttctgacttttcttgtcttagtgaactctttttgtacttaatccattctccttaaatattgatgcattacctggcatggaatattgtctgttactttcttcctcatttgaccatccttcaggaattgtttgcatcgtgtgaatcatatttgtagaatataggttgagtattcctaatccaaaaacccgaaatctaaaatgcccccaaatctgaaactttttgaacaccacatgatatcacaagtggaaaataccacatgtacgtattcaacacaactttgtttcatgcacatatagtcacgttcatctttgggtcccattcccaagatatttcattacgtatatgcaatattccaaaatccaaaaaaaatctgaaatccaaaacacttctggtcccaagcattttaaataagggatactcaacctgtataaattttttgttcttttgctcaaaaaccttcagtggccccttactgaatctgcccccaacatttaataacatttaatattaaaacttccaaatttttaaaaaagttgaaagaattgtacagttaacctccatacaaattgtgggctctacagttaacagtttattctatttgtattgttgtgtatttatcaatccatctatttttcgatcctttcaaagtaagttgcagggatcagtgtacttgcatgca

SEQ ID NO: 13340 - DNA, 1069 bp, Homo sapiens
ggtcattgttttcagcgagacgtttgggtgaaagccacatggtaatgaattggtgaggaaataaaagtacagaaaatgggagtatatacatacatatatatttcttttcaggatgtttatcactaaaggaaagaagggagctatggaaatagttcaaaaagcagaagaaaaagtatttatttttagctggggggaggttttttttttttctctttgaagtatggtgtgaatagaatatacacgtgggtagggagaaagaagtcagtgttgaaaaggaaggagagagaatttaaagaaaaaacaatcctttgggaggcaagatcttctctgtacagttgtctggcatttgggagtgaagaacataagttaggatggatgccataatgctaagtttagagctgcagaggagagaagttgaaggaatttttgcttgaaagcttattttcctccatgaagtaggaagcaaagattttgactgagagtctcatggttagaagtggagactggtggaattggaacacctgccatggtgtcagtgaactcttatggccttgttggaactggaaactaaatttgctgtggcagccacctacatagtcacgtgatttgttgtcttccctccaccagaaggcagtagacagacttatcccaaattgagtcttaatgggatagatgtggccaaggataagcggactagagaattgagggtgcagttgaaggtcatacaagttttgcattttatagtccagactacataggatagaaggtaaaatcaggtagcagggaatagagggcccagagaataggctcagtggaagtaaggaatgaaaaatgttgaggccagaaggttgggataaggaaccaagttgtatgaatgtaatgtttttgggaagaagcagttctagatgatgaccagatcagggattctgtcagagggtagagaactgaggtttactggaccactcaactgtagatatccatcattactttttgttttgtggctgaggtgttaggatggtttagttgtcttgtattacagtaggatttaaggttgaggggatgatattgt

SEQ ID NO: 13341 - DNA, 1068 bp, Homo sapiens
cttatataaaactactgttgttataatggaggaaaatacaaaagtgatgtcaaacagtgtggtgtatgctacttttagaacctcccttttttgtgtgtgtgtcagtgactctagcataagtctaatgagttgattgacctgtatagcactttactttattacttatgttgtaataagtgatgggttttatttttaaaataagcagtctgtattttctattgtaatgtatttctggagattatatttcaaaaattggggtgagaaatacttataaaaggaaatctaaagaactagctggataaaggaaaaatgggaagagaaagggacaagagtggaaaagtaaaacttcaatcttttagcaaagggaaatactgaatttgcttaagagattagagccgttgctgaaatcaagatgtgtaaaaaaattaccccttgtatgttatcggagcaaagtatttggggtcaggagcttcctgtgtctgccacttaaatgtttaatattgtgcaagtaacttaactttcctgaacctcagagatgctaagatcaatgtatacagaagtggtatatgaaatggttagtattatgtaaatgtttgttattattactttttctttttgcttttttggctgtgagatagtgggcaagtaaactaagttctttgtgcatactaataagcacatagagaatactcatatattatgagattcttacttctcttgtctggcactctttttcagaatttcattctagaggttcttgtttagtgtattagcctttaaacggtatttatccattctttctctttataataaatttggactaaagtaagatatatgattgtaatagtaatttatatattttatagcttataacataggcctataatagcaatagtagtcctgtattggtggccagttgtaaattattaagtcatggctatggctacaaaattaaatagattttattggttattctttttgaattctttcttcagatacagaagtttacggtgagttttatcccgtgccacctccctatagcgttgctacctctcttcctacatacga

SEQ ID NO: 13342 - DNA, 1474 bp, Homo sapiens
tatatatattatttagagattggaggaatcttaaggaggttagtgtggggcagagtagaatacagaggacaatgccagttccacttcagagccataatctagtgtttatttatttaggggaatgtgaaaatgtaatcagtgataaaaatgttgctctcacatatgctgaaaagaatgttgagcactttgtagaatgctgagaaacagtagccactgagcgattggtttttaggtatgaactgggtggcttcttttagaaaatgcctgagaagtaaaatgtgtgttagaaaacagcagctttagagacaaaggaagggatcccacaaataagttggtttacatttttcaataatatttttacatttggataacagtattattatctttgaacagcatctggaagggcatgagggtggaattcagaaggagtcccaaaaggagggagttaggatatgggaagcagatgcgattgggtttagctgtaatttataccatttaagtcatcatttgtatctctcttctgtctttcctctccaatttactacacacatgcttcttgtttttagtgatttgattactgtcttgcagttggggtacaaatttagtttgagacttcatattttaaattcacaaactccttttcctcctggtgaggaaagtcatacacatacagtagatatcttctgtttttgtttttggatcccccccaccctgttttcctggttaaaaatttgctggagttaataaatgtttccctaagaatcatatgcttaagtatttcaaaggcttatactagtaatggtaatgttttatacttatctaatattttttatgtgaaactttagagaattttacaggtattgctttttaaattattaaatatatttgtggttgttattttaaaatactactttacaaaggagaaaactgaggtagatataagatgtatcccaaataatctaaatcattagagtgactgtcttccaagttgtcttttctaactcatcttaattttttattataagttagttttttattattacttcaaaataagaactcataattaaaaatatgtacataatgcacgtatcttcaaatacagatttcacagatgacaggcacttgatattactatacaggcttattgtttttttcctcataattgttagtaacctcatgtatatatttcctttttatctactttatataaataaatatgtcttagttcacccagtagttatattaattgaaaagattgagcccatgggttcaatggggtttttatgagttgaatcagtttaagtgcgtcaggtaactttactattgaagaaaatcacttaaatgtatatttttatgtaattctggatttttatagctagatttgctttaattttggtacatctaggcttaacaaattgaaaaattgtatttccttgtgacagagtttatccttatagtgtaaaatatattacag

SEQ ID NO: 13343 - DNA, 1030 bp, Homo sapiens
catcttttactctattcctctttccaccttctttgaaaaaacaacaacaacaacaaaaaaaaccaaaaaccttaattgctatctcttttaggaaacctttttctctcatcctctttaattttgatcatcttggtttccatagccctatgtgtgatttctgtcaaggtacttatgagacagtgctgggagtattaatttttaggttactatcctcaatggtagatattatatcttactcaattttgcatgtcactgcccccccccccgccccgccccacaacacctaagcacaaagctcaatacatttaatgaatggttggataggatggatgccagagtgaggctgtgtgtatgtactggcatatataaaatgccttctggcctttaacttagtgtctaatagaggaagatttataaacaggaaaattggctagtattcaggtaggaacaaaaatcatgggtcagagcaattgaactccaggagaaaaagggcagtcttcactgcagaggtgacattggaactagatgttaaagaataagtagaagtgtgcactgtgtttaagcatttcatacattctcatatttttccatctcttgcatgatgttctctgccttccttgattctcctcagaaggaaggaattatctttccaattctcataacagttcttctgaggctctttattaaaccgctttctactgtgtatctcagtactttgcattcatgcctcaccacttctgcttgagggcaggatctgtgtgaggtgtagagtcatagcctccaatgggcctagcacatactaaacacctttaaaagatcaagattttccacatcattgtgagccactcactttaccactgcagataccactgcaggtgtccacagtggtacagacttccttttctccaaatgcactgtgcaagaagtaagtagaataattgcgaacatctttttcacatatctcccaacttcatctccctctctagaagtaaccactattaacaatttattacacgctcttacagatgtt

SEQ ID NO: 13344 - DNA, 1047 bp, Homo sapiens
tatctgagtttgctcaaggaactgaaatcgtcgtgtgctgagctcaatgccatgtgcaaggtctccgactagcacacagaaaactctaaggaactgtaattcagtgattcttgccatctgcaagcctgtggaattcaggtgcccacaggaaggaatggagaggtttttccagcctgaccatatcagccgtctcaccacaagaaccttctgttttggctgtcgtccctctatcagactcaggctgttctttatggccaactgtgagtttaacgtgtctggtttacattctgttggtaaagtgtttctctcagttccaagctcctttccttccatccgatggcttgactgctttgtattcatgtttgttttttaagaggaggtaggatgggtggacgttagggaccataaaacaactctagaagtttgcattcacaaaatagtgaaattaatactaataaggagaaagacaggcactgatagtgcagcagagaaaatccaacaagtaggatcagaggtgtaaggatgtggtaggtgattaaataactctgtcagtgtggagtgggcagtaactaaccattttatttttaatttttttggtgaattaagcagaagttttaatgactatccctttctcatatttgtgaggtgtgggctgctgtaagctatagaaccatggcaaagggcttaatggggaggaaaacagttttaaaatttctcttagaacccagcccactggaattatgaaagcagcctcagtaagtaagatagacttgcatgcgtccagttacagaggtgtagggaaaggaatgactctagttactggaaactagtatttgcattggacaacattattatttgaattggatggtggaggcaaaagtacatcttaactttatcaaacatgtttcagatgcaattcttaattcctccacttaaggccattatgcttgtggatacaggatgatagttaatacttttaaaacacattttaaaaaattacctttaagctcctcaagtattctaaggatattcttaagctccttaaga

SEQ ID NO: 13345 - DNA, 1045 bp, Homo sapiens
atgtgagttacacattgaaaataccatctttaaaataaatattcagttctatagatgattcatttctttctcattaagtctaagccttttgtggtgctaaaggatactcaggaattgatgaactaagtggaccctcctgcagcctccgtcactccctcccttggcttctgtggactctgggccttagtagggatgagatagtgagtgtagactgaaagtgctctgtacagacttgctttgtggcctcctgttcagctgccagtctcacagcttgccctgagaatggacttcctgtgctgtcatttacactcagtatcacactaagggctctttgtcactcagtctttgagacagaagggggcgagataacaaatctagactgcttgtgttgactttgtggataaagtaaagggctggagtcaagaaccctgggtcttatcctaactctgcaactgcctttcctgtgacattgagccagcttttgacctctccattcctcagttttcctcatctatgaaatgaggatccctatactgtgttctcttattttattacagagatgtggtttctgaaagagtttctaaatgcttaaagcccttagtaaaagatttttttctacaagtagataaaatgacctttttctgctttggagagatgggatggataccgcagttgattaattactccctactcccagaaatacttctctttagaacctcgtaagtagggcctttcccttctaccgttgtaagttttttctcattatttcattttgtgtgctgtctcttccccctgcaatatttccttcctttctatgtgggaaatgatagccccatgctatgggatcagggtgcgtagaagttggtaaatataaagtacacttataaaaggctgtgttcaaagtgcatctgcagagacgtggaggaaaacaaggagagcatgctgagtgacaggaatgaatgagggcacacagtaaaggccatggaagcttcagcaaatttattggcttcagaaacataaatccacaaaagcagctaccacctgg

SEQ ID NO: 13346 - DNA, 1031 bp, Homo sapiens
tggtagtcatttatggatactcgatctaaagtcagtttcttttacccttggataaatcccttatttcttcaagtggcttgaggggataatgtatcctgaaaagaaaccacagccctaaggacagatatcgatgcacagtttataattaatggcaaaatgatcatataatagggacaaaatacacatgtacacaaaataaagtgcacttaatattttgagcataagtaaagagtgaccttttttttttttttttgagacggagtcttgctctcacccaggctggagtgcagtggcgctatctctgctcaccgcaacctccgcctcccgggttcacgccattctcctgcctcagcctcccgagtagctgggactataggcgcccgccaccgcgcccggctaatttttttgtatttttagtagagatggggtttcaccgtgttagccaggatggtctcgatctcctgacctcgtgatccgcccgcctcggccaaagagtgaccttcttaactatattctgaatgaacttaccgtgctgaaaaaaactccaaatattgtttccttttaacaaatcaaagtttacgtactgggatataactgaaaagtgagtgggatataagttaattttattctgaatataacattgttctctaatcattatacctttgtaagtaggtattccacttagcaaatgcatgtggaaataagtcatccaggtaatattgtgcattgtctatcgaaggttctctgttgattgctttgtatgttgcattattgctataaatatttaagtgccatgcactggagagtatatagagtgaaataaattgcaaccaaaaccaaatgcagtgaggaaatataactttaataaaaatattaaatcaaagaaatttatagattgtggccaactatgtcctttttctcaaaaagaaatttacattaacttacagcaacatgtgtgcagtctacatttgattgctcccaagttatttgaaaagtctccaaacaacattgaatgcatttaaaaacacatg

SEQ ID NO: 13347 - DNA, 1004 bp, Homo sapiens
tcccccacccactgggccacatgtgcaaaaaccccatctaccgctcccgagagggcaactccgtagaggattacaaagacctgcacgagctcaaggtcacctacagcagcaaccaccacctgcagcagcagcagcagccgccgccgccaccgcagcagccacagcagcagcccccgccgcagctgcagctgcagcccggggaggaggagaggcgggaaagccaccacttgcggagccccgcctacagcgtcagcaccatcgagccccgggaggacctgctgtcgccggtgcaggacgccgaccgcttttacaggggcattttagaaccagacaaacactgctccaccacccccgccggcaatagcctcccggaatatcccaaattcccgtgcagccccgctgcttacactttctcccccaactatgacctgagacgcccccatcagtatttgcacccgggggcaggggacagcaggctacgggaaccggtgctctacagccccccgagtgctgtctttgtagaacccaaccggaacgaatatctggagttaaaagcaaaactaaacgttgagccggactacctcgaagtgctggaaaaacagaccacgtttagccagttctaaaagcaaagaaactctcttggagcttttgcatttaaaacaaacaagcaagcagacacacacagtgaacacatttgattaattgtgttgtttcaacgtttagggtgaagtgccttggcacgggatttctcagcttcggtggaagatacgaaaagggtgtgcaatttcctttaaaatttacacgtgggaaacatttgtgtaaactgggcacatcactttctcttcttgcgtgtggggcaggtgtggagaagggctttaaggaggccaatttgctgcgcgggtgacctgtgaaaggtcacagtcatttttgtagtggttggaagtgctaagaatggtggatgatggcagagcatagattctactcttcctcttttgcttcctccc

SEQ ID NO: 13348 - DNA, 1001 bp, Homo sapiens
tctctattgtaaaaaaattgtgactaataggcttccttaaataattattgaggaaaaagaaaggattggctacacatgtcttttaataaactgagtagttatgaaagacaatcaaataatgcttaattaatttaatcaacaggaaacaataagtcacatgtagactatgtgctatttttcattctctagaaaacaaacattaccatgcttggctttgatacagaaccttgggagccttcaccttctgcggggcattccaaagacattatttagcattcctatcctccatggataattagaggaccatcaaatactctgtgttacatgatgcagttgtaaggcaacttgtacagcaacctgagcctcaactcttttatataccatcccattccttcaggtgaaatcttctacatccccatggtgtgtaggctgttgggtttgttttatttttttgtcttttttttttttttttttttcctgaccagggcttgcacttccccactctatgctgagaactgattcttataaatctggatgctaacatataaagtcagcagatattgaaaacaacatcatcatcttttaagacacatgctatagaccaggtcatttcatgaggcctcctgaccagcagagttcaggaaaatttaggttttcaatattttcaatccttttatcccaaatattgccagttttttatcacagtcccattctttccttataaaggtcgagacataccaagactgtgtgttgagtcttcactgcagtgtttccaaacttgtaaccattatcttcggcctgattttcagcctaatctttctagtggttacagtagttaaaattgcttttaatactaccaaggaattcgtgagatatttatagcacccttaaggtcgaagaaaaatctgtcctgagcgctctctctctctctctgtgtgtgtgtgtgtgtgtgtgtgtgcgtgttttgttcaaggtctccaaatttgtcaaatttgtcaaaa

SEQ ID NO: 13349 - DNA, 1069 bp, Homo sapiens
cagtcaccaccctaataatccacaagaaattaattgcattctacatattgtagttaatttattattattttattaaactttgtctagttcctcaaaactcccagaatccatttttaagagcaataagcaaatgcaagggaaataagcagaaagcaaaaacatatgacaggcataggatgcactcagtatgtctaaagaaatgtaattttatgtaatttgcctacctcattcatagacactcagtagtctaaaggggctccagaattaacaatctatattactttgttttcttcaggagagtagaacaacccactcattttttctttagagaagactaatggatttctatgctaaatagttatgatgtttatagtccattgaaaccaatataaaatatggacaaaagtattgtaaaggccaaattttaaaggtatgtaagactgacctactgctataggctacggcagaaatatcctaccatattacttcattacatttcttcatagagatgagagagatatgaagaatctatacatctgaaacaaaaacgaaggatgatattcatttgcaccttacaatttggcagccagaatgatagtaactgtcacatatgtttcatatttaattctaaaaaggagtgagatatttgtgagcataggcattttgaatatcaataaactgaggctcaaaaatgtgaagtaatttgctcatatttaatattttatctgtaaaagcagcaacagaaaaatagaaaagcttcaatatctgagtttttctcacatcatttggattaaacttttaatgatgcctgcagaatacattaaggtgtggtgtagatgtcggtgcttaaacatatagtaagtatatttatttgttaactcatgcaatcaatgatacttgagcatgtagtagaatgtgataaccactcaaaatattaaaggaaataataatatataagactcaatatcccaaaaggccttcagagtagagagttaaacaggggaacaggcacttctatgatttccataaatgttatgaaaggtgtattcacatggtagtatcagaacaa

SEQ ID NO: 13350 - DNA, 5586 bp, Homo sapiens
tgactctgacccgccgccccctggcggctacgcggagaatcgcagggccgcgctcccccttgtgcgacatgtgctgccggcccgggctccatgagcgtggcgggcactttgcagtctcgggtgttcctgcccggtcttctgttcctaaactgcagcaaagggaaaaggaactgaaaaaggcaggctcgtcgttgcaatatcaccaaaagagaaaattaacggcatgccatcaggaccacagcagttggagaaacaactctttatcccggcttgcagccacgaggtcttgattgggggaggggtggtgaagaatagtctgtgggctgctttttttttttccttttactggagctgtacagtggagtcggtgattgctgctgatcataatcaagtattttaggagcttatttagacatgtatctgatagctaaggatttttcaactttattctcttacgtatttttcaactgtaaattattgggcttttaaatcctgctagtattgctcgactcttactctcacaaatggatggaattaattgctgttaggaggttggaaaatagcaaatatagatttggacggtggtagtaattttgagcaaataatgttttatcttttttttccttatttttccctattccagtcatacacgtggacctaactgcaccagtagcttttctgagaatacttgctgaaaaggaagttttctggaatgggtaagtgtattctgattttcttgaacttttcttaaaaacaaatttttcttgctattaaagttgaataaataggattggtttcttagagagtaaaagtaggtgtttctttctttagacaatgtaccttttctgaaaaactaactcattaagtacggatttgctaattttaaggtagtaaaattacagtgtaaatattcctgtacatttttggaaactggcttatgcagtttacgaaatataattttagaccctcttttaagttgggtgataaagtagatataacctgagatgatagatttaaacaggatatttacgttctgctacaattgactgataacacttgaagtgtagtctgaacagtaattttgttaatcatttcaacaagtatttgctaagtggaagccagaagaggaggaaaatgttttgccacgtggatgtgaagatttcctctaaaaggtacacatggactaaattgcctttaaatgttccaaaattagttctcatttatttgcagtctcattttgttttgttttttttctctatgtgtcaatccatttgggagaggccagccattggaagagccaccacttccagtgctagttggatggttggttatgattgccttctgtaaagaattcttaaggcataaatacgtgtctaaatggacctcatatctttgagataattaaactaattttttcttccccattagggattatgctgaatttgtatggtttatagttgttagagtttgaggtgttaattctaattatctatttcaaatttagcaggaaaaaagagaacatcaccttgtaaaactgaagattgtgaccagtcagaataatgtcaaagtgcttacagtgcaggtagtgatatgtgcatctactgcagtgaaggcacttgtagcattatggtgacagctgcctcgggaagccaagttgggctttaaagtgcagggcctgctgatgttgagtgctttttgttctaaggtgcatctagtgcagatagtgaagtagattagcatctactgccctaagtgctccttctggcataagaagttatgtattcatccaataattcaagccaagcaagtatataggtgttttaatagtttttgtttgcagtcctctgttagttttgcatagttgcactacaagaagaatgtagttgtgcaaatctatgcaaaactgatggtggcctgctatttccttcaaatgaatgatttttactaattttgtgtacttttattgtgtcgatgtagaatctgcctggtctatctgatgtgacagcttctgtagcactaaagtgcttatagtgcaggtagtgtttagttatctactgcattatgagcacttaaagtactgctagctgtagaactccagcttcggcctgtcgcccaatcaaactgtcctgttactgaacactgttctatggttagttttgcaggtttgcatccagctgtgtgatattctgctgtgcaaatccatgcaaaactgactgtggtagtgaaaagtctgtagaaaagtaagggaaactcaaacccctttctacacaggttgggatcggttgcaatgctgtgtttctgtatggtattgcacttgtcccggcctgttgagtttggtggggattgtgaccagaagattttgaaaattaaatattactgaagatttcgacttccactgttaaatgtacaagatacatgaaatattaaagaaaatgtgtaactttttgtgtaaatacatcttgtcttgttttcattcaaaaacatttcacttttggggttgcgtgtcagatttggcagtataaattctggctatattttttgttgttagatttatttggctgttaagtattgcgatatgactaaacatactgtatacctgatgatcatctgtaaagttagagtatatctttttgctttctttggagttagtgttattccaggatattttacttaatctaaaagttaatttatgttgctcatatattactcaagtatttaaatttagagagaatgccgctctgtttaaagcaatgtgtaaagatgagtttttttaagcatggaatttagggttggggtacaatttgtttctattaagcaagtaccagtttaccaatacatgagtaactgaagtgtaactgttaaatgcttgtatactagtttttctttctgattgtcagtgatttataagctataaatgaccaaggtcctcagactgcttttagcatctgcaacttaaaaaaatgggagttagaaaaagaacaaatgctaaatagagtaacagttaaatgtatgtgtacactcttcccaaatgccaagagtgcagcggtggggtgagattcagatattcatttatttctaagtctgtagttaacatttatgttccctactccctacgtaagccagactttggcaacagtgatagttgattccaggcttatttgacttaaagtcactgaagtggaaactaagaagtggcagttagtgttttacccagcatttctgccttctctcttttcttcatgtgtttttgtctctagcctatgtgtatttgtgtagaataatgtgggatacctgaataatagatttaaaaggaccaagtggtaaaattgggcccaagctgaagtacaggcaaacttgatgtttgaaagataagttttgagaaatgtcattgtattttggagtaaaagaggctatcttagtaataagaaataaacttccataacactaggttagaccacccaataaatctagaaatcagcttttaaaaatattgtctgaagtctaacaaaagttttcacctctaatgtgttctttaagaaatttaaggaacttagccttggattcctgaatagaaaggtaagaattctatcattctggagttgatgaaaacataaattttcaggatgtgaaatgaacagtgatttataaaatggaaatcaaattgtacattagcagagttcttaagctttttgaattgaaggagacctaataattgtgtctttttggttatttagtgacaaacgtggctttcaaactatgcttaaaaagttccggctggacacggtggctcacacctataatcctagcacttggggaggctgaggcagacggattacctgaggtcaggagttcgagaccaacctggccgacatggtgaaacgctgtctctactaaaaatataaaaaattagccgggtgcagtggcgtgcacctgtaatcccagctactctggaggctgaggcaggagaatcacctgaacctgggaggtggaggtttcagtgagctgagatcctgccactgcactccagcctgggcgcaagaccaagacttaaacgcaaaaaaaaaaaaaaaaaaaaaaaaaaagtttcataatacagcatggtctggtagtttgcaaaatggtgtgcttttggggagatacactagcaatttttttaaaaactggaacagtgtgataggaagcctgctggatgatttcttaaatattctaaaatgtaagtcaaatatgttttaataacaaagacttaaatggcttttctccctagagactgaaactagtattcattgtgttcagaacttaattgggcttgaactgagatttaaatctaataaacaagttaataaatgtgtatgttttgttgtgggtttggtagtgatctgtggttctatagggtttaataggaattgcttttgatttgtttctggctttagaatgtgaggcaaattttacattcttggttctattaagattttcttaggcatgctaacatgccaacaaaaagccatgtaagtattgtataaaaagattcacattgttaatttagccattttgaaattcagatgagtgagcaagttgataatggcctcatctctgacctgagaaaaaacaactttgacccttgttcttaaaatgctttaaccttgaagttgcttgagacttaagaggtcatgttgctttaggtttaataaatagccttaactatttggaggggaaaaaatgggtcaacttttttttttttttttggcgtttgcatgtacaactttctatttttagcctatatttggaaagaaagcacttaacattttaggaattctttttaaagctgcttgcaaagtgttggtgattttactgaaaacttttgagatcttcattttacaggcagacctgtctaactacaagccagacttgggttttctcctgtagtttgaagacacactgactcctgacaaaatgcagcctgcaacttcctggagaacaactcagtgtcacattaaagtttattatgtatttaatgatacactgtttaattgacagttttgcatagtttgtctaactttagagaattaagagcctctcaactgagcagtaaaggtaaggagagctcaatctgcacagagccagtttttagtgtttgatggaaataagatcatcatgcccacttgagacttcagattattctttagcttagtggttgtatgagttacatcttattaaagtcgaaattaatgtagttttctgccttgataacatttcatatgtggtattagttttaaagggtcattaggaaaatgcacatattccatgaattttaagacccatagaaaagttgaagaatgcttaattttcttatccagtaatgtaaacacagagacagaacattgagatgtgcctagttctgtatttacagtttggtctggctgtttgagttctagcgcatttaatgttaataaataaaatactgcattttaaagctgttaagaaattgtccagaacgagaatattgaaataaaaacttcaaggttattatcgcagtttttatggcgtttttgttttgtcactacagatggtctaaaggttacttattaa

SEQ ID NO: 13351 - DNA, 1016 bp, Homo sapiens
aagactctgcctttggctcacggtctcttactccatcttcatatctagcagcagcaggtggcgtctgcatcacactggacccctcttacctccctctttcacttttaaggacccttgtgattaatattgagcccatccaaatatttagaaataatttattttaaggtcagctcattggcagtcttaattccccttgtaacatttcacatttgcaggttctaggattaggacttggatattgttggaggtcattctgcctgtcttagggaattgtgttggttttggacatggttatagttccaggcatacataactgcttagagttgttttcagacagcgtaagtgaaatgaatgagctaaggaaaatacttaatccaataaaaaatagaacatactcgggctgtctcaatgttttcctacggtatttaagtgccagtttatggaggttttaaagaaaagattttctcagacgagaagagcttataatatacttcctgcaaacattctagaaaatgtaggtccttatcagtcaaccttcagaatggggaaaccacaaaataagtgaaattttgttaacctatctaagtaaacattaaagagttgcttttagaaatgacacaatgtaaagagaccatcagggtctaaaacctcattagccagaactggaaaatgagcttttaaatacaggtaaaaagtaaataagcaatttatcctctactttgttagagtacagaaatagtatttcaaagcaaccactagcagaataaaagactatacttaactttgaaatcaccaggaaaaaggctaggaaaacagcccacaaagcaaaagacaaaaaggaggagacagaaataagaacatttttaattaaaattaagcacagaaaaattttaagtagtttgtattcaagtcagttttacttaaattttataacatgcaagccctggttatttttagtgattggaaatgtagacaactggtggtttgcccctagtcaatgggaagtcctggccctt

SEQ ID NO: 13352 - DNA, 1034 bp, Homo sapiens
actttacctaataataaggctatacagctatagtaattaaacatgtggtattgacgaagggatagacacgtagaacagattagagaacccacaacagacctacacaaatatgcctgattttgacataggtacaaaggctattcaatggagaaagaatatccttttcaacaaactgtgttgagaaattgaatattcataggggaaacctaaactttgtacattatacaaaaatgaacccaaaatagatcatatagtttatgtaaaactgtgaaacttttagaaaagaaaattgaagaatcttagggacctaggtctagaagaacagttcttagattagacaacaagaacacccatgtttcataaaagggaaaattgggccttgtgaaaattacaaaccatgttcagagaaaggttaagagaatgaaaacactgtaagcaaataattgcaaactgcatatgtgatgaagtacttgtatctagaatatattaaaaattcaacagttaaaaaaacccagtttaagtagaaaatgaacaaaatatatgaatagacattttacagaaggggtatgcagatgacaactaagtacatgaaaagatatgcaacatctagctttcctggaaatataattcaaagctataatgagatatcactacaccctatcaagtatggtgaaaatgaaaatagtaataacaccaattgttgacaaggatgtagagaaactggatcactgaggcactgttcatggtaatataaaatggcacagtctggaaaacagttggcagtttctattaaaattaaacctgcacttattgtattgtccaataaatgcacgcttggacatttattcagagaaatgaagtattatgttcatgcatagaactatacacgaatgttcatagcagctttatttgtagtagccccaaacaggaaattaatgtgcttcaacaggtgaatggataaacaaattgtgttatgtccatatcgtggaatatgactcagcaataaaaaggaatgaactattgatacatgcaaa

SEQ ID NO: 13353 - DNA, 1142 bp, Homo sapiens
agatctatatgccaacaaactctttgagtttatggataatacagagacaaagtagttaacaaagaaataagtaaaaatcacttccctctgatgaagttgaaaatactcaaaatatcagagtatttgaaaaagtctaaagacttaaatgacatagaaaaaatgactttgaataaaatatttttaaacatatttaaagtaaaagcacatgaatatcaagtaaattaaaaatataatgaattatttatggatgactttgatttataatttaaatcataaaccttgattttccaagttttcctgcttaataatttgactatttgattattatggtgattatccaattaaaagtttaaatactattataaaaacaaaacatgccaatgctgagaaaaaaataagaaatataaatgaatagcattgaaaacataagtcccaatgccccaaagtaaccatggttagtattttggtatacacatttttatatatatcaaatagacatatactagattttcaaatatgtgtatatatcttagtttttgggggctgctataagagaataccatagactgagtggcttataaacaacacagatttacttctcatagctctggaggctgggaatttcaagatcaaggggctggcagatttggtgtacggtaagggcctagttcctggttcatagatatctgtcttcttgctctgtcatcacatggcagaatgaggaagggagctctctggggtctcttttataagaatcccattcatgaggacctgtattagtctgttttcacactgctgataaagacatacccgagactgggtaacttacaaaatgaagaggtttattggagttacagttccacatggctggggaggcctaacaatcatggcggaaggcaaggaggagcaagcacatcttatatgggtggcaggaggcaaaaagagagcttgtgcagagaaactcccatttttaaaaccatcagatcttgtgagacccattcactatcacaagaacagcaagggaaagacccacccccatgattcagtcatctcccactgggtccctcccacaacacgtggaaattatgggagctaaagatgagatttgtgtggggacacagagccaaacaatatcacagcca

SEQ ID NO: 13354 - DNA, 1078 bp, Homo sapiens
gtcttattttacggtattgaagtttgcacagaaatgatttacagatagtggtccattgttttacttgaagggaccttgatacttactgaatagctttagctatccaaatcattctaaaatgattttatagaagtcattgtggataaagcgaagaacataggggttttttttcctataaaaattcatggcaagcctattgactttctttgagctatggggtaaagccggctgttagataaaatccctaactctcttttaaaacttacaaaggaaagatactttttagtataaattttgaaagctgtaagtagccctagactcctttaagaacttgttcttcactcttgcagaagaaaacagaagggagtgtgccgttattaagtattaggtatactagaaaaaggtagaagacaaacgtctttatactcagttcttattcaaagagtagctgtgtttatgtccttcactttctttttgttctttatacaaaagtagcagcttgaatagaaactgtgagaagtgtactctaaataggaactggtatgtgtgataaagctttaaagggtaaatactttggatctgacttttcacttttattcagtttcactgtattttgtcattcaacttgatgttttcttgtgcttccagattgggaatggtggctgaaacactctctttcattgtttccatgagtctcttagatctttctgctaataagactaaataaatgtgttactcgcagtgacatgatttagtcacaaaaacgtttttctggggatccagctaactgaagttttcaaatctagtcaagcagttattgagcatttgatgatttggcatgggaattaaacaagtgattgtaagaaactcaaataactccttaatggaaaaaaaatgaaaaaaaggcagattaaggaaattgacacttgaatgaagagtttaatatgattttgacaaaaatcctgaatattcattttatatatgttattgtcaaagctctggctaaaaacgattaaattgcaaatggtattgaaaagggaagcattcagcagttggataatccaaatgcaggaaggtg

SEQ ID NO: 13355 - DNA, 1077 bp, Homo sapiens
agattttttaaagcttactttctgatcctatgcgtattacaaagtaatgaagctgaatatctttagaggtagtcattattttcatttaaaaatgtatttaatgagtcatcactatgtgaaatgcctcttaagagctcaaactatagcttatattcagtataacactgataccctttactctcaaatatttgaccctataaaattgttttaaacctgtaaattttatattgataattttttctagtaccagtatctaatttatttcctaattatgtattatacaaacatattaaaagcattttacagtcttggacactaagcaatatggaggtaagacttggttgaagataatctaaagagataaatgtggagagataaaattaaaatgaactctgataagagagtaagtgcttcaacaaaaatgaaaatttatccctcttcaaagttttatcgtatatatatgtatatgtatgtgtgtgcacacctatgtgtatatgtctatctatgtctatacctgtatctatttctagtttgtcactacatcctgccacttggtttattatctctagtaaatagttaagagagcctcaaaatttgtagaaaaaagatgacatttatcaccaagggtaattatttaccatattctttttttgtggtaaaattgctaactatgatgtaaatgtagaatgtccaaacatttgtatacaagttgaatacagttagagctacattctgatttgccattttggtttctggaacttgtttgacctaaatagctaagaataaaatactgggaatagggagatttggtttctagtctctgatgagctgtgtaattttagataagccacttaaaccaaagacttaaactttagtctttggtttccatgttgtaagataagatatgatttaaagtctaacatactttgtaattccaagagtccacgaggtagaagagagtcaggtgcttcaagcaagtacaagtatcagaatcagatgagacagtaacagaaatcctggagacacagttttctggagtttgattctaccaggtcaacaataggaacaataagggac

SEQ ID NO: 13356 - DNA, 1026 bp, Homo sapiens
acaaacattagtgattgctataccttcgtgataaattgatccttttatcattaggaatgatctttgtagttgataatatcctttcttctgaaatatttttgatatttcatatagccattctggtttaatgtaattaataaagcaatgtatctttttgatatatattttttcattcttataattttaatctattgttgtcttatattaaagtatatttcttataggcagtgtgtaattgagtcttgttttttatccaatatgtttatctctgcctttaaattattatggctagatcacatgctatgtgattacattagtatggctagatcacatgctatgtggttaaatatattgttaggtttaaatctattatcagttttaatgtctttcctgacaattataatacactgtcaattctgcattggctttgacgtattggtttttcttttgattatgagttgtgttttccttattgtttgcatgcctcatagtttttgatcgaatatcagacattgtgaactttaccttttagggtgctgggttattttatattcctataaatattcttgagatttgttctgggatacagttaagttttatattttgggtctttcttttcagacttctgggtgggacaagaattatgtttagtataaggttaatttttccttaccacaaggcaagacccttctgtgtactctctccagtgcccggtgaattatgaggtttcccagtgttgctggtagggacagtcactatctgtcactgtaagagttgggtattctctctaattcttttgggtgttattttccgtgcctttcctagtagccttacatgaatagactgatcaatattctggtgaatactccagaaccctcattgaatctctgaagttctctcacctttttgatgttgtcttgcaaactctgccgctttgatttctccagactctctgcagtgtctccctaactcaataaatcttcctggctctgcatgagctcctctgcccactgcaaggcctggaaa

SEQ ID NO: 13357 - DNA, 1045 bp, Homo sapiens
cccaaggctcaggaaagctggccagagtgaatggaatcttgtctgtgcctaccccactttgctctacaactttggaacccccaaagcattgcactctgggtttttatacgccagagtaaactttgctcactgggctgaagtgtttcaggatggatatggaaaaaacccaggctgttccagatagttctccttatctcaggatgttacattatcagtacattcggcctgagaattgctaaggaaagggggaagacatggattggccagggcgattcaaagacaggtcctcctgcacacctatttgtgtacattcgttatatggaatcaattcatttgctcagttattcagcaactatttatttggtactttcagtttaccatgtgtggtgtcagctgatggtgatttggtgatgattatcaagtgagcaaagatttacttttggtatactcattaatgtttttattcagcatttaatgacagtggatatatctaaagtatgtcagaacagtagaaagattatgaatgcattataaaatgtttacatgcttaattgctgaatccaaatttcatttttatatcccacaaatatgaatgttgtcaaacttctgtcactttggaaaacagtaatgaaaagaatttattgcttgctttggttttattattgttttttgttttgtttctgcctctgaatatactatttttattaccgtacatttttcttccgtagctcattttatcacattccttaaatgtcaggttcattttgttcttataactttcattttgagtagtggcaaacaaagggataggctattaagaaaaatgcatcggcttcttcaaatgtgacagtagttttgtggcgatatcagcattccaccaggaattcatcagtgtgtctcactctgagactgaaattctcatctggctgctttcattttctaaatcattttgctgtaagtttagctttactgtttagttgatttcatttaattctgcatggaatttattcatctgtgaatttttaaaaactgttatgattaagta

SEQ ID NO: 13358 - DNA, 1029 bp, Homo sapiens
tggtatatggatatgtgtcctaacaatgttaatgtgtccatcctacaatggtctgatagaaagagagcatgcaagaaagagagagagagagattgagaaagagagagagagactatgtaatagtgggggcacttttatatatatatatatatctgtttgaggcattgttcattgatatgttgtcaattattctcaaacttagaagtgaaattccatgtttactttttttcctgcctatctagaatttctttgacagtttcttttcctttatttcctataactgattgtactttcaagcaatctcctgagcttgagaaagtcataaattctccctctgtggtcaattaaactggttggggaaaagtctcttgatttgccaatactggtggttattatagaatgtaggataatgaggttttgtgtttggatctgaatctgttaaactataaaataaatatattttttatttgtacattttacattttggatttgaatccattaaaaagtatactttggatctgaatgtgttaaaatatatttttgagcagtctccaaaatgaaagatagggtgttaagctttctgacagatatggtttggctgtgtccccacccaagtctcatctcgaattgtggttcccgtaatccccaggtgacctgggagggacctggtaggagatcatttaatcatggggatggtttccccgatcctgttcttgggatagtgagttaattctcccgagatctgatggttttatacggggcttcccctttgctgtgcacatatacttctctttgctgctgccatgtgaagaaggacgtatttgcttccccttatgccatgattaaaagtttcctgaggcctctctagccatgctgaactatgagtcaattaaacttctttcctttataaatcacccagtcttgggtatttcttcatagcactatgaaaatggactaatacaatgaattacaagtaaacctcctctatatgcagataggtggtttagttaccacaaaagtgatgagttc

SEQ ID NO: 13359 - DNA, 1083 bp, Homo sapiens
attgatgtttggggtaagaaaggctattttttttttagttattagtcatttttcaaaaatttatatttgaacatactttcatttttcctaagcaaaactttgtatgggtagttgatatttatttctagtatcatgagtcagaaacaatacctgaatagtacagagtttttattgcatacaacatattcaagagtcagtagtagacttctcataattgttctgcaaagacaaagcttaagtttatgcagagccagttcttaggttcccattttcacaagagtccctatatctcaaggaaaggatatgtaagaaggacatgggggttggtgtccaataccatagatttctcccttctgcgaggcaacaatgcttattctaccattgatacctgtagaaaacagatctctcgccctggctggcaaaacccaaaataaattctattggaaaagtctaagagaaaagtggtatcatgactaccgatgagttaaacctcccagcctctgctgagctggtccagttggtacctcacagtatcgtccactatagtataatatgtacatctagattatttgaaaatttgagtgcataattgataataaaaccaaaagagctttaatattaatcagctcctctcattgaggagtgagtacaatctcactgtgaggacacggtgaaatcttagtggtttcttaagtgggataagcatttcacagagggtgcaggaagaaaaaacagaccttaagtgtatatttattcagtctcattcttttatattactttggttgtagtaaggtatataaaatatgtaatatattagtgcaatagcacatacatataatttataaatacataaatatacatattaactgggcatttattcagattgtttttataagatatgcacaggatgaaagcagaacggaaaccctattacagataataaagatggtgctgttccataagaagtgcacagttataaaaaaaacacatttacagagaagaacacatagatacccaatataaaaaggattatagaaacccttaggaggagggttcacatatttattgcccattcagcaaaac

SEQ ID NO: 13360 - DNA, 1026 bp, Homo sapiens
tacttatgtagcaagtttcaggatttttcatgtttattatcctcttgtaattagttttctttgaattgattgctcatattctcatgtcctgggtgacatgtatttttggatcacacattgctacttgaattggcattttatatccttgaaatacaaggatattgtagtccactgtcatctttttggaagaattctgttaggggagactaaagatgccaagaccaaggagttagaaactataattgaaagtcaggttgtgctatagcattaaagttaattctccaaaaacataggcatggtccatcatgccactcaaggaatctttattactatgtcatgctccacttacagacatacataataatcttgggctacagtcacatgtatcatatctagctatcaaaatgcaaagtgaatgttagacaggatatagtaaaataatatctcttgaaatatatctatcccctagagattctaccaaaaatgggtggttgtttggcaacttaaaacttccatggacattaataataatagtcttatcctttacagtacatccagttctcagtacacacctattcagtgaagggaaagcaatagcttattaaaacatcaaatgagaaacatatgaattaacgaatttgaaatgaaatatcttaccacattccctcttatttttctttttttttccatgttgcttttaattttttgcctgggaggggaattaaaattttactacttaatatgcaaagctaccaataagatgctcaatttcaaaatgatattttattttccaatgaaaggtgactaatacagggcttagcaaccccattccttggggatataattagctagcttgtttacacatagcctgttgagcttgtaagtgtctatacacagattatgtcagttaccacggactggccatgtccacagtggattcccaatgtgtttttatgaatatattcactatttccagggctatccctggctatcatttaattaggatgcaaacaaattggaggaaat

SEQ ID NO: 13361 - DNA, 1053 bp, Homo sapiens
gcaattttaaatcaaactatggtctcaatggactcaatttcaacacgtcatgccatatgatagggtgaatgaagtcaatgcttaaaaatacccttttagttaccctgtatttccatactggattccaatgttcaaggtaattctttgcacaataaaaagcaattcctctctttaccagaaggtggcactgcacccctcactgtcattctgaggtgggtgctgtgaagagattattcaacaatctagaaagaagctgggctttagaacattttatttgaaataatgagacacatgtgattaatttcctaaagaataattttacttttgtcatattggggaaagatgtgcatactaagtaaaaatgaacagctgttgagaataaaaggaaaatgcttcatttagaatctattaatttctatcatcattgttcagtacaatattctcagacttaattactcatgtaaagaacagtatgactaaatgtgaaataaagttttctttactcccttcaagatctgttctccttctaaccacaaactgtgccactgacattttattatttattttttaacatagaaatcccactagggtaactaatttcattctgaaacccatttatttatgttgtgatatgacagtacctactttggctttttttttctctctcctagtcccacctcagtctcatgggagtaaataaatcaatcattactgcaggaatctctccttcgagagaacagggctctttaaaaatactagttgcatatgtaatatttaaacacctgatttttaaaaaaattcctgagacagttgagatagccttccatgcagttccaaatgtattgtttgctgatggcaggaggaaagaaaggagacagtgaaaagacttattgacagatgaaaggggctcaacttgattatattttaagaaatacaataggagaaattcatgttactaaaagcacaagcactcaattaattaattgtcagaatcaggagtaaaaattgcatcttacaagagagaaagtaaagggaaaggataagaaaaagtga

SEQ ID NO: 13362 - DNA, 1045 bp, Homo sapiens
cctatgctatagttacccaatacactgtctttattattattttaaacatttatcttctaggtacatttacaaaggaaatagagaacatgttgtcaaacctttattccatcttcaacactcttccttatgtagagtggagtttctgacctatataatttttttccctttaaataacttcttttggcattttgtcttagaaagtctttattttgccttcacttttacaggaaaatttcagtgaatacagaaatccaggctggtttgtgtgggtttttgttttccccttttcaatggtgcacatatttccctatatcttcttgcttgcatggtttttaatgggagtccactgtttttctcatccttgctgtatcagtaaggtgttccctccacactgacttctttcaggattttctctttgttttggttttctgcagtttgaatatcatatgtgtaggtgtttgtttctgttttttttttttttgtatttttctttattagcttctttttggtatttatcctgttgggtgttctctgagctttctgtatctgtggactgatatctagaattaattttggaaaaatctcagccattctgacttcaaatatttcattctgttgtttcttttttgctcgtgtttgaattatacatgttatactatctgaaattatcccccagttcttggatattctgttcttcttttggatttatagtttgtttttgttttccattaacttatctgtttgcatttttgtttgggaagtttctactgacttatggcaagctcactgattctttcctcatttacattcaatctgcttgtaaagccatgaaaggcatttgttatttctgttacaatgttttttatttgtagcatttcctttccattctttcttagagtttccatctcttttcttacattactcatatgtgctttcatgtcatgtttgcttttttcattagtgcttttaacatattagccaccattattttatgttacctatctgatgagtccaacacttgtgttaaatctcaatctgattttgt

SEQ ID NO: 13363 - DNA, 1016 bp, Homo sapiens
cccttgcaatcatgctctagccaagaatttcccacagtcccttgcaaagcatcaagtgtcatcctgtacccattccctctccacttagaaaaaccaccttcagtctttgccttgctgttttctcagtactctgtccaggcatcactgcctccagagagcctcctcctttccctccactgtcttgtctagggatatgcccatggcgtcctattcctatcgcacaaattatcactctgtcttaaaattgtctaactgttccatgatgtcttatatttattttttgttttccagtgctggatacagggtggggtgcataggacaggtcaagatacatgtatagaataaatgagtgagcagttgttactaattttgttaaagacatttttacattatttaaaacatccaagtaggttatcttaaggtctccttcctctctaatttttttttcttttctttttgagatggaatatcgctctgtcacccaggctggagtgcagtggtgcgatctcagctcactgcaacctccacctcccaggtttaagtaattctctgcctcaacctcccaagtatctaaatttctataccatttttaatatcattattagagtgttttctaacaagatatgagaagtgaaaggaaatctatttattaactagttcaaacatttatttcaccaatgaacaaacagagcagaaaagttaaatcattaatctaaggtctatcatatggttagcattatgattaagactagaattcttatctaccaatttactttatggggctctacttgattcacattatataattgctgagttggagtatgacattttaactcattttaaagccttaaatcttgtctgtacaattgttctatttgtatagtgcagaatagacagaaagtaaaaatttgtttaattgaacttcttgtaacttctatgtttaaaacccaatttcccacgtctcttgcaaagactttcattatggtaaacagcaaaaggggaattcacataggaat

SEQ ID NO: 13364 - DNA, 1055 bp, Homo sapiens
agtccgaaactggccaccctgacttaccttgccaggggaaactcaaataaaggcttggcctaaactttccccttgcttttctgtcttctgatgaccgtggtgttttttccacatggtcccatttggtatctcatgtctgctgcctacagggcctgtgagcacaataacgtttgtttctggagcctctccaccgcctcctcatatgaccacagctgaccatcacacaaaggaacatgaaaaactccctgtcccctctcttcaggcacccaagagttcagcattaatttcaaaaatgcaagcagaagaggctctggattcatttgtttttctactccctttttccacagggtatcgctttttagcagggattcctggcctttttgtttgttatccagaatatgactttattggcatgaatgaaagacaattattaagtaaagcaattatcttaaatattattagcaaaatataaacaaattgtgatagaacctatatttattttttcaacatatgaaacaataaaatctattagtaaatgtaaggactactttgattacaaaatagtgatttgtgatatattgtgaaaaatgcaaataactgtgatatgagaatattggatttctactggtgacaacgtcacagaacctcatacagcaattgtgggttttagcctacaaggtctgcgacatgatttctgccaacaccagtactggaactcaatatggcctctacctcacatatatttctaggtccctttctgctttttaacaagcagataaaccagaaagtctctgaatgggctgcagcagaaacagttaaggtttgtgattggctgtcacattaatgtttgcagtggaagtagtgagagaaggagatgggtaaatggaacaagtctagaacataatggttctccatatccccggcatatacattggcaacatcactcatagatgagactccataccaggcaaaaggtggaaaggtcccagtttagaaacagtctcaccttattttacacatgaaatctaatttctgcctcagatacagagaattaa

SEQ ID NO: 13365 - DNA, 1164 bp, Homo sapiens
ttggagtttttctattgctttattcactaacctaatgaagattgaggtattaaagagagttgtccatgtgttttgtgttgatgttttaatgcaatatagctagccccattgttattatttttgtgtctatttttcctgcttcattttattttttggtgtttaattaattattttataatttcattttttattttaaattcaggggatacatatacaggttttttacgtgggtatattgtaggacattgaagtttgggatacaaatgttaccgtcacccaggtagtgagcagagtacccaatgggtagtttttcagtcctttttccccttcttctctcctccctctagcagaccccactgtctattgttcccatctttatggtcatgtgtacttaaggcttagctcacatcggcaggtaagaacatgtggaatttgtttttctgttcctgcattaatttgcttaggataatggcctccagctaacaccattattttgaggctaatttacttcagatcgagttggtttaaatccaaataaaagatgttattctttctttatcctaatcagaaaattttaggaaataatcagataaactttacaattggcaaatcaaaggcagaactgcattaaacacccagatgtaaaaggtgtgacacctcttctactcttcttgtattcacttttaggcaagaaaacaggactcttctggaaggtaaaaatgcactcatttcccttttaagactcataagccattctggagtccactaatacctaaagtatttgtcaattaagcataattttgtctgaaatagcaagctttaaagaatacgtaaatattttaaaggaaaatagattttgaagaaatcaacacatttttacataagttttccaaaatgggttatatattattccactgaaggaaaaagaaacgaacatttattgagtgattatactgctccaggcactttcaccttggtttttttatttcttttcttaaagattagttttataagttctatctttttaaataaaggaactgaatctaagtgattaagatctccgtccagagtcatgcaaataaaaacctgccaacctcacttcaaggccatagttcctccccttggatgacgttgtctcacatatagctttttttcactgctaca

SEQ ID NO: 13366 - DNA, 1048 bp, Homo sapiens
gaaaacattttcactataaatttacttttggccaggcgtgatggctcacacctgtaatcccagcactttgggaggccaacatgggcagatcacgaggtcaggagatcaagaccatcctggccaaccccgtcatctactaaaaccgtgtcatctgtggtgaaaccctgtctctactaaaatacaaaaataattagctgggtgtggtggtgtgcacctgtagtcccagctacttgggaggctgaggcagggggatcacttgaacccaggaggcagaggttgcagtgagccaagatcacgtcactgcactccagcctggtgacagagcaagactccagattgaaggaaaacagtatgtgtgtgacatttatgtgttctctttgactcttcagtaaaaccaaaagatgctagggctcacagcaatgatctttgtgttcttctttgtatcgtaggagatcttttattgctgtgtccacagactgctaattgttttataaggtctcttgaactcttgcacagtgataaacattttttaactggattacatttcccattcttccttgaagttaggtttggccatgtacctaaattctggccaaaggaatttaagaagaaaagaggtgtgtaactttaaggttaaccaataaaaacaaaatgctgtgccttttactttactgtttcccacagctagaatgtggacattttgccagagttggagcagacgtttcggatcgtgaagtgggaataatcttgataagtgggatattggagtagtacctggtaagtgagcctggatccctggcctcctcagagtcaccatgctttgcttggatttttctgtaagagaaaaaaaatccccatcttatttaaaccactgttattttggtctttctcacagagttgtactgatgaccattttaataaactcttttataattcactcgtcctgaaataaaactttcttatagaaacataaaagtaagatatgatgcaaatcagtgtataaaatgccattatgagaatgttttatggtgttccatgtgacatttcc

SEQ ID NO: 13367 - DNA, 1056 bp, Homo sapiens
ttactctcatcaaaggtcagtgtgaaacattctagtctttcctcattcatcagaattatgacctaagtttccaatcctcctcatgttggtggctctaaacttctaaaggaactctaccactgaaaatagcacctgcttaaaactctgggaaattcagagaatgttgtttcaggcttactctgccactgttttatgccttgagtcttgctaggatcattaattataacactttgtagttaacagtgacttattggcctacatgatcatgttttcattacttatgtaatgtgacattatttaacaatctcttatatagaatttactatgtgcccatcacctacttaaaaattattacctttataatatcaccttactgaattcttccaataacttagtagatactacacattaaccccattttatagataaaaaggctgtgtgacaggaactttaataaacttacctaagggtgactctactagtaagtaatgaggctgcagttcaaacccaggcactctgactccagggtctatatacctaacttggctcactgccttacagtattaaacattcaccatttattttgaatgaatgcatgcaaaatctattctttcctcatttcatatatatatatatacgtatatatatatatacatatatatatatacgtatatatatatatatatacatatatatatatatatgtatatatatatatatatatatatatacgtatatatatatatatagtctggtattattaatcactatatacatatatgtatcccttccagttttgcatgctaaatacgtttctattttgttccaacgtctctaattctcaatatcactttgactttggattttgtattctcaggaattggccatgctaccaccattaaatggttcatgcgtttatgcctttttctgaacgttttctggcaagatatagttacataaaacacagaaactaaagtacatgtcttggtttctttcagtatactaggcctattgaaatattgggttagtccaacaaagctcatgctggaaagttat

SEQ ID NO: 13368 - DNA, 1051 bp, Homo sapiens
tggcttacatagtcagggcaagccgttatttcacataacaagaagtcccagtgcagagtcttgcaggagtgagaaagctgtaagcttgcagtatcaacagggtgccaggttctctctgtcttttggctctcagatccttgttccaccagatcacctccaaataaacacaagatgatggctagagttccaggagctaaggcctcatgacaatgcctagaggcacagaaagaaatgatttcttcccacatgtctcttccttgatgaggcagacaactctcaacagtcccccagcagagatgcccacccttctcattttagaattgcctcctatgcctgtacctagaagggaaggcaaaggatatggtctttcagctggaccctcagatgggagctgatgatcatagcatggcttagctaatcttcattatccttttttttgttattcttttaaatttcaatagctttaggagtacaagtggttgttggttacatggatgaattatatagtagtgaattctgagcttttagcgtacctgtcacccaaatagtgttcattgaacccaagagcaaatttttcatccctcaccctcttcccaccctccctacttcttagtctccggtgtctattataccagggatccccaacccccaggccatggactggtaatggtgtgtggcctgttagtgactgggccatacagcaggaggtaacagtaggcaagtgaacatcactgcctgcgctctgcctcctgtcgaatcagcagcggcattagcttttcataggagcatgaaatctatcgtgaactgtgcatgcgagggatgtaggttgcgtgctcattatgagaatctaatgcctgatggtctgaggtgaaacagtttcatatccaaaccatccccaccaatccatggaaaaactgtcttttatgaaaccattccctggtgccaaaaaggttggggactgctgcattataccactctatgtgcccctgtgtatgcatacttatctcccacttattagtgaaaacgtggtatttggttttctattcctgag

SEQ ID NO: 13369 - DNA, 1098 bp, Homo sapiens
atataagaatgaccagtgctgctcatttttggatgccatttgtgtggaatattttgttccactcctttaccttgagtctataagaatctttacaagttaagtgggtctcttgaaggcaacatatacttagattgtgcttattaaattaattccactaatcttatgttttaagtggagcatttagatcatttatattccaagttaatagtaatatattaaatactattccagtcatcatgttgattactacctagttgttttgtattctccatcatgttactattttataagcagtgagttttatacttttgaatgttttttatactgttgcgtatagaactttcattctgatgtttagaattcctttgagcatttcttataggtccagtctagtggtgacagattctctccgagtttgctttactgggagagaccttatttctccctcatttatgaaactaagttttgcaccatacaaaattcttggtgaccattactctgtttaagaagactaaagataggattccagtcccctctggcttgtgagttttttgctgggaagtctgccattagtctgacagattttcctttataagttttgatgcctttgtctcactagtcttagaattatttctttcatgttgactttagataacctgatgattacatgccttactgatattctttttgcaatgaatctcccagagttctttgagactcttgtgtctggatgtttaaatttctatcaagaccagacaagtttgcctcaaatattccctcaaataggttttccaaactttttactttttcttcttctccttcaggaatacctatgattatagggtttggatgttttagagaatcccatatttgttggagactgtattcatttcttttgattcttttttctttgtttttgttcggttgggtaaacccaaaagccttatatccaagctctgaaattatttcttttgcttggtctagtctcttggtaaaacttttcactgcattttgtaactccctaaatgagtctttcatttccagaagttctgtgttttgttttgttttgattttttgattttttaaaatctatctcct

SEQ ID NO: 13370 - DNA, 1188 bp, Homo sapiens
gaaagaggttggcatttcagtcttgtggacttttgggaaaaaaatgttaaacataactgaagagcccttgtcaaattggaggtttttccattttaaaaactagagaaatagtatgtcttttgatttcactttggtccaagcagcgcctcatatttccactttccagtggtaactagcagaggtaagagaaaaacagccatgcgggtgagtcatcattcctcactccaggaaatggctcattttacaagcttttggaaggacctttgggaagttgtgagctgccaccatttttgaattgaaaatatacatatgttgcaactctgatgtaaaaggcatatagttcctttttcctccacctcttggtttctccttctccttctcttcttgctcatataacctgtgtagttttccgcaggagctcccacttgatgggtaacaggagaaaacattttagtctgatctagttgaaaatgtagtctgatcagttttgcctttctagctgacagtcaatcaagtgggatacttgctgtggtgcagtggctttgactcctggctcctctacttagccttttctgaacctctctgtgccttgatttttccatctgtaaacaggggtaatagcaattcctatctctcatcactgggattgtgctacacgaatgaacacttctaaagctcttagaatagtatctgacaagtacgaaaggctgtacacatgcttgtcaattaacacagagtagaggaggaaataaatctcttagattgcggagtgataaaggagtgactctttctcacgaaagaaaactgagggtcctagggctctgcccatttccagggccctgctggcctgcatatctgggggtggtatactttgtgatctgctcttattcaagttgggaaggaccgggtaactagtccccttcctttggtattcaccctcacattggcctttctgggcatgaagacctcctgagtcactggtttgtcactcaactggcctctggcccacctccagccttgatcacttggcatggggggaccatgacaagcctctggtttgcaactccgctgctttctgagttcttcccaggagggctctagggattgctgagccagaccagtgctacccaggtgaggggtgtagctctccctctgagtactctgtgccccaaagttgaccctaaagtt

SEQ ID NO: 13371 - DNA, 1030 bp, Homo sapiens
tgagccaccacacctggctatcctgtatactttaaatcatctctacattacttataatacctaatacagtgtaaatgctatataaatagttgttatattatattttaaaattgtattattttttatgattgtattatcttttaattttatttttttttccaaaggttttcacccctccatttgttgaatccaggatgtggaacccatggatagagggcttaccgtatttagaatagaatatgtgaatccctatatagtaagcccagtcttcattcaccaacactttttttataagaacttcataaaggatgataagaaaatcagattatgaaatttcttagaggtctactctctgagttcttaaatctggcctgctttattttagacgccaaacatatggccatagctcattatatgcttaaatgctgatgcatttcaaaaccattgatgctactctgtgaaggacctgagaggaaattatagtaagatatatggttagaaagatagaagctgtaaagtgaaattctgacctttagaaagagctgccataaactttaaagaaatcaatgtgtttgttaagagctatatttaagtttccttttatgtatttaatatatatcaacatatttgtatatattcaagttgagcatccctcaactgaaaatcggagatccaaaatgctccaaaactggaaacagtttgagtactcgcatgacaccataagtagagaattctacacatggcacattggatttccgatggctcagtatgcacaaccttcatttcatgcacaaaattattaaaagtcgtatttaaaattaccttcagcctgtgtgtatgaggtgtatgtgaaacataaatgaatttcatgtttagacttgtgtcccatccccaagatatctcattaagcatatgcaaatatttgaaaacctgaaaaaatctgaaatttgaaagacttctggtcccaagcatttcagataagggtactcagcttacactggtgtatgtgtatatgtctatttcaaatata

SEQ ID NO: 13372 - DNA, 1033 bp, Homo sapiens
aaactggcagaaatgatgctgtaaagttaagaaacatgtgcttcaaaagtagaaggaggttgagttcgtaagacccagtacgttcattaatacaaaggaggaaagggaataaatactgttaggattcatatggccaatatttaattgcctccatacagcatagcctatgttttaagtgctttgagtttgaatatagaagctgagggcattcgggcatgaatattttgtaatatgcatatacagtttgtattaaggttttctctcaatagaataaggaagaatgactgttattcagttaaatatagttaatgttaataacttgatcagaatttaaggagattaaatgtcagagttaagggcctgttggtaaatatcacttatagaaggcagaaataatagagaattacatatagccttgtggcttttgccactctataagtagtaaaatgtgatttattattctgtattctgtcgtgtatttctcaagaggcacaaagaaatgatgacttagaattcctgcataaaaatgaactgagagactcatgctttctggatatgaaagagattataaacagactataacacctactttagtttattgcttactgatctataaagaaaataacttgtaaaacccaaattaagcaggagtaatgatagttcactaatagcaaaagccagctgtgctggtttcctttaatagtgatattgtagtattaaaatgtggagatttacatgttagatctttgtaaatataaagaagatttacttcttaggatcttgatgaattcaagtttgttacaacctatttcatttaaggataaaaatttttagaaatgcaattttctcttaaatgaaaatttaagattggactaatgtagatcttccaaaaagatatgcaccaatgccattaaaagcattggagctgctaccttgatctcttggatcactcattcatcgttttccacaggagagggtttttttttttaatttactatagactttaattcttcataaagaaattcacgccagt

SEQ ID NO: 13373 - DNA, 1031 bp, Homo sapiens
tagttaatttttttttcgcttgtattagggaaaaataagctgtagttttttacttgatatgaattcttcatttgataatggggtaaattggattgtataaactagaccactttggggcatattatttctgaaatgtgactagtttgaataagataattatagttcagtggtaattttaatgacttagctttgggaatatgtaagttgtctttagatggcagatttaccaaatgaataagataaacaaaactaaaactggttagggatttaaccatgatatataaatttattttacattctaacttgccttttaaaaattccaatgatagtcacttcatttgagaaataatttatagaccaatgaatgtgaaaaattttaagcactgaaatttgagaggaaattgaagaatgaggtgattcattgtctgtgtgtatatatatatatatatatatatatataacttagaaaatgtttgaatggtatgattagaatggagtcatagtgttttgcaaaacatggattgttgaaatacaaaaatccaggttttgaagattattaaataattcatgtaagatatcagagtggagctccaacaatttgttctactcttatttggatataatgtctgtgagtgattccgtaaatgaggtcataaatattcatctattttatcactggcaatagctgagaatctctgaacagacagtggaccacagaattcagaccctctatgcctgtgcctatccattgacttatccaactttatttccatgttagataccagcagttcagaaacatttgtatttcccagctgcggaaacagaattatgcttctttctattaggatttgaaaaagctggtatttgattatccataaaatgcagtaaggtggtaggttttattctcattaaaaatgtaggacaaaggaaaaataggcagtgtttaaggaaaagaagttttttacccttctcaacaaaagctgaaatgcaacaaaagccgaaatgacctgaaatgcaacctgtaaagtcaa

SEQ ID NO: 13374 - DNA, 1092 bp, Homo sapiens
acataactttattgtggtaaatatcttttcaatgtactataagttttctaagggcaggaatcacatttctttagaagctgagtgcctagaactcaatagaagctttttgaataaatgatgggagaaattttcttttattgaaattaagggtttttatgtttgctttcctaccataaaattagagtttagtcccttgatgctgtgcccttctctttttaatcatactccttattttgaaaataagtgtatattatatcccagtgaattaaatatcttttccctctttactatagttcctggaaagagtatattgatactgtaataatatttgttttcaacagtaataatttgctggtaaaccttatatttgcgttactggctttacagtttatcttgcaaaacatttgcttcaggatcttattattttagacaacaagtgctgcagagggaaatagaacataaatacctagttccagatagaaagtgccacagtgattcagtttcattgtgtgagctgaatagagatttttttttaaaaagtttgttttatttttaattgtggtaacaaatacgtaacattaaatttgccatcttaaccatttttaagtgtacagttcgatactattaggtatatccgcattgttgtacagctgacctccagaatttcatcttgcacagctgaaactctacgcccattaaacatggattctccctttttcttgcatccagcccttggcaaccacctttctcctttctgtttccataattttgactacttgaaatatatcataaagaaatattcttataagacattttgatacattagtttttatttgtgtttatcattgtcatgtggatcatttaattgctaagtgacgttttcattcttattcacgtacaataaaaccagttaattcttttttaattagtgtcatgaattttgcctgggtaaggataaacagtaaaataataaagcaaagaaaaatattttatataatttgtaaagcagtgggtatatttaggatacaaagtagcagatatatagagtgaacacatctagggctataggtaataaagttgtattatatgcgg

SEQ ID NO: 13375 - DNA, 1024 bp, Homo sapiens
tctgtgtgttatcttgtaatttcaagtgtggatattttaaatcctgaagaaatgggatcaaataagctctcagtagtgttctatatcaactgtaatttaacacatctgtccagaggagtagtgaataatgaattacactaatcaatccagataaaagagatttaattaacattaacatctcctcaaagtctttaaaactttcttttttttctttctgttttggtattcagggattctaatctaagggtcctttgatgatgaaagaatatttttaagagagattttattaaaaggatttgtgatatttagatgtatgtaagatgaaacttttctccaattttttaaaaaggcacttcataaaacataaaaaggctgtcagtattatcacttcgtattactttataaaaatatctggaaataaaagttgttgtatagggaataaacatgctttgccaaattttaattaatatgtattcaaaaaattgatgatgtctggataaccaatgagtgaccttcagtgctttgtagggcaacctgcaggcatggaggctcagcaataaatacttagcccactaaggtgattgaaggggttacaggtgttttctgcaaagtggttaaaccacttcatgagtaaatgtaaatcttcatacagacctgtatagggcagtctacaaccacaggccagttacagtaattaaacaagcaactgaagagttatgacaatgagagcagtgaaatgagaatctgaatatggtcttttcactatgtggggaagtcctcattttggtctaagatggaagcaagagaagagaccagggttaagagtgacaattgccacagatagggatgttatactgacccataactggattttatcggtaccacattgaagccttagtgtaactaatactgatgactttattaatgctaacactgcaacgtctttaatgcacaccagcaggagacaaggggagaaccctaacctgggagtcagaatgcctgactcatattctttcccaactca

SEQ ID NO: 13376 - DNA, 2178 bp, Homo sapiens
atgtttggttctatgtttagtgagactccatctctgcaacacacactgtggcctaccatgggggagggcatcaggataaatagctaatgcatgtggggcttaatacccaggtgatgggttgatagatgcagtacaccaccatggcacacatctacctgtgtagcaaacctgcacatgtatcccagaacttaaaatttaatttaattcttaaaaatgcaaaataaaaaaagaaattagctgagtgtgttagcgtgcacctgtggtcccagctacttgggaggctgaggcaggagtattgagtaagcccaggagtttgaggctgcagtgagtagtgagtgcaccactgggcaacagagcaagaccctgtctttaacagaacaaaaagtaaaaagtaaaaaacaaaatgattttccccaccctccccccttcacctcagctaaaatgtcacctcctccagaaattccttatcatttggttgtaccactgtttgctgcttaccactgtcttaagttgtaattacgtatggtcttctctctaggtagggaacaacttgagactaaagacgttgtgactcacatgagtttgtataaatgaagaaaatgcgatgggacataagtagggtgtggggagagccttcatggggagatcatacttgacctgagtcttcccaaaagcaatccctctgtcttacaatacagctgtcaccacaattggcttgataaaatatggagtaacaaatgttaggttcacctagactaatcttcccttcctatacatgaagtacttggaggaaagagaaagcagtaaagtgattttccagagtcacacattctgacataggcagtgccagaccaaaaatcagtcacttcccataaggtggatatgcacactcacagaaagaacgagcctatgcatagaatgatctcattttcaagtaaaataatttttgagatacaaacatcagcaatgacaaccacaccccattccccagatcttgcatgtacccagatttattataaatattttgtgataaactctaatcagagcccagtccctcagtttaatagtcatagatttcaggattttgcttctgcttatcttcccaggctttcttcctcttctgtcttcttatggactggagaagtccttgtccttctagcaggcaggcacaccactttgggtttctgtttgtttttgtgtttttcagacagggtcccactctgtcacccaggttggagtgcagtggtgccatcacagctcactgtagccttgacttcctgggcttaagcgatcctcccatctcagcctcaccagtaactgggagtactagcacatgccactaggcccacctaatattttcttttttcttttttttttttatagggatgggggtctccctatctttcctaggctagtctcaaattcctaggctcaagcaattggcccgcctcagcctcccaaagtgctgggattgtaggcatgagtcacctcgccccatgggtttctctgtctttttcaaaccatcccctgcgtactgcctgacgtggattttctctctctgggagtctaggttaggtatctctcaagctttctctgatcaaagcagatgcaatcccttccgttggtaccacagtagcacttttctcttagggttttttttttttttggaattagtcacatggtgtctcatgtaatagttatttttgcacttctgttacttgcatctattagattgtgcacttctggtggcaggcattttatgcaaccatctggactacagttccttggactcagtaaagatttattgaatacatgatctcatggggtcatttgtttctttcaacatcttgtttccactactctccataaaattcataggttctctagtaatgagcacttcccttttatctcataaatacctttaagtgactatctgccacttgcaaaaatatctaaggaggggaattaagtgattttgacttctaataaattgacagaaaatgttttaaccataaagattcaatcaatacaaccacttttaatacaaactactgttttgaatgtttgtgggcagtgcagagcaatgtaatatattaattcagccttcatggaagctaagtacttagtggaggaactaatttaaataaagtcagaaaacatgaaaatgtggaaggaaca

SEQ ID NO: 13377 - DNA, 1023 bp, Homo sapiens
gagccgagattgcgctactgcactccagcctgggtgacagagtgagactccatctcagaaaagaaaaatggttattgttagacaaaaagctgcctgagggcataacttataattacatatccttagtgactgagaagtaactggtgcatagcaagtcctctgacactggctgaaattgttgaaccaaatttaaataattggatctatagtcatgtgttatttatttatttagagattgagtctggctctgttgtctaggctggagtgcagtggcatgatctcagctcactggaacctctggtttctgggttcaagcaattctcctgcctcagcctcctgagtagctaggattgctggtgtgcaccaccacagccagctaacttttgtatttttagtagagacagggttttgccatgttggtcaggctggtctcgaactcctgacttcaagtgatctgcccgccttggcctcccaaagtgctgggattacaggcgtaagccactgcactgggctgtcatgggtaatttaatttctgaaactttattacacataataggactgcatttataatcttaatttttttatggctaagaaaatattaggaagaaagcaaactgcaacaatgttttatatgtatttagtttatttcagtgggaatactgatcatcattgtaggatcataattgaataatttatcctcttaaacattcctgtttgagagaatgctggttcattcattcagtcagtcatccattttttgatttaatgggcacttattgagtaggtacttttttaaggaaactactatagtggaacaaaatactgaactggaacaatgaactggaaaatacaacagatccaaatattttcctcccgtcaaagagacctttatttctttttagaagaccatgctgcctaggtatattggacacaaataattcttgtttacaatgtaaatgatatgctttttgaaaagaatttaaaggttcttgatataacaaattgtgactttttaagtataaa

SEQ ID NO: 13378 - DNA, 1071 bp, Homo sapiens
accgtataaaaaacaatgcagctaattgtttccagtcaagaaactccaccaggcctcatcttccttcttcctgcttccttctacgtcagttcccaagagcttggggttttgacttttttgttgaagcctctgccaggtccatctccgtggagtgagcaaaaccagaatcaccctcaggaggcactttggaaacacaacattcacatttctgtattaccatgtcgagtggttgtcatgaacttgtagtgattggatattaaagtaactagactttctgcattgctcagagatgcctttagtccttaaagcccttcaaatatccttcaaaccagtcccataaggaaaatcctgtatataattttccggttttggaaagttagtctactatatattaaaaattattttcccatggttttattataccataaactttttgaaaatgcgactaccatgtccatggagagaagacgctactttgttgcattctatattttaggagcattgtgcgctgttgtaactaatcataatatgatggctacactcgttttggtatttgaataactgatatgacacattgcatcatatctgtcttctcatcttcctcgcctaagcatttaccttctaactactactattttattataaacaatttttacaaactacgaaatccttttacagtttatactataatgaggacttttatctgatgaaaaaatattgagtaggtagcttacgttatctaagaatatcctttctgatataaaaatgaagagttgggtctcaaaggattcactgccattgtgtcatcactgcctgtggaacccagaaattgcattacccatggccctaaagtctagacctccggcatcagaaagggtagggcaatgccagctgggactcactatgcttatggaggaaattttgacaccttttctatttctggaaggctttggttttcagataatttttttgcaaggaatgagatatgtttacctgtgtcttaacatgcattcattttacatttccctgtgggagcacacagaagaaactaacatttcctttcatgtgatg

SEQ ID NO: 13379 - DNA, 1031 bp, Homo sapiens
tttagttgagcaccttgcaatacttctctggtttagaatactgcagaaactcaatggttctttctcatgctgtgtgtgattttgctttgtttaaaacctgatgtgcctaagtagatttaccttaccagtagatggtttaatttgattttaatgatattctatttggctctataaactgtactgaagccagcgctgccatgctgttaaaaatgtaatctattctataatggcattaggtgataatgaaagcagatattagagacataaccattttcatatttaatagagaagcaatgtgttctaggtaatgaagttaagacttcacatgacattgtcagcacatgttaactctatgttttggaaggctgctttttagacctaagtaaatataattcaaaatgcccctatacttgtttatctattagatgctcttgttttgttttacacatcataactgccaggatcatttatttggcagagcctcagaataaaaacaactcaaaccaaccaaacaaacaacaactaagaactaataaaatctttgaagcttgaaactgtagaaatgaggtaaattttttttttccttggataactacttccaatctagtatttgaatggcaaacaactaagcaacatttgtatgcttttcttttgaagtaaggtggaaacatttttcatcagtttttcaactgttagttggaatatttgtgatcactttaaagtgtgacagtaatatgaaactcctgagatgaccagcagcatagcctttagcccatttgtgttcattttaaatatgcttttattgaataattaatatgtctagacactttattgtgaaaactagaaatttttcctatccactccggtgtaacccgtgtaaatagtttcctgtgtataccctctatacattttccatcatatataagcaagcatgtaatagattttttttttaaagagacaagatcttgatatgttgcccaggctggagtacagtggctattcacaagtatgatcatagtgcactatagcct

SEQ ID NO: 13380 - DNA, 1003 bp, Homo sapiens
cattgaacttagagaggttgcatacattggaacaccatgcacagctgggggtggagtcagtctcacaatacacagtgagatatcccatcaattacttccgatagcactggcagactggcctataactgtcccctcatgcatctctacacagattagtgaaagctaattttctggagaaactggctccagaggaaagagatggtgacatttgaagagtcaggtcacatttgaaaatctgttcactctgcagtgaaaccctttggttgacaagctgcagccctcgtgcatagtgttcctaggctgtttattttctcacttgtaaatatgtataagaatcaccaagtgtttggagtgtgctctgacaagaaataaataggccacaagaaggggaaaaacccactaaaaaggaaattggagaaactaaattaataggtatggatcagaaaaaatggcttaaataagcaagagagaatgttaacttagagaaataaaagttgcatccacaaaacagaatgtgatgctattactgtcagagctaatgaagaacaagagagaccttgtgagaactaaaactttggaagcaggagtaaaataaagagtagaagcatttgagcattaagggtgtatcctagaaaatagaacaagtagaacatatagtatccagcttacactgttttcagaaaaagagcagaacaaataaaataaattctcaaagtaataaaattaagtcccaggacggaaggaaaggtgcttccacatgctgagtgcattgccaaattaatgaaaaatgggtagaaacaaaatcgcaaaatttcagaacgctaggcatgaagaccagatcacagaggcctctagatgagaaaaatacatatgtatttttctccttcatatacaacatatgaaggattaagaatccaagtgacataggatatacatggagcatagtggaaactagaagtgaaagaaaatcgcaaaacaatagctgtttgacagctctagggaa

SEQ ID NO: 13381 - DNA, 1114 bp, Homo sapiens
cttggatttgagggttctaatcttatctcgtgctgtatatagtgcagattttaagtttaactaaaaaatccttctctgattccagcgtcaaatatactatttttagaactgtagttgaatgaatttagcacattttccagcaataacaatagaatcagaggttcagagaattagggttgaaatggaccttagaatgtgtttattttaaacccatcaagttcaaataaaaaatgatttttcttaaagcaggagcatttatatttctctctagaaaatatcagtaaatacactcatctaataaataaaagaagttgcatcactaaggcactgccccaaatgctccatatctgtgagcagactagacaacaaaatacaagttgcccctgatcttttaccaagaattctcagcccatttcaacatctagtgtgagaccagcattagctacctgctggatgggctttctggtggggttacatctagaagtacagaacttctcaaactctctgtcgtgatgaatcagtcttcctcttcctcccttcttccccctcctccacctcctgctctcttttttcttccaatccattgcagattggttctctcataaaatacagctaaattaatttatacaattgtataaaaagacacataaaatacatgccccaaattgttattattagatctaatggacaagaaaacgttgacttgctaccaaaatttctaagtttattcttttttaaaacttttaagttcaagggtacatgtgcaggtttgttacgtaagtaaacttgtgtcatggagtttgttgtacaaattatttcacccaggtattaagcctagtacccattagttatttttcctgatcctctctctctttgttcaccctccaataggccacagtgtgtgtatatgtgtcaatgtgttctcatcatttaaatcccacttataagtgagaacgtgtggtattcagaaccagaaaatctaagttaattcttttttttttctttcttcttttttttttttttttttttttgagatggagtttcgctcttgttgcccaggctggagtgcaatggtgcattctcggctcactgcaacctctgccacttgggttca

SEQ ID NO: 13382 - DNA, 1030 bp, Homo sapiens
tatagacaggatatggtagaggctctataagaatgcagatattctgattccaaaatatatgctcttaactaaaactaatgcatcaagtcgactgaaatgacatcaaatacatccttgacactaaagggagcacacaaacggaatgcctgcctttctggtggagatgcttatgttgcagctaacaaagagaacgaattcttttataaatgaagtttaggatcacagggtttccactacccttctggttatgttttccaaggctgaaaatggagaacagtttggagcaggaagagtggaagtttataggttctgttttccctctttttcttcatggatctttcatctccccacacactattgcagcccgcaacctcagatggagtgaaattctcagcggaattaaatttcagttgctacccttaataactgtagagaacccctttggaaaggcctccctattacccttttttgtttgttcatttttcgctaaattaaactttaatattttataacatcacgaggaagctactgattttaggaatttggattcatgttttcttcttccttttctcttctatacctataaatcagcaagtaacaaaacgagtgatttccactgcaaagtcattatccccggtgagttgaatatgggcattgtaattcaccagcagctgatgactgagtggatctaaaggaagaatgaaaaggtagatcttaaggatgaattacagctgtaataataatttattccacaagattcacatggaactgaaatttatgacaggcagccagaccagaaaatcaggaagtttggattttctcttcttcctaatcagtttctccacatcttgttctgattagtgccctcgctgagtctccttacaggtatctctgacccatttccagtagaccttttgaaattccactgtttttcaggcagtgatttctgcctttgctggattttagaatataaaagtcattcatctgtatcttagaaggatgattcacatatttatgttctagaaagtag

SEQ ID NO: 13383 - DNA, 1044 bp, Homo sapiens
ttgcttttatgagccctagagggatttgttggtgggagggtgagcctgacttaaaggttcagggtggaaaggacgttggtcttgtttgaaaaacgttgataaaacaaaaagaagtccactactctagagccctcgttgttggcagctgtgccccagtagcagttctaggagggggaaaattcttttgttaatgctgtggttccttgacttcagtttggtttgatgcaaataaattctttcatgtgtatctcctgatgaacaccctgattttaaatcctctgttatgatcttaccaccaatcttctatttaaaataggagataaacaaaatgcttatgttatagaaaagagaatgtttgtttgccacataatttcctagagaaacttccaaactgaagtctattcttcaaaagaagcaccttttgttacaaaggacataaagaggtagggttgaaaagttaatcatacaaatgtgtattttaattcaagtaaatcggttgtattttcctgtggaataacattttcaagtgaatatttgtgaaatagcactgtagatttaagcccaatatttctttttctaatttgctttttatttgcattcaaaatcatggccttgctttgaacattctaaggtattttaaaagcctgtagtgactgagcctttgaaataatatagtaagcaaaatataagtattaagactttagtaattatcctggcaaaggattgtacataattatatagttttgaaatcagaaatgaccaaagaaatgattctgctacttgatggcttcctaatggctagttgataagcatgaaacaccttagcatgaagtaaggcactagctccaaactgacatatttaattcatcctctggctccattgtttgctccctgcgtttcttctatgacaacatgatgccgctgttgttcttcctccagcactggttggcctttgctctgctccatctggaaatccccactcactttcaaagactagtttccatataacacaactcttaattcctcagttaattgctccctatt

SEQ ID NO: 13384 - DNA, 1085 bp, Homo sapiens
ctagtttgcttgtgattaaatcccaagcttgaaaatatatgttgcatatgttagaaagctattgcacaaataaggacttagacctgttctctctctctctctctctctcttttttcttttttgtttttgctcatccccagattccctcaattttccacctagaatttgtcatattcttttttgcttaatgatcttcagcatgttccattgtccctagagaatggcattcaagaccccatgatatactcctgccactggaaacactttctctccatccctgcccacgctctcttaagagttgtggttcatagaaagtcaacattaattttttttttcttattccttcctcactttttatatagcaaggctcagcacagtgtgttatgtatagcagagactcagtaaactttggtggaacttaaaaaaaagagttgtctctctttatgacattttcattttagtaatctctgatattaaactcacatttatgctgtttagtcatgttctcctgaatggaaccccttcccctaacttttccaaacatcgaaattgctcctgcaaggatcctttcaaatattactacctctataaagttttatttctacctgtgattttatttcaccagaaaatatcattttctttcttgtattctaatagcattttatgcttgtaactgtcatggagctcatggaatttgatcatcagcatgcatttacttgcacgccttccacattggaccatgagttcctatagaaagtggcccagccttactcattcttaggtttcttttatatggcttagaaccccacacatattatagtaagtattcaataaatgctgattgaaggaactggaaccttggtgattatgtggttattgcctttattgttttgtaagtgaataaaaacaatgttgctctaagaattcatttggtgattacctcaatgtcctcatcagcccctgatagttcctctcttaggttattggtttcttgctttctattcaaatgtaatacaaacttaaaagttaatgaaacatattttcaagttggtgaggctgataggtccagaattatttcctccatt

SEQ ID NO: 13385 - DNA, 1048 bp, Homo sapiens
cctactcaacttggaagcctgtcctttgccaagtataattatatggtattttatgaccctgtacagagtgtgaaatgtatattcttagcacaaactggcagcattcctaacactgtaagatgctgctaaggtatctgaaagggattatatgaaactaagcatttttaatactttggaaccagtgttgattcttccaatagtaaatttgttctgggttcctttctggtttgctctgtgccagcccccatttcagcactttcaaactacatttaggcagtagcttttcagtacaccttgaattagtcccaaaacacactggagcatggagtgataatgaaatagtataaccagagagaaagatagcatattaatagaaccacccacaagaaagaccaagtccactgaagcaaaaacgtatgttctttttatgtttaaaaatctcatcacagtctctcccattaagctttccttgcagagttttcaaactaaggagtcacatttggatctggtctgggatggagtgctctctggggaggcaagtctgctcagaatgagtaatggtgatttgagaagtggtgtgctttgtttcatatgctacaaactccacttgtcttttcagaaatcaattgtgcaatatcttcattttctttcttactgtcttctggctgtagcaagggaggagtgttgaggacatgagtagtctgctttaacttgtgaatctgcaccccttaccctgagctagagcaatagccaggtgagtgcagggtttgtctcaagtatgacattatattagggtatggcatgtgtggaataatcattaattaatggcagctagcatgcactgaacacttgctataatttaaaccaggtcctatgccagatacttgacatgaattatctcatttaatgttcccattaccctcgagaggcagagagttactatctgcattctaaagacttgactaatgtttctaagatcacaagatgatgaggtgatagaattgggattaaaaattgagcctgtctgagggcaaagcctgtgtacttg

SEQ ID NO: 13386 - DNA, 1049 bp, Homo sapiens
ttttcatgtgcatgatctgaaatacccaaggggagtgtccttgatggtgcgtgttctgaatggaaaacctgaaagtgccggaaactgggagtgagcccttagaagggcttgtgcatcttctcttcatacacctattgcaatttgtaatcttactctttgtgttcacttgttttaacactgttcttctttgtcctgtactgtaatctacatgaatgcagaaaccatgcctgatttgtttcccctatgacccagtaccttgtgcagtgcctagcatatggcaagtacttcataaatccgccttgagtgaaggaaatcaataaatgaatgtgtgtgttctctctgagaggatacaacacaggaattcacatccaggcttaaaataattattaatatttcctacgcatacacgagatgctgaagtggacagaaagtttcaggtgacaagatcagaaaagaaatgtgagtgtgactcatgggtctgtcttttcatgctgttgaacatatttacacaggaagaatgaatttcttccctcggtaagtccagagactgtgcaaccacgtggacttggttctttctgaggtgtgccagtgcccctcaaggcagtggtgtttgatgggctttgtacacatggcctcctgcccacaccttccgagcttcccaaatcagtgctgcctaaatgcctttgtccaaaaatgtgtggatctctgtcttttgcagaggactgcatgtgtgttctacaagcttcttttagctcagaaggaataaatatgttgctagaacttagggagtttcaggtgacttgaatactgatcagaagtaggcaagatacaatgggagtcttatgtatataaaactcagtaaattgaaataatcgcataaagctacctcccatgaaagcatattctgattgaacatttcaggactggctgacaaggtgttgacctgcaggtcttaaagtggttgacggggagatgcagctagccatttgagggcttggggctactgcaatctcttagagatttggttttctaagctcacctcttccgac

SEQ ID NO: 13387 - DNA, 1024 bp, Homo sapiens
atctttataatgaaatgtttgaagtggtaaaaagtcatttccaggtggaatgttcttagtttctaatgtaatgcttttatcattttgtccgtgcacactggggtgcatttccttgaatggaactgagagtgccaatttgattctatgcttgaatcttaccactgaaattttctttaacctcaatataatccttttttttttcttcaaggataagtaaactgatgtttgtcagacttaaaggagacaatgaccagggtaaaatgaaacaaaacagaacaataaaacagagatatgttatataagttatctactggtgtgtaataaactacttccacatgtggtgccttttgaaacatcacacatttatttccttcaatactgctggacggtggggtggatcctctattggctttgcctgggccccttcatgcagctgcattcagccacagggccaattagactggaaagtcctagaggccccactcccatgtctggtagttggtgttgggtgttcagatgaggctaaggctttattgcctgcagtgttagcacagaaggtgaagacataagccacaagtcttcttgaagcttagattccagcatttgcatagtgtcacttctacattctattcattaaagccagtcaaaggacagcccaaattcaatgtttggtgaagtagactctgcctcttggtggaaagagtgatgaagaatttgtggccatgcttaatgtatcacacacaagctatcattttcttcctgcaaaactcatgccacacgatcagttaaaacacttctcaagcaaaattgttgtgcagccttagaatccttttaaatacagtgctccaggcagccaccacaaatcagtcagaactgccacaagaaatgaaatgtttctgccatctggactctgcagtgagttgttggtagcgcctggatggaaaattcaggatttctggctctcaacccagcatcttttctgtccccattagtctgtctcctcacttctagtcagttcattaac

SEQ ID NO: 13388 - DNA, 1035 bp, Homo sapiens
ggaataatcaaaggaggatagattttcacgttcaaactgtgagatggggcattgacattaattgaaataaattaaggaaatggccagaagtgtaaaagaaaacaaaataagagtcatttgttcatttccaagacctagcctatacctagtttggtagaacatcaccaattcctttttgattgggtaaattaagggtgaagaaacttgctgtattaggttcttcccctggagactggcctacatccaaagctggcttctgtttcttgatattcaagctggggctgaaagattaatccaagattgagtccagctcagggattcaacctctttcagtactattggatttaatatctgctgacctgttaatcattttattctatagttattcacttgcttctctcagataggaatcttttaattcctaaaacatggcccaattgattattcataggttgcattttttccaatacaaaacctttagctacaaaccatacttctttcaactgttaaataaaaagatgtttcagaaagcactttctatcagtattcatttatcattatttaacaataaagcttaactaggccttgagtatatatcaagttgaagagcagctggtaaagctatgatcacttagtggcatgctcacgggtactaatagggatattatgcctgcattaggactataccctgcctgaaagaatataggtcagttatttaaatgatttacacagagtttgtccctttaataccttgcaaagagtcaggcagagatagtattagtgagttctggcagatgggatacaaatttattacgacaagtcaattttctttttcgtttctaagactactatataataaatgggcctccacagtatattaaattaatggactttatttttcatgtgaaagaagaagaaaaatcttatgaagtgttaccctagaattccaggatagtctttgagtttctggctcataatgtagcttctgaaaagcaattataactttcatcttaaacttctttcaatgacaagtct

SEQ ID NO: 13389 - DNA, 1051 bp, Homo sapiens
tataccatagcatcactttattaatggcactataccatagcatcactttattaatggcactataccgtagcatcactttattaatggcactataccatagtattattttattaatggcacgataccatagtattattttattaatagcactataccatagtattattttattaatagcactatactgtagtatcattttattaatagcactataccatagtatcattttattaatagcactatgccatagtattattttattaataacattatcagatttcctaaaatatgtatagcttttcatacctaaatttctacattatggtattaaaagctatacatattttaggaaatctgatcataaaatgcatgtagaaaggtctgtgaggaaacatttaatactggtacttatattcaggtcaacatctgggtaaaaatgggactataagaataatatacatatattctctttgtgattagttgaaagctagatcaccaaatttaaaaggatggattcacttgtaaataactttgagtgtgtgtctttgagctttttatggctcagttctctatgtaaaggtatttgaaaaatgttagcatctccttatatcggtaatgtttgtagcaattaaaatactatgttaatgcagagtaacatagaaaggttgcttgcatttcaacctttgtagtttggaaaccatttagaaatgtatttccttatccactttgctattatggagctaagtgcttggaatattatttgaagtgagatttctatgaaataaaatgaaacacaacggaaatgtgtatttttatatttgcctttcaaccgataatacagcatctccatgcggattgaatccaagcctgtaacacagtgaagcctcctattagcaacagttctgtgaggctctttgctgagggtctgcctgtgtgccattccttcatgacagccatcctcctttgatgacaatgttccttttattgtgtttatgaacttgttaagaattgtaggaaccatgtttggagatgacactgtttctacattaaa

SEQ ID NO: 13390 - DNA, 1049 bp, Homo sapiens
gaacaacattgtttttgcccaaaattactattttacagaaaagatttataattacagagctaaaaagtaacattctggaaagattaatatgcatatagcaccaacaatgttgtcaaacttaaactgagttttcaccgtcctgataaattgatagaagctgttcttatccaccctaatcaaagttactttttctgtttctttataaatatatgtattcaaatgaaaatcatagtcctagtttgctctctgatcccagtttaatgaaggtagtcaggaaaggtcttttgaggaggtgctatttgaactgagtcctgatgggactaccgtgggaaggaggtgtccatgctgagttggagaatggctttcaaagcagaaggaatggaaaatgcaaaagccctcagagggagtgagcttgctatggggatgggtgagagaggttaaaaagagtgggaatgaggtgaggttggagaattctgcagaaggcagattttgctggaccttgaagactatgatatggaatttggatttttaattacaaggagaacccatggaatgtttgaagaaggaaagtgacatctaatgttcattttagaaggattatccttgtttttctgtgtagaaagaaacagaaaacaggagagacctttgcagtcatttgagcaaaatatactggttcagttatgtattcatttgtccagtcaacaaaaattcactggagtcccaccatatgccaaggaactgctgtaagtcctggggataccatggttattaaggtaaggatcttactctcatggagttttgactagtaggaggttcagtagtgttaagtcccatgaagacaatacaggtaattcaatggaatgggagtatctaattacattgagtgtcagggtcatggtggatcctgaatgactacaggaagccaagcatgagaaaatctccagaaagaacttcaacccaagggaagcacgagtgcaaagggcctaagatgagagcacgccaggcataaaacaacaacattgtgtctggaggattgagtgacggcggcg

SEQ ID NO: 13391 - DNA, 1051 bp, Homo sapiens
gcatttatcacacagccatttttgtatttatttgcttgcttgtttcttaccttccctgcactttatgaaacatcctcctccctacccccccatataagttccctttcacgcccaatatattgcctatctctgtttctcacggatactccagcattgagaaaaatatctgcctgatactgaagcaaataatggatagattgaatagatgtaataagtattacattaaaaataatgtcttaatgatggaacgtagaaaattggggaaaatatttggtcgctgttaaagtctaggtaatgggaactagaagcttacaaggtaaatatttctaatgtttccaaaacaattatttttctttcctagactccatggtatgtatatttctcctgaggtctctttggacaacatactatttattatcaaattatattcatttatcttattttctgaaaacaatatattttatgttcaaaaatatatgccatccactcacagcggagttgttgcacagggcgcatgatttgaaacttgtccttactgtatttgtagggtaatttgaggtaaatgaatttggacagaagccattaagtaaaatgattctttcctaaattaccttaagtggttaattttattactgataataccgtaatggagacgttcttcatataattttaagggaacacgctttgattaaaatcatatttgtattttattattattatttttgagacagggccttgctctgttgctcaggctggagtgcagtggtgccatcatagctcaccgcagtcttaacctcctggattcaagcaatcctcccgcttctaccttctcagtagctgggactacaggcatgggccaccacacccagccaattttatattttccaattttttgtagagccagggtctcactatgttggccaggttgatctcaaactcctggcttcaaacagtcctcccaccttgacttcccaaagttctgggattataggcgtgagccaacatgtctggcctaaaataatcctttttaaggaaagatctgagttttatt

SEQ ID NO: 13392 - DNA, 1028 bp, Homo sapiens
ctctgatctgataaccttataaaagtggtacaccaaccaagttactaagcaaggttgctatgtcatgacccctgattggtaatttgcatatatactgggaagaattataaatgaattacacataccagatggtgctgccgtaatgttgtgattcctgagtatggtgacttacaaatggtatgcaccaggagggtggtcctgaaagctatgtccatgggattaatttagtacatatggactcctcgtggagcatgaggcttgtaaccaggatgactgtcatacccactggtatgtatcttgtcttcttgcacctgaggaacagtgtggattgctcctgataattctgcagaataatacctgatgctaccctgctggcaagctgtgattcttttttttttttttttttttttttgagacatggtctcatcctgtcacccaggatggagtgcggtattgtgatcacaatgactcactgcagtctcgagctcctggacccaagccatcctcccacttcagcctcctaagttgttgggaccaccggcatgcaccaccatgaccagcttattttttatttttatttttttgtagagacagtttctccttatcttgcacaggctggtctcgaattcctaggctgaagtgattttcccgccaaggcctcccaaagtgttgagattacaggtgtgagccactgtgcccagccaagcggtgattcttgtcctgtaaccttctaagtgtttgatgccaggtgacacttgtggtggtcttgtgagcttgaatgtttagctgaacctgaaaactcttgggtagagtcctagcaagtaaaatttttgatttttttatccacagataaacaaatatcttcaatcatttgtcttgatcttaatggccattgtcctgtaatgaatgaatttgggctttgaattttgtgagcttgaatgttaattgaacctgaaaactctttagtagagtcatagaaagtaaaatttttcattttatgcccacatatacacgaatatcttcaatta

SEQ ID NO: 13393 - DNA, 1027 bp, Homo sapiens
cagtttgatctcagactgctgtgctagcaatcagcgagagtccgtgggcgtaggaccctccgagccaggtgtgggatatagtctcgtggtgcgccgttttttaagctggtctgaaaagcacaatattcgggtgggagtgacccgatttttcaggtgcgtccctcacccctttctttgactcggaaaaggaactccctgaccccttgcgcttcccaagtgaggcaatgcctcgccctgcttcggctcgcgcacccactggcctgcgcccactgtctggcactccctagggagatgaacccattacctcagatggaaatgcagaaatcacccgtcttctgcgtcgctcatgctgggagctgtagaccggagctgttcctattcggccatcttggctcctcccactattattatttcttaacaaaacttaactagtgttaatcaaaaattttaaagcctggggtttacattcaacactgctttatagagacagacaacatattgcagtggaggagcatatagactttggagccagattgtctggctctgccatttacaagctctgtgaccttgggcaacttacttaatctctctgtgcttcagcttcttcatctgtaaaaactgtggtaatttagaacctattctatacagttatcatgatgatttaataagttaatatttgtgaagtgctttaagatgtgcctgacacagaggacttattttataaatagtctgtgttaaacataatatatacaagattgagtctgctaggatgaaaaatacagatttataattttttttccttcctgatctaaacattgctaggcaattggaggattatgaacaccaacccaagttgcatttcttgtcaacctgctttcgatgcgttaatccgaggaaggttgcaatggcttgtgagatgatgacactgatgccctcgtgctgctgcagcctgactctctatggttgattctgtctgcatcactttaggagtaaaagattaaaacaacaaaaatctagatttttttcc

SEQ ID NO: 13394 - DNA, 1048 bp, Homo sapiens
tggatttcatttgctctccactgtgctttgggcaaagtgtcaggaacatgccccccaagaggtaactaaagatcattctcacaaaatgtgctatcaaaacccaattgtctaagagcatgtgtttggaaaagaaaataaacctgagtgtcagtgaaacagaatagcttctaggattttatctgggaaaactgtcaggttttcttctaataggtttatacaggttcactcacctctgactccttgccttatttctgggaatttctcctggaaattgaaacttttataaagtacaacaggatagactcttctgagcactcgaagtggaaaaactgaactaatttttgatttgttcaggagccattctttttattcaccaaccttaaagtacttaacaaaaaaaggcctgggatgatggttgagcttgaggtcagtcaatggattttcaaactagagcacaaggctaagtttctcagatggttaattatttataggtgccagagctatctccttataatagtaggcattcaatatatgactgaaagaatgagtagagaaatgtaaagtgattgtgaataaatgaattaataaagaaccaatggtttcagcccagtggctcacaacctactcacacaagacccttatgtatttgctatacacatcttatgtttagaaggagaatgcacaacattgtaggatcctagagtttaaaagtgcattgtttgtttaaccttgacaattattaggtagttaacaaagatgtatgatatcttgccatgaattatatctttctgtaagatgaagacacttgttcagcatccagcacaacttttaaatattctgtcccatactctgatagctaaaaattctgtttgcgatgaaatgagcctagaacctaagtccacttttctatcaaaataaaatatggaaatatgggcttttccataaatcgccatacatcagggtgcattagaatgaacactataatagatgcacagaccaaaggtaattcagttacgtgggacatgtaaatgaatgtcaactaaggtga

SEQ ID NO: 13395 - DNA, 1073 bp, Homo sapiens
gcacgggggcatgcgcctgtaatcccagctactcgggaggctgaggcaggagaatcgcttgtacccaggaggcagaggttgcagtgagctgagattgtgccattgcactccagcctgggtgacaaagcgagactccatctcaaaaaaaaaaaaaaaaaaaaaaggagaggaatgagatgggcagaaagatgatcattgttgaagctggttgatgagtctttagggagttcatagactattctgggttgtgtatagtttctgaatttccataataaagagattaaaagagagagagaaagagagttggccagcacagtgcctcgtgcctgtaatcccacactttgggatgctgaggtggatcacctgaggtcaggagtttgagaccagcctggacaacatggtaaaactccgtctctactaaaaaaaaaaaaaaaaaatacaaaaattagccgggtgtagtggtgcaggcctgtaatcccagctactcaggaggctgaggcacaagaatcgcttgaacccagaagatggaggttgcagtgggccaagattgtgccacagcactccagcctgggcaacagagtgagactctgtcaaaaaaaaaaaaagagagagagagagctgacttgaacatacacaggactgaagatatccagactgtgaatccattgtacatacggaacaatgtcagcggttgttactgctctcaatttttgtatattcaacagtaaattatacagagcacgtcattttcaaattgcaaacctgaacacaacctataggattttgactcaattccaggctacttagcttatgctcccatccaatattctattattattgcgctggaaatgacatctctaatctatccacatgaacaggcctgttaaaatgaggcttaatctttaaatctccttggtaagtgtgattgaatttgttaaacttttgtttgtaagccatatggacatcaaaataaggaaaatatccaaacccgaactttggcaagattcaaatgacagtgtaaagtgtttattatcaaatgcattacaaataacatttccatatcattcagtagt

SEQ ID NO: 13396 - DNA, 1048 bp, Homo sapiens
ctgggcatcacctgcacacctaaatggatttattgccaatgagtaatgctgtgccttcgctgcacagtctacacagaaaatgtcagaactcaataaaaacagtgcaacagtcttctgattgagtttgtattaaggtctctttattggattaatccggttcttttctcttcctttcctcatctgaatgaaacatattttaagggccattcattttagatgaagttgaggaaagtattttaaaaaaggaaaaaaataatggatttgcagttaggctcactcctttaatcccagcactttgggaggccaaggtaggtggatcacttgagcccaggaatttgagaccagcctgaacaacacagcgaaacagtatctctaccaaaaaaaaaaaaaaaaaaaattaaccaagtgttgtggtgtgtgcctgtcctgtagtcccagttactctgtaggctgagtggggaggatcacttcagcccaggaggtccaggctgcagtgacccatgatcacaccactgcactgtagcctgggcaacagagtgagaccctgtgtccagcaaacaaacaaaatatattgccttccttgttagaattttgcttaataccttggccgggagcggtggctcatgcctgtaatcccagcactttgagaggccaaggcgggcggatcatgaggtcaggagatcgagaacatcctggctaacactgtgaaaccgcgtctgtactaaaaatacaaaaaattatgagccgagatcatgacactgcactccagcctgggcgacagagcgagactccgcctccaaaaaaaaaaaaaaaagaattttgctcaatatccagcataaccctgttaattttgtgggaacataataaaagctactttgataacaaagcagaaaaatcagctgtttgtcttcttgcgcatgtcaaaccttaaatttggctgtgttttctgctctcttccccagtaacttcatttttaagcctctttcttatgtatttgaacaacaatcaagaaaaataacattgttgtgaaataccttaacctcacatg

SEQ ID NO: 13397 - DNA, 1056 bp, Homo sapiens
ataagtgaatggcatttaactgagaagatgcatccatttgagtgtgtctttcaagatgcatcttctaaactttgaagggattcagatactccctccaaagatgtactagttacctccacttaccaagtaataggctgcctacattttttattccacttttagaagtattcattgtggctttttgtaactatgagattaatattaaatcttattaactagggaaagataacgagtatatctctctttttaattgttatgttcaggcatgctctcggtcccacaaaacttttgattttgatgagcagagtacatgcccaacatgattttgattccttaatactgattatattgaactggtgagcaaatatctcccttggagatgtcaagctcaagagcaatagatgctgaggtagaagggaagagaaagacagaatttatgcgactgttctatacacataccatgaggaacaaagaggggagaaagttaaaggaaacagtcactggggcagaaaccacaaaaataaggcagtgaataaaagagaagatatccagagttgagagctgagctgtactgccatgaaaatctagctcggtgtgagacctctgcacatccttacaacaaatatctacaacttaaagtaacctgaggctgtctctgtctggcatactaaaagaagatgacccatccagtttaatcatatactacgattttaagacattgatttcatcagtatttctaaaactaatgattctcttcattaactgattattaccacctttagactagaatctgcttgctcctgtgtttctttgccttttcatgttttagttttatctatgcatcccagcctacttattggaggtagatagaggattggagagttgcaaagatagggaaaggaacttgtatcaagtccaggcataactgccactacctccagtcctgatgtgcatctacaaagaacgctttagcatatgggtagagcctaacacaagacttttttcaaagatcttaaggctagttttgtttgaaatattttgataccttcatttaca

SEQ ID NO: 13398 - DNA, 1046 bp, Homo sapiens
tatatggttttcattcttggttctgtttatgtggtgtgtcatattcattgatttgcaaatgttgagccatccttggtatgaatcccagttgatcctagtgaatgatgtttttaatgttctgctgaatttggtttgctagtattttgttgaggatttttgcttctatgttcatcaataatattggcctgcagttttcttttttgttgttgtgtccttgtctggttttggtatcagggtaatgctggcttcataaaataaatttggaagtattccctcctgttcaattttttttaaaaagagtttcagtagaataggtattagctctttattttggtagaattcagcagggaagccacagttcctgggcttttctttgatgagagacttttattaccctttcagtcttgttatttattattagtttgttgaaattttctatttcttcatattctgtcttggtagaatttacgtctaggaatttattcattttcttctcagttttcaaatttgttggcatatattgttcatagtagtctctaatgattctttgtatttctatgatctcagttcttatgtctcttattttcattttttattttatttgggtctttttttcttagtctagctgtaagtttgttgatttttgtttatcttttcaaaaaaactacatttgttttgttttttttttcctgcaatttttaagtctcagtttcatttatttctgctctgatctttattactttttttccttctccgagttttctgtttgactttttcttgctttaatgggttccttgaggttcatttttaggttatttatttgaaatctttctacttttttgatgtctgtgtttattgttataaacttccctctcagtactacttttactgtatcccacagattttgatgtattgtttttccattttcatttgtttccagaaattttaaaattttcttttgaaatcctcttatttacagcaaagttgatgaaacttgaggtcattattttaagtgaataagtgaataagtcaaacacagaacatat

SEQ ID NO: 13399 - DNA, 1035 bp, Homo sapiens
aaaaaaaaaaaaagccagtcatgatggcgggtgcctctaatcccagctgctcaggaggctgaggcgggagaatcacttgaacccaggaggtggaggttggagtgagctgagatcgtgccactgcactccagcctgggtgacagagcgagaccgtctcaataaaaaaaaaaaaaaaaaaaaaaagtgaaaaagttacattaccatattttttggacaagacttttgacaagatatttaactttttgctatttcaattttttgatctgtaaaataaaaggataatcatagggttaagaaggacagctatatcaatacatagattgatggaaatatagagatacatataacttaatacagagcccaacatatataagcacccagtaaatattacctattattagctattatcattagatcataggaagtcaagttccattttactttgtacttgtcaagtcaaatttaaaataggtcttgttccaagcagcttattttaaggggaatatcaataaaatggaatgtagaatgagtgcacggacaatggactccatttgaatctagttcctatcacaacatgtgctgactttcaatgaaaatttttatgtgggttaatggaaagaagacacatagacactaaggatttaagcagttcaaagtctatcatgtgaaagaccaaagaaagatggtttttgatagctcagatatacaggtaaggagggcaatcatatgttcacattttcctgggcagtcatcttttatgtctgtgtaatcatcaattagtttttaactgacaaaggtattcttgtttggacaagaaattatatggtttgcccacatctaggttaaatatgttgtagtgcagtagaggcacatttaagttaaccataggacagtgcacaaagtatttgaggtgtccagtgataaagtctgccctttgaagttatgagttgatgtgatgggaaatattcaatttaatacaaaatgataattcaatgcaaggaatgattcattcactggataggaagatcaactaga

SEQ ID NO: 13400 - DNA, 1045 bp, Homo sapiens
tttcatcagcttcagtatgttatgaagaaagcatgaaaggtgagatgttatcacattctaaggaaaatatttacttgccaagtaaaagagtttgcacctattttcacttaatctgcaagcctcagttaaagataaaacgtgttttcattacaactctgaaaatgtcagagaatgaatctggaaggtaagtagattggaactattttaatcactaaaatatgaatgaatattgtatttgtgatttttaagccattattttacttttggcttgtgtaagttattgtgcaatgagttcctcatatttagtattcattgtttaatatacttatttttattcattcatgaatttcaaagtttcctaattgagcatttggtgtgacagcatattcatgatttaacagacttcaaacaaatctcttcacagcctccatattttctctattgccttaggcagagtaggggggttcaaaactttacctcctggcctctaagagtctcagctgggcctgagaattaaattgacataagatagattaacaggagaaaagcacagatatttttacaagtacaagggagcccccacaggaaatgacccaaagaagtggccaaagctaaatgcttatataataggctgaacagaggtaggcaggtgtggaagtaactaaaatctatgggaaggataaaggaaagtaagagctattttaagaaagtctgtttgtacagatttttctgggtttcagctccccatctctagtgacaagaacatttcttctttcctggtaaggggaaagcatttttcacatgagagttttctcccatctctggtgataagaatgtctgtttatttgtcctcctatagggaggccagagttttccttttgtatctgctggttttttagtctttagctcaagattcttgttatgccaaagtggcatattttagggtgacgtattctgccatcctgcagcagcaatcctctgagagcaggttagccagccttctccttcttcaccctaaagccatgatgctttcccaggcattcag

SEQ ID NO: 13401 - DNA, 1022 bp, Homo sapiens
cccagatatatgaacacaaatgctttcattgccacatatacccttggccacagttagatgattgaattataactgagtcatgcctgtgctgagttttagcagagtattcctgcaggatccaacaaggataaaaattgatgtccctcttgaaacagagtggtacagatggtgcagctttatagctgtctccaaataccaaatgccaaactgctcctttgataaggcaaggcggtgtaaaggtttaaatatagcctcttggtggaatgtcagtgaatgatggatcccagttacaaacacaccaaaatattctctgtttaaacattttttacaaccatggttgtgaagattctatatcaaggaaattatgcatgggggaaagaacaggaaacttaccctgaaaaatctatgtgtatactaacaaatcagttaaatttggaggaggggagtgtggaaaagtacaatggcaactagtaaagtcaatttttctgctaacacctgccacaagtagaatctaaaaatgttacgttaaattcacaagacttacatataacaacaatgaaatagggaacttggctttcctaaattagcttggttatcgttttacagcacagttttcaccaaaatgtcaaatgatggtcttgtagtaggagaatggcatacatatatagaatggttaacttgatcattttatatgtatgcgtatatgaatttattcttttgataaaatatatttttaaagtattgctaatattcatatccatcttcataatttgtactagggagatgaacagcaagaagtaaaattttaaagtacctgagaccttgtcaattttttgttaaaactggttaaagagccataaggaaaactggaattatagcaaacagtaggttcatgttttagaacctttaaaaattagctagtgaattagttaaaattatttcagctaattttgaaataattgtgaagatatacaaaaagaaacatattggataatgtaaacggtgtcagcaagtaaatcaag

SEQ ID NO: 13402 - DNA, 1048 bp, Homo sapiens
tagaggtcttcctgacttctttgagttctgttctcagatgttcctggaaataagtacatagaaaaatagatctttctactattaattttgttttttcaagtaataacattcctagaaaagacaaaagtatttttgaaaattgagtatagaaaaggtttactgaaaataaacgtgaagatgtagcacatagactgaaaagttagtagtgagtctgaggagttggatggcagttaggtggagaaaccaaccaacccaacaggcaagaaggaggaggcagagcatgagtcccagtgccagtggatcattaaccaggaggcagacctcagggtcctgctctctatggcaaaatgcaaggagagtgggagagtttgaattccaagttattcctccactatgttgtggtcagttatttatttcatgaatgtatcttttaatttttaaacttgaaatcacagagaatgaagaatttaaaaaggtttaaattctggccaacatgtaattccaacattttgggaggccaaggtgggaggatcgctggagactggaaggtcaaagctacagtgagttgagatagtgccactgcactgcagcctggacgacaagagtatatatatatggctttaaaaggggtctgttcatgttccttctgggattatataacgttgccttgcccctggaccaggaagtgacttaatgatcacctaaagtcctttgcatcttaccattattattattctttcctcaggtaaagtgaaaattcattaaatacaggatacttttttgtatgttaaaattcaaccacaatggttgtggtcatagtagaaaaaatgttccccaagttatctataaacagaatatggaaagatataacaaaacatttagaagtttcttttgactttttccaaatgacgtgtatttggcttttcaatttttatttttatgagaactttgtttgcctcacacatgagagatttgattacatcatggactgggcaatactggagaacactgaatccaaaaccatgttttatgtaagcatttatgttat

SEQ ID NO: 13403 - DNA, 1024 bp, Homo sapiens
ctgtttaatactacttaatgtaaacttcatgtaactacagcagtttatgatatttttatatcagcaacacttattctacatatttggtaacgaaggtggtatctcaggctagcagctctaacagcacctgggagagcattaaaaaggcaggatctcatgcagaagaatgaaattggacccatacctttcaccatatacaaaaattaactcaagatggattaaatatttaagtgtaagacctcaaactataagaaccctagaagaaaacccaggaaacaccattctgttcatcagccttgagaaagaatttatgactaagtcctcaaaagcaattgcaacagaaaagcaaaaattgacaagtgggacctaattaaactgtcgagcttctacatagcaaaagaaaccatcaacagagtaaacagacaaccaacagaatgggagaaaatattcacaaactattcattcaacaaaaatctaacatccagaatctataaggaacttaaacaattgagcaaatgaaaaacaaccccattagaaaaatgagcaaaacacatgaacagacacttttcaaaagaagacataatcagccaacaaacctatgaaaaaatgcccatcatcactagtcatcagagtactgcacatcaaaaccacaatgagataccatctcacaccagtcagaatggctattattaaacagtcaaaagacaacagatgctggcatggctgcagagaaaaaggaatgcttatacactgttgctgggaatataaattagtttggccactgtggaaagcagtttggaaatttatcaaagaaattaaaagagagctaccatttgacccagtgttcccattcctgggtataaatccaaaggacaaaaatcatactgatgctgggcagacccttggtccttgagggggtcatgggagatgggttcttgattttgtacaagaaggaattcaggagcaaatcacaaggagaaagccaaagtaaagtttattggagtgcttctccacagatggagca

SEQ ID NO: 13404 - DNA, 1052 bp, Homo sapiens
ttccaattatgtggtcaattttagaataagtgctatgtgatgctaagaaaaatgtatattctgttgatttaggatggagagttctgtagatgtctattaggtccgctaggtccagagcttgaattcaagttctgaatatccttgctaattttctgtctcattgatctgtctaatattgacagtgggttgttaaagtatcccactattattgtgtgggagtctaagtctctttgtaggtctttaagaacttgctttatgaatctgggtgctcctgtattgggtggatagttagctcttcttgttgaattgatccctttaccattatgtaatgcccttctttggcttttttgatcttgttggtttaaagtctgaaaacaactattattattaaaaggaacaactttatttgcttttagagtagctgattaaagtaaaactaagagaagggatgaattgttagaattttgattacttcagacttgtttcttcttatccataagtgtggcaaaatgcaaacacaaatttgctgatgagattgatgaaataaagagtctccagtactaattaaaattaaaaaggatgaacagatggtcttaacacagctggaagtattaggatgaaattctgcccgtgtgtttagtcagacagcacagttgcaagaaagccacacctgtttacttttctaagagcaaaaatattattaaatgtggttttgatttactgctattttggctattaaatcattccttagtccttatgtgtctgtggtatcgagagataatcagctttaagtaacttaatagtatacatgtatgtctgtgtttctttctgtctaataatattgatcatgacatccacatattaaggcaatcttttgctacttatgcgatttttgtggccacatagtcaaaacaccgatggaaagggtgaaaaagaaaaataataaatattagaatatgcatttgctttgaaaaattctaagtaatgttttcagatttttaatatttaagataatcctctaagccttactcattattcagtgtcttggaatt

SEQ ID NO: 13405 - DNA, 1123 bp, Homo sapiens
ggggagatgtgctgtgctacaagagtttgtgataaagaattaattttcttactatattttgcaagaatcaatattattatctttaaagcaaaattaggaatgcctttgttttcaagacatctggatatcaagacaatcccaagtctaggtctgttcaacaaacattatcaatttgttccctcaactgctaggaatagcttttggagaatgcagcccagttccagagtccctcgttttcctagccctcactcaacacctctgacaaaactgcaccaaaatgtgtcatatatgtagaaactcatcttctacaagctatacaaagcaatcccttatctgttagaaagtaaggactaaacaaattaacaaaaggactaggatgattgaaaagatattggtgccttattatgaatgtttgccaagacacttataaataagatagagatgttaaaagaaaaaacaatgtaaattctattgcctaatgtgtacttccatttcaaatatctagttcacatattagtaggtatcattcatcttaattgggttcaagaaggctcttcactgctaatggcaaatcaatcaccatctctgaacactgcagtatgtactcatgacctgtagattgtgttggaattttaatacatggggaagtattttgaaaagttaggaatttgagttggaaaggcatccagaaaattgattttgatttttcttaagggttaaggctgggtgtggtggcacacgcctgtagtccaggtcacttgagaccaggagttcaagaccagcctgggcaacgtagggagaccccgtctccgagaaaagaaaaaaaaaaaaagccaaaagcagctgagtatggtggcgtgtgcctgtagtcccagctaattgggaggctgaggtgggaggatcactttcctctgggaggtcaaggttgcagtatgccatgattgcaccactgcactccagcctgggtgacacagtgagaccctgttgaaaaaaaaaggtaaaaaatcaagggactttgttaaaaagattgtaatctcatattagcagtctagtaattggattttttcatttaacagaggaaaaagaactgtattttaatgagagtatatttttaaaaagcaat

SEQ ID NO: 13406 - DNA, 1033 bp, Homo sapiens
aaatataataggccagacagaccacattttaagtgttaacttcaggtgagagaccatgaatttaaactgagatcagtccacaaggctgtgttttttatctgtagtcacagcagagtgactgtttcgaacatgtgaaatgttctgggtctctatttccagtgggttttaacaaaggttacaattttgttagtttgcacaagagttggttttaacaagggtaataggccctggaattgggtcaggtaaggaggagagtgaggttctgagggacggaagcacaggaaaggcagtagaataatgaattgtactttatgttggtttgtacttccctgaaggattgttgagatgggagttacaaggggcaagctagagtgtggaaggcttgaaaatggggttatggaaggtaacttagtaatggcaaggtctagggtgtgactacctaagtcacataatgtcacatctctgctccaggtattatggcgatgatgaaggtgtgaaaaagagaaactgaactgacaactttaaagttgtattttctaattgggactagatttaatactggcataggtcttctgtgaaccaagttacttgacttgttgaacatgtataaatgacatgaagtatttgatgggaagtttcagccaaacaggtgataagaagttgaattttaaaccctgtaaaattaggtcagtctaccatataaaaacaagatttaataagcggcagatgatattttgtccaattcagttagattttgcagtgccaaataattataggcagtgcaaatcatgcatttgctgtgctatgaagggttatgtgaattctccgctacagacatgctataccttccctgaaaaaagcacatatggctatcagtaagaaggtcattttgaatgtgcacctacaatagtgacaacaggctgggcgcgttagctcacacctgtaatcccagcactttgggaggctgaggcaggcagatcacctgaggtcagaagttcgagatcagcctggctaacatggtgaaaacccatct

SEQ ID NO: 13407 - DNA, 1036 bp, Homo sapiens
tacattgctaccttcaataatcttcattcttcctgttaatgttctgaatcttcttcatgctgcaaatgaatgaatgaactaataaataagatgtttctcttttaattgtttcaataggtagtatactaaatttccccctttgagtaggtatttaagagattaagtttaaaagttcccagtagttttatttttactttaatttttactattaattatgacagttgttttttcactgtaagtagataatataaaagagaaatcaaagggacatacttttatcattatacagtttatgccttgtcttttatcttctgtcatcttgttccaaaatatggcaatttttttcctgtattccctttctctgtattttgttttgctttgttctgtaataactggagatacttggatatggatactcaactgttatttttgctatcactcagacacttccccttcccgaataaaatcctacatctaattgtcaaaataaagcacacacaaaaaaagtactttttttttttttaagagacagagtttcagtgtgtcacccagaagtacagtggcacaatcataacacactgcaacctcaaattcctgagctgaagccattcttccacctcagcctcccaagtagctaggattaaaggtgtataaccaccaatcctggctaaggtgtttgtttgtttttttgtagagacaggggtctcactacattgcccaagttggtcttgaactcctgggctcaagtgatcttcctgcctcagcctctccagaattacagttgtgagccaccatgctggggctgaaaataaccttttacagaagaaagaaaagtgatggcatgaaaaatggtatgtctcttggacagagttcagtaatatgacctatgaaaaataaatatatttgaagcagactagagaaacacctgagagagaaataattcctaggataatagaagaaagcttattgttctgattttttaatataagtttgtcaattaagagttttctctactccagactaaacttttatcatc

SEQ ID NO: 13408 - DNA, 1076 bp, Homo sapiens
aaggacattttaggcagaggcagtaacagagcagaagtgcagaggtgtgaaactgaatgatgtgtgcagggagctacaagcatgttatccttgagccataaagtacaaagcaatgatttgcaggagacaaggatagagaccttaactgaacccttgaatgaaaaccatctatttcactaatggttttgtttgtctattctgcctgcataatttaaaacagtttctgtggatagaagcattccagtactttcaagagacagacatgggctgagcacctactatgtgccaggcacttctctataagaaacagagggaaaaacaatgaatggcattgtccttgagggattcacagtctatcacgaagagagacattatgaaaagtccaagtgtagtgtaattaatcagggtgacagacgtatggataaaatactatatgaaccaatggaaatacatgtttccctttaccttgggaaacgggagcagacatcttagagtagggaatcatcagatgtggacttaaagaatgaatagcatctcacagagggaaaaaagaggtatggctttcttgccaagggcccagcatgtgcaaaggcataaatcatgaaatgttatggttgtttggaaatgaggccgggaagtagatttgaaccatatcatttgggcatattatttttaagttaaggaatttgaagagcatcacgtgagctgtggaccaccagctaagattttttaaaagacaaatatataattggttattttttcacttaagaaagatgggcagggagctgataaactggctgaaaggagacacactgatggcaggtgctgggatgggaagctgttgcaattaaccagacaaggggtgatgagacctgagtcaaagcagcatggagcagattggggagcacatctggaaagaccgcagagaccctccagctcaacagccacgatgcatagtttagggccctgtccccagagtcagggatggaactgtttgggaacagttgtctgcctgctgactgatttgaatatcaccaacatataaatgtttgttggcaaaggatagcaacatttat

SEQ ID NO: 13409 - DNA, 1028 bp, Homo sapiens
aaacaaaatttctcagtttcatccttcaactatgagtgtgagatagctgatgaaattcgtgtcctaaatctctcttcattttgccggactatctgtatgatttaagcacttgcttgttttttttaagtgacttaagaatcttcagcattcaaataaaaattattaatccattaactctcagacctaaagagaatgaatggcttcatgaatcataattcagtcttctagtttggggcacataaaaaaagccaaacattcagttggcctcttccatatctagctgatttgctttagtgattcatttttcattttcctcacaattagactcaaatttctgggctgactttctaattttgagtctctaaagttgtaaattctgtagccatagaacaaaaatgacatagaaacacaaggtaacacaattgtatctttgaatgaaaacatacatatgttgtcttgaccccgttaccattttacaactcttacataaagaaatcaccagatgtttaaaaaatagaacgctgatgaatcttttgttcttccctaacctttatgtttttctgctgcagttttatctcagtaagagttatgctcatagcttacttattcaaaagtattatgcttattttcctcacaaagattttgttaacagaaggtttctttacatagtatttggaaaaatttggatactctatgaagaagaatgcagtagaggtatgagtacagaaaataatcatgagcaaataaagatgatgtgtgaaaaaataaataaaaaattttaaaaattcactgtaagctggattgcagttagcaaagcatcagagaagaatttctgtggagaaattgtaaatattattttaagggaagaaagttccgtatgacacagttgttttctgttagatgaggcccagctgttctatccagttcttggtcacagctaatggaaaaaactcattctgatcattttctaaaattcctactctaaatatgtactcacgaaagtaaagaaatatactttcctgaaatag

SEQ ID NO: 13410 - DNA, 1025 bp, Homo sapiens
ggtgggcggatcacaagctcaggagttcgagactagcctggccaatacggtgaaaccctgtctctactaaaaatagaaaaattagccaggtgtggtggcacatgcctgtaaccccagctactcgggaggctgaggcagaaaaatcacttgaacccgggaggcagaggttgcggtgagctgagatcatgccactggacttcatcctgggtgacatagagagactccgtcaaaaaaaaaaaaaaatcacatctaactcatgatgtacttggagatcgacaagatgactttagtatagctgataggccatcataagttcataggatggtggtgggtattttgtcttattttttatcagtgtattttcagcacctaatatgtagcatgacttcaagatttatttatcaaatattttaaaggacttaagattacccttgactgacccatgtgccaggcaatcttctattattattgggaatattcaagcactattttgttcaggatttgattagtttcttagggatgagcaaagagggcagttttaaagctccttcagagctaactcaaagtcgctgctagcaattaaaagaaggttaaaaaaaaaaagtgggacatggatcctctttattctcctggacattaaaacgtgcctcgacttgtattctccaatgtcccacattaaagtttagctgataagagagttccagtgctaaaacacagtttggaagttactcatctcatacacatccatgttgtaccaaccgatggccctctcagaaacaacaccatcagtttttggatgtctgtagtgttcagctctgtcaacagggcttaggaagggactctagcccctgcgaacatctggagaatctggacaccatctccattaacctgatccagcagatgttcccaccacacatatctatttcaagatcttcattgggagaggtaccatctttcaactgctccaagttatggtccatttcccaccaattagtaaaagaaagtgtctgtcttcatgaatcctg

SEQ ID NO: 13411 - DNA, 1035 bp, Homo sapiens
cccaggctaacaagtcaaagggcaatggagttaaaaatgaatgctaggcactcagtgctcactctatgatgagagtatgctgcagagccctgagatgaaatccataggcatggttaactgacctttaggaagtttgatggctcagtgggaggtcttgcatggtattcctgtattcatttcaaagaacagctgaaatgtcattattacatgggacagaaataatgcaaaattaaatgcattttctgcaactgacaatattaaatagtgctgtgattttactgttctcatattttctaacaccgctctataaattccttaacattcatgtacagaatatgataggtagaacctctgaattttgactatctagcaaaggttagtgcttcacttgactcagaaaaccaaaattatagtcctggttccaatgtttaccaggcccctagccttgggcaaatgacctaatcttattacaccccaccatctttctctgtataattaagtaatgatgtgtagcatcttgagatctgattaatttattcattcagtatctactgagtgcccattagaagacaggcactgttaggaatgagaatgagctaggctgagtatccttcagtcttccagacagcctgaattactcactcaagtaacacttccatctctgtgaatcagcaaagagttaaacaaagttgaatgcttgagatatttcattaggtcttttgaagcatagttccctgttatttcttaacctttttatttgctcttaatcttatttcctacacatgatcgagtttggtttctcagatggtgctcagtgaattaaaatagacagtataaattaattttgtgaataaaattttatgagacactacatcaaatacttcagtaaaatcaagatatattttatacccattgtagatattcatggtctaatcttgtaattatgttttttaaaattggatttgtacagccttattatccaattattcaccccatgctgttcataggtacagctatattccttaatgttagttc

SEQ ID NO: 13412 - DNA, 1031 bp, Homo sapiens
aatataagtattaattctctttcagagaaagctccctgagagagatgcttgatacttttaattcagttccacttggcaaccttgcatggaatacaactgggtagttttaatattttctatgaatatgtgttggtgcatctttgcgatcaccaaaacattacattttttaactttcaaggtatttttgaactgttatgtaaattaaggcataagcacttttaggtaataagtaagtttaggtcactagaccttctttgcgactaatgaggaatacactacataattgtcagattcttcttaattgaaaaatacctactcaaattccaaagttatcagggactgaactcaatattagggtaaatatggaatatataataactgattatgtatcagattgaagcttgaataacttattcatacatcataaaattgtggattagaagtttaactcagtcctttgttttactgctgaggaaaaggagatctacagaagcaaagatatttgatcaagatacgtgaaagaattgaagctagaatccacatctcccattccacatctgatattctttttattatgccgtattctgctacaaaaattaaggatggtcatgaaacataggcctctctctgtctgtctgtctctctctctctctctctctctctgtgtctatgtatagagatgcaatatggggtgtgcttaatattcactggagtccatgagagatagatagatagattatagatagatagatagatagatagatagatagatagatagatagacagacagacagacagatagacaggaaagagggagaaaagagatatttgtgtttgtatccatatattctggcaatcattagaatatgaagcaaataatatgtgtgtggctaaaaaatgtgagtagagagtatgtttatatgtttgcaacagcagatatgaatcagtaccaccttagtggtcaaatggatagggtggaagcagaactcatacaatcctctggttttctagccttagcaaaagataaggat

SEQ ID NO: 13413 - DNA, 1029 bp, Homo sapiens
aatgtgataccaccttactcctgcaagaatggccataataaaaaaaattttaaaaaatagatgttggcatggatgcagtgaaaagggaacaatgtacactgcttgtgggaatgtaaactagtacagccactatggaaaacagtgtggacattccttaaataactaaaagtagaactaccatttgatccagcaatctcacttctgggtatctacccagaagaaaataagtcattatttacaaaagatacttaaacatgcatgtttatagtagcacaattcgcaactgcaaaaatgtggaaccagcccaaattcccatgaatcaacaagtggatgaagaaactgtggtatatatgtataatggaatactactcagccataaaaaaggaatgaattaatagcattcacagcaacctggatgagattggagactattatcctaagtgaagaaactcaggaatggaaaaccaaacattgtatgttctcactcataaataggagccaaactatgaggattcaagggcataagaatggactttggggactcagggaaaaagggtgggaaggggacgagggttaaaagattaccaattacgttcttgtatgctgcttaggtgacgggtgcaccgaaatctcacaaatcaccactaaggaacttactcatgtaaccaaatgccacctattccccaaaaacctatggaaataagaaatttttaaaaaatacattaggtaccaggtgcagtggctgacgcttttaatcccagcactttgggaggccaaggcgggtggatcaactgaggtcaggagttcaagaccagcctggccaacatggtgaaaccctgtctctactaaaaatataaaaaattagctgggcatggtggtccatgcctgtaatcccagccactcaggaggctgagacagaagaatcactcgaacctgggaggtggaggttgcagtgagccaagatggcagcattgcactccagcctgagcaacaagagcgagactccgtctcaaaaaaaaaaacaaaaaa

SEQ ID NO: 13414 - DNA, 1032 bp, Homo sapiens
ttgctgataaaaatgagcatctttttcatatgtttaatagtaattcagagtccctgttctctaaatatcctattcatattctttgcccattttttctattatattttgttttttctcgttgttattgtaggtgttctttatagaatatgatgctactcttttgcaagtatgtttttcccatctgtctcttttaatttcacatatgttcctctgtttctgaaatgtaaatctgattatattgcctaggtaagggagggagagcattaggacaaacacctaatgcaagcaaggcttaaaacctagatgatgggctgacacgtgcagcaaaccaccatggcacatgtattactatgtaacaaacctgcacgttcagcacatgtattccagaacttaaagtaaatataataataataataataataataataataataataataaacttcttaatttaaaaaaactctatttactcatggacattttatcctacaagattcacctgatatgtcagtgctcctgtgaattattctctgatttcttatgtgaaagatctgtctttcctttcttcttccttatgtactttgtactccataatatagaatcattatagcacttctgacaattgatcgtattggtttatttacatgacagtctagattgtaaactccttgatggttttcttcaccttagtactcccagaagctggcccagggtccaggatagaatgggtattcagtaattgctttttgatgtgaattccctttgaaaaaggaagataccatttacacttacttctgagagattttcacctttttgaagccgtggaccctgtctctctcactcatactcatattccactatgatgtcaatcctcacataagagatgctgaattaacataaccatgatctccagctaatcaacacacttgaaccactgtttttctttactcttcccaagaaaagtaaacatcgtaaagaaaataattttcatctatacatctttaaaattgtcattaaaaggtaaatatattc

SEQ ID NO: 13415 - DNA, 1051 bp, Homo sapiens
agacagaacttgggtccaaagcattctctcagtgtgatggtgttcacatatgccttgtgtgcctttagaacataacttaagtgcgatagtatgaactgctacagtccaaaccttgtagagcattgaacatccatgcagaacagttagaagaagagggacttctggtgaaacagagcccacaatgagggtcagaatgtcatgagtaagttatcatatttggaatcgtgatgtttcctaataagaggaccaagccctgtaagtctgagcctcgatttttactcagaatcctagagaaaaatgcttagtcagaggctaacaaggtcttagcctccttgacccacagagaagaaatacaggaagggttaatacatcccagttggccaaacctgcagaagcagtcaccccctcccagtgtaccttgtagtttgaccatggcacttcacacacttcgcacgttctatctcctgtttgacttttttgagggtgttttctgtccacactagactgaatctctgagactggaatggtatcttcaccatttttctggtgtcgcatcactcagcatgctgccctgttcccagtcacctcaggaaaaaaggtataggccaggataacaggaagcacatggagtttggagtcccaaacactctgtatcatgaacttccttcccaatcctcccaaccaagcccttcttggtgccccttatctcagagaacagtgccatctgcctctaagttgctcaagtattaaaggcggatgcatccaggtgccctcttcccttcctacacaaatccagccaatcacttccagtcaatcatgtttccttagcatctctggaactggtccacttaattctatttgcctaatttaccccaccatcatttcttgcctgtattattgcagcaaggactgatatccttttccccccttgtccttctagcccactcttcaatttgcagccagcgtgagcatttgctgtcacaaatctgaccatctttctctttagttagctttgaagtctcagctttttagtgtgtcttccaaacccctt

SEQ ID NO: 13416 - DNA, 1048 bp, Homo sapiens
cccgcttttcctccattcagtgtggaaggataagcactgaacagagccatactagagcaatctacagggacttgtttcaaattcaaaaattgggtgacccaaggttctaaagtctgtcagatgaatttgaataatgcaggtattggcactctatggcagccacaaatgtggcagaggtaatgagttttggaagctcccctgagcctcaggcagaattacaatgtcaatcaagtttatttccttccaaacctccttttctttacccagggatggatttgctttagttggatgtccaaagttcttgacttactataaagaagtaaaaagtggattggatttggagacatataacatgagtttgaacccaatccagtcaatcattgcttgggtgatcttgggtaattcacttaaatttgctgcttctcaatctcccaacctatagattaaaaagtcactcatttattcatcaaacaaatagttctgaaaacttagtacatgtcaggtattagaactgtattttttatgattttttaaaaacatcatttaccccaagagtaagtaggtaaaatgtaaagtataataggaagagcattactgagatcaagttaagtgagataaagtatccagtacttgcttacttcacagttaacacttacggcatattgctacatcctcaagcctactttaaaaaaaaaaatcattgtattccccttgtaagaattaaacctcccatctcttcagtgctgcaactctcattaaggtatcaatctgattacctaagtgaagaacagtaatttacccttaggggaatttatgctcccataaataatttactatttttaaacgggagctttttaactctaatggaagtcagctcaaggcaaccaataactactaagcacctactatgttttaagtcatgtggagatgtaatccccaccttcatgagttttgaaatctataagatttgtaaaaataatatatcaacccattaaaatttaaaaagctaaattttgaaagcaacaaaagttttaaatgattgatatta

SEQ ID NO: 13417 - DNA, 1061 bp, Homo sapiens
tgaaggcttgagcaagtttacctttttgacaagcttatttactacaggataggaaacaacgtttgcaatatcacttttaaaagaaaagcaacagctttcaagaaatgatttcctctgttgatgcagttgcaataattttcaatatctcatttgtggtgcagaaaaatgaaatacctcagccttggaaaatgaacgcagagtgagatcacaaattgatcttggcaggaaagaggcaggcaaaggattttaaatactttaaagtactctgcacctccaaaacactgtcactctgaaagtacagtaatcaggggtggtatttagaatgccgaaagatatacaagagatggagaaagccaatactaaaatcttaaaatactagaactcagagggttagagggttaacttctggaagattaaaaggacagttattgtgtctctgtgaatacttaataaggccagaaaacataccgagccagaaataaacagatgcaaagagcatagagatgtgactgactcttccacaacaaattacaaaggcatattagaaagcactgctacaaaggaatgaatcctttgtatcccttgcgggatcctgagaaacatgccattgggagagtggttgattgggctaagggtcctggtttttgaatcagattcacactccctggagatccacagagaacgtcacagagagaacacgtggctgcaggagccttatgtgctgagcccactttgatgttgctggagagtcctactccagcatcttcctattttctcagttccagagaaaatgaaaaaaaatgaacttttgctttagagtgaagggaagttggatgagaagtgaagactggaagttgggcaggcgggacctctggggatgaactttcacctgtcacagtttcaacttattttgtggcacagagttgattaaaagagctttcctttggcactgctactgttggaggcaagaaaaggaaatgctaatttctggaaactagaattgctgcccctaaaagcacaagaaataatgagtgctctgaaagaaaacacagacaggcacg

SEQ ID NO: 13418 - DNA, 1065 bp, Homo sapiens
agtgagaagtaggttttaaagccaaccaaggttctactattgacatccttctaagatgcatcttcttcaggtgtcaaatgacgctgcatttgtctgtacaccatctcctcagaaatctcttatgtcttattggcatttactttgagatagagagggtggatggaaaggtgaaatctaaaagggcatgagcttacccatgatcaaatagctcctaggtagcaggaataaaaatgtacccagtttcctgactcaggggttcctgattgcctgctttatgtttttttcaatgattctccatcactgtttgtatacgtgtaatttttaaaaatttgtttaacttagttcatgtttttctaggagatgctagtctctgatagatctccaaaagttaaaaaaaaataaaagtgatacatactctaattcctacctattcattgaaaataaatggaaagtgaatttaactgctgttcacaagctttttgacaggctttctctaaaagtgactatttctgtagttagctgagaaagcacaacaggaggaaaattttgcttttgattacaactctttcctgggaggtaataccactatgaaattctctttttttctatgtatttttcttaccttctaaccaggtcactacttttggggtaataatgtgtctgcaggaaaatggaaaatgtgagcagaaggtgaaattatttcactcaatagatatttacaggaacctatcatgttgctattcgtattcaaagaaaaaaatgcctgatcccaaggtgcttaccatcctaataggaaggcatgtaaactcaatagtgagatgagtgagcaggtaccattgtgtgcaggatttggtagaggcacagggggaggaggatgtggacatacctacaggatgggactccctacccgaaggctggaaagggagtagagagggtacaaggtaggagataacactgcagaggcctcattgaaaagagtattattagaaagataagggagaaccacggagggctttacacagacacatcctatgaccgtgacattggaagtagttcttagttcct

SEQ ID NO: 13419 - DNA, 1050 bp, Homo sapiens
aacacacttacaactctctgaacatcgacaaggctgacaaaaacaagcaatggagaaaggactccctattaaataaatggtgctgtgatagttggctagccatatgcagaagaatgaaacggtttcattctgcatatggctggccaacaacctttacctttcaccatatacagaaatgaacccaagatggattaaagatttaagtgtaagacctcaaactctaaaaatcgtagaagaaaacctaggaaatatccttctcaacatcaaccttagctaagaatttttggctaaatctcccaaagcaattgcaacagaaacaaaaattgacaagggggacctaattaaaccatagagcttttgcacagcaaaaaacaaagaaaaaaaaaacctactagagtaaatagacaacctacagaatgggagaaaatattctcaaactatgcatccaacaaaggtctaacatccagaatctagaaggagcttaaacaaatcaataagcaaaaaacaaataaccccattaaaaaaatggacaaaggacataacagatacttctcaaaagaagacgtacacacaaccaacaaacttatgaaaaaatgctcatcatcactaatcatcagagaaatgcagatcaaaaccacaatgagatagcatctcacaccagtcaggaatggccattattaaaaagccaaaaaacaacagatgccgattgggctgcagagaaaaggaagcacttatacactgtcggtgggaatgtaaattgtttccgcctttgtggaaagcagtttggagttttcccaaaaaaatttaaaacagaactaccatttgacccagcaattcaattactgggtatacatgccaagtgaaatagatcattgtatcaaaaaaatgcatacactcatatgtccattgctgcactattcataatagcaaatacatagaatcaacctacgtgctcatcagtgatggactggataaagaaggtgtggtacatatataccatgaaatattatgcaaccataaaaaagaatgaaatcatgtcctttgcagcaa

SEQ ID NO: 13420 - DNA, 1021 bp, Homo sapiens
attcttggtgccttgggcaacgtgtgtatcctccctcaaaagaaggcttggagcaaaatgaacacttacaggaaactgaggctcgtatgttttatgcagtgaatcaccggcataattggaattctaacctcgaaattttatttccaaatttgactggctccactccttatacatcaaattgatcaaagcagaaattacagattcaaatttatggtaaagctaagaaaaagaaagcagaacgatgagtcagaaggtaagaggccacgtaacccaatatttttttagcataaagcattcacgaattttactggcacctcaactaaaatgatgttcttttaaaatcgtgtcacttgattataaacatcttgttttaaaaatggaacatataatccaacatcccccaaatttctagactaattcaaacataagagttgatcttaatatggatttaggtattcaacaaatacttatagagtgtccactatcgggcaaacattgttctaggtgctggagttacaacagtgaacaaataggcaaaacctttaccctcatgaggcttagagtccagtggaaaggaaaagaccaaaaataagataagaaaactttatggaaatatataaacatacataggtatgtctatataatacactgtgatatacctagtaagatatatatagttttgagagaaaaacatggctaacttgtttgtgccttaccttgtcatacagaattagaatattatccatactgaattcctgggcccagccctggccagtgtctctgccattttatggggtacattatctctgctgagctaagtaattgctaaatccacactggaggctgtgtgagtagagaagtgacacaccagttaacagggtgagaaattaatgcaaattaattctccaccctcccagcagacactgctcccactttcttgcccttctccatccccctgccagttcacagagaaaagtatgaatattacaaatgatactcacttcatgtctcagtgacctag

SEQ ID NO: 13421 - DNA, 1017 bp, Homo sapiens
ttatattggctaatttgtttctggatttagtcagatgcatggtaatatgtcctatcaatgatggaataaatatctctgctggaataaatatatttgttggcttctaccattctataacaaatgatgtcaaaatgtgggttttttttaacacattgataccattctctttgggcctcatgtatgaatctacagggagaaaggaaattactaaggctgctaggactgtagggaagatggaatggggtgaaagaatagagagatttggggccagttccatggaatactgtcatctctgagaaactctacagtattgagaaaatcccccctcatctgtaaatttgctagggctcctccacacacccagaccttagtcaaaagctgcatactttaacataacctccactccctgccaagcatcatcaagttctcacctttaagaaggggagctataacggtattagcctgctagggctgctataacaaaataccacaaactgggtgtcttaaacaacagacatttattataattctagagaccagaagtccaagatcaaggttctggccaattcagtttctgggaagggttctccacctgacttgcaaacagcagtcttctctctgtgtcctcacgtggcagagagagagtgagctctctggtgtctcttcttataacagtgccagctctattgaattaggaacccacccttatgatctcatataactttaattgcctccctgaaggccctatctccaaatacagtcagattgaggattagagcttcaacatgtgcctctttagggggatacaattcagcccgtaacaataactaagaacaaaagatagtatctgtattttggcaacttactattatgcatctagtctgtaaatgtttttctgtcacccacaacaaatatacatttagcatcaaaataatgaataaacaattttaccaagaaacgtaacactttagcagtgttaaaaaaagctctatgccctgaaggccaaatatttgtagc

SEQ ID NO: 13422 - DNA, 1021 bp, Homo sapiens
aaatgtatcgagtcatattcttaaagtgcctttggcatgtactggcctttcttcctgagctgtaggtaatagctatagcatccaacaaaaaattgccaaaaagcctatgaccttccatttgcagtgatacttccaagtaagtaaggactttatgaagttattttcaaagtacttcattgaagaaatgtttccctagtcatctggattgagattttgtttgcctctacctttgatatatcataccctgttgaattattcagtgtgggtcaaagtaacattaagcttcttacaaatgcaatattccaaacatatcccagcattttactttatcaccatccatagaataaaccacacgcaccttatctgtgctacaaacatacttaatataatgataataataaaaataataaaagtgtaataaccttaagaaacagttgattgatgtcattgatcactttagaatgattgggagtaacggaaacataatgctgaatttaaaaactgctatacaaagccactgaatgttttactaaagaaaaaaaaacatgtaatttgaatctttcaaaaaaatctcttttttggcccagaaagtacaaaattcttagctcaaattttaaaatgaaatacagtgtagtcaaatatgtaatatattaaatatgggttccaaactctgctcatcagtgattttcagagtaacattttaaccttctgtagtctcctcatctgcaacataagcttaccctgaatcatcacaaaagctccttatgctctaagtttttacatataaatattaggaaatcatttagaacatctggaaagcatttgaaacaaagagatgttatcaaaggagtcaacagtaattttcatcaatgtttaagaagcccaaaaaattcctattccacttgaaaatttagtgctatgcagaacaggtagtaaatgttaccagttcaagtcagaaattattttattagcagttgttagaatcccagccatgtccaagctggaaaatagggaagcaatt

SEQ ID NO: 13423 - DNA, 1026 bp, Homo sapiens
atagtgatttcctttctctactaactgctgccttaaagtctctttctttccaatattaatgtagttacaccaaatttttaaaaatatttaactgaaatatcttttttcattttactttcaacatttctgaacccttatgttttaaatgtgtctcttataaacatcacatagctagatttattttaaaatccagaataacaatctttttatttcaattggaacacttagttcacctaaatgtactagaaatattgatatttatttcttccatctcattttgtgatttctatttgtctcatctttttagtcttctttttcttcttctttcttgtgggtcaattgaggatattttcttacttcactctttttcttttagtgtttggaacctaatactgtagtttttattcttctaataattacccttgaaattttaacatgcatcctaacttatcaaagtccaagtttaattaatacatcaatacctttccctcttttgtaacaatacaagaggaccttagaacaccttaattctgataattctcctcccaacttatatgctgttattatgggataatttcgttctgtcttatgttgtgtgtgttttacacaaaacaaaagttaagattgttattaccattttatactggaacttttaatatacaatcaaccacattttaccactttctttggttatcattccttttgcgtaaaaccatccatcagagtgacttccttggtctggaatacacattataagttttcctttactgagagttttatttgaaaatgtctttttgccctcattcttgaaagacatttgtgctgaactgtaattctaggtcaacagttattttctccaggtgcactgatgcttatatttcactatctcctggtttccactgctgctgttgagaagtttgctatcagttctcccttttaagtaatctgtattttctttcaagctgcttttagggtctcctttgttgttatataatttcgtcataatgtgtaggtatagatttcttt

SEQ ID NO: 13424 - DNA, 1001 bp, Homo sapiens
ggtggcaggagagagaagtacaagtaaagggggaagaggcccttataaaagcaccacatctcatgagaactcactcactatcatgagaacagcatgagggaaaccacccccttgatccaaggtcctgttctcaacacatagggattatggggattgcaattcaagatgggaattggtggggacacagagccaaaccataccaattgctaatgacattattaaccataccaggaagagtttagcaaggtgaaagcaagatacctacacaaagagctctaaccatttcaaaatgctcaaaatatcaatatcaaatcatagatcatgagaaggaaattagttatgatattaacaacatgccactaaaaaatatttagcattttaccagtgtctggctttttagctaggagacctttggccagaaaattcagctatgaattaacagcttctagtgtgtattttcccgatgactgtacagaaagacactgtgaagaatggccagatggcctaatgaataaaatgcttggttttttgagcttctctgtttcccatctgtgtttacctttaagccttggctaacataaagcctgggttttgaactgctattcccacagattgtcacacaggttgctgatattagtccatatgcaatttcttacaaaaggaaatatttttttaaaaaaaggccatgggcgaagttaggggaagagactaaacactaccaagaatatgaatggggaatataaagaccactgaagttagagctggaggagatcaggatggcagacaagttcctcattgtgcagattaagaactcagacagggtaaacaattagtccactgttacccaatgaacaagggtgaaagctgggaatctcccaaatcctagcccagtattttttttatggcaataccctacctcttaagcaaacaacagctaaatactgtcctccccaagttaggagaacaaatgagacagatcctaagtgctataaaagcttcag

SEQ ID NO: 13425 - DNA, 1034 bp, Homo sapiens
tgctcatctaagtgttgcacatatgtgtaaaaggtcatgtccttcagttcccaattcctctggcgtctaaactgaactcaccatcttccccatccagacctggtcctcttctgatgttccctgttttaagaattggcaccaccatccatccagtaaacagttgagaaaccaaggtgtcttctaatactcccctctttgacctttctaccccctcatacatcagttaagtcttgaggttttacttttaaatatctcttgaattcatcttgcctttgctatttcgacagtctcctacgtggttattttatagccatgctggtcccccttctgtaactagatctttctaaatagcagatttggtcatgttacattcacttctttaccacacccttaaaataaatggtttcccttaacctgaccgggcctccttaacctgaccagcaaagccattgtagactggctgctgcttacctctccgtttcatctcagggcattgccccactcactgcattttatttcagtgctactctgagcctttgcataggctttttcctcttcagcctcccctctggctcctccgtcgattaagttaacacctaagtttttatagcctcttgctttcctgcatagcacttactatagttaccactttacattttatttatttgttataaaatcagtcaatgagagcagtagggctcttctggtgtgttcattcactgagcgcttccactgtttcatgtactgctaggtactgttgatagatcagtgaccaaaatgtccttaaggctggtggaggtgaccagaatgaatcagatgaatgtgaataaatgtaaaattgcaattttgataagtactatgaatgctaattatatggcactatgagaatgagaattgatgataccccggtgcttagttaagtttttactaagtatttgtagaatgaatagtcgtagaccttcatgcttaagggcttgttgtttggctggttgttagctttttgtgtttggcatctcaaagactttttctatctc

SEQ ID NO: 13426 - DNA, 1115 bp, Homo sapiens
gcctcctgagtagctgggactacaggcacccaccactacacctggctaatttttgtatttttagtagagacgaggttccaccatgttggccagaactcctgacctcaggtgatctgcctgccttggtctcccaaagtgctgggattacaggcgtgagccaccgcacacagccttcaggtcctttttaactgtaagacttcattatttcatatgacccttatttttaggactggtcaaggctcactaggaagtaatgttctgctgcagttgttgcatgtgcaaaccctgctgcctctagtggagtacagatcaattagcacttcctctcctgccttccaggctgtagtcctttggctcaaaaggtggttttatgtattgagtagatccatgagacttttctggatcctgatatgcttttacttgcctccttatccaggcttccatttttggtctttttcttcatcaccaatttggcatgtaaacttttatcccaggctataaagtgatcacatttgtgccctgtgccatgcttggacctctgaatcccagtcataccttgccttgtcctgaaccttgcctatgtcttccagtgttttcctcaacatcttgagttgtggctagcttttctttatgatgcatactaaccgttatgattcagttcttagttttgtctccttctgacctaccttttcctgatttttgtgactgattttgattttatgcttactcttgtgtctaaaagctgtctttcttatactacaatggggaagttacattgagtatgtcagcaacaatgtttaaacaaggggcaaaacctcactataatcgtatgtattttcattaagcatgacattctatgcaaggcttaccttcggggattaatcattagaaagtgccagaagtatccaaaagcgtccagccttgttatgtggcttcctctaaacatcacatcattttattgattaaaatgcttaaaagcttttgtgaataactctacattgaagtatcaatgagtggttcttaacccatcactgtatgcatctggtttaaggttatgagggttaaaacaaaaattcagatattcacacccagagactcagatagatttggtttgg

SEQ ID NO: 13427 - DNA, 1046 bp, Homo sapiens
ggggtcaagcgattctcctgtttcagtctctggcatgtgctaccacacctggctaatttctgcattttcagtagagatggggtttctccatgttggtcaggctgttctggaactcccgacctcaggtgatccgcccgcctcggcctcccaaaatgttgggattacaggcatgagccaccgcgcctagcctcttgttttgctttatgcttaaagcagtgcaaaatttaaagtatttcatgttttaatttaactttctaaataggatcaaacatctaaaagtatttaaggagtagcaaaaagttattctcacctcctcacacaattgctattagttcttaatttatccttctggagttttaagtatatatgcctatatatatttcctttcatttttatacaaatagtaacatactaaacatttttctatatcttgtttttttctccctatatctttaatgtaccaaacatttcaacagctatttattaacttattttttatttcaaatttaattttggaaaagagaatacattactaggttcaaggaagaatagaaaaatatttgaaaagtataaacagttacccattcttacctgcccagctccccctcctctgttctaaccctcaaacaggtaacgactattaatgttttttgtgtatttttacaggatttctttgtgtatcagcatgcaaatatgaatgtacattcttttttcttttacaggaatattacacatttgtgccttgcttttgtcacttaataatttgttacttatattaataatttgtagtgtatcaaaatgtgtatgcaacagatttataaacataagattataaatactccaaaaatactcatttggttagaaacaaaatattaatgtcacagcaacagtaaatttatttctacattttattgcaggctgtactctaaaggcctgttgaggttaatcagaacctaaaaatgctagtaacatttttttgtctggtacatgctgaaaaaaagctacacagttctacttatttcactttttcctttgtttcagggctg

SEQ ID NO: 13428 - DNA, 1035 bp, Homo sapiens
attatgttattgggaaattacagttttgcttattttgtcatggaaaggacccagtgggaagtaatttaatcacgggggaaaatacagttttacttatttttgtcatgggagggacccagtgggagttaatttaatcatgggggtggttacccccatgctgttctcatgaaagtgaatgagttctcataagatctgatggttttataagggacttttcccccttttgctctgcacttccccttcctgccatcatgtgaagaggatgtgtctgctgccccttctgccatgattgtaaatttcctgagggaaatttactcatgccgaactgtgagtcaattaagcctctttcctttataaattacccagtctccggtatgtctttattagcagtgtgagaacgaactaatacaattgcccagcccctgtaatttggcaagaaatagggcataaagattgagaaaggaagaaataaaactgtcattcacagaggacttgatacacaaataatctgcagactatcataactgaaatgaatttagcaaggccactcactagataacaaattcaacatacttttgtagcaacagagtctctctatattagcaataaacaaatataaaaaacacctaagaagaaatctaatgaaagatgtgcaagaacactttgctgaaaaccacaaaaatagttataagaaacttaagaaagacttaaatgaagagatataccatgttcatgaataggaagattcaatattgtaaagttgtcaagtggcccccaaattggtctacagattcaatgaaatctaatcaaattctagcactttatttcattgaaattgactcgctgattctaaaatgtcttatggaaatgcaaaggacttcttcatgagttgccttgtggacgagatttaagacaacccaagccagctctctttggtctgtgagaagcatacatgtattctttgccttgaccatgtctgtagacagaggacagtccaaatagcaaccccttcttccttcttatgagagcagagag

SEQ ID NO: 13429 - DNA, 1032 bp, Homo sapiens
ttaaaatacctaattccttttttaaaaaatacattttttttttctgactggttcatgtttttacttttttattgtggtaaaatgtatgaaaatttaccattttaaccatttgtaagtgtacaattcagtggcattgtgttcacattgttgtgcagtcatcactatccatttccagaactttttcattatcccaaactgaaactctgcatccattaaacattagggccctattcctaaccctttacaccagcccctggcaaccactattctaccttctgtctctattatttgaatatgttaggtacctcatattagtgaaatcatacagtattttccttttgtgtctttgcttatttcacttagcataatgtttttaaggttcatccatgttgtagcatgcctaggagtttcatttctctgtaaggctgaatgaataacctgctgtatgtatggtatatcccaccttttgtttatccattcatccactgatggacttcggggttgtttctgcctttggactattgtgaataatactgctgtgaacatgtgtgtttgaatgcatatttgacccttctttttatttctttggggtatatacacaggagtagaattgctggcccacattgtaattttacattaaattttttgagaaatcatcttacggttttccacagtgccataccatcttacatcccaccaacagcgcacaggtgttccagtttctccacaccttgcgaacatttgttattttatctttttatttttcataatagccatcctaatgggtgtgaattggtatctcaatgtgtgtgtttttttttttttggttttgcttttttagtttttattagtatttttgttcccccatgcagatcaatgtggttttgatttgcattttcctaaaaacttgtgatggtgagcatcttttcatgtgctctttggccatttgtatgtcttctttcatgtttggttgtatagcctaatctctttttctgacccaccttcccctggcattttcaatgccattaacaa

SEQ ID NO: 13430 - DNA, 1059 bp, Homo sapiens
tgtaatcctagcactttgggaagctgaggtaggaggattgctggagcccaggagttcaagaccagcttaggcaacatggtgagactctctacaaaaaattaaaaaaaaaaaaaaattagccagccgtggtggaatacgcctgttgtctcagcttctcagaaggctgaggtggcgaatacgcctgttgtcccagcttctcagaaggctgaggtggcaggattgcttgagcgtgggaggtcaaggctgcagagggccatgatcatgccactgcgctccaacctgggtgacagacaccttgtccgccccccccccccccccccccccccgccgaaaaaggttataagttgaatatagttaatattctagaccaggggtttgcgaactttttttctaaagggctagacaagtagtttcggctttgcggccacagtcttatgtttttcttttgttctttcttttttttgggcaacttttaagaaatgtaaaaaacattcttaattgaagtctgtaggtcggatgtggcttgggctgtactttgctgacccctattctaggtctatttgcactgatcttgctaggcaacatgactcttttttgatgatgagattcttttcttaatgtccatcttagtagagttgcaagtgctgatactgtccaggtgatttgtttttttttaaatttttatttttgaataaatgactaagaggtaatattattttaattttcagatggtgaccctgataactatattgcttattatcggagggctactgtctttttagctatgggcaaatcaaaagctgcacttcctgatttaactaaagtgattcaattgaagatggacttcactgcagtaagtatatctcaactttctttaaaggggaacttaacagaacttggggagagataatttgtttcataaggtgaggactggcatgctagacatagctggaagagatcaaagctacagtgatgttgtggactgaggaacaagagaaattcaaagtccctagaatcaaagatctgtgtgaaagagaacagcgggtacattagatgttt

SEQ ID NO: 13431 - DNA, 1027 bp, Homo sapiens
ctgtctccactaaaaacacaaaaattagctgggcatgttggcacacgcctgtaatcccagctactcaggaagctgaggcaggagaattgcttgaacctgggagggaaaggttgcagtgagctgagattgcaccactatactccagcctgggtgacagagccagactccgtctcaaaacaaacaaacaaacaaacaaaaaaacccaaagttttaaaagaatactcaaagtattgtgaactgagaataaaggagaatggtacttttaagtcataaagtcattttggttataatttaaagatagcactttatgctatgattcagataactgttctggtttttattggttcagatttaatactggatcacatactgtaattcaccaactgtaaggagctatcaattataagacaaattattttatgtactactagaagaataaatgctgccaattaaagccatcttataacaatatttttaatttatgcttatggaaagaactgtttgagacttagatatgcatttttgttatatcatactgctgtattcattgccttcctgcatacattaatttcttgaagattttaagtggaatttaaactcagcatgtgtagtaagtaccaaaaatgcccataacacaaatgaagtgtgctagaccattcttgtgtatgtatgatcatgctgactggctgatggtaagactccatcaatttttagattcatccctctttgagagagattcaaatgtgttttcttatcagcttgctgagatatgggccaaagggaaagaggaaggggtgagcctaaaagatgccagcagtaaaatggagtaagactctattacatcaggaaaagagggaactactgacttttaggattcatggcttaaatgataaagtagagccattgattgaagagattgatggggagggatagcaatgggttgaagatgggaaacagaattccactttgtccctgttactgagatgccatttaggtgatggattggagacatctaaatgtgaagtag

SEQ ID NO: 13432 - DNA, 1206 bp, Homo sapiens
ccctgctgcatccagtcatcagacaagccagtttttccagtatctctttaccctttttacccaatgaacttaagtatttggaatggtttacccttgtgtatattacaggtatcagatttaagagattaaaaactctgcttagttttttattttccttatagctcaaatctaatccaagtgaaaatgaagaaaaggaagcacagtctcaacttataaaatctgatgaaatgcagcgtttgcgttcacaagcacttaacgcttttggaagtggagattatactgctgctatagccttccttgataagattttagaggtaagtttcttagatactgcagttgaccagcctgacacttattgtaaggcacatttatatacttcgacatgtcacataccacaaagacctagacaggagaaaatcaggttggtccttgggcttttgcctcttaagtataaaatagtgttcctagacaacaaaatttggactgaagttttcagtaaatgtactgaatgtgctgtggcatgagagttaaatatgtttataaattgcttgctttgctattttagttgattttgtatttttttgggaagaaaactctagcggttagataatgggataaaagatgaaaaagatggttggagtaaaaggaaaaatgatgttcgggaggaaagaggaatgtttagagaaaaatttctagagaataaggcagataaagagttgatagtatgtgcctgtagtcctagttacttgggagctgaggctggaggatcacttgagcccaagaatttgtcgctgcagtgagctgtgattgctccactgtaccccagcctgggcgacagaatgggaccctgcctctaaaaatattaataattggctgggtgtggtggctcatgcctgtaatcccagcactttgggaggtcgaggtgggtggatcacttgaggccaggagtttgagactagcctggccaacatggcaaaatcctgtgtctaaaaaaaaaaaaaagaaaattagctgggtgtggtgtgcatgcttgtgatcccagctactcgggaggctgaggcgctcgaacctgagaagcagaggttgcagtgagccactacactgtagcctgggccacagagtgagactccgtctcaaaaaaaaaaaaaaaagttaataataataatggttgataggatccagagagttctagctagggaaacctga

SEQ ID NO: 13433 - DNA, 1035 bp, Homo sapiens
tagccaggatggtctcgatctcctgacctcgtgatctgcccactgcggcctcccaaagtgctgggattacaggcatgagccatcgcgcccggcctaatattttcaattatatagttaagaatattgacattgttagcaacatagctctagaacatttttatttttgtgaaagtaatatgcaatacacatgaatctcaggcttttaaaactctctatttccatttccttttgttagatccttcatttttatcttctcccttgtcctctttcttgttttgtcttcatgtctatgatagttttgatttgttcttatttttcttgagtcctgattgctcacatttttacctcctcgtcatctggtctctttcctgagttctgattctgccttgtgattactcttaatggaagtgattggattaagttacataatttgtctatgatgcttgcccagaatttcctctggttttgtttttctgatggctattcagaaaatagtatgctttggctatgtttttctgatgaacattcattagataagttttacatgttcttttcctgatttttaaaatatctttgaagtgatattgtgccagttaaaaaaaaattattactcatcataaaatgagttggagttcactgccctagctatttgtggggctagtcctctggatgtcagttttgtttttttgttttctgcatgtaaggcgtgctggggccagggcagccttctgtagttaacagtcgcagtactctctgcttcactgtttccacagacattctgcttcccgctaaaatgattttgctgtatagccctgccctctctacttctctgcaccaaaccatggccaggaggtcatctgccaccagccccacttgcccctgtaccccattcctttgctacaccaaaggggtgtgtgttttgcacttcaggatgagcatagagttgctgttctctgggatctgccgcacaggctgtttcactgttccctctcactgtattctcttctttacctctgtcttgccccagtaagccct

SEQ ID NO: 13434 - DNA, 1042 bp, Homo sapiens
taggaagatacattgcaagggtgcaatgggcagcatagcagaaaaggggctgtctgcaaagaggcaggggctggagggaagtccatagggtcgtgctgctggggctccatgcacataaggtgtgcagataaggttgtgctgctggggttatgtacggtatttgggaacaggatgttgggccagcgggttgtctgtgattggctatctcttggaacaattgtactccccaatctgcgactctttcatcactgttgtttatttatcttattagggctccacaaccctgttggaggaaaccacgcaaatgttcagcctgttgccatgacatcatcaaggggtcctggctcatctgggcctctatgccttcagtttttcacctctctctttagtcttctccttcacctcctttcctctacccccagctctcattctcagtagatggcctttgtttgctgctgcatcaagaaaactgggcctataaaggtgatccctacttcttctgacttccacctgaaaatttagctaccatttcggccatctttattgttttttccaatcaaagacaatgaagtgtttggcactctatttcatacctgtaatggactgaatgtttatgtccccacaaaattcatctgttgaagccctaccaaacaatgtgatagtattaggagatgaggtcatgggggtggagcctcatatgctaatgttggctactatgctaattccaatggatacttgccattcttctatgtcagtggttcccaacatttttggtactagggatgggttttgtggtgtttccatggaccgggagtggttggaggtcgggggatggttttgggattaaactgccccacctcaaatcatcaggcattagattttcataatgagcatctaaccttgatttcttgcatgtgcagtttacaatagggtttgtgctcctatgagaatctaatgctgctgctgatctggcaggaggcagagctcaggtggtgttgctcgcttgcctgccactcacctcctgctgtgccacctggttcct

SEQ ID NO: 13435 - DNA, 1033 bp, Homo sapiens
gttatttagatatatgtccttagttctgctcttattctaggtacggtacttgcaggatctcacacatttctgtaatttcatctaccccttgtgtgctcattggttgcttaggaatcagagtgaagtcatctagaactgtaacattctggttatttgaactgcttaaatattagaatgtagagaagtaggaagaggtaacagctagcatattcccaaaggttttgaaataagatccccatacccactgcaacagaatcacttaagtatatatacccaaccctatccctgaatttctgagtcagtgtgattggaatggggcttgggaatctgtattgtcaaaggcttcgtgaattgcttctgttgtacacttatcgagtgattactgtatgttaagtactgggctaagttagaaagccagtgttttgttatggaaatttaaaacccttatctgttttctccagttattaagtttcctgactgcaggatgacctacgggtgggatcaaaactttcttctaaaagcagctctgaatgtgcttataactaatagagttgacgtagtgtttggttctgtcctgtgaggcatagcagtgtggtggcccagaatatttagaaggcaaagatttgccgattgtttgtcccatggatatcctctctggacagctgctgacattgagctgtgctgtgtcaggatgggtccagcatgggttggctttaaagtgcattccaagataactaagtggaagaagttgcaagctggatgtcggctgaggctctcctccttagttggctcctcaggaaggtgctgcatggttttgccctactttggtgcaaagctcatctcccttcaagttcccagggcctccattttcatctgttagtttactggagatttggggctcatgcgggaattgcatttgatatctgcagtctctctgcatctcctggttcacccctttcctggcttttctgtcttctttctcttcccctcaatcacattctctctcttccaaaaactagacaccttcccttct

SEQ ID NO: 13436 - DNA, 1024 bp, Homo sapiens
caccaccactgtgactgtgtcactcactgatgacccaaaaattgggtaaataattatcttccttgtctgtattaatctttcttaaatgtatgtatagctcacatttatttcagtgtttagtattagaagtgttttggttctttatttagaaatttggtgttgtttttgtgaccataaacataccatagcaacttaactcttgtttatataataactagtctatggtaaaattggttttgttacacagcgttttgcttaaagtcacagtttccaagaacctactgatgacattgaggacttactgttaagtgcatattggacaaagctatatattcaatgagagattaaatatatctcacagtcaattaattcaaaggtgggagagtatatcctgaacatggtcaggcagaaatacctgtgaatagggtctgtggagagagacaaaaatagagacagagcaaaaagggaggtgagattgtgctagtatttagctacttctgacttcggacctgcagactagagctatttattaagtgaacacttaagttaattaagaaaatgcacttaaagattgatgtttacacaaagactaccaaagaagtggaaacagcaacctaaagataatgaattttaggaaagtcaactttagtaatttaaatataagaaaatgacctgtaagtggaaggacccatgaaaattagattatttcttaaagcaacaatagttataaggatggcaagaggatgaagagaacaggatgaaacccaggtagctacacagagctgcacattggaaatgtccaagagtaaagattcggaattagagtaagcattaaaccagaaataaggcatatcaatgatggcatgaaaagataaaaccaggaaacatatggtgactgcaaggtgaaatacactaagggacaaaatagtctttatgtatgagaggaaaacaagactgagaaaacacatcctgtttattagatgcaaaggaaaagaggattggttccaaaacaaaattcagttgt

SEQ ID NO: 13437 - DNA, 1033 bp, Homo sapiens
ttataaacaaaaacaaacgtttacaaaataagaatggacatttatgaagaacctacttaaagatcttggaaataaaaaataaaattattaaaatgaaaaacatagctgataggctgtatcacagcctgggaacagcttaatagtacaccagtgatttgggagatcaaggaattttcccagaatacagcacagaagtaaggatataaaaatgtattttaaaaaatttaagtgacgtggtagacggattcataagctccaatatccatctaatgaaatgaaagagcagaaggtgaaaaagagaaagtagaataaggggaatgtagaagaaagagctgaatatgtgagacatttggaatacttgtcaaatatctagatatcaagtgtgaaaatgggagctgaagaggatccagagagactaaataggtaggcgacagcgccactgaatactggaagaaaaaaatttgtgggcaaagcgtttatttgttttgggacctttgggtttggaggtgctggagaaacatccctgtggacatttttatccagtactagaaactttaagtctggaagctcagaagggaggtagggaagagaaaacacagaggcgatacttgaaggatttcaagtgtatgatagaatggaaaatgtgataaaaggtggtgtgaagaattctatttgatatacaattgttgtactatgtggtttaactttattaaatcaaagtcaactgtgatacaatgaggtctgccccattaaaaatttatcacagttaagatgaaaggcaacacattttatgttatctaggagttctttttcatgttttgtgttttgtgtttggattatgtagtttggtttatatttgatatgttaattaactattgtgtttggttattatgaatgtttttccttgtaaacagtaatgtggtttagtttttttttgttgttgttctaccatccccttcccaaaatcaatgactaaattatgatggctactaaatgatgcacgtaagaggttcccccaaataatctgataaca

SEQ ID NO: 13438 - DNA, 1290 bp, Homo sapiens
atgaagaggagtattgattttattttagtttaattatactacatttgatgttgtatctgctgcagattaaaaataactatattgtcgttactttgccttttcttcttgttcagtacctgttatgaacaaaggcatagcattctttgcaattggcagcagacatagcatcaaatgtaatatacctgttgtgaataagcaaataaaatccttaacaaaattccttgtactaatacttagttgcaaaatgatgtcctggtctcaccttcttatttctgaagcctctcttctgaactaaagacctctgtgagattaggaatcaagtgaaataaaatatcagaaaaatagcctagtcactcacatctaaactgttagcttccttttcaaagtcttctgcaatttctttctttgtccaagtatttggagattaaggatttccattttgtggaggacagctattgtcagtagcctcctcctgggtgaattaaagaagtgatagaaattgtttgagagctgattctagatggcagtagaaactaacatgggacatggccctgttgtttttctgttaccaaatgttgtggataataacaatcattttcataacctccattttcttggaaaaatgactgaattgaaaatataagcttggaaattacagagtgctatgttaaagcttttttttggcgggggggaagtctcgtataaaagttgatttttcttctcctttactgttatctaagaggtataccttcatgtttggtaagagaggctgaactgaattgaaacgttgatttccactagggtcccacacctggagagacttagatgctcgaggtggaagaaagtttgggatgatcttcattttgttcagtgtgccttaggggaaattgctgtgggcacctggagatgtttttcaactcttctttccagtacttaagagttataaattatcccccacccccttctaattataaccctatcataaaacatctactctttccctttcaatttgaggcccagatagatgttgttgtgggttccattactctgtccatgaccacatcataaaaaatatctccttctaaaggaagttcttacctgtgctacagtatggatgaaccttgagcacattatgctgaatgaaataagccagttacaaaaagacagataccgaatgattccacttgtatgaggtacctggaatagtcaaattcatggagacagaaaacagtggtttccaggacccgggggaagggagaatggggagttagtgtttaacgggtatgaagt

SEQ ID NO: 13439 - DNA, 1056 bp, Homo sapiens
aaaatgccagaaggtggggcatgcttgaagagggccagtggggctgagtgacacaaggctagatgggattggagaggtggccaggacccagacatgataggctatgaaggccgcaatcaatgtggttcaagtgtgatgagaagctgttcgtgtggctccatcatcaagccagaagcctggtcatcattcttggttcctgtttcttcgccattcttatgtctaattaatctgtgactttctgtttccaaaaacttctcagttttacccacctctctacattatcactgctacttcctcagtccatgccatcaccattcatggcagcttctgactgttttttctgcctctagacttgcctgcttccaacctggtctctacctcactgccagaatgacctttctaaaatgcaactttgatcaagtccattccagcgtaaagacattcagtgcttccaattcccttgtgctccaacctctctcatctttgctgcgtatacacacaagaacacagtcctactgtgctacagtccttgtagttctttgaatgtatcacagtctctctcacttttatgactaggagtgcttaatttttgtgcattctgtttcttctccattcctgcacctggataacttcaattactccttcaaggcctagacacaagtagtgtttttcttccctagcaacccagtctgagttaattgcctctcttatgtgcacttactgcctctcgtgttgttccttcctattttaacatcactccatattttacttatctgtctttcccatcacggtgtgagctgtttgtcttatttactctcctatctgaaaggcctgaaacggtgccctagtactagtggatgtttaaaaatttttgtcaatcaaatgaatatatacatgtaattcaaatggccaaagatgtgaagaaagaggatctttttctctatgagtcaaccagtgctttgtaaataaaatatgctgtataaaagctagctgaattaagtaaagtggcaggatataatataagctgtttcttgaaacctaagtagagtcaggcat

SEQ ID NO: 13440 - DNA, 1030 bp, Homo sapiens
tttgataatatttgaatgtacattgcataaacgtgcagggcatttagaaagaggagtagtgaagtttcttatgggatttcattaagcccctttctagccatctttttattttgtaaattgaatcaactctttcaggccaccagagctaattaatactttgggtaatctgctacttcattaactggaattccttgaggaacccaggaagcttccagatgtgcattctaggaagaattctgctgcttttcagtaataataacaacagacatgagttattggacgtttacaatgggctaagcgtttgtgatctgagctttgtggaattctcttttaatctgcacagtaatcctgtgagtagacattttcccctgcccattctcaaagccctcgtctcccttatttgccgccattccacatattgcagctgtttttctggcatcctcatttcattgtatatacaatattgggaaaccaggaggatacaaaaatctgcttgtaggaaatgcattgtgtctgcctaaacctgattgccaggaagctaaaccaaagagccatatgtgaaatagagtgcatttgaagatatttagctctggcctctgaatttttaaacataatccctttagataaattatcgtcaattataaattcagggaagtatggaggtctctattttctagacttatcttggtacccagaaaattcatttttttttaattaaaaaaattattttctcccagctttattggagtgtaattgacaaaattatatatgtttaagatatatgatgtgatatcttgatatacatctacattgtgaggtgattatcatcatcaaactaattaacacatctgccacctcacatagttactattttttgtgtgtggagtagagggtactttagcaaatttcaagtatacattactactaattatagttaccatactgtacatttgatctccagaacttattcatcttgtaactgaaagtttgtattctttgaccaaatcccacctcccccacaagcccccgc

SEQ ID NO: 13441 - DNA, 1027 bp, Homo sapiens
aaatgtcacactgggtccgcacatcaactgctttctctctgccaccggctgaggcagccaccgctggtagcccgtaggattcctggcgtccaccttctaccctcctactcaaatctatcttcttatctggtctctgccatccttgttgcttcagtttcgtagctggtctgatcctcttggcctcgcctacttggattgtaacccatgtgtatagtctgttgggattttgacgggcatctcctaagtgtctcccccgagaatgtctcctctgctctctactttttgaaaggtaaatcagacaggaggggaaaggtactgtgttgacagaaatccccacaacagccctataccgtgggtattgagtcttcttttggacagttgatacaaaacagcatagagagaatgagtaacttctcaaggccatgggaccagtgaatgctttgctgtgctttgaggagcatgctgatgatgactgtgactttggtaactgtttctgtagctcagagcaggggcttaagaagacatgggtgtgcagagctcacctgcagcatgctgatgtcactggagggagagctgtgctaggtgggcagcagcaaccacggagggacctttctgaagagactcaccagtgacatagttggtttctgtccttctctttctttgttacaagaccccactatttagctactgatattgccatagggcagagagatttattcagctgcagctgcatccatggcatctgctgatccactcacagcctttgtttttcagagttaggaagtgccttccttactccaaaatgcaactttcttaccagtgtttctgcaccatcctgtggtttatatttctggctctgccattctttctctgtgtgacctctagatggatctatgtgattcacagaggactggctcattgtcaatgacatgacaagtgattgaaatgtatttgatagttagatgatagaaatttctttagcttttagggccaaagtacatctgtattagtccattttcatgctgct

SEQ ID NO: 13442 - DNA, 1033 bp, Homo sapiens
gtaacatactttattttaaattttgacttgaattgtacaagataggcctaccaagaaacaacccttttacaattttattcattttttggctagagaaaagcctaggaatgcctcttagctagtgtcatagtcaaaggatgtgcagattctggctcatatttttttttttatatagctttctagcaggccaaatgagaataagattaaaattaaacttcctcagagtagccaccagccttggtagccgacttctagactcttttcaggagcggaaaaatatttctgacactgaaaatgaattacatccatgtttcgagtctccaaatagaatgtcttcaagaactataggccatacttagttctaaacaaacacttaaaatgaacttcccttacgataaagtatcagaactgaaatttgcaaagatcattcagctgtgtgccccaatatttcaaaaatgtctggcatagttggaggtggaaccaaaaagtgggcttaaccattggaattctaatagtcaactctgcaatggctgcccatttcactcacagtaaaatctcataccctgcaatggctctcgaggcccacatgattcaactcccttattttttggaacttatctcttatcactctcccctactttcttgacttgatcatctttcctattttgacaggcctggcattctcctgccttaggactttgcactggcagttccctctgcctggaaggctcctctcttaggtattttacatggttaattcccttaagtcctctttgtgctccaatattgcactcttataaagcataccttggctatactatctaaagttgcaacttggccatctttcctcttctctccccagaccatggcatacctagtcctccttactctgctgtagtatttcattttggcacattttataactatattattttttcccatttgttatatctgttgcttttggatatcttcccccaaactacttgagggcaagaatttttgttttgctcgctaatgtatctcaggtacctag

SEQ ID NO: 13443 - DNA, 1036 bp, Homo sapiens
gtttatccgaaacacaatattagacagtgttaaatagtagcagtcctcttctttgatattatttacataacacactttgatatcctcaattaaaagggtacgaggtgaaagagaatttttgttttttgtttaccctcatttattttgggaatagttgttaatacttcagataacaaggcagatttttcccatgtataaatatcttcttggaaatatggaatattggggaaaattagcaggcacctttttttgggaagagaaatactgtttttaacattactgcttcactgagcccattaactgcatgagtttgtgcacactccaaagttatgtaacagataatttcggattttgaatttggcttgggatacagaactaccatagacttgtcaattgtaaataagttttgaatgcggatttgactagtaggagatacagagtgtagacatcaatatagtaatatagatggaaagatggattgtctatgtaattccttgatcttacaagggagagaattgagaaaatgagccattgagcaacttacagaagttgtgggttagcggtagcggggatcatattagaacaaggtgtctcaactcctacaccagtgctcttgccacctactatgctggattttgtggagaaggtctgaggtcatggagtgaatgctatacaagggtaccacagtgtaacagatggttggtgctccccagcttttttctggtttcctgtgagaaaaaaaatcttcgttattgttggcctctagactttctcaagctcattatctgttatgaacaaggagtcatgagaataggtggatgtaaaaatagtgggtctgatagtagtaaaagtagctgatacctttttgggagaatttctagtcaaaaaaataacatttggctatagcagtgtcagcaggaccttctacaggttgcccatgtggtgacccctgccacctgccccacctctcatgccacccacccatccaggcttttatttcctcaaatatttcaaccttagtccagcctagggggat

SEQ ID NO: 13444 - DNA, 1025 bp, Homo sapiens
tgaggttctggagaaattggaactcttgttccctgttggtgggaaggtaaaatgatacagctacaatggaaagcagtatagtgattcctaaaagatttagaaatagaattaccatagaatccaacagtctcacctctggattgcttcttttcaattctaaaaaaattgaaatcactatctccaaaagatatcggcactcccatattcattgcagtatttttcacagtagccaagagatggaaagaacctgaatgaccatccacagataaatagataaagaaaatgtggtatacacataccatgtatgtaattttaatttttcttatttacaaaaaaagaaagagttgaaattgactttaatatatttttaactcagtacatccaaaatattgccactttaacatgtgatcgatacaaacaaattgagatacttgatgttctgtttattttgcgctgtcttcaaaatccagtgtgaatttacacatgtagtacatctcaatttggactaaacacctttgaagtgctgcgagtcatgtatagctagtggcttccatattgggcaatgcaaatctatatggcaaatattagtgctaagattttattttcatttgctagttgtttcttgagcattctttgttttcttagcagaccttaagcttcttaagggcaggaatcatatttttaaactcctttgatactcttaaggtattcagagtaatgcccagcctagtaagatagcttgatacatcccatttgttgaattattttgactaatgaaactttttgttaaaccaccttgataatgctagtctgctgactagtcctttggaaactggattgctctttttggaacaacaaagttgtcagagttgtaaataattgacaaggctgctaatagctgctgtgtgtgtcattagacaatcatttaaattcgtgagcatcctgggggtgggactgaggtggcttttcagctgctttcagtcacaacagcttttattttaagtatgaacatctttacatgcaaa

SEQ ID NO: 13445 - DNA, 1049 bp, Homo sapiens
tggaaagcagtgtgtgtgtgtgtatgtgtgtgtctgtgtgtttgtgtgtccgtgtatgtgtgcatgggtgtccttgcacttgtgcacaggctggaggacccggggtgaaaactcaggtggtggcaaatcatgaaaggcctttcaagacatgataaggcacctaaaccttatcttaaagacattggaacctgtggaggattttatgcaagtactgacaggcacagacctagaaagctcccctgactgtcataggagatgactgtggtccaggtgagaacaagaggatgtggaagcacaaagtggctctgggaagagcaatgggataggtcaaaaatgctaggatacaagaatgacaggactttggggctgattggatgtaaaatctagacaaatccaaccccagtttgagttgactcagcagcaattcttcaatatttgaagagccgtggaaaacattttgtattttcttgtgattttctaattttactataaagatagcattttaacatgtgaaagccacaaccccaacctgtcatcttttaaatttttctttgattctgtctgcctcatgtctttatagacatttaacttcaatcattgagttttggatttttctatccattttaccttctcctttttctacctgttgttgtttaactggaaaacaaaataactattgattagcatctctgtcagagaaagagtagtcacagataaagaggagaggtgaaatttttgtttcttgtttatttgttcaaattatatttctattataaagtttaaactgttggctgcattaaaccatgatttgggtatgtagcaatatttttcataaaatattattttcttggtggtgccctcacttgagtgatgattatattgtttccttctgaattctgtagaaacacaaaatgagtcaataatcagagccttctatgtatcttcttttgttgctactgtcaaaaataatgaaagcatccaatacaacttctaaatgtgaatattcttcgatatccttgcttgaatcatttgatcactactttgcaagg

SEQ ID NO: 13446 - DNA, 1111 bp, Homo sapiens
cacttagaactgaatctttgttcctttaagctactgaggcttggagttgtttgttgctgatgcataacctctttagactgataactggagtcactgccagaactgaaggtgacattctctttctggattgcttttcattgagtgtgcaagtatcggttaggtttcaaataacagaaactcaactgaaattagttgaggcaaaaccaaaggaagttagcagcacctggagtctaacaaagagttaaaaagtaagacaatgagaaggcatggaaagagctgagcctcaggaacaatgattttgggaaccaaaccctgccaggcccttcctttctaccttctgactctatgtctttctgtgtggcttccctcccttccttccttcttccctccctccctccctccctcccttccttccttcctccctccctccctcccctcctcctcccccctcccttctccttctctctctctctttctctttctctcttttcttttctttatttgattctttctttctttcagacagggttttgctctgtcccccaggctgtagtgcagtggcatgatcatggctcgctgcaacctcaaactcccgctctttcttattaaggccaacttttttgcacagtggtataaaatatggccactagcagctcctgaattccaaagttctgactgtttccatcatcaaagaaggacagacttacacatgttctctgaatccagtttcagaactcccaggcagagatttctgttgggcataagcttggaaaaatgtcaaccttttaaccaaccagctgaggccaggaggttgagccctgtaggaccaaggcagtttccctaggagctgcattagactagggagaggatcaccttcaagaagaaggtgagtggggtgctaggaagacaagaaccataggtagttactccatgtgtgtctataatgtgtgcagacaccattaataaggtagttgggtggaacttttcttgagttattgctggaatttggaaacatgtataacattctttcctctatattttctttggtgatttcttttggataaaagtctcacatttggaaacagctagctggaaaatgatgagttgtggg

SEQ ID NO: 13447 - DNA, 1096 bp, Homo sapiens
acaaccagatctcctgacccactcaatagcaggcaaacagcaagggggaaattcatggctatgatccagtcgcctcccaccaggtccctcctccaacactggggattacaattaaatctgagctttgggcggtgatacagagccaaaccatatcagaagtcttactacagaggtaaatttaccagaacattttatcagtagaagagaatattctttctttcatgaaaaaaagtttagagaagatgaatatttattaatcatttatctggcttttaaaaatcaagtcactctatgggtttttcttttaatatcaagaatcaaaggtagactttatgtctttttatattaaaaatatatagcttaatatgttcataaaatatgtttgctctgttaggttgcaaattaaaaaattgataaaaatgtatagtttaatttactttgaaagatgtttaataatagtaacaacttaatgacctcaagagaaatatttttaagaatgttaattggacaacattttgcgtaacatcaaaaaataccagaagtaccattagaaggaagacattgaagtctagagttctggaagagagaggcatttgccttatctgggcaatgattctcgtctgtgattagctttctctttcaaatgaaacaatgtctgactgacagaggatgcctttaactattatgctgcacaagagatgtatgctgagttagtccctgtgcaaaccaagatgtatggtcatctctgtgaacaacccacattgcattggaaataattgtcaatatatattttgatatatttcttattcacaatgttaacttctaatcctcctcctatatacagttaaacaaaacaaaacataaaacatttcaccataatatttgccaatcttatataccttggtctgaaacactttggcaagaagagagaacaatgggaaaagaaagtttattgattatctcgcacttaaagccaaagtaataagatgaactaggaacattctttgaggcctatcagactgatccaaatgttcaggttgtaaaggggaatgtaggggtggcaaagtgcaatgggaagaaagctttgctctatcag

SEQ ID NO: 13448 - DNA, 1864 bp, Homo sapiens
ttggcatatttcctctatatttgtacaaaatatttacatagacttcaactgtggaaaaacaattttaaatattttctaagtgaatttgagatcaaatacacacttggcatagtttgcaaatatttattttcctcaaattttattctaatattgttataggttgtgtaccgggatcccatggtacttgcatctactcttagtgtttaccaccttctggtttttattatttgtttttctcacttagccatacatttttgaagaaggagggggtggcatttactttagcatctgcttggtttcatgctaagcatagcgcataggcatagagagtgttcaataggtactgtctaattgaatggtgataatcaacatcaatgatgataaaaatgacttggtttctgactgtgataaaaatttaaatgtaacattttaggaggatggtgctagcttatttatttgaaatatttaattgaattcctgtcccaagtagttagtttacttagtggaaaaattttcacatataacaaggctacttaaatcaagttctatagtctgctggggctccatagataggtttaacattaatgcaaactctgaaataatttgcaaaatgttgcttgcatgtgcatttttccagagagagagaatcaaagcttttaatagattctcaaagagctctgtgacttaaataagatttaatgactgagtagttgttttggcaaaaagtccagattttgtcagttgtcatatgttctctctattcttatcatttaaattaaactttgataaaaatgtaataagatcgtatgttcctattcaacactgtattcaatttttttaaaatttaaaaacacatcagtgtccttatttttaactataataggaaactttacatgagaagaatattgttagagaaaatcaatagctaatagtggggaaagaagctataaaacttaggtatagtggatatatagtttataattcaacacattttacataaatgaaatacatttataaatgcatagaataaagacaagaaagatgtccttgaattgtctacaatgattattcctaggtgagtcttacaagattttattttcttcttttggctattacaatctgtattttaaaatctactcttcaagaattttatatgtgtatagtgagtattgctcaaaaattttttcttagttctttgcatttttgtcatgctgattatttttcttcaagcatttaaatatcaacacatgcatatacatgttcacatatgcatacacagatatatgtatatagaatcaaacagagagcaatctgcttcaatgacattagaataacttaaacattattgaaatgaaatttatttatcattgtgttgtgggacttaatgcttccatggccaataaatctatcctttgcttaagagtcttgggtttgcagaaggtggaagggttgtctcagctttttggatacaggtagaaagtttgagagattctaaaaatgggctggaaaaaaaacaagttaaatctaacaaccagtactgaaaagaatgggagatgcccatattatccatacaattagaaaagacgaggaaggagatttgagatatgctctctctctttctatctctgtctccctccctccctgcctccctccctatctccctccctccctccttctctatgtccctccctccctccctgcctatctccctccctccctatctccttcccttcccactctgtggcacacgtaaaaacgtatgcgtgcatcacaacatactgcatccacgtactcctttattgtatgtggcatttttttgggttcttctctttttcagtgctacccttaatattcatttaactac

SEQ ID NO: 13449 - DNA, 1026 bp, Homo sapiens
ttttggaacattttcttcagccaaaaaagaaaccctgtgcctgttagcagttgctccccatttttctctaacatcccttagtccctggcaatcaccagtctactttctgtatctatggatttgcctattctggacattttctataaacagaatttgaaaaaagtggtcttctataaattgctttaacttatctttaacttatcacaatatttaacttatcacagtatttatcacaatgttttcaaggttcatccatgctctagcttataacggcacttcattttattgtggaataatattcctctctatggatagaccacattttgcttatccattcatcagctcatggacatttgggttgtttgaatgttttggctcttatgaataatgttgccataaacattcatgtatgagtctttgggcatattttttaaaatttctcttggatatataccttggaatcgaattattgggtcatagggtaactctatatttaactctttgaaagactgcaagacttttccccaaagtggctgcatcattttccattcccatcagcagtgtgtgagagttccaattgctccatgtcctaggcttttaattgaatttttgatgttgagccacactagaataaaagtctatacttagctgcaacattacaatgttaacactagaagcaatatttaacaagcttgttatgacttttgcaggtgcattttaggatttcgttttaaagcaggtgcatttcaggatttcgttttaaagcacttgagaacaatctttctatagctctttgctgggagtcagaaagttttccaatactagagctctctgaatactgggaaaacaagattgctgccccagaaattacttttctttgttctctgtggacatcagatatgagtctgtggtttgggcttctgattagtttgttcgtacgtgattcaatggtggtgagtttttcggtttactcctcaaatgacttttttttctttctgcatgctggtggaaaagggaagatgaaaa

SEQ ID NO: 13450 - DNA, 1674 bp, Homo sapiens
ggtcttgatctcctgacctcgtgatccgcctgtctcggcctcccaaagtcctgggattacaggcgtgagccaccgcgcccagccagtttggatttttttcttaaggaaatttcttctggatattgctgtcagctccatcttggagtgtcaccctgagaagggttcgtgggatgtgaaatgttctattcctacagttgttttcattgtttccagtttccagcattgctgttgagatacctgaggccactctcacttctgaccctttgttgtgacttcacctgcaccttctctacttggaacattgtagttctcagtgctctgatatttcactgtgatctacatcagggaaggtattttttcatctctatagctgagaatttggtgggctccctcatttaagaaattcatcttctagaatctgaaccattaaaagaaaatattttaattttataatttctctccctctattttctctgtttttttcttttgggggcaactgttatttggaagtaggaccacctagattgattcctgaattttcttataatttatcccctagagtctaactttttaacccagtttctagaagatttcctcctttatcttccagtcctttaagtcatttttccatttgtgtaatcatattttaatttttaaaaattctttttgttttggacatcagaacacaggtggcacttgtttcctgaataatttatagcctcctttttctatttttagatgtgatactttcttatctctctgaggatatttaaaatataatttaaaagattttttttttctctattgtctttgccatgtttaggttcttgtttcattttgactactttggtcctcagattttctagaggcttttctccaatgtttggtggcctctggctgcagttgctatgtaagggtgagtcacacaaaggctacttgaaactccacaaatggccggtgagccacgttgctaagatcaccaactttcagatgtggaggtgtttctcttgggtctcagtgcaccggggaaaggtgtacttggctgcagtattcggggagctactaagggaaggggaccctggggctcacacttctctctgcagattttcacttatccctggtgtactgtacatctctgagctcagaatccttctttctttctgtctccaaggtaatcttgccattctctgctggagcatgagaggggcagtcacctggccaagaagagttagagagagcatctggagacctcagtgcttctttcaacagacattaccaatatctgtcagttgttcgtatgctgccctacttccagagactcccggtgcctcgaattcctggggttttgggttacggaatctctagcttcaggacttcctcctgccagctttggtgtcagccctcccctcttgtgtcagttataccagtctctttgcttctgtctctctccttctctctctttatagttgtagggcttcacctttggtgcccctttctcgtcatttggtgggatacaggaggcagcggcagtacctacatcaattccatccatcagatttctggaggaactaacttacactgaaattctctttcaaaaaaacaagactctttgcttttgagatcttgaacagtcgagggtaggaagtggtgctttctttctgggttcaaaaattg

SEQ ID NO: 13451 - DNA, 1035 bp, Homo sapiens
gtgccaggtactatgagcgtgtctcacagttcatagatgctgccattttattggttaatccacattcttcaggggctgggttcattctctctgcttttgctgctaaattcacccattctgcagacagtgacactctttctacagcaactaaaaagactctcagttctctcagccaactttggaaaggttagcatcttacgttacttcaaaatttgttctggtaaggaacatctaccagtttttttagggattagctgtagggctgttgtataataccactctgtgttgtaagcacatctacctccctcaccctgacctggtcctatagttgggggcatatctttcaagtcccccttagtaatttgagtactttgccttgccaggcatcctatctctctctccttccttgcagaaatgtagccccagtgtctgcggatagacaatcagttccaaagtatcttcaccgtttctaagagggcaattttattttttgaagaatggcctgtactgagaccctaatacatatttgagggtatctatctgagtttgaactcctccaggacttttaaactcaaattaaaattgatttgagtcttcttatatattaacaggaagtactgtagcttccttttgggatctttcctctcttaaaatttccttgaaacctgagagcttgctcactccaaatgggggttgagaggtcttaatttctgttataagagaagagagactgaattctcatcagtttgctaatgctgttgcttgcttgctgctgccaagttgggtggctgttgacaaaatcatgctctctgctccgacagatgccgctaattcacatcttcacactggccaagggcactctgccaatgttgacttttgagcgaggacaactttaatttctcagaaccacgcttagaaaaagttgcccttcacttggcttcccaaggtcatgtttcttgctgtttagctcatttagtcctttttcagaaccagatccactgttccctgtctgttcctgaagacatacacctagag

SEQ ID NO: 13452 - DNA, 1736 bp, Homo sapiens
aagtgtgagttgctgtccttgggcaagttatgtagctgtgctgtgtcctgcgccctcacctgtaaatggagataatagtaacctacttcatagggcagttgtgaggatccatcagtaaaaaacatttagaacagagccgggcccttagcaactgctccaggaacaaatatttgaacaaagttctgccacagagcctgggttcctttcttctaccctgaatgctgccttttcccaaaatgagaccaatatgttgcatgtgagctattgatcttctaatttacctattacattctgatatgctaaaaattcctgatgaatgtaggaactggaagtcctataaaacatcaaatgaatccagttaaatttgttggttgtttagggctttagcaaacttgtaaacttgtcctttgacatatacataccacaaaacttttgttagctagcatacaattgtaatgctgaatgaagaaaatttcaaaaacaatgagtcttaattcatgttgctcctccactctgacttttattctatcagtttcttctctctttagacctatagccaaacatatgggccataaattgtatctttgttaaggccttgtatgacaggtagatctaactttccacctttaagaaaagatggcataataactaacaatgttctagtgacctgcaggtaccctaaccttactgtgtaggtggcactgttcagttgtcttactgttcctgaccagattggagatttatcttgggtgatatctgaaatgccagtttctgatatctggtagtttcatggtctggacacctagcaggcaatcagtaagtattaattgacggatttgatttctacagctttctggttagtaaagcaccagcatgttgctaccctgtgcctgtgtctataagtctcttcacgggctttttttttttttttcatctggcagttttgaacactttaaatgggaacagatcacaagttctgatatggagagggaaatgggtcaaagtactcctgtcatgttctcacaagtgagcttttctgctacagttatttaaagaatgtatttattatcaagcagggacaaagcagacacacaacctctgtgtaaatttgatgaagtcccagtctcttagatgctataatcatggcctttcaaggaagattcactggagtcagatatacaatatcccgaagtaagaattccgtacaagtttatgtaggtggctgtatgcaactggtggtcttctaatgcccatgtctgggacgggaacatgcaccatctctcatgtgcaggtaggttataggcatcagtagtttttatactttgtttattcaagggtgtgagtgtaacttacctatctaaaatattttagccaagccatatatcttgaataccaatgagaacccaattccaacatccttagtgtggaagaacaaaccatgatttgaccaagaaaaacctaatagaatcttctctatagggtggtcacactggtgtgcgcttccatctgtcaagtgggaattcctgatcaggtcaattaactacaactggagtgtaacttcaataaatcatacacagcagattcactgtctatgctcactaaaaagagtttttcttcttaaatgaaaatttagtgagcttcattttgtgcatatgtggtttttttttgtgtgttaagatctgaacccctcctgtattattgcttgttttctaagtgcataaactaaatgaaataga

SEQ ID NO: 13453 - DNA, 1033 bp, Homo sapiens
tttgtcttataaaattacttgacactattttttcccctttgtggtgaactgctataatctgtcttggaaagtacttttaaaataccaaagatgaagttctgtttccttcacagatcattgggtgctttgctttagcaccttgcataatgaatgtctcattggcacactgcttaagcatcatttaatcacaaaacctgaagaaattccctatttgactaggagtgactcttaaaaccatagcaatatatacatgaaaatataaataaaaaagaagcacaaggtcatgtaagaattaatgtgggatactttctccacgaaatgacctgggcaaatctaaacaaagagctccttaattaaattagcagaaatggcacatgatctcgctacactgattcttccctcatctctagttttaaacaagatattcctcatgaccctaaataaatacacaattgaccactggaatagtcctcaaatagaggaatactggaataaacagaaaacccaagtaatttaaaacactcgtagtaactaaatttcctactaaatccatgagagactatctattttccatatgcatttgcagaataaaagcattctctttcacctgtgtctttgatgagagaagaaattagaagtgctatggcaggtggaatgctagaggaacaagatcagagaccatggtgacattacagctgcagctacagtacataaacttgcatatgtgagagtgaggaagatctcaaacatggagagctcgggacttctgcttgacatagtgaattggccacacacatttatctctctccccttctaaaacccttctcaaaatgagagtaaaggaattaatggggcattaacccacaggaacctagataacaggagaggaggcaatagctgagaagacacttgaacaaactttggaagaaattgagtggagaagtggtagttaatttagcagagaagtgcatatttaaacttatataaagtaacagaaggggatactaatgaggagtgatccagtttgctccac

SEQ ID NO: 13454 - DNA, 1030 bp, Homo sapiens
gatgccacatcagggttggatgaggggattacaagttattcaagacttctggatggagacccccatcaagatcagaagccttttggatggagttgcagatctcattgcttggcaagccatggatattttcattttcatcccactcttagttgggttttctggcactcttcctgcaccgagcctcctgattactgaatagacatcagtggcatagcctgctgaagaatggaatgaagatacccatgggaaggtgtgatgtcaccactgcacacaggtgtgaaaggagaggcctcctccctaccacttgtctaccttgctcacctactggtagcagtgcctatagttggacctatgttctcagaaacatagatgggcaaataagcagttgagttaggctttaggaggacacatcataggagagtgagcatgcagggtctctgagctggttttcttttcaggcagacatcttgagggaccagtaagcaggggagtccttttttctagtttgcctgtagaagtaggaagactgttgatgtttcagtcctttcaggactttacaacatagctgtgtaatttcacaaggcagatctttagcttgcctaacaggtttggaatcttcaccccaccagggcaaatttccaaatagcttgttttaatctaggcaattccaactttcatgtgacgtatttcccctttttattgttgctgatttccatgtttctgtcagcaagttttcttctcgccttgcttgttcttcacttgtttggtggcaaagttcgtagaactagggaacttggaagatgctttgaaaacattgtcacaaaggcactgctaaatgatgcacagaagtggccagtgggaagaagtgatcccaaggacctgacactggttttcaacaacatctcagaaaactcgtcaagtggattgggtgccacgccagtgaacacaatgttttgatttaattatttttaaaagttgatgtggtgatggtgtggcttcccgaaatgggcagatattcaagtcagaagag

SEQ ID NO: 13455 - DNA, 1169 bp, Homo sapiens
ttatgtttaaacaatagcaagttgtatggacaatgtaacaatattaatttttctaagctatgaacacaggatatcgtttcatttgtttgtactatcttcaatttctttcatcaatgttttacagttttcagtatggagatattttacctgcttggttaaatttatttctaattgttttatgttttgatgctattttgaatgggattattttcttgatttcttttttagatagtttgctcttagtcaatagaaaatgtttatttttgtttgctgattttatatgctactaccttactgaatttgcttattatttctaacagtttttatgtgtattgtgtgtgtgtagagtctgcaaacagggacaatttaccttttttttttttccactttagacacctttttttttcttgcttaactactctagctagctagaatgtccaatactatgttgaatggagtgaagagagtgagcatccttgtcttgctctgaatctttgagtaaaagctttcaaagtgttcctattgagtataatgttagctttgggtttgtcatctatggcctatattgtgttgaggtacattttttccatacctaatctgttgagaatttgtgtcatgaaagcatattgaattttgtcaaatgctttttctgcatctgttgaaatgattatatggtttttgccctacattctgtcaatgtgatgtgccacatttgctgatttacataagttgaatcatccttgcatccctgggataaatttcatttgatcatggtgaatgatcttttgtaataatgctgttgaattcagttggctagtattttgttgataattcttgcatctatattcatcaagtgtattggtctgaatttttatttttgtagtatgtttgtgtttagtatcagggtgatgctagccttgtaatttttttttaaagtgtttcctctaggccaggcatggtggctcatgcctgtaattctggcactttgggaagccgaggcaagtggattgcttgatcccaggaattcgagaccagcctggccaacatagcaaaaccctgtctctactaaaagtacaaaaaattagccatgcatggtggcacatgcctgtattcccagctactccagaggctgaggcaggagaatcacttgaatctgggaggcggaggtt

SEQ ID NO: 13456 - DNA, 1047 bp, Homo sapiens
tcccctgtgtttaggctctcctttcttgtttctttgcatgttttgtaatttggggttgaaaaccacacattttagctaatataatgtggcaacactggaaatcagattctactcactccccaagatttgttgctatttattatttgtttgcttagtgacttttctgagtaaattctataaagtctgtgttctttttgtgtgtggctactaaagttcctgctaggtgaccttagtggtcagctaatgattggaaagagacttttttatatgcctgaaactgatgaatcttccaatttttgctgagcttggtgtgtgtacaggggaacacttttaatactcagctaggctgctcattcttagtcttcatttttttactcatacagaaccccaagtccagccagaggttagactttgttagatattccttagcatacacacagccttagctatatgcacacccctacacatgcacaagggcttccagattctcaggaatttgttgggtttctcaaagactcctgtggacatctcattacctatgttttccttttaagctttttgtttagtgttttgtgtcaactgttatccactgcttcaggtagtagttaaaatttaaacaattgcctctgatttgtgtgtgtgtgtgcacaaaaaggctttttaaagcctttttgtgaaagctcattgggtgagctttttgtaaagttgactgggtgagcttcatgtcacttcaagtaccaacagccctgtgagtggagtcttccagggaaacattagacagaccaaataatgaataattatatggaaatagagctttgaaggggttcttaccctattttaccccctccaaatggcttcccaggctgctggtgttaattatgattgtggcctgttggtttttaaggttacctcagaaatgagggaggaggtggatgggcatagggcaagttaaaataacatacaatgtgcttttcttaataaaatttagcttctttttaggaaaaatgaatgttctctgaattgctgcaagcctttgggttaatggct

SEQ ID NO: 13457 - DNA, 1050 bp, Homo sapiens
catgcattgaaatctccataagtgtgtttgaccttattataagcactttggctagaggattcatactgtctgaaaaaaatcaaacatatttaatagagagcagcacacagtatgagcactgtcttaagatatagcttgtattgaactataccattttattctataaataaacttaggaatgatggctcatcttaaatggttgttttgagggtagctctaattcaggcaagagaatttgaactctgtttatcagcttaaaggggaggaaatgccatggaaattgctaagggaagttctgggtttgttgtactgaaaatagtttataaacaatttggtagcatattttccctctagttctgtttacccagtggtctacttgggactaggagatctttcagatttctgaatctgtaattttcaattggatgctattacaaaaaaaaaaagttgctactaatagccaagatgaaattcaatagacttagaaagacaatttcctaacagataaaacttagaattttcaagtgtacaaaggaagaaacagacggaccagtaataaaagcctccatttagagggctaaaaaataaataatgtcgccatgttatgcattgtgattatgaactgctgaattggcgtttgcggtgacaagagtctccaatttattggatgcatgtcattggaatttgccctttctttttatgtgtctttccatgatgaatgccagtgctgggaaatgaagagctcttacccttttcatactttgctggatgctggtgaacttgccaattgatgcttctataatttttgcttcaaggtcacctgagtgaacagagtcatccaaacaaggtcactgaatacattgaatgtgaatcattctttcttgaaaagaaaagtcacagaaaaattaggacaccaggatataattactataagatggcaaatggattaagagaatattttgttataaaatataattcatttaaaataaaaagtgataaatagtgcttggacaactaaggtcatttggtgtgctctcagtaattcaatta

SEQ ID NO: 13458 - DNA, 1060 bp, Homo sapiens
cagtgtggcatgctgttcccacttctctcaatgctgatcccccataccctgctctactttttccatagcattttacatcttcaaacatattatataatttatacaaatatatgtcatacctattgtttaccatgtatatccccaactagctgttaagctgcagaagaacaggaatgccaatcgttttgttctttggtttatatcaagaatgaagagctgtgactggcactagcagacactataaatatctaagaatgaatgatttcctttgaaaggcaattcatccttgactttcatttctgtcttatatctatatcgaagtcattcctcttctacattctttcttggtgggtcacttctgagggactcaaggaataaggtacattctgaacgaatgagtcacttttggggtttttctctagaagctgaggctgggatgagggatttgtttatctgaaacaaccaagaacagaaagagtacaagaatgagtactgaatgtcaaattgaggaagtagaacttgatttaagtccaagaggtgtatggaaacttaaaacaggcagcagggtggaagactgaaatataagaatgatgtgggtgaatgcatggggaaccgagtgagtgtgaagttcacacaatggccacaggtaggcctgaaagtcttgtggtctatatgtattgtcctgcaaagttcttctatgtgtgggtggataagtctagtaaaactatataatacaagtagatagttcatactgccttccattcattctgtccattaaatttctactcctgtctaagtcccttttaactttagtctgtgatactacatcacagaaatagcctgttctttctgacatgccctctctaatccattctttttctcaacaccaggttcatcttccagatcatagtgttgacttgtcattattttctttccaaatcctttaatacctccctattggctactggaaaaagtcctgacttcttagtctagaattcaaggtttacttctaacctatattttgaaaattctttccttctaatttttctatcatcaatta

SEQ ID NO: 13459 - DNA, 1048 bp, Homo sapiens
ttaagggaagcctcattttatttctgtcacaaatcaaaagttcagatctagaagttattagatagtaaactcatgttccaagagatatgacagaaatccattgttggaactaattctgaccacatttcaaacttctgctcactctgaaagtagaataaaggccaggaaacaaaagagatgatgaaaacaaaatatgttgatgtggaagaaatgtgtttagggccaaggctttgggctcaaggtcagggtcactgtgaacttttctgcctctggacaatgtgcggctctgagctcttctgtagtagaatggaggaaggagtcgcaaaaacgatggcataggaatcctggtggaatccttcaatgaattggctattctgagaaaccaaggctgatgctcttgagctccaagctttaggcaagttctaaaccttacatttcatagcaaactgactggattgacggaattatatacaaaataatcttatgcttgctctaaagccatgtttggaatgtgtcacggccagatgcagtttgtcaaaacctgaatgtgttatggccagatggattactctggcttttcttttgtgtgtgtgtgtgtgtgtgtgtgtgtgtgtgtgtgtgtgtgtgagagagagagagagagagagagagaaagaatgagaatttacatgtgcacatgtgtcttaccctgccacacctgggatgtgcctcaaatggcaaagcaggaaataatcaaaggtagaacccaaccatccctaatatttattcagcaccaacagagatgtattctttcctaatttttgtttattgcaaagcaaaattatcaaaataatgaggagaaattttaaaaagaaaaaagatattgtcttaccaacctagaactcattcacttttacgatgctttaaggccaggcacagtggctcacacctataatctcagcactttaggagactgcagtgggaagatcacttgagcccaagagtttgagaccagcctgggcaatatagggaggtggcacatacctatggtcctagctacttgggaggc

SEQ ID NO: 13460 - DNA, 1046 bp, Homo sapiens
ttctgttgaggggaaacaattaaccatgtagacattcaagaaagactggaaactttgtccaataggtaggagacgagccatgatgtatcaaactgaaatatcattagcttcccttgaaaattctgttgacctaagttaaaatgtaagtgaagatttcaaaacataaaaaagaaacatgtcaatagcattttagtttcaacatgaaaagagcttaattttttgcttataaaaattacagtctcattgaaacattttcatacactatagagaatatagaattaaaattgcttattttcttccatacacagagaatcaatatctggctaatactcttttcaggcatctatctatgtttattttatctacatatttgcattaagagaatcacacttttttttaccctcatcatatgttttgaatatttattgaaacagtatttaaaataaaacatatagagatatgcttactgatgtggcttgaagggtgctcctcctcccagaatatgtccacttggaacttgtaactatgaccttatttggaaatagggtcatttcagaggtaattaagttaaagacattgaaatgagatcattccagactatctggatgagccctgtaaatccaattttgtcattataggataaaggcagaaagaaactagagagacccagagaagagggtggggtgaagatggaggcagagattggagtgatgcagccataagcccaggaatcctgagagccaccagaaactggaaagggagggacagaatctcacttagagcctttggagggagcgcaaactcaataccatctttacttcagacttctggccttcagaactgggagggaataaatttctgttgttttaagccaccaagtttgcagtaatttgttatggcagtcctagaaaaccaatatagacagacaggaatttatataaatgaatacatttttaaataaagcctggactcctaatgtgttccaagaaggcaggcatgtaactaattatagttaatgcaatgtttctcttcgatattctgtttaa

SEQ ID NO: 13461 - DNA, 1016 bp, Homo sapiens
ttcagtatttctgttagttgctttgtaaagtgaagccttagttaactgaaagggttgacgcacatctagagcaaattaactatgaatcagtttaatgttgactattcaattgcaggtgagattcatatattctcagattttgacagattctggaatgtccaagctttttataagctgatatatgccaagtctgtatcttcacctgggacaactgcctgttagatctcctcttttatggccttccccccgggaagacacgtcatagaagataagagcaaggcttctggatcagaaatattctgggttcaaagttttcctctgctcctaattagctgtgagaccttggccaagtgacttaaattctctgtggcttatttctaagcctctggaaagtggaaatgacaattttaatcacctggtgagaatcacttctgaagaatacgggagctgaagccctgaagcaatgaacaccatgcctgtgcaaatgcccagaaagatgctggttgctgttgtgacaattacatcacaaaccaaactctgtcttcccccatctttcctcctgaatgcctaattgagtcactgtcctcctgttacgggttaaatgctgtcccctaaaaattcatatcttgaatttctaacctccagtacctcaaaatgtggtcttatttggaaatacaattgttgtaggtaattagataaattaaggttataccagagtagggtgtgccccctactccagtataactggtgcctttatgaaagggggaaatgtggacacagacaagcacacagggagaatgccatatgaaacgaaggcagagattgggaagatgcaactacaagccaagaaacaccaacgattgccagcaaaatgccagaagttaggagggaggcctttatgaaacaaacaactaaggaaagagtatttgagatgattgtcataagaatttaactgaataaacaaggagatcaaagctgtagtgtgaagtgagcatctgtatcagtggcacagaaat

SEQ ID NO: 13462 - DNA, 1077 bp, Homo sapiens
ccaaaactcagaggaggcattcaaacacttctagcaggttgtctactccatccaactcaaaacctattcaatatgaaggccgagggaatgtgctcacaactccctattaagggaaatcaatataaacccgcccccaccaaccaaaaaaaaaaaaagaaagaaaactctccctttttaatgtcttcttccccaggctcctggtactttgtcagcaacatactgctttcattcttaaaggtttcattggctgttaaatgagtccctttgcatactcactggagagaggaaatgctttaagttgtcctaagataacatctgcacacagagagtttatctgattccttatcaaccatgatctctatctgaggtcctgtatagtgggatcatttagagatgggggttagggagagtaggagtaactctagagaaaattgtggctcctaaaggaggcagatctttccaaggtggaaaggtaatgaattaaatatatgacatgtaatactgaaaaaatagaaaaatgactaagatacagtctctgtcctctagaactagggcagcctggaaacatatggactataattattttagctatttaaaagaaatgaatgaagaggatcttgagacaggaccagagcattggaatggttgtagggactgaaagctgagttggaaggatcagatcaaagagaaagctgggttggacttacacaagaataccctgatctgatcgcagctgtgactccaaggttttcctttcccatagttgctgtgaccccattggtcaccagagcaactgcatgtcttcaggctgggtattagggctggctgggtctgatgattctacccattttgtgccatctgaggagcatgcgagggttctttctccaaggcactttcggccttccttcttctccccttccgccatctccactggacataagccaatgcctgctctcttctcaccacattcacctggacaaatctgaactaattccttgagacttcaaattagcccttctgagcaagtgggcaggttctgaaacctgtgtgttttgtagcctaatgaattgatggaat

SEQ ID NO: 13463 - DNA, 1665 bp, Homo sapiens
tggagcccagaagtctgatgtgcctacttgcatcctcacatccttggtgaattaggtccaggagctctgacacattcattccctaagatgtagatagcgccattctctcctcctcatctccaaagaatgtgaaggatagagaggaagggttatatgccattaacatcgcatttatttaaaaaatgctagttttaaagtcttgtaatagaaacgaagacattatgagaagagacagctgtctaacgaagtagcttaagtgaaatgcccaggcctgattgttgagtctcataccttgttataggtcatccatctcgtgcccctgtctgtcctccctcctttcagatgccttgttttcctgtgtgtcccacatgtggccccctctttcctagaaccaggagtcaagctaaactgatttagaggaagtgttccctacccagatgctcatttagtccacacacagatggccggtatttttatgcatttttaatttaccaataaccttttaggaatgaaacagaactaacatttattgaatttattgagcacttactatatggaaagtcctcctctgctgatagcttcctgtatatcaactcagttaaaccttttcatgaagaaaatgaagcttagagagaccaagttacttgccaaggttacagaataaggggtaaaactcaagatggtaggatggaaacatgcaacccttgtccaccagttcttacttggggattgcagcaaaaagggtttgctttagaaaaacttccccgacagttgtaagtactgttagtggagctcactaaatagttaaatagacataagcaattactggcatactgtgcaggcatgagttcagttttagccagaagtccctcctcacaaagggacttggtatattgccaaggatagctagggcatcatctccactatttgctgtgattatttgtcggcctttttcttactcttgacgctatgtgtgtgtgtgtgtgtgtgtgtgtgtgtgtgtgtgtgtgcgcacgtacactgaatgaacttaaacaacttgatggatctcaacatttagacaccttaaatagataccataggtaaaagctcgttatcaactgtaagacctattccaaagtgaaatgtttgtgctgttgtgattttgttgctctctatgagaattcttagagatcccttttttctttgacttcccttcctgtgcagtgccgttttctttgatgctctcgcttcaggctctttttcatatatatatatatatatatatatatatatatatatatatatatatatatctttttattatactttaagttctagggtacatgtgcacaacatgcaggtttgttacatatgtatacatgcgccatgttggtgtgctgcacctattaactcgtcatttacattaggtatatctcctaatgctatccctcccccctccccccaccccacaacaggccccgctgtgtgatgttccccttcctgtgtccaagtgttgagcaggctctctttttctagtgctctgcctgctcctgcgctagcccatggtctcttttctaatgtcctgttctctcttcgaagtctgtacctggcacccctactaaatggcacacacagacacctcatatttctggggttctagtcacacctgagtcttagctggtg

SEQ ID NO: 13464 - DNA, 1032 bp, Homo sapiens
aatgtcagcttgtgaatgaaccctttctgccaacttatttcaaatagtaatgctgccattgctgggatcccatttccttctcacctggctttactgctccccctaacacgagcatttgatatgagagatgcttacttgtttattggttgattatctgtctccctcctccactctgctagaacataagctctatgtggatagggactatgtctgttgtgatcactcttgtattcctagaacctagaacagtgtctcatacataacagatgctcaataaatatttgttgaattgcatgttctccatgttcatcaggaaagttttcaagcctctcagatagggctgctggatttgattgtacaggggtgcactgcactctaggggtgcctttctcatcacagtccatgtgattgacaccccctggagttgtgcagtggacaacctgtacagacatgtgctattgccctggtgtcagtatctcagtagatttcaaaatcagggagttctgtgtaggaatttcaagactctggaagtataatacaacattgacaaattttcaagtaaataatttgatttcctcttcagggtaattcaagcagcatatgatgcagaaactactttttttctaccctccttgtctgtctaaatttcaaagatgtcaagtgtaagttgctcatttacctatgggatgctgtctgtaatgtagctgatggcagtatgtaatttgccaagaccttaagttcatgttcttaaattgctgctgggctccttaatagcagtgaattctttgcagaaattgtttgagtattttctaagttattaattttggcctgatttgcaaatataatctcagacaaattgtttattatcaatagtaatcattgtagtaacatagagcctactatatgccaggtacttttcgtgcattatctattccaataactctgtcaggtaaacatgattaagtcacccttatagatgtggatacaggttcaaaaatttaagtaactcacttgtgactaccaaactcatga

SEQ ID NO: 13465 - DNA, 1013 bp, Homo sapiens
acctcttacattatattgcaatgatttgtagacatgatggagaggctgggactggaccaccagtgtgactgcctgggacataaatgggaaacttaccccttggtggtcctcatttcactttctccatctaagcaaggaacaaagaagcaaatacttccagaaaaacttgaagggcttcccagcaccagaaagagatgaggagaataggtgtcctacttatgagctcatttttcatgtggaggaaacctgcatgggaagtagacagcctttggacattggtctcctggggctcagtagagtctggtgttgttgccaggcaacaagaacaaggctcaaggactataagttcttgtctagttgggaagaaaatttggatggattctcaaaaggatttcaggaatgtgtggaggctctgccttggttggatcactcagtgttcatgaagtctcctgcatgcccagccctgtagacttttgatttttatcaatatagcatcttattccttattgttcaaggcatgttcctgttatctccctggttaaattgaaaacttttctgaaggagagaaagaaagtctaaatctcgtgggttccatctcccagcatccaacataaataaaaacgtcttcaataaaaccatgttgattgattggttgatgattgattatttgacctgccatcctagttggttgtcagaaatcctctccttatttttcttggtggacacaagtttagtgatacttgtagaggccaactttgcctttcaactttgaacttccattgatttttccactgtgtgtgccaaagccttaaattggttccagttgcttaaaagagatgtatatttttcttctacacattttatggaaaaaaaaaaacctggagcgtattttccctagactccaccaaaaccagatagtttttccagaaatgtatgaatgaacaacaaagtggttactttggaagccgacataccgttatattggatttcagaaaagtcaagtaatcccatat

SEQ ID NO: 13466 - DNA, 1031 bp, Homo sapiens
tggaggtacttcaattctacttgtgttttgacatgcatttgtggtagaaatatacttctgtgtaagtgattgcttgtaagatattaattcagtcttgcaaaacagccatgtaaacacacacacacaaactcacctaaaacccatgtattcataactctgtggtttgaagttaaggccaagtataaaggaaattagtctatggaaaagactagttttaacacaaaaatcagctgcatggaatatgcgtttaagggaaaaatattaaacaatcaatggaacagtgactcaatcatgatgcagcccatagagatggctccaggtcctgaaggcctcctcatgtcaaggtgtaatccttgcaagaccctggaaagttctggaaactggtggatcaggagcccagcaaccagggcagccgaggacactcagggacactggtgggagtaagtgggactacaactatttaccaattggtatgatcatatttcaatgtctcaagaacaagcatggctgctctagtgtgttctggcatattagttctgattgtgttgttgctaaacaggggaaattggaggatgagtaaatttagttttttgttttgtttggtttggttttgagacgtagtttcgctcttgttgcccaggctggagtgcaatggtgcaatcttggctcaccacaacctcctctgcccgggttcaagtgattctcctgcctcagcctcccaagtagctgggattataggcatgcgccaccacgcctggccaattttgtatttttagtagagacagggtttctccatgttggtcaggctggtctcgaactcccaacctcaggtgatccgccagcctcggcctcccaaagtgctgggattacaggcgtgagccaccgcgcccagcccgtaaatttagttattaattgagatattttctttaacttcaattgttctataacattcaagaaaacaagttcctatatataaaaaacatcgttcttaagttatgaatcaaaccaaacctcctgtactttgttgggta

SEQ ID NO: 13467 - DNA, 1054 bp, Homo sapiens
ccaaaaactgagcatctgtatatgaaaatgctacattataacatgattattcatccacatggatttttaaaatacattctacacatacctgcttcacaatgcgagatgaacaacatgttaatatgcacaccccgccctccaagacctcagtgtttactttaaaaggagagatctgcctctaataaagaaaactcccaccacagagtggtagaaagagatacacgtcactgtcctgctcactctagagatctcagtttttttacattcctagattattctaaattctatggaaattaagtttcatcacactaagacaggaagaagaagaatattaaccttccaggtgacaatcctaaagggaaatatttattatttttcattgtacttggagatttcattaaatgattctttgttaagtcaaaattttgttcatgaatatcagcctttagagacataatcgctcatctagttaacatgtcagaaaagatcaacccattagtggattcattctgtaaatacttaggactgcaaatgggaaggggaaaaattgagtccagaaagttaaggccaaaatgattttgagtttaacgatccagttcatgttctcaatgtgctctatgagaataggctttgtaaccttctttagctgatgcagattaattgaagctcaaaaaacaaaacaaaagaaaaccctgcactacttaacaatgcaaagctgtgcaaggatggaagattcgaaacaaaaatggcattatggaagttacatgatgtcaaagttacatgcaaggaaagaatatccagtacacagatgttttgtcagctcattgtttttaacgttcacaattgtactttcacaacattgatttcatgttattcgatgactccgatcaaaactaccttcccaaacattttcttctccattggccgttctaaatctcttctctgcctgtagtcctttctacttgatttctagtctcttcccctccatagctctccccttatcccctattatctccatactttttatcctgaattataaaacaataataaacat

SEQ ID NO: 13468 - DNA, 1049 bp, Homo sapiens
tagacatatcttatcgaattcttcatttctaggcctttccccctggtgctcttcatcctttaccaaagagacaagcacttgaaaaaagcaatggtaccagcgcggtctttaaccccagcgtcttgcactaccagcaggctctcaccagcgcacagttgcagcaacacgccgcgttcattccaacaggtatgtgcccttactgccctacgtcctgtgcccttctggtcatgtgctttcttctcatttctctaagctgtttggtggcatctagtttgcttttgaaggtataatacagtttgaaattcatcgttgtcctagctatctaaatgtatttaccttactttgaatgatagctaaagactgttaggattctaaagccaaatatttgatagattgaagagacagatttaacccatgagaaacagcagttagggcttttggtttcttgtatttgcacaagccctgtaaaattgtttatgtaaataagaccttttatgtgtgacaattgaaatttgtccttaactctgaatgacctaaaaatagcaattccagtaaatactaaccatttttttctatttctattcagagcactaaaacaatgaggctattcaaattaaagcaattctctactcatatttttatattcattctatctctttctccatccttctcaactttcaccaagttcacaagtatatagagctcttatcctcagtgtctaagccaatgcctgatactattacgtacgatgtgcattaactatgattccactaaaagatccattgtaatagtcatagaatcttagagtttaaaggactcttagtgatctcctcatccagctgattgttttacagatgagaaaactgaggccccctaaatgagaagtgactttccaaggtgccacaactaatgagaaaaagaactgagtttccctgtgaccaaacccatttacatcacattctaccacctgggcccgcctatatatacacattccacagagttctcctgaaaaaagaaaaaagcagataaaagtgaatttttaaataact

SEQ ID NO: 13469 - DNA, 1056 bp, Homo sapiens
ttaaatgaacagattttgatttttctataaatgttttacgtaaacataaatatgaaacaaaaatagcatttttgttttaaccattcatagttaaagcttttgatatgatactaaaattctcccattgacacaatgtgaatttggattttaggaattctgcctccaggttgcaaagatattaatataaaattttatgcaaaatatgagagtcttctcccaaactatgctaagataattattgccctgcttgatggcctagcacatttgccatgggtgggagttttctttttttttcttttttcattgggattattttaaccaagtagttagactttttcttttctatgttaggaaagtggcaaaaccacacacacttacaaaaatagcagcataataattcttggcatttctctgacaggtttattctaagttactgtaagtgttcttatagacattatctcattattcttcaagatgttgcagttctgttagtggcaggcacggttatttgcattttgcagatggaaaaactgaggctgtgtctacaccgcaaagtggaactacccagataattctggctcacagatacgacagctgaaatatttgtgcaactgaagcagaaaacatttgagaagtctttgttcatagaattggtgcctagtgaagtgcttcagctgatcagaacaaaggcaacccacagaagccttccttgatttatttcattatactggaagtacagaataagtagaacaggggacagtgcccagatacagcctaattatgagaaacgtgtaaatgttacatcagattatcacatgacttggtgaaagattgatcagtgtttagtggcatctgtatctgcataagcacaacaaaatttattccattcaattcattaaaacataccttgaacccgtggtatgttctgggttccagagccagtaatgagaatacaaaagagttcataaagaggtgaaaaccaaatattatacagaggatgaaggagtacctgagggtctgggcaaagctattcgagagtgaaggagaggagacaat

SEQ ID NO: 13470 - DNA, 1051 bp, Homo sapiens
gtgttgttgcatggaccagtagttaattctttttaatggaggtgcaggatgccccttgcatgaatataccaggatttcattaattgttctgtcgatggggcatctggatagtttctaggtaggggttatgaatgatgctactaagaacattctagtacatatcttttggtgaatgaatatgtgtatactttcttttggtgtagcattattggatcataagtacatgtgttcagtactaatgtatactgccaagtgatttttcaaagtagttgtaaacagcaagagtaacaattattccacatcctaaccaacatttgatcaagtcagtctttttaattttaatcaatccgataggattctaggaacctcagtgtgatttttatctttgttttcttggtgtataatgatgtggagtaccttttcatatgctttatgaccatttgggtattttctttggagaaatacccattcaggtcttttgtccattttaaaaattggattatctttttttataatttgtagaaattctttatacattctggacacaagttctttattagatgtatgtattgcacatacctttccccaatctttggcttaccttttcactcacttaatagtttccttgagtgagcataaattcttaattttattgaagtcaaattttaaattctttttatggttagttcctttttgtgtcctgtttaatatatctttttctacctcaaggttctgaggatccattctgcatatttacttctagaagtattataacctaactttagtttctatgatccatctctaatttgtacgggtggtgtgagatagggggtcaggggatttgtttgttttgttttgcatatggctattcagttgacccaacatcatttatataaaggaccatctccccagtaaattgtagccgtacctttgtcataaatcaggcaaatctatctgtgtgagtctgtttctaggctattttctcttttgcatttctcccttcttatgcctaaaccacaatcttaatttttgtaactttatagtaagtatt

SEQ ID NO: 13471 - DNA, 1028 bp, Homo sapiens
gttgatgtctgcgccctctgctaattacagagctttatttgctttgtccattgatgtaagtgtctagaatagtggctagcacttagtatataaatatgtgttgagtggatggataagtacatgatgtattgattgttcgattgttcattactagctatttatgccacatcaggcagttttcagtatagccttcagtattcacgtagttaaaaccatcccaaatatttgtgtttgaacaacgttgtctgtgaaatggaactgcctaggtcatgagtgcattttggagttctgctgttgagtcagagcatgctggcagtagtggctccgcttgtagaagtgaaacctcctgcttatgttttggccccatgagatctcataagatttcccccaacatttttggctttactcctgatgcacactttcatatctcttaaagatcagcctgttggacgttattcttagaacagtgctaagcactcagcaattaacctagtcaatgatatgtgttgactgtgggtgtgacccaccatgtctgttgtgatttttaacttcagagtatcttaggaattatccagtccagctcattttatacttcaagaaactcaggaaaccaagattaggttaatcttctaaattcacagtactagctagaggcagccccttctgggacaggagtcctagtctgtttggtttcttttttttttaaacccaccatattgctaaaacagatagcaacaccagcttcctcatgcagtgcagtcatctactgtcaacacaggtcttggcttctttcccttcagcgtctcacccatctttcttaaggaggatccagatttctccaaatgttaccttcatatgggaccctattctgtcaccccaatccagagccttcttagaatgcctttcccacaggggccagtatattctctcgagtgcccgctgtttgggaatgcttgcttttctgctttcctaggcccccatcaccatggatgttcagcacagggactctggagaagcacctggttagt

SEQ ID NO: 13472 - DNA, 1057 bp, Homo sapiens
taatttgggcttaaaagtgaacataaattatagagtggaaggtaagggacaaaagccttttacctttaattttcctggagaattatataaaggttttcttagaacaattttgccctgattactgaagcgtcaaataaagctggagtgaaaattttgttttgaaaaggtgctcaagctctgacatttttggttttcatagtcgtgaagtatttatcatttgcatgactaatggcacaggaaaaacctattcataagttttacaatcaagtatagaggggtcttcagctaacttagttatacataaatgctgaaaagattatcttgagctgggccttgggagaagaatttggccttcagaactgcaatatcactgagcctgcgatctatacaccaccccacattttgttggtttcacagtcttgtgcaagtaacctctggtcttacgtgtgtaactgagagaagagtgtgtgtttgtgtgtgcatgtgtgtttattgttcctaagaatttggcacaagtcagagataattgcctatactaagaatctatactgcagaatatagtgtatcaaaaacttttttcttttaaattattaaagtgtcttttatacttttatgaaatcattggtagccccccaagtgtttaataactggcattaagcttagagggtgaaaaaaaaaaaaaagattgatagtatttttcataatgaaaaaactgaagagatacgtgaatgaaaccaggccatagctgtcataaatctttgacttttgaatatttacattcttcagtataattttttataatcctcaattatgaaccaccttgtttataggacaaaaaaatttaaccaattttattgaaacgaatttcactgtgtaaaagttggtttgattcaaacatgtagagaagttgtagattcaagatatatgatttctctatggaaataaaaatatttgttagtgaattggttgagttttgattcctctaacttctcagaatgattctttagaattctataattcatagcaatttttgacaagtaagattgcaaaatagaaa

SEQ ID NO: 13473 - DNA, 1093 bp, Homo sapiens
tgaaggttgccgccaggctgtagggcctgcttgttctatatggggccctatgaaagttgacagatgctgttaattgtatacagccttcagctgctctgataaggagcccattcatttcctaagccaatttaaactatgccttttggttatgttgccttcaaactctgttgaaatcctctggcagcattccaccagttgagaagcttcattgttttagattataagaataatttgaatgaatataacagaggcactgtagatagaatcccagatatttaaaggaaaacatgcctatattttaggaatatcttctgaagaacttcataattttatttgaagtgtttgtaaattttttaataaattatttaaatgtatcaatagtggatagttggaagaacgtctttgaggctaaaaagtagtactctgaaattctctcaagttatattatttgtctgttagaggtccacgaatgaaaatatatgtagctaaaggagtaaggtgctgcccaatttggaacccaactgacctctaggatctatgaagcagagaatattaccacaaacttctgaaagaagctgttgacctcgtttcttaatttaaaatatgttgccacataaatactaataaaacatagttgctcttcatctcttaaatggatcattccaactggttttacatcgttgaatattatctagtatttttaataaatattttcataaatagtttttgtggtttttttgtttgtttttgagacagtctcgctctgtcacccaggctggagtgcagtggtgtgatctttgctcactgcaagctccctcccgggttcacaccactctcctgcctcagcctcccaagtagctgggaccacaggtgcccatcaccatgcctggctaattttttgtattttttagtagagacggggtttcaccatgttagccaggatggtctcgatctcctgaccttgtgatcctcccaccttggcctcccaaagtgctgggatcacaggcgtgagccaccatgcctggcctataaatagtttttagataatattcaacatccccaacatcgaggtattgagttttaaaagatttgc

SEQ ID NO: 13474 - DNA, 1028 bp, Homo sapiens
caatcatttatgcaataaattcatattgcctattatgttctggcgctaggcatacagcagtgaacaaaacatgcaaatctcagtctccattaagcttatgtttactgcctttgaaagacatttttagtctcttacaatatttatagttataaaatttttctgtaatgtaaatgttgtaagcaattatatgcttattgttgaatttatggtcatgtagattatttccattaaatcaaccaaataacctgtgagatttaatgcccattttacataaggagaaactactcttaattacagggtgtgtaatagtttgtattataatgtaagtttatggttaattcacattatcgttaaggatgttaatttttaagaatactttctgctttaatcagaaagcaaaataagatgagacaagatagagcatatattcagggcaacttgaatctatgctcctggggaaaaaaattttatattaattaaaatttaaaagattggacaagttagtggttcccaaccttgtcagactccaaactccttttttatggcaatcttttagtaatttttcatgtactcttctaaaaatgaaatgcataagtaatgtaatatatatgcataattttttagaatattaatatatggccttaatacaaaaaagaaatgcaaagaaacgtataataaaatggcttgcttctccttatgtaaatggtcagacaagactacactggaagacataatagactaggtggcttccaagtgatctgtacaaatgcaatagctaaaactggactaatagcaaagatattggcaagtcaaacaccacagttcccattagaattggtgataagatttcctaaaatagtaaggttctgaacaaagcaaagtagaggttgagtgtctcttattcagaatgcttgggagtagaagtgtttcggatctcaaaatcttttcaaattttgaaacactgtatttgtgttatacttaccagttgagcatctcaagtcagaaatccgaaatactcaaatgcgcat

SEQ ID NO: 13475 - DNA, 1050 bp, Homo sapiens
agacagtgggtagtatgtttatataatggaatgctattaaataaactgaaatccttatgtgttgagaaaaaagcaaattgccgaggtacatatattatgaaaccatttattatataaaaaatcaaatcttgaaatagtactataattttgtatagagatatggaaatctgtagttcaagtgtgaaaaaacaattgcggaatgagaaacatttgtgatgttgcttcttacctctggtgatggggagaatgtaatcggatttgggaatttcataggagggtttgacttaatgaatgttgctttttaaagaaacgataaaagcaaatataacaaggttaaaatttaacaaaccaggttttgggggcacagacaaataattgttttgtcttgttctcttacaggcaaagtaaaatcttaaaattcttgtttataaatagtgatatggataagataaagtcacagtcttcgggtatgaaataattgtttactttagttcctcagatgttagcaatgatggttgatttggaagaagatgaggactgggcaaatgcagatgaactagaagatgatgattttgacaggtaatcaaacattgtgtccagggtggcagtgaaagccctagggctccacggtccatctcttcactattgcaccctgtaacctgaaggtaaacttttaagcctggaatatggggcactttgccttgctgttgtatttattgctgtgtcacatgttataagtagtattttctttagttttcatgtataatttatattaataaaatttatgtttcttggaagttcataaaaatattttaatagttaatacataaagttgtattttataatcaggaactgaaagatacctacaacaacaaacaaggaagtttttcttttttaaaaaaaagtatgacatgaaaacagcaaataaagtagctatgttttttgtttggttttgagacggagtctcgctgtgtcgcccaggctggagtgcagtggcgcgatctcggctcaccgcaagctccgcctccggggttcacgccattctcctgc

SEQ ID NO: 13476 - DNA, 1260 bp, Homo sapiens
agaagtacctttatactgtagttccctgcccttcagtggaaaatatatttttctagaaagtgaactaaatctgtcacaatatagatgagaatttttcaatatgatagtttatctatgaaagttatgacctatgtgggcaatgtagtcgattttttggcaaagctttgctaattacacaagaaacaaaattcggtatcaacaagtgtgtctctacatattttcctctagttcatgcaggatgcatcagatgtgatgcagcttttgttaaagacccagacagacttcaatgatatggaagatgatgatcctcaggtaagtggtcttaatgcatttgctttgatccgctaatgagttgtggacagcacatggttcaatatatttaaaacaaaaggagtgataggtttcttgacatactatcaacccctgctagcagagacattcttcactgattttccttctgtttctcaagctactttttctcagtctgttgtaggttgctcttgctttctgtgactctcactcaagttttggtgtttgtgggttctatccaaggctctcttctcactcctgtggagcagtgtcactcacagacatggcttccggtttcctctgtgtgcttgcaactttcagatcttcagaattgaagattcatttatccaacatgtaatagacatctccatttgggtgtctcctagccctttgaaggctgcatgatctccctcccctggcagaaaatacagaacccaagaatctcaggacacactgcttgcctctccgccaacgaacagacaaaggcatttcattaggaggaacccctgcctctcgacacacacgcacatacacacataggtatacatacccagctaacgcttgctcacagttctcatcctttacaagattttcctgatctgctcagtctcaatggtgggcagttccaacactgttatagtaacatcataaatgtttgtcatatcttgatggtattcccaatgcctaacatataacaaggcactcaataaataattgttgaattaaattttgactttacattgccacactgtaatagtttaaataggaaaacataccattttgcaaagaaagcatgttttgttgttgtttgctttctttgcaaaatgatatgcaaatatacatgtatgttttgtatgtacagagataacaggcaggagggatacttagcagactgctgacagtagggagactgaggggactgtaagctgtagggaggggtggtaaggacga

SEQ ID NO: 13477 - DNA, 2081 bp, Homo sapiens
agtttctcagcatctttatatgtccttatttacactcctgtaattcagaattgcttctgattttccaaagacagcatgcttccatacctttgcctatattttatttcttctacctctaatgcccttccttcagtgttcttgtatgttgtgtgtacggagtatggatatagcaattgtgttccttaggagctggttgtgtgtgtgtgtgtgtgtgtgtgtgtgttttccatctttgaatcctcagtaccaagcatgatgcctggcacctaggtatgctcagtagtgttcaaaagaaaatatttttttctaactccaatctctaaaatgctgtcattctaacaaatacaagctaagcatatgtaaataatcttccaggatactgaactgtgttcatttttccatatgattcttagtggagtttaactttggactccaaacaccccaaatcttatggattgctttctttcctcaacctcattagtgcattgaagtaatgggagatggatgccttaataatgaacactttgaagaactgggaggtatattgaaagcaaagcttgaagaacattttaaaaatcaagaattacgacaaggtaagttttccatgcttttatttctgaatataatccttgaccatcttggcaatcatttaaaacatttatttgggtgtgttttagttaaaagacaagatgaagactatgatgaacaggtcgaagagtcactacaagatgaggtaagttattccctttggaacttacttacgtgaccacttgcatctgaaagacttgtaaatgcctcaatttctgatttatgtgacttgtcattctgatgtaattatcagtctttagcagaggagtcagatatatttcctctcttaatttatgaataagtaatttgaaattaaactgatatgtctttcggtgctatgtgcattttgttgtaatacctcactcaacaaaacaccttgaggtttacctagttcatttacatactgctcacaacaaccatttgtattttgtggtgctttcactatattaaagatgagtaacctaaaattccagtgttaaatgattgcctagagtcacactgttgacggtctggggcctttttcaccatgttacttagttctctcatcaaaccacctaggactgtcaagcatacttcattgtgtgtttagagtccagcatctcatatgtggccacttggtgggccagtgctaccgtgtaggtagtaccagcttcctgaaggtgcccacatgcttgtaggcccaaattgccactaacagcgagaccccattctccccaccatccaccccgaaatgaggattattctgctgaaaacaaagtaaaaatagtgaaaacacctttgtttcagaatgtagaaattagagataatttttcaacccatctattttaagtatgttccaaggaaaatctttgcaataaatacagttcttgccacacacctttgtctttcgaggtaagactggcctttgattagtaagagacatgataacccacacttgagggttactccggtctctagactcttgatttacccttaaaacaggaatgagaaattgattttctgcattttttaaggtttttataaatgttactattgataatagaaaatatactttttaatccatatgagtgtttatgtgtatgttttttttaggatgataatgatgtttatattctgaccaaagtgtcagatattttacactcaatattcagtagctacaaagaaaaggtgttaccatggtttgaacagctgcttccattaattgtcaacctcattgtaagtgttacctctcttaatagttgttttgcgtagtttacctggaattcttttcactgcaacgtaaaatctaatgcttgaagttaaaatgggtctcagaaatgattgtttccattgtacatctttgattttatcaagttgactgcattaccctggatattttctcattcattatatgcttgaagattcctaacttggttttccataggccaattcagttctaacacatctgaaagatatataagtgattttttttattatttcagattatctgtgcc

SEQ ID NO: 13478 - DNA, 1036 bp, Homo sapiens
agacccaaaagttgaaaaaaactgatgacagacaacaagcatgaagatggcatatttgatgtcactttggttctttttcccagaaggcttatacagtgactcagtcgggaagctttccagcttccagcccttgaatgtgaagtgtcattggcatgtctggcagtagtctctcattcactcctcaataaacaacattgaatacaaaagaggcttgtgtaaaaactcagtactgtctggcttggattcatttcatgtttttaatataagaatgatctaatatttttttaaagtaatagctatcagtaatagctgagtgttttttcccctaatattttccttgtgcaattcagacttaagcatcgagtttttaccatcttccactttaagctaagttatgatacctattccattcacaattggtgttctttttaaggtttgcaaatttcagccaattttgtagctaagattgttctgatcagctcaaaaagatttggcttagtgttttcattgcaaattataattgctgtagagccacacacaacttttgaacttttaattataagtgttatggctaaagttatttactgaaaatttcagtaaaatgtgtgaatgtttctttatgtattaacctcatagcagtaaatgacttgctgttgtttaatttttctaaggcatcttaatagacttctgttgaaaacttcagtgttaacatttttatagtttgtactaaatttaaccgtgatataaaaatgaattttatgcatagatcagaattttaaattaaaggttttttctttaaatgatttgtattactttattaaaactaaatctgaaatggaatagaaaatagaatggattacatacagatggtttccttgttagcagatgcccttcaaatatattttacgtttgcagcacaacaccattgcccggaggcttccgaatctagcaaagcagcatattaaatgactccacctgcgcagtccttgtgttcagtggatgaatacctgtgggctcttgtaatgtgtggtaatat

SEQ ID NO: 13479 - DNA, 1022 bp, Homo sapiens
ttcatactctcacacatttgttgttactaggtccctagcagcacaggcttctcatttagcaaaaattttcccagaaggctccagcatctgggaggtctttgaagaggattctggggaatgtttgtgtgcacttaaaaggagacccaaagactagatgtgatgcctggaatcacagcagccatgtttttactagacctgaagcaggcaagagggtgacagagctgaaagtggaaccagagtccataaatgcatcattgagtcatttagatcttgcgcacctggagcttagcatgccaaatactaatctgttctaggataccagataatatgtgaattcactttctcgtcgtacttgagttggggttttcggttattgccatctaaagcatcatgactgatatattaattgggagattttatctttcatctgctatttaatattatctatgagaaaactgatttctacctgttaattatgtggaaagtgacttaaagtcatatcaaatcactgttagagatgatctctttataaggactttagatgtttgataatgtgtgcaagtcgtgcaactgagtctacatgaatttcgcgtccttttaagctggccttgcagggcatctgcttggaatctaccatctggcagtttgggttacagaacatacttgagagtattgcttcatttcttcaagaaaaaaatgatggaaatgccagccatttctgtcaacctagaatatcatctatctgcacatttaatattgttaggaactttgtgaggaacttattaatcaggggtttgtgatcttcctttgtaatcttaactggagtgtttggttctctaacatcaggtgctagcaggggccaagatggatccaagtggagtgagctgtttggaaatatcaggatatggggaaaccagcgattttctaaatgagacaaacatgttagtgaatctgtgaagaaaagttaagtgatgtaataataacctttatatatatataaaatatatataaatatatttata

SEQ ID NO: 13480 - DNA, 1054 bp, Homo sapiens
tactgtaatcccggtactttgggaggctgaggtgggaggatcccttgagcccaggagttcgagatgagcctaggctgtatagcaagacccctccctctctagaaataatttaaaaacttagccatggctgggcactgtgggccatgcctgtaatcccagcattttggaaggctgaggagggcggatcacttaaggccaggagttagaaaccagcctggccaacacagtgaaaccctgtctctactaaaaatagaaaagattagctgggcacggtggcacatgcctgtaatcccaggtactaaggaggccaaggcatgagaattgcttgaacccaggaggccaagattgcagtgagctgagattgcaccactgcactccagcctaggtgacagagccagactccatctcaatctcaaccctccctgctccgctccccctccccctttccccctccccccacaaacttaggtatggtggtgtgcacctatagtcccagctactcgggagtctgaggctggaggattactgagcccaagaatttgaggcagctgtgcactatttcaggcagaccaaaagctgcctctcacctgcgtatttaattttcttttctctattttcgcacttctattagtcggatccgctattggcacacctttcagtacatggtggatgcttagtaaataccactggatgcacaaacgtgagtcctacccacaccatgccatctgccatcactgctatttaagaaccttttttcagggactagttgatgtctcagttcctcagtgaggtggcatccttatttctgaggcttttaaaattcgtttaatacctattgtcagaagtaaacatgttgccttgaacagtcatctctgagttacctgttctcttgcctgatagattatgcatctcataaagacaaaacgatattgtgccacattattactttgtgtcctatagggtgtgaaatgtagttgctgaaacataataggccctcataaatgtttgttaatggtgatgatctcgattatggtgacacttgaatgatagtata

SEQ ID NO: 13481 - DNA, 1058 bp, Homo sapiens
taatatgtgtatctacattatctgtgtctttcactaataagacaaggttcaacatctgtcttcagattgcattttctgtgggaagaacttaggttgtaggcatttagctcagagaaaggggaaaaggtactttcactgctcactttttgctatttctgccccaagacctactgttcattctccagacttgctgtattttatgtcgaaaggttttactgtttccatgaggaactgtggttcattttccccaggcttataatcagtaagtagtgattttcttttcagtgttacttactgtgatactgtaaaatcaaactaacaataaggtgccacaacgccataaaaaattaataatattgggaagatgttgattcccaaactaagatttgggctttggttttgaactgttaatttgttcattcattttaatatttcctttgactgtctcagatataccaaagcgtggtgcattgtggaatgtgtgccagtctcaatgcatgtagctctgtaggatggaaagtcagttatgaagagagacttctttttcttctgtgtcctgttgattaagaagaatctgtatggccgggcacggtggctcacgcctgtaatcccagcactttggaaggctgaggggggtggatcacgaggtcaggagttcaagatgaacttggccaagatagtgaaaccctgtctctactaaaaataaaaaaaaaaattagccgggcgtggtggtgggcgcctgtaatctcagctacttgggaggctgagacagagaattgcttgaacccaggaggcggaggttgcagtgagcctagatcgtgccactgcgctccagcctgggcgacagagagagactccatctcaaaaaaaaaaaaaaaaaaaaaatctgtataacttgcattgccctttcaggtaattaatcaccctttttttccagcagggttaaagattgtagtattgactatcagttattttgtaacaaaaactggacctaaagttcaattcactgttgactttttcaagaggagtattaaatttttactccctgctgtacatgt

SEQ ID NO: 13482 - DNA, 1028 bp, Homo sapiens
cctaatgaaatctagagtttggaagagagaacacatctacaaaccagcacacggtgacgacttttttccaaggacccacttggcgtcatttgctaaatgctcctcttaacggtggtgagtcttatctcctcttacattgacagtactgacaagtatacatatatatatttttaaattttactttaagttctgggatacatgtgtagaacgtgcaggtttgttacataggtatacatgtgccatggtggtttgctgcacccatcaacccgtcatctaggttttaagccccacatgcattaggtatttgtcctaatgctgtccctgccctttctccccacccctcgacaggccccagtatgtgatattcccctccctgggtccatgtgttctcattgttcagctcccacttatgagtgagaacgtgtggtgtttggttttctgttcctgtgttagtttgctgagaatgatggtttccagcttcatccatgtccctgcaaagggcatgaactcattctcttttaaggctgcatagtatttatggtgtatatgtgccacattttctttatctaatctatcactgatttgatagactgtatatcagtatatcactgatttgggttgcttccaaatctttgctattgtaaatagtgctgcaataaatgtacgtgtgcatgcttccttatcatagaatgatttataatcctttgggtttatacccagtaatggaattgctgggtcaaatggtatttctagttctagatccttgaggaatcgccatactgtctcaaaatacatttttttttctttttctttttgaggtgtagtctcgctctgtctcccaggctagagtgcagtggtgcgatcttggctcactgcaacctgtacctcctgggttcaagtgattctcctgcctcagcctcccaagtacctgggattataggcgcctcccaccacgccagtctagtttttgtatttttagtagagatggagtttcaccatgttggccaggcttgccttgaactcctgag

SEQ ID NO: 13483 - DNA, 1055 bp, Homo sapiens
tgtggcccagggaaaccaaaagattgttggtcaacacttggataaccaatgccaccaccttccttctatgtataaatgtctttaaatgaccaagatgatacatatccataacttgcccttcctatgccctgccccatccctgccctcacctcacggtacctaggcaacaaacaaagctaaatccctgagaagtgttcccccaacccgagagctagacatttgatccccaagaactaagtggctaaactggcttcagcagacacatagatatttgggaaaaaaaatagcagtctcattacggaattagatgaatgaacccattgctctttttcttcttctgattacattaaggatatctagacttttccaaatgcccagtctcaagtatctgagttactgactccctttgtccctcaatgttttttcctgattatatttgcaagtgaagtttgtttctactctcagtgagttgagaaaattaatttctaatattcagaggatctcagtctgcctcagagtaatttgagtgaagtgttggattaaaaccaggctctggaatcgttcttcctgtgccagctgctagctattgactctccttgagctgaggcacacttcttgctagttctctgtgtacgcatttcctattagacagatgggaaaatgtcactcctgttaacagaggtgggcccccttggacctgaaagccacacagagtctgtctaatttatggtctggccctagatccgactttggaatgaaagattttgaaacctgcttccatgttgctacttttccaaaaggtgcgagtattattattcagtagctaaaaggtaatgctgcagtgctcatggaaatgcattccattcaatcaagcaggcagtctagattgtaacaatgtgcatgtccccttattggacttaacaaagcttttttattttgaagggaaaaaatgtaacatgtacacattaaaaaattttaaaatatggaatccctccccaccccccataacctggaggcattcttacttataagaagtttaaaaaattgaaataaaa

SEQ ID NO: 13484 - DNA, 1045 bp, Homo sapiens
cctttaaatagattctgaggcccttgggcccagaaatgcggttttctgtcattttatccttagtgtctgtcttaacatctgataggtgctggaggagtctcatggttagtggtgcctacagacggatcattgttttgatggcggtaacagcacctgggttccacaagtgtttgaacgaatacacacacccctgctggatatccagtgaatgagatttcagctttgggcgagatgctggcctatgtggtgtttaaatgttttgaaagttatcactgctttttttctattacataattatttatttttaccaagctctcaaatgtcttaattgtgccagtcatatgttatgaattctatttctgggtattgtaggaacagcagttcctatggcttttttttttttttttctgtgtatgagcaattcgactcagtgggatgatattttcttttataactcattaatgtttgcgataccgtgtactcaaatattcaatgtcagctgtcagctaccattgggatccatcccacagaccatcaaaatgtacttttgggctgaattagtcctatgccaagacttgtgggtggatccagcagcagttgggaaccacgtgccaggcctggtgtatgtgctcacggacacattaatccgatcatacctttcttcccttaaagaaacaattaatgttaatgttattgtactttggctaatgcagagtctcaaagttaaattaagcacaacataggaaattctaagtggttacccgtaaaatggaagaccgtttcattcccgctgagtgcaaatctggtgtctccgtatactcaacatgaatggccgtaatacttaatgctttaaaaaatgcatctatttccaatgatagatgaaaagcatttatttgagccatccgcatgcagtgaacaatctgtaaaatatttggttatcttcagctgggcagcattcttccagctcgtattgagcttgactacgtctagatctcatgcaaggcatccgggccagccatgaaggaggatgaggtccctgctctca

SEQ ID NO: 13485 - DNA, 1045 bp, Homo sapiens
tccacagccctttcagtgtatcttacatgctgtggataatttaaaaagtacccatttattttacaagttggagggagtgtaagacccactgaattcaatacatagcatccacatttttaaccagaaatctgaagtgttaatttgcttcccgtttgtccagtgaacttgactcttaacattttcttaaattaggggaatgggagctgtaagttacagtagatgccaagtacttggtaaaaatgaaatgttggtgggggaaagccatggggaaaatgtatttgtcaaaacactttaggctaaataacttaataataaatgtagtatctcatggccaggcagtgcaacattcaatacagtagtcacttgccacatgtggctatttaaatttaaattaaataaaattgaaaacacagttgcactagccatactcaagggctcattagccatctgtggccagtggctactgaattagcacagatatagaacattccctccctggtagaacattgtattgggcagtactgatggagaacatagtataggaaccatctatgataaattatcatacatgtcactcattgttgtccagcccaaagcctgagggtaggagatgctaagagacttgaagaaaatcttgttctacagtggcatgatcttggtggtgtaggatgggaagctcaagttttgtacccttcagttgaaacatttatcctgctggtaactctggtctaggacagtaacagtgtactgagctacacgatcctgtgtagataacgtgctttgttctaagacacttacatagaaaatataacctattttaataagaaaataatggagtcatttcaactcatggggtaaataaaatgtaggaaagaaagggggaagcagaggtggagtgaattttgaaagtcccccgtttgtgtcggtgggtatgtgatctgactttgaataaaagagaatcagatggacgaatcttttcttaactcaatggtggatgactgacattgccctattttccagttacatttaaatggaatcaattgtt

SEQ ID NO: 13486 - DNA, 1061 bp, Homo sapiens
acaggtgctcgctaagcgttgtgaacccagctcacctcagcgacaggagtgactttgtgtgaaggctgtggctttattcccaggtttggccaccttcatgcccagtgttttaacaaaggaacagagatggaagttcttaaaggaatgaagcacagaatattcagtggtcataaattagtggttatccagtgaatcggccagaatggaggttttgattcgagtagttccccatttaagagatttctcctggctttaacagtcaatgggtagcaaactgcagaaagcagtaatatacagatgggtgcttcttaccccgtctaaggaaagaaaggggaagcagtaaggcccgggcagccccgtgttcctgaaatgccaagaacctcgcaggaaagccctggctcctcccagtgcatttggctgcatgtgacttctggagaaaactgcagacactcgtcattgatctttccacccgtaagtgcatcgtcttcttctttccagtggtttcagagcacagtgagcaaagaggacgccatgccggaagcactgaaaagtctcatattcccgaattttgaacctttgcacaaatttcatactaattttctcaaggaaattgagcaacgacttgccctgtggtgagtacatttctacttcccagctacgttcctccctccgtcttgcttgtgttatttttatgtcgtccctgggtaggcagcaggcaggaacaaagatgaaaggcaggaaactggcttacaacaagtcagccttcaaatgattttcagttaaatcctacatgcgttcagatctcatttgcagtttctttcctctggtttgcagttcttcaagatggatttttttccctctcttatgatgattatatgattatcacaaaataaagacagtcgttacttctggaggggcaatagggattataaagagtaggggcttaggaaggctttgaggggtgctggtaatattttactggtgcttgctttaagtcttttatgaagtacatacatgccttgtgcagttttctgtattctattccagtgtttaaaacatgc

SEQ ID NO: 13487 - DNA, 1046 bp, Homo sapiens
agtgggaagggtgtggttgaagatacagacaggaatgagtgataggactgagttgtgaggaggtgaggatccggggcccagggcaggtatgcttctcattgctgtaggagggaagaggaggggttactcttggtcacggagcggtggttgtcaaacgctgctcctgtcccagctgcaaaaaaatcaatcacggtgttttctgaatgtacaccttcctgggtctcctccccagagggtcagattcagaagagctagcatgagtgtcagaaacctgttattttttgttttaagaaatgtgtatttttaaagtctccacatccccccaccccaggacattttaatggacaaacagattgagatggaggcaggagggcagccacaggcagggcagagagaacggagtctggtgcgctgatgagagaagatagaagatagaaggattcttggatgtgagggcgatctggctgtgacatctgtcaccccattgatcgccagagttgattcggctgatctggctggctaggcgggtgtccccttcctccctcaccgttccatgtgcgtccctcccgaagctgcgtgctcggtcgaagaggacgaccatccccgatagaggaggaccggtctttggtcaagggtatacgagtagctgcgctcccctgctagaacctccaaacaagctctcaagatagaaggattctaaagatgtgtattctggtaggttgtgtcaataaagctgattggatctgcggcgagggaggagttgaagctgactctgctttactgcctgggcagctgggtggataggtaacgttcccagtcactagagagggaatgcagagaagcaggagctcatttcaggagaagatgagttcagctttggacctgtgcagtgttgaggggtttgcagagtccggtcagaggtactcgggacacttggggaaagaaatccagagctggactggattggacatgagtaggtgagagttaggttgtgggtgtgagtgaggactccagaggtggggggacagttggaagctgaggacaga

SEQ ID NO: 13488 - DNA, 1047 bp, Homo sapiens
caggcacgcaccaccatgcccagctaatttttgtatttttagtagagacagggtttcactatgttggccaggctggtcttgaactcctgacctcatgatctgctctcctcggtctcccaaagtgctgggattataggcatgagccactgcacccggcctcagatttggtttctaaagaccatttcccaacattccctaacagggatccttagagaaattctaggtcttgggcagggcgggtataggtgagcctaaagcaaggaagatgagtgggtaggtggagcagccagagcaggcgttgagggccctggttgaaaggccgcaggagctggtcagagggcttccacctggaccatctgaacgttggaaaaagaatgcaactgattgtgacacattgactaagtaaaaatccatgagtgtagagtgataccgagatacaaggagaatgaagacagaaggccagctaagaaatagaaaagtaatgacagaattatcaaaattatcattatgtaaaccctagtgtaagtcttaattgtaaactttttcacggtaaaaggatgggagaaaaaaaaaggcagtgtttttggttcccgatgaagcgtaagtatttcattatttgatggaaatctcagccatgtttttgtaaccaaatctgctggtaccacttgagttctcaagactagtcttttgatactatgaatattacagggttattattttattattattattattcttattttcagttgcaagatttaatagagtgaaaacagagctcccatacaaagggaggtacagggttattatataaagtaattatttccaaggaaagcatgttatttcagcggttttcctagattgagatgcactttatttttctgagtctccatcatgggccggacattgtgctagccgtttctttttttttttttttttttttttttttttgagatggagtctcactctgtcgcccaggctggagtgcagtggcacaatctcggctcactgcaaccaccaccttccaggttcaagcgattcaagtgattc

SEQ ID NO: 13489 - DNA, 1062 bp, Homo sapiens
aaaaacaatgtttaatctttttttaatgcccagtaggcatacttagctttgccaaaaccttgtctcaatttgaatatttgattagaggagctaggctctgtcagctgtatcagattatgaatttttgataacttttacagtggtggttaaacgaagtaagaaatttctcttgagtttctgctgtgggaaagagcagaagtgcttttcaaggtttctggactgatcttgttgaaaatgctagtactgggttcttgtctatgaattggagtgttcatgcaaattctggtatatgactgctaccctttctttgctaagcacttggttagcccattttaagcataataatccatttcttgaacactgacaccttttcttcatagtgatataattaataccattgctcagattggcttcaccaacttactgtgcaggtcttttagttatttatccgtattactgatttgtcagaagatagtgtagcttctgtattatttcagttgctataatgcagtccttctcaaccccggacacacattagaatcacctgaaaaaacttcaaagatctgtctccatatctatacttacgtgaaggtataatttatacctagatttatataaacacagtatctcgccccagaacaactgagtcacagagtctggtggtggcgcctgggcattgctgtacatttaaaaacaacccctaggggattctagtgtatggctggctttgaggaccactaatgtaagggcccccgggccttgggttgataccttcctaatttctggagttaatttggttcgtttggctaagcccactctgtgggcatctgtgctttaaaggtggtgacctgcttggatggaagaagaccactcttctgtccaggaatgggaatagccacatccagattaacacttaaaacacctaagaggctctcagtgtgtattcatgagagatatgggagttgcagttctgccttgggaaatctaaacacacgcatacacataagaacgtgatctgtaggtcacaggtgtacatgacatccttggggggtgatcaaggaa

SEQ ID NO: 13490 - DNA, 1048 bp, Homo sapiens
aacacttccatcaaacataaaacaaagccggtgtataggttataactttgtagacaacctgccgtggccaaccccactcagaatttgtatgctttcatattgcgttgatcttctttaaaaaaaacaaaaaccatgtattagtgtgtgaaataactagaatctaggagtagagttgacagaacgagactccatctcaaacaaacaaacaaaaaaacaggccgggcgcggtggctcatgccacctttgggaggccgaggtgggcggatcacgaggtcaggagttcaagaccagcctggtcaatatggtgaaaccccatctctactagaaatacaaaaattagttgggcgtggtggcacgtagtcccagctgctcaggaggctgaggcagaagaatcacttgaacccgggaggcagaggttgcagtgagcggagatcgctccactgcacttcagcctgggtgacagagtgagactccgcctcaaaaaacaaacaaaatacccccaaaaaaccatgtattagtgtgtgaaataattagaatctaggagcagagttgttagcacatgtaaatgacctccaagcatctgaatgaagtatctgagacactatttgggaaatgagatagtatgaaatatagataccagatatttaaaattctgtgtgtactatcttcagtctccttttaattttaaatatatgttttgagaactattaagctactgtatgtatcttgattcaaattcactttggatccctattttaaaattatagttagtgttctaatagctttcgtacctgcattgttaatgtttacagtgtagctgccttttgtgaattatagttggtgtgaatatccatgaatgttgacctttagctcttttaataatgtatgattctgaataatgtttgaatggaggcataaagttctgtgtcataattagcatgcagtttgaattccacaggtggtcattgtaattagactgagaagttaaagttgagtattctgttattggggaaaatagtgtagtcatcaggaatgattccacattgac

SEQ ID NO: 13491 - DNA, 1037 bp, Homo sapiens
acttagtcacaaattcttccccaaggccgatgtccagaatggtgtttcctaggttttcttctaggattcttatagtttgaagtcttacatttatatctttaatccatcttgaattaatttttgtatgtggtgcaaggtaggggtacagtttcattttctgcatatgactagccagctatcctagcaccatttattgaataaggaatcctttcaccactgtttagttttgtgaactttgttgaatatcagatggctgtagttatgaggctttatttctgggttctctattctgttccactggtctgtatgtctgtttttgtaccagtaccatgctgttttgcttactgtagccttataatctgaagtcaggtaatgtgatgcctctggctttgttttttccttttcttttttttcccttaggattgctttggctatttggggctctttttttggttctatatgaattttagaataattttttctaattctgtgaaaaatgacattgtggtttgctaggaatagccttaaatctgtagattgctttggtcagtatggccattttaatgatattgattgtttcagaccatgagaatggaatgctttttccatttgtttgtatcatctttgatttttttcttttttctttttttttgagacggagtctcactctgtcacccaggctggagtgaagtggtgtgatcttggctcactgcagcctccgcctcccaggttcaagcaattctcctgcctcagcctcccgagtagctgggattacaggcgcccaccaccatgcctggctactttcttttgtattttttagtagagacggggtttcactgcattagccaggatggtctcgatctcctgacctcgtgatcagcctgcctcggcctcccaaagtgctggctgggattataggcatgagccaccaagcctggccatctttgatttttttcagcagtgttttgtagttcttgtagagatcttttaccttcgtggttagatgtattcctaggtatctttttgtgtgtgttgtg

SEQ ID NO: 13492 - DNA, 1034 bp, Homo sapiens
ttgttgctattaattttgccttgtagtaagtaacagtaatgagttcaacataatttcttatataggaattctggaagtcagtgtttgggacataaagtattggatttataattccattcctagtgcaaattagacctaagggagctgcatctagatagaaaataatttaatcaaattattttgtatggtagctcgatttcccccctactgacttgattaacacacatgtgtcgcttgcacatagaaatgcaaaaagttaattatctgtgtgaacaaggcttgactaggaaagaaaaatcagatgcttttctctgaataattcacaaaaatgttttatataagtttttaaaatgaagataatgaatttattttttcaagagaaaagggacttgatagtattatacagaatatccattgacgccagagtagttagtgaagtgaattttgatgggattgaaatgaaagaaccttattattcataacatttcactgtttatattgcttagtgaccgtagactaccagatcggaaactttttctgcgcatgcttcgaaggtaattacggtatagcatgacactaatgactcgagcctgaaattgttttgaaacgatgtagtagagaatcacatccagacacgtgctgaggttcatgaggaaggtggtaaaggctccccagggattgtaactgttctcccccgttcccagcatcaggaaagcgaaacagatgtggaagggcataaagcagacgagcacctgcaccagcagcgtgatgatgatccttatggacttctccttgactttgggtttcagcttagacgtcctgccgtgaaggagattatgaataatgaccaagtagcacccaatcatgatgaacaaaggaatcaagaaaaaaaatgtcagtcgagtgaggttcagcacgttcacagcttttagatagatgatgtcagaaatcttgaggcaggtggcgggagtggagtctttatctgggtctttatagagcagtagcagaggggtggtcgtggtcagggtcattat

SEQ ID NO: 13493 - DNA, 1076 bp, Homo sapiens
cattcgaaagggtaaagtcattataaatatcaagtccactaatgccacattcatcatatagatggttaccgtggttctcttcttggtggtacaactgaaaacccataatgcagtgatgttaacaaataatccaattatgaagatacagctatagaagacaagggctgcaattttgtattcatctggatgtgagctgttaaaagggacaggttgatcttgattgttcagggtgatcattttacagcttgttggtaggcatgatacttagaaactgtaaaaatagttaagaaaaataagaataaaatcgttggttaaaaaataaatgcttaacattctcccactcagcttgactgccagtgaattttaagttcgagagcatttaatcaaggaacgattcaactggttaactactgaacattcacagtaattctcatttgagagagaatgggaacttttcctttgttacagctatagccccactgtctattgagcatgtaataggtactcaataaataaatatttactgaattgatgaataaatgaaggaacttttgatgagatgattcacagcaactctactttgctaaaaaactctagtttgtaattctctagtttgaaaatgaagacttgtgtagctggctattaaactttttgttttttttaaagtggaaacacttcataatatttattaccttatgttctctttaaattatcataggttgagaaacagcaatgttttgtgtcatggtcagcagatcaagaactagactgttagagcaatagatgagctgttttctagtgcacaattgggagtacgtaaagccaagtcttccaggttttgtgatttcagctgctctacttcagtggttcacagaaagcagcaccttgaaaaaagctagtgccgttagtaactttcatatcctcattccatctagattcagaagcttcaatattatttaaattttaacaattttcaaagtaaatccaaaaaaggagtatctaagacaagtagatattaataagaagtcattcagtaacttgatgtgtatgtagaaacttataaatttccatcacca

SEQ ID NO: 13494 - DNA, 1040 bp, Homo sapiens
ttagctcatttctctgatggtcactctccccaggggcagttgggtgaggccttctgtgaggggtcatccacttccggccttgtgtgatttgaaggcattcctctccccaactctttgcattgcagagagtattttacctttggtcttcctctgaatttctgtaggactgtggataggagccggcaggataggagcttggaggctgcatggaagcctgaatgcgtccaggatgcatttcctaagtcctcatcccagggaggaaaaccaagaatgtgtctgctgaagtttgggcctactctaaatgcaaagcactcagtcccctgatggggtcacattagttcctgatctttgccatcgctgtttttttttttttttttaattgttcttcagtgtgtatgttttttaccatattttaaatttatttttaagtcgacctcttggagacattataatcaacctttagaggaagacgtgttgtttttttcttggtaataaaactgcattgattttggttactcagacaaggtatttaccagaactctcccttgtatgcttataaaataaaactagtactccattcagttgaatatttgcagcaatgttatcttcttattgctaataccatttgtatgggtagactttatgagaagtttatgactttcagctcatacagcttcttgcgctcagcaagccacagtctaaagagagtcttaactgagaagggaaggaaggaggcaggcaggaccaccctgagacccacaggccagctgccgctgtgcttctttggaaaaaaggttctcagactgtgttggcttacatctttctgcctctggtgtaggatttgctcttctaacatgaatggaacatttgatttaggatcagtaattacaggttttagaactggagtttgaagtatctgtgacacatctctctttgacagtcatgtgggtactgatccctgattgcactttcaccccttttcttcttcttgttctcgttttgtgtgtgccttgtgaacaaggacctggcacgtgcgtctt

SEQ ID NO: 13495 - DNA, 1035 bp, Homo sapiens
tatatgagtgtcttagtaaactcgtgctgtcatagagtgggtggcttacacagaaatttattttctcacagttttggaggctagaagtccaagatcaggatgttggcatggtcaagttctggtgagggcctgccgtcttcctgacttgcagatggccaccctcttgctgtgtccttacatggctgagagagctcactttggtctctcttcctcctcttacaagggcactaatctcatcatgggggccccaccctcatgacctcacctaaacctaattgcctcccaaaggtcctacctccaaataccaccacattgggggctagtgcttcaacatatgaatttaggggtggggggagacaaagttcagtgcacagcagcatgtatattgtgtgtgtatgtgtacattgtgagtctgtgtgtgtatctgctttactctctattccattggtccgtgtgtctgttcatgctctagtatttttagccattttgtttttgtagtatgtattgatatctagtagaacaggttactctttttttttttttggttcatcttttcaagattaacctaactattcttctgtataaattttagagtaagttaatcagttatctttaaaaattcagctggaatttgagatattaatattttcttttatctcttctattagtatacctattaatatattttataacttgaggttcatcttttctaaaaatgttgctttcctagttggtaatattattcagtttgtttcttttttgttgcgactgtgttctaaggttgcctagtgattttggcctcttagctcatgtttccctgaaaggtgttaaaccactttggcagagtcagattaggttaagaggggcagtgagcacccaggatagagaatccacagccactgcaggacctttgtgatccactcctgtttggtgaggttccagaggtgtcttggctagtgagggattcatttttaaactctcagaaattagcagtattgagagtaagcggtttctttatatggtagtttgcctgtc

SEQ ID NO: 13496 - DNA, 1033 bp, Homo sapiens
ttaaaatttcatgacatgcaatttttaacagtttataattataatatggttacatatatgataacaggaagaacagaataaaatttgtgtttttactctcacaatttgctgactttggcaaagctctggcaaaggaaacagaaccatttaaatagggcaaacgcacttttgtgacagaagggaatgcactaaatttttaggcagaaattccccttcccttttttgaatcattgtctggttaagtaaagcaccccacatttcagacaggcattaagctttgcttttaaatttaatttcagttggatttttttttaaccaaatgcatatcactgccaggaaatgaaatcagtcaccacatttatgtagtgaaatatgaacttaccacagtgatctgatttgtgttaacctaaaagtctgagaaataggcttagtccatgttaggaactgaaagttagattttctttttaaaaagaagaagacgacgaccgcaacaaccatgactaaaatgacaaaaaaagaagaaagataaagaaaatgagagagaaaaagacttaagctacttcaaggggaaattattaaattttaaaactctatcaatctgcaagtactccatggatccatgcaatctatacttctacctttgcacatagtagcaagcatcacactttatattttgtttcttgctttattcaccaaacatcttcatgtcagtgcaatgtatatatttgtcgtgtatattttatataaacatttgatagatattctacagtcttccaatgtgtcaatgcataatttgcttagctactcccttgatgaacttttggattctttccaattcttttcttgttataaataatgttaaagcagaaattttaagtactaaattgaaaaatggaaaactcctacaataaagttctgtagatgagggtaaactttgattaaagcaggaagaacagagcaataaatcctgtgtgattatttttaaaagaaaaataattcctctgatagaactgtgtgtacataaatctcacct

SEQ ID NO: 13497 - DNA, 1062 bp, Homo sapiens
tgattgtcaggatgcttacaatgtgtactgccttactaggttcttgatgtgttctctatagtggtagaatacctggactgcctattttaaagatagggaggctgagtttcaggttgcatgaatgatgggtggtagaaccaggacaaaggccaggtgttctgctccaggcccagtgagtccagcaccttacactgcacatctcaaggctctcatccatgtctcttccagccacgagatgcacagacacagttattcttaaagtttcccttagccacaccactaggatgaggccccattcatcagcaatggagacatgattctggagggcaatcttgggtatgaagaggttttcaaagtccccagaggccctgaaaaacacaatcgacaactttttgcagccttctgtgtgctgaccaatagccaaggaaaattttttctcattagcagactctattttcttcgtaatatgaagaatgtggcctatagctatgctttctcttctaaaatcatcaagatatttaactggtcctctctccatgcttggttaaaaactcagcttaaacctcaccttcagcaaactcactgtcttgtatttcttgcattgtcatactcaatctgaagtaaagaaacattcagagaaaacttaaaggataatttaaagtatattaggctggtatagtagtgttactgaataaaggaaaaagaagtagagataaggaagaggttgccaagaaacacccgtacttttacattgtagagattactggtagattatcatgtccgttgcaggacagaacattttcccatgggtcttcacattgtctttttatcaggaaattaaaattttttcatcagttttgattatctctttaaactatatgtagttttggtttttggtttttctctctctctctgtgtgtgtgtgtgtgtgtttaagtgtccagtgtttgtcttcggggactgactgtgttgatattttccttctgtcttgatgatagcctctgggaagggactatggtaaaattaacatgtcgttttgaatttatttattatttataaaca

SEQ ID NO: 13498 - DNA, 1020 bp, Homo sapiens
gagcggatcaatatgatacttccttcccagtctatagatgtaactgcattgagagaaagctcttccaagcattatgatgattctgctccttctgtgtctgataactgtgtgttgatctctttttagggaggaatgatcaattggaatcgtctttttcctcctttacgtcagcgacaaaacgtaaactatcagggcggtcggcagtctgagccagcagcgccccctctagaagtttctgaggaacaggtaattaatcagtaatacctggtactcattctaaatccatgtttcagagttgaagcagtttcgatcaacaggactcaaaagtaatcaagcgtgtaaatacaaagatggtgacagcagtccatctgccaccatgatagagactttgggcttttttttggctattgtggttcttacgagtttaaggaaggcattattggttggggggcggcgggtgggaatgtattatggtagcttgttttagatgctcttacacttcatatatacaagaaactaatgagattggttctctgtgaaggatcggggacaaggaggtgggaggatggggagggagtgtgcctttggcatggtttcacttttgtatggttttgagtcatgttaatgttttacatattcaacaagcaaaccaaaaggacagggacaaatgtaaaactgaaaagaaacaaacaaatgctctaactgcatttcaaatgaataacataatcacattgaaggagggaaaatggatttcagtaacgtttgtaccggatataccctcagtctaatgaagaaacaaaaagaactgcaaacaaatcttaaacatttcttcaaggtttagttttcataaaggtatgagtatagcaattctaaaattatgctgtgtgtattatagatttgagcaaatgaggaactcggttgattttattgtggaagaaggaaaataaatatataaagcagggaaaggcaagggagaaccctgtggggttggaaaggaattatcactatcatcgtaaactc

SEQ ID NO: 13499 - DNA, 1046 bp, Homo sapiens
tacaaaacagaatgtgagctcccgccaggcagtactggaacagtgcattttgtaagaaggaaacagagcaatagaaaaataactgataggttaacattgagttacttcaggttgctttttttttaagggttaaagcagaggggagttccttattatgctgacttgtgtagtctgggatctcctatttttagaaaaagcaggtcttcttgttttgggatctgtctgcttccttaaagtttcaatttgattgtgtggcatttagcatgagtgactccatttagtttggtcttctggtttgttggagcccaaaacaatggcgtcccataattttggtcaattcacatgacacgtcgtgtggattctgtttatgtctctgagatatccattagcccaagtagagagaatggctttaaacccacaaggtgctttcactcttagctgataaatagcaaaatgtatttagtattagagaatctaaatcttaatgaggctgtctcctctcttctcatctcaggaatccttaccactgtctccagaaaacccaccgaaactcctaaaatgctcaccttctgaaagcagggctctaatatttattggttttgagacacatctcgtgcttctgctctgagtagccaagcatggcagcacattgggtattgggttagcctcccatggcgtctggtctccctgtggacagcgagcttcctgagggctggggccatgtctgccttgtttgctaccctatgaaaagcctgatacacacaggtgccccagcatcggtcggagaagggttgaacacgaaggtgtggccagtaaacttccctttcagaactcttgttttcacataaaaaatgtgctagagagtggtattatgccaggtttttccattgcttgctctagtagattggaaatacgttttctaacaagatcccaaagttagatgtgttacaatgaaatactagatggtactcaaatagtaaccaacttttgtggggtgtctcattctgctgggtgctctgagagatgtacacaaaggagctcagcca

SEQ ID NO: 13500 - DNA, 1048 bp, Homo sapiens
aaatacataaagtgtattttagaacaacacagtctttttgttagaatgttatgctcaccatttaaaaagattgttcctgtctttctgacttctttagggcccaccacacacctggccccgctgccctccataggagaatagtggtcctgagaggtcatgtttattgagcgctggtcatgtgcccgtcactgttctgggcttctcacatgcatccctctcatctcccaaactgcgaggaaacagagagtcagagcctggtcccctgcatgtggtcacacggggccaactccaaagctcgggtctccctgccaccctgcgctggagtcagacctaagacagcatgcagcttcccctgcatttttatttcacggaagcatgaacctggttttctgtccctacaagttgagtatcccttatccaaaatgcatgctgctctagtccttcagtaagcccatcacatattttctctgtgtcgtctgtagacactttttctgcagcgttagcatcatctccatcatcactgttgtcacagtcaccttgactcagaaccatctcagctatttcaccatgggtcagttaatgaacagctggagcccccttatcgatattaaaaacttcaatatctggctgggctcagtggctcatgcctgtaattccagcaagttgggaggccgaggtgggcagatcacttgaggtcaggagttcgagaccagcctggccaacatagtgaaaccccatctctactaaaaacacaaaaattagccaggcatggtggcacatgcctgtagtcccagctacttgggaggctgaggcaggagaatggcttgaacccaggaggtggaggttgcagtgagccgagatcacatcactgcactccaacctgggtgactgagcaagactctgtctcaaaaataaaataaaaaataaaaacttcaatatccacttcttctggcttactgacagactcgaaggtatattttttacctgttaggaggtcaggcatcattttatcctcatttgacatgtggaatccttcaaagtcaccacc

SEQ ID NO: 13501 - DNA, 1619 bp, Homo sapiens
acaattgaacacacaggttgactcacctaatgaagtgagcactggattgaggtgtcagatttgccattttggtgtaatattgtctctctgcttaacttattttaagtttggtgtctgtgcttctgatttcttagtgtgtatacttttttgtttttccattttccactttttaagaatgaatctttaaggttcatataaggtttaaaatatcaactagtggtacagatatggctgtattggaaatagcaatgcagacagaatgaaaacattggctgacaggtggcagcagtggactatgcttaaacattcacttagctgcttcactgcacctgctttagggatgttaataaatacatacatacaaaagagtgggctgcttagaagtgaaccatgccatttttttaatcaccttatgtaataaagtttgaatttattaaaagatggaattatggctggttgtatagctggtaaatttcagccttctggagtcatgtttagcctgattttagacatctgaatgtcacatgctctcttgttcactgctgaatctctatcacctgacacttaaggagggcacttaacatctgttgattatttgaacataaaaatttgtctgcttgttactagaaagccattaactccagaattcctaagacatgaccatgggatattactaggagagactaaagttccatttttgttctacatgggatttttttttctcttctagaacttatttacatttaaaaggtaagtcgattgaaattaccaaaaagaacgtatcaaaggaaaacttgatgacgagtctttagagaaacacagtaggattaaaatttaaatctgattgagctatgaggaatttaaaaatttatttattaccaatattaatgcacttaagtaatttaatgggaccagcacttttactctatttgtgatattggtatgaaaaacctggatattttttctgaatttgctttccacttccttttaatacagtttacgtttaataagaaggagacctgtaagcttgtttgtacaaaaacataccatacagagaaagctgaagacaaacaaaagttagaattcttgaaaaaaagcatgttattgaattatcaacatcactggtaaggcatgaatattttcgattttggggtttatcctttccatatgaaatctttgttgctttgactatataaattacttgattgtgtaaaatatagcaaattaattgatttccttttttttgttactagtggtcgtagcttgaagtagtgactcttagttaaagatgacaacatcatttaaagtatcatcttttaactgtgtttagattactgtaatatctggtacttcttttgatacatagatctggtacatagagtagttatttttattcacatacaggcataccttggggatactgaggttcagttccatgccactgcaataaagcaaataacacaataaagtgagtcacataaagtttttcttggtttcccagtgcatataaaagttatgtttatactacatatagtctattaagtgtgcaataacattatgtctaaaacaactctgtaagtaccttaattaaaaaatacattattgcttacaaaaaaaaa

SEQ ID NO: 13502 - DNA, 1021 bp, Homo sapiens
ttgcctcatctgacacacgcacctcctaggaaccacagttcctcctagaaaccacagtgctagaggaagagttggcctactgtggaagtgtaaatgtgttgcacatcaggcttgacggttcccagttttataacaaattctgaaactgactgcaagataagtgagaatcccgtgtgcccttcctgtgcctaggcccattgattgatactggctcaggatttaaggattcttttggttgtgaggggaaaagaagaactgatcttgatgacttgcctctgattctctagagcaggacttacctagggaatcccatcctgtatgtctcagatttggattatttaataaaggaatatcatattatatttgctagtaccattttctaggaatgagtactcattgctgtctgacagtttggcaaatatcagacttgtaatatggatatttggtttgctttaaagaaaatctgtatttatacaacttttgttttcttctatagcctttggaggtgagaagtggaaaacaaatgttttattaacatcatttctttgtcctgggtaagtgaatttttcaagaattactttcttaacatagttacatgttagtccccaaattttcagtcgttgagtctttaatcctccgtgtctctaaatcatgtacctaagaaagtaaatttaatttttgaaaaggggtaaaataaatattttataaacgtttgccaaatgattaccacatgtcttatctggggaaagtacctttagacatgagaaatgttttaattccttctcttcaaagtctttctgtttcttggtttttagtggtcagtctgacatgttgttctgtaggctgcatttaaagcttttgagccaggcacaggaaggaatcctgaagatagttcaggcaagcatatgttttcccatttttatccaaagcattgccattttttagagtttattccattaagtaaagtaatatacaccaaaaataaaaaataagcagccaccacaaatccaaaacaaaacaa

SEQ ID NO: 13503 - DNA, 1050 bp, Homo sapiens
aactaaatgtggtggtggccactagaagttgccattttatgcgggactccctgtgaggaagcccatagtgctggtagctgaaatttaggaatgcaggtttctaagaaggctcggaaaagcaagctgggctccttggggaggagctattagtacgtttaattaaattttttaacatataaaaagttgttaattataaaaacaacatttttttctaccctgagtgcagctggagctgtgttctgccgttacacaattcctcattaattccacacattgcttacgatcctgtgaagtttagaattttattaggcaataaataagaaatcaaggaaataatatttgtggtttcatatcggtcacttgggtatgaatttaaatccactgtaattcaaacaggtttagtttatttcatgttgctacttgaatgtgttatagcgtatcaattaaataactcacttgaatgatgcagacttgagattcattccctccttctttccttccttcctttctcaccccatcctccctaccataaaccaggtttagaatagctgttaatttagctgctttgattttttgttgttgtttattttgaaacggagtctcactctgtcgctcaggctggagtgcagtggcacaatctcagctcactgcaacctctgcctcctgggttcaagcgatcctcctgcctcagcctcctgagtagctggaattacaggtgcacaccaccacgcacagctaatttttttatttttattttttatttttagtagagatggggtttcaccatgttggtcaggctggtcttgaactcctggcctcgtgatctgcctgccttggtctcctgaagtgctgggattataggtgtgagccaccacgcctggcttttttttttttttttttttttttaagactggtgaagctatgttgcccagactggactgcagtggctattcgcaggtgttatcatagcttactgcagccttgacatcctgggcaccagtagcgcttcttcctcagtctctagtagctgggactgcaggcatgtgctac

SEQ ID NO: 13504 - DNA, 1086 bp, Homo sapiens
gatactctggggttcaagtccaatgctgacccgcagttggcccttgaccttgttcaaggcccttatctagattgtgccttatttttctcacccatcaaaaggaggatggacaagtttcttcctgccagttgacattccagagtctagaaaggaattattgccctcaagtaagacgaccttggggaattcagaaataaaaagtatatagctttttgagctctaagttattttggtccatttgagctcaatttgaccagagattgaagataaaagctctgcctcccccaaacttattggtacagcctgcactcaattggttttaccgccttctcctgacattaagggagatgtttttggttgtgtggtgttgaccctttaggtcctcagaaggggcggcaccctcatggtgtctctgcctgcagcagggagtgctaccaggcactttgttccagtgacttatgatggacacagcacagcgcctaggggttaggattctaaaataattcaggtgtatggagacgcagaacctaaaagaactcaggagaaagagaaggtagatatcctaaattttagtctgattttgactcagaagtggatacctgattttggcctacatttcacctctttcagtttttttctgctccatttgggttccctgctcacttggaaccctcaagctggcttgcaaatgcccagagccacagtgctctcatagggtctgcctgttctagggcccatcagccagcagtccagcagggatgaccagtgagcccaagaaaacaagcagtgctgatgtcagatgtgtagcccttctcaagtgctatacattttaagaaatgccttcactgggcatggtggctcatgcctgtaatcccagcactttgggaggccaagatgggcggatcacgaggtcaggagttggagaccaacctggcacaacatgataaaaccctgtctctactaaaaatacaaaaattagctgaacgtggtggtcacacacctctaatctcagctactcaggaggctgaggcaggagaatcgcttaaacccggaaggtggaggttgcagtgagctgagatcctgcca

SEQ ID NO: 13505 - DNA, 1038 bp, Homo sapiens
tacagacctgggtggcgttagcagtctctcttctgtgaaccagggggcgatttctgggcataatatcacctggatttaaaaaacttaataataaggccacacacgcatttttaaaaaaacttcccttgcctgtggagacagagaggagatagcgatgttattttcaggtgtttgagcttcttagagaaaaagaaacaaataccagactccttaggagctaggtgcgaatggaataaattgaggcactccagcgacacatccagcttgttttaaatgatgtgattaaaaaggacatctgagaacaaatttatgaagttgttatggcaactgaaatacttggattgaaatgtgtgtatctaaaacatgaaagattgcaggaagccggagaaacaagcaaagcattgtgtttgggaaaggcaattgaacagtggtagccaaatattattcctctgtcggtcatccttcagggtaactgcctcggtttccacttttaaaaacgtgtggtgattgatgctttcatggactctgttgccccaagtccccaagccttgtaccagcgtttgctcattggtcctttgacctgttgagaacacaatctctgtattgtgttcaatgcagggatgcatttagagttgcccctgcatctacccattaagtttatactcctgtgttctcatattaacgtctgtgtttgcgaatagtctctctagtctttgattcactaactcccccaattctaacccaccaatggccaccaacaaacagccacactcaaaggactcaacatatttaaatattccctagaattctttgctctgttctaaaagctatgtatcccgtctacataatttgattctattgtaatttctcatggttttaaaattttccttaccagtacttgtaagagtattgaataattgtttctttcaatcacaggcaaggatatttaaaattaacatgtggaaatgtgtgttgcagtgtgttgaaaaatcagtacttgaagtcacatctagaatgcttccgattttttccatcatt

SEQ ID NO: 13506 - DNA, 1049 bp, Homo sapiens
aaattttgcttggcaccgtagtccagtaatcagagttagggctagagactgacactggggactctaggttatcttatcttattaaaatctgttggaaaaagtttaaagattccaaataatctctgctcctatgttaattcccagaaactaaaatgtttttaatttagctgacatcagctgtaaggtttccatccacaatattaatcaaactgactttcttccatccttccagaaaaatgttttttgagatacaacgtgcataccattaattattttagtttcaaattatttggtaaaatgctttaggcaggataaatcatttccacatgatttgttttaaatttataaaggattttcttaaaagttaattccatttttatgtctttttttataataatggtgattccattaatatttgaaaattcttcattcagaactgaatttaatatgcttattaaagtaataggatttcaacagttcttttttatcaataaagaattttatatactgtaaaaattggatacttgaaaacatctcaagcaaataatcatctaatattgatatcaatagaaataattttatataaacacatatagcatacatgtttatacaacatataaacattcaagtatgtatgataacgtgtatttcctcaaatctatattatgagcttagtgctaaagtttttatctttccatattcatcactcttaggcaaaaatgacagctaaaggaaacagtcagttgcttttttaaaacagtcactaatcacaggaaatgttaatataggaatttactatttctttccaaatggagactctaacagaagaatgcgaaggaatagcacaatatattacgtgtgtcaaaattttaaagatactctgctagaatattcatattttgcagtatctggctacaaatatggctttgcttcattttcagttttccagacattctctttgattcatatcatggctgtacgtgctttgtttggttttggaaggattttgtttggctttttcaatatttctccttcgttatagcttcaca

SEQ ID NO: 13507 - DNA, 1050 bp, Homo sapiens
aatcgtgccagacgatttcctaaaagaaagccaaatgttttagcaacttcccccgtcaatatttactccgaagtggggatgcgccagcggcctattgttctcttccgggaagggagggagccgaggtgcgagacaagcttttaacaaggtttaaaatttgagaaatttatttgcatgaaatgctcgctttcgagtcctgtgtctgagcggatgtctttaagaaacaatttaggtgctaatggaatttaacgttaaacggtcccctttccaagtggaacgacgtttgagttctcgcacctctaaatgactccaagcatttggaattctggcaacaggatgcagagacagccagaaaattaaacggggaggttttgaaaggctttgctgactcccccaaccctcgcccaccagcttgtgcctctccgcagtcactagatgctgccttatctctaatatttaccttttcttcaacttatttttttaaagacgggaggtgagactagaattgtggttaattcaatttgcagaattttggatgaaaaatactggctcagtcactctccacagcccggcccccaaacaacacgtagcaactccaaatgtaattgcttactggccctggcgagaaaccgacagcagcccagcagcctgtgtgattttgataatgccccaaatattttgtcataataacagcttctccgtggcgagagcaacttgttagaagctgcaaatccaagaagccctctagaaaggcaggcagggctaggagcttccccacattcctgagaaatttgaggagatggacgtcagcctggaagaaagtaaaatacgaaataaatgagcaggactgtcgggcgggaaggcggttaatttgatcttagttctgccgcagaggggatcggactggtttgagggacccagccccctcaggtccttctccctcgccgcggcccagccccctcgcagcctgagtgggggctctgcaggctctgggtgtctgcagccagcgccgatgtttgccgtccacaggggagaagccgttccagtgtg

SEQ ID NO: 13508 - DNA, 1086 bp, Homo sapiens
gcagggattttttttagtagtaatgttatgaatgagtagaaaaaaatcccatggggaaagaatgtaaattattaaatctttatggcatgaaatataagtagttgaatactaatgcaagcattgtttctcattgtctcatactacttttgataatgggaccctttggtagggtccatcagttaatgacagggatatgttctgagaaatgcatcgttaggtgaattcaatattgtgtgaccatcacagaatgtacttacacaaaccttgatgatacagcctagtacacacctatatagtatagcctattcctcctgtgctacaaacctgtgcagcacgtgactgtactaaatactgtaggcaattgtaacacaatggtaagtatttgtgtatataagtgtatctaaacacagaaaaggtacagtaaaaatatagtataaaagataaaaaatggtacacttgtatagggcacttactgtgaatggagcttgcaggactggaagctggtctggatgagtcagggagtgatcaaaggcctaggacattaccgtcactactatagacttcataaacactgtatacttaggctacacgacatttatagaaaaatagttttctttcttcaataataaattaaccttagcataccataacttttttaaattataaacttttaaattttgtctttactctttgactctttcttttttttttttttttgagacagagtcttgctctgttggccaagctagagtgcagtggtgcagtcttggctcactgcaacctctgtctcccgggttcaagccattctcctgcctcatcctctccagtagctgggattacaggcatgtgtcaccacgctcggctaatttttgtatttttagtagagacggggtttcaccatgttggccaggctggtcttgaactcctgacctcaggtaatccacctgctttggcctcccaacgtgctgggattacaagcgtgagccaccacgcccggtttactctttgactctttcataataaaacagcataaaatgcaaacactgtataactgtacaaaaatgttttctttatatccttatttta

SEQ ID NO: 13509 - DNA, 1044 bp, Homo sapiens
ttaaaatgaaatttttaggacttacatgaggacttcttatttttgtatagggaaaccgatttttaaaaatgctcttttctgtacattttctattaaatcctaatataacaacataatggggggggattgacaaagagtaaatatgcaagaatagcctagataattctgaggaaaattgatggggagtagcctaacatattaaaatacattttaatacattgtaagtcagcaagaagacataggtctatggaatacatttgttagattttaggcagtgggatgatgtgggaggatttttgagttgttaaagagggtctcatgaatattatgtggatttagaagacaaggtaattctaggattgcttgcctctaatttactgagatttttaggtatctcagagaagataagaaatataaggaatgagaaatgtttaatggctttagtgactaggagtttctaaatggacacatgggcccatttcattagtttggtgaatagtgagagcaaagaatttgggaatttaagattgttgtacttctccaaatgaatgttttaagtataaagactagtatgtctttccacaaaaatggtaaaatatattgtcacatttatatcaaactgctaaaataagttttgatattttttaaaaaatgagatctcatcaggttaaatgaaaagagttgagaatcttcattcccaaagaggaaaatgattctgtatatcaacagaatcattcaacctttgactgtattctctatctacgttcctaaattgaacctatctatacatattttgttgctttgtctgtgtacagtcatgttggatttaaatgagaaatatctgattttaccacgttgaaacaagaacctaaaattagggaagtattcactgtgactcacatcttacccaggcagcctgctgttgaaaggatgatccctggtgcgcactgtagtctcagcctcaggattctataatgagattgagtggggtttcctgtgagcactctggggtgattgacagtaaggtgagggcagtcatcactt

SEQ ID NO: 13510 - DNA, 1053 bp, Homo sapiens
gtgatttgtagtatagtcacagagttatgtaaccatcactgctatgcaatgtcagtaaaatccattaacatttaataaatgatcaaggtggttggatttatgtctagcattttattatttgttttctctcagtctcccctttttttccttctgttttccttttctgacttggattattttagtaatttttgaaattccattaaaatttatctattggatctatctatttttcagtgttttttctaggattgcaatatccatcctaacatttcatattctagttagagctaatatgataccatttcaagtaaaatgtagaaattttgcgatcatatagtccatcctccttctcttcccatcactatcctctatgttatagttgtcatatgtatttcatctgcatgtattataaattctatgtgaaaatgttataattttgttataaacatgttgaggtgagttaggacatttctttaaattgatctgtcaaatttaaaatatagagacaaatctctagattaaatattttatttgagaatcacagaattggaatttgagacatacacatggggtcttcagtatatccaaggaacaaagagaaggttgaaggttttattagatagaaaaaaaatgttactgattattttgaaagaaagttcattggtacttgaaaagctttgggagctggcaggctcggataggagagtggcagtggtagtttaaaaactagtcttagagtgatagcaggttgtttcagcagttactaggtaaagctggtcttagggttacagcaggctgtttcagcaactgggcctctggatagttcagttcttggagcctgtgctatgtgccctgagtgcttttttcccctgactccttgactcttatgtagttgggtatacaagaatgacccaattcatgtaatcaactttcacagatccaaatatcattcagttgaaattaagactcattttattttggtccatttaaaaaatgttgtcttttaaaattacatatgtatttttattgtggtaaagcagacataacataaaa

SEQ ID NO: 13511 - DNA, 1056 bp, Homo sapiens
agaaatccagaattgggagatatatttttggaagaatttctgtctaaaagtgttggtggggtatgtgttatggcaagaagagagctgggatgtttaatgggttaacagcattttgttctttatcatatatttattgaaaaattttcctatcccattgtgctaggcactgaggaaattatttaaaaaataaagtagggcacagaacttgcctttccaggaaactcatttacaggtattgggttttgattctttctttctttcttctttggaaacagggtgttgctctgccgcctagccggccaggctagagtgtggtagggtgctcatggctcactgcaccttctgcctcctgggctcaagcaatcctcccaccgtagcctcctgagtaactgggactacaggcgtgcaccaccatgcctggctaatttttgtattttttgtagagatgtggtctcgccatgttactcaggctggtctcgaactcctgggctcaagtgatccgcttgtcttgattccttgtataactgccccttgtattggatttggggactgaaagaacacttagttactaatattcttttttttgtttttctttttctttttttctttttttttttttgagatggaatctcgctctgtcgcccaggctggagtgcagtggcgtgatcttggcttactgcaacctctgcctctgtgttcaagcgattctcctgcctcagcctcctgagtagctgggattacaggcacgcgccaccacacctggctaatttttgtatttttttgtagagatggggtctcgccatgtttctcaggctggtcttgaactccagggctcaagtgatctgcttgtcttgattccttctataactgccccttgtattagatttggggactgaaagaacacttagttactaatattgtttttttctttttctttttttttttttttttgagatggagtcttgctctgttgcccaggctggagtgcagtggcttgatcttggcttactgcaacctccacctccccgttcaagcgattctcctgcctcagcctcc

SEQ ID NO: 13512 - DNA, 1478 bp, Homo sapiens
attcgtaattcctgtaggtactggaaattaactttcatatttctgcaaaatcgatcaactactcccaaacaatagagaatcaactccccctgctgacagaatctaggaaaacatgacacataatattggacagaaacaagctggctgcggacaagctttaatgacctgatttatgattcagtattgattgtaaacatctaaattctgccattaaattccggcaactgcaccaaatcattggcaattctggtagtgcttcctgccagctcatttcaactgctttgagtttcttaatataataatgatgaggtagaatttacattccacttatggtattaattttacatttctctgaatgaaaagggttagaaggtagtaaaattgaacattaaatgaatcggaggagacagtagtgcaatatatgactgccctaaagacattgtgcaatgcctcatgggattaatgttgagtctcatttcctgcttttacaggatgcagaagaagctgtcagaattgcaagggaaattggtaagtccttaaattaactttggtaggatttctgtgtctttcagcagatacggttgagtcaacaggtaataagtaattcccatagagcaaataatactttaatagttttagattttgattacttgttgctctggaagaatgtatcagttgaattgccaaattctattattaaaggagactgtaaagagtaatttgaccttaactatacataactcttttgtaagatgagatcacaggctaattcaaagaaggaattgtcttaagaattctaaagattggatataagtttaatgtcaatttatatgtacatagttgaatgtggtttgttaaaattaagaacatttggattaaaatgaagataccatatgtgacatagttctttaagtttttgccttttgctaagatgttaggtatcaacttaatcttgttagatgggaaagataaaatagatgtgggaaattagaactgaatgatctaaattggaataaaaggtagactggaggagtttttaatggctgttttacatgtacttgtatttgggcagtgtttcccaactttttaatttcttttctttttcttttctttccttttttttttttaagatggagttttgctgtcattgcccaggctggagtgcaatggcacgatctccgctcactgcaacctctgccttccaggttcaagcgattctcctgcctcagcctccctagtagctgggattacaggtgcctgccatcacgcccagctaattttttgtatttttagtagagatggagtttcactatgttggccaggctggtctcgaactcctgacctcaggtgatccacccgcctcagcctcccaaagtgctgggattacaggcgtgagccaccgcccctggctcgcaactttttaattttaaaaatattcttggcggtcatgagaactatttttggtatctgctaattga

SEQ ID NO: 13513 - DNA, 1067 bp, Homo sapiens
attccatcctgtcagacatctttacatttaaaaagctctttttctagttctaggttagatattattatcaacctcattggatataataatactgttattattattattacagtatctacataaaggacaatatttagagaaatttagggaaataaagggattagaagaaaatttacagttacactgcagtgccacattttgaatggtgaattttggacttgcgagcattccctttgtgtaaatagcaggccgtggattgctttgcttcctttatgccttttcttccactttctttctttctttctttctttttttttttttttgagacagacttttcactcttgttgcccaggttggagtgcagtggtgcgatctctgctcactgcaacttctgcctcccgggttcaggtgattctcctgccttcacctcctgagtagctgggattgcaggcacacaccacaatgccagctaatttttttgtatttttagtagagacggggtttcaccatactggccaggctggtctcgaactcctgaccttaggtgatctgcccacctcagcctcccaaagtgccgggattacaggcataagccagtgcacctggccattttccactttcgttataacctgtcacctttaagataaccagctcatcatgatgggcctctgtctaactagttctcatcactttgctttcctccctcaatattttaatgctgtgctttacctccttttcattttttattttttcctactgaagttacctaatctaatctaagtcttttttctttgtacttgggcacatcctttatgactcctttctctttcctgtccttcttctaattcttccccaattactctctcttgcttgtgaaataaatgatagcaatcatggctattaagtataagagtactggtgttttgcttatactgaaagaaagggaaaccataaaatttgaggtaaaataaaccataaagaactagggtcatcagctcttacaaagcttttagaatttctctgaaaatctcttctgaatcacctcagaagcctcgcataaaatcttt

SEQ ID NO: 13514 - DNA, 1051 bp, Homo sapiens
tgaagtgctactttctaaagtaaattaaattatgttttattaaagtctgttggctttctgtgttgtttgatatttcgtaagttttttactactgattttattgagatatatcacattttaactatgattatgattccatgtgaaaatgtgttcctagttctaaacaactgatttataatcaaacctttgaacctatccatttgtaagttgttgattgtccatgtgttatacctattcatagagttctctcttaattctttctgtgttatgtgatgaaaatgaagtttatcctgttttatgtgatttcctcctctctcatgtctttgcttttcttctggaaacattaatctatgctgccaaagtaggaaactcactgtattgagcattgatgaattaagtgccttttacataatggtaactccagtttatggagcatttcttcctaaggccaggcactttggaaatgttgtttctaatgctaattcttgggtttaatcatttttgtttacatttaaggaaactaatgattagaaatggtaagtaatttgctcaaggtcacagaactatcgagtggtggaccctggtttaaatttaggtttatttgactccaaagaccacagactttttattatactgtgtctaaaccaatgggattagaggatggcagctaaaatttgagcgactactttgtgtaaaatactgtaaggtactcaaatgtgttatacatggaattaaagaagcagacagtctcctatccttgatgaggtgagagacagttaagacttaatatgttacttgtatgtatttgttttttggactacctagtttctctcattcttgttcctgattttttactttgacctatctaagttgagagatacagagctattgatcctcagtttgtctttaacctcaatgatagacaacagtaatcagtgagcttgatttccattgaagtttgatctttttactgggccaaaggtccttaatacaatcaagtcaaaattgattcttgaaaggaaaataaattgtgaatctaaaacctgtcctt

SEQ ID NO: 13515 - DNA, 1027 bp, Homo sapiens
gatgggggcaactgtagtagtggggagttctgctagtaggccagtacaagagtcctggactgctggtagtttgtgtaagtattatgattaagtattatgataactgagataaagaaaagtgaatagatttgatctttttaaataaagaatttataagagtttcatactatccagcagttgtgctcttacacatagatccaggaagctcatatacaaagttccagacaacaagtacaaaaatattcaaaggaccattgttatataaatagaacaggttacagtctgaatgttcattcacagtggaatggataatgctgcagtatgtttgtaggtgacatagattacagcagtaaaaataatgacttacagctgctcagattaactaatagatttacttagtaactcttactttgcatgttattctttaggcagtttcagccactgcagaaacaacaaagaagacaggcaaagatctttgtctttatgtttttttaatcattgtgcagtgaacaatgtagatattgactaaagcaagaatcattaaagttcatttttaataatgggtgaaaattgtttggatataggatcatcacagtttcaaagtatcaatctacagattatttgctaagaaaaaatggcatactttctgtgaggaaatttaatggatgccatcttaagtaatcaagctttatcagtttgggataaattgactttttattttacttttgatgcgatggaagaactcgaggatacaatatcaactatgttgtatttaagatttgttaaacatcttgaatttaatgagtgaataatcaggtatattcaaattgtggaatattctatcaaacaaccaccctgggttcttcagaaatatcatggtcatgaagaactccccccgccatcagcacaaaacaacaaacacaaacccacactttcccttctggggaggctgagggggttcaaaaggcaagtgaactactttacattagaggagcacaaagaaacgaaacaaagcaatgcgtactat

SEQ ID NO: 13516 - DNA, 1033 bp, Homo sapiens
attttattgctgttatgttttccttcattgcttggaatcattcttgagtttcagaaagggtttgttcctaaaaattaactttacagtcatatattaactatttattttacattttaccaattatagccatgatctttatttgatttttttcagaagccatatcaaatattaagattgatattatctgctatttataatgcacaaagaaacagaatgacttgttcagagaagttgcatagctgtttggaactaaaattagtgcctggtctttgggcttctaaaacagatcttacctctgtaaacctaatatatgtattcagaaatataaatcaacaccttaaatctgaaaatagattggtccgtttctgaaaatcagatgttctaggcaaaaactttaatgaagagctgcttttgagtttccagatttagctgaaaaagatacatgttaaatttgaatttcagattaacaatgattttttaaaatcactgttccatgtagtacttgggacatagctagaaaaaaattattcattgtttatctgaaatttaaatgtagctggatatcttgtattttatctggcaatctcagcttattttccattacaggttgaatgtatctcttaactgaaatgcttgggaccagaagtgtttcagatttcagatttttttgggttttggaatatttgcatttatacctgctggttgggtatccctaatctgaaaattcgaaatgctccagtgactgtttcctttgagcgtgatgtcaaaaaatttcagcttttggagcattttggatttcagattttctggttagagatgttcaatgggaaaaactattatgtttgtatattaactccagacctttagcagtttcctagaacaaaaataaaccacagtacagacatccatagatagataacagattacatattgggtggaaatgcatacaatgtcatttcccaatcaacagacatttaataatgttaacatcaagcagatgtttgtaataaagctgcggtggcactcctcagca

SEQ ID NO: 13517 - DNA, 1024 bp, Homo sapiens
tttaggaagatcctggaaggtgctgaagctaattacttggtgttgatctgaagttagacacttagctagggagacttgttagtatctttttcttaagaaaccatgtgctgagctagaactagtactgtagtactgtagtatggaggaaggggaaaaaggatacctgtggaacagtaagagtcttcaacacacatgtcttgcaattttctgtttccttgactgattatcaattccaattcaattaacactctgtttttagtaaaaacctactcaagtgttacctgggatagaaatctttcccagactgggaaccttgaatcataaaatgtgtttgttttttctctttgtctagaaatacaaacttttcataatgaataccttatctacttatttagagaaaaaaaggaaaatatacagcagtaggaatcaaaatgaaaaagctagaactcatcattaatactgacctgatatgtatttgtacactgtgaaatgttaaaataaatggaatgtgtagttttcagttcctggagtaagaatcggctgggcatggtggctcacacctgtaatcttagcactttgggaggctgaggtgggaggattgcttgagcctaagagtttgagaccagcctggacaacgtagtgggacctcatcttcacaaaaaagtaaaaaatcagctgactgtggtggcatatgcctatagttccagctacttgggaggctgaagtgggaggattgcttaaccccagaggtcgaggttgcagtgagccgacatcatgccaccagattccagcctgggtgacagagcaagaccctgttctcccccaccccccgaaaaataaaaataaaaaaaagaatctactaatgtgctttgagggcaatgctagctagggtcactcatatctctggatatctagcagggcttttgaaaagggcaagggcaagatcaaataggagaaagatagtttcacagagctgcactgagattctccagatgttatgctattaattgttagttggggtttt

SEQ ID NO: 13518 - DNA, 1083 bp, Homo sapiens
gaagtattttgattagcttttaaatacttcagattccaaaacttctttctaataatttaataaatgttctgtcctcagtaactgctcatttttaaagttttgcatggctaacctccgtgccttgctgctggtatcaaactgggaaatgaaaacaagaatcagtgatgtactaactcactcgttggctggttaacagcaatcagcctcttcaaaagaatattttgaacttgtgctatccccctaccccccaccccaagaaaatcacaaaatcagaactctaattggggctttacaaagcaaagccataggaaaagctgtgtaaacatgaaagcctcaggggagcaacagtaacagaaaaatagtgttttacagttgagagggtgaggcagaaaaggaaagtgttacagacatgaaaggcccaggcccacattcctatggagctgaggaccaggcttgacgaggggcctcactggtgggctcagaagggtctggcagggagtgcagttagcaagggcatcgtccatgccatgcttcagctggaagacaccatcagagagccacagcatcctggcatagtgatgtaggaagtcttcattttttattttttatttttgctgttttttagtttcgtcattcagtggcagaacaaaaaatgtgttgcattacatattaacggatcaagattttagattgttttcctattttccagaagttgaaatgttatttgagattgaaattctctatccattttctccatggaaatgaaattggtggttacaaaaaaatatctacacaatatgaattacttttctttttttctttttttctcccaggtccgagtggacagtggcatccaaccaggaagtgatattagcatttattatgatcctatgatttcaaaagttagtttaatttctcaatggattatttgatttcttcgaaaaatcaatgatatttaaagagtctgaaactgggcctttatctgaatcataagctataattaaacaactaattatgcactgatgtaaatgtgaaagcagagcaggttttttctcttgagagaaaattcagcgttatgttagt

SEQ ID NO: 13519 - DNA, 1035 bp, Homo sapiens
aaacatatgaaaagataagtataatattaatatagctttgtaggtgccccaataggggattgaaaaagggtagtgggagtttaaggaagaggctagcatatctttcttttctcgcctctcttggtcctttgaaagtaactagtactgctttaggactcatagtgtctctgtgtctctgtcgagagtacctcactttgttctgctttcaaatgatcctcagagtggcaggatttttaaaaagactggtaatgtcctgtgtaggtgaaataaaggggatgggcacgctcaagcgtctttgcagtatcacttgttatagtattttgggaaaataatctggtgttagatgttaaaataaaagtgcataccctctgacccagctattcatcttttgtgaatctttcctatagagttaaaaaactgaattatgagcatgttcaccatgacatttacaacaacattgtttgtagtagccaaaatgctgaccaaccacagtgtccgctaaatggatgaatgactgaataaattacaatgcattattactataaaatactatgcagctgtgacttaaagacctgtttgtatgaatcgttaaagtagaaaagcaatttgtagtcatgtgtagtacattctcatatcacttgaaccatcttctcatcctaaaatattttaaattgtgttggatgagcacagagaaaggtgtggacatctacatatcacaataatttttttaagctcaaaggatttatgagagaggggtttttcttgacacatttctcttagactttttaattttaggtattttcaaatctatagaaaagatgaatgaatagtactgtgcatgcctgtgtactcttcacctagattattatttaataaacttttttttgatatttgctttctctatttctccctttctttgccttttcctcttcctttctcacccttcctctttcctttcctccctccattctcttctctgtttttctcctgatccatttgaaagaaggttgcaaacatcatggcgcatcactcctg

SEQ ID NO: 13520 - DNA, 1050 bp, Homo sapiens
ttcctccctaatgttaccatagccttagctacttatctttgggtccttctcatctttctgttttccttcccagccaggaaaatctgtgtaagtctcaaatactttcctcttcccggaacaccaaagctgtcatttcctatgcaggtgaacctttctggcaagtgatacctcttttctttttcaaaagcactctagtttgtctctttgtgaaacatgatcaagggattaatttcccatgttttatttagcctgatctctttcaaggagctttttacatttttgcctacctaattgatctttctaagcatcctagcatattgccttcagttgcttttcactttcatctaaacaaaagcaacgccacattttttcaatgatttcttaggtatattgatgtcattagaaatttcatctgccttctactatgtttctcattaaaaaaacttattaaagccctctgaaacatagttattatgtatgggccaagtaaatcattacccacagaacaagcatgaaatagctgtgtagatctcatgggcatgcgctatagaagatctgtgtgtgtgtgtgtgtgtgtgtgtgtgtgtgtgtgtgtgtgtgtacataaagcaatctataatatatatatatgtatatagtgaagaatatgatcgattctgatatatataactttttccatggaatttttgtgtagctaaaggaatagcattaatttgaatttgtgaatgttttctaaacgtcttgaggcagttttgataaattgagaattggcctttataaaatttagatacatagcatctcttgagtcaggaacagaaatgctcaggattttccatatggttgtggatatggtctagtataaaaggatgcataggaaaatgcctgggagggtatacatgttaagctgttatcattggctagcttagagatggaaagtcatattgaaaaggtgtgccctgctcgctcaaacacatgcactagggtacagggtaacctgctgtaacaaagatttctaaatacagtgggataaataagagagacgtttattta

SEQ ID NO: 13521 - DNA, 1090 bp, Homo sapiens
cataataaatttctgatatttaaagtattcaatttcatgagttttgacatacgtatacacctgtgaaaccattaccacagccatggtgttgaacacttctttcacctctggaagtttccttatggtctttgacatttaccctccctctacccctttcccagtgtaaccacatgatctgctttctgtcactgtaggctcgtttgcatgtcctaaaattttatattaatggaattatacattattatgcattatttttggtcttgcttttttaactcagcataattatttttaggtttatccttgttatttaatgtgttattgactctgtgtgtgtatgtggaatagaattccattgtatggacaagcccagttttgttaattcatttgcctcttaatggagatttaaattgtttccaggttttgattatagtaaataaagctgctattaacctttgtatgtaagtctttgtatagacatatgtttttatttaacttgacttaatacgtaggagtgagttgtctgaatcagtgaatatatgtttaacttttccagaaactgccaaactgttccaaagtgtgtgtatcattttatattgccaccacagtgtgacaattcttgttccatatcctgactagcacttgctattatctgtcttttcactttggccatgtaaatcggtatattgacggcatctcattgtgtttctttaacaataatgatgttgaacaatttttcctatgcttagtggacattttgactgtgtttttttacttggtgtgttttttgtcttataattgtgttgtaagtgttctttatatgttggtagatacaactcccttgttcaatatatgtattgtgggccagacacggtggcttatgcctataatcctagtactttgggaggccaaggtgggtggatcacttgagcccaggagttcgagaccagcctgggcaacagcaaaaacgtgtctctacaaaaaatataaaaattagctgggtggccgggtgcagtggctcacgcctgtaatcctagcacttcgggaggccgaggcgggcagatcacgaggtcaggagatcgagaccaacctg

SEQ ID NO: 13522 - DNA, 1055 bp, Homo sapiens
atatgtgtgtaggagagaatgttgcttttgttttaaaacctgaatttcatattttttattcttttgataaatgcagtattcagatcctaattcctttaccttcagatgttatttggaccttgattatttcagaagttctgagtgtagctaaatatgactggtttgatttttaagaaatgtatgcaagttattttcagagagtgctgccttactgtgtggaagaatctgaaaagggcttaaaaagatggagaataaaaattacctgtaatcccataattattcaataattacttttaatgttttggtagaacccttcaaagtatatatatatatatatatatatatgtatttatgtgtgtgtatatatatgtatttttatatacatacatgtagcatttatactttgcataattagagtcataaacctgggaatatggtttgaattacttgtgcaagataaacagcagtatattgaacacccatgcacacattatctagcttcaatgactgtaaaaaatctatcttccttgtttcatttttacctctacccactccacactttccccatttgttaattttttaaggtaaaatatacaaacacacatatacacttcttacctgtacagtttttgtttttgttttttgagacagagtcttgctctgtcgcccaggctggagtgcagtggtgcgatctcggctcactgcagccttcatctcccgggttcaagcgattctcctgcctcagcctcctgagtagttgggactacaggcatacactaccacatctggctaatttttttttgtattttcagtagagatggggtttcaccatgttggccaggctggtcttgaactcctgacctcaggtgatccacccacctgggcctcccaaagtgctgggattataggcatgagccaccgcgcccagccttacctgtacagttttaacaaagggatgcttgtgtgtaactcagacgactctatctttacatcgtctcttccagtgcactccctgcctccttttgcttgtggtgctacctgcggtgtgatttctt

SEQ ID NO: 13523 - DNA, 1031 bp, Homo sapiens
tcaaaaaagatatagaaatggccaataagcccataaaagatgctctgtatcattagttgataggaaaatgtaagtcataaccacaatgagataccacttcacacccatgaagtggtgaagatgtggaaacatgggaaccattacatgttcctggtgggaatttatgactacagtgatatgaacttgggaataatttgacagattcttaaaatattagacgattaccacatgacctagctattccacttcctggtatatacccaagggaaatgaaaccatgtgtgcacagaaatgttgtatacaaatgtttatagtggcatttttcataatagccagtggaaacaaccctaatgtccttcaaatgatgaatgagtatataatagtaaataaaatgtgatacgttcatagaatggattatttttcagcaataaaaataaatgagctattgatattttctgcaacatggatgaattttgcaaaaatgctagatgaaataattcagtcaaagtagatcacaaattttcccagaataagcaaagctatagaaatcgaaagtacataacagttgcttagggctgaggaggggaatgtagagtaactgctctcgtatctaatgtttcccttatgaggcaatgaaaacgttttaaagttgcttgtggggatggttgcataactctgtgactatactaaaaaccattaacttgtacacttcagatgggttaaatgtatgatatgtgaatttcatctcaaactgtttaaatgtatatagtctgttacacattttatatttaagaatttgttttcctaatggtataatagatgttcaaattttaggaattaaatgaggcatttcttccttctagtttgatggagtctttgagaatatttcttttcaaattgtaaaatatgtttctatgtctgctctcaatttagtgcaagagtagctcttgggggtagcaatatcaagtgttcctgggctaccacctggaaggtggaagtagtagatgtatgtgaacccgcgttcttccatc

SEQ ID NO: 13524 - DNA, 1048 bp, Homo sapiens
cccagggatcccagaagatcccagaactgctggaatgctgaatgaactgagctaaaatttcagttgcctaccatggttatgataatgttggaatctgaatctcatcaatttgaggtacttgtaaacaccttgagctttccattaaaaccctggaaggaccatgccttgggagaaaagactgtttctggaataaatggtttggactttttatttattgagagcaaaaccaaatagttcctagtacaacataaaagtgagcctccacaacttcaggactggtaactagcaatgtaactgcctgctgtaataaaaatcagtacttttcagagggagataacatgatgagtgaagtctgacaacatctccacaatacagtttacttggcatgcaatctaagaataaagacaactataatccagaggaaaagcagtcaacagaaatcaaccgtgagattactaaaatgtttgtttcatgggcaagagctttaaagtagctattaaaatcattttcaagtattaaagatgaaaatgagggaaaaatgggaactatcagcatagaaatggaaattaaaacacactactaagtggaaattccatatctaaaatgtcctatatctgcaatggataatttgctggataggctgaaaagcatactggtgatggcagaagaaggaataggtaaccttgaagatagaagaatagagattatgcaatctgaaaaaagagaaagaaaaatgtgtttaaaaaattgaagagacacaaaaggacaaaggaaacttttggaggtaaaacatgtttattaccttgattgtggtgataatgtaatgaccgtatgcatatgtccaaactaatcaacttgtgtgcattaaacatgctgttttttaaaatgtcaaatacacctcactaaaggtgtttagccgaggtgggcagatcacctgaggtcaggagtttgagaccagcctggccaacatggtgaaaccctgtctctactaaaaatacaaaaaattagccaggtgtggtggtgcacgcctgtaatcccagctactagg

SEQ ID NO: 13525 - DNA, 1073 bp, Homo sapiens
ataagtgggattccaaacagaatccatgtagcgttttaatgaattcacatttggagaaaaaagtcacagactttcaaaacttacaggaatttggctgtcctagggcaactcctcacttaacagcaagaggggatgagaaggttgagtgactcacccagggaagtgactcacccagggaaggtcaagtgactcacccaaggttacttggtaagtaaagagagaagccagaagcctggggcctcctgacggctcctgcttctctttttactaaggtcttctgccatgggaagaaactctgaatgttagcaaccatctggatggtgttagttgtatgtctctctatgtatgttgaaaagaaaatgttgaagaattgaatttctcctgcttatgggttgtgtcacatttaatagcgttctttaagaaaaaaacacgattgctcaatatgattatatgagctcaccataaccaatgacaggcagaaaatcctgggaggatagacactaacaccacattatcctgttgggataatatcccaaattctgaatataactttcttttaccactttaaaggccaaaaaatggctgttaaatggagtatttttgtcaaaccaagtttttaaagttttcagcagctgcttctgctggcttttattaactactgaagagtctttttttttttttttttttgagatggagtcacgctctgtcacccaggctggattgcaatggcgtgatctcagcccactgcaacctctgcctcccgggttcaagcgattctcctgcctcagcctccctagtagctgggtttacaggcgcccgccaccgtgcctggctaatttttgtatttttagaagagatgcggtttcaccatgttggtcaggctggtcttgaactcttgatctcatgatctgtacacctcgggctcccaaagtgttgggattacaggcatgagttaccggaccctgcctactcaagagtcttaattgaacatcaaaatcctggttttgtttataaggaaaaaaagttaatggtgcaactaggactaattctttgattaattttttaaccacttc

SEQ ID NO: 13526 - DNA, 1058 bp, Homo sapiens
gtagtttttttgaaagtatgttgtctctcgttaaaagcattctgtttaaagtctttaaagtttaacttttgtacttttaaccctttactgaaatccagtaataaaatttcaccgttattcaagatccatctcccagcatccctgactaatcctactgtatgctgatctctcgttgatcagcccctggctatcttatcctcctttctacactaaacactcatcctcctccccacaatgtcccttcccttctggatcctttatcgtgctttctgattattgaggtagcattttggaagtaacgagggggagtctggccgaatctgcttagaaacccctgggaatcttgattcctggtgtgtgttcttcagcaccactctggagtacagcacatcttttgtgaatcagaagaggatcaggtactgaattccctcccggtaactggagttatatagttgtcgttgtattaataacttaaagacttagaacaatgacagctatcaactcatttggggctttattacaaagtaataatgcttttcattcagctgtggagtgtgtttactttttataggatgagtgggaggaaaacagctgggataagtggttcaccggttcttttgtcaggataataagagggtcagaaaagtttggagaagtgctgcttggtagaatttgttggtagaatttccagatctgtttctcacattattctgttactctctctaaagtaacaataattttcaccccacagccttgttgtgaaaattgattataagaggactggctaattacatgtgacttttttaaatgctcaagaaaaatattaaactattttggcaatgatatttattcttttttgtatatataatttcaacttttattttagattcagaaggtagaagtacaggtttgttacatgggggtattgcctgatgttaaggtttggggtgtgattgatcctgtcacccaggtagtgagcgtggtacccagtaggtagtgtttcagtcttatttccaccccttccctttgggatccccagtatctgttgttcccgtctt

SEQ ID NO: 13527 - DNA, 1030 bp, Homo sapiens
gctctccctgccacatttctgctaattgtttagcgcgtatctctgcacttaacgggtggcctcagatgactctgttctgagcatctgtcaggacgcagagcctcagactcattgtcactccaaatggaacaaaaactggttgagagaaacagtgtttacagaggattacataaaggagaagctattagttgatttctttacagtggattttgaccttgcttatgtcatgtttccttttagattcttgatgaaagctctagattctttccacagaaaattgagagatgtgtgaaaatgtcgagaaatacataaaacaaaagccttttctctcatcctccccacttacatgtaccctgctctgtgtatgagcctcattttgatatcctttctctgtattctagctgctacttgaattcagtcaactagaccttcagaaagttataaccttgcaccacattcatacttgtcctctgtcgtgttatttagagaagtcagtaataatttatgttttgatgtgttggttgtattgttgagtcattccaatgatggtggttataagaaactgacctgtggaatgtgtcactgtatttgctgtgagaatgttgttaaggatgatgatttcgttaattccttaatcatgtggcagatgtttattgagtaccttctttgtaccaggttgacaccatagaagctactccatggactctagattccatggaagcaagtgttgggaacgtctgaaccagtctaggaagaatcgagaaagatttcccaaaagtattaataacatcttacattgagacttgaaggatcatcacagtaaactaagcagagaggtagaaagggtgggggaaagatccagaggatgttggaggaactgtgagaagtttggtgtggccacagaggatatgatgggagcaggaggtgagggaggtgagcagatgattattaggggcattgctctggagtttcaatgttaagagccgttggaagacatggaaggttttcagcaggagtcaaatgtaggggc

SEQ ID NO: 13528 - DNA, 1048 bp, Homo sapiens
tacttgtttttgtttcttaattttaggtctgaaagctaataacattgactacacagttcattcagtcagaagagctctagaaaacactgcagtgaaggctgacaatatagaagtatttgctcaaggacatggtattattcaggtattgttgcctatatgaaaaatgggttgtaaagcatcattgagataatatcttagatattattgggtaatattttgttttataacagtgattcagtatatctgaattatggattatatggccatagaactacaagcaaaaaggatacacaaacaaattttgtagttaagacaaatctgttgcactaagatcaagaaatgtaatagatggaggccatgtagaggttagaaattcaaagaaatcgaggtcaaaaactggccaatcataacggcatagggattagttcctaaatttggtcacttgagaataacagtgtgaatagagtggagtggaagatgtgactggtgttgtttctaaaaatgtagaattgtcctcttagttggggtactaggtagttttgagaggtgaatatagacactaactttttgttttacaactgaaatcaaattgattggtaatttgcaacaaaatattttttgacccaaccatttatatcttaccatgtatattattttcactaggttgataaagcctatgactacctcgttcagaatacatcatttgctaataaattaggttttactgttactgttggaaataaccgtggcatctacctccgagatcctgttcaggtggctgcaccttcagatcatggcgttggcattgaacctgtatttccggagaacacaggtcagtaataggctggcagtaagctgacgtattcacatttgctgtttgaatgagtggtatcataataaagaattgctgtttgggccagtgttgtgaagagaatacatgaattgacagtatgattattttaaatcttagtcataagagaaaatattagagcaatttggggtccttgtacaatggcaatttagttagcatcttaaactaccagggaaa

SEQ ID NO: 13529 - DNA, 1050 bp, Homo sapiens
aggtgggatgggtggcaaaagtaatggaggccagtgtaaatgctggaccaaagaattgttgtaagatcaatgagatttcaataaaactgttactgaaacacacatcagtttggttataatgttagggaaatggattggtttcagtgaattttcacatttcagttttataaagtaattagaggtcctgaagtatgtatatgttgctttattaatgaatacacatagccaggtgtgtatttttaaaagtttgtaagagagcagtgacttttataagtgctaaaatactgtgtgttctatattttcaaaattttttaccacaagtatttttaatgttttttaaatgaaaaagtctcatgtcaataacaatattaaaaatttgtatcagaaattatatgcaaatcatgccaagtaatcttttttgttttttaatagcccaagagtggggaagtaactccaagctgcccactactttgtgaactattatatgaatctgaatttgacagccaactgtggattatttttgaccagaacaaaagacagatgggttcaggcgatgcctatccacatcaggtataaaattgatggtgatttttagaattaacggaagctgtttcctgaactaacaaaatcctggtttcttgttatggtaatgttcatactttaaaaaaaacaaaaattatagctttgtgtttagtacttttgcaaactgtgagagcctgtttgttgtagtcggtgaagaacagatggtgtcaactatttcaccatgtagttgtgctgaattagaggaggacaagggtgaaccttgcccacactggccagcataacttttggtgtgtggtgtttctccttcctatacactgattctacctatctgaaggtagaatcatcaaagcatgcatcaaagagatgcgagcctcttgaaatgatcctaagtctgagggggctaaagagagcactgcagcagtggccgcatgtcttcagttcatttgtacttttaaatttactacctcgttggacaactctgtaatgagcacttactacataccaggc

SEQ ID NO: 13530 - DNA, 1091 bp, Homo sapiens
gtttatgtgaagcttttaaatttttgagtattcagttactaacaattttaagaactaaagaaattgccattttgaaccacaatttaacttatagtgcgttgtgttgcccaaagagtagttattggtttggcaggtgagtttgactttctgaataacactgttcagtttgaacactgttgaaatacttcatgaatagctggaatgccttttttctaaacttaacattaaatatatactgtagagaaatcttcatagcatttctgctctgaagattcttcttgactgtctttttaaaccataatcaagatttctcaagaataaaggtacaaaattatttctattaaattggtactatgttaaccccttgagaattgtcataaaaatattaatatttattggcacaaagaagaaattattgtgatacagcaagtgaaaatagcgccatttttcttttgattagaaattaaaactaccaggtttataatttttactaataaaaaattccctgtcctgaaacatcttgtaggattacactaacatttataattgttaatttgatatatttaacatgtaaaatgctgattacaaaaccttgatttttgtttcactaagataattcatcataaactttctttgtctctttttttgcttttaatgatagtctaaggttactaggatatcttttttcccacttttgataggtctttgttagaattaattgtaaatcctaaattaattttaatagattgttcattttaaattcaattctcttttctcttctgtactaaaacaatagcaaatacctctgagtctgaggaggaagtgcctcacaacacataggctgcctgcctaagagcagcatacctctctccctgatacggtgaggaggtgtgggaagctcagggagaaagactggagaccactcttctagcacactgggtggcagagaagctcaattccatggagaatggagctatattaacagaaagtaaatattggaggccacttagcccctttaattcctagatgtgttgtctttgctgtacagatgacactgatgcagtctgtttccataagaacttggtggtaga

SEQ ID NO: 13531 - DNA, 1011 bp, Homo sapiens
ctagcccaagcaatagacctgtttccttttcccagtctcatgtttcacgtgaggcctttgtttacaggttctggccccctgacctcagagggagaatgacagccagtggctacaaatggatttatatggttatctgacatcaaagtggttttctgtgctttaaatgagtcagtgtggagataggattattattttgtgttggaatactattagaactacaaccatagttcctgttgtttactgttacatcattttataccccgaaattgtgttggtgaaaatatttaaaatgggaatatttgtgtcgtatatgctcctaaaaatcctatttgcgggaggtgaggacttgcagtattatttttttactcaaccagagtaaagctttttcagtgaatgtctttttgggaacatttgtttcagttttacaaactttgttaattaaaatgaatatagtattttaatttagcaccattttaaatgcaaacctgaagatagaatttgaggaactgacttaataaataacgacttaattaaggacacccagttactgtgccaaaaacaaatctagcaggtatagcatgtgatttcatttcccaaataatgctttacctttcacaagtcaagacttatctgtgaataaaataaatacagttactctccatttctctgctgctgtcttcaaagcaaaacttctcaaaagaatcacagacatgttgacttccattctcttttcatctctgtctcctccagcctggactgctccactgtcccctgacactgttcttgtccgggggggtcagtaggctctgtgctgccgggttttcagttccttccttcttcgtcgtacactgcctctcagctaaatgggcagttgatcattttctctttcttcttggtggtttttcctcaaggcttccgtgatcccaggtgctttttgctttccttttctcactcacagagctgctttttccattcactatccctaactgaccttattcatccacatatttt

SEQ ID NO: 13532 - DNA, 1033 bp, Homo sapiens
gaaataaatgataataaaattaggttaaaactatctggcaacttttatgaaactggttttatagtattagggagaataggaggagagaatttatagttttgcctttataaaacctaatgctgtgtgtaaatagagaagcttccctgggtttatgagtggttggtatggttccttccatgcaagtgtgatttccgtatgttggtgtaattaatggtccagtgactctgaaccaagctgccatttggtcactttcacccttccatgaactcttaaaccatcacctcatggtagctctcccagtgtcagttacttgtttatcacttttgtttatttttgacttacaggatcattaactaggtagaaatatcctgattcttttgtggttattataactaataaaccaaaactattcaggctacctgaaaatactaaattttccttaaaaattttctcagtttcagtcagtatttttttctacataaaatacttggattccaaactgctagaattctttccattatatcatttatattgatactataggatcttatgaatcttacaagcaataattttcaagtgggatagaatatatttaaaattgcttctttggccactattattaccttttcatatttttcaaaagaatagtctcaaaacattgccattttgttgttgttgttaataataacagaaaatacagccaccatttattaagtgccgattatgtataagggactattgagggcattttaaatacattgttttatttaaatttagtcttccaaacaacatggaaggcaggggcctttgtatcccccttttaaggaagagaaaactgaagttcagagagtttagatgacttggcccaggtgccactgctaggaagttggaaagcacatagtcaaatcaggatctgcctccacagccaatgccctttcttttctctgtatattcttctcccttcttgagaaggttaacataactcagtattatctcacagaaaaaggagcatcgtctgcctcccacccatcct

SEQ ID NO: 13533 - DNA, 1050 bp, Homo sapiens
acattccaaagtagagaccaaaaatatatataaatgattataagtatatttgacagatgcagtaattacaggtaaaaacttgtaccaaagaaaccatgtttatataatctaatacttgtttttttacttctatcctcatttgcaattttggcattttttatttctatcctgatttgcatctttgtaattatttatgttagctctggtttcttgtgcatgaagaggtatttttaagtggatttccacggctaataatttctcatattagttttcttcccaaaaaacagatggttcattctgtggaatactcagctcttttgaagacaccaattttctttttcaaagtttttaaaaatgtactctatgtaccatattcatttcaaaagctacacttctgttaaagccttaattttatggttaaagctaatgccttaaaatgtaaattattttataaacaagctttatcatgttttacattgtaggttttgacatttgcatataaacatgcattagtaaataaaatgtatgggagaggccttaaatttgcaactaaacttgtggaagaaaaaccaacaaaagaaaactggaaaaattgtattcaagtaagtgatatttaaaatgtcactgttaagcatcactttgatattgcatagtgacaagataactagaaaggattaggactgtgatatagcaatactggttttattgtgaccagttattacagtaattagcgtaatatgaactatagaataaatatatgagagacagtcaataagctatttaaattttaaaaacacttttcactgctatccaaaaaactgatactagcctcaaatgttttcaacaagggcaaatgcattttgaattttgtaaccgtagaagccagtttttctttatgaaggaaacaaatccttttaaaggcatgttgcctcaactctaaaatggttcaacttctggagtttatatttgattttattcttcatttgagatggtaggcatttttaaaattatcttaccatatacaatattatgtgcagagaaattttatag

SEQ ID NO: 13534 - DNA, 1337 bp, Homo sapiens
agaagggaggaacacaggttaataggaaagagggaaaaggacagttggtagggataatgatgagaacaataggttggttggtaggaaagttggttgatagtaagaaaagttggttggtgggaaggaggatcaatgggtgggtgacggttggtggaaggaaggttctatatgctactaccttactgttactatttaatacagaatttattctaaatactgagcttaaaaatctgtcacttcctttataataatatattattgtattttgttgtagctgatgaagttacttggatggacccattgtgcatcttttactgaaaactggctccccatcatgtatcctcccgattattgcgtattctaaaataggaaacaagactttaaattttaaaaaaggaagttttatagtgaatgggtataaaaacaaatttgtggcatttttagtctaatgcatgttttcatccactatccagtactgattattaaaatgacatgtatttatcagagaattcactgacgtgtggcttaatacatgtaaatctagacctctgacatcatggtgttttcttaatgcctcacattgctggcacggggatgtgccctgcctgccagcacctaggacttcgagttgggttgcagcttatgacatgcatgataggttttggaaggtaacttttaactgcaaacctataaagtactattttttattttataaatgaacagggttttaacgtgctcaactttaatttttttcaattgtatgaaggccttaaaaaagctacattaagcgtagctaaaattatttattggactaaaaactaacagaacttcatttccagaattttttttttttttttttttttttggcaaatgtttacattcaattaaggggaaaaagtagaaccagcacaaatgagtggcagttgctggagcataactgcttcaataaatcttcatcttggggtaattacaggcaagtcattttcacatcctcttgaggttcagagcatcagaatgaactctatgaatacatgtgtaagtgccagacagctgaatctttatcaggtattgtaaagatacacatatgatatgtttattaaaattgaaataatgtaaaacacatgaataaatttgcaaaaccaagatcacagtacaccatatgcactctggtaccttaatttttttttataaataataaaagtgaatattgaagcttcttaaagttggtcttaatttttcataaataaaatttggggttataacagaaataatacattaaatacatagacaaaaaaagttaaacataagataatctattttacagtgtttcttatagg

SEQ ID NO: 13535 - DNA, 1030 bp, Homo sapiens
atttctctttaaggtaggggactattattgaaaatacatgtattacttcattgtgtttgcaaatatcacttttagaacctgtggcagttatttatttgttattattttttctttgcactttctcagcagaattattaaggcagttacttcttaattttggtgcataattaatttttgtcatttcagtttacttcatcttaagcattttgcttattttatactcttgtattctaggcaatgcaaagaaacaagtttccaagagaaaaacttcagataaaaagggaagatatcagaaggaatgtcctcagcattctcctcttgaagatattaaacagcggaaagtattagacctcagacgatggtgatgttatcagtttttatttttttcatttttgaaatatgtaatatatgttggcaataacgtagcagtttacaaattaatacattatatgtatcataaatatttttatttctaaaattattaccaggatttctgaatatttaaagtcaccacaaatgtttgaagtagattaataatgagttatgctggtctttcccaaactcggcttattattagagtcatctgtgtgactccacgtaactgccatgtagatttaacaatgattaaccttttgatgtagttaaatacttagcttttcattgctgaagaattttcaagtaagtgactgatttttattatatttcatctcaagttacctaagtatgcatctctaaaaaatgacttttttctacttaaccacaatacttttgtcatacttaataagattaacgatatttccctagtgtctaattcccaggctaaattcacgtttcccagattgttctgaaaaggtcttcacatctgtttgttcaaagtgggacccagttgtgaaccacatgtttgcttgtcatgacccataattctctcaatctaggtcagtctccaccccactttcccccttgtcttttaaaaattctattattttaatcgacaaatgagaataataaagattgacttattgaagagact

SEQ ID NO: 13536 - DNA, 1050 bp, Homo sapiens
gtactatttagcaatttccatttttaaaattgttacaatcttttgactgtgtaaatcagaaaattgtaatacattgttaaagaaaaaattattctgacacttgttaatagggtgagaagactttattttaaacttgtgaaaggcctattgtagtaggaatgagagatcaggctcagctctgaatacagcaaagacaacaaagacaactgggactttatagccaagggacacagcgaggggtttgggggtgggatattactaagagggtcaagggtatggggattcttgctaaagcctaacagacttcttgctaaaggcaggtcaagggctgagacatcaggagttggcaggggacgtccgtaaggaacttgattagatattaagggttgtgggttctctctaaactgacttagcaggattcatgctaaaactggacacagaagtctaaggtccaggcctgtttgagaagaggactcaaggattaatcaggaagagaattgttatcaatagagggtatatggtttaccaaggtaaaagactgagcacaaagtcagatatatttctgttgacctatattgggtatatcaggttggttacttggaggcaggcttggagattacatgttgctttctacacatactagttttgtgaccttgaacaagtcacttgctgagccttgatgtagaccttttatctttctatatttgtatagggtcagtgtgaggataaaaggagacatacttgtaatgtacttagcacgctgtgttacagagtaaggactcagtaagtgctagcatttattcctactgactaaattctatgcattcacatggggcctgtctatccttctggaaaacacagctttaaatgctgtgttgctatttatttctgtttctagtgagactgtcaccacactactctcagtaagtgatcaggcaacgaaaaactaagaaaggatatattatcctgtttggtaattttctcttcagctgtgtctagtttgctttttatactgcctattgagtttgagttttttaaaagaggttttca

SEQ ID NO: 13537 - DNA, 1050 bp, Homo sapiens; identical to SEQ ID NO: 13536

SEQ ID NO: 13538 - DNA, 1050 bp, Homo sapiens; identical to SEQ ID NO: 13536

SEQ ID NO: 13539 - DNA, 1050 bp, Homo sapiens; identical to SEQ ID NO: 13536

SEQ ID NO: 13540 - DNA, 1037 bp, Homo sapiens
attatagttatggcaaatgtccagggaagagtgggcataagaggttgtggtggtactaccagcctgtctctgtagagatgttatcttgtcacttggcttgtgaagactactcctctagcctccataagttttgtgtaaagattaaagtgtgtgtagaaaaatctgggttcttatcacacaacaaggaaagattaggctcacagatactttgaagggtgaaggggaacagaatttattgggtgaaaaggaaaaaactcagcaaagcgagaagggttcctgctaacaggcccccatctcacagattgaatcccaggttgccacacagggacaggagaggccaaggtcctcccctctgcaaacagcgggcacttcctgaggcccaaccccatcctcccagcacgcaggccagctggagattctccaggaagccgtttttacttggctgtctcattagtaggagaagtttgcatttttagaacttgattattacctggagtttatttttattcatatacatcagtagttttttaagttgggatgtgtgtactgcatatatattagaacttctatattttaacctaattttaaattccaactttttgtatatcttttataaagacatattagtacagtggtatatgtatatactttataaatgcatgtgctaacattgggcatgcttgttcagaattttaagtgacagctgtgtacaaccagaaaagttgaaaccattgctgaatacactaggtaaatttcatagacaagtatgtgtgttattagaaggttttggtaagcaaggacatattttagttctttagtttgctaatgagcttacctgaatttcagtttaaagagtaaaacagaatacatttattaacattttttgtacctatcaatagcttcttgtttttccccagcagtgtcagtgtattccaagtaatgtcttttctgtccttaagcccttaaccggtcctttgtgtaaagcatggacactgctttatgggctttcagtttgtgtgtttgtttgtttttaatag

SEQ ID NO: 13541 - DNA, 1037 bp, Homo sapiens; identical to SEQ ID NO: 13540

SEQ ID NO: 13542 - DNA, 1037 bp, Homo sapiens; identical to SEQ ID NO: 13540

SEQ ID NO: 13543 - DNA, 1037 bp, Homo sapiens; identical to SEQ ID NO: 13540

SEQ ID NO: 13544 - DNA, 2334 bp, Homo sapiens
ggaaggtgttttggctccggtgggcattgttatattttgtaaaggcagctgttagaaaaggtgcaggatgaggtgctctgatgatgcctggaaggaaagtaccattctgaggccggtgaagtaaaaaaagaaagaagggagttcatagggacctacaaattagtacaattaatttccctttattttcttcagccaacatttttttcttctcaggttgggggaaatttgcattgcatcatagcattccagagacttaactggcaaagatttggcctttggaactttccatttggaaccattagacaagaatcacaacctccaacacatgcccagggaattgccaaatctgagagtgaagacaatatttccaagaagcagcatgggcgtctgggccggtctttcagtgctagtttccatcaggactcggcatggaaaaagatgtctagtatccatgagagaaggaacagtggttaccagggttacagtgattacgatgggaatgattgactatgcttgctactgaacagctggcattatatatgaaactgctatatacaggactgtataaagacagtagaagattttagtaagcctacattaaataggagcagatcttgtggtataaaaaataaccttgtagttctccagatactaagcttgtatatgattatggtgggtgatttcagatatataagcagataagcacagattattgtcctttcaagttaagagtatataatctggacagaaaatttcacaaaattcaataaaattacaactgttgtctaaataagtgaaacacaaattcacttaatagcatcaagatttgaaatacttaagcatgaagtgacttttataatgactcgatccctagacatttgttacagatagttttatgcctaagaccaagatgtaaagtaccatctgcccttaaaaaaaattggggctgtcaatttctagttttcactcatggttaacacgcatttaaaattatttcatgagtctagtagttctttgatttatagcaggatcttgcttgcctcatttgtttcctggttatgttcttaggattctgactaagaggcaaaagagaaaagactcaagaaactgatcctggagatcgagaccatcctggctaacatggtgaaaccccgtctctactaaacatacaaaaaattagccgggtgtagtggtgggcacctgtagtcctagctactcgagaggctgaggcaggagaatggcgtgaacccgggaggtggagcttgcagtgagcggagatcgcgccactgcactccagcctgggcgacagggcaagactctgtctcaaaaaaaaaaaaaaaaaaaaagacggatccttttttttggtgcaaatgggtgacttagtgcattgattcagatttttaaaatttcttgatgtggtttgtaataatcaaatattgacaagaaccttaggtctcgaaagacttttataagtctagatgacgtttgccttaggggtaaagtaaaagaacaattggcaccttaagtttctatacccaaggttatctgtgaaatgagatctcctgatatttgattgctttctcagtatggagtcatatgttgataacagtactgaagatgcataagaaatgcccaagtcactcagaggacaactacccatattccagactctgagctgtttcctttttaaaaatcatatagacaattagctgtttgaagtgagtattaaatatttcagaagtgtgaatttcatgtatttgagctcctctagttgctgttggtttttcttctgctgccaacctgtgactcacaaatgactaggatctcttgttctttaattttagggtcttgttccaggactcaaatcagtaacttggtgattacaaggtgctgaatgtgttggtaaccatatcgcaatacacctcaaggaaaaggttcagatttttatttttaaaatattttcatttttttcttgaattttatatccgtttgttcactcgtacatgcctagcctacagaaggggatatatattatgaaatggtcatttttctgaagagaatattttgcttgaaatgcaaaggactgaaagagatttgtaggttgttgattttgttacttcatactggaacttttaaaaagatttcatcaaataaagttttgttttctacttttaattatatgaatgtttttaaacctttgttttaggtagaaggtaccattgtgtctttgaagtacatgataatttgtcaattctgctcaactggtacattgtaagaaaccatcttgagccttttataattaatgaaacaatatgcattatgatgactgtaatt

SEQ ID NO: 13545 - DNA, 1035 bp, Homo sapiens
ctaactaaagaactaaagaaacttattttttgtattgaaatgttattggtctttgggtcttataccgaaagtgatttttggctttgctgcagattttaacttttctgtccgcagaaatttaattttgcgtatataaacttactgaaattagacaagtcaaattatacaaatattttcagattgtctcatttttcatatttcttgtctaacaatttatgtgaatattttcaggtcgtctaattttacatatttcatctctaagaattcaagccaaaattctcaaccctagctgagaattggcattacctgtagttaattgaaaaataaaaaataaaagaagtcctacctcagtctctatgatttagaattttaggcccatggggtttaataatccgtatgtttcagaagcttcatatcctattctaatggatagcagggatgagagccactgatctgaaactagatttcctcactgaagttaaagtttaaagtagtgggccaagtagaaactaatttaatcctatgtaatagtgagcttcatggcttttccagactatacttgtagcaagcagaaacatcgatctaatacaagacagatgcacatcaacaccaagttctacctctgagatgtatcttttatccgatctcttctcgtggtctccaccactactgtctgcgttaacttgggctattgtaactcattttagaactggtttccttataatctgttcttcacatgttcatcaaagttatccttaaatcatgttctagaaacttcccagtggccgtatcacctcctgccattccttttgtcctgctgcactggcttcctggagatagggaccgtctctgttttgttcatggctgaattgtttggtgtatatccctagggtcttggatatgcctggcccatggtattgctaaatattatagaaataagcatagcagtagcttgctttccactaggtattttgttacatagtgttttgtaaattaattgttgatggacctacatttttttttatgttagtaaaa

SEQ ID NO: 13546 - DNA, 1049 bp, Homo sapiens
atccgatattcagccataagcacagggactatccatttgtcactacttgaacatttcttacaagatatttctatacattttagaatttctcatgatatataatcttgaatattgaagggcagaattacatgtaagtaatgcatgtttataaaaagcaatattagaaattgtttttggtgtcactgtgacattttatagaataaataaataatttcttttgggaagcatttaagctttccacttcttgggcatattaaaagacatttaaaagaaactgaaagtaaattaagtttcccaaatatattgtgtagtagcccattaagtaatagatggaaactctgggtgtcctttacgtagcagcaacctgaagatatacactgatatggcaattaggaggaaatgctaaagcagccatagtctgaaaactcagacaaaccaaattctctggaaaataaatcacagcaatgtttctagtggtctaatatcctgaagtgagatcttacatcctttcttctcataggtgaagagaaggcagagaaaggacttagcgtccagtgactccaggaaaacgacagagaagcttctgaaaacatttttgaaaagacaagccatcaaaactgccttcagaagcaaaaggcaagaggaaaattatagtcgtgttagagatgaagttttaaaaaagtgatttttgtcttgatttcctgcgattctctttccctatctaattttgactctcaacagaaaatagagagtgaaatgagacaagtaggctgccattttgacctggtaatttggagttgtggcaattctccgttctgtgagaatcaactttgctaatgagaaaaaaaagctgtcgtgttgcgtcatgtacactttttactttgattatggtcttcttgactctaggtgagcagccccgccaaggttccttcctttctctcggctgcatttattttccacagcagtggcctgagagcagccaggtcaggtccctgttcaccatcctgagcagggtctgcataatctgtttaaagatttgtgtactttcc

SEQ ID NO: 13547 - DNA, 1046 bp, Homo sapiens
tttttgattcccaaattcactgtttcttgtttgttcatatggttttgttctatcaggtagaaacttttgagctaaaacctcgagatccttcaggttgcggaggtgctgtgctattaatgcagctagtgagagcaatcttagttaagaccatgggcctcgtggtcaaaaagacctgcgtttcagtccaggctccactgttcactagctgtgtgatcttacacagattaaattctccaaggctttatttttttttgtaaaacgaaattgatatcaatgccttcctgatgggggtgatgggagcattagtgagggaaagcacaggaaatgctgagcgcagtgacaggtctgtcctacgtgtttgctggttggtacgtacacatgtaacatacagacatgcaggacatcaggttgtattagcttatcttttttactaatgaaggattttaaagtacttttggtaatgagttaaagttgagaaaagttttacacttttccatgtcttctgtgaatttcttttaatttcatttcttatgttataagcaaaataaaactaacttaattatgggaatgatatatattgcttgaattcctaaggcacattctgtcttgggttcttgcattttctgttctctcagcctgaaatgctctatcctcagtgaggctctttgatatcttccaagtccctgctcacacatcctctttttagtggggtcttctttatctatcaaatagatctttttttccacgttctgttcatgtaatcactctcatatcagataaatctgctttattttaccattatcttgttcatttatttatttatttattgtcttctctcctctgctcctaagagcagggaccttatctggcaccttatccgatctcacagtaccttagcacctagaacagtgcctggtgccttagaggtacctgctaagtatttttttcttttgaatgaattaaagagtgaatggctacattccctaatttgcctactcactttgttgcctgtcacagattatatgcaactgtgtttagccaattgt

SEQ ID NO: 13548 - DNA, 1046 bp, Homo sapiens; identical to SEQ ID NO: 13547

SEQ ID NO: 13549 - DNA, 1046 bp, Homo sapiens; identical to SEQ ID NO: 13547

SEQ ID NO: 13550 - DNA, 1046 bp, Homo sapiens; identical to SEQ ID NO: 13547

SEQ ID NO: 13551 - DNA, 1106 bp, Homo sapiens
gtaagacagtaagagaggagagaagggaagtggaagaggaagaactatttcttagtcacagctttattctgtgctgtgtaaatagcataaaaacatactgagcaacttccatgattgtttatatactttgataatcctcctttttgaatttttaaaacaatgtcagttaacttagaacatatttatataaagcgaatatacaaatcttaagagagtttcctactttcaaagacagtgccagtttacctaattgaaaaggcttgttttgaagttacaggcatttgtgattacatttatttattaataacgctactattacatgtattctgttatagtcatatctttcctttttaggatgtagcatttttcaggttcctccagaaagctcttgatgattgcaggatcattttaatgttttgattgtagatgaagtgaccttttaattttggtacaggaagtttcattgaagtgcaaagtgtgattagtgatgaggaacttcaagcagaattccctgaaacttccaaacctccctcagaacaaggcgaagaggaactggtaggaactagggagggagaagcccctgctgagtccgagagcctcctgagggacaactctgagagggacgacgtggatggtgagccacaggaagctgagaaagatgcggaagattcgctccatgaatggcaagatattaatttggtaataccgtaacattgtgtttcgacttcttgctgaggaagccaggttaagtaggttttgagttttaaggagttggtggatgagtatttagtagctatttgcagtacatcttgtggttgctgatggcttcatttttgtgtaggttactggctgggatagactccgttttccatgtggtttagtgatgaatctctaaagatattacagagtcttggttagacatccagtggagtacttcctaaggagaaagagcttattggtaatttcagtcagactaaatgcaggctttttgtaaacaaaactcatttggattattaatataaatctataaatgaaaaaacattttataggaggagttggaaactctggagagcaacctcttagcacagcagaattcactgaaagct

SEQ ID NO: 13552 - DNA, 1029 bp, Homo sapiens
ttatgttagtaactttgatggcatttattttttcctaattgtgtaaatgtttctggtcagtcgtcactgcattacaaactaccttcagccttagtggcttcacacagcagtagtcactgattttgctcatgcctctgaagctcgctcaggcctggtgggggtgtcttgtctctgttccatgtcggctaggacagctcagctgggctaggaccccttaagatggctcgcggggctgatgaggtggcttcggcctcggggcctgggtggacacttggtgagcttggcttcctcatagcatgttggagccaagagcaggaggtccaggggacaggaagtggcgagggcctcccctaggcctggcacggcttgagtcacactggtcagccatggccgccctgctcaagaggaggccacagggacccccttcgtgatgggaggagggtccaagagtgtgtcgctgtctttatccggccgatttaggcttagaatggaaaacattgaaaaatgaataaaatataaagaagaaaatgaatggctgtgtgctcacgtagaatattgcctagcacacagcgaaataatagttgttagtgttatttattttaagtatctgtttacttttctcatatatgtgttttttccaaaactggaatcatactttaagtagagttctattatctctgtttttgtatatatttatttgttttacatacatatgtatttatatatatataaaatgttaaattttaaaaacagatacatgtatctgtttttacagattttttaaacaaatttaacattttcttggcatatttacattttattaaatattcttcgatccattattgtatttgatttgaggtaaataatacagatacattacttccattttactgctgagaaagagacccagagaagttgtaacttctgtggtataattatgagtgtgggctctagaggaagactgtaccaattccagctgtgaaatcttgagccagttacttatttttgagttcagttccctcctctgtg

SEQ ID NO: 13553 - DNA, 1029 bp, Homo sapiens; identical to SEQ ID NO: 13552

SEQ ID NO: 13554 - DNA, 1029 bp, Homo sapiens; identical to SEQ ID NO: 13552

SEQ ID NO: 13555 - DNA, 1029 bp, Homo sapiens; identical to SEQ ID NO: 13552

SEQ ID NO: 13556 - DNA, 1087 bp, Homo sapiens
aaaagaatagatagacgttgaattattgatattctccctctctctctctaggatacttacagagagctacaatggaaaagtcctggatgctgtggaactttgttgaaagatggctaatagccttggcttcatggtcttgggctctctgccgtatttctcttttacctttaatagtgacttttcatctgtatggaggcattatcttacttttgttaatattcatatcaatagcaggtattctgtataaattccaggatgtattgctttattttccagaacagccatcctcttcacgtctttatgttcccatgcccactggcattccacatgaaaacattttcatcagaaccaaagatggaatacgtctgaatcttattttgatacgatacactggagacaattcaccctattccccaactataatttattttcatgggaatgcaggcaacataggtcacaggttgccaaatgcattacttatgttggttaacctcaaagttaaccttttgctggttgattatcgaggatatggaaaaagtgaaggagaagcaagtgaagaaggactctacttagattctgaagctgtgttagactacgtgatgactagacctgaccttgataaaacaaaaatttttctttttggccgttccttgggtggagcagtggctattcatttggcttctgaaaattcacataggatttcagccattatggtggagaacacatttttaagcataccacatatggccagcactttattttcattctttccgatgcgttaccttcctttatggtgctacaaaaataaatttttgtcctacagaaaaatctctcagtgtagaatgccttcacttttcatctctggactctcagatcaattaattccaccagtaatgatgaaacaactttatgaactctccccatctcggactaagagattagccatttttccagatgggactcacaatgacacatggcagtgccaaggctatttcactgcacttgaacagttcatcaaagaagtcgtaaagagccattctcctgaagaaatggcaaaaacttcatctaatgtaacaattatataatg

SEQ ID NO: 13557 - DNA, 1032 bp, Homo sapiens
tagcaaattaaaatacaaaaaaatggtaaatatgttgaaaaagtgaaaaggttagggcaggtgaatgagtatcaggaatgtgaagggtgaggaagggaaagaaatgcgttttcattttgaatggagaggccaggttcattaagcctttttatcttttcttgaaagctcaataattctttatacttttgactattttttttaacattgcagacatgggtaggtgatttttaaaataaattcaaaatgtttatacctgtgttgtttttattagtaattccatatgaatggaaaatgttagttttaatgcttattctttttatagatcaactcctacttaaaagaactgcattgagcagctgcatttttgttgtggtgatattttttttttaaaagacattcccatttctgaagagttagagaaacagaaggtttctcttcaaatagatttatcacccactgtttctgcaaatatctgaggtaggcactccataatatacagagaagaggacagcgaagctaacaattatcaggcgtgtttcatgtgcaaacactgtgttgggctctgggaatgtatatcatttactttctcaacaactctgttagttgggcattattgttttcattttagatgagaaagctgcaacccagagaatcaattgcctctctcagcaagctaattatttaatagttggagaagttaagccaaattgatgcaaaatttaaaagaacaataaaatagacaagttatttacaattcataaaacacatctaaatgatgacttcaatctattttcgcagcagtatgaaatggatattgctattcccattgttacaggacccaacactcacccaaagttaacctttgggtcgggggtttctgtactatattcccttctgtggtcgccagagaaatgttacaggaaaggagtcccgatccagacccccggagagggttcttggatctgacgccagaaaaaattcggggcgaatccacagggtaaagtgaaagcaagtttattaggaaagtaaagg

SEQ ID NO: 13558 - DNA, 1032 bp, Homo sapiens
gctaccacatcatcctgtgcccctcatgaaaacccacaggaaaaaatattctttaatctcaattctagaaatattgttatcttcttgggcttctagcctattgtctgttgtggattctgaattttattatcaattttgttttcatttttgctatgatcaggatgaaatttggagacaggtatggttcaccattaccaattatatagggacatttaaagtatgattttagactaacttctatagctctattttactattttatccttatattacagtccctcaatcttctttttattcattttacatcatttaatttatactccccaaatttcccaatctccagccttagggctcaccctttattcaacacacccatgagaaatccagggaatgtaaagtatgaattcacaggaaaggaatgtctctgctctcttaatgggttttgatgtctgaacgcacctacagattctggctcagcaatgtagtccccccatgtgcctactcactgatggctactgtcttctctctgtccctttcatctcacccttgagcacagtggtctccttgtcactacccaagtgacttttgatgggtaatggaggagaattatcactgaactgaacagaagccattgaaactcaaatatcatagatggttgttacaaagttccttgaccgttcttagtaaaggttgtgtcttagtcactttcttctttcttccgtaggctcccttctgttgccacatttgggccaaggaatggagagatttcttcgtctggaaacattttgccaaactcttcagatactctttcctctctgggaatcaaaggaaaatctctactagtgtgttattcagagaaattttgtccactctttgcttcaaactctcttatccagatcagcctttattatgaaatagccgaaatatagaccaataaagggaaaacccagacattcatataaagggttagctctcaggttcttgtatctgatatattaacccaggttaacatataagtgatggcaaagaatc

SEQ ID NO: 13559 - DNA, 1048 bp, Homo sapiens
ggccgaggttgcagtaagccgaaatagcaccactgctctccagtctgggcgacggagcaagactctgtctaaaaacaaaacaaacaaacaaaaaaaacctagttactaaacatagctctgccctaatctcttaaatccagagccccagtttccgtactctgaagaattacggcttcacagaggccaagtgccctaaggcagataggacacctctatgcctccccaaaacctcatcattgctgcaagctcacccccagtctctttgactctttgatctttggatggcaccaagaacattgattgcccagcagagcttctcaaagtgcaggccccctagacccccagacctaaaccctgaaaggcttgttaagaagtcaggccccatctcagaccttcaggtcagacattccagggtggagtccgggactccgcctccccacatgataccagaatctgggaaccactgagctacagtattgggttgagaggcagttgagattacttgccaattcactttattttcctgggctttagattctaactcaaccaaaaaaaatagatatttttaatcattttactagggacctagtaatatgtgttgttaagagacatgtagtttgttacgttcaacaaggggctggtcttctacttactcacttcttggtaaccactggctttaatggctgttccttgtgaaataatgtttcaattttcaactgtattgattaaagatttttcttaattgtggcaaggactctttcctgcgtaggtcagttcaggaaaaagggctgccgctgggagccctttggcttgttttgtttcggaagcagctaggatgggcagtgaagagccttggtgattacttattgggcacttcctgtgtgccaatttgtctgtactaatgcttctaatcctcacaagcaagcacactgatgagctaggtaactattattacccccattttacaggtgagaaaagccacaaagggtttgcagccctcgcccaaggttcctgtctttgtaactgaatgagacggattagaacccag

SEQ ID NO: 13560 - DNA, 1038 bp, Homo sapiens
tgaagagaatgagtgtctgggaagctgggggccagcccacaggctcctctcctagacagacagagcatgcaggatgcccagtgccagcttcccctacctgctacctgcagtattgcatacaataagggcaggtggagttgaagtcagaaaattccaaaggaaaggggcttcctcctccacaccaaatctaagcacaggccccaggtggctccctgaggacagggaccaagccatgggcacgctgcccccagcgcccagctgggcatctgctgtagcagctggagtctaagccacacaatagacagagctggtgggaggaaagagagagggaaagtcgagattcctggccaggaccgaagctaagtagtttggggactttttgttcagaatcacaacacaaatcattatgctgagtgcgaaaggcatggccctcaaaaatgtgcaccttgggtcaactgaaggttcctctctcattggtttcacttgatttgaattacagtcgaaaaaattattgggtagacagacattggcttatctgcaaagtcaaactaatgcaaaatatgcttcaactgcaagacagagtgccaaactatttcaatttaatagcatggtttttttttttcttgagcttcaatgcaaagggaagccaggcatctggccagtgagcagtctatgagctgagctgtgcttttcttcagggcaggcagaggttggccagtggccttcttggcactcccagaaactcagcttcatgggcgtcaagggtaagaatgtggaaggtggtctggtggccaaaatcacacagtccctggatgtggtggtcaccatccaccaatgtccactggtgggcgataactggactcgctccttcttgacacctgtcctgctgggctcttgatattgaggctactggaggaaggagcttgcctgagaaggcacttccacaaggagagggatctgagtccacaggggaggggaggtctcttcgcctgaatgcatgagaaagcatactggacatgaagccccagtcctggctgg

SEQ ID NO: 13561 - DNA, 1026 bp, Homo sapiens
tatgagttgatgctttaccctatagacccaggaggcccgcctgcccttcccagacaactggccaatgaattattgggtcaactgaggacctctgccaagcgcctgttcatgcctccctcacgtgtagtaaaaggcatgaatgcgccagcccatctagtcttgagctttggtgctaaactttctggcttagtatggagttggatttctagaaatcacatattcaaatcatgggatttatgagccccattgcagataaacattggagccattgaaaaattggcaaatacctaggatcgtgttttcagggcgtgagaggattttatatatgtttacttttacaccataaactccagctgcctcattacctcactcaagacaaaaagatcactggaaagaaatgtaaaagctttcaaggtactgttttctctgaagggtttgggactttccactttttggagttttttttttttatagtagtaactgatgcatcagatactatattaggtaaagaattataagaagaacataaaaaacgtgaaactctcagatgagagttctctagtagaaaattgttagctgaaagaaaaaaaaaatcacccatacaaaaggaacatggagtcattgctggaacccaaggccaactcttgccaggaggttttgggtcagaagcctgcgtgtcctgcccttctgccctggactatctggaagaccctgctgggcggcagtggcagagtgggcctggccatgccacttgcacctccacgtggacatgcagctggtgacaggaaaggggaaggttccagcagacccgctatcacaaaacaacttacagagggagtccccaagtgatagtcctgtttagtcattgacacgtaactcagaagagagtgaaaaggctgtggtaaaatacaatttgcttaacattggaaagggttctgtcatctggtaagttttacttgcatgataaggtttcaatcagtgaacaccagaagccagccttgtccagggtcccttaggtgtaactgt

SEQ ID NO: 13562 - DNA, 1037 bp, Homo sapiens
gaaagcagtagaggggcagataggaaatcggagtcaacaaataagacagctttgctttgcttgttaactcacctagcagatggtgaaagtcttggatttttccaagtaaggtcaattttagttcattatttcagtaacttagccaggttcctgttctcccccaaacatctgatttttgaccataaactctgatcagataggttgtttcaaattttttaatgacatcaaccttcacagggcacctcctatgtcctaaggcacttgggtattccagaaactggtaaatatgaagactggttggataactccgtgttgggaattagtgagatggtcaaatggccctgtcacacgacaacagggaaaagagaacccacgtcatcagcccctgaacgagtgagtggaggcctctgcatcactcagcatgcatccaggcggtacccacagtgccccctgtggcctggcagctgcagctgagagcctggagactatgcttctggaaggttgcgattgacaagctcgctcaagtaagcagtggctgagtgcttagggcaacaagttgtgtttagcgactgcattttttcatgtagctaagagtttcccacagtctatgggtccctggacttgggtcaaatagtccttagcctcaccagatttcttaaattcaacactataaatcaaagtaaaagaaaccagagagaaactgagcaaaaatagctgccaagagaagagggaacgagtgctcggggcgggttggaggcagataacgagaaggcaagaaaattctttgtctttggctcctgctgtcagctcagaggggtcatcttgagatgaaaaagaaaagtccccagccttggggaaggaaaggagagggtgccccacgcagatatgaagcaaagccattggcaagatattctctctaaggagagcagcggtcttgccaaaggcatcttctattgtgtattgccgtcataaaccctacccttccatgtagatagccaggattttaaaataaaactaaatcttccccaaggagagaa

SEQ ID NO: 13563 - DNA, 1027 bp, Homo sapiens
aacctccacctcctgggttcaagtcattctcctgcctcagcctcccgagtagctgggattacaggcatgcgccaccacaccctgctaattttgtatttttagtagagatggggtttctccatgttggccaggatggtctcgaactcctgacctcaggtgattcacctgcctcggcctcccaaagtgctgggattacaggtgtgagccactgttcccggcctggcattttctttaattagaactagatgtctcattgaatggcgcaccaaagtatgaacctcgagactttgtcacaaagggctctgtgaccttgggtagggcacatgacttctttaaaggagtctcctgagggcttcacaccttgctcaaatgggccttccagagctttgcacacccctccccctacccttctctctgaacctgccctttctccacgcaatggccttggctctccaagagtcaccctggccccattgcagcccctgctgctggggcatcctccccggttcattgactccttccttctcttacaccagtgccttacatgcagttgctgatagaaaatacatatttgagcgttgaaggaatgtaaaactccattgctaaaacgaagctagggcctttcttaggatggaggacatgaaagaaaatgccacttccaaagctccacactccatcagattgacaagttagctgggatcagataataatagccatttcatgtcttgattaaaaacctcacacagactccacagaactgttgataaactagagcaaaaggaattcacagttccattcttcttataaaccaaactaaaatgctgactttcgaaatccttttttccgacctcctgatggaaagttttgacaagtgtagcactgaagcatttccccctctctgctagaggagaaatggcaatcttcaaagaccattgttttgttttattcgcttccaattcattcttagtaaacaattgcaggatttctaaaaagaccagaccatagtagttaccagacatgagatgct

SEQ ID NO: 13564 - DNA, 1052 bp, Homo sapiens
tgctatgccttgattattacttatttcaatgggacaaatttgcactagaactacagtatttgttatcactgaatttttcacggttgccatatatatatccagcatcatttgtgtcctactgctgttgaacaactactttaagatcagaaaatagaagtagtttagccagtctaaaaggatttccattcatcgaatcataaatagagaaaaaaacaatcccttctatccattactaaacctctccattccaaatgtcttcaaacaaagcaattatggtggacaagtatttgaggacagttttttctcataaacagctgcatagtgctatagcatccttgttgattagccaattagaataaattctttccacagcacattttaaaagacttaggggaaaaaacaagacttgcaagacttgaagttttcatagaacaatgtgcacccgtcttccgcccacttccccagagagaaatatatgaatcacatagcagtaaatgagtaaagtatcaaaacaggtgctggagactagggagcatgaatcatcttcttccttagatactttgtaaataaaacaggatgtatttatggtaactctgtgcgtaaacttctatttacaatgaattatataaaataaatacaatgtcacacaaagtaaataaaattgaagaatctattaaatatcactttaacaattatattaaattgtttccttaaattgatccaattttgaaagaggaatttgaataggagagatcaacaacaacaaaaattcctcctgtattcaaactttaaggaacgctagctatctattttaatgagtgaataacttatttcccaaaccacattttaagaaagtcaaaaatagttgcatcacatttttcctattgaaaatatacactttgaataacagaaaaataatccgcagataattttttaaagatttttactcagcttagtggtaatagatttctgtttatattaaccttaagaaagagtgttcagaatggagtttggccatttcattatgagttatggatattattgtataaaac

SEQ ID NO: 13565 - DNA, 1045 bp, Homo sapiens
attgagccctgcaggagctagtggggagaggtttacaaggggaaggtggtgggcgaggtcatccaacatggctgaccatgctgaatccagattggccacaacatttaattagcataacagttatcctaactccgtgtgtgtgcatgtaaggcatgaaagaggaaacagtgttctggagggatgcacacgtgtgcccccattcccatatcagaaaaagatcaaaatgggaaactgagttcatcttttttttagttttttgggggggaaccagaagtgtgtagcagtcttggaatccaagttacatgatcaaaaaatcaaaacttttctttggactcaatgtttctcaaaaggaataattgttatccctatagtttaatggaaaaactaaatttgcagactcttatatttctttccaaccctgaaggctatcgccacaaaatagtctaagttttcttttgaaaaaatgtgcttttgtttatgaaattgggtttatggatcatttggggaggcttggctgaaagccaccctgggctgggtgggacaccaggcgtctctgtggtgcccatgccctgtgtctggggggaccctgggcatccttgatgctggtgcctcacaactgggtgggatgccgggcacccatggtgccgatgccctgcgtctgcgtggaaccccaggcgtccgtggggctgatgccctgcgtctgcgtgggaccccaggcgtccgtggggctgatgccgtgcgtctgcgtgggaccccaggcgtccgtggggctgatgccctgcgtctgcgtgggaccccaggcgtccgtggggctcatgccctgcgtctgcgtgggaccccaggcgtccgtggggctgatgccctgcgtctgcgtgggaccccaggcgtccgtggggctgatgccctgcgtctgcgtgggaccccaggcgtccgtggggctgatgccgtgcatctgcgtgggaccccaggcgtcgtggggctgatgccgtgcgtctgcgtgggaccccaggcgtccgtggggctgatgccctgcgtctgcgtggga

SEQ ID NO: 13566 - DNA, 1067 bp, Homo sapiens
cctgctcacctatgacctttcatgaccttggcctctgaggccagggctcttgccctccctgacggctccctggagccggctcctccccttggcccgcaggcccagtggtggcaatcttcagctctaagcactgaattccttaacctccttcacactccccgcaactcaacctatgcctctgaatgtggtcccagtttttaagtatctttagtaaacatcagagtcaaattctgaaccccatgagactatgagtgaacacttgagtcacttagtctgagcctcagttttcccatctaagaaatgggggtcatagtgcccatcagaacaggcagtgtccataaagcaccaagtgtgccacccagctctccccgctgcctgatacccctctccccgccacgctaagaggaatgcggaacaaggaggccctcctctccctcctctgcaggtgacgctggggaatgcagatgtacagaaggcgacgaagctatcaaaggtcttccgggactgccaggacccaagggcttcgcaggcatcaacggggagccggggaggaaaggggacagaggagaccccggccaacacggcctccctgggttcccagggctcaaggtgaggagcaatttcatcatgaagctggcaagacactctgaggcctccccaggtgtcccgttcttgccttttatctcctaagtttacacagcttcagaccggcaacactcatggacccaaggcatggctaaaccattctaaaaacccacataccccaaggcggactttctacatgtccactggtgagactgagaaggggcgctgctgtgggaaccgcagccgacagctcttgaaagagttcaatagggggtcaccacgtgacccagaaatgccactcctggtgtatccccaagagacttgaaagcacgtgtccacacaaacacacatacaccaatgttcacagcagcattcttcaaaataggcagaaggtgaaactatccaaatgtgcgtcacctgatgaatggatcagctaaatctatacagcatctataccacagaatagccctgaccttcacgtg

SEQ ID NO: 13567 - DNA, 1025 bp, Homo sapiens
cccccgcaggtgaaataaataacgatgagtgacacccccgcaggtgaaataaataacgatgagtgacacccccgcaggttttccgggactccgtgggatccgcggcttacacggcttgccaggcaccaagggctttccaggatccccaggtactctgtgccgtcccagccccgagtcccacgcagaggtgtcgagggtggggactctgtgctgagtctgccctccagacttcagggaatggagggtctcagagagcagggtgggcttcctgaagtgctatgcgatcggccgtgaggggcgggtccgggccctgtggtcctgtacgctgctaagatgtgatccctaagaatcggtttctcaaggcagttgctgggttgaatggactcatcaggcttttagacggagagagaaatagagtccttgctttttcagcagcaccgttgggagggtgggatgcacctgcgcccctcaggtgtctggagtgttcactctgcccattgcctgtctgtgatctttcattttgttggcctaaggaagccagcggtttccacctgcccctgggcagttctgatgctggagacagtgatagcgcttgggcacccacaggctgggagccaaaaacaaccaaaatgggtttcctcccagttctggaggctgggatcagcatgccagcgtggtcgggttctggggggggccgcgtcctggctgctcgctgtgtcctcacgagggagagcacccgctctcccctgtcacttcttataagggcagtaaccccatcttggggccccaccctcatgacctggcctaaccctaatcacctcccaaaggcccctgctccaaatgccatcacactggagttagggcttccacttaggaactttggggttggggagaatgacacaatcagtccatagcaaggtgaaccaagggcttcttaccacaggaaaaagaaactaacaactttcatagcactttctggcttattttataaactactgtagcacacatttttccctgaatgggga

SEQ ID NO: 13568 - DNA, 1063 bp, Homo sapiens
tctccttggcccacagtttatagtgattctgtgccgggtcttgtgtgttggtctggaagaaggtgaaaagatttggggttgggctgagcgcggtggctcacacctgtaatcctagcactttgggaggccgaggtgggcagatcacaaggtcaggagatcgagaccaccctggccaacatggtgaaaccccgtctctgctaaaaatacaaaaattagctgggcgtggtggcatgcgcctgtagtcccagctactcaggaggctgacgcaggagaattgcttggaccagggggtcgtaggttgcagtgagccgagattgtaccactgcactccagcctggcgacagagtgagactctgtctcaaaaaaaaaaaaaaaaaagaatttgggttgatggggattcataggatctttttatcttggggaatcccagcatctgctctatcagctaaggcagttacatctactcataaagaaaattccttcaaaagttttgttgagtaaaaagtaaaactgtaagagttaaaagacaaagctcttttgctgtgaaacgctcagtgagctttggactgcagtcagtggaacttgtgacactggtttttctctgctgctgagataattggaaggataaaaatattgagtgccttgtttgaaaaaatactgtttatatttgcaaagatcctttcattctagggagaatgtatgctttattcattgagctctatagaacataccagcatttctctcatagccgagctgttttaaatattaaggtaaaatatataacacaggaagctcttcaagaaaggccaattgaagtgtagctgtttagagacaactcaagatgatgaaaatacattaaatgccactttgaacccaatttaagaggtgtgccatatttagaatgccatttctaggttatttaattaatacccagttgagtgttggaatacagttgggagtaatatgatgaatctgtcagacttctgagcaccccagcggattacaggtgggagcttgctttccagtttgtgaggagagaaaagacctaataatcctaaaggga

SEQ ID NO: 13569 - DNA, 1023 bp, Homo sapiens
gtcccttgtgctgttggtgtcttatctcagaagcttctgcctaacccaaggtttactcctacatgttaagagccttattgttttggttgttactttagctctgcggtgcatgtcgagctgatgctggtgtggtaggaggaggctccagcgtcagtcttttgcttgtgggtgtccagctgttgcagcaccatgtgctggagagactcctttttcctcccaacttgtcatcctccctgacaatccgttgaccctaaatgtgaaggcttatttctggactgttgtttctgttttgttgatctgtacagctgtcctgcaactgcccggtcttgactgctgtggctgtgtaggaagccttgacgtcgaaagcccgagtcctccaaattcgctctttttaaggttgttttggctctcctgggtcccatgcattccagttttggatcagcttgctgatttgtggaataggcagccgcaactttggtagggatgatgttgaaactgaagatcagttgggggaatgtctaacaacattaagtcttctggttcctgggctggctttgaacccacgttgtctgaatctggagcgcaggctcttgaccaatgcacctgtcctcacactgtgctctttgcacactcgttaacagtgtgtcctggagactttttcatggaaggatatgtggatactcattatttttaacagccacatcagaatttatggatctactacagtgtatttagttcatttacactgttttcagctttttcttcatgttaacatcagtggtgtcctgaatctatgtgttttgtgcactcttttgggtgaagttccattgctgaatcagagtaaggacgtttaaatttttgagagatgcccccagatttctccctagtgtaccaaggtttgctttcccatgggtggggacacccttctgcgctgggtgctctgatgctgcaaacctttctaggagacccatgtaacattgcattttccagggtttgaatattcacttttgagtactatttgca

SEQ ID NO: 13570 - DNA, 1167 bp, Homo sapiens
tgaaactcccacggttgcccatggagagctgtgggagcctgggctggagtggaggcagtgctgacaaggagatggggatggcaccaagggagcccaggagggtgcggcggcgggcagacagggggacagtgatttgggtgactcctgggtttctggttgcacaacaggatagatggggcggtcgcctgtgctggagccctgggcgaggcttacctaggtttggggcaaggagatcaggaatggattcagggttgggtgtgtcgttggaggcatccgcatagagctgttggagcttagaggccccctggactgaagcatacacgtgggactcgtagtacagagatatgtactgaagctgaaggacttgtgaggtttcttacagggcagttaaagtgcgaacgtgagaaggccaagggccagccttgggaagggtggagatgaataaccaggtggtgctgatgagcctgaagagagaaactaaggcagggtggtcagaggccattaggagacgggcagtgacctgaggtcaggggacgagagtgctggtgtgtttctgagaggtcaggtgagtgcaattcagaagattgtctgctggcttgggcctgtgctgggtgggaaggagggtgctattcctagctgttctaggacaactggccagcacacacccagagcccacatactggagcaatgcaggcatgcccaggactgaagagggggctgggagggagcctggcagtcgcagaggggagtggaaatgttggaatagagttgtggagtatgagagaggggtggactcagtgagggggtggaccgtgagccctgtggaaacccacccatggaggggtgcatgcacctgtagcaattggcagggaactgagcgggagattagggcactcattaactgtcttgaatgtttggttaagaggaagtgatcttcagtgagggtcagcgtgtttttcttgataaaggaggctctagcaaactgtatccctttcaaccgctttaggggagaatgtctgatattttttctttcctttcccacattttaaagtgtgttcttttccttcctgatggatgcatctggtggtttaaggccaataagtgttgcgttgagcctgaacagttgtttgttactctcaaaatgtctaagactttcatctccagctt

SEQ ID NO: 13571 - DNA, 1040 bp, Homo sapiens
ttttaaaacacctgagcaccataaaatgaaaccacagtattcctgagtagcctggtgaaatgtcgtgattttctcctacagtacagaaggacaaaaatgcctttaatgtcctcaaatgctagagttctagatgacgcattagtttaaatgtcaacgcttaatgtcttcacatgtaatttggaacataagttttcttacagttaaaataatccttagagcaaaaaacaaaataaagtttttcgtatgcctcaggcttcttaaaattttctagtaattggtactgtttctggtttccttagtttcttgccgtgggtaaggtccaaacaccttacatgtgttgctggtggccctcacaattctaccttggactaaagcactagggagtctgtaggcgccttcctgcgctcctccactgcggtggatccacaatttcttctcagctgacttactggttttcatgttaactatttcggttaatcattcatgaagcgcgtggcttatatttgggaaaacattgcaccttaatcccaacatgcataatttatgttgcttaattattttaagtcattgcattagaatagtaactgcgctctccatgagcctaggctagaaagaagggaaaaaatcccaggttctctcccaacgatcaggggttactcaagccgcccgagttctctggggcccctctgggccaggctgcgtccacttgggagaggccgaggacctggcgccaagaggcggcggtgtctgcgctaggggccgagcgggtgcgctgtgtctgcggggccaggccaaggacctggagcagggaggaggccgagcgcggagccgggccttgtcggctgcgtccgcggggctagggtagagaccgaagactggacaggaggaggcggcggtggccgcgcgcggggccaaccggtgggctccctctaccggaccgaggcccagcactgggccagaggaggtggcagctcgccggcaaagcagggtgggctgcgtccgcgggggcgaacacccgacgctatccgaagacgtcccgc

SEQ ID NO: 13572 - DNA, 1042 bp, Homo sapiens
tctccttgtctgtctccctttcttgctcttccttcacctttctcgcagtcttgctcttgcattttatgacttcctggtcattacaaggagctgggaaatgccatgcattatctgggcatacgtggcttagttcactaagttttcctgtagtgctattttgagttcattgtcttgccttagttaaagtagacatctggagggccactttgctccagctttgtgaaaacacaccttctgggtttgccctgctctgtgtccacaccccgtgcctcagctgtgctagcggtctggtccatctgtacgctgggggtcgtaagcagaaaggagaggaaacaccgggaggtccttgcagctcctaggaagcagtttgctgataactcagctaggcgtgcgaggactagaagttgctgacagtcctcgggttggttttgtgcagcacatgtgcttgtgcgtgtcgggtgaaacctaaaagctccatctgttgcctgtgtctcgggatcttgctgtctcctcctcaaccgtcctcctgtgttgggagcatacagcagtgtgaatttgactcttccctgttttaagttgaattaaattagattgtagcctttccacaaggtagatctgccttctgggagtgggacgagcttctctaaattgaatatttgtttgtggtaagctgcttatttcttttcgtaatagttcactgaaatagccactaaggagttgatgggataattcagcagctgtgcactgagggcccctgtgggtcccacactgtcttagaagctctagagtcaaggcccacacttgtatggttcagaatgtacagaggacagacatgttcacaacagaattcctggcgctgatggaagccatgaagaagacagagtgaggggagagtgagggaatgggagagggtgagagagcagggctgccctgtgagactcaaagcctgggagcacctctctgggggccctctcagtcagggtgttgccatgtgagtgtggggaagggcacccaggcagaagagtgcctgggcaaaggctct

SEQ ID NO: 13573 - DNA, 1035 bp, Homo sapiens
atataatgtaataggtagcatcactctttctaatctgtaagtgtataaaacggttatgtatccttagatgccatcacacacatccacgggcctttcctgtgctccagagaagccgcacacctgtcttttcctccctgctcctttagtttgcgatggccttcagatgccaggccaaggaggaaaacctgagcctcctggtgacagggtgtcttcggtctccatccatcagcagtgaccctaaaccctggcgttgcttcgtctcttcatcttctgctttgcccttggcttttctccacctcaatgaagatttctgttaaatcttttgactcctgaagtctctgcttggggcccgtaggtggagatggttaatgatgaggggccctgaggtatcagggagggtgtgcagcttgtgggatcccctcttttcctgggcggcgaggtgcctgctggcttctttcacacctggctcccattgtttttcatgggatttccttgctgtatctggactaagatgatacagatgaaggttgtcaggtaggcactagtggaatgctgacacggagaggagctcagtgtttgggaggattgagtgacttaattgcaagaaaggctgtcttgtgaaataattacctcctgactgaaggagtcatttaagaagcagctccaagtaagactctacattgggctggaaggtcgaagggtgactggctagatgccttcctactataagccaatgactggcactcttgagtaaccattataacctcgtaaaacccctttttgtgaaaaagggaaacagaccgatagacttgtccagctgcagacagtcagtggtggagcgcagctgggagcccaggtccacgtggctgcagaggccggctctacctgtcgccatgctgctgtgcaggtgccattggtggtgtctgcttccccctgtgtgctggaggctttgcaggagccattgcctataaacctttaacatttaggagaaacgtaccccaagacctgtgaatctccaaatttaaaagtaataga

SEQ ID NO: 13574 - DNA, 1099 bp, Homo sapiens
aggatgcaactcagaatgagatggatagaagaaagatgtagggtaagggatgggagcagagtttctaggccctctgggtgcagcacctccgtgctttcagcaacccaaaatctctccaagccctgtccttggtggtttctaatgtaggctctgttaggtagacatgcatgattgactagatcactggacattgctgagtggcatgatctccagccccttgtcctccctttaggttgctggttggggctgaaagttcctgtgatcatggtggtctttgtgacacctagcccccatcctgtaagctgtctaggggccgacccagagttacctcgttagcatagactcgggtatgacggaaaggggttcatgatgggtaacaaaagacacttctgtcactcagaaaattccaggggctttgggagccagggacagtttatctgatatcacaggagagagagcaccctgaggtgggcattggctgtggctggagcctgtgaatggagaggagtggaacagtaggagcccggacgggcaggcgagatcaggtcctggagactttgattggatcttaggtgactgtcaagagtagttggaagccgctgatggatttgaagcttggcagtatcatagtcggcactcttctgtaaaaggaaccgtatgctctgtgatgagtggtctgggtggggcagagggcaggaggacacagagactccagaaaggaggatattgaattttgtcgagattcttttccgtgttaaataaatatccgttaccttaaaagccactgacttataatcattcagtggtaattttgtggaggtgtttataaaagttacttagcaagtctgtttttgcttaggcattgtagttagtgcttctgggatccacggctggttgtaggcagcgtcttctcccagaaccactctgaaccaggaagtaggtcactactttcacatacactcatgcctgcatgcattcattctcccggaaccactctgaaccaggaagtgtgggtcaccaccttcacatacactcatgcatgcatgcattcattctgtttttgtttttcccccagaatgaccctatgcctagaattctt

SEQ ID NO: 13575 - DNA, 1094 bp, Homo sapiens
aaaaaaaaaaagaagacccattgtgctgggaatgcttgagtctgaggagagaaaacggtgggtggtgggatttggcacctctgtcacagcgttacttcctgtgcttttctgtctccacagctattataggacgtactgataacagctcagtaaattttcttaaattgatgagaacaggaacagtctttttgagcctcggttaacagttactaagaaatgaataaaaaatggttgaaaaacagggagaagaccaagttagcataaattttgagtgctctgtgttttgaacatgaggtttttcctaatacttgtgacttgctgattctcctgactatgactttctccagccagtacttagccgcggagcggaaagcagtgctcatgaaggtggaggcacacccagagactgcatggaggtggaaccgggaagtccggggtctgaggtcctgcctgcagggttgaaaggcatgcctgccagcagacacatttgggagccagagtgtgctgtggtctgaatgtgtttccccagatcatctgttactacagatgatcaccaattggatggtattaaaaggtgggccttggaggtgggtaggttgtgaggatgcagccctcatgaataggatcagcagccttgtaacagctgtgagggagctgttttgccccttccccgctgtgaggatgcaataggggaccacctgcgggtgccttgatcttaggcttccaacctccagagctgtgggcagtgcatttctgttgttggaaaattacccagtccgcggtgttctgttcccagcaggggcggactgaggccgtgtgcttatcggtggggacagcagagcagaagcagtgtccccatgagttgtaggcctggaccttagacccaggctccagccacctttgtgttggatgctgacgtctttcatttttttttgcattcctctgtcattttggtcacgtacctgctctgggaacttcccgaggagcaagtgcatgccaggcagttaatccatgtgaatgctcacggttgactcagatggagacagttagaggaagcgatttccacccccgtttcaaggggtgcttcagtgttt

SEQ ID NO: 13576 - DNA, 1029 bp, Homo sapiens
atagttaatcacagagctgaactctttaaccaaatatagtttcaagatgttacacaggctaattgtgagtccaggatcttttaatcagtccgtttactttcttaccttttgttttttgaagaatttggaagtccttctctttacctatatgttaaagctctctcataatcatatgttaagacttaatacagaatttatcataattgtttccatttaatttacctgataaaacttgatagaaatacctaaacgagaaatatcatgtaatgtttcatagggcctagtataaataagtgaagtatttgtgctcacatttgttaagtagatgttttttaagaaatgttttggatttctttttttgtattaggaaaagaatgaaagatatcttctactcttcccaaatgttttgctaatgttgtctgccagtcctaggatgagtggctttatctatcaggtaaaacacaatttaaatttatattttattgtggatctgaggataatttcaaactggctttgaattttgtgttaaatattacgtgtatctatctgtgtatgtgctgtgtgtgtagtgctgtatattcagatatggacgtacagctcctgtttgtgtttcgttgtgactgcaagcatatcctatgttaatttcaaaaaaggaaagaagtgtaaactgtagagcaacctcataaggacacagactactgtggcacaagtcagtctctgtcattgccttctgtcgtttcatgcaaaataccttgctcctccttgctatggttttattctgtgaaattggttcaagtagggcttgtgggttagtggggtagtgtagactaagatcttgtgtcagtggcacggcaccgcccaaatgcatcagcaaacagaaagtgatgtaagggtgtaagtagcagtgtgtgatcgttgaacctttttaatttttgtttccctgcttctctttgagaaaatgtgacagcagatttgggaaggaggtgcaagggtgagcagggccttttctgttgcgacagtggtttatag

SEQ ID NO: 13577 - DNA, 1028 bp, Homo sapiens
caccgatgttcagaggggctaggttaaacacagttgtgcggtttcattttctgtaggacttacagctgttaaagtacttatatgcattacgaatcttggaaaggagttcacagtgtgtagcattttttaaatacgcttggccacagaagtgtccagcagtctcctcttccaccggccatgctttaggatgagatttctcagcctgggcactgctgacgttctggactggatcgttcatggccaggggctgggggtctcggtgagactgtcctgggcactgtagggtatcagcagcctctctggcccttacttgctggaggtctgagcccctgccaggttgtggcactgccacccattctctgtgggggcacgttccccacaccagttgagcagcactccgtctggaggtgcttatgtagaatcctgctccgcagctgatggagtgctccccaggcagcgctgcccagacgcccactgcctcttcctgcggacttggtgggccaccatgtactgtggtttctgtcagctgtgccaggatgttttgtgttcacttctgacttgtttgtaatgatcactttgtaccccctttctggtatctttccattgacatttcctggtgcagttaccgatttcttctgttttcagggagcactggtttgccaaccattttgtgcattgtgtgcagcatttagcacaactacttattttctgttttacaaagtagaatgttatgaaattcttgttcttgcctcaatttcccacccttattttgactttaaacttggaacttcctctgcatttctttacgaggaaaatacatggttcttttctgcaaaaacatcatttaaaacaactgttatacacggtagttttttaaaaatcataatgtgtgatgtcttttgtcctggtgtctatgtttagtagcagctcatcagatacagtgtgtgtttgggcttgtcactctgtcccttgtcgccagttgagtttcttgcttacagtacagtattataatttattatttgagataa

SEQ ID NO: 13578 - DNA, 1183 bp, Homo sapiens
gtgcaaaacacttgcttcacatttctctgcagatctttggccctcttcgtgcagtagtgaattgttttccaatgagtgttctcgagaaacaaccctgaattgtgcctcctcacgcacagttcagaggtgcttgggtgggaagctgcttctgctccgtgtggccctagaagactgatttaggggagttttacactcaactatagatgatttttctgagaattttaactgtttattatgcttcatttaagaaaacaaaaaataaatgattatgatgatgaaaagggccagactcatgttgaaggcattaaaagaatttatgacacactgttgattttaagaaattgaggtgtcttttacttagaaaagctcaacaagtctttggatatttagagacttttttttttttttttttttttttttttacaacttttcagaatagatgaacactgaagcttcagtgtttaaacctctcctggtgttttgtgctcaagaagttggtatcgggttgttttaacagtcgtcatctttatcaagtaatacggaaaaactgggcagagcttttaaagaatgaatgacgatgacacaggcgttttctgcttacagatttcctcacatccttattaggctattaggatcagctctgtcgtgtgctcagttttcatgttttcttcttcatgtgaaggttgtagctcaagaaggattgctgtactctgatattctcatcagagtttcagagtccatctgatttctttcagcagtaaagattgtaactactcattggcttttagctagcatttcatttttaatggctctaccattttaaaattctccattctttcatggagatcagtttatcccagggacgtgtgtgtacacgtgtgtttataaagaacagtggatgagctgcttcactcaggttttcaacagcagcctgaaactctacttcatacaattttatatcaagtcagcttttctctgtggccagaccctccgtcttagtgtttctttcactggtggctgggaaggcatcccttcagcggggaaggcactgtgcctcatgtttaaaatgttctgcattctcctacagagtttcttgtgtgggatgatgtattctgtgatccaactctgaccagctgaaatcattttctaattttagcataaagcatacttcctttgacttttt

SEQ ID NO: 13579 - DNA, 1046 bp, Homo sapiens
agggaagaaaattgggataaaactgttgggcaaagaagtagaaagggcaacggaaggggtattgaagtgaagataaacaattttttttgataagtctggctgcatttgctttgccaactccacactgggagagaagggctcacaccgagcagctgccgtccagtgttgctgagcaccgcccagcagtagcgtggagagtgatcttgcagggtgtgagaagaggacatggaggctcgtggaggccgctctgcagcccgctctgcctggctctggctcaggtgtgctgtgtgctctgtgaccctctgcgcctgcaggtgccctcggagcacgtgaggggcgggcgttggctcttcaaggctctccatctcaatttgcttcgaattagggaagccatgagcacatgtgtataaatgtgtcttctggaacagattgctgctgcatttctaagagctttccaattttttatagaaatacttttgtttaactttttgaaggctattttagattcagagtttgttacgtggctgtattgggtgatgctggggtttgggcttctggggtacctattacccaaataggaaacattgtacccaatgggtagcttttcaaaactcacccccatcaccttccgccttttggagtccccagggtctgtcatttccatggtcatgtccatgtgtacccattgtttagctcccaagaaaagacttttaaagataattttaaaaaccaagctttgtttcctctgtttccagcctggttcattccatagcacatctcatcttctgagtcttggtctcgcgtttagcattcgtgatggtttatgtcgttggggtgatgcagaaaccagcctttttttgatatcggtatttaacacgtgcttgacagttgacaccttacctgctctgttgggacttgctttgctcactttgttttttgccgtcgtcttctgtgcttgtttgaaaagctgtttgaagaggtaaggggtgggccattccgttgtgaacactctgagctggtgtgcatgtggcccctgcacagcagcc

SEQ ID NO: 13580 - DNA, 1071 bp, Homo sapiens
aggtttaagccatcaccaggcctttgcaaatggcctaaatggtgttccctttgaaataacgcttgccacaagtatataataagctatattaattgtgttttgcataaaattgccaaaacacagtaatgtgtatatagtggtataagatcttgaaaaaaatctctataattgtgctctttatctgtgaatgggaaaagccatttttagtaggtgactaccatttgaaaaactcaattggatgtatatctgaatgttgcattgtattgtacagtatgcatattattgtttgtggttgcatatggcaatgaagtgtttgttttatattaaaaaaaacctgttatgtacagttgaaataaattttgcatttgctagcccgtggcttttaatatttgttacatgggggaggggaatagcatagtttgcagtgtaatataatttggctcttctacctgaacggaacatcttccaaaggcaggcaggtgatagatagaacccttctgtctgccctgatagaaaagcttgcactctcttagattagccgtgttctggacaagacgaagtcactccttgtacatttcttatttcatctctttcccgtttcttaagaagctttcagtcactggcgggtttgtcttcagaaagaagcattattttttgtgtgtgcgcataaatgggaaaaagcacaactttaaaatgtttttatttagactaaggccagtttttaatttttgttttataaagtgcttatccagctaagagagtaatgaagcaaaataaagggaaaggaaacgaagtacctggtggcaggtatagtgataggacaaggtgcagacagtaaatgtagaaaactctctcagcacaagttgggagttttcctaagaaaagtaaattagacccttagagccataaataacaaaatggcctagatgacttttggagagagattactaaatcgtttttaagtgtagttgtattttgctccactgtgaatgttatttgattttcagttgattagagatgcagattttagaaaagataatgaatttaagaaggtgaattatcctgcacatg

SEQ ID NO: 13581 - DNA, 1053 bp, Homo sapiens
gagaagctggtgaggaaagtcctgaagaacatgaatgatcctgcctgggatgagaccaatctataagggatgtcctcagttctttctgttgaagaccagttctgaggtgaagctgggcacccctgacccaagtcggggtgcactcaggaccacagggcagggctgggtggggcgccaccttgctctctgtatatagaaaagctggagcttattctgcgaatggagacgatcaaaccatgactgatgaatccagacaggagggattgactctgaggacctgagctacatcaatccactctgtgaacatctcagttacctcattctgcaataagttcagtgactgactaaaagtcttgtttttccagactttgaattgaatatataaatattatatatacatgtttcttgtaaatatcccattttgaatgcatacctgtggtggttctgtccgggctaatccccatgctagaatgtcctttccagctacgtgaataagaagtcccatgcccgcatccaccggaagcagaagcctggtggatgcctggttcgttccgcagcaccagggcctccaccgtgctgtggcagcaccccccatgtcggtatttctaaataaccttatttatacctgcagagatacacttcagtcccattcagaagtcttctcttaaagcagcattacagtcccagacctgcgggtttctgagggcaacttgctggctgacagactcagtcttgacctcaaggaaggcccatacggcactgccgcatccacctagaggtgtttgctcttgtccgctgtctgagtactgtgattctcagatgagtttgctgcgttttgggaggacacagacggttctgtataggctagttcagtaacaacaaaatacactgttttgtcttccctcaaagagagatcttactagaacctgtaaatagaatgtattatttattataagtcactgcagctgatgaaaacagatggaggccatgctgcaggctgatactgatgggtggagttttgtcatcaggccagcctcatcccgaggtctcctc

SEQ ID NO: 13582 - DNA, 1035 bp, Homo sapiens
agctgggccaggtgtggtgatgcacacctgtggtcccatctacttgagaggccgaggtgggaggatcagatcccctgagcccaggagttcgaagccaacctgggcaacatagcaagaccctgtctctgatacatacgtaaataaaataaaagttaaaactcaaaggggaggaacctgagatccaattttaaatccacctgatgagaaaaaaaaaaaagcagcccagggacgtcaccgtaaacaggcaccgcatccaccaggggtcaggagtcaggtcagggctctggactgggaggggcactgcagggacatcccgtcagcgggcaccgtgcgttgagccaggggtcagggctttggaccgggcaagactctgttttgcttccattttttaagcctctggaagtcctggctgttcagaattccaggcttgaattgctagtgttcccgggactgggaaacagcccggatgtgtggagtaagaggcagctcttggattgctgtgaacgtaggggagcaaggctccacgccctctcccagcctctctgccttctgaatacagcccaggagcctggatgactcactttctggagcacatagataaggagcgggtggaggggagaggccttagttaattaacattcctaggaatctgaggctccttctcccagccctgttgtctgggtagcaacgtgctgaacccagagtgagaacagctggctgcagtgtcaggggcaggaccttttgtcgatgagtttaaaaaacaaagcagaagctgccaggtgcctccttcgcatgttggctcccacgtgttttccccgttctccctccccaccctgagtgacacacgctatgctgcttgaaaatagcacagatgcattttgcttcacggtgaaatgtggccggtagttccccaggagtaaacaatgtggtggtgcccacgggggaagagcagcttaattatgcacccagccccgcatacaaaacgctccctccatggttagaatttgctggggctaagggagtcagggctggttt

SEQ ID NO: 13583 - DNA, 1026 bp, Homo sapiens
cctgtccttgtctaggcctctgagacaggcccgaaggacaggcttttctctctactgtgggtgatggtcccggctggtcagctagcgtccacagcccctcgactccctgcgcagagcccctctcactggaccggcgtcagtgccccacagagactggaaacctgtttccaaggtgtggctctatggccggaccacagtcggtgaggtgagggccagttccagccagggtgccacctctgccttttcttatgtccactggaaaaaataaagagggtgtttgtcatcccctgtcttttgggactcggggttcagtgcaggccaggggaggttgtgtctctggtgtttgctgaacacaaagcgtatgaaagtggtaacacctcggaggtgagggctttctttttatagcagccatgctggaactcagtgtctgaggagacctagagtatttgtttgaatgtttgaaagagacgtatctggttaatgtgagcagaggcttggaaatttagagcacgctcgactgtatttcagtagacttatgacagcagctacacatccatccattttagcattctcagagtattctaaaacatggagggctgggcacggtggctcacacctggaatcccagcactttgggaggctgaggcaggcggatcacaaggtcaggagtttgagaccggcctggccaacatggtgaaaccccgtctctactaaaaatacaaaaatttgctgggcatggtggtgggcgcctgtaatcccagctactcaggaggctgagacaggagaattgcttgaacctgggaggcggaggttgcagtgagccaagatcatgccattgcactttagcctgggtgacagagcaagactccgtctctaaaaaaaataaataaaaacatggagttcacaaagtggcatgaataatcatgaaacgaagtgacttcaaagtgtaatggttctcatgcatgtaagaattcatgttattaaacaagtataaataaaaaaattgtgcactgcataagtgacaga

SEQ ID NO: 13584 - DNA, 1730 bp, Homo sapiens
agcctcctgagtagctgggattacaggtgcccacaccacgcccagataatttttgtatttgtagtagagacagggtttcaccatgttggccaggctggtctggaactcctgacctccagtgatccaccctcctcagcctccaaaatgctccagtgatccgcctgccttagcctcccaaagtgctgggattacaggcatgagctactgtgtccggcctcctatacagtctttcttagataaaacaggaagggttagctttattactaaagaaaacagattagctttattactaaagaaaacagaaatgccatctaagcagaaatagaaactaagtatcagaactcccttgatgactgcgccacacacttcattcccactccattcccagccaggagtccacagcccaagtctcattccagccagctgaggttctgtagttgataatcaattgcacggcactcactagttttctgttttatttatgagtaaagttttaagtgtgacgatgtaagtgaaaattcaagagtgggaactggatgtgaatcaactcattgcctatcgatggcccagcaggtactgctgtccccaaggaaggtgcgggaggagacagtaggtgtcacttatgttcatggctgtcccacgaggcctgtcacgtcctatcctatgagatccatcacatcttatcctgtgagacttacaacaacctatgctacgaacatatcacatcctatccttcaaaaaatatcccatcttgccctacaagcctctaggagcaggtgcagaagtgcacgtgaggaagggagcagtggcctgaggggtgcatgggacagtggcagtcccagcagtgtgtggggtaaacctactagatggtggagaaatgggggcgggggggggcaggtggcccatgttccggtgtgggaaggcatagcgtgcgggcactggcctccccaggtgagacagtggcccgcagcggcatcctgtgcatacctgcacctacggtgttgtgcagtgagtaaaaggctccggcatgagttcggtcctgtcgggaagttggttgggagttttagggacgtggcaataactgcgtcccaagcagctcctccattcagggcccgtgacggtctggagtcggaggagccacagaccaccttctggttcctccattgcactcaggtgggcaactttaaacgtttctaagttaaaacaaagtctaacttactgtagaatagaatgaaaacttggcataaaaatgtaagaatatatacaaaaactaaaagaaataatgtgttgtagtgggtgattagaggtcctgggccagtgagtctctctctccccatcctcttctttcctactccctgcttccctctctctccagctgtgtctctctccatctctctctctccagctctgtctctctccagctccatctctctccagctccatctctctccagctgcatctctctgcattttctcttctggcctttgtggttaaacttgagaataaaaataaaagcacttacaaatttattttatgaccatatctgcctctagtttgtttgtttgtttatttattttgagacagagtctcgctttgttgcccaggccggagtggagtggtgcgatctcggctcactgcaacctccccctcccaggttcaagcgattcttacgcctcatcctcccgagtatctgggactgcaggcgcacgccaccatgcctggctagtttt

SEQ ID NO: 13585 - DNA, 1064 bp, Homo sapiens
gcttccctggactgctaggaggcggcgatggcgagtcaggaggaagcctatttttagaaacgcttaagtgcccacgatcttctgaccatcaaacaagaaacgttgctgtttgaagctatacacggacggcagaacaagaagtggctgtgtcactggatacctgtacatttgaataccggccattagggagaatcgccctgtaaacattgatccagtgattgaggccggtcggcttgcttctgttctgccccgcggtgtaattcagctaataggttttgtttgtctcagctgaaatgtgaaacttccattaggtgtctaaccctggctaaaagtggttttcagcctatttttaaaaaatctcctttgtccctgcatgcattctaaccccattctaacctgatgcgggcagccacaacccaggccctaacagagttcatggtaaggatggtgaaggcgtgacccacggtggaaagttggttattttgggtaatccagcgattttctgattgaacttcgaatgcggaaacatcttgcccttactggggcaacgaggggaggcaaggcgtgcgccaggcagagacaccttggaatcccacccagcccagatgtgtctcctgggttctgggacgggcgcaggtgactgtatttgcgctggtgggaggagttgcccccttggttaaatccggaggacacagctgcatggtgcttgccctcagccgtttctctcttcttactttgagaataatctcttttttttctagtttctcttttcttaggcatactcctttggaaacttactgggctcacttttacccactatgagaccctatctgtcatgagtagtgcaaggttagagataaccaggtccacatgcacttgtgtctttctgtagtgtgaggcctttgttgacgttatttcagtcacaaaagccgggaactgctggtgcttcccgtcactcgggtagtcccagccgcgggcacacaggctcaagccactcctcacatcagtcaatgttgtaaaccatagtaatagtatacctaatcaatacataaatgttataaaca

SEQ ID NO: 13586 - DNA, 1045 bp, Homo sapiens
ctcacccttcagacacacagtccagatctgctatgccttcctcacccggcagacacacagtccagatctgcaatgccttcctcatccttcagacacacagtccagacctgtgatgccttcctcacccttcagacacacagcccaggccactgagatgccttcctcactgatgaaataaaatggatacagacacaaactagaccatgacctttaattaaaaacccacatgatcaactttctgtgattgatttttactttagtttttgaaacattgttgccacttttgctttatttgtcctcatgctttgatgatctgggcagcgccttggttctgttgatcaggaagctctcagaactcgattacctggttcataaaacgcctagatttagatcaaagcttctcacaggagtacttcccacttggccacgctcacagaacactccaactcgtcgtcttggtctgaatcaaagataaccttgttacaggtgtttgtctgtgtttttgctgcggaagttagaacattgaaacctgacctggtctttccttggtcccagcagaatgtctggcaagagtcttttcctgaaaccgtgtccacatccccgtgtcttcctgtgaatagatgagcagcttgagggaagcggtcccacaggacgggcaagctttcacggaggggctttccattgaccatcctttctgctttgtcctgtaggttggggacattgtcatggttaaggaggacgagacctttccctgcgacttgatcttcctttccagcaaccggggagatgggacgtgccacgtcaccaccgccagcttggatggagaatccagccataaagtaaggggccttttcattagactccagggcaggatcttcctgtcctgcttcggactgtgcccatgcggccacagaaactaacatcctgtttgaaaagtcaccgttttcatgtaacccagggagttacaccagccatgtttttcctcacttttccttcctcctattttccactttcttctttttcctttttaaaaataaattgtatt

SEQ ID NO: 13587 - DNA, 1027 bp, Homo sapiens
ttcctgggaacagtctgttcctttcaggccatgccttcgtgatgtccagcagacccacagcagtgcctgccccgggtggtgctccccagactgccaggccctgagcgctgtgcctggtgagtggccatgcctcctggcagcaggctgtcccaccctcctcctaatggcttgttgctggcctccaggagcttcctcacagttgcaggtgcttgaggggccgtccacagcctctggcatccactccatcctaggaactctggtgcttgttcccttgacacccaggtctgccccataactcagggaattcactggctccggctacgttcccctgcccgagcctcggcctggaagctctccgggtagtgagctgggcacttgcagggccccctcggttggcagcattttattttgaaataattacagatttaggagaagttaaaataagtagaaagacagtccagaggggcctgtgtgtccttcgagtccagttaatttctcctttcgctggctgtgcttgctgtcatatcgaagaaactgctatgaaatccaagatgatgaagatttgccaccactgtgtttttttctataagttttctagttttagctcttaaatgtaggagtgtaatccatgtttggctaatttttgcatctttcataaagtgagggtcctactttatttccctgcatgcagttatccagttttcccagcaccatttggtgaagactctcctctcccactgagtgatactgacactcttgctgaaaagcatttgattacggtacctggaggtttatttctgggctctctgttccatcccattttctctatgtctgtctttatcccagttcccgctgttttgattactgtcagtttctagcaggctttgaaaccaggatatgtgagtctttcaactttgttcttctgttataaaatggtttggctattctgaacctcttgagatttaataggaattttaggatgggctttttcatttgtgcagaaaatgccactgggggccaggtacgg

SEQ ID NO: 13588 - DNA, 1074 bp, Homo sapiens
tgtcatgtattgcattgactttcatatgttgactcacttttgcattcctggaataaaccccacttggtcgtggtgtatgatcctctatgtgccattggattcagtttgctagtattttgttgagcatatttgcatctatatttctaagggatattgttctacagttttcttgtagggtatttgtctggctttgttttatgtgctgtgtccagggttttcgtagtacttagcaggaggaatagagaaaagtatttctgttctgtgttaccacaagagaaagtccctgattgacttttaaaagcagcgacatatttatttccaaaagcttctgcttatcactcacagcaacctaagttctgggaccattttgggttattatcctgtaaaaccattttcttgttatgtaatttttctggtttcagactgaagctatatatcttgtatgttttattgcctcttaggaaaagtcagagaattcattctgcaattcgcatttatgtctccaatctgtaacttgatcaacaggtgcacaaaagatctaatttcaaccacttatttattcagcaaacgttgttgagttttggctgtgtgccagggattcagtggtgaagtcagacacagtgcccacagccagagaacccagtgcctaacaatagaggcaaacccgtgagcagaaagctgcaaggtcgtgtgctcagcaggaggtgaggctggggtggctgagcagcgtctgttcagtgctactttcctctgagacgggtccactggcttctcacttattcttgaccaggagacaatatctggaggatgggaaggaaggagttccagaatgttcctggagaacaggactcaggcacacatagaccctgtcttgtgttctgacttcttcaactccccctttcccaacttctggcttttgagagctcaagggccatgacagccgttgacccagtggcaattctgtccacaccagttaagaggtcggaactagtgataaatatgagccttccctgagagttaggagacgcttcatctcatagaacggaaaacattgtttcaactcttacaaaccag

SEQ ID NO: 13589 - DNA, 1177 bp, Homo sapiens
aatgccagctgtgagggagtttttgtgctcagtttgagaccttgggacgtctgttgtggctgagagcattgagcagggccagcgtcaggagcgggcagcaagttgcagataggcaggctctgagcccatcaccaagccacagaactggtggtgggagatgcagccgggaaatgggggcgtcctgccgtgctctggggagttgctgcatcttcttttacgggataataagaaaatatagtgcttatatctttggggtttgaagtgttggcacacaagaaaaatgaggtgtattttctaaaactcttgattgtgaaagagaaaaaaaaatacataaaaacgagatgacttggactattttccccaaacagatatttggaaactggacgtttggaacgctggtattcaccgtgatggtgttcacagttacactaaaggtaagtggtctcgcgctcacgttcctcccccagccacagtgaacccctgcagtgtaggcctcacgcgctctgagctctctgaattataactctgtactgaggctggaagccactctccacccagccttggctggctcctggggcacccctgggcatccttgtcctgctgtttagacaagtaatgcacagccactcagcacacccggccaccccatgtgcaaaccccagagctacaccggaggtaacctcgggagcaagctgcttctttgtgaaagaattcaggctagaattgttttcagtggcaagtagccctccccccagcgccatcaaaatacactttaattgaaacaaattaatgtattttgaaaaatttcactctttaaagttcagtgaaattatatacagaatatatcattatgaaatctcaaaacctatcagactgagtcttaaaaagtgataccaaaacattcctaaggtgattttcttagatagtgatgtaaacaacacctgactctaaagtaactttctggccaggcatagtggctcacacctgtagttccaacactttgggaggccaaggtggatggatcacctgaggtcagcagttcgagaccagcctggccaacatggcaaaaccccatctttactaaaaacacaaaaagtagccgggcatggtggcacgcgcctgtaatcccagctacttgggaggctgaggcacgagaatcgcttgaacccgggaggtg

SEQ ID NO: 13590 - DNA, 1028 bp, Homo sapiens
acgcaggagggacattctgctggcccaccctgcgcgctgtcatgcagaggccattcccccaggcctgtgtcttcacccacctgccatcattggcctttgctgtcactgggagagaagagccgtccagggacccatggtggcccacatgtggatgccacatgctgctgtttcctgcttgcccggccaccacccatgccctccatagggtgaggtggagccatggtggtgcgtcctttactcaacaaccctccaatccggatgctgtgggaagggccgggtcactcggataccatcatccctgcggatgcaccgccgtaccctgctcatctgggagtggtttccctgcggttacgtccaagcccgcctgccctgtgtgttggggctggctgagtttcggtctccccatcaccggccgcctcgtggagaaggcagtgccacgtgggaggacaaggccacgccggcagcttccagccctgccgcagaagtgccaggatgtccatcagccactcgccagggcacggagccgtcagtccactgttacgggagaatgttgatttcgcgggtgcgagggccgggagacagatacttggctgtgatgagcagacatcctctgtccccgtggaggggtcaacaccaaggtggtgttcgtgcaccagaacctgtctcgggctgacgggggtggcacacaggacacgggtggatcccaacaggcagcaccgcacctctgcccgcctcccgcactgcagctccgcccgccgggctctgcgtccccacgtcccctcgtcccatccccacgtcccctcatcccgtcacctcgtccccacatccccttgccccgtcacctcgtcctcatgtccccttgtcctgtcacctcgtccccacgtcccctcgtctcctcatccccacgtcctctcgtccccttgtcccgtccccacataccctcgtccccatgtccccacgcagggctctccttcgtcttaggatctgtccagcgctgctctgggtgggttagcaaccccagggctgct

SEQ ID NO: 13591 - DNA, 1138 bp, Homo sapiens
atgattcacacccagtccctgccacagaccgtctcagacacgcacagtgggcctgctgcatgattcacacccagtccctgccacagaccgtctcagacacgcacagtgggcctgctgcatgcgtgttacctggcttttggctccacgctcactcatagccatgtccacatgggggcttgcacacaggatcactcacatatgtacatgtacccaccacaaacgtgcaagctcctgcacacatgcatgcacacaaacgtgtacacaagtgtgagctcctacacgcatacacacacacacgtgtacatgcaccaaagcatgtgtgacctacagacatgcagaacatgcacgtgtacacataccacagacacgcgtgtgcatgctcctacacaatacatatgcacatatcatgaacagcgtaagttcctacacacggacgtgtgatacacacatgcatgtacaggtaagcacacatgtacaagctcctacaggcttgctctcacacacgtgtatgcacagcagagagacgtatgagcttctactgcacacatgcacacacacacgcacacgtacattcactacaaacgtgcagcctcctgcacacgtgcacattcatgtgtacaccacaaatgagttcccagacgtgtaaacacacgtgcacacatcgtacacatgtgagctcccacacgtacacacagatgcacatggacacaccccaaacacgcacaggctcctacacacatgcacacacgtgtacaccacaaacgagctcccagacatgtaaacacacgtctcccacacgtgagctcccacacgtacacatgcacatgtacgcaccacaaacacatgcgcaggctcctgcaggcgtgaatacacacatgcacacacatatacacacatgtgccacaaacaagtgcacactgtcctggtgtcctgcactgcatcctgcctccttgctgaggggcccctgtgagaggcctctggatgggcatgggaagatgggctccctggcccccagcccatgcctccctgggatgaagagtccccctcctggcagaatgtctgggctttgcagagcaggccccgggggtgaagtcgcagcttcacttacaccagctgctctgtgagcaaggcttggtgc

SEQ ID NO: 13592 - DNA, 1032 bp, Homo sapiens
tgacagcatccctctggcatcccaatgcaggttcctgagtcccaccacagagcttcccgcctcacagatggaacagggccctgcgtcttcggcaggtactcagtggtgtttctaggttccaacttgagtcatcagtggattccctgtggagggtccttcaggggacagcagggcactggtcaggggccatgcaggctgagagcccaccctgagaggaggccaggccggcagagcacagggccccagctcggagtgcgggtggcagagtctttagtgcgtggccagctggaagcagcagtggcactttgagaatttcaagtcttgtccaggggccttggtggcctctgactcacatggcctgttcatggcaacccccgctttgggaaagctacatcatgagggtcgctcctggcgtcctaaagtgaacctctccgagctttcagccaacggtaggatacgggacacggtatggccaccgagaagcttttggacatctgtgagggccaccatcgtgaacgtggtggtcaggagcccagcatgaaccggactcagttgagcatcagggctgccccagccggctctgcggggttcacaggaagcccactcctcctccccagccatgcctgggatctcctcggagccctgaaaggtcgtccccatggggttccacagcagggacaatgatggctcaagcggccattggaaccagagctgggaagctgtgggacgtcccggatgaaatgtaggatgtaagtccctgttgggggccatgcagccccacctgttgagaaagtgaagagcattactgacatttccatcatgatgtaaggaaatcaaagcacatctagtgagaaagtgatgctgtggagaccggagagggtaaccgtgttttcttcgcagtcaccatcttcacttttcattcattaaagaaatggcagaaagaaagcagaactgactcctgtggggacaggcccacttctgtgtccaggtgggcagactagagtgaggcagagacatggcaggtggagccgt

SEQ ID NO: 13593 - DNA, 1044 bp, Homo sapiens
ggtatgaaatatactcacactgttgtacaaccaccaccagtgtccatcttcagaactttctcatcttctctgaaactctgtccccattaaacacccgctcccattccccctgttggaaataagaactcggagttgcaaagaaaacgagcacgtaaataaaggatttctcaacaaggcaaatttacttctgcagaagggtgctgctcactcttctggtcgctgcaagagcacaccgaacaaaggaggagagggggttttatccctaacgcagccagtccctgctactgtgtccagtccccattggctggagtcagactacacaatctcagctgatcctgattggctacttcaaatggaacaggggtgggggctacagtggtgggaagagcagtttcagaactaaaggcaccaaataaggaatagatgtgggttgttacagattgggaatggatgtgggttacagattgggaacggcacgaagtttgtttaccgtaactaggggcaaggaggcaaggaagttaggctttgagcataaaggacaaagacgagggatttgaacaagtggaacttttgaagaggatctcactgtatccaacacccctgcccccagctcgacacccaccatcctactttctttctctatgaaatggacaactctagggagctcatgtaactggaggttattacactgggcataacattctgaggttcatctgtgttgtaccgtgtgacacaatttccttcctttttaaggctgagtaatattccatagtgtgggtggaccacatttgtttcttcacacattcatccacggacgtttgggtcacagccgcctctgctattgtgaataacactcctatgaacacagtgtgcaaatacctgtgcaggcccctgctttcaggccttggggttgcctccccagaagtggaattgccgcatcatgcaagtatttattttgaaaccatgatagaaggtgattccccctggttctacctttattttcctgctgggcgatgaacagtgtcccgtccaacttccctgttc

SEQ ID NO: 13594 - DNA, 1033 bp, Homo sapiens
tgtgcctgcagaattagcaccacgtggactctgccaaggatgactgcttgcatcctctggacacctgagccatagctgtgtgaccaaggagtgctgtgccagaatgtggagaatagagacctcagatggctgtgggcagtgaggttgcatgggtgtcctgggcttctctccctaaactattctgtgctgtgatgggcatggcaaccctgaagatctccgaaatgcccttggggccgttagtccataatctttatgaataacaccaggcttccttcaatccatactaatcttatgaaagtaggccacactgttggttttcttccctaaatactctttgttgttctttacatggccaagctgagaatttttaaatctttatattctgcttcccttttaattataaattttgtccttaaataattttctgttctcaaattttaccataagcagttaaggaaaactattctgaatactttgctgcttagagatttcttctgccaaattatcttagttcatcactcttaagctctgccttccacaaagtcctaggacatggacacaattcagtcaagttttttgccactttgtaacaaagaaaatgaaaatacagcatatcaaaatttatggaacacatctaaagcagtactgagaggggaatttttagcactaaaatgcatgcaatagaaaataggaaaagtctcaaatcaatctcagcttctacctcaagaacttcttgtctacctctctagaaaatgaagagcaaaataaacccaaagaaaagcagaaggaaggaaataactgaaatcaatgaaataaaacacagaaaagtggctgggcatggtcactcatgcctgtaatctcagcactttgggaggccaaggtgggtggatcacctgaggccaggagttcgagaccagcctgaccaatatggtgaaaccccgtctctactaaaaatacaaaaattagccaggcgtggtggcatgcacctgtagtcccagctactcatgaggcacaggagaattgcctgaacctg

SEQ ID NO: 13595 - DNA, 1050 bp, Homo sapiens
atggtacacggatgctctgttggacgctggaatgctggtgcattgttgccggatgctggaatggtgcacgcatgctctgttggacgctggaatgctggcgcatgtgcacatgttattggcatgagctgtagttcaaacctcagccatatgatgcttgaattcccaaaccattcgtggaaatgtgtacttcttcctgctggaattctctctctctctctctctcttttaactgattggggagtgaggtgggggggggggtcttgctacattgcccaggctcaaacttctgggctcaaatgatcctcctgcttctgcctcagcttctgcctcggcctccggagtagctgggactacaggcctgaaatactgtttctttaaggaagggcatgttacctataataccaaaccacaaaaggatagctgcggttttgggcgaggagagctcagagagtttcttgcatatggccctgtgatggcggccatggccctgcatagacacgagctggaatctgcaggtggcagccaggacgctgcgtgtgtcgagtgcacagtgtggcttggtgccaaccatggcgagggtggagagccccgtgcctgcagcgcgcgcttccctcactgggtcctgcgtccttgggcaggcgatgcccctgcggggaggggctggtccatccccggccagccacggacccacgcatggacccagcgacccacggacctgcttacctgggcgcggcgcgggtggcatgcggccacacggaaggggcgcgctgggctgctgcggcctctgcagcttctacacctgccacggggcggccggaggtaaagggaggcggcggccaggcgcggccccgcggaggcagctgcactcgctcggtccactcgcggcttcgcggctgcccgcaaaccaggagggcgtggagacccggaaccggggggaagggcgggggcacttgtgcggcacccgcggggctcccaggggacctcggcggtgacacgaatttctaggtgaccttggcggtgacacgaatttctaggtgacctgtgtgatac

SEQ ID NO: 13596 - DNA, 1035 bp, Homo sapiens
gggcggaggccgcgcggaccggggcgggcggagcggagctcggcgggcggcggcgctcggggcggggcgcggcggttccggcccagccatggcggacgaggccccgcggaagggcagcttctcggcgctcgtgggccgcaccaacggcctcaccaagcccgcggccctggccgccgcgcccgccaagccggggggcgcgggcggctccaagaagctggtcatcaagaacttccgaggtgggtgcggcggccgggtcgagggccaggcgccccgggcggggaccccacgagaccccgcccgacttggggggaaggccccgagatccgtgcgggccccgggagcgggggcgccggggcgccggccgggtcgggggtggctacgcggggcgcttcgcggcgcgccctgagccgcccgctctccctccgccctgcagacagacctcggctgcccgacaactacacgcaggacacgtggcggaagctgcacgaggcggtgcgggccgtgcagagcagcacctccatcaggtacaacctcgaggagctctaccaggtgaggcggcggccggggctggggacgccgctcctgccccgcgtgacgcagacgcggccgggcggccgctccgggtgcctcgcaggctctcgccggggagcggaaaggcagggcgtttgcctccactgcagggccgggagccccagaggcaacaagtggttttgtttattgccgtggtggaatttttgttttcaggcttaagctgcttagaaccatatttaaagttatcccattacggaagagaaggaggtgtgtttctaggagccacgtgactcatattttgcaagtatacggcaaattattttctcgttatatgtaaaactcatgactgtgtcacttgccacagtaataagagggtcttttctctgttgtgttttgtgattaatggttgcctttaagatattcaaacagattttgaaaaaattcaaaattcagaaaaagtggttttgttctctgttgtgttttgtgattagtggttgcctttaa

SEQ ID NO: 13597 - DNA, 2101 bp, Homo sapiens
cgtcccatggtcccatgtggctgtggaggtcgtgtgtgactatggaggtctcgtccacgtggctgtggaggtctttgtgtgactatggaggtcacgtcccatgtggctgtggaggtcgctgtgtgactatggaggtctcatctgtgtggctgtggaggtctttgtgtgactatggaggtcacgtcccatgtggctgtggaggtctctgtgtgactatggaggtcatgtcccacagctccatggccttccttgttctgtcttccacatctgagagcagggattgcccttatccgcagtgagcattttgtttaagtagcagtgagttcactccaggcaatgctttgacactataaatagacgtgtatttgacattcacacacgtgtctgttgagctaatacagacaatcatttgatgaacctgctagttaggaagtagctgtgatgtgagaagagacagtgctggctgtagatatacaccaaatttcctcacttggctgttgatacaaggaaagcatcttgatactaataggagtagaatgcaaatgatacttctctacctccgatcattggattacattccttttctctggggtgaatctttaaaatgctaatggcctgagtgcaccaacatgaagcacacagtaccatctgattagttgctttatgcatccagagagggtatttctaaatctcaaagtatgattgagtgtcaaaaatccatttgggggaggggcaactcctgtgttgtgctgcttctataacagcacaaaaaagtcttccagtatgttcctgccagcaaggagttggcagggcggggagaaacaaaggctgtcgcctttccagtgatgagtgcctgtaatatgaagccgggagtcctgactcagcacctacagcaaacctgggttacccagggcttgccacttgttttgagaggttcttaaattcttaattttaaaaacaaagtaaattgcagtatgactcatatgaatagtaaatgtgcaccaaataggacacataggaggcagagtgggttataaaatatttagtcatttgccacaaccaggaaaagatggttttaaggatattggttcttggtctaggaattaaaacatccagaaaatggtcctaagttactgttgatttttgctgaagaaaatacattttcttcatgtgttatataaaaaacttactttgtaataattatgtttgtgggattcactaatgtttaactactggagcaaaacctttgtcgtaaagttctcttggttgtttgaggagacaaaaggatggcagatctttgaccaaattatgaagatatggaattcaaagggatggaattgaagagtttgagaaaggagttaaagtaaatacagaatgtgggtaggaattccgtttctatagtaagacaaaatgtagggggaaagtttgtatttctttgttattatgctgataataagcttgctagaaaacaggattataattaaaaacaggattataattattccacatcctcttttgatctttgtaaatatgcatgtattttatatggtagtaatcactgtatgtatttaactttggttaatatgtagcagctctccgatatttagtattggaattattaatacttgtgtaagtattagtaaaatgaatagctttataactttaatttaccttttttcctaggggtatattgtatcctaattaaattcagattatttatctaaagtgtttttattctgtatatccccacatttttcgaaccccacattggttcaaaacttgttagaaaaaccatatttctgtttataatatttcatattggaattgaatgagtttaagtttttgtacctaagattggaaaggaaattttattagaactggtaagaatgtacaagcattgtttctttgaggtgagtaaaaatattgtgagaaaaaattttctgcttcaaaaaatggtgtcagctgggcacggtggctcatgcctgtaatcccagcactgtgggaggccgaggcggacaaatcacctgaggtcaggcgtttgagaccggcctggccaacatggcgaaacccctcctctactgaaaatacaaaaattaacctg

SEQ ID NO: 13598 - DNA, 1034 bp, Homo sapiens
ttcctgaagtactggggtagggtgtggggtgcctttttcttatgattacagctatgttaacaatagggtttttttatgaaccaatctgttgttcatactgaagaattgatgtagcccttttgtttgcaggctgtggaaaatctctgttctcacaaagtctccccaatgctctacaagcaactgcgtcaggcctgtgaagaccacgtccaggcacagatccttccgtttagagaatatcctttttttggttcataaagtttctattcattatctaagtcttttaaaactgaacattattatgataaagagctaatgagtatccttaatattaaaacaacagcttttaaagttctcttttatttgataggtttgtaagcgaaatttaccatttaaattattttgctgatttgaattaaagggaaaccgtgttcatttattgggtatggttgaagtatttaggaaatgttctgaaaaatgtcttcaagtttgagtatcctttattctaataaacaccatctgcattggctttctgtgataggcaacaaagtcccatcgacttggcgacttatggagacacccacttatcagcgcacagttgtgtctgtcaggaggccaggcaggattcagtggattctatgctcagtctcacgggcagagtcaaggtgtcagccaggttggggcctcacctgaggtctttgctagcacgggcaggcagttggcggaagccagttcctgtggtagtgggactgagggccctgccttctgtcccgtgttgcttggtgtcactctcagctccacatgcacaggtccttgcctctcctctcacagcacgactcttttctgcttctagaccagcaggagaatctgcctgtctgacctgctgagatagggccttatatgatgtaacccgtaacccagtcaaggaatgatgaccttcgtattcacagcctcgttcacagttgcgtgtgaggcatcctccacgtggggacagggcaggagcatctcagaattctgctgccacaccagctgtgact

SEQ ID NO: 13599 - DNA, 1375 bp, Homo sapiens
agtctgaggggatgatgagaccaggaagtggctggttactgtgatgaaggcttttaggctacattcgtacgttaacctagtaaacatggggtgtttctgtccaactcagcactgtgcgttggggaccagggacaggcatgaatggcacgggtcctgctctcaaaaagcttgtttttgctggaagagagttctgacccagcccagtctcacctggggaaatgttaatgtgatggcagatgctgagatactgtgtggcagggagtattccaaggtctgcatattcagatttcttttgcctctgggatattccagtacttcaagtaactctactttctaagatttaagtaatttgttgttgttgttgttgttttgagacggagtttcgctcttaattgcccaggctagtgtgcaatggcgcaatcttggctcaccgcaacaacctccactcctgggttcaagcgattctcttgtctcagcctcccgagtagctgggattacaggaatgcgccaccacgcctggctaattttgtatttttagtagaaacggggtttctccacattggtcaggctggtctcgaatttgcgatcttggattatctgcctgcttcgacctcccaaagtgttgggattacaggcgtgagccaccatgcccggccagatttaagtaatgttatgtaccgattatattttgattgtatgctgatattagattatagatgaaacccatcagatgtgcaggtagaaaaagggcttttgtggaattgagtcattcactaccatcttcttcgtttaccacatccgttttcttgtctcacatgtttgataaattctgcacttagctgtccgtttcaaaatagatagctgctcttggtgacgtcccttcctcaaaataaaggccatttgtacccttgcactcatacacatgctcagccacaggcagctgctgcagaacccacaccacatgctgcaggaccacgtgccacccagccaagctacgtgggcaacaggagctcttcaaaaatgtcaagcccgcagagtgcggtggctcacgcctgtaatcccagtactttgggaggccaaggtgggcggatcatgaggtcaggagatcgagaccatcctggctaacacggtgaaaccccgtctctactgaaaatacaaaaaaattagccgggcgtggtggcgggcacctgtagtcccagctactcgggaggctgaggcaggagaatggcatgaacccgggaggcagatcttgcagtgagccgagatcgcaccactgcactccagcctgggtgacagagcgagactccatctcaaaaaaaaaaaaatgtcaagccaactgtcctcagaatctaacctgtagataactatagatgaa

SEQ ID NO: 13600 - DNA, 1047 bp, Homo sapiens
taaagagatggaaatcacataccaaggggacaaaattaactttagaaaaaaaaaataaaacatgagggctgtggtggacaggaaacagctgttggatttgagacagctagcatggagttaaaaggcctgatctttcatattttgctagtagaattcataagtaaatggttctcctttctgctggtcagatcatgatcagaagcatcttcctgttcttggaccgcacctatgtgctgcagaactccacgctgccctccatctggtgagtgtcctcacagcgcagagctgcgtcttccctgcagctgatgcttttcgtcccgtttgtgtcttccgcaggctaagatggtaaagtgtgtgtgattacttgtgccttcctttcttcagccaaaatcattaacgtgaacgtaggagtccaggtgggtcttagccttgaaacaccaggtgtctagccagcagcaaggagtggagcaggaagctcggacaggcggctgactttggtcatgagggtgaagacagagggtcttggtttctctctgacgactggaggttgagcctggagcggctctttccagcgctgcagttgaaactcggagaaagactgcctgctgcccgtggggtcgcagccctgaggctgtgcgtcccctgtggaatggcttgctcagcctcccggcctcctgagcacatagcactcatcgtccgtcatctttcggggactgtatacaccaggggttctggggcctttcctcagcagcgttcgcggccacggaccccacatgtcctctgctgacccctgtgtgtcctctgtggccaccccatggcgctgaatcctgccgcctcctgcaagccgactttggacaaaagctgtgtccggtctcaccgtctgatttgtcttgttctctgttaatgtagtgtttcattcttctcacattcatacataaaagtgatgtcgtgccttctcatgagctttaaacccaagttctttaaaatgtgcctgcttttcctaccccacccactgggcacgctgacccaaggcaatgtgatttctgc

SEQ ID NO: 13601 - DNA, 1007 bp, Homo sapiens
agtgatcttcctgcgttggcctcccctgtagctgggactataggcacgcaccaccacattcgactaacttctaaaaattttttgtagtgccaggatcttgctatgttgcccaggctggtctcgaacccctggcctcaagcgatcctcccacctcagcctcccaaagtgctggaattacaggtgtgaaccaccatgcccaacactaaactcttaatttataaacatagtttataccataactgtcatacaaactataaacattgtttataaaatagaataaatgataccacctccagtctaccacaagtggctaaaaacctgaacgtgagcatcattacaagaagaatcctggttgaggtgtgtgtgggcaatgcatggtgaggagatactttgtccatctctgggatggggaggagggctgagggtgaaccttggcctgtgctttgaagaatgagcaaaggtggtcaggcagctaagaaagaaagagtagaaggaagcagtaagttcaaagccgagtatctcctgctagtgatggctaggacggcagcatgaccagaagaagcctgtgtggggagtgggaggtggggagggatagagctgatgagggccctgaagggtttttcagctgaggttgatgttttaaagagaagatcccagtggcagggtagagagtcacacaagtggagacctaagccttcctaagcactggctacctgcctggcactgccccaagggcttcagaggcaggaactaataacatttgatccccattttaacagttcaggaaggaaaggcacagagacattaagcttctcacccagggtcacacagctagcaagtagtagggccaggattcaaacccaggcagctgcctcgagcccacaagtctggccactgcaccttcctgctccaactgtggtgaagtgcacagaagacctggtgtgcagcacacgcgggagcaacaggagaggcccatggtgatgtgggcagtcaagggaggtgcacgt

SEQ ID NO: 13602 - DNA, 1008 bp, Homo sapiens
ctttctctgagggggtgggggtgccgctctctctgagggggtgggggtgctgctctctccgaggggtggaatgccgctgtctctgaggggtgggggtgccgctctaaattggctccatatcatttgagtttagggttctggtgtttggtttcttcattctttactgcactcagatttaagccttacaaagggaaagcctctggccgtcacacgtaggacgcatgaaggtcactcgtggtgaggctgacatgctcacacattacaacagtagagagggaacatcctaagacagaggaactccagagatgagtgtctggagcgcttcagttcagctttaaaggccaggacgggccacacgtggctggcggcctcgttccagtggcggcacgtccttgggcgtctctaatgtctgcagctcaagggctggcacttttttaaatataaaaatgggtgttatttttatttttatttgtaaagtgatttttggtcttctgttgacattcggggtgatcctgttctgcgctgtgtacaatgtgagatcggtgcgttctcctgatgttttgccgtggcttggggattgtacacgggaccagctcacgtaatgcattgcctgtaacaatgtaataaaaagcctctttctttttggggtgggccttgtccttctgtcagctaaaatgggagctcatgagagaaggacgtcagggaaacggggttgagggtggtctcggtgcagagagaagggtgtcagggaaacggggggtgagggtggtcttggtgccagacgtagggaatggtgttgggagtggcccgagtgcctggcacagttgtctggttcattcatgtaacatgataatttttaaatcattaaaaaaattacctttcatacagataccatggaatactatgcagccataaagaggtatgagatcttgtcccctgcagggacacggatagagctggaagccattattctcagcaaactaacacaggagcagaaaaccagacacc

SEQ ID NO: 13603 - DNA, 1051 bp, Homo sapiens
tgcttctccttttgggagtcagtctccaagaatgttttgaattgaacactttctaaccagaatatagtcttttcttggtgacttttgcttgtaattctgatcagtactgttgtctaacacagtactgtcttcaggacctgctggggtgcagacagtcgctgagccttcaccgagtcatctggcctccaggcttttttagttctcctgtttgttttgcataaggtttgtctctttctgtggctgccatttcatggtttgggcagaatgctgcctccagaaatgctgcccttacttttgctgcatctaacctactttgcctgggaaactcgattaaaccaattagaatttgggttagcagtgaaatgaaagtatagatatatagatacatcttttagtaaccaggtttccaggtcggggaatctttgtaatatgtgatggttgagtaggaattcctgagtaacagtccattggatgctgctatgaagaatggttaggttaatattttgttgttgtttactttaaactgtaaatctgcgtaagtggtaggtgttggttttgttgccttttttgggatagctacttgtgactggtgatctcctagtggccaaattccacggactctacgtttattactccttccttccacggtctcggtttcccacctctcagctcgttctgccttagtgacctttgctggccgctgtctcatcctgctttctgaacagtgctcctgtctgggtgccttgccctacccctgctcatcaccacctggacaccacggctacagccgcactgaaaccgtcctcattcccccagcagtaatgttcagaaagcaggttcctgtctgtgctgtgccttgccaggataaattaatatacattgttttaggtattcctaaagaaaggaagagaaggagactgaattgggatgataacaaaaagttctagagatctaggtattgtggcatatatatatatatatttttaattcttgacatcttggtagcacttgactgtagactgactttggaaatgtggcaacatttcaaatg

SEQ ID NO: 13604 - DNA, 1031 bp, Homo sapiens
gtttttcagatctgattatttaatactctgatcaatagtaatgaatcattgtttaactatgtgtgacaataactctttttcagctgaaaatgtgtgtctgacatgcaagctcagtggggcagagacccgtggattgctgtgccctgccctccggacctggatcatgaaggtgttgggaagaagcttcttctgggtgctgtttcccgtccttccctgggcggtgcaggctgtggagcacgaggaggtggcgcagcgtgtgatcaaactgcaccgcgggcgaggggtggctgccatgcagagccggcagtgggtccgggacagctgcaggaagctctcagggcttctccgccagaagaatgcagttctgaacaaactgaaaactgcaattggagcagtggagaaagacgtgggcctgtcggatgaagagaaactgtttcaggtgcacacgtttgaaattttccagaaagagctgaatgaaagtgaaaattccgttttccaagctgtctacggactgcagagagccctgcagggggattacaaagatgtcgtgaacatgaaggagagcagccggcagcgcctggaggccctgagagaggctgcaataaaggtcagtcctagagagggagagagagagagagggagagggagagagaggtgaagagagagggagagtgcgtgcccacatcctcatcctagagacagcccacacggagctggggagcagacaggaagggaaggcgtgaatgctgctgatgtcgctcaggtgttgtctttcacaggaaatcgcatctagaaaaatctctcatgtgagggagaatcttttccttttgcataatagtgtagctcttacttctagaaggagccagtctcatacttttctctatagagaaatcccctggtaattcaaaaagttattcaagttgtactagtaaactgatgcaaagataaatataacttaaatcaacatttgctgagtttctgacaggagttccttttagtgtgaagtttgacttttcttcagtgtcatatat

SEQ ID NO: 13605 - DNA, 1031 bp, Homo sapiens
gtcagccccatcgtgagactggacagggttggagggtcgggggctgagtgaaatgaaaaaagaccaagtggggaccaggaacgacgcatgaaaacagctcctagtttagtggcccgcacacgggacacccacacctgtgaagaaatctgtggctggaaaagagctgacggactcagcagtcacagcgtgaactgcccttatggacagagaagcttcacaaagacttcaaaatcagtgcacggtgtatatacactcggaggtgtgcagtatatatacactcggagtcacggaggccgggactggagaggcagagggccggagtgtagatggagagggtcagtatatatacactcggagtcgcgggggccgggactggagagggagagggttggagtgtagatggagagggtcagtatatatatatacttggagtctcaggggccgggactggagagggagagggttggtgtgtagatggagagggtcagtatatatacactcggagtcgcgggggccgggactggagaggcagagggccggagtgtagatggagagggtcagtatatatacactcggagtcgcgggggccgggactggagagggagagggttggagtgtagatggagagggtcagtatatatatacactcggagtctcaggggccgggactggagagggagagggttggtgtgtagatggagagggtcagtatatatggactcagagccccaggggccggagtgtagacggagagggttggagtgtagatggagagggtcagtatatatagactcagagcctcagtggccggagtgtagatggagggggttggagcgtagatggagaaggttggagtgtagacggagagggttggagagtagatggagagggtcagtgtacatagactcggagccccaggtgctggaactggaagggggccggagtgtaaacggagagagtcagtatatatagatttggagccccaggtgctgggactggaagggggctggagtgtagatggagagagtcag

SEQ ID NO: 13606 - DNA, 1164 bp, Homo sapiens
catgagcctcgctagtattcggggtgcaggctgatgggactgagatcgacgccatccacacaagcctgctgccaagctttgttttagaccgagtcttgcaacaggaagacatgagcctcgctagtatttggggtgcaggctgatgggactgagatcgacgccatccacacaagcctgctgccaagctttgttttagaccgagtcttgcaacaggaagacatgagcctcgctagtattcggggtgcaggctgatgggactgagatcgacgccatccacacgagcttgctgccaagctttgttttagaccgagtcttgctgtcacccaggctggagtgcagtggcttgatcttggctcactgcagccccaacctcctgggctcaagtgatcctcccatctcagcatcctgagtagctgggatgacaggcgtgtgccaccatgcctggctaagtttttagtctttttgtagagatggaggtcttgctatgttacccaggctggttttgaaccctggcctcgagcagtcctcctgcctcggcctcccaaagcgttgggattgcaggcatgagccaccgcacctggccctggcagacatttttaacctgatctaccattggcaagaatgtggagttgcaagatctaagcattctccatgggaatgtaaattggttcagccactttggagaacaattttgcaatcagaaaattccatttctatatacatatcctagaaaattcttgcaaattattataattcaaaacagcattatttttagtagcaaaaaattaatcaactgaatattcagtaacatgctggacagttaagatgtattcatacattggaatgctgcagaagcaaatgtgaattctgtagcatggagggaaagatagaagatgtggaatgcaacatgttttatgtgtttaaagtctgaactttacatacatgcaaacttttacactaaaagcaacaagaagtgtttgagaatgacagatgtggccgggtggctgtgccagagatggggaggcatgccatcagagagagacgcagggcagtcggctgcttgtgacatttcttccagaagctcagtgatggctctggttgttcatgacatgctttgtaccttttttcttgatccaaagtattttataataattgtttttaaaa

SEQ ID NO: 13607 - DNA, 1011 bp, Homo sapiens
gagacagagtttgcagtgagccgagatcgtgccactgcactccagcctggttgacagagcgagactccgtcccaaaaaaaaaaaaaaaaaaaaaaaagaaatgcagctgacttgtgtgtgtttattttgtgccctgcaactttgtgaactggtttattgtaatagatttttgtgtgtggaatctttaggattttctacatatgagataatctcatctgcttacaggatcattaaattcattcttcccaatttggacaccagccttgtgtcttagagatgcacattgaaaggtatggttaagaggatgactggggtttcccttaggagggtagagtggaggttagtgtatgaaacaaggttagtctgcctgatcatggaaactggattatttgttccttgagatgcactgtatttttctttctacttttgcatatgcttgaaattttattagaaattcctatatatgtccaggcatggtggctcatgcctgtaatcccagcactttgggaggccaaggcaggtggatcacatcaggtcaggagttcaagaccgtcctggccaacatggcaaaacctcatctctactgaaaatataaaaattagccgggcatggtggcacacgcctgtaatccccagctactcgggaggctgaggcacaagaattgcttgaaccctggaggcggagcttccagtgagctgagttcacaccactgcactccagcctgggccacagagtgagactccatctcaaaaaaaaaaaaaagaaaagaaaagaaaagaaatttgtatatagcccaaacttaagactgtctcaccagagcttaaaggtgttagctctggccacagcagcggcctcagtcactcttcttacatggattttgatgcaaattctgctccttttctatttctcaagatttctagccccttcgaggggcccaaccctcgaaggagtccagtaaatgtgtaactccactctgccttgcctgtgctgaaaacacatagaaagaggaac

SEQ ID NO: 13608 - DNA, 1063 bp, Homo sapiens
taacagtagcttttttttttttttttgagacggagtctcgctcttgtcccccaggctggagtgcagtggcgtgatctcagctcactgtaacctccgcctcctgggttcaagtgattctcctgcctcagcctcccaagtagctgggactgcaggtgcccgccaccatgcccagctaattttttgtattttttagaacagatggggtttcaccatgttggtcaggctggtctcgaactcctgacctcaggtgatctacccacctcagcctcccaaagtgctgggattacaggcgtgagccaccgcgcccagccgctttttttttttttttgtaagaaaaagtaccttgttcggggtggggttgggggaatgacaatttaatttttagaagcatatttacagagttcatagctggaactgtacattgaaaattgagacctttggaggcttgtgcaagttactgaatttgtgaagaaggtctcattttcctttcttctttccagagttgttccttagtctcttcagctagtcatggctactactgttctgccctcgtgagccggtgtttgtctgccgggcccgccttggtcacacagtgaaggctcattccgtgtggtggcttgggtgcgtctgcaccatttggacaccaagtctgtgttggtcacacagtgaaggctcattccgtgtggtggcttgggtgcgtctgcaccatttggacaccaagtctgtcttggtctcacagcgaaggctcattccgtgtggtggcttgggtgcgtctgcaccatttggacatcaagtctgtgttggtctcacagagaaggctcgttctgtgcagtggcttgggtgggtctgcacacgtggaacacaccacgtgaccagaggggcctgagtcaggcctacctggagtagctcagggaagctgtaaaggtgagaagcaaaggcttctccatgtgtttctgggacgcagtgaaattggtgtgattatccaagcctgtcatcttgtttgccatgtcacctttttgtcatgagatttttcaataattatataaataacaagtaagtcgtg

SEQ ID NO: 13609 - DNA, 1040 bp, Homo sapiens
taacttatcactgtttgctggaatccacgttttaccacttcatgtgaaatgtagaagccttatttccacttagctccctccccctgcccacatgttaaatagtcacgcgctgcataatgacattttggtcagtgatgggccacctgtacagcagtggtcgggtgggattctctggacctgaacaattcctgttgcctagtgaggttgcagcccttgtaacgtcacagggcagtgtaatgcccccatgcttgtggtgatgctggcacgaacaaacctgctgcactgccaatcatataaaaggctcacacacccaattaggcatggtacggaatacttgataacgacaataaatcactgttactggtttatgtatttactatactttttatcgttagagtgtactccttctacttataaagagaagtagaactgtcaaaacagcctcaggcaggttcttcaggagctattctagaacaagccatcatcatcataggagacgacagctctgtgccggttattctagaacaagccatcgtcatcatagcagacgacagctctgtgcctgttattctagaacaagccatcgtcatcataggagacgacagctctgtgcctgttattctagaacaagccatcgtcatcgtaggagacgacagctctgtgccggttattctagaacaagccatcgtcgtcgtaggagaggacagctctgtgccggttattctagaacaagccatcgtcgtcgtaggagacgacagctctgtgcctgttattctagaacaagccatcgtcgtcgtaggagacgacagctctgtgccggttattctagaacaagccgtcgtcgtcgtaggagacgacagctctgtgccggttattctagaacaagccgtcgtcgtcgtaggagacgacagctctgtgccggttattctagaagaagccgtcgtcgtcgtaggagacgacagctatgtgccggttattctagaacaagccgtcgtcgtcgtaggagacgacagctctgtgccggttattccacctgaaga

SEQ ID NO: 13610 - DNA, 1109 bp, Homo sapiens
tggccttttgaagcgttttagtcatggctgctttaacaccctcatcagataactccagtatccgttcgtctcgatgtgaagtctggcgcttgtcttttctccttcaagttgtgattttcccgattcttaatatgatgagcgacttttcgttgtatcctgggtggttcgtgtgtttattaggaggctttaaaccagtgactcccctggggagggtggtgtgaggcctggccagggggttctgcttcctgccaggcctccagccccaccccggcccaaacagctggcaagcgcttcctcatggcaggcggtggggtggaagaattttttagtatttgccttttgccagatcttctgttacatcttccctgctgtcggtagctcagccaggcaggcaggaaagtagaaggaatgaagggctgtttacctgggttttccagaggttcagcccaggctagagccccagcttggccatgctctggccgtgcaagccctggcagctttctgtgaattggggaggacgtgggaacagtgcctacctggtggaccgtgggaagactgaaagagaaaaccaggcagggcacttagtgcagccgctggtggaggcagtggttagagttcactcgctagagggtccttgtgataagagggtccttatgataagagggtccttatgataagagggtccttatcatggccattttcctttgatccagatgtctttaaatatcagaaaaataacgcttttagtcccaaccgccacatcggaatcagttcttattccttctggctacaatgtccaacataagttgaacaacataatttggacaacagaaggaagggttgtcatgctagccggagatgacttctagttaagaggtctgagcattttccacgcacaaccagttattctcaacggagggcggactctccatacgaaacaagcagagccctggcagagactgcagggcatttgtaaaactcaaacaccacgttgatctcactgccacgttctttccagttacacgcaggtctaacatgctggcataagacattgtcttaatcagaacacttttaaagcttttttttcccttttttccaattcaaaaaat

SEQ ID NO: 13611 - DNA, 1039 bp, Homo sapiens
gaagtgctgatgggtacagggtttctttttgggatgatgaaagtattctaacatggattgtggtaatagttgtgtaattttgtgaatatgctggaaaccattgaattgtatactttaaatgggtaagttgtatggtaagtgaattatatatcatagctgttaaaaatatatacgatattttaattagacatagaagaacatgaatagagactagaaatatatatatgtatatataacaaggtgttaatgattttctactagtagactggtagatttgtactaagttttttctactatatatacttttctgtaatttaggaaaacctccctttcaattttaataacgagggaaaatttatatttaaaatatcaaagaaataaaattagttgcaacataatagactctgctttcttattaagctttattcagaattaaccttgatcattcctagaggaaagaactctttccctcaaaatatttcacaggtaaagaacagaacacagaaggctgtaataaagcaaaacagatgtttatgcccatattaaagacagaggcttatgtttcttattttataaaggtctcctataccttaataagaaaaatatgaataactgagtttgaaaacaggtcagcagcaaagcagctattagacttgagtaaagtaggaaacacccaccctcacaccaaagaagggtgatggcaccacccgcccatcagactgggcaccattagaagctgggtggtgcccaggttgggaagtggggtaccttgggcatcattgttgggatgggaattggagcaacttcctggcggcccaccagacagcacctgtcatagtgggaggcacccggctcccttagtgagcacccactgccaccatcagtggacccacaggctccttggtcaccgcagcgcccaagaaccaggatggccgtggagtcagtgtgagaaccgggacagcccttgcatctggctgagcaaatgatggtgcgtcccgccagggagcccttcctcacctgtccgctggccagacatgct

SEQ ID NO: 13612 - DNA, 1688 bp, Homo sapiens
ttctaaacagaacatagcaaaggatcactttctctgtgtctgaatcacagacacagacctcagagctggctgcctcgggagtgccttgctgacggtcgctggagttcgtccatcaggcgactgcggtggggcacggagagcaaccgctgcctggcggagactttgatgtgcggctgaggcctggcgaggaattttatcgtcaggcatcagctgagataggaacgctgtcagtcgagaattttcacattctagaatacgcattcaccccagagtattgactgcaaaccaatgcagcttccacctttggctcaacacaacttaatttctgagatgagtatgattcataggtgtttttgtatttgaaaataaagatgtgtatgattcaggtaatttattttgtagcatgttaaagaaaaaaactgaaagattattttattgagttttagagaactgtgttttggaagtgaaatcacgtctcttttttctttcccagcattgtcgtggaagttctccgaatcctggttttgattggtcagattcttttttcactagcggcggtttttcttttatgtcttgttataaagaagtatctcattggaccctattatcggaagctgcacatggaaagcaaggggaacaaagaaatcctgatcttgggaatatctgcctttatcttcttaatgttaacggtaattctcaaactatgtgttatttatgtaatctgatacataatctctttcactgaaatcttgtgatccattctttacctttccattttaataatggttaaaatatttgaaacatttactagtattttttattttatacacactttcttatactacccatcaaaatataatacagggagctaaacccgtttaactggtttgactcatactcttaagcactttgctaaaatagtgtttgtgagtatttcattaaaaacaaatccgtgggccgggtatagtggctcacacctgtagtcctagcatgtggggaagctgaggcaggagaatcacttgagctcagaagtttgggagcagccaggacaacagagtgagaacccctctgctacaaaaaatagaaaaaccagctggggcgtggtcgcgctcatgtatagaccagctgctggagagactgagctgggaggatggcttgagcccaggaggccaaggctgcagggagctgtggtcgcaccactgcactctagcctgggtgacagagcaagaccccatatcaaaaaaaaacggccgggtgtggtggctcacgcctgtcatcccagcactttgggaggctgaggcgggtggatcacaaggtcaggagatcgagaccatcctggctaacatgatgaaaccccgtctctactaaaagtacaaaaaaaattagctgggtgtggtggcgggcgcctgtagtcccagctactcaggaggctgaggcaggagaatggcgtgaacgcgggaggcggagcttgcagtgagccaagatcgtgccactgcactccagcctgggcgacagagcaagaccccatatcaaaacaaacaaaactgtgatgataaaaagcgccataaacactaatatcaaaccatgctactctgtcttaaattttcaaatagctttgcacctgaaatacaaaattaagtttggaaaaacagtttttaactgtgttgctcacaagctaattaactgta

SEQ ID NO: 13613 - DNA, 1551 bp, Homo sapiens
cttttatcctctccactgtgcttgtccgtaccatgccctgacctcgtgcgggcatgcactcagaatgccagatgtgggcatgtgctcagcgcgcaagccatgttcattacatctcctcatggtgaggagctggacccagggcctcggttagagcacgcttctggtgttgtgtggtttcctgtgtggtttcctcagatggttctcaaacacgctttgatacataatggatggtgttttcggggccctctttcattcccccgtgatttcactggcactgtctgtgagcagcatgtagtgtgaggctgggggtggggggcgtgtggaaaggtggtccggctctgcaggaccctgaatgctccatccagtgtgggcacctgagacgcagcatttgtcaggaactgcataggcacaggggctgggggctcaccttgcactcaggggttgtgatctgagttgggggttggcgctgggaggagagtaggattctgcagctggtgaggccttccctgctcaaagcctgggagtggtcaggagtgctgggtctggatggaaagtgaggttgtgaacaagtcaaggaatttgatgttttcgctagctcttttttttttttttttttttgagacagagtctcactctgtctcccaagctggagtgcagtgacgcgatcttggctcactgcaacctctgtctcctgggtttaagcaatcctctcgcctcagcctcccgagaagctaggattacaggcatgtgccaccatgcctggcaaatttttttgtatttttagtagagatggggtttcaccatgttgcccaggctgggctcgagctcctgacctcaacaatccacccgccttacaggcgtgagccaccgcgcccggcctagctaactcttttaagtagaggtgtgacatttgagttttgaaaagatgatgttggcagcttttgcagaagggaacatcgataaccagttaggtgttttgtttttgttttttgagacggagttttgcttgttgcccaggctagagtgcaatggcgcgacctcagctcactgtgaccttggcctcctgggttcaagcagttcttctcctcagcctcccaaatagctgggattacaggcgcgccaccacacccagctaattttttgttagtagacacggggtttcaccatgttggccaggcttgtcttgaactcctgacctcaggggatccacccacctcggcctcccaaagtgctgggattacaggcgtgagccgctgtgcccagcccaccagttaggtttttaaaagcactggtactgcagtaaaaccacaggtgtatgtcaaaagcctttatgctgggggaaagctgtgccacttgggttgaaggaggcaggcctccagcttctaagtgccctggggcctctgtagagggccatgaggggccacaggatgcagggagctggagctaggccctggtagtcaccatggaggaggagaaacaaggacatccaagacctgaggctggaaggttctggagagaacacaagagaaaaacaactccggagcttccaac

SEQ ID NO: 13614 - DNA, 1625 bp, Homo sapiens
tgagtgaggggcagaaagaagaggatgaggtcagtcctctgggggtgtcatctttgaacagcagttgacaggcagtgggtgtgaaggtctatatggcaaggagctacacacgagggaggagagaggtactctgaaaagtttgcagagtgggtaggaaatgactgtggagcagtgaggagagtgatcagtgatggtgtagtagttagagagtgagtggtggtggacttgatggagagtgagtggtggtgctggagtggtggagagtgagtggtgatggtagattggacggagagtgagtgtggtagactcggggacagtgagtggtgatggtagattggatggagagtgagtggtggtaggactgggggagagagagtggtgatggtggtgtaggtggagagtgagtggtgatggtggagttggtagagtgagtgtggtgatggtgttgtgggtggagagtgagtgatggtagtgttgtgggtggacagtgagtggtgatggtggtagactggaggagagtgagtgtggtgatggtgttgtgggtggagagtgagtggcggtgctggagtgggtgatgtagggtcacagaaggaggaaacagcctagaaggtggctgcctttgatggtccttgagtgggcccagctggagaaatggtgagaaggattaggtttctgttgtcttgctcagggactttttattttattgcacttatttgaattaaaatggtaaattcaaatggaatatttgtgtttatactctgttaagtgggagaatgtggagaacaggagtcagctgccatacggccacctggctggctccgggaacctgaggcctggtcttgcccagcaggagcgctggcatagcatggatcacttacagaaatttatgatcaagattatgggctgctcctggcaatatggggaggatttccttgctgtggggactgtctgtttccatgcctggcccacccggtctgtgatagcctcaggtgcagtcctgtcttaagtttggagacaccctgggaggtccgtacagactctttgagtttctgaactgtcctcgaaacatctcaggccctccgcctcagggcctagggaggctgtcctctggttcctgaacagggtggctctgacccgcagatctgtgggctcccgttgcaggtaccggtggtgctcggaaccgtcctcagattcagtcttggaaggtgctttggcacctccttagagtcggacagacccttgtcacgagtcagtccagctgcaggggctcaagttgttctagagctgggctggcagggcccttgggtgagggagtgtggcttggcactggcatctcagcctgcggccaagtttcctgcctgcccaggcagcatgacccttggtgggatcaggcagagctctgcctctcccctccctacctcggaacatcctgtcgtcacacacgattgtccagtgtcatgaaagtttgtaagtgggaaggcaggcagatgatgaattcatcaaacattacagggatgcttttgctgtaagacttcgggatgtagcccgtgtggggctgtttctggggtcccgttcgcctctccaagctcctcctgccattggtaaagatgcagggcatctgaact

SEQ ID NO: 13615 - DNA, 1951 bp, Homo sapiens
tggtgaagttcaggcctgaagaggtgaacctgatgcagcaacaaactgctgtttccttcagtgcttgaaggagtgagttctgggaacaggattcagcgactcaggccttcttttgtcctcataaagaaacaactttacatttgaggttaagaaggttgtcagtttagccccctcaggtttaagtgttgaagaaatctatgatgacgtgcttgtttttacaagagtcttttcatatttcaggattttttttttctacataggatgaggttagagaaactctgaagggatattaaaaattagaaaattataggttgggccgggcgcagtggctcacgcctgtaatcccagcactttgggaggccgaggcaggtggatcacaaggtcaggagattgagaccatcctggctaagagggtgaaaccccttctccactaaaaatacaaaaaattagccaggcatggtggtgggcgcctgtagtcccagctactggggaggctgagttaggagaatggcgtgaactcgggaggcggagcttgcagtgagcagagatcacgccactgcactccagcctgggcgacagagcgagactctgtctcaaaaaaaaaaaaaaaaaaaaagaaaaagaaaattataggttaattaaaagttttgcccctgctgggcacggtggctcatgcctgtaatcccggaggccaaggcgggtggatcacctgaggtcaggagttcgagaccagtctggccaacatggcaaaaccctgtctctactaaacatacagaaattagctgggcgtggtggcgggcgcctgtaatcccagctactctcgaggctgagaaggagaatcgcttgaacccgggaggcggaggttgcagtgagccgagatcacgccattgcactccagcctgggtgacaagagcaagacttcatctcaaaaaaaaaaaaaaagaaaaaagttttgcccctaaaacatgctttaaaagaggtattataggaacatctggtataaaattcaaagaataaaaaaggacatcttttttcttacataatcagctctttgttagctctttacttttggtatttggaagaaatctctggagttcgttgtgtaagaattggaaacctcacctttggtgcacagctcgatttgcagtagaagtatcaggtgctctttaggggatgttaaaaacttttcactcttggtatttacattaaaaaatactttgttgtagaacaattagaaaatccagatttgcagttgatatttagcttgacttacagtgtggctttctgctgtttgtcataagagactagatttgtcaagttttgcttagagaggaggactggtagcagcaggtggcttagactacgtgtggggatggatctgcgaggggaagggcagatgtcagcgttggctgaattagaggctgaattaggtgacccctcatcccccaggtgtcttactcagatgattctggttgttcgggtactggccatgcactgctctctgtatctttgtgtgtagcccaagcctggaaaagcatccgccctttgtacctttttcccgactggctgagattcccgcagcatcccgactccgcttcagggctcctgtgaggacagggactatggcttttaagttgtcgcacaggtcatgggcactattcacatgtgctgcaggtaattttgagactcaaggatgaagagttatatctgcctcttcccgttagtcttttatgtgaatcctgtttgtttgtttgtttcgagacggagtttcgttcttgttgcccaggctggagtgcaatggcacgatcttggctcaccacaacctctgtctcccgggttcaagcgattctctgacctcagcctcccaagtagctgggattacaggcatgcgccaccataccctgctaattttttgtatttttagtagagacggggtttcttcatgttgctc

SEQ ID NO: 13616 - DNA, 1072 bp, Homo sapiens
gatgccctagatgtgtgtgtttaaatacacatgtacagtacggaattctaaataaatgaactcacatgttttgttcactgctatgttttactcaacagtttgtcctaggtttttttttttcacatcaataaatataagcagagataattctaaaaaatttgtggaacgtttcagacacacacaaaggagagagattgtgctggtgcctcgtccctgtcacggacctgggtgactccctgccgggccagggtgatcattaagtagttattaaatattctgacatgtgtctctcagagatagtcattcactcttattgtcacataggcagcatttacatttctcaagttgtctcaaatttggaaagtttgtttgcattggagcctcgccccctccaggctgctggagtctggtctcgctgatgcgccctcacgtactccaccctgttgatgggctgccctggctgaatgttcatccttcgaaaccctcaaaggtgttgggtgttggggcctttgggagtgactagaattgagtgagggcacgcgggtgtagtcccccctgccctgttggatcagtgtcctgatagccagtccccacggcgagcctgcccttttcccaccttgcgaggcccaaggaggaggtagtaggtgcagcctggaagctggctctgccctgacctcccgcttccacatccaggaccgtgagagagaatccttgcacttagggctccaggactacgagagagaacccaggaccgtgagagagaacccaggaccatgagaaagaacccaggaccgtgaaagagaacccttgtgcttagggcttcaggactgccagagagaatccttgtatgtagggctccagaaccgtgagagagaacccaggactgtgataaagaatccttgcacgtagggctccaggaccatgagagagagcccaggaccgtgagagagaatccttgtatgtagggctccagaaccgtgagagagaacccaggactgtgagagagaatccttgcacgtagggctccaggaccatgagagagaacccaggaccgtgagagagaatccttgta

SEQ ID NO: 13617 - DNA, 1073 bp, Homo sapiens
tgtgccctgacgtgtgactgtactgtcatgcgtgtgcccccaccgtgtgctgtaccatcacacgtgtgaccccgctgtgtggttgtgccatcatacgtgcccccactttgtggctgtgccatcacacatgtgcccccgctgtgtggctgtgccatcacgtgtgcccccgctgtgtggttgtgccatcacgtgtgcccccgctgtgtggttgtgccatcatacgtgcccctgctttgtggctgtgccatcacacatgtgcccccgctgtgtggctgtgccgtcacgtgtgtacccctgctttgtggctgtgccgtcacacgtgtgtccttgctgtgtggctgtactcttacctgtgccacacttaaatagaatgtgtttaacattctattgtgaacattttcctcatcattacaatcttgatttttcaagactgtgtggattctgtaagtcatggctaattcctggtggacggtgctgttttggccctgtaggtgccatggtgatagtgacattccttctccggacctggcgttctcctggttgttcctggagttgcttgcttaactgtggtccttctgcctttttatgacgttatttgatagaacccttgagggtggttttaaacacccctagtttcgtagcccttttagctgtcatatttattattgttttgttgctttccgcaggccggtctaattgaagccaacggagaactcaaggtcttcatagaccagaaccttagtcccgggaaaggtaagggcacctgttctggacacactcttgtgttgatgaatgcatgaagcttcacatgtttatgaagctgttgacgctgaagcctcttgctaatgatggcatctcctgcatgggcacctttgtgctccgggaacccaggagggtgggcgtaggagccttctagcatttagaacacagcctgcacacacaccagtagctttgtggattttgaattctaaggtatgtatactatttgcaaaagtttagaaaaggtagaatattgtaaagaagaaataaagatagtttgttttctctccacccaaagataatgacgtttcagc

SEQ ID NO: 13618 - DNA, 1053 bp, Homo sapiens
gtttttaattagttcatttgaaaaacgctgtgtagtgccttttacagttgaaacaatattatttctattgagttggcttgtgggccatgtcttcatgtgactcagcttgtccctgaaatgttagccctcctccctcccatgcatagattgtgtggcagtcttatcaagaaaatgtgtggaacactctactctacttatattgccagattaaaactaaatgattggctgggcgtggtggctcacacctgtagtcccagcactttgagaggccaaggcgggtggatcgcttgaactcaggagttcaagaccagtctgggtgatgtggcgaaactctgtctctacaaaaaatacaaaaattagccgggtatggttgtgcgagcctgtagtaccagctacttgggaggctgaggtgggaggatcccttgaaccgggaggtggaggttgcagtgagctgagattctacaactgcactccagcctgggtgacagagtgagaccctgtctcaaaaacaacaactactactactaattgaaataacattctatcctgaggtggacaaaaaaagtggtggggagcggcagcctggctgccactggtgcgtctggcctggaatgaccacttggggagctgggtggactctgggacagcggccgctgggacccgggcttccctggtggcaggtgtgccgaggaaaacacacagcatgtggttcagtaataacaaacagcattttcatatgacatctgtgttcatatgaccactttattataatggcatagcataacagcatttaaggaaatcagcctgacggctctatgtatgggtaaatctgaaacacaatgttggcagaattgcagaatgcgagccatataatatttgtctgtgtttcagacgcacacaaaaacaatcatttatagccttaggttcagcacatcctggaaaagtatgaaaaataaagtgagtacgtccctgcaggccctgggagttgcacacagggcagactcggggggaggctgaggatcctggggactgtaattttatttctgctcttta

SEQ ID NO: 13619 - DNA, 1091 bp, Homo sapiens
cactggcttttgtgaactcagaggtctgtttctttcttcacatttattgaaattagagactcgtttgcaaattttaaaagatgttatctttgtaatgaatcaactacatattcttgaaaactgagtgtttactcatctgtatgtgaatctgaaaagtgtttaattgcgtactttaaatcattccctgcatagtagaatattatttttgcttttaaaatgcctttccctggtaagtattacaccgtgtatatgtgcatccaatcatcactggtacatttcgaatatgtacaatctttacttttcaattgaatattctgaaaatacctttcacatatataaaacaataaaaaagtaaatatttgcttttcttaggatgcacacctttatttttggaagaaaatttcccaaagcagatcatcttattttagttccagaagagaattttaaatatgtgctgacattggttggtaaaaatactaatatttaacccagttgaatcaaaaggcaaatgtctttttaatcacttcctaatgatctgtcttggccaacttaggttattaagagaaattactaagtgtccttatgtagcacaaaattcattgtttaatatattttaaagaaatgcataaaaagcagtagatgttttaaaaatgcatgggttgtaaagggccccaaaatgaaacttcagatcgcaaaggcaatgtattcgaaagtctcaccgatgattcatgagtcattttggtgctaactggtgggaatgaagggagatgcctgtggggaggtccagggtcctgcagctctgcggatgggcggccgtccggggaggcccaaggtgtggcgagatcggggagttcttctttcctgatgttgttgtgacccgaaagtctgtgttttcttcacctgagagtatcatgtattttcaaatggggggctatccgctcagctcccccagccgtggggtggggtgtgggtggcaagccacccaggtgccgaggcaagagaccgaggacacgagctgttccagtataataaaatataaaacaagaatggttattccagatatagatcttagatatgattatatatgaata

SEQ ID NO: 13620 - DNA, 1033 bp, Homo sapiens
gagataggagctgaggggacatagtgaggagtgaccagaagacgagtgcgagccttctgttatgcccggacagggccaccagagggctccttggtctagcggtaacgccagcgtctgggaagatgtccgttgccaggtggactgtggtctagcggtagcctcagtgtcacggaaaaacagcggctacttagcagaccgggaaagggagtttagagaagactctgttcctccacctcttgtggagggcctgacatgagtcaggctcgcctgcagttatctggaggcctaaccgtctccctgtgatgctgtgcttcagtggtcacgctcctagtccaccttcatgttccatcctgtacacctggctctgccttctagatagcagtagtaaattagtgaaagtactaaaagtctctgatatgcagaaataatggcgtaagctgtctttctctttgcctcctctctctctctgcctcggctgccaggcagggaagggccccctgtccagtggacgcgtgacccacatggccttacctgtgattggagatggcttactctccttatctttcccttttgtcttgtatccaataaatatcagtgcagcctggcattcggggccactaccggtctctgcgacttggtggtagtggtcccccgggcccagctgccttttcttttatctctttgtcttgtgtctttacttctacactctctcgtctccgcacacggggagaaacccaccgaccctgtggggccggtccctacagtggggcactgcgagccccttgctgcctctgtgtggccgcccacccttccagtgttgccctgacgcccctcccgggctgtgctgaccacccaggcctcccaacttgtttcccagggtgctcgctaccacctggtttacggtttctttgtttagttctctctgcccgctgatgccagtttttgaactttatcattactacttctgtttatgtgtaaatgttccaggacttttatccaccgccctgtccctaggaccttttgcataccgctg

SEQ ID NO: 13621 - DNA, 1052 bp, Homo sapiens
ttttggtcatttttgcactttagtctttattttatatgcattcctgctatttccgtttatttaaatatgcttgaaattctctggattctttaacagatgttaggatatgagttttaagagagagtggcttgtgggtcacagccttgaggatctgagcaggattgccttccccgcgctcccttccccgcgtcccacttccctgcgccccgcttccccgcagcccccctccccgtgtgtgctcccacacagctgtcctgattgagcggttccagatcccaggcagcttttgtggccccgtttcctgcctgtggaaggtgacaaaaaacttgctctgcagaagttttgtggccattgaaagtagcggtttgtggaagccctaccacgtcatacggcttttcaaccacgttgcacagcagatcacggcttttcagtaaatgccattttgataaaagctaaaaattcagtttttgttttgcttgataattagattataggtttgcttataagttgactaggaattctaagtttgattttataggtgctgtgtgtcatagcagagtttgtctgggtgaataattgtagcaccactttcgtctttactgccggtgtgaatacactggggggaaacgaatgagaagattatcttattgatgtgctttaaacttcgtcactgaaagtcaagttcctgatttaaattcagctgttcgggtggagtttgtcattgctgttttgtgctttgcaaaatcccagtgatgggaattaaagctgacaaagggcaaatgtttcttaaacctttttatataccagaggtttacaaaaaactggactggctcattctgacacgaggggtggggctcagtccgggcatgtgagtgaaagcggtggggaggtccttaggtctctgacctgcaccagtcagcaggcgcagggcttgtcaaggtcagggtcttttgaggtgcggatgcttgtgaagcctgtggtgctgcagagctcagcacgcgcacaggaacgtgtgcgggacagaggacatatgtgctcagccggcaggagca

SEQ ID NO: 13622 - DNA, 1032 bp, Homo sapiens
tccaggccgcccctgtgatgctgactcagctcacagggctggtgagcagcaggtgatgggtgaggagcagggacagtgctgcggagacacagtgaggggagctgccacgcagggcacgcagaggaaggtgcaggcacccttgcccagcactgcatgggccggatgccgcggggccttccgcagggagcagttaaagcaggagagtaaggagagcttcctgtaagacctggcctccgtaaacaacgcattcccagtgcactggtggctcgttctcagggtgcccctgggtgctgagtcctgtcttccaggaaaggttgttggtgagcaccattgagcacctggtgtgtacctgcctctggctttctcttcttcccaacttacagtgggtttgacctgtgattttgactttaagatggtccaaaagcaacatgcattcagtggaaactgcttccactgcccatacgaccgtcctatttttcattttgagtgtggtattcagtgggtctcctgggatacccacacttgactagagtgggctttgtgtgagatgcttctgcccgactgggctaacatgcgtgatctgagcacgtgtaaggtaggctggctaagctgtgatgtgtggtaggagaggtggatgacgtgcatttcgacttagggtattttcagctcatgcgggtttatcgggatgttccttgtaagttcctcgttgtaagtcagttcctcgttgtaagtccactctttgtgagtaggtttgctcctgcctggaggacagcggcacggtgacggcatctgttttggggccaagatccagtgccttgcgtggtcctgggattcctggggaagggagtggacccatgaggtgggttagaatcgtgtgtgggattctccagccccctgtacctgtgcgtgtggtatgcgcggagccagccagcactgcctggcgtggagctggcgggttctcagtctgacatcaactcccggagaatggcatctgctgaactcaacgtaggaagccgtgcggggccagcgcgc

SEQ ID NO: 13623 - DNA, 1050 bp, Homo sapiens
acctgcaggaccactgggcctgggggctggggctagggggtcctggcctgctcacgtgttggatctgctgcgcccgtgggacgtggcccctttttgtgcagctcattagagctctcaggtaaaagcattcctcgattcaggctgatcctcaggagggctgacagtcgcttctcttttcctttgtattttgaaggaagcgcaacaggaaaggagagaagaatggcaagggcctacggcatttctccatgaaggtctgcgagaaggtgcagaggaaagggaccacttcctacaacgaagtggcagacgagctggttgcggagttcagtgctgccgacaaccacatcttaccaaacgagtcagtaagtgtgtgccgggggccgagaggctggggtggcggagcccagcggtgtggtacgtttcgctcttttaatatcgggaacagttaaaaccatacagaaaatgccaagtacagcataaaagaatttttaccaaacgagtcagtaagtgtgtgccggggccgagaggctggggtggcggagcccagcggtgtggtacgtttcgctcttttaatatcgggaacagttaaaaccatacagaaaatgccaagtacagcataaaagaatttttccgatccatttgctggcacgatgctttgtcaactccagtgagtgagcacgtgggctggctctgcacgtctagcggcccagaaatgcacaaatgcccacctcaccagctgggctcgacacccgagagcccccggctctccttctggaacacactcaggcttcgcacagccccgtcttgccctgcgtcatctgtggggtgggagcgctccctgagggcatgttggggtggcggctccgtgagcggggtgcccctttgagccagtgcccatggtctacagtttaaggatccaccggcctttttggatcatttggaaactccactccctgtcatccccaggcttatgaccagaaaaacataagacggcgcgtctacgatgccttaaacgtgctaatggccatgaacatcatctccaaggagaagaag

SEQ ID NO: 13624 - DNA, 1842 bp, Homo sapiens
ccaaaattggtgttttgttgagcgccgttgccgtggaggacacttttatcagggcacggatggctgtgcgcccgctttcccttagttctcccctcaggatcccgtttcctgagcgcttttctccctgggctgcagaggtcagcacccagcggccggcgctggcatttcagatgtccaggccaactcctcgctgtcacgtggacgcagggagggctgtgaggacccctcgagcacaggggctgcgttcttgtgccgccacgggccacctggctcctcttattttttttagcaaattgccttcaagaacctggtgcagagaaaccggcatgcggagcagcaggccagccggccaccgccacccaactcagtcatccacctgcccttcatcatcgtcaacaccagcaagaagacggtcatcgactgcagcatctccaatgacaagtaggttgtgggcggggagctgttccctggtcacccatctcttttttagggagccgaccctgttggtattgtcactaggacaagttttaaatgttgtacaaatagcaaatgttgcacaaattgctgtccattggggggtggtgggaggctgccgccatgtggcagatggaaggtctctgttccgggagcgtgtgccttagggcatgtcctcctggggagaataggcctcgatttgcctctcatctcatttacttcagagtttataaattctgtgaggagacactgatgactgggaaccgggaagctgtgtgtggcggtcagcgggtcagccgtcctggctccaccccagtgtgtaccgtctccgctgggagaccctgtctttctgactgtgcctttccccttcagatttgagtatctgtttaattttgacaacacatttgaaatccacgatgacatagaagtgctgaagcggatgggcatggcttgcgggctggagtcggggagctgctctgccgaagaccttaaaatggccagaagtctggtccccaaggctctggagccatacgtgacaggtcagcaatgcccagacaacctggcgtggctgtgtgaggaatggcccccagcctccgacggtgccctcccctcccggctcgggatgtgtcttgctgagatcaggcccacgtgtgtagggccaggagcaaagacaaaggggctgtgagggggatgagggcaggggtgtggctggggtggggtccagccagtgccgtgacccactggatatgggggccttgagtccacaggtggctcgtgtggatttcctatgtggtttgtgtgaggaggtgctaagtcaggattttaccctccaagtaggcccagaagtagaagttgagattctttgagaagtgcagttggattgctgatcccacccactgatggtagctgattggtcactagggcaaagtcaccaagaaaaagcatttcagagtcattggcgtcctgctccggagggccgggagcacaggagcttttgttgaaggagctttttttctgttctggtgaattctttccttgggggccgtagggtcccagccactgacagcaggatggctttaaggtgagaaattgtgaaggtgtcatatctgctgatccttctcttgttagcctaaacttggggtgtagatttattccctgagagggtcagagattcctccctgagctcttagactgccccagatcttgtgaaaatctggctggtccatgttgtcaggtgacagtgggctctggccgcccacgtgggctgggccctgaccccggcctctgtcccgtgcttcatggagctgccaggatgggctgtgggaagagggtttcagcttgacactttgattcggttccgtttcacga

SEQ ID NO: 13625 - DNA, 1048 bp, Homo sapiens
tcttagggtgtgccttagacatctacactatctacctgtgtatagtttatgaataaacatatacaaatagtatctatgcagaaaaagctttatcagtaaaattgcaagaggccaatggtgtggggaccttggcctcatgtgaggggcttttctgcttcctgggcagaaaggggagcccagagggcaagtggctgtgaggagggacctccaagtgatttgcgaaacatcaagatcagccttgagtggttgttttttttggtttgtcctcaagcttatttaagagctgcctcagaataacataatgaaaaacatcaatggctaatgcccaagctatgctctgtaaagaatctaccttctgggcaatgaattaatgctgtgctgaccagattgaaatggcctgtagtacagacagttctgaaagcaaactagggagacaacaaataaaagcagcttcaaggaaacgtggctaagagtcacttctgtggagactttctgccaatgtagagacttaagaagctgatctcagaagaagcggccagaacgtgaaaacatctccacattttcaagaaaggtgtggtttttttcaaatccccaaaaaataaaacgtagtgtaacagatgtattttaatacatgtatatcgaagtgaaattttgatatttttgacgtgtggagttgaactgcagtattttgaagctcagcacatgaagaaatattcctgttatccctggagaattctcaaaccgttggtgaaagccacatgtgtacgtgtctatcaccacagacacacagacaattacagaaaaggcaaaactatttacataaagaagtccggtttccagtgcattaaacttgacaccacggccccagcaactccaaggctgtgccgggcgggccaccccttccaacagacactcactgggaagtgcgaccggcccggcgcacctgcgtgggagcaagagccgtcttaggcctcggcacggtcgttggcaggtccatgttggctgctctgagccagattttcggtgggtgttgctgaaatgcatgttc

SEQ ID NO: 13626 - DNA, 1050 bp, Homo sapiens
agctttgctgtgcattttttgtgtgtttttatttatgccttgacagttgtgattgactaaatccttttaaatgcaataaaaacttctcagcattcaaatacacaattctctatcaaaagttaagtttaagggccaggcatggttgctcatgcctgtaatctcagcacttcgggaggccaaagtgggaggatcacttgaggccaggagtttgagagcagcctaggcaacatagcaagattgtctgtacaaaaaatttaaaaaattaactgtttgtggtattgtgcacctgtaatcctagctactcaggaggctgaggcaggagggtcatttgagatcataggagttcaaggctgcagtgagctatgatcgcaccactgaactccagcctgggagacagagtgagactctgcctctaaggagaaaaaaaaaaagttaagtttaaaagtactgacttaatatgtgactcatcatttttccaacagataaagagttctatctgtcttctacgcgggaaaatctatgatgctctagataaccgaaccctggctacctacagctacaaagaagctttgaagcttgatgtctactgttttgaagcgttcgatcttttaacatcacatcacatgctgacagcacaagaaggtttggaaactcaggcttttttgttttatgtttagcaaaattaatattgtttggattttttgcctctgaaatcttctaagtcaacaacaggccacatacaggtttaaatagacctactcactttcttaatgtcttcaaatgtaaagcacgttgcagaatgcagtattgtacggtgccttgtgctgtccgaatctagggattgtgataggaagaggccatctttttgagaagtgattgagatagtataaaccaggatttcagtatctcatgcagtgattctcaaccgtgttgctctttacatccttgggaagacagagaaacatccatgtccagttcccaactccagagcagatgctttaaagctcccaggtgatcctaatgtaccacaggcactgagaatcagtccaa

SEQ ID NO: 13627 - DNA, 1055 bp, Homo sapiens
tggaatggtgttgcatggaaatgaagatttttttgttatgcttcctgaatgtttactttgagaaatacgtcccgctgtggaattctgttctaaaattgagaagggaattaaacttactgagaggagtacttataaaacctaaagttataagttttcagaggctctcacatttgttcttgtaaatgttttaaccacttgggccaaacacaaattgaatccacattttattttgtttttgctcattgagtttatgtttacatttctatgtgtttcagtataataagcctagtgaaacggtcatccctgaatctgtagatggcttgcaagagaatctggatgtggtagtgtctttagctgagagacattattataactgtgattttaaaatgtgctacaagcttacttctgtgtaagtatatccatccatttttctgtaggaacatggagttcactccatcttacctaggtgattcacggacgtgctctctgaataatcttgaactagatgataatttaagttatctttaccaattgtagagcactgaacagggtgctgtcttaaaagagcaatttacagacatgaatttgtgcatatttgtagatttattacattaacttgggagggatatacatgttgctcttactgatcttgataatttgcaagtttgaaaattccattttggcacattgttttgtaaaatttattctcaattatgagactcacactgtagatactaggtgtttaatatgctgcacgcagtagctaagccatctcccacatgtatcagttttccagtgtacctaatttaaactttagctaaatgacatatgctattttttgtagatcttggttcggtttaaaatccttgaaattacaaaaattttaattggcaaatacacataacctatttattagtttggtgcaaaagtaattgcagtttttgctgttgaacgtagtggtaaaactgcagttatttttgcaccaacctaataggatttcctgttggttttgattcttttaaataagcggcctacttattttatgtattacaatt

SEQ ID NO: 13628 - DNA, 1026 bp, Homo sapiens
ccttcatctaactctccagttagagagttaattttttatctagaaggaaagacaagtatgaaatcattgctgtaagagcagaattatatgattgtgaagagttgtaatgaaatcatgtcttaaattacatgtgatacgaacaattgttctttttctgctttttcctgaacagaacttttctatctttctcataaactggtggatttatatcctagtaatcctgtaagtaatataacttttagtcttagtttttttttttttacctgtactttaagaaaatgcttaactcgtatttagacaatagcttaagttcaagcaaatgatgttttattaaagtgttgcaacagaatctcctagtgtttattgtacttacaaaagcagcattaacttttcaacccatgaaggtattttttaattataccaaagcaaaaaggtttttaaacccttttttctgattatagaagttatacatgcttattttaaaatacttagcgtatagcaatataaaatactgaccatgacagtcacgcctccctttcctaagaaatgtggataattgtttggcagctttctcacattgcacatgtaagacaacctgttgaattgtgtactgattccaaactgtcatggatcggaatggagaactaggaatggaaaatggaatcagggactgcgtctttaaggacaaaatcaggaatcagggtgtaagactcagacgacaagaatttgcaccctatcccagtgtgaaaccagagcaagagaaaaccagctaaatagtcagaactcggacagagagcaaggaagagccagggtcaggctgggggagatgagcagtgcaggggagtcaggactcacaggctggtttttgaaacagggactcctcaggggccttgtcttgtgtagacgtctccttgagaaagagccatggagtgtctgccctcttctcttggaccttagtagactgtattagagaaatgtctaacttaactagaatatgtgataaggaacatgtagtataccctctgt

SEQ ID NO: 13629 - DNA, 1890 bp, Homo sapiens
tagatttttggagtccttatgctgccattttgaaagtacttctaccaggtgtaaatatttttaaagaatttgtcatgaccttctgtagaggatataatcttaatttgagttatgactctagattagaaccaaagcacacaccaagcaatcagtatttattgatgttctgagatcatcatcaaggaaagattgtcttattacacttgctttaatgcaatcactgatcccaatcgtgtgaacagatgaaaattcaattaaaaagtagttctgactctgcctagaactgtctcagaaggtgggaaaattgaatcaatacacagggcattattcataactcttctgcatagaactgattataatgggaattcacagaagggagagcatttatgttagaaaagtcagaggtagcttcataaagggaagtagaagttgaacccaatcttgaaggataaatggtggtgagtaaataagaggaagaccagtgtcggctggggcatgacattagcatcaaggaggaagacagcaccacagagacctgcccttttgctttagagagtttttgtttttttactgtggaataataatgaaaattaaaggtaaataagttgcagatagattctagaagtggcagctgattagtccaaagcccattaggcattcattaaatatttgtaaattaagagaaaaaagtaaatgctgtgttttggctacctttaaattattttgcagataggatttgaagttgacagattaatttctgctaaatcacagtttttggtgttgaatatgtgaaattttccaattttttaggtgtcatttgcctatgctgtatattggattagaatatggtttgaccaataactcaaaactagctgaaaggttcttcagccaagctctgagcattgcaccggaagacccttttgttatgcatgaggtcggcgtggttgcatttcagaatggagagtaagtactggaagaccagaaacccttctgttaactagtgattgtaaatacagtaggtgatcactagagttcactgacaaaagcgactcttcagtagatttgtacttttaaatgttctattttaggagaaggagatagaaaaaaaagagagaaactgttatcttggatttccttaaaaattctaaacccaggttttggtctttttttgatctgagctaccacttcttttcttacatgattggacagttcagattacacataccccacagtgtggctgggggcactgtggaatccttagttatctctgtgttgataaggagttgaatttacgtatttgagaagaatttgacatggtttttgaaacaaaagtgttttctatttagttactagtaagtcagaaaatttaattcctggtcagtgtaggctttactgtactctagaatatttgtagaataagtgatttggtgttatactcaaagagaaaaatgtatgtaatcctttgcatttcatgatatacaaattttaaaatggtaaattagtttcagttttttttggtttttgtttttgtttttttgagatggagtctcgctgtgttgcccaggctagagtgcagtggcgcattttcagctcactgcattctctgcctcccaggttcaagcgattctcctgcctcagcctcctgagtagctgggattacagatgcccaccaccacgcccggctaatttttgtatttttagtagagacagggtttcaccatgttggtcaggctggtctcgaactcctgacctggtgatccgcctgcctcagcctcccaaagtgctgggattacaggtgtgagcctccacgctcggctgtaaattagtattaatactactacagtgtcatttatggcatgtatgtgttctaaaaaatgggttatctaggta

SEQ ID NO: 13630 - DNA, 1075 bp, Homo sapiens
ttcgtgcctgttttgtttcattctattctgattttcacttctcagcttcctgctgttactgtttgtgcacacctgcccacagttttcttctcccttggctgttagctctctctgctgttacagacacagctttgcctccctgccaagcgatctgcctgtccccatagacacagctttgtttactttggtctctcatgtcatctgaacttataaacactatttctgtgtttgcacatgcgtgtatataaagcaggtgcctctgtcgcatagtcttgggtagttctggataatccaagtgttttgttaataggggattgccacttgccaccttgtcagttttctaagaagtgactgccttatgccccagacgggctcagcagcatcagcatcacctagaagcctgctagaagtgcagaatctcagaccaactgaatcaaaatctgcagttttagcgtgatgcccaggggattatcacgcacagaaaagttttgagaagcactttcctaaaccatacttaagttgagcctgtattctttgatgattaaggggcactaaatttagagtcttacagaaacttaatggttttaagtatgaaagcacaacactattgaaatgtcaaaatgctcattaaaaagttatacgaagagggggaaaatattgactttattagaaactgcagcaaatgtcaaagagaaacagtcatgcctaagagtcattaaatgatttgtttttcattcacatgggctgtgcctcctagaactggtctcaatagagttagagaatctgtggctcaggtctgttcattcatttagttgacatatatttaatgagtgtcagccatgccataggctctgagctaggccttgggatgcaaaggggaatgagtttactatttcctgacctcagatcaactggcgaatgtaagtacgtaaattgacagtgaaaatacggtgcaattgaggaactaaaggtgcccacagagaaaggcagttcacccagaaatgagccttttgcatacacctcagtcctgaaagtcatcagacatcagctaggcaaaaattagggcaagggtatt

SEQ ID NO: 13631 - DNA, 1070 bp, Homo sapiens
aatttagtgcttttactgtagccaataattgtgttctctcccacagaaagtatgctgaggccttggattaccaccgtcaggcactggtgttgattcctcagaacgcatccacctactctgctattggatatatccacagtctgatgggcaactttgaaaatgctgtggactacttccacacagtatgtcttttctttgtacctaattttaaatctggttaacattgaccacttccttttttgaaaatattttttctaggtaatattgacttactattttaatattctttaggcaaccttacgtgttattcttttctttgcagagaaaagcatgtgggtgttgtacagtattcatcaaattagaaacaaacatgaatcctgtccttagtgtttgcagtgaggtgcgcaggtgcccagtggcactcaccagtgatctgagtgctgagcacggggttatctgtccacagtagcccctttgggaactcgcagtctttctgttcatgactgtccccttagatcacattagtagatgaacaaaacagtctctgcagtcatcacaaggaaagaacctttcattaatccatgtaccatattccatcaaatttaagacaccatgagtaagcaggatgaccacaaagaaaaaagtgctgccaattaaactttaacataattttttcccggcacttaatttttttgtacttagagaaaatattcttgaacatatttaggcagatttgtattactctagtacatacatagaaatgtacatataagtgaaataaatggttacaatattcagcccagagggccagtatctgtgttttctcaaaatagtgccctggtgctagcacacacgcccagttcctgactctgggtttcctcccagccacagacacctgctttccaactctctctctctctcgtccctctcagtctgctaaagtgtcaacagaaggtttttagaaaaccacaattcccgcatctgtttaagtgttcctcgcatggtttgtgatctagtctgtgctgccaacataaccaccaagttcacgcttctcaggcaggttacccata

SEQ ID NO: 13632 - DNA, 1080 bp, Homo sapiens
tctgtttctataatgggaaaagaaatcttagcaacatttttctgataaacaattgaagaggctctgtcattattttataatgcagggtataacaatataaatctttacatttcaatagaatgttgagatgccatacatttccataacagtgaataagtaatagtataagtttggatggaattgctgtacttgggcactcgtttagttataaacattatgtgataaggaggatgtggtgaggttattgagatctaggataggaaagttgcaagcttgctaactcccgttcctactaaagtaattttttttttttttgagatggagcttcgctcttgttgcccaggctggagtgcaatggcgcaacctctgcccaccgcaacccctgcctccctggttcaagctattctcctacctcagcctcctgagtagcttggattacaggcatgtgctaccacgcctagctaattatgtatttttagtagagactggtcttctccatgttcaggccagactggtcttgaactcctgacctcaggtgatctgcctgcctcggcctctcaaagtgctgggataacaggcatgagccactgcgcccagcccctactaaagtaatttctgatgtaatttcccccaaagtcaaaaagatcaggtaatgtgatacaaaacagagcagagccttagattttgagagggatctgtctgcttatgtgtcttggggttccctgaggaaaacagaggtttctcctaaaacggggtctgtggcaccctctggttttcccaaggagcccgaggctgtcagaaattaccttgggtcctctcatgtggacatccagagtggcgagaagacagactggggaactaatctagccaactgagaagaaaaacaaaaaatgagtaatacccattgtaaagttggataaactgaggcacatcacagtttaaaaatgcatgttcccataggctccacagctcactctcttaaccatcctgtaattgtgcctgctctatgcccagtcactgatgcacttgtgtggtagctcatggcacacctagcaaacagtttccctgcccccttagaac

SEQ ID NO: 13633 - DNA, 1035 bp, Homo sapiens
gcctcggcctcccaaagtgctgggattataggtgtgagccaccgcgcctggccacacagtgcagttcttacctgtaacagctgaggagaaagttgtccacaggcctcatacgtatttaggaggccttggaaatgggcaactgttgaaacactggagctgcaactgcatgtgcttctgaaagtcttctgacacttcctttgcaaatggtggaaaacaaatgaaaaagaagattggaatgttgttttccttctgctctcaacttgtgctcttaaaagtataatttgacttaaatgatagagatggtgtataatgatggaaatgataaatgatggagttttgtattttattctaaatagtataatctgacttaaatgataagagatggtgttatataacaatagaaatgataagtgatggaatttcttattttattctaattatagtatttctttttaggagcagacattaaagacaaattaaaatgttatgactttgatgtgcatacaatgaagacactaaaaaacattatttcacctccgtgggatttcagggaatttgaagtagaaaaacagactgcagaagaaacggggcttacgccattggaaacctcaaggaaaactccagattccagaccttccttggaagaaacctttgaaattgaaatgaatgaaagtgacatgatgttagagacatctatgtcagaccacagcacgtgactccagtcagtggtcctggtcccactgtcccagtgtaggttagtattccttcacatcctctccatggcttaagaatgtcccacttcctaacgtgactccaaactgcatctctacatttaggaacagagacccgccttaagagactggatcgcacacctttgcaacagatgtgttctgattctctgaacctacaaaatagttatacatagtggaataaagaaggtaaaccatctgttatgtctttttttttcttttccaataaacttttattttggactaatttttgatttacagaaaaatggcagagatagtacagaga

SEQ ID NO: 13634 - DNA, 1016 bp, Homo sapiens
aagaaaagagtacggaagtaatttataatcaacaaatatgtgttcactgagtaagtgatactgacatggcatatggcatacaagcatcctgagagtaggatcatggggcattcaatggtgattgtccctagagctggttagggcccagctttccactgtccttgtactgctgcgtgtacaatcggtgtcttctttaacttcacagagatgccacaaggcaaatagcattgtcttcactttctgtgtaagaaaactaaggctcggtgagagtatgcagagctggttcatggatttgtttgggtccttctagtttcaaaacccgtgaatattttcctgtctctaatgctaatcttagcaatatatttggaataagcatataaacatataaccacagtccactcaggtaataggcaactaaattataaataaatgctcaacgagattatgagtgattgaatgagctatatacaagaataataactggtggaagtgttattcataggataaagtagaaatcatttaaatggctaatagtataaggagggttaaatcaagcaggtgtggaaatagctgatttacatatatagtttatgccatgtaaaacgtttataatctaatattggatgaaaaacagatacaatattttatgtacagtataatctaaaatttctatgtttagttaaaaatgcaggaatataattatcaaaatttgagtgataaaattatgaataatttttttctttgataactcattttatatttaccaaagatcctccaaagagattatacactttttttaactagaaaaaagttatttgttaaagagatcataaatgacataatattttacagaagttaagagctgagattgtgagaatttccagggactcctgccatcagcccacctcgcatcattgtttacatggaaatgttgggactgaggtgacctcatgcctctcaattcccagccagccttctctccctctggctcttagctagcctgttaaacagaaaat

SEQ ID NO: 13635 - DNA, 1023 bp, Homo sapiens
tctaatctcactagagtacttcctgttgcactgacctgaaggcattttatcatgtactcactgtaatgaaacaatacattcttaaactggcttgtgtctgaactgcagacatattcaggagatttttcttctgcttctttcttgcccagttgtataaccattcaccagcttgtgtcaatgctggagaggaagtactgccatagaggaagttaactcaccatggttgtaagctgttggtgtctaaacaaagattggaaacaaagagggcaaatacaagtagtttttcaaattgccctgaatttgccactgaattaaactgtgtgtctgcaaattagctatacgttttctgtaatggagctgcccagggccgaaacaaaattagacagattaagcaaggcaagcatttccttctttccccactccaaacaaaataaagcaggttttcattttattttatttttaaattacaaagtctcattacatagatataggaggaatttgcagtagtccctgtgagaaatgctggtgtttcataccagggggatgatattggatttatagtaaaagctggaatcagtgcttggctttgacatcatatattcattcacctgatactcagcaagtcactaaccctctttaactttcagattattcaaatgtaaactggctatgatgcaatctatgtactggatattgtattgtaaaaaattagtaataaaacgaaaataacatgcaaaaatactttgaaaactctgtagttctgtaaataggttttattctaaaaactgaaaataatgtaagagttcattaaaggaaaatctgaaaatacaatcaacaaatctaaccacatatagtcattcttaaactttgatgcatgcacttctaagttctttaggcatatacttttttgtttacagatatgagaccatacttattcttttgtaaataaccttattacttaatgacatcatgactatatttttttgttaatatatattcatgtgcacttacaacattatttgc

SEQ ID NO: 13636 - DNA, 1046 bp, Homo sapiens
gctattgagtccaagtgtggtggcccacacttgtaatcccagcactttgggaggccaaggtgggaggatcatttgaggccaggagtacaagaccagactggacaacatagcaagaccccctctttttttaaaaaaaaaaattagccaggtatggtggtacacctgtaatcacagtgctttgagaggctcaggtgggaggatcacttgagttcaggagttcaagactatacagtgagctacgatcgtgccactgcactctagcctgggtgacagggcaagacctgtttctaaaaataaaaaaaaattaaaaaaaaaaaagcttttgagaggtatagaaagataaggactaaaaaatggtttttggagcaggtgtggtggctcacacctgtaatcccaacactttcagaggctgaggcaggaggatcacttgaagccaggggttcaagaccagcctgggcaacaaagcaagaccctgtctctctctaaaaacaaacaaacaaaaaccccaaaaaagtggtctttggatgagaattttggaatagtgctagacagaaggaagcatgagataatactagtgagagagtagactgcagagtgagataggaagataagccaccctggacaaatctgtaaaggttaggaatgaacccagtgacggctgaagggcaggtgacaaagtgaggttgagagatgcgtttttttctttaatttgtttaaaatgggaaatgataccaattgctcagttgcctattccccttgcccagcctcaggtctgagtataattctcaggcctgatggggtttgcagtgtgggctttatctccttgtagtcctggggaggaatggaggagtagcgttggtgccactagggtgtcgttctcttaagacagatacaatgctgtttctttacaatactggctaagttgctgtcacaaaaatactccaaatatgcagtagctcaaacaagataaagcatatttctttctcacttagcagcctgaaagtgggcaggtggttctgggtgagtaggtgtttttgttccatttc

SEQ ID NO: 13637 - DNA, 1042 bp, Homo sapiens
taagacacaggaatttaaaattaagtcatctgtgcttttgattagaagaatgtacttttcagtagtgaaatacagagtatcttaccagaaaaacaggaagctgaaatttatcattcagaactacagcttgtacactacacggtccacagagccgagcaataacttctttacccaaaaagtttgcatggaagataaacagcaggatgccagagcctgaaaatgggagatgtgtgtgaattacttcaaaggcaaccttcagtccccagaggaacactcaacaccagatggaagcaggcccctgagctgggcctggtcagacaggcatcacccactctgcctggaggctcagaggaggctggccctctcaaagctcgtgtcacctggcatttttcaaccacagaactctttttaccttttgcccaagtaatctctgctgacagttcctggaaaagacttacgtatgattttctacactgaagttatttaactggtatttaaacactgctgctgaatgtgcacacgtcccagggacattcctgtggtgggcatctttgggtgtgggtctgagtggttttccattttcttccacatacccttttgccccttccaatttttctgattaatacataaccaaaaattggccaggcatggtggctcatgtctgtaatcccagcactttgggaggcagaggcaggcagatcacttgaggccaggagttcaagatcagcctggccaatatggtgaaacccccatctctactaagaacacaaaatttagctgggtatcatggtgggcacctgtaattccagctactcgggaggttgaggcaggagaattgcttgaacccaggaggcggaggttgcagtgagccgagatcgcaccactgcactccagcctggggaacagtgtgagactcctgaaaaaaaaaaaaaaaagttggtggatgcagacattgtacacatgctgagaaaactgcaggcccagcagttgtaggtgtcagtgggggctcaggttcaccagggccagctcagggcatcgttct

SEQ ID NO: 13638 - DNA, 1070 bp, Homo sapiens
agcagtgtgaattccatagtggtcttgacttcttagcaaggatttgggataagtctaaaacttcagacttaaagctttgaagcatgttaactgcatgaaatattaaacatttcgaacttctttagcctttgtcattttgtgacccaggtttttcatagtctgctctatgtctcctgcttttccttgttttgctaatcatcctccttgagctccactgttttcattctgggcatccaatccagcctttcatggtgtgtgcttcatcaggcccctggttcacatgctgagtgccttataagcctggccagcactagtatattctcattaacaaacaaacagtcagcttcgtttgggagggtgcttcactttcaaagctacccagtataatgcatacaatgcagtacaagcggaactcactcagaagtagcacctgagcttcaaatagactctcctgatcattctactgagtaagattctccacatttaagaatcaatacaggatttacttgcgaggatagtgtataaaaatggaatagtttttctatttctggactgaaaccaaactcctcatatctaattgtagttattcaacattatcagaatccctatttattttggcagaacagacaaaaggacgtggaatgtactttctgctacagccattacagtcaactagatttgagtgctgccgctggtaagttaattgaatagccaagttatgttgtccttacccaagtagacagtggaaaggaataatggcagaggccatgatgcgagtctggccacagccatgcatcccatctgtggtgatcttagtcctgagatcacctatgtcctaggccacgaactgaatcatgtactagtaccatatcatctgacttcgtagctttccaggggaaaagactaggagatccggacatgactaggtctgtgtcctcagtcacataagctgtgctgcgtacacttgaactgcactacacaacattgccctgggccttgacctgtacttctaaatgttataataaaccttttggtaaggtgctgcctgagaactgctttgttttccagag

SEQ ID NO: 13639 - DNA, 1067 bp, Homo sapiens
gttcagtttgactgttttcataaacgtaaggtcttatgagctcctttgtagtcagtccatcctgcgtcagaggacgtcactgttgtgtattgatcaccgttgataaatctgtttttgaatttcatagaaatggaatggtacaatatgtactcttttttctctccggcttcttccacttcacataatgtttttgaaattcatctgtgttgctgcatttatcagtacgtggttctcattctgctcaatgacatatctttaaatgaatatgtcacattttgtctgtctagttttctattgatatgctcttggggcagtttttatttttggggctattgtgaataaagctactatgaacactcttgtacaagtcattatgcattcattcctcttggggaaaattcctaggatcagtattgctaagtatagagtagcttatgtttcttagaaactcttagagtatagggcagtttctttctttctttctttttctttttttcttttgagacaggatctcactctgtcacccaggctggagtatagtagtgcgatcatagctcactgcagccttgagcttctgggcataaaccatcctccagtctcagcctcccgagtagctgggaatacaggcatgtgccactgcatctggctaatttattttttttttttagtgagagacagggtctctcactatgttacccaggttggtcttgaactcctgggctcaagtgattctcccacctcggccttccagaatgctgggattatacctgtgagccatactgtcagtctagggcaggttctattaatatgtttcttagaaactgccaagtaattttctaaagtgcctgtcctgttttcttttcccatgaacaatgtataagatttccgttcctccgcatccttgacaacactccatactgtcagtcatgttaattttagccattttagtgaatatatctcattgtggttttaatttgcttttcctcataactttttttagtgagcctgacgttgtgaacattttccgataacttctgatgttgagtaccctttatatactgcttttt

SEQ ID NO: 13640 - DNA, 1048 bp, Homo sapiens
aaatatgttgataccagactttttcacagtttttcctgttatgtattactaattgtcttcagtcaagaaatgattatttttaactcctgtgacaccaaaatgagttacatctctacaaaaatcagtgtttaacttttattcttggtacatgaatacagaaaaaaaaatgataaaaatttaaaaagggacctgccttgagtttttactttgtgtcatcttatacattactgaagtcttctgattggaatgtggttccctcccccaccagcatgcatatttaacggctctagcattaccttactgggcagccatagaactttatatttgatctgttgctaatatgtagatttatgcatgatgattaattgggaaaaataagactacttcttttgtttcttggctgtgtattgtgctacattgccctttatctgaagccattaaatttttttaaaaaattagtggaagatgggcagtttgtggaaaataacatgctccaagttttagggctgggaagtacaatgtagaaaagtgtgtttacattcttagattctgctttgcaatagaatgtacttaacttatgttctgctgtttgtgctacaggccttaaagtcaactaaagtctaggggttcatgtcatgaactttttgacatatgaatggatgaaatattccctaggttggctgaaaatatagatctcatagtttgaattattttggaattacttgaatgatatagaagactaacctatcacagccagtttctatttcttttctgtaggtcataaacacagcatagatacacatgttaaataatttagcagtgcttgaaaccctcttagttacatactgacttcctacagtttgctatgtagactgtagtttcttgcagtttgaagtgtgaacacagtggacccatcctttgccctgatagcatttgtgtaatagagtgacaaataatatcttaccatgtagcgataaaggcagtagagaaaatgacagctactcttttagttaaggggcctagaaaatagctatcttaggagacaaag

SEQ ID NO: 13641 - DNA, 1034 bp, Homo sapiens
ctgcttgtacacataaataaaatttcagttctgtcttgtggaatataaatcactcaaatttcacatgaggtagttcagtctcaaaattaagaatagaattagaattaagtaggttcaagtggaaatgtacttagtttgaacacatttcattttagattttcttcatattttaatataaatttagtcaataagacaaattattcattaaatacgaggtcctacattgtgttgatagtaatataagtggaccttatattttttaaatgctttgtttaagtgttttgttgatggtgttgaagactttgaaatagataccttaatctaaattttatcttaatttttatttttatttcattgtctaaatttttatctaaaattttttctagctctttattacaccaagacagcttcacatttttatttatatattgtacatctcatgtaaggaattaccgtatataagctagtgtcataacttaagtagccacattcattcagtatgttttatgttttctctctgactggatctctgatacattctttcctgttctagctgcttttatgcaaaagggcattatatgtttgtcaatcaaccaggcttctgtgactgtttagaagaattatgtaaatatataatcctgtgcctgttcactttgccatgtttggaatacaagttatttacattattatctttatggttatttaaataatttactttttgcaagttatttgtattatttattacgtgaaaattgagaaaacatcttagtgtacctttcgtggttaacttttcctcaggatatttttacattattagataatgtaaatcagtattaagtttcagacattctttagatttaaatatgttgcctggtgtttttatgtattgagaaaaagtaaactaaattctacatagtcattctgtatgacttttagtaatttctgacctttttggtgttagaggcaataatagtaagttgcttagttgttaatcactgtatgttaattctttgagttgattagaaaatatgttc

SEQ ID NO: 13642 - DNA, 1031 bp, Homo sapiens
atatttctgaggtgtcagaggatagcagtgatataaaaagtcagacttcttattttcaagaataaggcagtaaatatccatatacatatcttctaattcaacagttattcatgttttcctgtgttcatagatgtttttaggcatggactttttggggggatggcaaactactttaaagtaagtagcaggcttgatgttacttgtcccttaaatatttcaacacatgcctccaaaaacaacatttttaggttaatttcatactgatgaagattcatttcttgaaatcgaagagtccacctcttatgtagcccagcatggaaacatttcattctaagcaaatcatataattcaatgaattgggagtagtcttatactttacaagatcattttgtttccagcagctttcattactgaagtttaaaaattaaaatcatttttctctgttcactttacatgtttttctggtggtgtaaaatgaagtatgtctgccatttcctaagtgagtatccatcagttaatttatggactgttactctggggaaataatgaaaaaaaaatgcagaaaaaaatttatagtgtctaatgtttaaaatctggagttttttaaataccaaaagctgagatgagcctgggcagttgtagtgagacctcgtctctacaaaaaataaaaaaattttaaaaataaatatcaaaagtagtgtcttctatgtgttgtgagaatattttgaatttgtttttgtttccttgattatggaataacaatattaatgattgaaatttgaagcttgtaagacagtgtttaaaggcttaccacaaaacttgttttctgattttatttgacctttttttctgtaaaaccgtttagaatataaatacctctaagggttcctctttgttgaaacttactatttgattacacttttttttacctgatgaaattaacagtgtatgtgttttttctattttatgacattttttccttttgaataacagaagtctgttatttccagattgaagatactgaaattctt

SEQ ID NO: 13643 - DNA, 1031 bp, Homo sapiens
tctaatatttctggctcctaacgattttcttttttgttttttttgagatgcagtcttgctgtgtcgccaagcttttcatagagatggggtttcaccatcatggccaggctggtctcgatcccctgacctcaggtgatctgcctgcctcagccccccaaagtgctgaggttacaggagtgagccaccgcgcctggccaacagttcttatttaatctttctcatgaaagtttaattggttataaccttattgttctgttatgtaaccttctttagtgaaggaaaaggtaatagaatatagtttgctcacactaaaatattttcaattgctaaatatagttttttttagggaatttatttttaggaatatttagatattcctaattgattaaaaaggctgaatcctgttgtcagaacttactatatttttctctagaattatatattttttagtggatttaaatgttctacattattttagcattttcgttttttgagacatagaacctaaatagcatgtggtgattcctggacaattcttaaagctttttttgagataaacatgagaggtctttatcaataaagaattttgactgtgacctaaaaaagagtattgattgtgcccattaagattgcattcactcaaacaagagttatattgataaagtgttagatgaatacctctcgtcattgatcattaaatggtgttccagttgacacagttaaagcagtttttatttagttcagtgagtgtatccccaagtttaggtggtcatactacactttagctttacctgagtactgtgttaagtcattcctttaaattaggttattggtaatacacacacacatatacacccacaaaatatacgtgttgagtatcccttatctaaaatgtttgggactagaagtgtattggaatttggatttttttgaattttgaaacatttgtgtattatgtaatgagatatcttggggatgggacccagatccaaatatgaaattcacttatgtttcatatatgtcttatatac

SEQ ID NO: 13644 - DNA, 1028 bp, Homo sapiens
attctctactgagagtgtcattaaatagtcttggtacttttgtgtgtgtatatgtctgtgtttataaaatgatgtgatttgtttattattcctgctgtgttgtaggtatacctcatgtcttttcatttgaaatggtaagttctaataatttttggttcagaatggtaagattttttagctaatgttaactcttttttgagcaatcggagaagaggagagtcaagaccggcaaatagacatggttaactaatgtaaacatatcttgtgcattgtctagtgtataatataactaataataattttaattattagtttgaattagtaacagaagatcctcagaaggcataaaaatttaacttgttacttctgctttgtgacttgtttaatgtatttggagccaccttacagtgcttgttctacatagtgacggtaaattatattttaggctagtcagtatctaagatcttctatacttcatattgaggatagtatctctgtagtatcatctaaaatgttagaattttgtactaaaactaaaaaattataatgtctatgttcagtattaagtaacaactagtgagatgtaggctgtaggaactctggtttgtaagcatctgatgagatgcagttatgagttagattggtaattattataattataaactttcaaaggcttttacttatttgagttagattgataattataattacaaactttcaaagacttttacaattcaaagtaactgaaagtttatgggtaagtttgtttcttttcttaatggtatcttatactatattgtgcactatgtgtcaaaccctggcttttctggttgttttaccatagttttcttaagataacttcttcatttgatttattcttgttttttctatatatgattttaaccaattgatatgattgttacagtagtttgttttataatggcaaattttaaataactttgatttttattttggtaccacttaaatgtgtaaaaaatgactatgtatttaaacctgtagctttgagt

SEQ ID NO: 13645 - DNA, 2447 bp, Homo sapiens
cactgcaacctctgcctcctgggttcaagcgactctcctgccttagcctcccgagtagctgggattacaggtgcctgccaccatgcccagctaatttttgtatttttggtagagatggggtttcaccatgttggccaggatagtctcgaactcctgacctcaggtgatctgcccgccttggcttcccaaaatgctgggattacaggcatgagccaccacacccagctgagaagtttctttttcttgtatggtacatattaatgtttgccttttcaataaagaaaagaataattcttcatacccttttcaggtttcctgcattgaactaaatatatacctgacttactattaaagcttattagtcccatttgagtagttgggaatagccctaggtgtttcaacacagtttattcaacacacataataaacttgagaataaaggtatgttgtatgctaaggcaacagtttgactcagttgtatttctttgcttgtcagaggcattccattgtagcacccgagggactgtgaggccagaatgattaagggaatgttggcagaggctagcagtgtagtgcttcttccaaggacaatgtaaaacattttttttcttttagagatggggtcttgatatgttgcccaggctgggctcaagcagtcctctttcctcatcctcctgagtggctgagacaacaagcacatgccactgtgcccagcagaacagtgtttttccaatgtacgtaataaacactcaaggagcttttaaaaaatgtgggttcttagatcatactactaataattgatttgttttgtgatccaggtagattgtaatacattgatctttgatcacatttttttgctaaatccagtagttttcaaccttgcaatatatttgtggaacttaaggaaaaatgcctgagattcagtcctccaagtattttgattcagtgtgtctaggttggtaccaggagatatacgtgttaaagaaaactctacaccttgcttatttctttttggtagcgaagattcaaaactactggccttgtattgaaatgagacatactgaaatgaaaatagttgaatttttcatggatcctgggagtgttagtggaaggcatgcttgatgtggttcaacatggtgtaagatttatataggatgcaatttatttatttattgatggtatcttgctgtgttgcccaggctggagtgcagtggctattgacaagtgtgattatagcacactacagcctcaaactcctgggcttaagtgaatcttcctgcctcagcctcccaagtagctgggagagtaggcatgctgctgtacccatctttcttcatttttttctttcttttgattgggtctccctgtgttacccaggctggtcttgacctcctgaagctatcctcctgtctcagtctcctgaatagtgggactacagttgcctaccactgcatatggttatatatccatctttagaacacggttcaaacagtatgacattctacgtgaatagtaccctgcagaatttgggtgtggcaaccttgatttgggctttcagactatatgtgcaggacatattatctcaaactatgcattaattttgcgtgcatagttctaataattttaattgtctcatccagtcgaggggttgacagactagaacagaccaggctcagttcacatgctgcctatttttgtaacacttttttttgtttgttttgttttgttttgtttattttgccctacaaaaactgatttgagtagttgtgacacaactatgtgagactgtattgagactacatggcctgccaagcctaaaaaatatttacacctgaccctttacctgaaatgtttgctgacctctgaatccgagagttgaagggaatctataaaagtggctcatattaccaaactcgtagagcttgtgaagaataatgcaaatctattcatttatatattcttttccagtgtttttagaaggctcactgagcacagtacctcatattccagatccaaggattcctgaggaatccaaattagtatccagaaggttcattggtagtcatggttataaaccagagcaaaagttaatgggaagaaatggtaaagagtcactgcattgcagctgacacctgggattttaaaatctttttttcgtttttgagatggagtcttgctctgtcgcttaggctggagttcagtggcgtgatcttggctcactgcaacctctgcctcccaggtgcaagtgtttctcctgcctcagccttccgagtatctgggattacaggcacgcgccaccacgattggctaattttttatttttatttttatttttatttttgagacggagtcttgctgtctcgccaggctggagtgcagtgacatgatttcggcccactccaacccccgcctcccaggttcaagtgattctcctgcctcagcctccc

SEQ ID NO: 13646 - DNA, 1063 bp, Homo sapiens
ctcttactactgcaaacttaagcactaaaagcaatatgaatgaaagctctacctatctcaaatattttgtgttaatgggagtatattaataggaaagcattgtattaagaatgcattgaggccattctggcagttgttcttcatttactttgaaaactgtctttggagaaaattgttaaacaattttaatgctgtgtgtgtgtgtgtgtgtgtgtgtgtgtgtgtgtgtgtgtgtgtgtttaagctttgaaattaggccctcttatgtgctttctctttatttcactgttcagtttaaagggaggaatcaaatggtaagtgttcaacttgtccaagtaatgagtaaagttgattttctttgttaattttaagatgccacctctctcttcttgccttcctaatagaaatattccaacaaaactaagagttatgggacttttaagtataaaataaatattgatttacatatttcacattttaaataataatttcatgtaacaaagaaagagtgaaaacacttgtcatatctggtcatctttttgtttgtcagccttcaacttgatcataattttatgacacatgggaatatatttttaagagtttcaaggatgtaagccagtacttcatcaatatcagttgtcagttttatttaatacttgatttttccttagaagacaaactttttgataattactgttgtaactataaattaaacaacattttttactcatttaggataacattcaactgccttaagaatgtatacattttaataatatgtcttaattgcatttaggtttgtctttaccataatatagagtgtattcaatttttttccaggcagtatttactaagtggaaattttctacttatcacaatttttggacacattaaaagctattattctggaagcaatgagaattttatgagattgttttttataattgtcttgtgattgttttcatattaggttactccaccaactgtagattaagtagtttaaacacttcagtacttaccagtctttatgggaaaaatctgcattggactaaatgacagattt

SEQ ID NO: 13647 - DNA, 1108 bp, Homo sapiens
ggctaatttttgtatttttagtagagatagggtttcaccatgttggccaggcaggtcttgaattcccgacctcaggtgatgtactcgcctcaacctcccaaagtgctgggattacaggtgtgagccaccatggctggctgagattttttcctttctatagtaagagagtacatgtttcagctttttttgactctcaatttcttgaatatacgcaaataactatcctagttatgattttactttgtttttctggtttaccttagctaagttactttatttctttggcttttttgatttattaaaggcttggagtgacatagaaggaaggtaaatttaggatgccgtggtcagtcgtgattacaggtttggcataatatgattgcataaatgatttcattttacatgaagtaaaatgtccaatggcagcccacatgttatgatgctgaaatttttatttgaaaaattttcagacatgaagaggagcatcggcggcgtgaggaagaaatgatccgacacagagaacaggaggaactgaggcgacagcaagagggctttaagccaaactacatggaaaatgtaagtaaactactagttaactaaaatgattttatattttcaggtttatgatgcatatttagaatgctttagattttggtttatacagtagtcttttctaatctttctaaattcatcatgtttgataaattagtgattttcttaacctctcataggtggtaaagtaaaattagtttctgaagatatctatgttttatgaagtggatgttatattttttcctattattttggttgatctttaaaaaaacatatgctattaagttagaaatcttgatatatacatcatttccacttgactgattttcaccacatactaatattgaaacatctctattttggaagatttcagacatgtacagaagaattgtagtgaacacttataaacatatggccaatcttttacatctttaagtataaccactttatttcccaatttatgttatttgaaatacctgatttcatataattttattttcagtatgtatctctaaaagatgaggactttttaaaaaaatctttatcatattttaaa

SEQ ID NO: 13648 - DNA, 1060 bp, Homo sapiens
cctactccctgcttctgggttcacttgtgccgaagtacttgtacttatttgatccaaagtctgcaattggtaaatttcagttgtagtttgtttaaaaatttaaaaagttacaactttctcccatttgttctacaattttgtatttctttttttttttctttttttgagacagactcttgctcttcgcccaagctggagtgcagtggtgcaacttcagctcattgtagacctacctcttgccttctgagttcaagcgattctcctgcctcagcatcccaagtagctaggattacaggtgtacaccaccacgcccagctaattttgtatttttagtagagatggggtttcatcatgttggtcaagctggtttcgaactcctgacctcaagtgatctacctgccttgacctcccacagtgctgggattacaggcataagccactgtacccggcctacaattttgtatttcatccagcatttctaaggatgtattcaggttgaggagagactgtaattaatcttagttgtgtggttccgcagaaacatgtatcatgacatatcatggaaggagaaatctcaaacaatacagaaaaattgtccccctatttactaccttctgcttttttgtaggaatcactttttgtattttaagtctcttttgtattctttaatgaaaaaaaatttgcatatgtcattagatgtttttgtgtatttgtaagcaaaaaacccaaaaatcgtaacaacaaaacaaactggctgggtgtagtggctcatgcctgtaattctagcactgggaagctgaggtgggaggattgcttgagtccagcagttcaagactaacctcagtaacacagtgagaccccgtctctaccaaaagtacagaaattagctgggcatggtggcatgtgtctgtagttgcagctacttgggaaggcttaggtgggaggatcacttgagcctgggagcttgaggctgtagtgagctgtaattatgccactgtactccagcctggatgacagaacgagactctgtctctaaaaaaaagctgtttaccttttctgt

SEQ ID NO: 13649 - DNA, 1030 bp, Homo sapiens
ttacgctgggcacggtggctcacacctgtaatcccagcactttgggaggctgaggcgggtggatcacgaggccaggagatcgagaccatcctggctaacatggtgaaaccccatttccactaaaaatacaaaaaattagccaggtgtgatggtgggcgcctgtagtcccagctacttgggatgctgaggcaggagaatggcgtgaacctcggaggcggagcttgcattgagccgagatcatgccactgcactccagcgtgggtgacagagtgagactccgtctcaaaaaaaaaaaatcattgatattaataaagtttcagggagctgacaagatccaattagtgagaaaatgtggtgggaaaattagtcttagagaggcagcaggttgttttagcagctatgagataagagtggcctcaagttacaacaggcagtttattcagcagctggacgtacagagaactacatttttggagcaatgttatgtgcccctgagtgctttttccctctggtctcttcactctgttttgttgaatatgacaagaatgtctcaattagtatgatcaactttcacaaaatcgggatggaatttgccttttcagtggttgacatctgctctgacaggtacaaaagaaattaaggaggctgagcatggtggctcagcctgtaatcccagccttttgggaggctgagggcgggcggatcacctgaggtcaggagtttgagcctagcctggccaatatggtgaaaccccatctctactaaaaatgcaaaaattagctgggcttggtggcgcgtgcctgtaatcccagctactcgggaagctgacgcaggagaattgcttgaacctggaagcagaggctgcagtgagctgagaacgtgccattgtactctagcctgatgaacagagaaagaccttgtctcaaaaaaaaaaaaaaagaaaagaaattgaaactgccagttccttggtattaatcaagaatcaaagaagtgaatgcaagtctccattgtattcttcaccaacacatga

SEQ ID NO: 13650 - DNA, 1080 bp, Homo sapiens
tgctcaggctggtgttgaattcctggtctcaagtgatcttcccgcatcagcctccaaaagtattgggattacaggcgtgagccactgcaccaggcccacattgaagttgagttcaattttcactggactcttttgcatattgcaatagtatgttactgattaaaatctgcccttacctctttagtatctggctttatctctgatatagcttttttgaatgtttgaaattttcataagattgggataaaaattaaaacacacacaaaaaaaatagacacatgtaccagctatgtcagagtaactggtattgggctttcctccccctataaacaagtagaaaactggggctggctgcggtgactcacacctgtaatcccagcactttgggaggccgaggtgggtggattacctgaggtcagaagtttgagaccagcctgaccaacatgatgaaaccccgtctctagtaaaaatacaaaaataatagccgggcgtggtgactcatgcctgtaatcccagcacttcaggaagccgaggcgggcggatcacaaggtcaggagttcgagatcagcctggccaatatggtgaaaccccgtctttactaaaaaatacaaaaattatccaggcatggtgacaggcgcctatagtcccagctactcgggaggctgaggcagcagaatcgcttgaacccgagaggcggaggttgcagtgagccaagatcacgccattgcactccagcctgggcgacagagcgagactccatctcaaaaaaataaataaaataaatacaaaaattagccaggcgtggtggctcatgcctgtaatcccagcactttgggaggccgaggcgggtggatcacgaggttaggagatcgaaaccatcctggctaacatggtgaaaccccatctctactaaaaatacaaaaaattagccgggcgcggtggtgggcacctgtagtcccagctactcgggaggctgaggcaggagaatggcgtgaacctgggaggaggagcttgcaatgagccgagattgcacaactgcagtccggcctgggcgaaagagcgagactccgtctcaaaaaa

SEQ ID NO: 13651 - DNA, 1046 bp, Homo sapiens
tctcgaactcctgacctcaaatgatccatccaccttggcctcccaaagtgctgggattacaggcatgaaccaccgcacccgaccgtcgtcgtctttttgattggcatttctttgatgcctaatgatgagcatgtgcttattgagcatttgaatatacattaatttttaaaagtttaacctaaaataaaattataatcctctttgtcctcagatgatggaaacaaaatcaaaaaaattaacagcatcagaaaatagaaaaaggaatgcttttagagaagaaaatgagaaacaattatatggatcgtcaaatacacttttgaaaaaaatagagggaatcccagaaaaaaaggaaaagacttcacagctacagctttcagtagaatgtggcacggatacattactgatccaagagaatgtgaatttacctccttcttccacgtcaaccatagctgatacatttcaagagcaactggaagagaaaaattttgaagactccattgtaccagttgtgctttccgcagatccaggtacgtggccccgaattttgaatattaaacaacgggacactcttgttgaaaatgttccgcctcaagtaagaaattttaactttccaaaagataatacagggaggaagttttcagaaacttattatacacggattcttccaaatggtgaaaaaaccactagatcctggttactttattcaacctcaaaagattctgtgttttgtctatattgcaaactctttggggaaggaaaaaatcaactgaaaaatgaaaatgggtgcaaagattggcaacatttatcacatattcttagtaaacatgaagaaagtgaaatgcacgtcaacaatagtgttaagtactcaaaattaaaatctgatctgaaaaaaaataaagctattgatgctgcagaacacagattatatgaaaatgagaaaaatgatggtgtgctgttgttgtacacgtaatatacctgagttgttttttggcatgatgatcagaatcttacattactcagaaaacatctgtcctgcaatagtcagt

SEQ ID NO: 13652 - DNA, 1051 bp, Homo sapiens
agtaagctgtgatcatgccactgcacttcagactgggcaacagagtgagaagctgggactgcaagcgagcgccaccacacccagctaattttattttttgtagagatggggttttgccttgttacctaggctggtttcaaactcactggcttccagtgtcccaaagtgctggaattacaggcatgagccattgcaccctgcctaggctgagtcttaaacctctggcctcaagtgatcctcccgccttagcctcccaaagtgctgggattataggcatgagccacctcacctgtccaaaagctgtttttgaagatagattacaaaataattctttatcatagaaccttgtttctcaaagcttcaccatcatctgagagttggttagaaatgcagagtatcagatttcttctcagacctactaatttagaatctccatttaaacaagattcccaagtgatttaatatgcacaataaagtttgagaaggatctcgcctataagtaatactgtaccttttgaagctaacagtaatttatgatactgcagttgctatgtaaggttaggaaagctgagtttttcctgagtaatccacaatctatattaatgcctgataagtaatattttagaaggctgggaaataataatagatttatattaaactactgcgtctaaagtattttgaaagtaagtgtactaatgtctacaatttacttgaaatacatagaaagagatggattgattgtttagtggtatgagtagacagaaagatgtgattaggctgggagtggtggctcacgcctgtaatgccagcactttgggaggctgaggcaggtggattacttgaggccaggagtccgtgaccagcctggccaacatagtgaaacaccctctctactaaaaatagaaaaaaaaatttagctgggtaatcccagctactcgggaggctgaggcaggaaaatcgcttgaacctggggggcagaggtagcagtgaaccgagattgtgccattgcactccggtctgggagaaagagcgagattctgtctcaaaaaaa

SEQ ID NO: 13653 - DNA, 1049 bp, Homo sapiens
tttggtctcagattcactcttaaaatgaagaccccaaaggtttcttttatttctattattagatatattaaaaattaaagctttagccaggtatagtggcgtgcacctgtagtcccagctattcaagaggctgaggtggggctgggcatggtggcttacacctgtaatcccagcactttgggaggccaaggcaggtggatcacttgaagtcaggattttgagaccaccctggccaacgtggtgaaaccccatctctactaaaaaaattaaaaagtagccaggcatggtggcatgtacctgtagccccagttactcaggaggctgaggcaggaaaatcacttgaacctgggaggcagaggttgcagtgagcccagatcactccactgcactccagcctgggcgacaaagtgagacttgtctcaaaaaaaaacaaagaggctgaggtgggagggtcacctgagcccaggagtttgagtccagtctgggcaacatagcaagacctaatgtctttaaaaaataataataatggatggacgtagtagctcacatctgtaattgcagcacttttcgtaggctgaggcaggaggatcacttgagccgaggagtttgaggctacagtgagccatgatcacaacactacactccatcctgggtaatagagtgagacccggtctcaaaaaataataattacctgggtgtggtggctctcacctgtaatcctagcattttcagaggccaaggctgtcggatcacctgaggtcaggagttcaagaccagcctggccaacatggtgaaaccccgtctcttacaaaaatacaaaaaacaacaaaaaaaaattagctgggtatggtggcatgctcctgcagtcacagctacttgggaggctgaggcatgagaattgcttgatctcaggatgctgaggttgcagtgagctgagatcatgccactgcactccagcctgggcgacagaaatttttttgtttcaaaaaataagataaaatcttaagaaaaattaaaactagtccgggcgcagtggctcacgcctgtaa

SEQ ID NO: 13654 - DNA, 1044 bp, Homo sapiens
cgcgcacgaggctgaggcgggcgcggcgcccctgctgctggatgggagcggcagcagtctggaggggagcgccctggcagggacccccgaggaggaggagcaggccgtgaccaccgcggcccagatgcaccagccgcccttgcccctcggagacccaggtcgggccagcaaggccagcagggccagcagcgggcgggccagaccggaggacttggccatctagtgcccgggtgcctgcctccagacagctgtgtagtgatctttttcttagaaaccaaaaccaaagtgcacttcccaccagcagatagaacctgaaagtcccaggaggtgggagcgactggagtcccaggaggtggacgatggaggagagatcaggtttccgtgttcaatgcttgctgttcttagcactgtgagttacagtggggataactcccactttctgagtttgggggtggcggggacaagggttgtgggcctttaagatcttcacagcagcccagaaatctggtcgctgagggctgtctctgggggtaactgttctgtagtggtaaagcaacaggtatcctgcagtccctttagctcctgggcaattgggtttgctattcctaagctctccagagcctctgggcggcccagagggtcttagctctgggccagagcacttagctctatctctttgatacttttaacttagagttgaatttcatttgggatatttgccaaactgcactaaaaaaagatttacagcaagtctatgtagtgtcatttgagtttccgaaattgcatgtgaagcccaggatatcaagcttcaggcctcatgacaagtgacaaagagcagttgccctccagaggcaggctcagtgggcaagggccccagaggttgctggcagaaggcaggtggaaacgcagccacgcctgaggccatttttaaacagttgaggaaattgacataaaagtgtgtcgggtatgccgtaggtatttattttctaaatgattattttgtgctttgaatggtgcagctatgcctattttctcccactttct

SEQ ID NO: 13655 - DNA, 1022 bp, Homo sapiens
agcagcccatgcaccggtcagcaccttgtcccgggaccctgcggggctgagctccctgcggtgagagggggcgcaggaggcaggacagagggggacgcggctgaacgagaccctcgttcagccaaggaggcctcgggctggcgaggagatggcccagcgggacttgagaggcctttgggctgcacaagggggcgtgcgcatcgtcggtgcctcctgagaggtgaagccagccaggcaggggtgatgcggggcagcgttgcgagagagggcaagtctctggagtccagagaaggaggaccaggaggacgcaggaacattccaggcctggccccagcaccgacccgacctgttccgcaaggtggtgcctcccggtgcagtgcgcccaacccctccggctgactgcgagagtcctcttcctgccttccgctccacctcacctcccttccctgcccacccctcgcctcctttccccaccccgacccctcgcctcccttcccctccacccctcgccgctctcccctcctccttgcctccctttccccccaacccctcgccttccttccccctacccatcgcctcctttccccaaccccgacccctcgcctcccttgccctccaaccctcgcctctccccctcttccttgcctcccttcccccccaacccctcgccttccttccccacccagacccctcgcctccattccccccacccctctactctctcccctccaccttgcctcccgtttcccccaacccctgtccttccttcccccccaaccccccgcctccctttccccctacccctcgcctcccttcctccccatccccctcgcctcccttcctccccatccccctcgcctcccttcctccccatccccctcgcctcccttcctccccatccccctcgcctcccttcctccttgcaccccctgcctcccttcttcccccaaccccttgcttcccttcccggctttcctgagccagccttagcagggaggagcctcgtgactgcaagcctggtg

SEQ ID NO: 13656 - DNA, 1050 bp, Homo sapiens
ttattttctgaaagagattgtaaagattggcagtagttctttaaatgtttggctgaatgtggcaaaccctgggcctggagttttctgtgttgatagattttgaactacaaatttaattactttcctataaatagactaatgaggttttctattatttcttaagtgagttttggcagtttgtgtctttcaagtaatcagtccatttgttctaagttgtaggatttcttggcataaataattattcataatattgctttattattcttttaatgactataggactggcagtgatgtcccctctttcgttcttcatattggcaatttgtgtcttctctctttttattggtcagtctgccttgaagtttgtcagtgttactgttttttccctaagaaaccagatttgatttcattgatttgtttctgttgtttttctgttttcaatttcattgatttctgcttttacttttattgttttcttcttcctttctttgtatttaatttgctttttttcagtttctgaagatagagggttggattaacgatttgagatattcttctttattaatgtaaatatataatgctatacattttcctctcagcattgctttagttgaatccaatgatttaatatattgtgttttcattttcaaaatattcaaatatattagaatatttcaaaatattcaaatatattagaatatttcaaaatattcaaaatatttcaaaatattctaatttcccatgagaatttcaccttgactgtagattatttggaagtgtcttggttaatttccacatatttggggatttcctagatattcttttctcatagacttccacttcaattcaattatggccagagaacatactttgtttgatttctattcttttaagttttgtttcatggccagactataatctatcttggtaaatattacatgtgaacttggaaaagtcaggcattctactcttgggtggagaggtctctgaatgtcaagtagatcaagttggttgataatgttattcagctctgctataatcttattgatt

SEQ ID NO: 13657 - DNA, 1034 bp, Homo sapiens
cggtgctggccctgctgcatgtttttcttccggcttgggctccctgctgctcacctagcggtatcagcacgctgggagcatatctgctgacgcagagctgccttgctgtgtttattttcatttgaaagtcaatattcaaagacttgttgcccagtaagtctgtttgaaccactgggggaaatcaaaaggtttctttcaaggggcggcctttcacctcttatgggtctggttgacctgtatcagtccctgctgcccagcagagaccttcctgcctttcgtttttcctttttttttttttttttgagatggagttttgctctgtcacccaggctgtagtgcagtggcgcgatcttggctcactgcagcctctgcctcccgggttccagtgattctcttgcctcagcctcctggtagctgggattataggcacatgccaccactcccagctaattaccttcctgcctttcagaggccctggcgttcagcaagtatcgcattgcacatttgtgtgtgggaagacacctgggacactggagtagctatttctgttgttttggcagaggaggctgctactgtggtttcctctgagagacctactgtggtttccttccttcctgccgcgtgcgcaggacctgccccggaactgccgtgtgcgtggggcaggtgacacaggccaggatgaggctgtggccttcctggagcaagtccactttccactgactgagtacacttacacagccttcctttaacaggctctctgcctgtgatttgtggatatgtcaccgggactcgtcctgcggccttttgcttcttgctttgctcgcgtttgaaggcacttgctatcttgccatcctagttggtaggtggtgggtgggaatcttccgctgaaagggtccctggtttctctgagcctggccagagccagttgcacagcatcaggtgattcccctctgttcccaaggcctcctgaggctgatatggctcttctttagtcttggcctatgacccgcagctaatgggaactactgtgcatc

SEQ ID NO: 13658 - DNA, 1027 bp, Homo sapiens
atttttcacagaaaaaaaaaagtcctgaaattcctgtggaacccaaaaacagcctgaatggccaaagcaatcctgagcgaatagaacaagggtggaggcatcacactacctgagttcaaatgatgttacaaggctgtagtaaccaaaacagcatggtatcggtattacaacagacacatagaccaatggaacagaatagagaacccagaaattaatccacatatctatagccaactgatttttgacaaaggtgccaaggggaaaggacacctcttcaataaatggtgctagaaatattagatatccatatgcagaagaatgaaacaggacccctatctctcaccatatgcaaaagtcaactcaagatggattagacgtaagcatatatcctgaaactataaaacttctagacaaaaacataagggacacacttcagaacgttggtctaggcaaagatttcatggctaagacctcaaaagcacaagaaacaaaaatagacaaatgggactctatgatatttaaatgcttctacacagcaaaggaaacaatcagcagaatggagaggcaacccattgagatgtgtaaaatatttgaaaactattcatctgacaagggactcgtatctagaatatataagaaactcaactaaaatttcaaaaccaaataatcccattaaaatgggcaaaggacctgaatagacatttctcaaaagaagacatacaaatggccaactggtatatgaggaagagctcaacattactaatcattaaagttatgcaaatcaaaaccacagtgagatgtaatgttatcccagaatggctattgttaaaaagattaaaaataccaggtactggtaagggtgtggaggaaagggaactcttatacaccgttggtgggaatgtaaattactatagctactgtggaaaacagtatggtgatttctcaaaaaactaaaaccagaattaccatatgacctagcagtctcactactgaacatttattcaaaggaaaagaaattagtatatca

SEQ ID NO: 13659 - DNA, 1048 bp, Homo sapiens
gacgagacccccgtctctacaaaaattagctggacatggtagtgtgcatctgtagtcccagctactcaggaggctgagctggggtaattgcttgagctggggaatttgaggctgcagggagccacaatcgcaccactgcactccagcctgggcagcagagtgaaaccctgtctcaaaaaaaaaaaaaaatttatatgtcaaggataaatatatatgcatatgtgtgtatgtatgtgtctgcatatgtatatggacacactcatatacacacacaaacacacttttatttttctttcagttctaggcagtattgtggtgcagccttttttaaggaacttgtactcttcgattttgccaggcaatattggcttttactagttgcctgatttttctcctgaatgaaaagaactcacagttctgaaataccaaattgaaaccttttagttgtttgcagatcattttgccatgttttctcagttcagcatgcacacaagctaatctttggaatttttacttggaaattttccggcctgttgggttctggtatgctttcctgaaaatgtgtttttgtgcttatgcttattgcagtaaactagaactattcatttcaagcatttgtaccattctttggtgggacttctatagacaaccccgtgttgactgaaattatttttagttctaagtataaaaaccttaaaagtagataatccatcacttttcatcttataaaactgaacagtacacccattaaaccctattctcccctccccccagcccctagcaaccacaattctactttctgcctctctgattttgactactctagatacttcatataaatggagttatgcagtatttttttaaatgactggcttatttcacgtagcataatgtcctgaaggtttatccacattgtagcatatatcagaatttccttcttttccaagggaatcatattccattgtatgtatttatttcattttcctatattcatgcttgctgattctcttctgcctgctcaaaactgcttttaattcctctagttagt

SEQ ID NO: 13660 - DNA, 1033 bp, Homo sapiens
tgtctttgaactttctcttttaacaaaaatgtcaagtctttatagttgtaatatcaccatgtttcccatttctgttaatacttctatgaacccctaaagtattgaagggaactagctgtcagtttcaaggattacaagtttgagtctcctagtattcaacatcattctgaaccctgaaataatatttttctctgttaaacaatttttatctgtttgccacctctgttgttagaggtggttgtcaattgaccttactaagttagctgtctttgatgaggaattattgttattggttcctgaataaaacattaaccttttaagtcagaaggaacctcggtacttcttaaggtttgtttgtgttttctaaaaccagagaataaggaactgatttggctatgaggtttaacattataattttctgtaagctttcccacaaaaaaacattgttgatttgaggatataataatgttttaatctttttaaaatataagtggttattctctgacttggtaactatgttctgaaaacactgcatttaagaatttttaaaaattggttttctaaaattaaaatgtccaaattaggcatattgctgagctcaaattgatgtgaaatgccatggttccagttgaattttaagcatattttcatttagatataaaatatatgaagtatgctttgttgattatagtgagaacccatgacatagttaaccaaagaatatgtttggttcaaataaaaatagaagcttaatactgggcattcatactttttaaagagaatgaatgaagaaatcggtttcctgctgtagttctctatgggtaagtcttagtaaagacgagaatgctgaagtcggccgtggcgattccctcctaggaactgggaggtgtggcttgcccattacccgcttgaagctcacatctttaccctcctctcccactgtggtttgatcttcacctattcccaggccctcccagcaattggagaggtgtctttttttttggttttggttttttttctccccgtctgcatt

SEQ ID NO: 13661 - DNA, 1077 bp, Homo sapiens
ctggcacaggtgcactcatgaaactctgcttccaccatgttcctgacacctatctattaaaccattctgcaaatacggtttttctacctgattgcatatagcatatgtgtcattacatgtgatgctgtgcaaaactttgtataattctgtgttattaacagttaacaaaactggagcatctgaattacatccaacctgtgcatgtgatgttaggtagatgtgaatgcagggccttgggccataacttacatttctctcaatttgattagctttgagtcacaattaaggggaagcaaaaacatcttgaaaagactgctaggaaggaaattaatatcagtcatccagaagtacacgtttctgtattttaaaaaatactttgatgcatttatttttaggtgttttttttttccccttaaaaaacttgaagtgatatgcagcagtaatctatttgttttgcattgttcttggtgttttgtgtttcccagatccctcaagctttctcagctgttgtgaattatgtgtatctgtgtgtgtgctaagtacagtctctttaccaaagggcactgaaacacacaattgactggacaggtccacgcgccatgacaaaactataatcaagttattaaaactaaagaggagtgggaaaggaatgccttggtaagtaaaaaggcatctatatttaataacttttatccagatggcaacatatttgcaaaatttgcccagatcctattacaatactaaaaatagaaaatttcacctccatattcctgaggtgtaatttcattagactagttttagtttaaaaagaccttcttcagattggaccaaataatacttataagatcagcagaatgttgaatattagctcactggggtggggagaagccactaccattttttaggtgatggggatgccactgagttgcaacggctagaccttttcagggtggttgtgtccatgtttgcctgattggatgcttattcactttgtgttttcttttgttttattttgtccaattttgtctttagctgtgtttattaacttctccggtcttgttttgttttaatgctctt

SEQ ID NO: 13662 - DNA, 1811 bp, Homo sapiens
catgcttctcagtaacatgggcccttacttagtctctgtttctgccccaaagtcctgcaggcacccatacattagtgactcgttttgtcagggagtgctacagaaaggagcctgtccttttagaaagtacattctgttagcagttttgattacctcataatttgtcactaagggaataaagtaagttaaaagtttcagtgttttcctctgatactttctgaacatcattctcaagttaagggattgagcaaaggaaggcattttccaaggggcaccatgtaaaaatgggatggtatgcttccaagactgatgctgttttaaagtttttgcacattctgactacattatgccttggttttgtcagttaatattgagggtgtggtggcggtgaggcaacttttttctaccatccgtaagtaccacagagggaggtctcttgtcatgagttgtcatagcaggataagggtggggatgaggacatgggtggaaaggaaaggaggagtttgtgtgtgtatgtgcacatgtgcatgcatgcatgcgtgtgcacacacacacgagataaagacaaggagtaggaggaagtaagatagtagaggctgggccgggcgcagtggctcacgcttgtaatcccagcacttttggaggccgaggtgggtggatcacgaagtcaggagatcgagaccatcctggctaacatggtgaaaccccgcctctactaaaaatacacacacacacacacaaaaaaaaagccgggtgtggtggtgggcgcctgtagtcccagctactcaggaggctgaggcaggagaatggcgtgaacccgggaggcggagcttgcagtgagccaagattgtgccactgcactgcagcctaggtgacagagcgagactctgtctcaaaaaaaaaaaaaaaaagtagaggctgagaagtgtccagaaggtgagtacatacgagaagaatgagtcctgtttgattgccagcatagcaggatctaaccgtgtgcttccccctccttgagagcgtctctaactattggaaacaatgttgatgacccatggcattcacacagcagccagccagcaggatgaggaagtttagtcaactctccatattgatttgcatttagggtttgtttaaacaaataagccattaaacatttaagtgtgtatttttcttaagtgtggttaaaccagattacttacttttacctcagttctctaggatagtacaactggaaaaatgtttttggaagtgtaaagaccgaatactctgctctgtgcatagtcttaacaatttgtattaaccttcttgaattttttcagcatgcttgaatggaaatacatttacaaaaaggttttactcctaagttatttaataattttaaatctggctgccttgtttactttttccgggtaaacacagaatatcaggaattgaccttagattttattaactatctagaagataattgttttgactgtctgttactttgtttcatagtagttactaaaatatgccctttatttgtacctgtttttacatttaatttggtcttcatgttttctatatcttgtacatgttttaaagaaatcattatatttagaagcttgtcagttactttattttattgcattgatgaaaatagaaattggatactaatgagcatccaaataattgaatatttctttttcagtttccaaccctttgtaatcagtactacaaattaatcacatttatctgtgagatttttcctgaaaaaataccacagcttcctgaggatctgtttaaaagtctgatgtactccctagaattag

SEQ ID NO: 13663 - DNA, 1052 bp, Homo sapiens
tacagattattatttgggaatagattatgcttttttgtatttggtttaatactatgttaattttttaatactatgggaataatagaagttgacgggaaaatcacactggaaaatgtgagtggattgaggatgtctttttttttgaccagtggaaatgagtacatgtgtaaagttgatgtgaagtaagcactacttcagattagatactaatttcagttcgatttttctctgttttttttttcttgagttgatctttcttgcttaccttaaaaaatttgtttcctctcttaagataagtctgccattcagtacagcgttcggagcagatacagagggttctcagtggataattggctacctcttacaaaaagtcatcagtaacctctcagtctggagtagtgagcaggaccttgcaaatgacactgtgcagctccttgtcactttggtggaaagaagagaaaggttagcccattgttggaggctgactgtgtgtgtatgtgtgtgggtgagaaactctttttcacttcttagtgtagtcctttgaactggcaaatggttacacggtcctaattccagatagagcctacatttttggagtaatgggttttaaaaactatgtcacagtactattacaaatgcaaatggagctttcccatcttataattgagcattacattgactccttcaggatttggcatcaaagccctatgagtaacacattagtaatttatcgtgttgcaaacacttttatgtggaatatgctcatttgaatttttagacatccccattttaaagattaaatactgatatttaaaatttaatgttggaaagtaaaatttttagtgctttctacaacaattctagaaatgttttcgttgttcttactgtataggagtatcattgttattattaccattgtcattgtctggtttattgaattcttataatttactatgtactcttctaagcatgtcataggtagtatctcatttaatcattatatcagtctcagccccaggagactgttattattcctattttgcagattatag

SEQ ID NO: 13664 - DNA, 1029 bp, Homo sapiens
aatattgtgataataaaactccagtgcataaatttaaagtgttaatgtaaccattttcttttgaattttgttaggctggaatagatatttaaaatgatttaatcttaccaggaattttgacatatctacaacttaaatgtattactgtactgggagattgttggggttttatttgtttgttttgttgttgttcatataccccctaaaaaatttttttaaaaaactcaaacgagcactggtggtataggaagtgtgcagacagtgaagaaggttgggcatggtggtttatgcctgtaatcccaacacttggggaggccaaggtgggaggattgcttgagctcaggagttcaagaccagcctgggtgacatgacgaaaccctgtctttacaaaaattttttaaatcggcctggtgtagtagtgtgtgcctgtagtcccagctacttgggaaactcaggcaggaggatcacttgaacccaaaaagttaaagctgcagtggaccgtgactgtgtctgggcatactgcagcctgggtgacagagcaactctgtctaaaaaagaaaaaaaattagaagagattctggggtggaaccttaaaaacctcctgatttaaagaagaagttcaggagaagaggatgctgccatgaagactgggaaagaggaagcagatggctagatgaagagaggaagggcagtgaccccagggaggctgcaggaagataagggcagtgacagtgggccatccagtggggtaaagaactgaaacacgtgtgtatgatttcatgatgagatcatttcaggcttcctgagagcactagtaaaggagcataagccgaatttgagtgattagaatccttttctcagcactgatattcattagtgtgtaatggggtctttccattacctcctttgcttccttgccttttggctaaagtcaggttaaatatatatcacttctgattatgtgccctcctcaacaaagacatttctgtttgtctgcatgtcacgctatgtgattgacaccacacgacc

SEQ ID NO: 13665 - DNA, 1052 bp, Homo sapiens
gggacgtgtatagtgtacaataatttattacaagcaataacatgtagaataattttttaaaatgagcctttaaaataatagcttttattgaaaacctgtgtgcactcttaccacataagaacaactgttgagttttgtttggtgcaaactaattataattctaattttttaaaattattttttaaatgatttttataattgtaattttgtgaaatattgaaagcttctttttccagtaggaaaacaggttccacatgtaagactttgttttactgtgagaatacttttttcagagctgtgtttgtttaggaatatatacagattatcatcttttttaatagcaattcatgtctttgatggtggtaacgttgtgtagcaagggaagaagagcatcttcataggaagaagcattcttgataccagtgtgtgtttttgaaacccatgtcataaagccaccttgctgggtggctttagcatgtgagtgaagagacatatttatgagtactctgacttgcagttaactgagagtctgtgttcacaaagagcaattctggtattcagccaagtttctctgtggctgcagaagtttcttgatattatttgagactttttggagataagaattttttcattatacccagaaatcaaattattatctattgctgaactgaagaggtaagaatgaatgtggagatgaaaaagtattgccttaaagattaaaatcctgctgggcttggtggctcacggccgtaccttgggaagctgaggtaggcagatcacctgaggtcgggtgaggagaccagcctggccaacacatcgaagctccgtctctactaaaaatacaaaaattagccaggcatggtggcacactcctgtaatcccagctactgaggaggctgagacaggagaattacttgaacccgggaggcagaggttgcagtgagctgagatcatgccactgcactccagcctgggtaatacagcaaggctttgtctcaaaaaaagattaaaattctatcaataattgttcatattaatacaacagctgtttt

SEQ ID NO: 13666 - DNA, 1061 bp, Homo sapiens
gaatgttgcatagtcgaagtattttagctgggcaattgattaccaatggaaggggcataaccactgttttttgtttgtttgtttgttttgagacagagcctctccctgccacccaggctggagtgcaatggtgtgatctcggctcactgcaacctctgcgggagagtgttttcaagcgactctcccgcctcagcctcccaaatagctgggattacaggtgcctgccaccatgcccagctaatttttgtatttttagtagagatgggtttcaccatgttggccaggctggtctcgaactcctgacctcaggtgatccgcctgccttggcctcccaaaatgtggagattacaggcgtgagccaccgtgactggccgagttttctcatttcttcaaagcctcagttactgtggcagtatcaatgaatcgtattcataaaaacctacaaatatatgatggttactttgtttatggtaaaacagtattctgtttgaagcatgtttgaaattgaatgcctgaacaccatataaattgctttttagtctgtgggaattttaaataagcatctataaagttttttgtcaatagattatttctttgtcttgatatttagatactgtgacctgtgggagttttttttctttaatattatatgtgtttactctttttgttcttttgcttttccagtgaatatatttcttctggaaaaatgctatttttccaagtagactatatgaaactcacattttgtatatgtggtgttaattgttgcaagatattgggggaaatgatgggataaacttgcagaaattgattctttttacatgaattttggcatatgctttgcagtaagtgtatttccttctgttgccaccattaaattctctggttctcaaagtttctgtatgcctacagcatgacacataattacaatgaaagcattaccttacattcctgtaacattctttttttccccaggcacttaatgccttctattccttagcttcatggatgaattatgtagcatatgtgaagaggcttaaactgttaccattacaaattct

SEQ ID NO: 13667 - DNA, 1007 bp, Homo sapiens
gatcatggtcgtggttgcacacatctgtgaatatgctaaaaccattgagctgtacactcagtgggtaaattgcgtagtgtgtgaattatgtcttaatgaagcctttaaaaatacccatcatgtcacggtgtagaaacccacttcacacaggtcaactgcaccattagtagaattatagagggagattaggggtggagataaagttgtgggagagtggggccattgaagttaaggaaataggagaggtggtccaagaaggagcagaggatccatgtcaggacctttaggtgcatcagtagtgaaaaagcaggaagaagcaaaagaaaataagaaagccaattaagacaagtggatgggagaacaaggcaaggagtgtttggaaagcaaagatagatgatgtttcaaggaatcaggtagtcaacatcgtctgttaccgataggtaagatgtagattgtttttgatctacaccgaatatcagttagaacatagttggtcatatggaagtctgtttatgtgaatgacaggggcaaaagccgtatctcagtgatcaggtagtaattagtaattgatgaagtatagagtgaagtacaattgacccttgaacaatgtgagggttagagacaccaacccccatgcggtcaaaaattccagtataactttttactccccagaacgttttactaatagcttactgttgcctggaagacttactgataacataaacggtcagttggtacttattttatgttttatatgtactataatatattcttaaagtaagttagagaaaagaaaatgttgttaagacaattataaggaagataaatgatatttagtgttcattaagtataagtggatcaatcataaatgtcttcatcttcgtcttctagttgagtaggctcaggaggaggaggaagaggaggggttggtcttgctgtctcagtgatagtagagacagaagtggaggaggtgaaggggaggtaaggaaaggaaggcacacttggtg

SEQ ID NO: 13668 - DNA, 1043 bp, Homo sapiens
attttaaagtgtctgttttaagggaaaatacagttggtagagagtgactattttataaaaagaaatagttctctgggagtttggaaacaaagcttgtctaaaagatacacacacataaaatattttataaagtacttagataaagctttggaaaatctgtcatctgaaaatgataagcaatactgcagtgttgccaaaggaaataattccttgtttaaagaaagtatatcttggtttttgacttgaggatattttgcttcatggcttatgagtgagttcttgtgtgaccttttcatatagtgccatttgttggctgactgcactacagctaagtattctttgagtggattagctttaagtgtgggagaaagaacttggcagtgagattaaactaagctacagatttagcactcattagggaaatcaatttcaaggaactcaattctgactaatttctaattttggaaattacctggagatctaccattcaatcagtaaggaaaagaatggaataattatgcagccttgtaccatggagagggtctaaataatcaaatttaacttagtttaaaagtgttgaattgatgccttttaaaagatggtttatctgctgggtgcggtggctcactcttgtaatcccagaactttgggaggttgacatgggaggattgcttgagtctaggagttcgagaccagcatgggcagcatagcacaaccctatctctacaaaaaaatacaaatattagctaggtgtgtggtgtgtgcctgtagtcccagctgttcgggaggctgaggtaggaggattgcttgagcctggaaggttgaagctacagtgagccatgatcatgccactgcactcaccctgggcgacagaagagaccctgtctcaaaataaaaataaaataaaataaaataaaaggtgatttgtctcttaggatagacaaataataaatcatggaaaatttgtgtatttagtgttaaatattttgataatttagaatggtatgttaaatgaggctgtgttaaattatcagtaacaatcc

SEQ ID NO: 13669 - DNA, 1051 bp, Homo sapiens
acagtggaagatctaaagttagggagaaaatgttctattatgtttgaacaaatgcattgaaacaaagcgttgaaacagtaatgcctcacaattatttcttatcaaataattacagcaaactctggcctgttctattctgactgcgctattgagtgaattttcaagttcaagtaaaactagcaacattggattgagcatggaattccatggtaactgcaaaagagtttttcaggtattggtagttttgttcttgagttttaattattggatcattcactttttactcaatctattcctaatgacatgagaatatttattttatgtagttgaatggtagcctgtacttcaggatttgttttgtgatttcaaaggatatagtaaaatgataggtttggtgaatgtagttgatggtttaaaattacttgtttaattctagtcttaaaaacaatacttctataaagatctttagtttattatttatttcttattgtgtttagatataactaattcaattgaagggactctgctggccttaaaaataggtctggaagaatgccagaaggccgtgtatttcaaatgttattgcagatggtgcgggctctttgtcttgtatgtattgtttggctctggagtaaagttatgtgaaggcattggcttaaatcctagggctctgcactatagcaactgactcctctggctccgcagtagttgtcaaagactctcttctctatggaagtagcatttatattcaagtaaaagtattccatctggcgtcacttgaaagcatactgcgatgtaaattacaagtagaggcctaaaaatggaacacgttcttaaggaaatggtgttttccattggaaattttaaggtgtttgttttgtttcatgattctaaaaggggatacattttgaataaatttttcatataaaatatttgtgatttattgactataggaagaagaccttcgtcagatcttcatgttaactgttgaagttctgcaggagttcagcaggcgggaaaacctcaatgctcagatgtcttcagtatttca

SEQ ID NO: 13670 - DNA, 1089 bp, Homo sapiens
ttataggtgtgagccaaccatgcctggcctaaagtcaaatttttaataccagggctgagaactactgtaatagtaggaaatcagtatacttcagtgggaagtagaatttaatttcaggattgcaggatgaaatttattttggtgactacattaaaaacattaaatgtgaaaaatattctctatatggcaggttaaatgcatacactgtccctatttgtccttgcccagtagcttgaaactagctcaataggaaggcctaaaaaatgaagttcagacattttcttatatcatcctctcttcttcttggactgttaagaatttgtaagtggttcaagaatttacttaatgttttcatagtctcagatataaatgacagtgaacaagatgattaaaacctctgtaagaaaggagaatgataactgatcagaacattgatttagtattggctataaactttctttataaaggtgacttttaagagagatttgaaaagtagaaaaaattaactaaaggttttctgtagatgaagaaagggttgacttcatgaaccattaaattagataactaattttcccctcacacctcttctagaaggacatttccatcaaccttcattggccagaaactgtatgtagtctggcttttcccccttcgcttttgaagcatattggtttcatttgtttgttttgttgttttagaaacagggcctcgctctatcgcctgggctgaagtgcagtgacatgttcataactcactgctgcctcgatcacctgggctcaagtgatcctcccacctcagcttcctgagtagctgggactgttggtacgtgccactgtacctggctaattttaaaatttttttgtaaagatggggtctcactatgttgcccaggttatcttgagctcctgacctcaaggtgatcctcctgtttcagccttataggtgtgagccaccacgtccagccaagaattgatttttgatggtccatttccctgtactagtctcatgtttgcatttatacaggtttaggggcagtgtagtataatagaacactgattttggattcacacttgggtttaaatcccagct

SEQ ID NO: 13671 - DNA, 1002 bp, Homo sapiens
ataattttaattcttgccagtagagatatttaaaactatgtttgtgtacatttgtagtcatagtcttcagctttatgtacattttctagtagtagtcagtgcctatgaaactattctgtccccctaaaagtacagaaattccctttggccaactaatattcttatgcatagtaggatctctgcatttatttgcttaatgagtgaaagataaatggttcaagtgtatgttttgaaggaatgttttttcacttcagtcttgacgatagggagacatatttattcatctgtataaatatctaataaatgcatgttatgcagcaggtagtgtgctttgcatatgctagtgtgcatagagtgggtggctgatctgggagctagtgaaccagtagtaacagatatgtcctgtcatgtgagggtgccgtgggagcccttagtaataactttctggagaaagtgacgtcataatcttgggagagggaatagaagttcagaggcctggaagtcaaaagagtgtggagtgaggaactgaaaggtcaatatgtctgcagttgtgcgtgtgtgtggaagggcagaagtcaaggagaggagcagccactggtggctataggtgggtctccaaactgggacacttttgagagtgaaataaagaacgactaataattatttggggcaacaggtgaattgaggctgtcccaggaaagctagaatggttcccactgcttataagccatgttaaggggtttgggtttattccaggggcacttggtggttgtatctttgtgggattccagaggctagattataaagtttgggattatgttttctgatccttatctttcagaaaagattgtgaaaagtcaattaagtttctgtgcccttgtggtcaaatgggcttggtaaaatgcctccacttgggatgggtgcttctgtcatcacatggaggaacagaacctagatatgaacattttgaatgtttgtgtgtgtgtgttttacaattttatg

SEQ ID NO: 13672 - DNA, 1053 bp, Homo sapiens
tccacctgctgggtttacgccattctcctgcctcagcctcccgagtagctgggactacaggtgcccaccaccacgcctggctaattttttgtatttttagtagagacggggtttcactgtgttagccaggatggtctccatttcctgacctcgtgatccgcctgcttcagcctaccaaagtgctgggattacagatatgagccaccgtgcctggcctaatttttgtatttttagtagagatggtttcagcatgttggccaggatggtcttgatctcttgacctcatgatcttcccatctcggcctcccaaagtgctgggattacaggtgtgagccaccgtgcccagcctccttttcagttttttaaattgagacagggtcttgctgtgttgcccaggctggtctctaactcctgagctcaaacagtcctcctgcctcagtaccccaaagggctgggattgcaggaatgaaccaccgtacctggcccaaattaatctcattttaaaatcattttgataatttagaagctaaagtaattagtttgattgtagagttgattgtagggttccacattgaaatagctcacatatatatatatatatatatatatatacacacacacatatatatatatattttaattttttctttttttgttttttcttgagacgaagtcttgctctgtcacccaggctagagtgcaatggcgcaatcttggctcactgcaacctctgcctcctgtgttccagcgattctactgcctcagcctctggagtagctgggattacaagcatgcgccaccatgcccagctaattttttgcatttttagtagagacggggtttcaccattttggccaggctggtctcgaactcatgacctcatgatccgccctccttgacctccctaagtgctaagattacaggcatgagccaccacacctggcttacatacatattttttatctcaaacattttttttaagagagagagtcttgctgtgttgcccaggccagaatgtggtggtaaacacaccctttttccagtagaggctca

SEQ ID NO: 13673 - DNA, 1056 bp, Homo sapiens
cagggcgggatagtggagaattggagagagctgtagttgtaggggagagcagccttagggagctgtggcttttggtgggaaaaaggaagcactgggacagagtgaggaagcctgagtcatgtggtgtctagaggtcagcctctcggggctctgagtacagcagagaatggatggtccctttattctcttacactccctgccttttttttttttttgagactgagttttgctcttttgcccaggctggagtgcagtggctccatctcggctcactgcaacctctgccctactggttcaagcgattctcttgcctcagactctggagtagttggattataggtgcccaccaccacacctggctaatttttgtatttttagtagagatgggattttgccatgttggccaggctggtcccaaactcctgaccccaggtgacccacccacctcggcctcccaaagggctaggattacaagcatgagccactgcgcctggccaattctcctagactctttatgatgtggtttggatgttttgtcctctccaaatctcatattgaaatgacttctgatgttggaggtgggcctagtaggaggtgtttgggtcatgaggtggatccctcatgaatggcatggtgcctccctctgagttcaccggagatctggtttaaaagaatgtggcacctccccccacttgctttctttcttgccatatgatatgctggctctccctttgccctctgccgtgattgaaagctcttggtctcaccagaagctgagcagatgttggtaccgtgtgtatggcttgcagaaacatgagccaaataagcctcttttctttataaattacccagtctcaagtattcctttatagtaatgtgaagggactatcatgcttcatgtttgtgccttcctatgtttgtaataatttcccatatctgtcttcagtttttcccaattttcttttctttctttcttttttttttttttttttgagaccgagtcttactctgtcgcccaggctggagtgcagtggtgtgatcttggctcactgcaac

SEQ ID NO: 13674 - DNA, 1088 bp, Homo sapiens
gccgagggctgttttgttttaaattagtccgtcgattacttcacttgaaattctgctcttcaccaagaaaacccaaacaggacacttttgaaaacaggactcagcatcgctttcaataggcttttcaggaccttcactgcattaaaacaatatttttgaaaatttagtacagtttagaaagagcacttattttgtttatatccattttttcttactaaattatagggattaactttgacaaatcatgctgctgttattttctacatttgtattttatccatagcacttattcacatttaggaaaagacataaaaactgaagaacattgatgagaaatctctgtgcaataatgtaaaaaaaaaaaaagataacactctgctcaatgtcacggagaccattttatccacacaatggtttttgttttttattttttcccatgtttcaaaattgtgatataatgatataatgttaaaagctgctttttttggctttttgcatatctagtataataggaagtgtgagcaaggtgatgatgtggctgtgatttccgacgtctggtgtgtggagagtactgcatgagcagagttcttctattataaaattaccatatcttgccattcacagcaggtcctgtgaatacgtttttactgagtgtctttaaatgaggtgttctagacagtgtgctgataatgtattgtgcgggtgacctcttcgctatgattgtatctcttactgttttgttaaagaaatgcagatgtgtaactgagaagtgatttgtgtgtgtgtcttggttgtgattggattctttggggggggggaactgaaacatttgtcatatactgaacttatatacatcaaaagggattaatacagcgatgccaaaaagtttaatcacggacacatgtccgtttctgtagtccgtatgctctttcattcttggtagagctggtatgtggaatgccatacctctgaccctactacttacctttttactgacagactgcccacactgaaagcttcagtgaatgttcttagtcctgttttcttctgttactgtcaggaaactgagtgatctaatggttctctca

SEQ ID NO: 13675 - DNA, 1383 bp, Homo sapiens
gtgttcgagaccactctggccaacatggtgaaacccgtctattaaaaatacaaaaattatccaggtgtggtgtcacacgcttgtagtcccagctactcaggaggctgaggcacgagaatcacttgaacctgggaagcagaggttgcagtgagccaagatcgtgccactgcactccagcctgggcgacagagcaagactctgttccccgaaaaaaggggaagggggcttttgaggaaatgccttttctctgctccctgaatgacttacctttgtgagtggcgcaggtcctaggtgggctctaggaatcactggctacttgcgtgctgtggtgttggtccctgcagccctttgggagctgggtccctccactgcgagcaacctgctcttctatcccagtgtgcagtacagatattagcattttttatgtgggctataatgtgaaaaatattggagatcataaatattgttcacttaatgcctgttgtgtcacaccaaacgtttactgctgagattatttgctgtcatgtggttgtagagatctaggcgggaactcatgtacagtctagattgatggtttttgttgcctggaaccccaattttgcctggcttgatggatggggccctgggagaggggctccgagttctgggtctccagtctgcatgcaattctgtgtgggggcttcatttaaactgtttctgtcattgccaaaccatttgtggatgtaaatagagaaaaccaacaaggatgtaaataggggaaaaaccaacaaggaaatagaatgttttatggcatttaacaatgctctcttttagaactatttttactagggttatgatgaatttcaaaattaaaaaaaaaatgccacatccattatcatagtcactacccagcttctctttattttggccttaaaatttacttgccagaaattcatagctcttgaattaaagccacattcatcatgcaattttttatatattaggttttactcgttttagatttcttttcttgcttttttgttttgttttggttttgtttggtttgttcttgtcaatagagatggagtcttgctatgtttctcgggctggtctgaaactcctggcctcaagtgatcctcccgccctggcctaccaaagtgttgggattacaggcatgaaccactgtgctcagccccatcttagatatattttgtagtagtgtatttagaggggagatttttttcatagttaaatttttacaatttgtaatcttctataattgacttatttgttagcggatgccttttttttcctaagagttcttgatgactttcctgtactgtgggaaacggcaggaaattcttctcccctctgtatcctcccccagcaacgagcctagctgtg

SEQ ID NO: 13676 - DNA, 1034 bp, Homo sapiens
gccttgcctggcctcagaaatttatttctaaccccaaggatgctccatgcattgggcattgtgttggcagattgtcatgttcccgtcttgctctccctgtcttaggcagtgtctctggaggcctggatcttgggagtttatccctctgtgcccacaaggcctcccatgttgcagagcatgtgctcaatcagtgcttgctcaccagtgaaagttctgtgtactagtccagccaaaaccctcacctcagttgtcagacactggaaaagatgctaaccagaaatgcagatctcctcgggatatttatttggcttaattctaacaatatgcatcaccaaaaaagctatagagaaatggtaacactaatctcctagccctttgtcttggtgacaagatcctgccacaggattcttcattgtactaaagatattttgctaatgaaaaagataaaaggaatttagataacatgtacatttcctctttctcacttcctcttgaaagggaaccaccgtttggtgttactgaacacgcgtgctgaaatattaataagaggagaaggaagaaagaaacacttaagtttaggaatgtcggtcatgtaacaggaaattgtattacaatggcttttgggtgtagcagttccttgccttttcccctttttttttcttagtggctttcaaattaaatttggctcttccagaaggcacaccacatacctttttaatgtaggaatttaaattactttgacaagacacaagcaaagcatacccctctgtgtcataatcccctctccccttaagccttgctcctagtttttgtttttgttttcttgagatggaatctcactctgtgcctaggctggagtgcagtggggtgatctcagctcattacaacctccgcctcgcgggttcaagcaatgcgccatgcctcagcctcccgaggagctgggattacaggcatgcaccaccacgcccggctaatttttttgtatttttaatagagacggggtttctccatgatggtcaggctggtctagaact

SEQ ID NO: 13677 - DNA, 1511 bp, Homo sapiens
tccagcttttagggatgtatttacagtgcatttctggagggtagcttggcagcataaatcaattgctctaaaaaatatttttcatacctttaaaccatatctctgaattttttctaaggcaaattgggacaaagatttaaacaagttatagagtaaggaacagcattatttataagcacaaaacatgggaaacagtataaatatcgaatgatatcaaagaactaaaacacagcaaggcatatccataagatcaggtgttacatatactatcatgttttgaaaaacagatgagagcatataaaaagaatgttttcaagaaatattaatcatatggaaaatgatgtgtgtgtatgtacacacacacatatatatacacatattttaaggaaaaagtggatagaaacagcagtgtagttatctctgggtgataaattatgggtgattttgtgcttttttcccctaaattttaccaacaaataaatttaatcagatttcatcaaatcaaaaccttatccctctttagtcagtatggtcacttaaccaatgctatagaaaaccaatactgtattagggtatccaatagaattttctataatgatggaaatgttttatagtctgcactgtccaatatggtagcctctaatcacgttattgagcactgaaaatgtggctagtatatctgaagaactaatatttacttctttaaattttatttaattttaattagcttaaaatttaaagagccccatgtggctgtggctactatattggacagtgcagctatggatgaacacagggctgtgttatcagttgaagtatcaggttatctgcctgttagtacctgccatttacaattcatctactccttatgttcacgtggaaggtaccctactgaggtgacactctatcgtctctctctcttaactctgacctgagagagatgaagcgacttacccaattggctgatttagcatgaataatctgcatactaaacttacctctgatctgctttcttccttttgggagtgcatgtggtaacatttgttcatgctgtgattttcgtctgactacactcactgttgcctgagatggggtgggagtatccatctaaatctttggttcattctatatagttatgacattaagcgtttttttggtttttgttttgttttgttttgtttgtgacggagtctcactctgtcacccaggctggagtgcagtggcgcgatcttggctcactgcaacctccgcctctgggttcaagcaattctcctgcctcagtctcctgagtagctgggattacaggcaggcgccaccacacctggctaattttttgtatttttagtagagatggggtttcaccatgttggcgaagctggtctcaaactcctgacctcatgatcggcccacctcggcctcccaaagtgctgggattacaggcatgagccaccacaccttgctgacattaagctttaactcagcctttattagtaatgagatgatattttgtc

SEQ ID NO: 13678 - DNA, 1035 bp, Homo sapiens
agatatgattaagatgggtcatactagattagggaagctgtccttgtaagaggaaaatttggctgatacaggaggaggacagccacctgaagatggaggcggggactggagtgatgctgccaccagctgccagaagctggaagcagcaaggccggatcctcccttagcccctttggagggagcacggcccagctgctgcggtgatctcaaacttccagcctacagaactgtgagaaagtccatttctgttgtttaaagcctcccagtttgtgtactttattagggcgatcctagaaaacaagtagagattcaagtcttattattttaataataagatattgatttgttggcccacagtttgaaaagatgctgaattacgggagggacaatcagtagttctaatgttgggatataatcagaaaaattaacctcttattccccagaatttctaaaccaataggactcaagacaaatgaatgtgatcctaggttagagtgtgaatggaatttacattatgtatatacgtagaagagctggatatatagttgtttagttttttatataataccaaattatatttcagagatacttatttttgtgtttcttggaaacttagacaagttattttagaaaaatcctaatgatttttttctcttcacccactcccttctcactaaaaaaggattgcttcattgtcatgaaaattaaatctagaatcctaaaaaaaaaatcagaattcttttttaaccactcatttcaaaattactaaaaacattaaaattatcagattttattgaactcataattaagcagctgatcatttggtaaactttggataaactattttgctagttttactataccttttgagatactgtttcaaaagagaaaatataaagaatataagcataatcccaattagaagagtcaacaggtgctgctttctgatgcagggcagttcaatcattataattctaaattacaaaccctttcaagtctggcagaagaaaatgaattgccagcgcattttccttt

SEQ ID NO: 13679 - DNA, 1079 bp, Homo sapiens
atgtttgtttcaattaatgaaccaacattgacacatctctatcacccagagtccatggtttaccttagggttcactctctgtgttggacattttatgggttttgacaaatgcattatgacatgcatccatcattataatatcagagtagtctcactgccctacaaatcctctgtaccctaccagttcatcccttcctcccgctccccccttggcaaccactgatcttgttatactcttcatagtttcaccttttccagaatgtcatacagttggaatcatacagtatgcagccttctcagattggcttctttcactcagtaatatgcatttaagtttcccccatgccttttcatggcttcgcagctcaattctctttggcgctaagtaatacgccattgtctgcatgtaccccagtttatcccctcacctactgaaggatatcttggttgtttccaacttttagcaaatacggataaagtggctctaaacatccgtgtgcaggtttttgtgtggaaaaggttttcaactcctttcataaataaggggcgtggctgctggaagttaacgcaacttttactttgccttgatggctctcaagcggggctgcccattataaccacctggtgagcatttaacaaatccctgtacccacccccacccaggccactttaaaccagactcggagatgggtggggcttgaacaaagtgttaaccaacccattgggaggtcctgaagtgcagccggtgttgaggatcaccaattcagaggctgacactagattcccgagtttctgcagatttctagtcagcttctctaccaagagatatttagacattgagagcaataagaaaatggttaaatgaccaagtatttatgttttataaaacattttttaaaaaatttatatatatgtgtgtatatgtgtgtgtgtgtgtatatatatgtagagagagagagagagagagagactcactctgttgaccaggctagagtacagtggtgtgatcatggctcactgcagccctgaacccaagggcccaagtgatcaagtgattctcctgactcagcctctcaagt

SEQ ID NO: 13680 - DNA, 1058 bp, Homo sapiens
cgcttgaacccgggaggcggaggttccagtgagccaagatcacggatcacgccactgcactccagcctggcgacagagcaagactctgtctcaaaaaaaaaaaaaaaaagaaaagaaaagaagaaaatatggtttatatagaagggggccattattatttcagttttcagagttggaaacaaattggagaaattatgcaactaccgaaggtcacatacttaataacataggaagaatttaggccgggcgcggtggcttacacctgtaatcccagcactttgggaggccgaggcaggtggatcacgaggtcaggagatcaagaccatcctgactaacatggtgaaaccccgtatctactaaaaatacaaagaattagctgggcctggtagctggcgcctgtagtcccagctactctggaggctgaggcaggagaatagcatgaacctgggagacggagcttgcagtgagctgagattgcaccactgcactccagcctgggctacagatcgagactctatctcaaaaaaaaaaaaaaagaaagaatttaaactaaaatctggctattccagcatccagctactttccactataacttgctactcatagttaggaagaatataattataattaaagaatataattaaagtaggagatacctactacattttagaaggatttaaacatcattagatgtttaaagtttgggtatgtaaaaccaggggatcctaacacttacaatgcctttgcacatattagaagagaacacccctacctgtgtggtgtcagcctcatgaattttggcttttgatttcccccttagctgggcacctttgttcagttcacaacatactaaccataccccttatttaaacagatttagtgccagatagatgaaatctaaattacctaatttcacatttctctatcagaaaattcagcaatgtttgtgtgcaatgatttattaaagaatgaataacttttttggattaattctgagtaaaaaaagacttgtaaacgtaaatatacctttttcttcattcaataaatatgtatttagt

SEQ ID NO: 13681 - DNA, 1029 bp, Homo sapiens
ttcaaaaatgcattcccagttttattgtttatctggggtagggatggcagataaaaagtgttttttttttttaataaaactatttcagaatttcaaaaacaatcccacaggatgccttaaaagtctaaattttgatattactgtaggcattgtggtataatagaaaaaaacactggacctgggacttactaaatcttgagttctggtctagttctgctactcaccctggtgtttgaccttgtatgagtcatttatttgctttgcatctacttttcatctaaaaattgctgagcaaactacattctgatgttctcttttatctcttgacattttgatttgagaagctctctagtataatacattttggtattgttggtattgttttaaaattattagttatcaattacccagagttattttttttagaaaatcaagttttaatgtcaaattagttaagtttgtacatccttcagcatcttccttttacttctttcatgtagctatcagatattgtgaaaaatgtcagctgattaaacctgatcgggcgcatcactgctcagcctgtgactcgtaagtgttactcacacatatgcttaatatctagcactggaaatcagtgatgggaaagtgcaaggggaaggaacattttatatgctttacacttgacaagaacacttcatcctctcccattatttgctgtgcatacagggcagacaaaaatattgataaaagctggaatatactcacaagttgtatctttgataacagttcctataccagttaatagaattttcttggactttatgctgtctatgcttgtgcttaatgtaagtctttgtgtacatgtaaggagataatatgttgaaggaaagatcgttagtttggaatcccagataatccttgacttttagtaacacagttacttaactttctaagtattagattactcattttgttattttttttagatgatctgtggtctaccttcatataagtatagaatacatattctagtagggaggcaaattt

SEQ ID NO: 13682 - DNA, 1032 bp, Homo sapiens
tctagaaccagaaataccatttgacccagcaatcctattactgggtatatacccaaaggattataaatcattctgtaaagacacatgcacatgtatgtttattgcagcactgttcacaatagcgaagacttggaaccaacccaaatgcccatcagtgatagactggataaagaaaatgtggcatatatacaccatggaatactatgcagccataaaaaagaatgagttcatgtcctttgcagggacatggatgaagctggaagccatcattttcagcaaactaacacaggagcagaaaaccaaacactgcatgttctcacttataagtgggagttgaacaatgagatcatatggacacagggaggggaacatcacacactggggcctgtcggggggtggaggggaaggggagggatagcattaggagaaatacctattgtagatgacagattgataggtgcagcaaaccaccatggcacatgtatacctatgtaacaaacctgtatgttctacacatctattttataacaaagtataataataaaaacatagaaaagcacaaataacagaaacctggttgaaatgcttaactagagtcaattagatgtgcaggagtaagtagtataagaagaatcaagtccaggagtgatcgggaaatgagtattaaacagtatttgaaaaagagaagatgtcccagggcccaaaagtcagaagggacccaccagccaggcaagttgcttagatgctgtaagtaggtgtagccaagggaagccaggagtatttgatatatggcagcaggggtttatggctgccagggggaaataactggtcaagtgttgggctttcagttaagatctgatttaatttcctttccctcattctgcagcaatcagaatacacaatcttaaccactcagtccttagtggttttgttccattttacgttggatgttttcactgcctcacagagtccgtttcaaatgttttggctgaaagggctttttgcatttgtatgttctgagttcagatcctg

SEQ ID NO: 13683 - DNA, 1021 bp, Homo sapiens
gatttagcctttcacccaaagcaagtaaatctttggacattcttgcaaaaattaaaaatctcttgacagtaacttttaaacaactaaaatttttactaatggagactatatattaagcctttcctgtgtagaaatttaattttatttgtgaaaaacgaagatggaaaaatatttagttcatattctttgccatctggtgtggagggcaaatattttttaatatgccaaaggtatacagtttttgttaaaatgtacttgatttatctgcttttttttgaagacaagttttgtcttcataaaatagtttttggttttcttttttctagataaaactttttctgagcatgataattaacatcatgggattaaaaaaatttaatagtcctctttccttttatagttctacttgtccaattctgaaaaggaacgttatgaaaaagaattcagccaagaaagacaacaagaaattttgagaagagcagcaagagctttacctatctataccacatcagcttcaaaaagtaagaaaaagaataagttttccttttcaaatgatttttaaagtatgcttattcctgccaggatatatttgcatggtttgactattaaatggatactatgattgccataaataatatctgtagcaacaagactttcctgtttccttactgtatttcagatgcagaaatagatatataaaaataataatcaatataaattgtttaaggggcccgctttaatatgaatctcttctgtacttgtttttttcccccaactcaactttcatggctaaaaattttaattattattcttagtaaactgtcatttggaagtctgaatttgagtattatgtgtcatcactgagtaattaaaaaaaaatccaaaagtgtgctaagaatggggaacagtaagagacacaaataggaagaaacttgttcagatgtataaggctaatattctgagagtcaggctgtgaactcaggtttgtctagttccaaagcccttggtgtttcctctgtac

SEQ ID NO: 13684 - DNA, 1002 bp, Homo sapiens
taagttttagggtgggttgttaatgccacattatcacctatattgtagtatccttgtaaacctgtctcttcctgtgctccacccccacctttattccatgtattctccaggaagcagtcagaatggtctttttcaaattaataccagtttgttactcctattctcaagatcttgactggcgtcctttcttgctcagcaagatatctaaaagccttaccatggcctttaaggcattgtgtattcattacttcattacttctctgacataatttcctttccactcttcctctaattttatctctagcttaagaaatctattttctatagacagaggtgtgggagggtgtgttgtctaagggagggagccctccacatcatcaccatgtgggattttaagattaatacctgacgctattcctgtaagcatataagcaacacatttagatactgctcaaatatgtagaacatatacttgaacagatgggcattacacttaaatgactgatataataaagaataaaggtgactagttttatggagaatagattcccttaaatagagatccataggtctttaaaataaaatttaaaaaaaatttggttttaaaacatctctattttggctttcccaatgcattttactatcgtaaactttgaaccactcattggaatcataggaagaattaatttttatggacatactaattcaacagcatataaaaacaaacacaaacttattaaatgtgaagtcttctgggaagcttttaaaactaattgcatgaaaaggatatcctcagcatctgaaggaaataataccaaatacaccaaaatattaacagtgtatgttgctgggtttgagattatactgattttttccttatgcaatacatagcctcttaatagactttcatattttccccttacagcatattcttcccttatcccccgaagagctaatgaatctgctaaaaaaatacaagtcatgattattactcctctgctc

SEQ ID NO: 13685 - DNA, 1050 bp, Homo sapiens
aaatatgtggaaattaacaacccactcaaacaaccaatgcctcaaagaaaagggaaatgagaacatacgttgagacaaataaaaatgaaaacacaacagcaaaactatgagatgcagtgaaagcagtgctaaagagggaaatttttttttttgggggggatgaagtcttgctcttgtcccccaggctggagtgtaatggcacgatatcggctcactgcaacctctgcctcccgggttcaagcaattctcctgcctcagcctcctaagtagctgggattacaggcgcctgccaccatcctggctaatttttgtattattagtagagatagggtttcaccatgttggccaggctggtctcaaactcctgacctcaggtgatccgcccaccttggcctcaagtgctgggattacaggcatgagccatcgcgtccagccttaagacagaaattaatagctataaatgtttacatttaaaaagaacaataatctcaaatcaacaactttacaccttaaggaaccagaaaaagaacaaatgaaattcaaagatggaaggaaataaagaaaacctaaactgtgatttaatgtattgacagaggctccttacggacaagtttgagagttaaaaactccaggctgggtgtggtggctcacgcctgtaatcccagaactttgggaggccaaggtggatggatcacctgaggtggggagttcgagaccagcctgaccaacatggagaaaccccgtctctactaaaagtacaaaattagccgagcatggtggcacatgcctataattccagctacatgggaggctgaggcaggagaatagcttgaacctgggaggtggaggttgcagttagttggttgagatcatgccattgcactccagcctgcgcaaccagagcaacactctgtctcaaaaaaaaaaaaaaaaaaaaaaaaaaacctccagagggccctgacatggtggctcatgcctgtaatcccagcactttgggaggccaaagcgggaggatcacttgaggtcaagagttcaagaccagcctgacca

SEQ ID NO: 13686 - DNA, 1048 bp, Homo sapiens
tcttagagaagaaactccattaatgtgtgctcagtctggttccactccctagtaaccttaagcatagttacattcactttttgtcttttacccccattttcagttctgttgtgatcatcttttacaacataattcaccctcaactatttttggaggagtgtgggaaggaaataaacagtaacgtaaagtatatatgaaatcatgtttaaccttgaagacaatgaccccttgatttttactttcggttaacaggtaccacaacatcagagtatacaagaatactggaagtgtgtgaagaaagaaagcattaaaggagtaaaagaagtctggaaacaagctggaaaaggtcttttttaataaaagatataatagtatggcaattatattgttccaaatgtcaaaatttgtgattttttagaagtacttgctatttatcttcttaagtcttcattgatattctgtgtgaaataagcatgtcttgtacttgctttctgattcataattttattaaagaacttagtagaaagaaaagtaagtataaaaatagatattggattctgtcagaaggcctagatttgaaataatgttttgtacttcggtaagatggaaaacttagtgattcactgatttcttagacactctaatatgatatgctttctggaaggataaaacaaatacatatgggaaaaagtacttgagaccaaggccagcatcaattccagacatcttcatgttcctaataggctaaatgaagttaaaaacttatttcagatttttctcatctgtaccttatatctcataaatttattgcatattttatgtcagtagcttagctgtttattgtctttaaaataacatgtaaacttcaatgttctatctggaagcagaataaaatatttacatagatacaaaaaatactgaggtgctttttattttacatgtgtttttaaaactactttaaaaaaaattgtaaatactctcatcccttgccagcctcattagttcttaaaacctggtgtagctgggagaaattttgaccccaaggtca

SEQ ID NO: 13687 - DNA, 1042 bp, Homo sapiens
ccgtttaagtaaaaaccacagtgtaatttaattctgtctcccagaattttggtgtgcttttattgttatgaaagcagcagataatttaaattctgaaaattgagttttctgtcaacctactacgtattgttctgggggaaagcattgactcttgggctactcaggcagctcctgatggcatttacccgccctgcatcagtgccttctgattttgttgtgtttttctggtcttttttactcttctctcctactctctttggtgatttttcttcttctgcatttcttttctcttcttttaaactccatgattagccttaaagatagtgaccagaaataatccctgagtttatttctattctgacacatttgacctcattttttattccaatgaattttttaaactgaaaataaacctgtgacttaagatatataatggttagagggaagaaaattggcctcaagtcttctcgtcaggaaaaattggggaggatattgatactgatgtactttttagggctgagtttgttaaaaattctgaaataccaattattagttgaggatttctgagtttcatgaagcgtttttataaattcagaggtgtctagaggcagtggtgtgctagtaaatatgtttaacaatcatctgtctcaggaaaaacagccttgatttgtagtgtttgccaattagtagtataaataaataaatactctaccatgccaatgtcaagctcccctgcatgaagcagaggtgggaagacatgcatgatagactcacagcctgtacgcgccactccagtacaacactgcctaaacaattccaataaggaaaaacagatctctcccattgtttccaattaacccactaatttataaagtatgtaatttgttcacaatgtgtctggcagccttatctactataaattttccaattcatatatgcatgttcagctcatgttccagagtttcatgttataacaagataatatgattttaggcttaaagggaaaagattatcatcataaattgatttatattcattaaaa

SEQ ID NO: 13688 - DNA, 1050 bp, Homo sapiens
tagaaggactaaatagtttaaagcaaaagaaaatctgaaaacgtactatagtctttttgttaaagaaaagtacacctgctccaaaatagaaacaacaaaaagttggtaattcaaaaaaaggaagccattgaaaacatttaaaatatttacttatagttaaaacatggaatcatctaataataccatgtttgctttccttgctctgaactacctttggccctgactccctcctttatttgcttgggagtcattagggtatgttgtcctgcacagaagggtaaatacattcccaccgtcatcaccctctgcagctctttattcttcctgtccgaactaccatagtagtttttttttttcccattgctgcttccacatgagcattatttcagacaatcactttgcagttttcatattcagcttcatctgtcttaaatagctttcccatttataccacatccgcttaattaaaatttttaccaatcattcaaagtttactgttagaattacctcctctgtgacatctttgatcatctaaactccgtaaatgcctgcacatttttctaaacttttgtaactcttactattcgtatctctctatggtatctagtattttctgtaaacatctgcattttggcctcctaatggaagtatacaatgccatctgtgaagaattcttgtcaaaatcaaacctgaatcttagcacacatctggatttaagtaccatttgtagaaaatacagaaggtagaggaacatgtgaaatgataccaaggacatacagtcatcagaattttatagactattagaaattttatgggaccaatgaccacctttttcaacaattaaattgaaaggtaggggcaaaaaagacaagggagaaaacgtatatattaagagagacataagagacaggaaagctgggcacagtggctcacacctgcagtcctagcactttgggaggctgaggcaggagcatcacttgagcccaggaattcaagaccagccagggcaacataggaagaccctgtctctccaaaaaaaaaaaaaaaaaa

SEQ ID NO: 13689 - DNA, 1029 bp, Homo sapiens
acacacattttcctcattagatagttttctttctttgttatttacatagatggaggactgtttatgttctcagaatgaacaacagcattaatcatatatttccaggattttttttttttgaaggagaattaagacccagtatttcggatgattgggagaaagaccttagtgatgaactattagaaaaataggattttccccccttaggcaaagtctatgaggatattcatacgagaaatagaggaatgagcatgatgagaggggaaggggtgagggaaggaggctttaaaaggaaccagaaacagtaaatggctgtaaggatagagaatatacatagcattcattacagagtcaaagataaatttttaaaatgcacatgcagtggctgtgggaggaaaatcaacttacattcctacattcataaaggactggcagggaaatcaggactgtaagatgtaacttaaggatgacaagaaaattaagcaattggcaggtaaaagatgaggcagaactggagagttacagaattgggaagcgttagaagtatcatgaaagggcaaggtgtaagatctgctctctcaccattcatccaaatgctggccacccttaacttagacttttctatacttagacttctctgtacttttatcccacgctgattggggtctcaaccctgatccttccccttctccatccctccaacacatctactgtaccacattctagctggaagaagagtgtccctaattgtgagaagccttcacaggctgaatatatagagtctcccagctcctgtgtagcttgtggtttatgagctgctttaaagcctacttcatctgtaaaatagagatgataatatctacttcaaggttacagtgacttacatgaaacttctgacacagtgcctgagatcatgtcaacgaaagatctgttaattaggcaaatgtttgtgtcacaagtcctcttgatttctctgaaaccacactgtcctagtctctctctgtcattggccctcttccacctcctgcc

SEQ ID NO: 13690 - DNA, 1071 bp, Homo sapiens
tcttctccggagtatcactttaaccacacagtgtacccttcttcagaaacccttcttcagtgtctcattttgccaagagtaaaatgcactttttttttgttgttgagatggagtctctgtcacccaggctggagtgcagtggcgtgatcccggctcactacaacctcttaactccccggttcaagtaattctcctacctcagcctcccaagtagctaggattacaggcatacgccaccacgtccagctaatttttttttgtattgttagtagagccggggtttcaccatgttggccaggatggtctcgatctcctgacctcgtgatccgcctgccttggcctcccagagtgctgggattactggcgtgagccacagcgcccggccaaaatgcacattttaaaactttgtctttcagagccttttatagtcacactctgacctgacactactcaggcaccttcccactaaagtgattcactcactatccctagaacaagacttaaataccgctcacccgccagctgcaatttgtagactcttgatttcacttatccatctaattgttttttttttttctggcccacttctaatctttctcctttgaaatccctgacttgattctaaaagcttcacactagtgtagttattttggattctcttcccaactctcagctctccttccctgcagctttgtaagtttaatcttagctaaagtaatacagaaaccattttattatcaatcgttttataaggtctgttggcatagcatttgcctgatctgctattggaccgagacagtggttctcatccttttgccaccacggtggacattcctttcagcatcagtggctgaatacaggaaggattgagaggacctataggttgaaaactttgccttcgcctcagtgattttgatacatttccctaagaagtgggcctactaccactactttagggacaggtgtgcatagttgagctagatatataccagaattttggcttgtgatgaatctttcattgcaatagaattttatgcattaatatagttacattggtattccaagttggta

SEQ ID NO: 13691 - DNA, 1030 bp, Homo sapiens
gtgcacatgtaccctaaaacttaaagtataataataataaaaaaaaggtatttttcctttatgaaaataaacgatgttcattattaaaaaaaaaagaaaatgcaccacttaattgatatgtatatatacatatacaagagcaggtctgtttctctgaaatttatgttgtattttggtgagagatttgaacttcgaatgtatagccatgaggtgaactttgacgagatttgaccatggacaagatgaattattgacaagctgttactctgaaaaagcccccagtttacacagagtcccatgttatatcgaatatattttctattatgagtcattaagtcatatataaataattctgaggactccctagtgatatttggagaatatgaaagctttcatggtggcaaagtcaattaaatagagtttctaaaagagcagtattactgtcatttaatcccttccttacctgtttttgactattttatcctttttccctattatccttttcatgacttatccctgacctgtaaaatatttttttcttcttctgcctctttagacgttagcatttcctacagtgaaaacactgatttaattggtcatcctttagtctgatttttcactggaagccagagaacctaaacaattttagcaaggttttaattattttctgtattgtttaaattcgtttttcgttgtgtttcattctatttcgtttttggagatactatggagataataatcactttcaccttcattattttaattactttttggcttttctctcttcctggaaaataaaagaacaccgtgttataaaaaagttccctctaaagtagctttttgtatataacctttaaataattaaaacttcaaaatctttttatagaagttatacaagaaggtgcgatatttacatattcttaagcaaatggaactgtgctttagaataatagattattccattctgagcagcatttattatttaaagttattggaaagttggcactaaacctgtactgaaccaataagc

SEQ ID NO: 13692 - DNA, 1043 bp, Homo sapiens
tttagtagtttatgtctttctaggaatttgtcaatgttgtctatgttgtctaacttattggcatacagttttttgtagtattccctcagtattctttttatttccataaggtctgtagtaatgttccccctttcactcctgattttaataatttgagccttctctctttttctcttgctcatccttgtgaaaagtttgttaattttgttgatgttttcaaggtaccaacttttagatttgtttattctacctattgtttttgtattctctcctttatttttcacttaacattttattagttctttccttctgctcactttaggtttagttgctcttctttttccagaattgtatgtggaagattgggtttatttatatgagcccttacttcttttttagatacaaacatttaaataataaatttccctttatgcaccatttcactgcattcaatacattttcgtttgttgggccctcattctacataatcttaaagtattttctaattgactttgtagtttcttccttgtcccattatttatttaagagtgtgctgtttccttctgttatttgtaggttctggattattagcaaataattgttaccactaaagtacctattttttgcactgctagtcattccttggaatgatattaataaatacctacaatttacttataatttggcaacaaaaatgctataaactgactgttagatttgtatacaatttcctttggattctacccagtttacttttggtactcttgcaatgaaaccaaatagtatcatagacacaacctctgtagcacattttaggtggaaaacactgtcacagaattttaactaccagatctgttttaggccatacagtttgctcttagttttatcaagagaatttttaaggcttgctgcgacactgctatgtgtccttttcaaaatctgttcttttcattacttacttagaataagatctctctaaaattttaaattaatagcacagagagagaggctgggaaagcagcctttttatgtaaatgaaacct

SEQ ID NO: 13693 - DNA, 1829 bp, Homo sapiens
gaagcttatggtgtagacagtttaaaaacaagataccctgatttgcttccctttcctcagatcccaaatgacaggttcacttctgaggttgctatgagggtgatggaatgtactgcctgtatcataataaaacttgaaaattttatgcaacaaaaagtgtgaagatatttaacgaaaaaaaaggtagatcttgaatgtgttgtagcacgaataaattgctgtacttcattaagcttcattgccaattagctaggaattgttaagcacattgcagattgttcttggagaattctggagttgttatgaacatgaataccaacggaaaaccttaactgaatctaaaagaaaactattttgaagatggtggtgagctgcaaaatagctggatggatttgaatgattgggatgatacatcattgaactgcactttatataaccaaagcttagcagtttgttagataagagtctatgtatgtctctggttaggatgaagttaattttatgtttttaacatggtatttttgaaggagctaatgaaacactggacatataattggtttaaacataaggggaattaagtctttgtagtctgtcatttttttaagtggatcctcttggatgcgttattttctcatcagctggctctgatcatgaatttgttgtaattttatgttgtactcagtgcatttaagaaatggtagagtattttaatcctattacttgactaagagtgtgaaggtagtactttttagagtgcactgagtgcactttacatctttatttaaatttttttttaacatcttatgtttacaggcttcctgtttgatgaagatagcaacggaaaactcaaaatggtggcagttcttattaccagttgttagtattgtttctggaaactgcttgccaagacaacatttattaactgttagaacacttgctttatgtttgtgtgtacatattttccacaaatgttataatttatatagtgtggttgaacaggatgcaatcttttgttgtctaaaggtgctgcagttaaaaaaaaaacaaccttttctttcaatatggcatgtagtggagtttttttaactttaaaaacatcaaaaattgttaaaatcattgtgttatctagtagtttataattatcggcttatatttccccatgaatgatcagaactgacatttaattcatgtttgtctcgccatgcttctttactttaacatatttcttttgcagaatgtaaaaggtaatgataattagtttatataagtgtactggctgtaaatgatgctaaatatactttatgcaattaagggcttacagaacatgttgaaactttttttacttttattgggaataaggaatgtttgcacctccacattttattgcttctggatgtgaaatcatgtaattatttctgctgttatataaagtgccatacttttaataaaggaaaatgtacatatgaaatcatcgtaatgggtgtttcctgagaaatagttcattggaaatcaaacttaacatcttaatattaagttttaatgtgtgtgtatgtgtgtatttattggaaatattaggaaaatattttcctgtatattttcatgctggaattatagatttttaggattaatagaatatgaagtgcttgttatatactaggtttaggtgctcattgatttagttgagtttatgtcacctttttagggaatcagattagctgatatatgtggtatatatgtgtttggaaacagatacattaaatatttttttcctctaggtagagctgaattgatatttccattgcctcagggacagctgcatgtctgggact

SEQ ID NO: 13694 - DNA, 2528 bp, Homo sapiens
tcttttttaatgacattttcctctcctgacactaattgccatattgggaagctgccttgtcgtctgcagcagactaatctaaaactttttcatagtttaaaacttttagttgattattgttttaaagatgcagaagaaaatgagattgaagttgagggattgccccttctcatcacactggacagtgttttgcaaacttttgatgcaaaacgacccaagtttctaacaacatatcatgaattgattccatcccgcaaagacttgtttatgaatacattatatttgaaatatagtaatattttattgaactgtaaagttgcaaaagtgtttgacatttccagctttgctgatttgttatcctctgtgttgcctcgagaatataagaccaaaagttgcacaaagtggaaagacaattttgcaagtgagtcttggcttaagaatgcatggcattttattagtgaatctgtaagtgtgaaagaagatcaggaagaaacaaaaccaacatttgacattgttgttgatactctaaaagactgggcattgcttccaggaacaaagtttactgtttcagccaaccagcttgtggttcctgaaggagatgttctgcttcctctcagccttatgcacattgcagtttttccaaatgcccagagtgataaagtttttcatgctctaatgaaagctggctgtattcagcttgctttgaacaaaatctgttccaaagacagtgcatttgttcctttgttgtcatgtcacacagcaaatatagagagccccacaagcatcttgaaggctctacattatatggtccaaacttcaacatttagagcagaaaaattagtagaaaatgattttgaggcacttttgatgtatttcaactgcaatttgaatcatttgatgtcccaagatgatataaaaattctaaagtcacttccgtgctataaatccatcagtggccgctatgtaagcattggaaaatttggaacatgctacgtacttacaaaaagtatcccttcagctgaagtggagaaatggacacagtcatcatcatctgcatttcttgaagaaaaaatacacttaaaagaactatatgaggtgattggttgtgtacctgtagatgatcttgaggtatatttgaaacacctcttaccaaaaattgaaaatctctcttatgatgcaaaattagagcacttgatctaccttaagaatagattatcaagtgctgaggaattatcagagattaaggaacaactttttgaaaaactggaaagtttattgataatccatgatgctaacagtagactaaagcaagcaaagcatttctatgatagaactgtgagagtttttgaagttatgcttcctgaaaaattgtttattcctaatgatttctttaagaaattggaacaacttataaaacccaaaaatcatgttacatttatgacatcctgggtggaattcttaagaaatattggactaaaatacatactttctcagcagcagttgttacagtttgctaaggaaatcagtgtgagggctaatacagaaaactggtccaaagaaacattgcaaaatacagttgatatccttctgcatcatatattccaagaacgaatggatttgttatctggaaattttctgaaagaactatctttaataccattcttatgtcctgagcgggcccccgcggaattcattagatttcatcctcaatatcaagaggtaaatggaacacttcctcttataaagttcaatggagcacaggtaaatccaaaattcaagcaatgtgatgtactccagctgttatggacatcctgccctattcttccagagaaagctacacccttaagcattaaagaacaagaaggtagtgaccttggtccacaagaacagcttgaacaagttttaaatatgcttaatgttaacctggatcctcctcttgataaggtaatcaataactgcagaaacatatgcaacataacgacgttggatgaagaaatggtaaaaactagagcaaaagtcttaaggagcatatatgaattcctcagtgcagaaaaaagggaatttcgttttcagttgcgaggggttgcttttgtgatggtagaagatggttggaaacttctgaagcctgaggaggtagtcataaacctagaatatgaatctgattttaaaccttatttgtacaagctacctttagaacttggcacatttcaccagttgttcaaacacttaggtactgaagatattatttcaactaagcaatatgttgaagtgttgagccgcatatttaaaaattctgagggcaaacaattagatcctaatgaaatgcgtacagttaagagagtagtttctggtctgttcaggagtctacagaatgattcagtcaaggtgaggagtgatctcgagaatgtacgagaccttgcgctttacctcccaagccaggatggtagattggtaaagtcaagcatcttagtgtttgacgatgcgccacattataaaagtagaatccaggggaatattggtgtgcaaat

SEQ ID NO: 13695 - DNA, 1058 bp, Homo sapiens
cttgcattcagatgtgagcagtcatcttgtatcatggcttttcccctttactggcactttgtttcacagccagaagctcttaaggtcaacttatttttattcatttttatataatgagataataaaaggctcagattgtcaaatcacatgcacaagaatgagagctctcacccagtataacacactttactaaggatttcaaggatacagctgattataagacacaggggaaggaagcacggagagtccctctgtgctgcactaggacacaccttggcctggatctcacggagttggtttctgagtgatgcacacagaccagcacttaacagagggagctatttcagtcataaaacatgtacatgattttctctgataatcaacataacttgtgacattttcaaggggattatgcctcttaaatatataaattccaagcttatttccaataagcaacttctgtaaagtatccagtagctaaggactcttcctagtaaacaccgtgtatgtgcttgcctagaggtctgtcatcagcatgttaacaaggagatttggctgggtcatctctttctttcttgggtattccctggggaaagggggaaatagactgcaggcctgctcccagctctttccttcccagacaaccttttaatttttctctcaggatgtttattccttttttttttttccttctttttcgaaacggagttttgttcttgttgcccaggctggagtaaagtggcgtgatcttggctgtctgcagcctctgcctcctgggttcaagggattctcctgccttagcctcctgaatagctcggattataggcttctgccaccatgcccagctaatttttgtatttttagtagagacggggtttcaccatgttggccaggctggtctcgaattcctgacctcaggtaatcttcccacctcggcctcccaaagtgcttggattacaggcgtgagccaccatgtctggccaggatgtttgttcctttcttatcttacttttagaaccaagaacacatcgttttgatcagagtagatacaggccatt

SEQ ID NO: 13696 - DNA, 1395 bp, Homo sapiens
aacatagtttataagtttaacctacaacctatgactccttttgttctgtttagatgataaccagattttaagtgcatcatgaagacaggaacaacagaagcaagatcagtagagacttgcacatcactgggacttgccctgcattctgatgctaccatgttagagaaacacaaatactttaaagtgctcagagttgagagccacagcagccattgctgtgtttatggtccacttgccccatgggtaaagtcagaataagccacgagatcacccatcttaagcattttcacctgcctttatatccttgacttctctttttactttagtagcactgattttttaatctgtccttgaactgtttactcactggcgtttaagcattttgagcaaacctgcagtaagaaatgcattttacattatgatctattgtacagatacatgtatgtacatttaggtgtatatgtacatatatgtgggagtgaaactgaaacaaaagtaccacaaatctaaagttaccctctgtgctgtgcactatatattttctgtcccattttcttcttttttttttttaatgcaggtcacaagctactgtacagattttacaaaccattagtagatactggtgcacagtttgaaaaatctccatgttaacttatcctgcccagtgattttgcttattctactttctttcccaagtcaaccataaaacctttttccgatagagatgttttagaactaaattatttagaacactaaaaccacaacttttatttaatcccaccaccacttctcctcatgtgtgttaattcatttgaatgacatctttcaggatggatgatatatacatgtacaagacagtgtgaaaaatgatacaatgcagtgctgtgagaacactattataaatagagaagtgttgaattttgcctcgtggagtcagaaatgaccattaatctgggcttagttgcttctgcttcagattttaccctagcttaagccacagtagggaggagggagtgaggaacaggtaaggtatgatagaaagtggttagagaatatattagtcctggttgcttgatgatagggaacttggaacagaagggaggggctgttgtttgggggttgaaaatcagactgggatcaagtcctgaagagttctttatgtctgctcagaggcttatatatgactggggagggaatagggaggccttagaggtttgaagtttgtaagcagagaagtgacatgagcagatataagctgcaggcaaaaagttaaggtttcagtatgggtgatagatggggggtacagagattgaaggcagggagaaaacaatctatccaagaaatagatgaaaacaaatagaaaaatacagtgaatatgaccatatacttaaaaac

SEQ ID NO: 13697 - DNA, 1068 bp, Homo sapiens
agtgtagcaccacgtattgacctcatgtagcatcaagtatataatgattttaccttaaaagcgttaattttagaatagttgataagacatgaagataagaaaataattatccattaagtgatttctgtcatctagattaaaatgtcaatcagattgttcccattagttatttttaaactaagacaggtaagtaaccgtgatcatatggggagtccttatacagaaatcttagggttgctttggaccttggctatttttatcccacacttgttcagatgttggttgaaagaatggcataagggtctgtttttaaatgtataaacaaatatattgtctattaaacaataggactggagccccaggcgggttaaatatttactgctctctctccagagtattcaatttaaactatttggtaaaaatgcttattcctcctattctttttttttttcttcgccctggggaagaagtttcctcctattcttatgccccagctctcctgcaaatggaaagtctcttccatgaggtgaagttagtgcctgggctgagctagcttggaatatttgatgttgctaagcaaacatcaggttaaagaaaacaatatttatttttgtttttatcttaaatacgaagaaagaccatatggtgcatatctagaaacacctaagtggttaattgcatgttaaatttctttcctctttgcctgcataaacaactgaaaaaatatttactttctgtgtcatgctaggtttatttatgactttgtaactaaaacacagaagtgttataaattgaaactttaatctcatgattgactcattttctaaaaatttatatggtttcagtttgtgggacagctgcaactctagatttcagtgatttaaaacatgaggaaattatgactacccggttgtttttttaatatggtcctttgagccaaatcaccaactttcatttttgtcttggttttcatgaataatgctgccctttttttcttctcggcctgcaatttgacaagctagatataaggaactaaaaatccaggctattagtagaagttatttcttt

SEQ ID NO: 13698 - DNA, 1076 bp, Homo sapiens
agagggtggggcccccactccctagtgtcctttaaggggacctttcacacagcaatggctgattgtgtctcacagtctagttggggctctagaaatctaagtttaagtcattgaatgcatcatcgggataggatgaatcaattagctaaatgcttgaaataggagcatttggttacccaaccgtagtacagccttgcggggtggggcaatgtgaggcaaccactccagggcttttaagtcagttctttttagtttataggcaactttagcatattagacaggctgcattgtcttgttatagtcatatagtcaaatcttgagtttttaaaaataaacacagaaattactgttttaaatacagtggtaattgtggaaaaattcaggttggattattacagtaagcacattaggtcactgtagttaattactggcatattatattccaatagtagaaacaacatttctaccattttcctattttaaaaaaccacccacgatgtttgatctctgcttttgaaataccactgttacggtagtacaaatggcaccatttattgttagggtaattgcttttccaacactgtgaatgattactctcttctaaattcctttattgctttatctgcacctcttttgtggctcttggtgcattttcccatgctttatgaatcctgaaatacatttggcccttctgtgtccacacagtcaactaaccatgggtcaaaaatacttggaaaaaatagtaataataacaacacaattattaaaatgcaagtaaaaaagcagtacagtgtaacaactatttacatagctactttgtattaggtattacaagtagtctagacatgatttaaagtatataagaggatatgcatctaggttatctgcaaatactatactattttataccagggacttgaacatgtatggattttgttcttggaggaaggtcctggaaccaacccccctcagatactgcaggttgtacattccttttctggttccaggtagcaggatcaggtgagattcattgtgtattacccagctgcttagtaggatgccttgcacagggtggg

SEQ ID NO: 13699 - DNA, 1034 bp, Homo sapiens
tccacccacctcatagtttgctagtttactaatatttttatattcttgatttttgcatttatgtttatgagagagggattgcttatgatttttctttgtcattatttgctggtgttcacttaaatatatactatttcataaaatgagttggtgagtgtttctttttcttttctttacaagcatttatttataacattgttatcatttgttctttaaaactgtcggaattcatctatgaaaccattcagggtctgttgtttcctctgtgggaagattttttaaatgactgaatccttactagtcataagcctctttgggctttcttttcttctcagataaactttgctactttgaaattttctagacatttatcaatttgagccaagttcttcagcttattcacataaagttacttatagcattcttttatccttcaaattctgctataattgtatcctttttaatttctaattctgttttctcatttttttctctctgttaatcttggcagaattttgtccactttatcactgtaatctctcagtgtctaagcaggattggttcctgggccactactccccgccaacgtggctaccaaaatccttggatgctcaagtcccttttatgaaagggtgtagtatttgcatttaacctgtgtacatcctgctgtatactttaaatcatctctagattacttataatacctaacacaatgtaaacgctatatagatgctgtattgtttagggaataatgacaagaaaaaagtctgtacatgttcgatacagatgcagtttttttccaaatatttttgactcatggttgattgaatccatgaatgtgcaaccctcagatatggagggctgactgtattttcaaagaaccaatgcaaactttgtttatcctattttgtttgtttcagtttgttacttcctacttttattattactctctccttcctccatccttgtttttttcttctgatttcataggcatttatctaattcggtttctgttttatttaacataagcattt

SEQ ID NO: 13700 - DNA, 1034 bp, Homo sapiens
ttacctatttatatttaatagctatattagtctgttctctgttccttagaatacctgaaaatggataatttctaaagaaaaggaatctattttttacagttatggaggctgagaagtccaaggtcaaggggccgtatctgatgagcgccttcctactggtggggactctgcagagtcccaaggtggctcagggcctcacatggcgagggactgagtgtgctcacatgctagctcaggtctctcttcctcttcttataaagccagcagtcccactcccatgataatctcttaatccattataatcaatggatgaattaatccatttatgagggcagagccctcatgacccagtgatctctcaatactgcctggagaaggggtatttaagccccattggggcttaaatttcaacatgggttttggaggggacagatactcaagctatagcagtggcatagtgtgctctctccccaaatctgtcataaaatcacagtggctctttacaaatattgggttcttagattcaaggaaagaagacagtctaaacccctatacccagcattgaaaatgctaagcaccttcaccgtgcagtctaatagcctgccccttgacctctgctgtggttagaatatggtttgctccaccaaaacttatgttaaaacttggtccccaacatggtggtattggtaggtggtgcatttgagatgtgattaggtcctttagatggagtaatagctctctctggaggctgggttctctctggaatggattagttctcatgggaacagatcagttcccacgagagcaggttgttatgaagcgaggttgcctcttgtattttgctctttacatatgcatcaggttccccttccatttctctgccatgctttgatgcagcacaaggctctcaccaggagctgccggatgtgttgcccagtcttgaagttcctagcctacagaattgtaagctacataagcttctgttctttataatttacccagtctcagatattctgttatagcaacacaaaatg

SEQ ID NO: 13701 - DNA, 1054 bp, Homo sapiens
aggttttcattcctccctgttccagggctaacctggatcctctctcacgacatttccacaactcccattctgttcttcctaaagcaagaggcagcacataggtgttatttttggttattctttcctactgttcaattttagacatggctgtttgatttcacattttgatacagcttaagctgaatgagagaccattgcaatagaggtctccttgctgtagtgagatttggccccagcctctatggcgagaattctgtcatctagtggcacattggtgtggtgtcatctctcactgaagtcaggcctactggtttactttcctaatccctaggatgatgatggaattgtactgtctttctttagctttgatttctgttaaccacagttttcagtgaactgtgttgctgatctgcaccattaatgaaaattatttcctggttgccaggaagtttgactggagcaattttcttgccactagcttcagaagtcaagacagaaccaaattagcaatggtggattctttatagaacagggggaaaggtcttttcagttctatatagttacctaaagggcaaacaggtttccagtatcattcagttcctttactgctaccttctctatgtaaccaaataaaacagtagctctccctgtggttttcaaggcagcatttcaaaatgtcacccagctataacatgagaattatacttagtcattcctgatgccaaaaatacagtttcatttgcttttgataaagttaaaaatagtttctctgacagtactgtcacgtgctgtgtcctttacaggtgtccattttttcctcgcccacacgtgccctccggcaggccatcttgttcattctgtaacaagcctctgtgggcatttgccatttggtgcacatgttctctgtcacatttgctctcactcactgaatagaataaggtgagactgaagctgtgtttacctgtgtttcaacctggattctctgactgtacttgattgtgttttatattttcactaagtttgaggccatggtgtttggacgtaatatccaagt

SEQ ID NO: 13702 - DNA, 1047 bp, Homo sapiens
caacaacaaaaaattagccgggcatggcggcaagtgcctgtagtcccagctacttgggaggctgaggcaggagaattgcttgaacccgggaggtggaggttgcagtaagcagagataatgacactgcactccagtttgggcaacagagtgagactttgtctcagaaaaaaaaaaaaaagcatcgttaggcacttttgtcattgtatgatcttagagtgcacttacacaaacctaagggtatagcctacacacacgcctatgctctctggtatagcctgtcgctcctaggctacaaacctgcacagaatgttaccatactgaaaactgtaggcagctgcaacacatgataagtatatatgcatctaaacatggaaaaggtatggtgaaaataggtataaaagataaaaaatggtatacctgtatagggctcttaccacaaatggagcttgcaggactggaagttgctctgggtgagtctgtgagtgagtggtggtgagtgtgaaggcctaggacattaccgtacaccattattgactttatagacactgtacacttaggctacactaaatttatagaaagatatggttctttcttcaataataaattaacttttgcttcctgtaactttttttaccttataaactttttagtttttaaaaactttttgatacttttgtaataatatttagcttgaaacacaagcacattgtatagatgaacaacaatattttctctttttttaatccttactctataaacttttttctattaaaaattttttttgtactttttaaatttttttgttataaaccaagacacaaacatacacattagccaaggcttacacagggtcagaatcatcaacatcactgtcttccacctccacatcttgtcctactagaaggtctgcaagggaaataacaggcatggagctgccatcccctgtgataacaatgccttcttctggaatccctcctgaaggaccggcctgaggctgtttcacagttaacttagaaggagtacaccaaaatagtgatagaaagtata

SEQ ID NO: 13703 - DNA, 1050 bp, Homo sapiens
tccttgtttaaaacaaagtgtgtgtgtgtgtgtgtgtgtgtgtgtgtgtgtgttttgaagaaacttttggcagtgaggctgaaaaagacttatttatttaacaaaaaaccacaatttttttgttagcaatttttattacctgttataacctggggctcatttcatttataggcgagtggctgaactgtttatgtttgattttgaaattagtggaatccatctagacaaagaaaaggtacatctttctgctgtttttttgactcttccagttttactaacatttagttgataccattattgctacagtccttgtatatattgcttgaatttgcatattgcaaaaacgtgcaggtcttttatctgttatgaaattcttctttagattgtatttgaatatagtcccctctctggaagttgacctatcacaccatgataattcagaattaagacaggcttgagccaagtggagtgttttagataatcatggaattaggatgagataggcaatatcaggaaagactggcaagtgaatgggaaagctgatgtcattgaagattggtagtacagggaatatcacataagaccttacataagtgtatttatttatattatacgtgtgtttgactgatggaacaagcatagattacacagtgtttacactgggatggaggccttctacctagtccatccccttcattttacagatgtggaaacaagacaaagtgatttgttcaagttgccatcctaactaacaaatggccagtgttcttaaaatttctaacactggccactgttctttctagcacataacatcctgagaaaccaagtgcctcatttcagttgtaaattcagagttggaagaacaggagggacttgacaccattggaagttcagcctgccccacagtctcccccactcacctgcagtctagactattatggctttttgtttatttgttttaaacagtaatacatttttcctagtaaatatggtagaattaaaccacttacctatgaagagattaagttatcaaaatatctggaaaagcag

SEQ ID NO: 13704 - DNA, 1026 bp, Homo sapiens
gtctatcatctatctcaccagactgcaagctccttgagggtagggcttggtctgttttgttcccagctgcatcctcagtacctacacattcatggcatgtggtcagtgctcaactaatgagtggactcctgtagacagttaataattacacttagctttatgctcaaagttccataattgatactatcagaaaatgtaagcaaatcgattttatctactgggaggatgtcaagatccttgtaatgatttgctttggttcattaggctacatttataaatctgcatcaaaaaggccttacttttaaatcaacatgttagaatatttgatataggaacctagatatcttatttctttgctcaaatgcaattgtgagtggagtagggtttgtccttaacctgcttataatatgtatgtcataacacagattaattttttttctcatttgtttgttcctgtttatctacgttttgttggtgggacacttcctctgacaacttgattctttctgatcctgtttccttctattttgtctccatatgtggcttattgaccccaaatgaagccattttctatagggaccaattgatcatccagtttgctgttaatctaatacatgagcagcatggtatgtgagtaactcagtctttgaggggttattttcatctgcctggcaggtatgcaggtacctagtggtgtttcactttatcagtcctgatgctcaggacactagtgaagctagctgtgtcatcacagtagtttaagctttatcgttatattgctttcattagcaaagcaaggaaaagtcgaatgcctattaattgtgccagatttatacggaactggtactgactttacataacaacaaacaatgttaaaaatagaaggttattcataatctctatttactgaagatcgacatgcccctgtttgtgtataaagaattgtagtgggctagcagaccattttagatagaaaggacttgtagtgataggatacataccacatttctagatattattaaaaat

SEQ ID NO: 13705 - DNA, 1096 bp, Homo sapiens
ctcagcctcccgagtagctgggactacaggtgcctgccacccccggctaattttttgtatttttttttttagcagagatggagtttcattgtgttagccagatggcgtattgtaattctttaatgagaattttataaacaggcacagtttgagatgcagagtttccaacagacttaacggagtttttttccttttaggtgtaaaaggaagagaatgtctcctggacctaattgccacaatgctggtactacagtttattcgcaccaggttggaaaaagagggaatagtgttcaaatcactgatgaaaatggatgacgcttctatttccaggtggctttaactatagtattatgcaacttatttatattttcaactatttatttaataaaccttagaaacagctatagggaattatcttacatgtgtacactataagtatgtagcaagagaatttgtttgcaggtgacagcttgcccatagtctcctgtggcgggcagggctgatgtatttgtgccttgggctgcacaggaaatgggctcaaagagtttcagtgcagctcccgctggaggctggcgcttctgggctctggatgtggtactcttcactgcagtctgctgatcctgggtgcctccagaagacccacaatgtgactgttgggcccagccctgttcccaacaatggcagggcctgggacaagaatacaatacaagtatttaaagtttataactttgtagtttataacaagtgtttaaaggttataaatcaaactagcaaactattagattaaatgtgttctaatctcctcccttggcaaatacaacttcataaccacctggaaggccaggttcaaattcggcccttggttgacccccagcaccctaagagggtttgcctgcaaacgtgaataccccaccccacccatcaaaatgccatccagaccccatgccagtgccccctcacaccagccaccttgtagcaccagtgagatggcaacactgttcaaactcaggatgacagaccagggaagaccctggaagtggactcagggccatgtggtcagggatgctggagttgcagggtctaaaaaggaggatat

SEQ ID NO: 13706 - DNA, 1073 bp, Homo sapiens
gtgttttgttcacagaaaaggtctggagggatataggccatagatcagataagacattctgtatggcttttattttcttctttgtgtctgtctacttgtgtctacttgtattttctaattttctcatagtgcacatgtgttgtttttagattttttttttttttttgagacagggtcttactctgttgcccaggctggagtgcagtggcaccatcatagttcaccgcagcctcgacctcctgggctctagagatcctcctacctcagactcccaagtagctgggattacaggagcgagccaccatgcctggcctgtttatagaaatttttgaaattattttcaaaattggttctaaattaatttaggttttaatacagtgtgatgataaattatttcatactaaatttgcaaatacgttggatcttaatacttccagatccaaacatatcagatgaaaaatattatccattagcttgatgacttgaaagtttatgttagctgcaataagttgtttgaacggaccatgtaatttagcaaaaatgtcaagcctctgttactcttcctcgatatctgttttaccaaaatgtggcacctgccgcattctacacggagtcattccactgaattcagtaacacgccagccgcaatagagcccggacatccaggtctgtttggtccttcccgactcgctgaagcttggggcatttccttatttgatacatcttcattgtgaaatgagaccctccagggagcgcaacaccttttctgctgggacgtgctcaggaaggacagcgctcagtgctgtgtgctcttgtcctcccacagccacgcctgggcttaggcgcagtgtcttctgcaccaaccccaaatccacttcgttccctcccgctcatgaaagcacattgagaacaagcgagaggcagagatttttaaaacatacctcctaatccaagtttttaaagtaaatcatttgtaaaattcagtgctataactcttagcaagaaattgagggcactgaagctgagggtccagagcccacgctgttccttaaatcaggggtccccaaccccca

SEQ ID NO: 13707 - DNA, 1058 bp, Homo sapiens
gaaagtttcttagtgggaaaactgcctgggggttccagctaaagggaatgaggaagaaagggatatatacaggttagaggtgatgagggaattttttcctcaggtttatggaaaatttacttttcgaatacctaatctggtccatttctattgaaattatagggttggagtgctatccttgaggaatgagagaaggacaaagaacaacaggcaaagcagtagttagactttcctgtacaaagtctactttagggtaacaaattgttgataagggaaggttttcttttttaggtaaattccagctaatacatggaaaaggaatgagaaaattagaaaatcacgagtttgctactcctcacgaaataaaggatcttttgagggaatgttttacattttattacaaaaaatttcaaagtaggcagttgggaggagaattagccatactttcgtcaggagaaaatcttaggtgataatcttgtgttggttttttaggtggaaaaggtttataagaatgggtgccgtgttatactgtttcccaatggaactcgaaaggaagtgagtgcagatgggaagaccatcactgtcactttctttaatggtgacgtgaagcaggtcatgccagaccaaagagtggtatgtttccagaggtgttctcctccatagtttaaccatctctggagaaaaggcagactgactgtgtgtctttacagatctactactatgcagctgcccagaccactcacacgacatacccggagggactggaagtcttacatttctcaagtggacaaataggtacaaacttgctccaccctctcattaaattcttcccttccttcaaaaaatatttactgtaacaactttttaaacagaaaaacattacccagatggaagaaaagaaatcacgtttcctgaccagactgttaaaaacttatttcctgatggacaagaagaaagcattttcccagatggtacaattgtcagagtacaacggtatggcaacattatgttcacagaaaaaccactcagtgtgacacctgttcatctgtgctcagaag

SEQ ID NO: 13708 - DNA, 1065 bp, Homo sapiens
ttgctgatgtgtggcagtttgggacctataaatcagtgatttcccatggtgtaatggaaccattcctgtctcacaggcacagcacagccgcctcacacgcccagcagcttgttggctgaccacctgcctccgctctcctccttcaggccattctcccgtaacatccagctctgttacactttttaacatggaggtcagattctggcacttgctcgagacccttccaagttgagtgtttacaatatgatccattggcacataggatgaaaatactggcacttcagtgtatttttagagagagattcacctcactttgttgttggtgggggcgtgtttattttgtaatgtatatgttgctggtacagtatgtgattggtgtgctggacatattacaaaaagtttataccatagccacaagggcatttatgttttaactaaatacccagttatttggtgaagccaaattccacaggtcttagatgcctcttttatctgcaccttacaccttgtgattgtctctgaaatacatttgggtctgtcaggctgtttcatcacctgtctcttccccaggattgtaaactctgagacaagatactgtctttcttggacatctaggacttaagtacctgtgtcggagaactacaaattagtaaagaaaaatattaagacatccttaactaatggataaaggacagcagttcacaggatatgaactaaggaaatgtgtgatcatactaataaaattttcaattaaatattaaatctaactcttgacaattttattctaataggcaatccacctcgaagatccaagtctgcacctcctcgtgatttaggcaatttggataagggacaagtaaatctctgtttttatatattcttcaaacatacattacttaggcttgaaatcaatttgttaatagacttaacgtttctaaaccacgtgtaaaaaagagtttttacttaacattataaatgttatattttgtaaacactagtcctagaaccctatatcagaatctggctttggaagtaagagtaggttttagctgcttgaaatgtgtt

SEQ ID NO: 13709 - DNA, 1130 bp, Homo sapiens
caagaaaaattatcttccaatgcaaggtaagaggctgcatgatctttttataaaacatttcagaatgtaaggaataaacaatttatacccaacttaataaaacatttcttaataaatgtttttgaacatttgaatgaatttgaattaataaatgtaattgaagctcctgtgcatcatcttattccgccagttaatttctaccctgataatggtccatgcttcggttttaaattattttaccttgttgcgttcataaattgttatactggtcgagcatcccaaatctgaaactttttgagggcaagcatgatgctcaaaggaaacattcattggagcattttgaatgtggattaaggatgctcaaccaataagtatttgcaaatattccaaaacttgaaaaaaaaatggagatctgcaatactgctcccaagcatttctgataagggacactcaccctgtagtattgtttcatattctgtgtgtccttctgcaatttttttctttcaatactgtatgacttaccaatcttaacacataaaacctccagttgattgattttaatagctatgtagattgcattgtatacttccacagttcagcattcctggtgatgggcaattaggtttgcatgataatgaatagggctgcagagcgtgtcttgatcctgtggcttctctaggatatatatgaagagtaagatgccaggccatgtcagctggaggttttccctttgctctgcaacatggttgtaccagttttttttactgtcagcagagtatgctcttcatacttgcaaacacttgatctggccagactttaacattttggccagttgatgtaaaatggtggttgattccgtgagctggtaaggccctgtgagcatgttttcttacatttagtcagcatttgaggttccccttttgtgaactgcctgttcatttcctttgtccatttaaaattttggatgtgtgtgtgtgtgtttctccttataaaatattccgcatagtaatcctttgtcagttacaagcactgctaatattttctcccaatctgggtttggcttttcagtttgtgttttttttaatgtatgtttttccttgtaatgttgaatttactagtcttttaaaata

SEQ ID NO: 13710 - DNA, 1013 bp, Homo sapiens
tattttagctgcatgaggacagcgtgggcccagaggctttcaggacatggcaagcactgggggtcgaggacccgtagggccatgtcagctgtgagcgtggtcaggggtggggaattaacagaataagctgcaaagacaggagcgtaatgagaaagtagcattcttctccccgccgctcccaacctttttagtatgaaagcttcccaaaatagagaataggtgaaagaatagtacaattaacacctggatatccacttggattcaaccactaggaacattttgccatagttatgtctatgtttcactgaaccatttgaaggtacttgtaggaatcatggcaattcacccctaaatgctttagcattttattaaattgcattaacttttgaagagaccaggctgattgctttgtagaatgccctaccttctggatctttgtaagtagaatgctttgaaattaataattttgtggttattgataattgcagatgttgatagtattgataatgacaagttctagggttgaccattggggtgtggagctgaggtaggacaccaagaaggatggcactggaagcatcacctcctggcagggacggacatggcgggggctggggcaagtagtattggggcttgatttggccagaaatggaggtggggtgcagagaggactcaccccacctcatcctcatggggagtgctcagtggtggtctcggagaactgggctcagctggactgtcccagtgggagtgggagtggggagcacccaggagaggctttgttctcgaacaccatgagctgaagggcctgtgtgctcctcctctgctctgtaatggtcagaggagatggttcaggtaaccttgcctactgtgtcctaacttgaatgaatgtttgtcaaaaggggcgcgcgtgcgtgtgtgtgcacacgcgcagtgattcctagataacagcttgtttgctttggcctgttgtataaatgaaaacaatatgaataaacaaaacccacagcatt

SEQ ID NO: 13711 - DNA, 1169 bp, Homo sapiens
ttttttccccttcctgtccctggccagtcctcctgccatttacttgtcatctgcgctggtcccttgtagtgctggcactgtgccaggcaccctcctgttgcttcccacacgcgctgcctcccccagctctgttcagtgacacccagcacgtgtcatcctgcctccccacacagccccgccaccttacctgccctggccactctcccgtcaccccctcacctgccccagccactctcccatcaccctcccactgtccccggcagagtgagcctcatgagatggagctttgttcttagtataataagggcctgtgacagtgcctgataacagatattttgtaaatattaattgctcttgaattctgaacccatttagacttgtattttaccattttcatattaaatccatattcctgcatgataaaagtgcttaccagaaatttttcttttattggtcataatccgtctcacaaatgggaaacctgatattcatggaggttgtggatcttaccttgttttaagcattcaagtcagaaaactcggatgtgaaccttgatgtcacccaatccaaagtccacaccctctgtggtggggcccagatgtcctctccatcctcaccaggctgccgtgtggctgccgcagggattactgaggtgcaggggcatgggccgggccgcacctgctgcctcaccactgatgggcttcggtgccctgctccttcctcgactctaggtcagtcgctatcacttgcagctgcacgtgatctcgaattgcttctagacatttccagcatattcttcccttattttagtctttctaaaacaactcatttttctggaaatttatttcttctcatgaatttcagatagttttcagggcaggtagttttgactttggaatcttttattctttagctctagtcttccttcagttattcatgagttcctattgcatttcttctttttgggatctcccccctggatccctttcagttaatagctcaggtgaggtctttcctacctcttggcagttttctgctgtcagctcccatgtgctgtctgccttcctttctcctggcttctggaattagttttgctgatggtctgcggtgagactctgatcccctcctcccgccgctgaaaaccacgacattcgtcttaaatgtcgtct

SEQ ID NO: 13712 - DNA, 1031 bp, Homo sapiens
actcagacacaggtatgcagtgtttaagagcagctagaggactgctgggcactagtggctgaagagtgagtagtcttgaacagctggagctgcctgtttttattcagtacagacataatgctgaaagcctggagaaaacacaatctgcaggtaattaacattattgttcccccttcagggaaggggtcacgtgtgtgaatgatcaacggtcagctcctggtcaacataagtaaacaagcctgttgttagtattcgatttaaccttctgaggtcttactgactgggatgttagtatatatccaagatatttccaaggagaggacatctgtaccttttcaggtgctatgattaagcctgttaactgtgtattctttttgacagaggcatataaattcaaaagtattggctccgttggggctgccagtaagatgtcatccatataatggattatcttgcaattaggaaattcttttctactggggagcaaagccttatttacacgatactgacacatggtaggactgttcagcattccttggggaagtactttccagtgaaatcagggagctgggccttcattattgatagctggtattgtaaacgtaaatttttctctgtcctgttttgcaaggagaatagtatgaaagcagtcttttaagtcaataatgactcaaaactcgaggaatcactgcggggggaagggagcccctgtggaaggggccccataggttgcaaattagcattgatagcctgtaagtcatgcagaactctccatttaccagactttatgggaatgacaaaaaatgggtgaattccaagggctgtctgctggttctatatggctggcttttaattgttcctcaattaattcatgggtttgttgtaatttctctccctttaaaggtcaccgttctacccaaattggatcttgagacagccatgtcaggggtaggggaggacttacaacagtggccactattagaaagggctctgcatagtgacccccccattgggctaataaggtcccattc

SEQ ID NO: 13713 - DNA, 1063 bp, Homo sapiens
cccactccccttaaaatgtaagtaaatatcttcaggaatttttaaaattattttttccagaattatattttcaggattttggattttagggatttttgatctttcagaattttaagagctgggattgtgtctttcaagactgcttcttcagggactatgacgggcttccctctagacagcatgggctaggaagcatgttctggaatgtgacatttaagctgagaactgaattgtacaaaaaacctagccacgccaattaccctaagtgaattaatgcaaaaatagaaatccaaataccacatgttttcacttataagtgggaggcaagcattgggtgcacagggacataaagatgggaaaatagacactggggattccaaaaggcaggaggaagggagagggttgaaaacttacctattgggcactgtgttcactatctgggtgatgggatcagttgaagcccaaacctcactgtcatgcaataaatccttgtaacaaaccactcacgtagctcctgaatccaaaagaaaaaaaaaaccaaaaaacaatattaacttttacccgaaaaccacctagccacagaaaccagggggcagtggtggagaggaggccccaggaggattctaggtgaggtggctggacatgcagaagccctgctggggaaggaagaggttttgtgtttaggaagtgaaagcccaggtagctgagctgtggcgagccgggaagaatgaagggatgagacagcagagacacaggcttcggttctgggggtcctgctgctgccccacctcctcaatggtcctcctggcccctctctgctaagcaggaagcaatggcatctttttttttttttctttttttgagacggagtctggctctgtcgcccaggctggaatgcagtggcgcaatctcggctcactgcaagctccgcctcctgggttcacaccattctcctgcctcagcctcccgagtagctgggactacaggcgcccgccaccacgcccggctaattttttgtatttttagtagagacggggtttcaccgtgttggccaggatggtct

SEQ ID NO: 13714 - DNA, 1094 bp, Homo sapiens
aacaccatgtggaagctgccaaggcttgaggtttgcaccttctgaagccatgtcccaagttctacgttggcccctttcagccatggctggggcagctggaatgcagggcgccgagtccctaggctgcacacagcataggaaccatggacctggctcacgaaaccactttttcctcctaggcctccaggcttatgatgggagtggcagctgtgaagacctctgacatgtcctggagacattttccccattgtcttggggattaacattcggctcattgtcacttatgcaaatttctgcagctggcttgaatttctcctccgaaaatggcattttcttttctactgcatcatcaggctgcaaattttttgaacttttatgctctgcttctgttataaaactgaatgtctttaacagcacccaaagtcattcaggagaagattgtttaagcagacatgaactaaataaacagtaatacgtgggaaagcaagatctcatccatgagaggcagtaaaaggaatgaaacaaataagtaaagaaaagcaagcagaaccagattctttagagatttttaggtagcagaattatcaggtacacaaaataacagtggtttatactgaacatgatagtataacatgtttaaaggaataaaagatgatattgaatgtatgaataaagaaaaaaagactatttttaaagaccttagtagatttggaaaaggaacaaataagtcttagaaatcaaaatacaatactatattaaaaagtctcaggggttagggttaaaaaaggggacaatggagacacatgatcaaaggcagacttaatatactataaagtagatatgagaaaatactcctgacacaacatagaaagatgaagaattggaaaatatgaagaagtgcttcagaaacacaaattacagggttggtggctctagcctatatcaaatcatatagtttcaaagtgagagaataagacagttttcaaagaaataatggccaaaatttttccagaacaaatggaaaatgtgactcttaaaattcagggactgtaataagtcccagggatgataaataaaaagaaacccatacttaa

SEQ ID NO: 13715 - DNA, 1033 bp, Homo sapiens
agagaatgtagagtttatataaacacaaagtatgcattgaagatctgtttctaccaataaacattaaaacaaagactgtatgtgaactatgtttttctgttgttccactgtggtttattcaccctccactaatatttcatactagatgccaggcagtgttatgggatagagtatttcccagacgacagacaaaagtccctggcttcatggaaaagacatatttgctcttagaaactgaatatcaattgataaagtgaattattattcttactttcatatttgcttattaatatatgacaggattttcttgtggtgatactgtttgggcaaaatcacaagaacagtacttaggccagattctgtgagatttagaaatatctccacatttaattttcctttctgactggtgactatgttcaattcattaggttagatgcatgcccaggaatgttaaggagtgcatttacatggagtaaaaggttttcataaaagttgtgactttgtttggagtaaattatttatgtaggtcagtttgaggatctaagactgggaaggttgatttcaatcagatttgaaggcttttcatagcaaactaaggactttttatcttaccttatagagatgttagatgtctcttgattttagtggcatagggtaggatcatttttcatggcccaggaggatgggtctactacagcatatagaacacaatggaatggagagagatgggaagcaaagaaaccaataagagaactattgtgataaaagacatcattatttttattaccagttgtcatcacttatctaccctagaatggtggcaatgaaactgaaaggaaagagaagggtgtaaaaatgttggtttttaaaaaaagacgttgtttggtctctagttcagtatgaagaggtggaagagagaatcacctaggtggaggagggagaggtagcacaaattagttacaaggtatgccaatttaaacatcttgaacatagcttaattcatacatctcacttattttagtgttaaaatttg

SEQ ID NO: 13716 - DNA, 1029 bp, Homo sapiens
ccagatcctgaaacataaatgaggacttctggatcaacttttccagatcgtcaacatggtcaaaaatgagataatcactatggtattcaggcatgagcattgtgtggtaaacccaaatccagtctgacttaatggctttaggcaaagaagtaagtgccaattgtgttgtatttcctagaagctgtttttcattttatatgtaagcttctcactgcaagatttggcaaatacagtatttgggtaggggacaacatttaaaaattaagaaaaactgcaagttaaaaatacaaagccaaatgtggtccatgacttaacaccttgaatgttgtttatattgtttgaacagaaagccaggaatctcaggatgaatcagtctagatcgagatcagatggtggcagtgaagaaaccttacctcaagaccataatcatcatgaaaatgagagaagatggcagcaagagcgtctccacagagaagaggcctattatcagtttattaatgaactcaatgatgaagattatcggcttatgagagaccataatcttttaggcacccctggtaagagatgggtaaaagaggaaacacccttttttcatcatttagatggaaggatttcaagataaggagaattggtattctttttccttgcttctctttatgaaaatatagtatattgtttttgtgagtttaagaactttttagtataataaagtagaaaatcactggcttctgtattttataaggtgaaaataggggacatggagcactattatacaaatgccaaactaagaaacaggttaatgtacataatggtgttaagtatttacatatatggtcctatttgtaatttttatacaaataaaatatgacttaaaacccaatttgaactcatttggggtattataatttatttattcagctgaattaatagctccccccaaagcccaatgtgttccataaagtttttacaaatgaactaatggaaatttgtatgtttatatattgtgtgtttgtatattgatgacccata

SEQ ID NO: 13717 - DNA, 1045 bp, Homo sapiens
gaacctgggaggcggaggttgcagtgagccaagatcgcaccactgcactccagcctgggcgacagagctagacttcgtctcaaaaaaaaaaaaaaaaaaaaagatagaaaccaagcacaggtgggtagatatttgaaaataaaacagaattatccgtgagccttctattgtggttaaaagaaaaaaaatgtcagcttccttgaaaaagagtgtcacgttcagggcagatatttaaaataagaaggccattaattcattgattcattgaataaatatttattgggcacctaatttgtgctcagcattattgcaggcaataaggaagggaatgagacacctgccctcatggaactgacctactggggcaaatgatgaatttactaggtggcgtggtaggtatgaagggaatgaacaaggccacgtgctaggatggccatgctggggaggcctgctatagactgggtgaccagggaaggcctctctgaagaggcaacccttgggtgggacttgcagaatgagaaagcgtgagcgtgcaggagctaggcggggattgtcctgggcacaggggtgcaagtgcacaagccctgaagtgggaatgagttggaggtggagaagtcctgaagtgggaatgagttggaggtggagaagtcctgaagtgggaatgagttggaggtggagaagtcctgaagtgggaatgagttggaggtggagaagtcctgaagtgggaatgagttggaggtggagaatgaggcgggggctgcttcagtgggaatcccaaacacgagtcgctttacttctatgacttcaacatcgcgagttttttgttgaatgcaaaattgaatagtcattgggtttgttttttaagtgacttaaaaattattacatctgttttgtgtgcacctcacagaaaatttgatgaaaggagtgaaagaggaaatcaaacagctagccagttgttccaatgtcattcatcaaataaaacctctcccccactggtgtgaaatgctatctctgtcatgtactgaaatcccatatgatttgtaac

SEQ ID NO: 13718 - DNA, 1027 bp, Homo sapiens
aggctgcagtagcacaatcacagtggctcactacaatctcaaatttctggactcaagtgctcctcctgcctcaacctctcaagtacctgggattataggccaccacacctagctaatttttaaatattttgtagaggtggggctgtcactatgttacccaggctgctctcacctcctgggctcaagcaatcctcccacttcggcctcccaaagtgctgggattacaggtgtgagcctcctcacctggcctaatttttcttttgttgtctttacttttggtatatctaagaaagcatcaccaaatccaatgtcatgaaacttttgccctgtgttttcttctaagagtattattttagctcttacatttaggtctttgatccattttgagttaattttagtatgtgatgtaagggtcaacttcattcttttgcatgtagctacccagtgttcccagcaccacttactgaaaagactgtccttttcccactgaacgaggtgccaaaatcagttggccatgtatgctagggtttattttaggactctcttttgtcccatttgtctgtatatctgagcttagccagtaccacactgttttgattaatgtagctttgtagtaagttttgaagtaaggaagtatgagtcttccaactttgttctttttcaagatcgttttggctacttaaggcccctcagagtttcatgtgaaccttaggtttttctgtttatgcaaaaattgtcgatgggattttcaaagattaaattgacttaacaattttaagtctaatctatgaacactgatgtctttccatttatttaggtttttaagttctttgaccaaccttttgttgtttttatcatacaggtctttttaagtattttattattgatctattataaatgggattattttcttaatttcctcttaggattgttcattgtgtatagaaatgcaactgatgcttgttggttttgtgtcctgcaactttgctgaattattagctttattagtttttttttggtgtggaat

SEQ ID NO: 13719 - DNA, 1007 bp, Homo sapiens
caattttgaaagaagttctgtggataaaatgctgtcaaacagcatcacatgctacagagaaatctgtgaaaggaaaagccagttgatgtggcagacattcttgtcttattttgagaaattgcctcagcctggatcttgcagtgagccaagatcgcgccactgcactccagcctgggcgacagagcaagactccgtctcaaaaaaaaaaaaaaaaaaaaaattgcctcagccaccccgaccttcagcaaccaccatcctgatcagtcagcagtcatcatccttgaggcaagaccctccaccagcagaaagattatgattcactgaaggctcagatgatcattttttaagcaataaactatttttaaattaagatatggacttttttcagacataatgctgttacataatacactacagtatagtataagcataacctttatatgcactgggaaaccaaaaatgtgtatgacttgctttattgcggtcttcactttattgcggtcctcactttattgcggtggcctggaactgaacttgctgcgtgtccaagatatgcctgtatttctgtcactactctgtgggatccaatgattagtgacagtacgctgggagctaagctccttgccttctcatctttcctctctcaagtctctttactctccctttattccgtgtgtgcctgaccccacttctgggaccagtcctgttcttaccaggtattgaagaagatccatgcatggccaggtgactcagcatcacattgtcatggccacagtccatctctgagtatctgccctagatttaatgattgaatggcttcctgtttgtgagatgaaggccctaccttttgcttcattttcctaactagatccatatcttattcccctgtagccagttccagtaatggtaacttgtgtagtatcatgtcaaaatcatatcagcaatagggatttgctttgctgtagtcagcatctgcaaccacctgttggcacacacacccccatgca

SEQ ID NO: 13720 - DNA, 1049 bp, Homo sapiens
aaatccccttgcaattagtaggcagtctgtggggagacacaaatacctccctcctcatcaaaatctcacccaagatttagcatgcatttatgattttgcctgatctcatctttactgtgacagttgtgctgctagtttttaataacattggaaaatagggtccacaagcaagaaagctaagagtcctgtaaagtctccatagttttgccttttccagaatattgtgtagttgaaatcatatagtatgcagcctgtttggattagcttcttccacttagcaatatgcatttaaggttcttccatgtctttttaaggcttgataacttatttcctttatttttggctgagcaacatttccactgtaaggatgtgctgcagtttttaaagttcattcacttactgaaggacgtcttggttgcttccaagttttgccaattatgaataaagctgctataaacatttgtgtgcaggtttttgtgtggatgtgagtttttacttcctttgtgtaaatatcaaggagcaggatcactggattgtatggtaagagtatacttagtttgataagaaaccaacattctgtcttccacagtggctgtacgatttttccttcttaccagcagtgaatgagagttcttgtttctccacatccttgctgacatttggtgttgtcagttggattttggccattctaataagtgtgtagtgttatctcatgttaatttgcaaggccctaatgacatatgatgttgatcatctttttgtctgcttatttatcatctatatctctttagtgatgtgtccagatcttttgtccattttttaatcaggctgtttttctttgagtattgtcgaattttaagtgggttttttttttcgggtataattttggctactagttcataatcaggtgggtctttggcaaatattttctcccagtccgtgacttgtttttcattcttttaacactgtttttggcagagtggaagttttttttttttgagatggagtttcgctctcgttgcccaggctggagcgcagtggctcaccgc

SEQ ID NO: 13721 - DNA, 1049 bp, Homo sapiens
acaggggccacagctccaactattaaaggttggtgaacattgtgaattatgctcagaaataaaactgtggtcagagtagatgcagcagagctagtagagtggttaattccatgcagcaggctggagtgtggtggtgccatcacagctcactgcagccttcacctcctgggctcaggcaatcctgccttagcctcccgagtagctgggaccacaggcacacaccaccatgcctgtctaatttttaaaaaatttatttgtagagatgggatcttgctatattgctcaagtttgttttttttttttttttaaaaatggagaggaggaaaatacccacagattaacctagcagaaaattaaacagagtagttgctcttagtgctttaatgacaacctgttttctgttactttcagttgcagatatttttgtctcagaagaatattgtcacagataatggctcttatggcagcttactcttaattacctgtcactataatttgtataatacatagaatgaggatttcctctcagcttatctcctgtagatacaatgctattcctgatattattggaagtagagaggagaaatactagtgtagcttgaggacctttggatggggaaaggagcctttggaagctttcttttgctgtaaagtatcccacttacaggccagctgttagatagtcagcaaaattcttagataacaagttgttttaacctgataaattgccttttttccttttatattgtagctggttagtacttattttagtagagctgatagagagtgatttaaaccacaatttagtgtatctttcttacttgtaatatagtctgtgcatttttttgaatagcttttttttcattgttttattgtatggttctttattaattttctaatacaggtaggcctcaacacacaagtagcctggcctcagtaagtccatttgtgagggtactgtgaaatatgcttttcctgtcttctaaggttttaggttgtttgttttaaaaataacaaaaaaagaaatgtgctttcccttcagaatcttt

SEQ ID NO: 13722 - DNA, 1039 bp, Homo sapiens
tttaattttctgaatagttttagccatgaaaatcttagttcatgtaaagccttacttgaaaacccaacagataaatttggaactgggagttttgaaaatcactgaggattctgaccccttttattttgcaagtgaagattcttaaatccagaagggttaaacgatgatgatctacagctctttccaccttactcctcttggcctgctgtcctcagacttctgaattggattatggttctgctttgttgttaggccgtgtgggggagtacagtgatgatacctctgggggccgcttcatggaattggctcttgtctgccaaactaaggagagtatctatttttttgtattatagctgtcttgttttgtcttctgatttttctcttgtcatttcttagcttttgcacggagcagaaaagatgtattactgtgactagtttattttctttttgtttgaagggaagggtaagaagaggaccaacatttattggacacctgcttgtgtgccaggcgccaccagctgccttagaaaagttaaaattctgttatagtcaccctataaagtagttgctaacatttttctttaacagttgggaaactgaggcagagagagacaatacctgacccatagttgaaactactgtgaggacaagggagtgggagaagagcttactaagcaggcatgaaagtatgtggtacatatggtgacaggtggacatgtggggtggttagaatacaaggcgagtggcatgtgattcggctaacagtagagagataaccttcacctgttaccttgttcttagtgtgtcttaaaggccagaaatgccttcctaaggtgtatggactggtattttattgttctagatgggtaagtatttgaggttgtattttggttgatggcaccttttcttctgttttggtcgggggaaaggattatactcatttgaataagccagtatcagtttgaatttttacaacaggtggtaaaaacctgggtttgttggttattttcaacatatgtcagggacttctgtgacaaag

SEQ ID NO: 13723 - DNA, 1041 bp, Homo sapiens
gacgtttctgaagttcagtaatactctaattttagtgtgtcattttggttggagaatcattgtcagctgacttggacataattgtcaactctaatctcttgttagagcaaatgaatattttgcaatttgaaaaactggaattttaagttaaaatctttgaatttattatatctaaaattgctttatatatgaagaaagaatagcattaatcaaatttctgctctgtttaggatttgaagtgctgacttacagagaagacttcagttttgttacttataaaattaggatagtatcttctaaggttattttgagggtacatgatgtatataaagttcctagtagagtccttggcctaacctaggcacttaataaatggtacctagactattacactattgttattgtgccctatagtgtctgtaggcatagaagcatgaaaaaatacttctttgcttaatattccttattgatgtagatttaagatttcatattctaaaagttttgactgtgtgttttcataactgtgctgaattgaaaatgaaaatttcacataaatgtaaacttcaatgagttttcagacaaactacacgtgtactatgcaactagctccaatattaagaaatagaacgtcatcagtacttctgaaaccactgtttcgctccctccagtcactacacaacatctttgctttcaggggacattgcatgagttttatgtctttttgtttattctgccctactcaaaacacgtagggaaaaaaaactattttggggattagaattgcattagatgagaaacttgaaatgagctttgtcaatagctttttatgttgcatagtgtaatttttaatgtaagtacaatagaaatgtattttgcaggtagggagtgcagttttaatttttattttactctgttagagggtaattagtagaacctttttgagaaacaagtatgttagaacatcttttttactatcacttgtttattgtctgtgaacaacaaaggcagaaactctgtttccctttctgtaaggataagtca

SEQ ID NO: 13724 - DNA, 1106 bp, Homo sapiens
aagttaacaagagggaattttcttgtctttttcctaatcttagaggaaaagcatccagtgttttcgctattaagtaagatattagctgtgagttttttatagatgcgttttgtcagattgaggagctcttttcctcttttattttattaattccgtaaatcaatcttttcttttgttaagacagggtattgctctgttgcccaggctgaagtgcagtgctgtgatcttgtcttaccacacccctgccttctgggtgaaagtgattcttccatttcagtcccctgagtaggtgggactacaggcgtgtgccaccacgcctggctaatgttttgtatttttggtggagatgggttctcaccatgttgcccaggctggtcttgaactcctgagctcaaatgatccgcccctcagtgtcccaaagcattgggattacagacatgagccattgtatctggcccataaatacaatttttattgtattcagagaggaattcttttctatgtttttatcatgacaaggtgttggatttttgtcacctgatttttgtgtgtgtgtgtgtgtgtattaagatgattctgtgattctggttttttaattcaattgatatgctattttatgttagcccatttcaacctacctcttttgtgctgttattattatttatattatatatatatatataattttttttttttgagtctctgtcaccctggctggagtgcagtggtgtgatctgggctcactgcaacctccgcctcccgggttcaagcaattctcctgcctcagcctcctgagtagctgggattacaggcgcctgccaccacacctggctagtttttgtatctttagtagagacggggtttcgctatgttggtcaggctggtctcgaactcctgacctcgtgatctgcccgcctcggcctcccaaagtgctggcattacaggcgtgagtcaccatgcctggcctataatatatatatatagttttatacagttgctttttaaatcaattaagagaagaaagaaaaaatacacatttatagtgtcctttataattaacaattgctgttacaggtactcttgtatgttttttcatgtggacttta

SEQ ID NO: 13725 - DNA, 1047 bp, Homo sapiens
ttctttttctcctccttctttcctttccctcccccttccagccctaggcaaccactgatttactttatgtgtttatataattatctgctttggactttggtatgtggaatcatagagtatatggtctttgggactggctgcttttactttgcgtgttttcaaggttcatttatgttgtaacatgtatcagtactgcattgcttttaatggacaaatattgttccattgtgtggatatactacattttgtttatttgttcgttgatggacatttgggccatttctaccttatgggtattatgaataatactattgtaaacattgggggtgcaagctttttatggacatatgttttgttttctcatgtgtctgtactttggagtggaattgtggtttaatcttttgaggatctaccagactgttttccagagatggaccattttatgttcctgccaacagtgtatggctgttcccatttctctgcatccccattggtacttgttatctgactttctgactgtagccattccattttgggtgtgaggtggtatctcatttcattgtggttttgatttgcatttctctgatgagtaatgatgttgagcacctctttaggtacttattggccatttgtgtatcttctgtggaaaaatatctattcgcattctttggctgttctttgagttgtcttttaattgttgtgagttttttgttgttttgtttttgttttttcaagacaggatcttgctgtgttactcaggctggagtgtagtgacatgatcatcccttgcaactcctggtctcaagtcatcctcccacctcagcctctggagtagctaggagtacaggtgcatgcctctatgcctggctaattttttactttttgtagagatgggttcttgctgtgttttgcccaggctggtcttgaactcctggccctcgggatcctcttgcctagtcctccgaaagcactgggattacaggcattagccaccctgcctggccctggtgtaagagttctttgtatattctggatacaagtttcttg

SEQ ID NO: 13726 - DNA, 1056 bp, Homo sapiens
ctctgtcgcccaggctggagtgcagtggtgtgatttcggctcactgcaacctccacctcccaggttcaagcaattcttcctgccttagcctcctgagtacctgggattacaggtgcctgccaccatgcccagctaatttttgtattttgtttagtagagatggggtttcaccatgttggccaggctggtctcaaacttctgacctcaggtgatccgcctgtcttggcttcccaaagtgctgggattacaggcgtgagccactgcccccccagcctctttctttcttaatactcataaatatccaatcattgttgaaattacctgattgtctcaaatgattatagttggatccataatgatcatcgttgcgtttcgtcactatatctcttaaatgtggatccctgtttcttttttattatagtttatcttttgaggaaatcagattgtcacatagcttttttcattttctgtactttgctgattgcatcccctttgtgatgtttaacatgttcttccatcctttgtgttttctgtaatctggtagattaagaggcctgaaccagattccttgattttttttttttttttccttgcaggagttgaggtacaagtggtggtggaaaaacttaggtgatgtgtacttctggtttgcagtggaatgtcgtgtctctttataatgatgaggctggcattgtcagaatgactcttctgttacggagctgctggcagctttttacctcatggtttttagcaactgttgataatcattgcctagatccagtgtttcattagggcttcagaatacagttttaactgcttctataggttttttttaagaaatatttttaaaaacattgaaagagaatgtacatctatgttatatttgaagctacatagaaataaactttttacattttcagaatattttcatagttgtattccgaaagtcatacatttaggcaggctaaagtttacaaattaagttgaaccttttccgcatctagacttaattttgtgatattacaagtgaatgagcacatgaagttctaacagatt

SEQ ID NO: 13727 - DNA, 1032 bp, Homo sapiens
tttgtagggataaagagtgctttttctaaagtattttgaggaaggattcatggagacctacattatatcgtgctgcatgtaggttctgagaacatgaagacgactgtgataaactctggtcttatggaacttcccattcagtgtgtcttgagtgggttatagttgtgctgaggaagtagtcctcttgacccctgggaagcctggaggtatctgggttgataggagacccttagccagtccctttctggtgagagcagacatacctgtcttacctgtagcttcttttcttttttttttttctttttttttttttttttaagacaggtcttgctctattgctcaggctgtctcctacatttaaaccatcctcctgccttggcctcccaaggtgctgggatgacaggtgtgagccactgcacctggctatgtctgtattcttgtgggctttacatatactattttctctgtgtgtcctgatgagaagattgaaaaccagctctacttacagtattgtagaagaggatggacgtataaaacaaatgcatgcaatgagatgtttttcttattggtataagtaatggtaattatatgtgaaagagaaggtggttttgggagagagaagagggcttcaggaaaaagcttcttagaagagagttgaactttgcaaaatgaatggcctttattatgtggacatggagggatgggataccagatgtaaatagataatgtgttactcttaggctctgtaggtggtttggcgtgaaagcgggtcttgtgaacagtaaggctggagagtaggaagggggcatatttaaagaagtaccaggagtttaccaagtattgattcacattaaaatgattattaaagtgtgtgtttagcctgaggaaatgtaagtccagaggacagtcatgaggatataagaaacaatggagttggtaaaaatatgctggtaaattgaattacattgatttttcaaaatttgcttgtattttttttaagaagagaaaatgacaacaaaacaagatggatgg

SEQ ID NO: 13728 - DNA, 1071 bp, Homo sapiens
ttgctcttacatagctccatccctcctttatgttgctattgctgcaaactacatcttcatgcatcgtgtgctgattaacatatatttataactattgtttatgcacttgtcttttaaatcatataaaaaacaaggagttataaagcaaaaatatagtaatactgttttttgtagttataatacctttacctatgtagttgtaatacctttactgaagttctttcttcacatggccgcaagttactgtatattgcctttcatgtcagcctgaaggactccttttagcatttcctgtagggctggtctactagtgacaaatttctccagtttttgttaatctgggagtgtcttaatttctacttcattactgaatatagttttgccagataaaattttttggccaggcttgctggctcatgcttgtaatcccagcactttgggaggctgaggggggaggattgttttgagctcaggagttcaagaccaacctgggcaacatgacaaaatcccaactctacaaaaaatacaaaaattagcccggcattggtggcttgtgcctgtagtccctgctactcacgaggctgaggctggagagtcacttgagccttggaagcggaggttgcagtgagttgaaatcatgccactgcactccagtctatactcccctgtctcaaaagaaagaatttttttttttggttgacattttttctctttcagtactttaaatgtgtcatccactaactgtggctttcatagtttctaatgaggaatcaattgttaattttatttagaatttcttgtaaataatgagttgcctctctcttgctgctttcaagatgctctctttggcttttgacagcttggttataatgcgtctctgtctggttctctatacttgaaatttgttgagcttcttgggtgtgaagagtcatgtctttcattacatttgagaagttttggccattaattcttcaaatattgtctctgcccctttctctttctcctcctcttttaaaactctctctctttttttttttttgtttttgtttttgatacaaagtgtcactctgt

SEQ ID NO: 13729 - DNA, 1032 bp, Homo sapiens
tcaacaataataaatgaagacttcaatactctgctttctctctctctctctttttttttttttttttttttttgagtcagagtctcactctgtcacccaggctggagttcagtggcatgatctcggctccctgcaacttctgcctcccaggttcaagagagtctactgcctcaacctccagagtagctgggattacaggtgggcaccaccatgctcggataatttttgtattttgaatagagatggtgcttcaccatgttggctaggctgatcttgaactcctgacctcaggtgatccacttgccccggcctcccaaagtgctaggattataggcgtgagccaccgtgtaggccattccactctctataatagataaaacccagacaaaaaattaagaatgtagaacacttgaactgtattatcaaataactggcccaactaacgcctatagaacattttaacaatagcagactagacatcttcttaagtgcatatggtacattctccaggatagaccatatacttggccataaaacaagtctcaaaaaatttaaaagacttaaaaccatacaaagtattttatcaggccacaaacaaacataagaaatattttggaaaatacaaatatatgagaattaaatgatgcactgtgttaccaattgattaaaaaagaagaaataatagaaattagaaaattatttgagatgaatgaaaattaaatacaagagcctggtatggtgactcatacctgtaatcccagcactttgggaagctgagacagtaggaccacttgagcccaagagttcaaggccaacctagaaacatagaccccatctaaaaaaaaattagtctagcatggtagcacatgcccattgtcctagctacttgggaggctgaggtgggcagttcacttgagcctgaaagggcaagattgcagtgagccatggtcatgccactgcactccagcctgggcaacagagtgataactgtctcaagaaagaaaagggaaaaaaaggtatcgaaatttctgg

SEQ ID NO: 13730 - DNA, 1041 bp, Homo sapiens
gatctccgcaaagcactggactctgttggccagctcttcctccatgaaacactacccttcctcaccactccacagtctgatttgctgattttccctcctctccctgtcctataaagactacatttccctgggtcttggagctaggcccctgctcttctctttctgtactgccttcctggttaattccatttactcctataattttaaatttcatctctgtgttgcttactaccagattgatttatgtgattccagcctttcctcaagattgctattcaacttgatatctattcttggatactctttagcatctcaacatgtccaaatcttttatttttcttttctttttttttaactgctccttgtggagcagggctatcccataggcagcgtgcctagagtagccaaaattaattgtatgtgggtactctactgtttaacatccccactacagttccccagttaatttgcttaccttctgtcaacttaaaaaaaaaatcaagcttttacataattagttttatttagaagtctcactgaggactatagaccaacgtttatacccttggtataaccttatgggatgtgttgtaagtttttatgggatgtttttaagttttagatatactttttttttttttcttttggagacagggtcttgctctcttgcccaggctggagtgcaggaacatgatcatggctcactgcagcctcaacctcctgggctcaagccatcctcctgcctcagccactgatgtagctggcatcacaggcatgcaccaccacacctggctaatttgtaaaaattcttttgtagatatggagtctccttttgttgcccaggctggccttgaactcctgagctcaggcaatcctcccacattggcatcccaaagagctgggattgcaggcgtgaacccctatgcctagctcataaaactttttattttctgccagatgcagtggctcacacctgtaatcccagcagtttgggaggccggggcaggcagagtgcttgagcacaggagttcgagaccagtc

SEQ ID NO: 13731 - DNA, 1046 bp, Homo sapiens
ggaggtagaggttagagtaagccaagattgtgccactgcactccagcctgcacaacaagaggtagaatccatctcaaaataaacaaataaacaaataaagattttgggaaatttgaaaaattaacaaactccaggaggaaggcagaaagccactcaactacccgatgattttgcctcattttctctcttcaaggagagaatagactcaaacaggcaaggacggaaggaacacggcagggcggagcaggagagagtgcgcatcccctgttcttgccaggtgtgtcccatcacactcagtcagggcagtcagaatcccggaagtgaaggggcatgggggatgcactgggacctggaagaggtggttgctgaccagttttctgcactccctgcactgtcatttagcatccctgccacttaactatgtcaaagcttaggagggatgacaagcaaatagggggtcatcaggagaccaggccgggcaaactcacctcagtccttttctgaaggggaagtcagcaggacctgtagacaaaataaatccaagaatcgtagaaaatggcaccttagactcatgcacagatgggaacccagggctcactgaaatgaggcaaagtgctctggtcacagctggcgagtggcagaacttgaacttgaacttcagttccttactgctttagtccaggggcaagaagagagttgtcatttgatgtgtgctttacatgctaggcactttgtccattttctcaaccaatccccacagcagaggcaccattatccccatattccagataagagaattgagactcaaagaggatagaaaatttgccccatgtccaccgatagaaagtggggagatgggtgacaaatgccatctcttcctactgtatcatgccctcccatttttaaacctaagcatgttcaatgtcttttaggatttctttgtgagaaagatggagaaaggtgaacttgatgatgctgtataaaaggacacacactgtctgcgagtcaggaatacagatgttctctctacagactgctctcttccg

SEQ ID NO: 13732 - DNA, 1026 bp, Homo sapiens
aggcctggctaatttttatattttcagtagagacagttttgccatgtgggccaggctggtctcgaactgctggcctcaggtgatccacctgcctcagcctcccaaggcactgggattacagaggtgagctaccaggcctggcctctttttcttttctaatatggttactaggaaaaaaaaaatttgtaactgaaagaaagaaagttgtctcctagttttctggtaagttaagttcaaaccaaggcctctgtggtcagactcctaattggattgtccagatggctccatggtgccatttaccctcccttgctccagcagcctcctcagagcacacacttacagtatttcctccaactgtaaagctttttcttctctgctggttcacgttgttcccatatctggagtgagggcttaagtgacgctccatgtgtctcactctcaactccactccccactttccttcctaatggtgaatctccgtaggcctttgtgtatgcatttcttctggcctcgatctcttgctacctagttagagttttaagtaccatctttaaccttgcaactttgagcaccactgacacctaagtctacagctcccacagtccacagcctgagacagacacccagatctcagcacctccaaaactgaaatctgtgctttcccaagcatttgcctacttcctatctcttcatctttcaatccaaactcttaagccttgagagtaacttctgaaccccaactctaatcatatccttgccctgtttaaaaatcttcatttggctgggcgcagtggctaacgcctgtaatcccagcactttgggaggccgaggcaggcagatcacgaggtcaggagatcaagaccatcctggctaacacactactaaaaatacaaaaaaattagccgggtgtggtggcgggcgcctgtagtcccagctaactcgggaggctgaggcaggagaatgttgtgaatccgggaggtggagcttgcagtgagctgagatagcaccactgcactccagcctggg

SEQ ID NO: 13733 - DNA, 1466 bp, Homo sapiens
cactgcaagctccgcctcctgggttcacgccattctcccacctcagcctcccgagtagctgggactacaggcgtgtgccaccatgcccagctaattttttgtacttttagtagagacggggtttcaccgtgttagccaggatggtctcgatctcctgaccttgtgatctgcccgcctcagcctcccaaagtgctgggattacaggtgtgagctgccgcacccggccgttcccattttttattggtgccaacatttcaaaacttcatactgtttataaactgattttctggtttatttctactgtaatctctcaatattcatagaagatgaagaaataagtctgacaacactaaagaaatttcttaatatactattattagaatagtagaggataaaagataatgttatccagttacaaaggaatttggatgataattataacttaatgttagagatggtaaagctgcacttacttgaacagcccaaaagcattaaaaatctatttccagaggaatgttttgctatgtagggaaattttgaagtagtttttgctaaaaaattatttctagagttgtgttattcttagcagtaatcttggctagaaatgtttttgtgatttatgcgattaaacgaaatgataaagataaaaccatattattaaatacctatatatcacagctaagtaggagaaagggagacctttttattttgttcaggtaggagtatttcttgtgtattttagaaacaattatttttcccattatttcttatgagattagttgtttcaagtaggagacagaaaagttctgttttgttggaaatgtaggttttagatgtatctttcagtcagctctcagtcactagactatttcatattttttgaaatgtttttgaaaattatgactagcccattttttgtcctttattcaacatacttatcctctgaacacataaataagtgaataagataaaaatatctttaccttattaatattatacatacttgaaaaaaatttcatttagaaacctagttcagaatctgagcaaatttacaagtgacctctgtaataaatggtattgataatcagagaatgtatttcagaatactacagtacaatatattatgaagcatgaccactttattttgaaacttagcaattgtattgctggggtttattgtatctgtagcatgtcactgattatttcagttagttttataatgatttttaaaaaacatatctatttggaataagatacagcaacaatcattgctactgacttgttcaaccccttagttacactgtatgatcaacatataacaagatacagtggaatggcccatacagtatattactgttgtgtgatgattggctttggaagcagtttgattttgaaatgctttgatattctaattgacatggaacaagttttttccctgctccccaaatagaattttgtaaccaact

SEQ ID NO: 13734 - DNA, 1055 bp, Homo sapiens
tgttttctgtgtattgggtttcttctcaatattataaaaattacaaagaaataataaatgccatttattattataccttatctcatcagagttgggggaactaacttttgttgcttagtttataaacaacaagatttgcaggtgaaaactcagtggctcagctcatttttcttgtttcttcatctgaacaggtgatgtgttgctaaatatcaacggcattgatttgaccaatttaagtcacagtgaggcagttgcaatgctgaaagccagtgccgcgtcccctgctgttgcccttaaagcacttgaggtccagattgttgaggaggcgactcagaacgcggaggagcagccgagtactttcagcgaaaatgagtatgatgccagttggtccccatcatgggtcatgtggcttgggcttcccaggtactgagcgctttcttgttgctttatggaaatcataatcatgcttgcagcccttatcagtgtgtagcatgataaatttactcgttgggataaaaaaaaaagctttaattcagtaaaatagcaacatcaaatcaaattacaaaagaaaaggataatttttcttaggatattacactttaaaaggtacacaaagaaagcagttgtgtccattcctgtcaaggctcctcagtgggctagccatgagattggataacccagcctcttgcttagaaaagttgtcgtttaccagcactcattccgctatgtgctgagacttcatgcatttttcatcagaaaacccaggccaatcttggggcttccccccatcccagaagcctttcttaacacctttttaaatttattttaactctcgctaaaaagggtggcatttaaaactcaatttttattggatacaagagtctattaagccaaaccattagtgttcaagaatggctgcttcacttttattttttataaatgtgaccagccaagatatgctgtggttggtcagtgtcggggtcacagaagcacatggaacctccagtggcatcccagggtacattcctttccgcggttgttgtttgacatttgag

SEQ ID NO: 13735 - DNA, 1025 bp, Homo sapiens
tatggcaaggttcagaattacttttcctcttaaaaattacagtttaatgccattataaaaagtttacaatagaaaacctttaaagaagcctctttccttgctgagaacttttcttgttcatgagatggttatgaaaccttaagttcaagtttgttcagcctgtgccacatgcagcccaggaaggcttttgggattattttttttttaagcttatcagctatcattgatgttagtgtattttatgtgtggaccaagacaattattcttcttcccgtgtggcccagggaagccaaaagattggacaaccctgctttagatgatggtccaggaaaaactaaatagaaaaaaaagggatcaggataggctgaggcatgattgcacttttaaattcacactttaacttggagggaagtttgtgtttagcacattcttatcagtattgttttttcatgtatggtgtgaaaaagcagatatatgtatttgcaaatcatgtgtattctagtatccagaatatataaagaactcttagaaatgaaaagataaatccaattttaaatgggcaaaggatttgaatagatagttctccaaagatactcaagtggccagtaagcacatgacatgctcaacatcattagttcatttttatattggattatttgtctttttgctaagttgtaagaattttctatgtattctggatactagacccttaccagatatatgatttgcatatattttctcccattctgtcagttgtcttttcactttcctacatcctttaaagaacaaatatctaatttttatgaagttcattgttgtttgcttatgcttttggtgtcatatctaagaaaacattgcccaattcaaggtcacaaaaatttacatgtacgttttcttctaagagttttctagttttctctcttataattcagtttttgatccatttggaattaattgcaatgagaaatcataatgtgtattgttcaatcctttaaattttattgaggcctttcttttcttttttt

SEQ ID NO: 13736 - DNA, 1029 bp, Homo sapiens
tactgcatgccagccattgatggcgggggttgcttcttgcccagttttctcatttggaaactgatccatgcctttatcccactagttaccctgaagtaatttgaacttagggagcatttctgcctggagacctgtaagaataggtgttacgtaggcacttagtcttcagattggtttgggatttcgtacattgtaggcacgtagcacgcaggccacttaaaaataaatgtatgtgtctttgggctgttgtattacgagctttgcatatgggcttgtctggccgaaggacccagtgtccgaggtggaggtagtagtcagggacatgtattattcatttcagaacacttggcaccttttcttgcttacattgggcactaaaatatttactgaattgacttgaacagaaaaatgaaggattttttataccagattaagaaatttggactttatccagtcagtgatactgagctgctaattttaagcaggagaatgtcatgataacgggtaagcattccagaaagatatctgcagcgtctggaggatggtgggcttccagatgggcgatatggagactaagttggaggctgttctaatggaggggttaagtgctcagggattctctattcagattacctggggtggaatcaggctctgtcatacactgaaacctctttgttccttaggtttgtcatctcagagtttgggggatagaacttgaaaaaacatgtctattacttagaatagtgattgccagatagtaaggacttagtaaatgctagtgtgctggcagtggaaggagaaatgacgtggtgtttaagaggtatgactaggaggctggactaggtaagtgactgggtaggcttaaggagggaaggatgaatcctgggttgtttgacttcaggcattgattgacatgtactgggtaagctggctgtgaaattaaaacgggtcaaattctaattctattacttacccttagaataactatcctgacagaactttgatttcctaacatttgggaaatgattg

SEQ ID NO: 13737 - DNA, 1057 bp, Homo sapiens
ggagggagggtagggggagagttgggattctctcactcactctctcgttctcttttcttaaaggggccgcgcgggacgacggggtgagcgcgcgggcccagacggggacttcgagggcgcgggcaggggaagagggagcggcagcggcaagcgggtggggaaggcggaggggccggtttatttttaaattctgcctccactcgctctctcgcgctctggttcctccgagttgtttattccattttcctcttcctgagacggccgtcgccgctgcgcgtgcgcgctgagacgcgagggcttatgggtagcgggagcgctaggggaagcctggccggcgtcgggcccccgggggcatccgcgagctatcggcggttggaccggcggctctcggtggggttccggacgcggatctggcgccgaattctcacgagacctgataccttccttatttgtatattctcttacttaaaaagccagatgtcttttttttttttttcattgaaaagagaaaattgacaaggtaaacggtcgtttggaggggccacctggggacgcggcccgagccctggctctacctgaagaatatcttctatttgccacacttcctctccccgtttcctttcttcgcccctctcctctttccccttcccctcgaaggtaatgagaactactggaccgattacgctaacctcttggccctttgtcaaaaaatggagccaaaaaggttgatttagacagaccccctgctcagtgcagcacctgttattctctgtatttatattaccaagggccttcggtaaattatgaaaaataggatgccacctgggacaacactgcttagacagcactggaagacctttataaatatactaggttgcttttctccaatcagcctagccttgatttgaaattcatttttattttttttgagacggtgaaattcatttttaaaagatagttttaacctcagcgatctctgatgtttgcgctaatacccttttaaaggctttcagaaattttaaagaattgctatgaaaggaaaagtaacattctagtt

SEQ ID NO: 13738 - DNA, 1064 bp, Homo sapiens
aatgataaactgtagaaatcaaaatttattgagaaatctgtttctcctaacagatagtaaccctgccatgatatactacttcaacaatgttataaaatttatgtgataatatacattttaacctgggatttctaaattgctttaacaaatgctaatcctgagagttgccctgcaggactcaaaagggaaaggttttgggacgtggcagaaccctgcagggacatggaattaaggccattgcaatgtatcatctttgtagcattgtcatcactcctaagctgccttcacagttttagtacactaagatgaggaaatcgaaaatgggcagagaaagctcatactgtataattgaagacagtgacagagaacgtgtcagttatgccaaaactcttttgatttctgttccaggatttccaacaagaggggaaaggaatgacttgggagggtgggaaagacattaggagttgtttttattttttaccttggaagctttagctaccaatccagtaccctcctaactagaatgtatacacatcagcaggactgactgactacttcattagagatatactgtactcattgggggccttgggggtactgctgttcttatgtgggattttaatgttgtaatgtattgcatcttaatgtattgaattcattttgttgtactatattggttggcattttattaaaataaattgtattgtatcatatttgtatgttttaagagaaaataatataaaatacaatatttgtactattatatagtgcaaaaactacaaatctgtgcctctgcctcttgaattaattctttggttgcttgcatttgggaagggaatggagaaaggaaagaaccaataaagctttcaaagttcaagaaattctcctgtttggtctgctgccttacaacttaggttactgacagttgagtaacacaaacacgcccccacaaatacatcaatcaaaactcacacaaaattatattagcctatcactacagcactatatatttatataaaaatcattacaagactatacacaaaatcatgtttttgatttatagc

SEQ ID NO: 13739 - DNA, 1057 bp, Homo sapiens
aaacaacaacttgggatgatcctttccttccattttgatgccaacctctttttatttttaagtgttgaagctgcacaaactgaataatttaaacaaatgctggtttctgccaaagatggacacgaataagttaattttccagctcagaatgagtacagttgaatttgagactctgtcggacttctgcctggttttatttgggactatttcatctgctcttgatttgtaaatagcacctggatagcaagttataatgcttatttatttgaaaatgctttttttttttttacgttaagcacatttatcttgaactggagcttctaaaatgggccccaggggtgcaagatgttggtgtaattcagagatagtaaaggtttatcgcagtgtgaattataagagtccatccaaatcaacgtcccctccctcctctcatgcgatccaggtaattatgcagttagtgccacagtagactagcctagcaaagggtttgctccttgctgtctctgactgcaccacacagctattgatggcagctgaaagaaagtggatcatgccttaattttaaatattcctgtcctctggttattattttaaggaacttcatcatgttaaaatgacagcattcaaaggtgtaccacaatcaatttatcaaggaaataaaggctattgtaaccagagatttaatgcattcttctaaatgtaaatttaaaatttgccctttaaaaaagtccactttccccatatgcaaatgttaataggatttttatggggattaagaagcggcaaaactacagaagcagaattcaaagtaatttaaaaaatacacaccagttttaaatcaagagaagttgtaatctcttgttttaagcttgcgtttgagggaaaatgactttttcaccaatttaatatgcattgttctgttgtttttatttatgattgatcattatatgtgacttgcataaactatttaaaaaaaaaaactataatgaccaaaatagccatggctgagaaacacagtggctgggcagttcaataggaggtgacaatatgacaactt

SEQ ID NO: 13740 - DNA, 1021 bp, Homo sapiens
tggaaaggaaatcagaagtcaactcaatgaaaaggtagcacagctgtatgcagatttggatggaggtttcagccatgcagcctggctcttaccaggttggctgcctttgcctagtttcagatgcagggacagagctcattgggaaatcaaggatattttctataaggcaatccagaaacgcagacagtctcaagaaaaaattgatgacattctccaaactttactagatgctacatacaaggatgggcgtcctttgactgatgatgaagtagcagggatgcttattggattactcttggcagggcagcattcatcctcaactactagtgcttggatggacttctttttggccagagacaaaacacttcaagaaaaatgttatttagaacagaaaacagtctgtggagagaatctgcctcctttaacttatgaccaactcaaggatctaaatttacttgatcgctgtataaaagaaacattaagacttagacctcctataatgatcatgatgagaatggccagaactcctcagactgtggtagggtataccattcctccaggacatcaggtgtgtgtttctcccactgtcaatcaaagacctaaagactcatgggtagaacgcctggactttaatcctgattgctacttacaggataacccagcatcaggggaaaagtttgcctatgtgccatttggagctgggtgtcatcgttgaattggggaaaattttgcctatgttcaaattaagacaatttggtccactatgcttcgtttatatgaatttgatctcattgatggatattttcccatcgtgaattatacaactatgattcacacccctgaaaacccacttatccattacaaacgaagatcaaaatgaaaaaggttgcaaggaaccaatatatgtgatcatcactgtaagccacaaaggcattcgaagagaatgaagtgtacaaaacaactcttgtagtgtactgttttttttgagtgtgtaattctaaaagccagtttatgatttagt

SEQ ID NO: 13741 - DNA, 1084 bp, Homo sapiens
gcattgtgaactggctggtgtttgcagtcccacgtggcatggcctccagcccaacccacagtggagactggagacagggcaatgagtctggtggggggcacgtggacatgccccataggggccccacccagacttaacaggcaaggtcctgggcattgcgcgacgcaggactcaatgctaaagcaagcctgcctggctctgtgccagggcccctcttctgattcacacatcccatttttacacagacccttccttcttaataaaggctgacagttctgttggcagccaagaacccacaccatgaagacagggagtgaggggcctttgtgcccaactccagcacagctgcgttctggggtgtgtgagaggcatgttcgtgtctgtgcgctggtggtctcgtgagacagttccgaggacggggaaattgcagggtggtgggggcgtgaggcttatatgtggaactgatgcagagttcgcctgcagacggatctggatatacactatgtataattgttacgtgtaatttaaaatatatctgtttgccatcgtcatgagaagattatatgtaaggctctgaagggagagggagatgtacattctgccaggctcctggggaccttatccgagtcatgaaattgattactgttgatccagtggtgcaagaagctacactccatgtgtcatcacgcttatgactcctaatgtatttttaaggcaaaaaatgtcagccgactccatcttcacccctcgattcctcgagtccagcctttctgtgccagtgcttcactgagccacaacgctctcgccatcgggacccggctgggcctggagtctcggggcacagttgccatggagccctcctgggtcattctacaaatgtgctgagtgccagctgaaaaccccacaggagatggagtaccttggccaagcttaaagagaagattttctcagggtatttattagtgtgtccagcagggtcaggaagcaggatggaaagatgcactcagactgttaatttattaacaaggcaaatgattttgtgtttcttgatgacagactattaagtttgggacttattttccca

SEQ ID NO: 13742 - DNA, 1024 bp, Homo sapiens
taacatattttgataaatactaacttattttgttggggttttggttgtctcttgtcttaggacctggtagttatttgcttgatttttttttccgttattttctacataggcaaagagaattcgagggatagacagtctccaagaaaagtgaagtggtgggagagaattgcttttttcttttttttcttttctctagtttttctttctggctgagatttccgtgcaagacagcacccaatagactatttagagttgacatttgacattttaatgggcgccatggctcattttgtagattgagaaggtgcgtctcccctgctccaagtctcatcatgacagcgtgctgacagctgggagtctgtggccttcctcacgcagaggccttaaagctggacacagaagcacgcctaggctgggcagggatgggacccatgccccctccttagaggacgggcttcctggttaggaaaggacacgtgggggtgccttgcataatagttcactggtcaccgtgcttttatgagtagtgtttttgtgcacttgccaggggttttctctctgtgtgagaggggagtgatttaagcaatggtgtctggagtaagccttacaattttaatagactttttcttatcatatccctcatttctttccctgaaataaaaatacacacaagcaaaaaaaaaatgatagtttcacatctcttagttcccttgcccaaacaagaatattcttagttccactggccaggattttcctacatagtcagaacttacacattactagaggcacacccaccaaggagtattgtgtctacttttatctgtgcaccagccacaaatacccacattggaaagacccatttgtgatgggtaaacatcccttcctgtctcccacaacccctgtgactgccctgcatgtgttcatgacctccgaaggcccaaattcatgaagcagcaaacccagcagatctccacccccctgcctcaggacctctgctgaagagggggatgaagtgggtctccag

SEQ ID NO: 13743 - DNA, 1623 bp, Homo sapiens
gtggcagctgctccagatgtggaaaggtcacaggggccgctggctgcgggctcatgccaggcaggggcaggccgcctgagagggtttgctgtgggaccgccctgggctctgagccctgcctgcggtggtgcaaccggcggtctgttcacgcccgtctctgctgtcggcccgcaggcttcatcatctactttggctatggcctgtggcacagcgaggaggcgtccctggatgccgaccaagcaaggactcctgacggcaacttggaccagtgcaagtgacgcacagccccgccccccggaggtggcagcagccccgagggacgcccccagaggaccgggaggcaccccaccctccccaccagtgcaacagaaaccacctgcgtccacaccctcactgcagccaaaggtgcaattacttgacctgcagccccagcccaccctcggctctgcagccggttctccgggccctggtcacctccagacagctgcctggccggggccactaggctgcggctggccactgtgtctcctcacttctctgaacaaagcagttcctcccctaccagctcagccccgagctgccgcagcctcaggcagaacggaggtcaccttctctccttatcttgggaaccaggccttcctcccggggactgttctgggattgaaattgtgcatactccaaactttcgcagccatcttcccgctcagccccagacacccagcaatcaagccagatgagtaccacaaaacagtgtgtccccagcagctccccaccccagagccaaatgacagtagtgcacttaaaaaggaaaatcaggcctgttgtccttctccggttgcattcagatgggtcattagggccggaccctgcctgccccttggcttctcagggctttgctctgacaccatgacagctgcccggggctgagggcagctggctccactcaaatgaggaagaagggatcactcccattagggcctgctttgcttatgcatgtgtgtgcacatgcatgtaaaccagggaccttcagctcacggcctccaggcctgggccagttcttgctgctcctgccgtctcccccgactggctgtgtcctgagtaactggaacatgagacagtatctgcaggactggccccatggtggccgagtcagaagtctgtttcctgtgagtcgccaccgttcactcagtcttgccctcccatgctttggagccagtctggtggctcctgtaaggttctcaaggctggtggcagctcagtctggggtcaggacatgtcggggtcatgcgtttctggccctgacataagctgtctggcctctctgtgacatgatgaaattgaaatcaatccacagtccatgaaattgtgacactccaccagattaagttagggcataacattaacttggaaatggccatgtcatcacccctgcggctgtcctatagctgagatgcgtgggtcgcaggggaggtgatttctaggcatattgctgtcccttttgtgtatctgtcatccggatgcttcggaccccacgcctctgcaagtgggagagacccgagcatcctccccacccccatagctccagtgcacgccacccccgtcttgcctgggtcggggcctgcg

SEQ ID NO: 13744 - DNA, 1063 bp, Homo sapiens
tgaaggcacagagaggaccagaccctggaaggaggcagcagcccttctcccctggacgtttccctgagtagtcaagggcaggctgacaccttcctgcatgacacaggccaagagagacctcgccagtccctggatattcggcatctatttctgaattctctggaaaataaatgtcccttgtgatcagtgttttatgaaatgtgctgcctcttccccagacagtatcaagggtgctgctcatgaagccacttgcccctaagtttatacataatagcagacccagtggagcagtccctccggggtggtgggatgcttctcgtaaatgtctgctcaagttgatgcatgagttttccaagccttggagacgggcaaggcttctgcatttttagattacacaaataataaaaaaggttgttgaccttagaggtaaagtggaggtccgtcttctagtcctttctttagcaggagaatcgcaacagagaaaaatgagaatggagttcatttggccattcagagcttagaatcaaatccccacctactaagatgtacccttgggtgtgtttgtgtgtgtgtttgggtgcgggctgtgtgtggggtgtgggagtgggggtgggcactccctctctcttccccacactcgcccgacggtccctgtcactctcagttgtgctgcctttactagacagttttactgaactattggaaccggcgccactgccatggattgaagccacctcctgtctcttcaggttcccttcctgccagtgctccccatcctgagcatcttcgtgaacgtctatctcatgatgcagctggaccagggcacctgggtccggtttgctgtgtggatgctgataggtatgtgatgctgctgccagcacgtccaagatcctggcttcccctgggggtctcccttgtttcagatttcataacagaatgacgcacatccagtcagcagctttctcgaagataatgctgaatccctggtaggctgtgagtcctctcctccctgttagatactttttgtttccattgcttcttgtccaaactatttattcttttg

SEQ ID NO: 13745 - DNA, 1030 bp, Homo sapiens
cctagtatctttagcatctgagggccgctgccacttctcagagcaagagagatcctctcagggtattcctctgggctgctcatggtggaggtcatgtcgccccgaaggagagaccatggaggatgttccccagaagcaacagcgggaggtggtgttcccggtctctcctcgtctatctacaatgcagcatttgactatatccttcccattttataccttgtgtcccgggcagctcactttggaggcttattgagaacttgagttggtgcacgtcattttgcttgaagcagatgtggcggtcacgcaatgcctttcttcccaggtaccagccagagcagcctaacctggtataccagatggccagtacttccgacgagttagatccagcagaccaaaatgaattggcaagcaccaatgattcccagctgggctttttaccagaggcagagatgttctctttgaaaaccatactctcacccaaaaacatggagccttccaaaatctctgggctaattgtgaacatttcaaccagcctcataggtaagagctagcccttccctggggccttgcttgttggcattgcatggtttctaggcagtggagctggagttgggggaaggtgccagagaagatgagcatctgtcttgctcctggactgggacatagttactctgtgttaactgtagttgtgccttcggaaatggagcctctctctccacaagtttaggggagaacagtggatgcctgtgggaaattgggaaatggttgagttgcagcttgctgtcttttccttcccccttagctgttctcatcatcaccttctgcattgtgaccgtgcttggaagggaggctctcaccaaaggggcgctgtgggcagtctttctgctcgcagggtctgccctcctctgtgccgtggtcacgggcgtcatctggaggcagcccgagagcaagaccaagctctcatttaaggtgagcagctcggcctagggaaggaaccctggtacacagaccctggccctcctgatgcctg

SEQ ID NO: 13746 - DNA, 1032 bp, Homo sapiens
gatgcagaaagcttagggttacttggtgaccagcaggggctatgtgcctcctgaccaggggacagtggccagggaagccgcctgcactgactgcatggtgcacccccagaacacagcatgtggggggacaggccagggctttgtacatcagggaacaagggcttgaaggacccccgacagggccctgggaggggccatagcgccacactgaacctgggcaccgtgtctcggcacaggtgtcagatttatgggactgttttctgaatgtttaagcagcctgcttcttctggactcctgagtttgtaaactgtgcttattttgcttttgcgttcatcagtgtagcaaagatgtgctgagcccctcccgtgggccagtgcccagctgtgcccgggccccacacacctggcaaaagctgcgccctcctggactccaccttgtgcatacaggcagttaaggaatgcctttgctgacaaagacttttattttagccttagtttctctggaattgtttgttttgagattgagttactggtaaatatgggacccggggtaggactggctggcggctctgcatccttcctccgaggggccctggggagaagggtgtgggactggccgcgtggctggtttctcccccatttcctgttggacccctgcctcatagtccccacgtctccctaccctagtcattgtttagaagatgcttctggaaggggcgatactctgcacccttgtgaccctgggccacgaacagcagggaggcctgcacacacggagttagcatgcagtggctggactcagcgtctgaagcccagggcctggcagcggtaacagggagggctgactgccaggttccgctcatatcaggagatgagcacagctccttacgccagactgcgcagcgagtgacgtgacatttgtttgcggctcttttttctagtgacacaaaagaagggaagcccggtgttggtggattcatgcccttcgggttctctggtgtcctgtcgggggcagcgacttgcttctatgcct

SEQ ID NO: 13747 - DNA, 1036 bp, Homo sapiens
gtctgcagaggctcgatgcacttggattctttttcagtcgccttcttatccccatccaggaaggaccttcccagtttgtggttaacactcagacaaagttttgtgtctatgcactttttcaggacttttaactcttggtgtgaaagagtcggccatggtcaacaaaatattcacttgtattaacgtcctggtcctgggcttcataatggtgtcaggatttgtgaaaggatcggttaaaaactggcagctcacggaggaggattttgggaacacatcaggccgtctctgtttgaacaagtgagttgctgcttctgaccatttttcttagttgacatttaatgacatagattgtatgggggatataactggctaggatggcatgtgcttttaagaaaacattatttgaggatattttgttaattgttttgtgtttttgcagtgaagtagctgagggtattttgtatgtatcaagtttgtgtgaaggtttattcccctgaaatggaaagactattgtatgacaagaaagactgaggaaaagaaaatcatcaccctaattccaaattgtgtatcattcaggattcttgtcagactcattaaatgatccctctttccccagattctgtttgatggccaactttggaattttgtgttcagaaaagatttttctctgcagtgccgtggtgacctcacttcacctttaaataccttcctattagattaataatgtagagggaagagaaataggtgaaactatttttgaaggttttcagaatgactgaagtgtcagaatgtgagcacaatagtctttcgccgacatttgacttgtgctgctcaagccctggcgacagtggccccatcaccctcatgtctctgacacagacatccggaactggaggtgacagctccaccctgtgccatctcaggtctctcgcccagccctcattgaaagctcagataacctaggaaaaaaaagccaaacagtcatatcttttttatctttgttgtcagatctccatgtaattctttaggtctcagg

SEQ ID NO: 13748 - DNA, 1214 bp, Homo sapiens
ctgtcgcatctggtcgggcaaggtgggcccgtaggttggaggaaagcaatctcagagccatcccacaaggcacaaggtgtcctgggccctaatggggcatgtcccatgtgagggtgggatggatgaatacatgtcctctcatgataagtgcccaagagcatatcagatatgcatatatatcatataccacagagcacattgggctgacatttcagcccagaagaaaagtgcttcctgtagtagtaacagtgacgaaaagccctcacttgtaataactcaacatttttctgcttcgacctacctctgtgttaccttaaaagtgaaaacaacttgctccttaccctcaggggatcctagaaagatctagaaaaacattgttattgccattcagggcctctgagttttaataatttaataatttaatttagtaatgaaattaagatatggtttggtttgctttctattacagcatacttgaactaacaccttgtttttcctggtgtattatctgatgactgagtgtaggaacaatgtcattaatgtgtgtttcctctactgcataatttccacccatggaagagtctccattaagaggacctgctacaaatgtggaagctcagagacctcgaaatgaagtcatctgtatctgttggcctgctgggttaattctgtatgtgctggtgaaactggagaagtctgcgtgcttctgacaattgatggtggaattctacgaattaaagcgttttagcaggaaatgattatgaaggacctgatcactgtctgtgtttccataatgtgataagattagagtaatgggtgaaatgaggagcaatcaggaaacatctttgttctttttcaacagctctgaacagcaacatggggtgcaaagtcctgctcaacattgggcagcagatgctgcggcggaaggtggtggactgtagccgggaggagacgcggctgtctcgctgcctgaacacttttgatctggtggccctcggggtgggcagcacactgggtgctggtgtctacgtcctggctggagctgtggcccgtgagaatgcaggccctgccattgtcatctccttcctgatcgctgcgctggcctcagtgctggctggcctgtgctatggcgagtttggtgctcgggtccccaagacgggctcagcttacctctacagctatgtcaccgttggagagctctgggccttcatcac

SEQ ID NO: 13749 - DNA, 1048 bp, Homo sapiens
atgcccacccattcatgatatcctataatagtaataccaccctaataaagacagagattccttagcctgatacaaacgtagaccacagtctttctcctgcgagggtgaaagatttccctctggatggctcccaccaggtgcctggagaaaggggtcgactggggcctggccattctgaaggccactgaaaggggaagctaaaagcattggcttcttaaagatcccaagatgaagattttcttgaaagaagggcatttccgagtgtcgtataacagcttgcttttgactcctcctggcccccagggaagccattaagctggaatgtatcagtggtggaatgatccgttaaattcaaggtgaaaacgtcacaccattcaccctgtcacttgtatcagaaatctttaaaatagaacataagagagtctttatctcaaattctgactcattgggtcattttactcctggtgttatgtagtggttactagaatagaatgcagagttagaattcctgtgggaaacgtgcttttctgaggatacccctcaggtaagtgttctttgataataaatgacagggagcaagagggatccgagacccttgggcttgcaagatttccatcaaaccctcaaataaaaggaggcatcaactgttgtataaattcctccccacctaatttccaggtgatgctctcaaagtattctggcaactttctgtgtaaaccccaacagcaggaagtctctaccaacctgactttgcttgctggggttggaatggttagctaagtctgtgcggagtagcttcgtgcagcctcactgttggttgaacaaccagctttggagtcctggcatgaatgtaagagctggtataatgtgtacaaaatgctgacagataaaaccacttggagaacaggtttttgcattacttccaaggagacaggatatttcttaaaataaacccaggacagagtaagtgtctcattttctcctaccctgggaagtaggaatgaacacctagcctgagacatttacattctccagattatcagccctg

SEQ ID NO: 13750 - DNA, 1051 bp, Homo sapiens
agacagcattgtctactttcggcctgtgggttatttgtttatttgtttgggcctcttcgtggtgtgagtgggtgggatcccggcgctcccatgttgctttaacctggctgaggcccgatgctgtggtctttgccatgcctgcactggggcctctgttggcagttgttcttggctgggcaacttccccactgtgcctggaagctgttctgcagttggtggctgctcagcccaaggaatggcacctgtggtagagcctcatgtcctctcctccccgcatgtccccgcctctcccccactctgtcctcctgcagaacctctgatccttgcctcctctccaccccctccctcctcctgtagaacctctgatccctgcctcctccccacccctcttcctcctcctgcggaacctgtgatccctgcctcctccccacccctctccctcctcctgcggaacctctgatccctgcctcctccccacccttctccctcctcctggggaacctctgatccctgcctccttccgcacccctctccatgtaatgttgcttttgctgtaagacttagagtggtgggctgtaaactttgtctatgggacctcagaggtccctgggaacttctgccatcagccctgttgagtcagtaggcagaagcgtgtggcggggaggcagggctctcaggctttctgattgtgaagtcagggaggcctgaaggactgaaacccctggttgagtcatcaccctggcccttgggcccccttgtgccagacttgagcagtcacattgcctgcagcttgtggattttagaagagtgtaaagtgtctttgtaaccaaggcctccagctcgatatatggaagtgcccaaatggctctgtgcctctgtacttcttgatggaaggccaccttttttcccccatgaaagtagtggccttttgagacagaccttttctttgtcccacactctcctttgggaccctagtgctccaggagtgtatgttcatagcctcgcaccccccgcaaccccaccactctgtgctttccaagaataaggactg

SEQ ID NO: 13751 - DNA, 1051 bp, Homo sapiens
catgtggctgtcacttacagcattttggggctgtcctggcactggggttgtggagtagggtacttggtgcaggtagtggagtttcctcggtgttttttgggtcagccccagacgaagtcctttgtttttacatttaattttggaaatttccaaacatgcacaaatgagaaaagcataatgaagccccgtgtacccgcttatcagcttctcctagacagactcgaggtgggcttggcttgtcctgggaccctcatgccttcctttgttctccctctttgttggtttcattacaagagattttctttcccttaattcagaagcattacatactcattatttaaaaattgtcgaaatatggaaggaaccactcataatcttctgtctagagacaaatgcctcacttcttcctgcactacaattctttgtatacacttatttttatgttataattttttttaaggattgctataatgttgttttgacactttttctctaatgtaacacgtaatccatctgctttatctgccacttccttccacataccctttccaggcctctgctatctgtatcctttccacaactttccgccgaagccccggttgggtcctgcagccaaaattacccacttttcctcagtcccagataaagttcctgttacctcacagccagcgggtcttggctagcagctggctggatgggaagtggatggattacgttgattcactccacggcatgaataataatgggcttcatttttacaggggtatcacatttaagaagaggttgtcacttaactcatgactcttttatatttgtaggatttcagacagggtaacaaataaagtaagaattatcaggcagcagggagaatgagcttggtcaaagttgagtcagtttggcacctggcagggaatagggtttcaggaattagatgacctgggttcaaatcctggcttcactattacaagttacgtgacagcaggcaatataatctgccagctacactccgcgctcttattcttacaagaggattagcaattgtgactcgatt

SEQ ID NO: 13752 - DNA, 1066 bp, Homo sapiens
aggctcagcagcccacacagagttcttaatcagaaggacttctgggggatatagccagtgacctttgccacatgtaagcaactttgagcagcctgccttgaaataagaattaaggaggaaggaggggctgcccataagcttcaagttcctggggaggattaggctataagtaagcaccttgtttatgaggctgctactaccttgtaaatgtcagaaacaaaggtgcagaattaccaggtgcaccttcccaaaggcggtgggtaaaattagctgctggccagcagggaagtgggaggacattctgcacaggccagaagccactgtgtgttggggtatgtgagccttgagcacccttttctttccttccctgtttaggtgcttaattagtagcatgacttaaattagagtgagttcattctgcattcttccccgcgccgccccagtcagatgtgtttctgctgtcttaacagactattttagaacatcttctggtgttacctaacactggggctgggcgttgacacctgagtgaatagcctaagtcagagtcttccgcttcttgggctgggcagtgcattatcaaggtgtgaggggaagcccttgggtggtgttggggcacaagtcttgaaccctgtctgaattgggggaatttatggcttactgggcaccgccatgatgtcatcttttcctgttgaagagaatcaggccaggtgccagatggtaacatagttgccacatctcctggaggcctttcggtcttggccacgcttgttgtttggtttatcacattctgtcttctctcttctgttctgttccctgctcttcctcagcctctgcaaagagggagggcacacagtaggtgcataataggtggttgttgcatggatcgatcattgtgaacagttacttgcttgcttctttctttccagactgtgcactctgagggcagggacgatgtgtggtctcatctttatagctcccataacttcctacgaccatggcccaaggaagatcacccaatttttaaaaaaatgaaataacagctacttaatgtatgccatttttc

SEQ ID NO: 13753 - DNA, 1047 bp, Homo sapiens
tgacagagtgagaccctgtctaaaaaaaaagaaaattaaaatttagaacaacttgaaataaatgtcttaatttacctaaaataacaaggattaacccattttgtgttactataagtaacatttttatgaaaaatagctattttccagaacaaaaaaaaaatcagtgagaagagtggcattgttttacatatttgccagtgtctttaatgtttagcttatggcagctggattcatatatgtgcttctgcattcagtcagtttggacgtgttgttttagttgaagtatataaggaaaatatggcttcacagggatgtacctagaaagggaggaacactttagtggccttttcaggtaattgtagatattcttccttgatactatattaaaactccacaggcaatcgtgggttccgctgtggaatctgaagccatctcggtaagctctttgttctaaaataatgggtctgtcctgcacttcaaatcagtctgcacatttaggattctgttttactgaattacgtggatcttccaaatgctggcacatttcatcatatatttttaaaatatcccatttgttaacatcacccccagtgtcatcagaaaattcaacttttagggagctgtccacatcttggtgacgaatacaagttttctgaaattcccatttttttcttgaaagttcaaattttatcactcgcagcaaatgttgtcagttgtttcccttctagattctgcccgccccccctttttttttccagagttaactttttaaactacgaatcccaatcatggccccttggcagccaccctgcagtggggcaccaggatgctgtgtccctggtgggctgtgagcctgactttatcaaccttcatggttctcggtgctctcatggtacatgatagagcatcaagaaatagcagtaactgacagttagggacatttggttgtggactgtgttttaaatactattgaattaatgttcagttccactggtgtgatcatggcattacagtttggtaacacaatgtaattcttttttttttttt

SEQ ID NO: 13754 - DNA, 1098 bp, Homo sapiens
ataccacaacaatgataactgtgcgaggtaatgcatatgttagttggccaggttcagtcatttcacagtgtaccggttgaggataccttatccaaaatgcttggaaccaggagcatttcggatttgggattttttcagattgaactatttgcattatacttaccagttggacattcctaatccaaaaaagtctgaaactgaaaatgctccagcgagcgtttcctttgagcatcatgttggtgctcaaagtttcagattttgaagcatttcagattttggatttttggatcagagacacccaacctgtgtatacactttaaaatatgatgttgtacatagtaaatacatacaattttgtctgtcaatgtgaaatataaaatgaaataatcttaaagaaagtaggggaagaactattgacattctcacgtggagacgaatccattctatgagtttgcctgggaactgttgagtaacagctggaacattcactgtcatcaggtgaaggacagggcgtgatcattgggaaactggcaggctgagaatatgctatgctgggatggaactacggaagtcaggaagtgtgggtccgtcaggaatgcaggggaacgtgatacttgacagttttggtttctagtaccatccatttgtgagccttgccattactctgtattactgcagttaacaagagtctggataaatctaagatttggactttcaggactggaaggctcaaggacagaggggatgcccccgtttctgtggtccagaaaaccctttgggaattgcagctttcagtgtgtctgcagaacagccgctgggatggtcagccattgatgcagtccggtggtgccatgtgtggggcccatcacaaaaggggcagaagggcctcagacctcgagagcctcagagggcagttctggattcttcggtgatgcctggggcctgcccttgtggttccagggacgctgaggtctttattgtgcacattaggttttgatttctgtcctccatcactctccttgaacagaaaagttatttcagtctcttagcccaatgcttttaacaaaaaactcatggaaatttcaagacaatatttat

SEQ ID NO: 13755 - DNA, 1051 bp, Homo sapiens
ttctttaaaagtcttagaagtggctggctaaaggtaacggggtgctgaagcatggctcccacacatctctgtcaccccaaaggtgctgggcacgagtattcagggaaaccttggctgtgtctgacctatgtttacttcagagctttatgcctagcacgggggtttgcacagggacattgaaagtaaggaagaagagagcaaagtagatgggtctctcggaaggctttgaaggggtcccaagcttctgtattttctgcaaacgcctgtgaaaactcccagaacattccttgatcaaaatggttttcttgtaccttctcacagggagagaagcgagggtgggggcagggtcgggatgtcatgggaatggaacgttcttaagctcagttgtatgtgatttttatttttctctgttgcctggttcattaattcataaactcccttagaaggctaaacagttcattagaaatatcctatttctgttaaatagcatagaaacatgtcatttacatttttctttaaaactcagaacttgagatcacttctgtaaaatgtgagccaaggctggctcttctccgggaggctctggcggtggtgggaatgtggggttcaggggatagagggcacttgcagtttaccctgtgactttgggtagcttttgaatttttgagccgtgtgtgtattgccttgttgaaaatcccatcatggcattgcttctttggggaaatctgatttcgtttgtatggtacctcttgcaggaatgtagagggtagcttttaatcaccttcagtctctagaaactggcatattattcatttgcctcagcaggcgttaagattaacaacatattccatgggtgaaacttcgcagttgggcccaggaatagtctctctgctttatagcactcatcaccttgctggagagggaaaatcaatcaggtaaggagacatgtcttgattgtttagtgaagcagccacgtgaggaaattaagacttgtttccaggtgtgaaaaaggcctatgaaggaggaggctctgccagccattgaaagtgtg

SEQ ID NO: 13756 - DNA, 1030 bp, Homo sapiens
ttgtggcacctaaaatagtgctcaagaaatatttattgaatgactattcttataattagtaaaactgtatttaaaggaggaatgtctttgagctaatgttttggcaggtggatgggacaatatattattttaagtttctgttgtaattttgccctagcagctcagttctggtagattttgttctttggcacacatacataccccattttgcactttggtacaaattatactgtgaatgggtgactttgacatttatatttttggaagaatccagttctactgaaatcagagtatcagatgttgtctttttcctaatgttcccagatggggtagaattacagcttcttcttacttactctgtaactaaggaacctttgggccagtttgtcctgtcctgtggttgagaatttttgcctggtttgcccagggtttctcatccttgagcatccaaggctaccaagatacactgttcatatgtcgtcctggtttctaatggatagttatctaaaaatgcagcttcccattcttacctgcactgtaggttagcttggaagatgtccatccctggtctcagtggtcttgttcagggagggtgactgtcacagctgtcctttcctctctggtgagattgtttcattcctccttcaggcacttgggattcagagccctgttggctgcctcttctgtactgtcagcttagcacaggattctggaagcccggtgctgggaaagcctttctctgggctgtttgggatgggactactggttacccgcacacactggtactcactgggtgttcccgaggatggcggcttttaaacttctttgaccgcagtctacaataagaactaaatttacattgtaatcaagtacacacacagaggcacacatattgatatatagataaaatgaaaatttttatgaaacagtactcatttttactatctgtgatacgctgagataatttttattcttttctatttcattacaagaaaaattcctcgtggcaacttggagtttgcaaaacaca

SEQ ID NO: 13757 - DNA, 1071 bp, Homo sapiens
acaagactgttgacttcagggagttacaattttctatttggtagaagaactcattctttgatggaattaaatacgtgttgattgattattctggtctgtagtttattttaaccaaagtccatacaaatagataattatgttggagggctcagaattatgtccaattaaattaatcctttctcattatcaaccatgtatttggagggattgctattaatcctagggacaaatttgaaatgtgaataagtgcatccttgttatggagaaaaatattgtttccctctaaccttggagatacttgagtctcggagttatctcttccagaggcatcttcagagatgcctatcactccacctgcctcttggtcctcactccaagcaagaccttccgataggatgtggtgtttttctgtatagttggcccctgcagacctggatagattttaaaggcagatccaataggattggccggtggattcatggaaggacgagaaaggtcaaatatgactccaagcacatcggagttgctgtattaatgagatgggaaggctgagcaaagaacgtgttggatggaagagggactttttgaaagtcacaactgacctttttagaactcttatccccagggtcagggctggaagatgtatcttcttggggcccctctcaggtgcctgcctgtgtgttgcagccacccgtccaggctgctggcctccttccccttcacctagctttactggctcctctcgccaaatctggggggtctcttcagcctctgtctccttgctgcccatggcctccctttgctcccctgccgccttctagtgggccgcctggtggtggacttgtcctgtgggatggagaccctccatacatggggttcaaaggtcctggggtattcctggatcttcaggacatctgcctaccctcaggtttcccaggcctcgggtggggaggcatcagatccctggccaacctgctatccaccccagggtttagacctctcttcccgtgagggaacagagtagtagcttcatttgtggcagattatctgccttgtgataaactttagtgg

SEQ ID NO: 13758 - DNA, 1033 bp, Homo sapiens
caataaatggcaagctattatttttactttttataactcactgttccacaccctactcaggaatctcagacccactgctgcttcctttttattatttttaaaattcgtccagcaaatatttatcaagcacttacaattacatatcctaactatccctccctcctgtagttatctgtttgtatgtctctcatagcttcaaggttatgagatcctcaaggagtttcatattaaccttttgcaatccaggtaccaagcagtgtctgttttagaaaatgtttgaataaatgaataaaagaaagtttatgaaatacgtaattaccatattttagcgctgcaattgtttgaataatttttattttaaatcagtcttacataggaaaatgaatatatcgcttcctcattctttgtttcttttacagtacagttagcaaaaattcaaaatatgccctttataaattcataactctagaaaatgtttattttaaaatttacatattaaaataagtcactgataggtttatatcttctagatcaagtagctgttttaatatgatgttattttttaaaaactattcattttcaaatgtcaataagaaaaataaccagagaccgacataaacaccaaattataaaaagttgagcacttaaaaaaaatctttttaagacaattataaattaaccatgcagttttcagaaataatacagagaaatccccaacactgttcacccagttttccctaatggtaacatcttacataatcacagtgcagtatcacaacaagaaattgataatgataggccaggcatggaggctcatgcctgtaattctagcactttgggaggctgaggcaggtggatcacctgaggtcaggagttcaagaccagcctggtcaatatggtgaaaccccatctctactaaaaatacaaaaattagccgggcatggtggcgtgcacctgtagtcccagctacttgggaagctgaggcagaagaattgcctgaacccgggagccggaggttgcggcgagccgagat

SEQ ID NO: 13759 - DNA, 1029 bp, Homo sapiens
ttttatttagctgaggattgtcttatggctgattgtgtgttctattttaaagtatgtgccatgtgcagatgagaagaatgtatattctgaagaatatacattctgaagaatgtatgttttttggtgaagagttctgtagatgtctgttaggtcttttttggtcaagtatcaagttcaggtcttgaaaatctttgctaattttctgccttgattatctgcttaatatagtcagtgggatgttgaagcctcaaactattattgtgtggagatctaagtctctttgtaggtctttaagaacttgttttatcagtctgagtgctcctgtgttgggtgcagatatgtttaggatagttagatcttgttgaattgatccctttactgttatataacgtccatctttgtgttttttgatctttgtgggtttacagtctgttttgtctgaaattaggattgaaaccccttctcccttttttttttctgttttccatttgcttggtagatttttctccatcccttactttgagcctctggatgtcattgcgtgtaagatgagtctcttagagacagcgtaccaatggatcttgcttctttatccggcctgccactctatgccttttaattggggcatttaacccatttacagtcaaggttaatattgatatgtgtggatttgatcctgtcattgtattgttagctggttatcatgtagacttgtttgcatcattcttttatagtgtcagtggtctgtgtacttttgtttttttagtatgtacttctgtgtgtttctgtagtggctagtaatggtcttctttcctttccatatttagcactcctttaaggacctctggtaagttaggtctggtggtgacaaattcacttagcatttgcctatctaaaaaggatcttatttatttctcctttgcttattaaacttagtttggctggatttgaaattcttggttggaaattcttttcttatagaatgctgaatatatttgtataagtgaatgatttgtataagtgacctgc

SEQ ID NO: 13760 - DNA, 1117 bp, Homo sapiens
ctcgattcttatgcagctcaccagtttgtgggctagggaattgagccttgagcagtgaagtgacttacccaagattatatagtcagctagtttaaaagccaggactaggagagtccaaggttcctgacttacagtttaaccttcgtttcccatacaagaagtagcaagaactgggcttgacattatagaaaatgaattatacaaatattaactttatacagtttgtggtacctaggttctctttaacaatagttgggtctctgtggaaaaggaaagaaaatatggtaaactttcagattcaaatgcccaaattcatattcttaccaattcctttttggtatcattactctttctttgtgatttcatcattctgaagtacactacatattagaataactgataattataattgaattgataaaatatggtatatattaaatattagtttggaaatacaatctcacagtaggaaagaacaagatagaggttattataaaacttaaaaattgcaccatagacacaaaagctactgaagaaagcattacagatcacaaaagacaataaagtgaattatgagtttgcacgtgtatcactgggtcaggagagatgacaaagccatggccattataatatcccttcaggcagtgatcacgtgaagccagttttggagtgaggaaaatgctttttaatatttctgaatttaagccaaagaacgcctcagtatttataatgaagcaaagatcttggtctaatttaagaaggtgttagactggggtcagtaaatatatggcactcttgcacctcagcactgcacccaccatactccctgccccccagccctaccctttacttatgacagacatggatgattaataacaactcattttccactaaacctagagatggtttaagatccttcttaggggagcatattttcagcagctcctgtaaattaatgattggcaagagtgataaaatttgttttccaggccggcattagatattttctggatatttttcttgctaaagtagactaatgtaaaagtaagtcaatcaataaccatacaagaagagctaactactcacttgctgagtaataaaggttttttctctatag

SEQ ID NO: 13761 - DNA, 1022 bp, Homo sapiens
gctcccaaagataaagctaagatagacctgtatgagttcagttccttcattgcagtaggtaagttatccagacatctttcattgagtgcttttctatttgaattggcatcttgtttaatcactttgtgaatgacatggaaacccactcatctggtaacttttagatagatttttaggcaattcagaaagcacactgagaatttccctaaaatgtcagtaacattgcctgaagttttattttatggttctgggttggaaagacagtacatatttgggaataaagtggcattcagaagagcaacaataaaatggggttttgtttgtttagtttagctgtgggttatacatattccttggcttctagacctcacaaatttatttgttcaggaagttattaacacatttctaacttggataaaatacttttaatatctttgatctatggtaggtgggtaattcatggtcatttcccaaagtatgtatttatcatttttggtatccagactagaggatctcagaagtttgaagctgatttattatatgagatatttctcccccccacacacccatttcccactcatctaactcgttctatttgaaatctcagctgagtctttagaattctctgggatgctgtttcagacccttgtaaatctgtattggtgctcactctttgtgccccagtgacacaggatttctgttgtagtacacactggattgacatttcaattgctactgtgttttgcgcagagttaggacaattcataggggatgggaactaatagttggtgaactaacacagtaataataatcttaaatatttgcccaacatatatttaatagaagaggaataaactgattttataacatttctatatagaaacaaatacctactaattcgttttctactggccaatgcagggtcagttttctagaaataattagacaaaacatttctgaaggtttggtagttttaatcccttagatcttattgcatgatttttctgaaccaggcagctttc

SEQ ID NO: 13762 - DNA, 1166 bp, Homo sapiens
aaagtagccagagtggcaggatagctgcttccatcacggattgccagcaatgtaaagcgtagactccagaggaacagtgctaacttaaattaactatgcaggcatcagtacttctggttctgatggcccggggatttctaagtagtagtgagtctcagcattatttgttatacagtctactgctagatgaacaaggctaagtctacagagaaggtaaattatagaaattaggccccgtctctactaaaaatacaaaaaattagccgggcgcggtggtggggtcctgtagtcccagctactcgggaggctgacgcaggagaatggcgtgaacccgggaggcggagcttgcagtgagccgagatagcgccactgcagtctggcctgggcgaaagagcgagactccgtcttaaaaaaaaaaaaaaaaagaaattaggtaaaaggattggaatcttagctaattggtctgaaattcagagctaggccacagaattagttgctctttcataaatttcattacctgtactctagcaattgtaagtgtttttatgtgtttctcccactaaacagactatgtacttactctgagggcagagaggcctcatctttctaaactgctgtgtctagcacagtgcctactaaataaggaaaactcaatgaatgttgaattagcactgcaggtgtctgatagaacttagcacaatcatggaaatgttctttattgtgtcgtctagtaaggtagccacgtgctgggctacttgtgtctattgggcactttcttcatggctagtgtttgaggaagcgaatttttacttatgtttaattttaatgaaaatatctatgtgtatctagtggctactattattggacagtgcacttgtatggtttatataatactttcagtggactaaaaagatctttgactttttttgtttttttgtttgtttgtttttgacttgtattccaagtggtcccagactgctaagctttttgttttactttttgtgattttttagtttttttcttctcttaatgtcagcgttctttttttttctatcattaagtaagctgtcatcagcctttcttttaacttttctgattttagtcaactatcatatagaaagacatataatcaagcttgtagaattatctttttttttttttttttc

SEQ ID NO: 13763 - DNA, 1048 bp, Homo sapiens
tttgtatttttcatagagacgtggttttgccgtattggccaggctgttctcaaactcctggcctcaagtgatccgcctgcctcagcctcccaaaatgttgggattacaagcatgattacaaagtgttgggattacaggcatgattacaggcatgattacaaagtgttgggattataggcacctggcccgggaattagctaatattctttaagtattatttctattcaattgtcttctttccttatgggactacaattacgtgtatgttaggtcatgtcactgtttccattcttttttccccttctcgtaagcctagagattttctagcaacctatcttcatgttcacttgtattttcactgtccagtatccagttatttctaattattgagtttttaattttagtttttgtattttttatcctaaaatttacatagattcaaattcttatgttttcatctgttttcttgagtatattaactactgttgcaaaattcctgtctgatgaccgtcatacctagattgtctgtgagcctgtttctgttgttttgtttttgattatttgatcctttttccttgggtgcctggcaatgttttattaacattgtgatgaaaaattatagagaatctgaattatggttatgtttctccgtataggatttaatatcctctggtgagtagttagaaaaacattgattactttgattcgtaagtgactgataagacatgagcctgaattcagggcagtcaggaaattctgatagcctcactattggtggactactggtgtatagcccttagctaaggtctcagttgaaagtttgccatgtttaccaagatacctcttccttggcaagtcctgaatttcaggtatcatgaggctgatgaaagctatttttaaaacctcttttcaacatctttttgttgggattttctgaatttcagtccatgctgtttacaattcagcacattcctggagaggaaaagttgaacagaatattgggcccctttctttgaggttcctttttattttcctgagatcctcaatt

SEQ ID NO: 13764 - DNA, 1031 bp, Homo sapiens
taatgaggacttgactcgggagcaagtgtgaatcattgccggggctgggaaaggaggaaggcgcatttaaccccctcccacccctctccatgtccgtgtgtcactcggctcggtccacctggcgcggccggtcctggggctgctgctgctgttgacgacgacgacgacgacgggggctgcctctgctgtcccgggagtttcctcctgctccggccacacagctcctggggattgttcctcttcgaaccagaacctcggcctgaccggcactttggctccaaaataactttatttttgggggagaaagcacatcacgaaccagtcaaaatcgtggtttatttctgtaacgtgaagacttctgctcttttttctttgtttgtttttttcgtaaacatctgggtgtatatcaaacggcaagatgtccagtaatgtcccggcggatatggtaagtgacggataagttatgacactgatttaattgtggtttccaatcttatttaatcggaaagacggcaggcgtggggcgaagatttgctggggactgtcgaaaagccactgtgctgagcgatttggagaagttggagcttctggtttcccccttttaggaagtactgcttttaatatgggttctctcatttggtcgtgttttctaaagcattgaagatagtggagaagtagggaaatgtatcatggtagcttgaggggacaaaacatctccctcttcgctagaagcctccgaacactagtattttaacgtttctgaaaacgtcagggacagtgggcagagctgaggacgggtgtccctacgagagaataggtagggaaacgggaatcttgctttatgacacagacgagatcgtcattgcagtagggacgaacttgatatttttcaagaacagggatgcacatctcttcaagaaaaagtatgttagaatttgctgtgaggtttttgaaatgtctgaatacggatggcaacagaaatataaagatattttgggattttcagaaacgtaggctgaccctgtattggt

SEQ ID NO: 13765 - DNA, 1060 bp, Homo sapiens
ccatagatctgtgaaaatgaccacgggaaagctcaggatactccagagaacagactcccaggggccttcctgccatgcccatgatcaaggtctgcaggaggaacaggattgtgggaaagaacaagagcatgagacccagactgttttggggctgaatcttggtctagctgttgtgtgaccttgagcctcagtgtgctcacctgtaaaacgagttgcatgaagactcagtgaaatagtgtgtattagtgatctattgctgtgtaacaaatgaccccaaaacttagtaacttaatacagcaccatgggttatctcacagtttctgtggctcaggaatcttggtgcagcttaacaggtcctctaactcagtggctcctgagacaacagtcagggtgtcttctgggttgcagtcatctcaaggttcagtgggggaaagagctgcttgcaagctcactcatgttgttgttagcaggcctcagtttctgttgggcctcctccctctgactgatgctcaggactgtgaacttcctctgggaatttccccagcaaagcaccaatatgttaggttagaccaaccctacctagtaggttttcactgtggctgaatagatatggtcaaacaatatctgtggcctcaggtccttacagcagttggctggggatggtcctcattccttgccctgtgggggtctccagagggcagctcacaacagcaaagcttgtttcctgagagcaagtcctggagaagagccagagggagaaggaattccagcaagaaggaagtcacagccttttataacctgacctcagaaatacaacctatttcacctgccctattttattgtgaagcaagacacagtctgctcacaaaaacaagggactgtagaagggtgtgaatgccaggaggcagggatcattaggagtcatttgcaagcagcctactgcatgatgtgtgcatacagtgtgtatccttgcttcacatggcgggcactcagttaatgttagcagcctccctgctctagtttacatggacttttagagctcctgtgctataatggcaac

SEQ ID NO: 13766 - DNA, 1059 bp, Homo sapiens
agctataaacagctgctaatgttagaaattaactcctataggaggtggccacattaatggcattacaggatggccctctcagagagcatggaaaaaggcatcggagaaataagaactttgctctggttatgcctatagcatcaattggtcgttttcatggtttttaaaatctcaacctcatgcaaagttgagggctccctaacaaagcaaaaaaatatttttgtaaaactagtgtttcaaattttagtgattcctggttgatctgtgttaaaattctatagctagaaaagcatttggacagtttctgaatttggagtttatgaaactttgacatacacatagttttcaaagcctaaatccccagaagcttgtcaaaccaaagtagcaattggatcagaattcctcttaaggaatcaccaggtattatgcaaaaaatttagtgtgagctatgtatttaaactctattaaaaattctggaagaaaataattatttaagaacccattagtttttaagactagagagttggattctttgaataatttttattcttcactgatttctttttatagaatacttttatgtttgttttcaaaactaagaagtaactgaagtttagtttttattctgtactggttctttcatcactattactattttatataagctaacgcattaaaatgatacaaatcttgctaatttgattatgtttgaattaccactggattttttactgttaaccttattaactcataaatgggtctttattttttactgaaagctgtgtattataaatgcactgtggaagataggttctgtcccttatagagggtaaagaatgtgtaattctgccacatgtgatagaaaatgtcttatttttattatgtgtaaacagaacagttgcttttaagcagtgctgaatattatatgtatatgtcatatgctaggttcaggaaactgagattatatctaaatatatgagaaacttgtttgttgtctagtctttttgttaggttatctctgactacctctggcttgagacattttgtgaaatttcttca

SEQ ID NO: 13767 - DNA, 1065 bp, Homo sapiens
gtgtttattaagttctttccagccacttggacattcatattaaaatgaaattttaattttaacttgataagtgtaaattacagtgccatatgaaggctcaagctccagatatgtcagtttctgttgtattctttcgttgatacgtttctagaatagtttttaaatgattacagaatgttcctagtgatttgtttgaatatgacttggtagccttggcctatctgtactataaaatttgactctagcctaagcttaagtttgttgatgttatgtttcttgtgtaggtgccaaaaatttactccttttaatattgtcagtattgatatctgtcatctggaatgcaagaatcttcgggaaaatttactaataaatttaatgctaccgccatactgcccagaaataatttatttttttgggtgaagtaccagaatactgtttggtcacttacctagtggcttgaaggaaccagagcatctgtccaagggagccatttagtttcctccagcacttatgattgagccttttgactatctcagaagtgggattggagaagtttgtcttgttctcttgtctcttttccggttgaagtttaggagattgactcattttgaccattttcttgttttgtttttactctaggcagtaactggggctaaagctctggggaggcacttggctgtgcttgctgaagtatttccatagttggactgtctctggcaaataagtgaatttcatttaaagctcgtcaaagctgtgtgaatcttggcagaaccccatagaaaccatagcataaaatttcttttaaaacaactatattattaaatgaagaatttggggtaaagcatattgctttaatggtcttaatactatttaaaaagatccttccacattaatattcaaaatgttttctagtagtggtggaaatcctctgcgtctaccagttcaaaggtaggctttcccagtcttttgggatctagcaaggatcagtttagtcttacctgcatgcaactgttcctgcaagaatgtagatttgaagtttttaataaagttgaccagttcatgtat

SEQ ID NO: 13768 - DNA, 1046 bp, Homo sapiens
taaatctgactcaggaaagacatttatatgtacacaagtgtatacaaataaaagtaaagttttactctattactttccaccccttcatccaaaaaaaaaaaattaggtcaaaaaacagtggtcacattgaaatactagaaatagagcaatttaacaattacaattttttattctttaccagactcgtcacatttttattttataggtagaatgcttaaaagactactaatgtcctaaagatgataatgtaataatactttaaattttaaaatgcctcatagccattactatgcactattttgtagttgctttcctgaggatttctttcacaagattgcttgtctttgtctcctcctagggtcagtgtggtagaggccatataccacctaatgggtgcctcagtaaatacttgtttaactggactgaactccaaggattaagatgtcagtgtatgtttacctcatagatagacatacggtttttgccggccttctagaaatttcacgatgtagtctaattccaacatctaaatatgctgtatcagactcacaacatgttaacacatttttttttctttttttttctttttcttactgttttggcccttagtttgcaaccttcatggctttttatccattttcctatctttgaattatgcatatgtgtcaccttttctgatatgaggaacggaactccatgatgagttaggtgaattataagtgtgaggctggaaaggggataataatagatatggcatgtggttaaaaatggaatacacatatgggatctagagggctacagatacatacatagctatagaaagagaaaaggtaggaaaacagaggtagagacatttcaagagagaactaagattagacacgaagtgatagagtccctttcccaagaatcaaaaagagacaaaaactgtgctgagaagcctcaaaactttaatgtttgcaggagacaagttccacagtagatgaaacaaaatatgttattttgcatgcatacttatatgtatttatcaaaatttttaatcacatttg

SEQ ID NO: 13769 - DNA, 1032 bp, Homo sapiens
ctgctttacccccagcaccaagaatattgcctgccacagtgtaagtattcagtaagtatttgttgaaagaatgagtaagtagaatgcttatttaggtttattcatgcgtttgccaatggttttgtttaccatttcttgcatttcactatttctagattcagtttcatctttgctgaagaatagtagtttttacagccaaggtctctattagtggtaaactaacagttcttttctcaaaatatctgtattttcctgtcactcttacatgatattttagtataaaatactagtttggtagttagtctctatgctttgaagatgacattagtaatagtattttgtcttctggcttgtgttattagtctgtttgttgtttgtttataggtaactttttttctcattggttttaaggttttttctgtctttgtgttaaacagtgtcactgtgaattatttaaatgtagatttatttttatttatactacttaagacttgtgcatcttttgctcgaaaatttttaaatgcttctgatcatattaaacatatttattttgtagtctatagctggcagttctcttatcaaagttattgagagtcatcttgctttttgttatttctggtgagccttgtttgtggtaaagttgagaatgtttcttcagtaagggtttaacaagtcatttcaatatgtggcttgtttggaagaagttgtcactcctgagacatctgtgtttgcttcagccaggtgccttagggatgttacctgcgtaggcccacttttaggcccactttctctgcttaaggtagtgtaaaattgagtcataaatcacatgaggatgggccctttgctactatatctagggggcactttcgcttcactccacaaatgtagaacatagacccaagtagaaaaatgtacttttatttcttctgtctttaaaattctacgcttttaccaaggtggttgtcctttgagggtcctggctttatgtggtagtctcaattcaacttctttgacttgtgtggggctacgacc

SEQ ID NO: 13770 - DNA, 1046 bp, Homo sapiens
catttctctcaggcatgtgtgggtcttcagatacctcaaaagtagaactgctgagtcaaaagacatttgcatttaacattttggaagatgttgataaattgcaccccaccaccccccccccccgcccacaaaagctgttatttatgctgtgaaacattttaacaatgattttgcaattaatcaagatttttactggtttttctttggctgtataactctatttttaaaaacgagaaattaaaatactgaaatactgtcatttgtccagagctacctgaccagaataagaaacacagagagaatcaactgaaagactcttaggacaagccactgctttatttaaactgctaaactatttctcaaactcctggcctcaaactatcctccctccctcctcggccttgttgctgagattacaggcgtgagaaccacagttcctggcctaaactgctaaactatttctctaaagttactgcagtaactaaataagtaatccactgtgtgaaaatgaggaggttctttctcattttgatatactctgtcctaaatggaagtatgtggtagttttttggttggtttgttttattctggggagggtcttttctagcagagattctatgtcaatcttacagaagctgcagccaacagttttggaaatgcaagttgttcaataaggtgtagcaaaaggagaaatgtgtggcccagatactagcctttaggagacaagtgtttggaaaggcagaatggattctgaggatttgccttaaatggaataaagttcaccagttccttgctggagatgatactttatggcaaaggacatactccaaatgtgcttataaatgaaattgtatttatatgctcaaagtgaaattaagctggccgggcgcagtggctcacgcctgtaatcccagcactttgggaggctgaggcgggcggatcatgaggtcaggagattgagaccatcctagctaatacggtgaaaccccctctctactaaaaatacaaacaaattttccgggcgtggtggcgggcgcctgtagtcc

SEQ ID NO: 13771 - DNA, 1049 bp, Homo sapiens
ggaggaagatgaggaagatgaagaggatgaggaggaggaggaagatgaagaagatgaagatgaagaagaagatgatgatgatgaataagttggttctagcgcagttttttttttcttgtctataaagcatttaacccccctgtacacaactcactccttttaaagaaaaaaattgaaatgtaaggctgtgtaagatttgtttttaaactgtacagtgtctttttttgtatagttaacacactaccgaatgtgtctttagatagccctgtcctggtggtattttcaatagccactaaccttgcctggtacagtatgggggttgtaaattggcatggaaatttaaagcaggttcttgttggtgcacagcacaaattagttatatatggggatggtagttttttcatcttcagttgtctctgatgcagcttatacgaaataattgttgttctgttaactgaataccactctgtaattgcaaaaaaaaaaaaaaagttgcagctgttttgttgacattctgaatgcttctaagtaaatacaattttttttattagtattgttgtccttttcataggtctgaaatttttcttcttgaggggaagctagtcttttgcttttgcccattttgaatcacatgaattattacagtgtttatcctttcatatagttagctaataaaaagcttttgtctacacaccctgcatatcataatgggggtaaagttaagttgagatagttttcatccataactgaacatccaaaatcttgatcagttaagaaatttcacatagcccacttacatttacaaactgaagagtaatcaatctactcaaagcatgggattattagaatcaaacattttgaaagtctgtccttgaaggactaatagaaaagtatgttctaacctttacatgaggactctattctttaactcccattaccatgtaatggcagttatattttgcagttcccacattaaagaagacctgagaatgtatccccaaaagcgtgagcttaaaatacaagactgccatattaaattttttgttgac

SEQ ID NO: 13772 - DNA, 1033 bp, Homo sapiens
actgggagagatgtggaataacactgctgcagatgacaagcagccttatgaaaagaaggctgcgaagctgaaggaaaaatatgaaaaggtaagaagtgtgggtttgcttggtaaaatgatgacaagtacgccagatgtatgattgtacttagtttgaggtgtaataagtttttagggtaacagctacattaagtatggtgttgatataagtcctcatccttcaaagaatgcagaggaccaaataaattagggtttttttgactaaaatgtaatcagactcagacaaaggctgtgtacatttatgttggttttgttattccccagtatcttgaagttcatgaaaatgttggtagtcacttcaagtcaaaaatgagcattttcaaatggcttggcatacagtacaaaaacaggctagacaaagtaatataggctatatttttcttagtcatatcctgaaacatttatgttcttttcctttagatactcaaaaaaccacagcatcactaagttaaattacaagtctgctgctctgtccagtaaattaataagattaaggaaatctataactcttatagttcagtaaattgaaatattaaatacttaattttcagctttagtcattctgaaaagtgtttatttctagatgtttcttaacctaattgcatgtttattgacaaattaccttttttttttaagaccacatttcctactaaggattaaggtctgacagtgtaaacctgtagagtgcttttttgcattcagaaggtggcagtgtctaccctttaatcaaagtctctacattctggttttaatagagttaggatgtggtacataattgcacctcaatgaggcataactttgcaaatattagactatgccatttcatgagttatagattgttataatgatcttgtatttttatgttcatttattgaagttctagttatttctggagttgctgtggatctacagatacgtgatattttggtataactagaatcttgatttctttcataaagttctgccatgttct

SEQ ID NO: 13773 - DNA, 1097 bp, Homo sapiens
ctccaaaaaaaaaaaaaaaaagaaaatgctagattcatttgactccttttctttcctctccagtatttatttggtcactttagttatgtgaagttttgaataatttccaattttttacaaattatatggtttgtatgtaatgaaaagcttatcaaaaatgtttcagtttatcagtctactaatcaaatatttttaaacttttaaaattatacacagaaatgtggtcctattttgaaacaattctctcatttttttcacattaaaaagttcaattctgatttctaaaaatcagaaaatcataaagaatttattatggagaagctatcctggtgtacaattatgacagtatttttattttaaatgatactgtccttctaagaatgtgtttctgtcaatttgtccttatctctacagaaccctgaaattgtagcactactgtagtgtttctagagagtaatacgtttctgctgccatttggaggagcctgcatcacagagtaatgagttgagtctgacttacaaagatgcctcctttgcaattcagaccccccagaagaatttgcagtcaaattcctataattaatgagttgtgtcttctagattcctttaagtactacatctaatggaagttacaattataacttaattattttaaatagtagagattctgatggtgtgcttacaccactgaaacaaaagatattctgaaaactgaaagtgaaactgtcagcccttggcatctgtagttaacaaactactcaagagttttgttgctagatatctagataattgtgagaataagccaagagtgtgggaggcttgctttgctcttcagatgaaatggcttaagttttgccaaaatccctgaagggtaatcacggtctcttttaatcccaagtttcagataatacccacaaataacttattctttagagtggtctttggaattagagaaagcagaaatgtattaaaatgtatttcattcactttgttcctgatccttacaccagggtcaacggagtcactaagaattagcaaagttcattggtaagagatttacccttctgatatcttgctctggtgaaatactagaaaaat

SEQ ID NO: 13774 - DNA, 1035 bp, Homo sapiens
gggaactccaaaagcaaggagggagagcgggagggagggggcaagggctgaaaaactgcgtgctgggtactgtgttcactgttgtggcaacaggaacattagaggtccaaacctcagcttcacacaatatacccaagtaataactgcacgtgtatccccggaatctaaaattttaaaaagctgaaacttacaaaattaaatttaaaaataaagatttcatctcatttgctttatcacttatgcacatgtgtgccttgctctcttccgctaatacacgtgtgtgtagatacgtatgtaaatgaatatacacacatttttttctaagccatttaagggtaacttacatacatcatatctgtgtgcctaaattcttaggtgaataattcctaagaaatacagttagcaacttcagcaagtttaacattgatactctactattgtaatccagttttgtcagtcaattcaatactgtcctatatgccattttttcctttcttgcatttaactttagtctccttcaatctgtaacatttccatagccgtctttgtcttttatggcattgatatttttggaagaataaagacctctccccactccttttttagtggaatgttccacattttggatctgtctgattttttttatgattagactcgggttgtagatatctttttaaatgttctaaaatgtggaaacagtagtccattcaaaggatcaatgtaaaacaaaatttaggccacagaaactttgaaataattattagaagccaaattggaaaaccaaaatgtgttgtagaatcaacttcctagaaaatgtttagagtaagatagtttttagtctttcaagtttctatagatgggtggttcgacaactgggttttcaaaaatcaagaaatgtcttggcattgaggtgaacttttgtggctttctttagtttcatcatgaactcgggctccccaaaagccagtggtatctttctgtagaaacaggatttttctttcaacttctgctaaatttattcaacaaacattacca

SEQ ID NO: 13775 - DNA, 1050 bp, Homo sapiens
ctgatctctaccaaaaaaatacaaaattaagctggacgtggtggcatgtgcctgtggtcccagctccttgggaggctgaggtgggaggatcacctgaacctggggaagtcgtgctgcagagctgtgatcacaccactgccctctgtcctgggtgacaggaaaaggaaaaacaagatgggagactgctaatgtgtttctctcagacaaggaaaacaaaacgaggtaaggtcatttgttcttgaggaagaacaattatttagcttaaaccagactaaagcaagggcaagagttctaaatctgaagagttctaaaacatcagtgattattgaagtgttgagtacaacagataataaagccagctggctatgctactcatataaattctaaggttattttaatttttatgcattataaaaatcagtttttcaaagttggaagtttttggaggaaaaaatgacttttaaagtatgaagtttttctcccattcttacacttctaatttagtattgtaaatgaacatgtttttagtcgaactgtaatagttgtctaattttgtgtaacaaatgctgctccaaatctttgtggtttaaaaaacatcgtttattatttgtcatgatctggtaggtgactggaagtttcctctggtctcacctggttctgttcatgtggctgtagtcagttagcagctgggctggggttgaagggtctaagtgggcctcagggacatgtctgagaccatggggctggtgtccccgatgacatgtctgaggctgtggtgctggtgctggtgtccctgggtgacatgtctgaggccgtggtgctggtgtccccggtgacatgtctgaggctgtggtgctggtgtccccggtgacatgtctgaggctgtggtgctggtatccccggtgacatgtctgaggctgtggtactggtgtcacctggcttgtacgctcgtacatgtgcacgtcctgttcacccccctgccccgagtatgctctcttccttcatagtctccccagagtttttcttaacatggcaacaggagtgttccaa

SEQ ID NO: 13776 - DNA, 1055 bp, Homo sapiens
acgtatgaggccaggctggtctcaaactcctgacctcaagtgatccgcccgccttggactcccaaagtgctgggattacaggcataagccaccacgcccagccaaggattgtttcttgatgcttttatctgtttggcataaattaggtccaggcttactgaagatcgtgtcccaaaatgtttgagagatactggcttagacaattgcaattgttcattaaaaaaagaaacaaacaacaaagcataccttttcattgagcattggactagaaactgacttttaaccctggttgcatattagaatttctcaggggctaattgtacaaaatactgacacatactctcagagattgatgtaattggtctgggatgggacctgggcatcaggattttaaaagcttcccaggtgagtccaatgacaaccacagggctgttgactgtatgtggggtgtcctgtttgataactgatgtctcagtgctaagaatttgaagtttccttttcaaagcactgatgatctattctgtagataaacggatgatagactcatccatttacattttttctgtaattatccttttcacattggctatagatgttcaagtatcacttacatatacccaacttccctatacctctcccgcttctcacaggaggaattttgggattgatgcaaaatggctttctgcacctttctataggttttgtacatgtttaactgacttctgcattaatcactgaagctttgagtcccactgagaataagcctctctgtagccgagtgaatgaaggcagctgagtatcttgctgtagttcactgttggactggtgctttcaggggctgcttccctgcatcaccaccacccctcaccccccaacatcctctgcacagacacgtacatcgtcccccgcgtggacacatacacaatcccaggggtttcctatcaatgtgttcctttttgcttctggctcttattattaataaaatacagaaaagcatggagaattgggaaacaaccccttcttgcactcagtactggcccagctgagcagggaag

SEQ ID NO: 13777 - DNA, 1019 bp, Homo sapiens
gaagttacttaacctctttgaaccattgtcttccatgaagtggagattataatttctgtcttttaacactgttgtgaggattgaaggaatatatgtaagtacatagtcctaacacatcctggaagaatattaatactctattttggtcagaatgtaaactgtggtttggggcaagtgtaatgagaaaatgtaattattttatgtgtaattggagttggtagaaaaatagtgggttgagtatgtggagaagcagttgaaaatgaactggatggatctgagttaatctgataactagtttttgttttctttaggaattgaacaacacatgtgaacccgttgtaacacaaccgaaaccaaaaattgaatcacccaaactggaaagaactccaaatggcccaaatattgataaaaaggaagaagatttagaagacaaaaacaattttggtgctgaacctccacatcagaatggtgaatgttaccctaatgagaaaaattctgttaatatggacttggactagataaccttaaattggcctattccttcaattaataaaatatttttgccatagtatgtgactctacataacatactgaaactatttatattttcttttttaaggatatttagaaattttgtgtattatatggaaaaagaaaaaaagcttaagtctgtagtctttatgatcctaaaagggaaaattgccttggtaactttcagattcctgtggaattgtgaattcatactaagctttctgtgcagtctcaccatttgcatcactgaggatgaaactgacttttgtcttttggagaaaaaaaactgtactgcttgttcaagagggctgtgattaaaatctttaagcatttgttcctgccaaggtagttttcttgcattttgctctccattcagcatgtgtgtgggtgtggatgtttataaacaagactaagtctgacttcataagggctttctaaaaccatttctgtccaagagaaaatgactttttgctttgatattaaaaatt

SEQ ID NO: 13778 - DNA, 1046 bp, Homo sapiens
aattatggtgatctggtaataaccagattgcacttcaaggtaattatttttttgtcctgcttccacagtaggtattggaagctaacttaaatagtgatgttgtgtgccttggaaaatgacagtttgtaatcaaacctttaagattcatggtcagaaggatattgaaaaatttctgttgttaactatgaatcaccgtatgttttgtagaactttattttctgtacaagttacatgtaaataattagcctgctcttggttgtttggtttctcttatattctgagggtagagttttttatcctcaggcaaattacagaatctttcattgggtcaggataggtttctatactatgtaaaagtttccagtttttaatttttctgtcccctcattgatcctgggggctcccaatgtgagctatgggtcctgactctgatttctgaaagctgctctctgttttctactgttaagttgtgtgatgatggtggttatttggaaaaatagatgcttagtttcaacagcacactccttgacttgggatgagcatacacatcaactcttgccgatagtcttagtacctgtctagaacatgacattgggtaggatctcattcatgctccttagttgtaggtaggaccactagtctcaaaccttttggagcatgattactcacccctttggagacggttcctcatccattccatgttgaaatgccattttgtgatgctggttttgtcagtagttggtttaattgggtactatcaggttgtcttgtcttcatttaacttccgtacatgtgctgttatccatttgtttcccaacatctgttgctctccagtgtcttcctaggtgtatgtttgattggattcatttttctttcctgtggctcatgccctcagagcatgcataatgtattgaaggattgtgtgcactagcaggaaaatgatgtggggaggactgtaggctgactgcctagctcatccgtagtgatacagcttatggcacttgataggtgatttctaaggaacactgagatcagtctctggaacg

SEQ ID NO: 13779 - DNA, 1027 bp, Homo sapiens
ggtgaattgtgactaaattctgtgtaacttaatttgaagtaactagtatatgacagagtagatgatgttttattgagttgggagttttttggttttttgaagacatagaccacacattgagaagtcgaatgttgactgacgtttaagaaacttaaaaaacagactgctacaaaaactgtttgaaatagctaccaaatattaaagttttttaaattgtatggcaaaattggctttgatattttagaacttgtttttatttttacatggttttctgtatggtgggaggaaggaagagaagtgtctgtgtagcgtatagtaagagttgttattcatcattagcatgagtgctagttctgtgtggtcaacagaagaattttaggaagctaaagtattacaataattacagtttatttctagggaataactagaaatagcttaagagggaggcagtgtggtgttttagttaagatgtgagaaagtgcgttatctagtgatcactgttacctttctagaacatctaagcaacataaacattctgaaccgtagttttattctcatctagaaaaattctaatgtacagtaatgggttaaatgatgagtgccatatactttctcaatctctttagtaccttttggatatcaggaatgccttgtttctaaatacttcagtgtctatcttagaatcttgaccttagaagaaaaatatgagagagttcagtgtggacagaaagtagttaacctagagtatttcagccctcttccaaagatgggtaaagatcaagcaagcactaatatattagggattgagggctactaaaaaagaaaattaggaaactctagggttcattcttctttttctttaccaaatttttaattaggattgttaatgtgtagcatttattctttactctgagatcttttaaggtataaatagctggatcacagaaagtggggacagagtgagtcttggctgtctataagctgaagtgatgaatcccgaaataactgataattggccattttatgt

SEQ ID NO: 13780 - DNA, 1045 bp, Homo sapiens
caagtcagtgctgtaagaaacctcagcccttgggttgtttttactcttaggaaaattgaaaggctttgccaaaaagtgattttgtaatcttaacaggttgactgaattaaagagcacctcagtgaatagcagaactgaaagggtggtggcatatgttagaattagctctttaagttcctgtagtttttacctatagtttaattatgttgaacattaaatgttgacctagcattataatttcctaatgccagtagaaacttacaactagtttggaagcagatttgatctgctttaatttcaagttttctcttagatttatgtaactttgaatatgtcttatgaaactcctgattaatttttatttcagcttgaacttggttataagaaagactattttgatcctgtaattttgggacagccttttcaaaagtagttactgtttctgaaggttaaggagcttgcagaaaactaaagccctatttctgttttgtgacttggcgaggcacctacttagctggactgttgtgaatttataagtggtttgtgaggaatttctaagtatattttgtgttctagataattcaaaattttttgtttgtttgtaggtcccctccttctttacagatgctgagaggcgatctgtgttagatgctgcacagattgttggcctaaactgtttaagacttatgaatgacatgacagctggtaaggaaaaggcatttgtgtggaagtgaatatactatcagaactaaagatgttctcagtgctattactttcttatagatacagaaacacagcctgttaaaaagtcaagtcagatttgaaaacaaaagtctacctcttaaaatgcttatggttaatgagaaattggtattttatcaaacttatgaatctgctttcattagagaattcttttcatgttttttaatcctttgaaaatgtaggttggatttagctttgtttccttacattgcatttatagttaggaagcaatttttcccacaatcttaaaattctgggcttcaaaactaccttggcttataag

SEQ ID NO: 13781 - DNA, 1035 bp, Homo sapiens
tccatttccatggtggctgagaaggttgtttcacagttgtaagtcactttccatctcttcaaaacagatttgatgtaactgattagtcactcctttccctcgacatttatattctgttttgccatggtacttgttgtgcatcatttttttctttctccggcagaatctcccagatgggaacctctttgtgctctttaaacttcagaggtgtaacttgggttcatttgcttgcgtttgcataaaaacttttgattcctaaagaagccggtggtatatcagaacaaaagtcggtatgacaatgacatttagatttgtacagagttggtgactgaaaggtagagtcacatcctattttttgttagtcgtgtgtagggtcaaattaataataccgttaacatatttaaaacattttcaaagttaatgttcggttcataataactggaacctggagaattcctgagccacgagcagaggtttttggggtagtagaactgccacctaggttggatctcagagcagcaattaagtggaagccccctttgagtatctgatgaaagctatagaccttaaaattgtgctatgcttgttccctatcccctaatgggtaggacatttatgttagtatttttctcttatcagtttaaaatatcaacctttatgctttttaattttttggaatatatttttttctaggtcagtcatatcatttggatcaaaaaatagaacaatcggagttgcagccaaaaatcaggtatgttctttaagagaattcggatcactttttaaggggggagtttttaaaaggaaaatctcaagagacatataagagggtaaagtgtgcctaagtttatgtatttttgagttttaaaaatgtaattcaagtattctttatgaaccttcagatgatgacactctttcctttctgttccctttcccttgttttattaagatcgactttaactttctaatctgccatccttaactttttttttttttttttttttttttgagatagagtctcgctctgttacccag

SEQ ID NO: 13782 - DNA, 1013 bp, Homo sapiens
agtaattctttgaaatctgtggaggtctagctttatggcctagttaatttctatagatattatatgtgagcatgaaaagaatgtgttttcaccaattgttggatgtggtgttccatattagtgcactcaatcattattatgctagttaaacttctgtgtctttgtctcattgttctatcaattactgagaaaggtgttttaatctctgagaaagatggtgaatttatcactttgtctatatatggccacttagtttaaaaaaatttttttccacttccaatcatttgcaattacattaagtaaattacatttttggagaattttccagttcttctaactcaactgtttgttttaagtaaatcataagtatcacattgccacattctactcttgaattgcatcgtgggagtctcagtgaaatttataagattgcttttgttgttgttaatacataataaaaataagagctgccatttatgaagtacccactatgtgtcaagcattgtgctaggtgctttatttataattaaagccctcgtctctaacatgattgggacagaaagctggttagttcattgaaaaaaattgtttaaagaattattatgaaatgatacatactttaaacattttatttgaacttaaaatacatgtttttatatgtatttattcagcaatttttatgtataattttgttcagtgcagtttaacttttttcatgcataaaccacatctgtaatgtgtagtcaagaatttctagtttctgttgatataaattggaagtagaacccaaagaaatattcaaagcaatatgagtgcataatcataggtctttattattttcaaccaaattttatagttatgctgcctatttaacagctgtttagcacttcatgtttagtgagacaaactacataattatagtaaaaactattattggcataaacagacttgcgaataaacccatctgactccttataaatatacagttctaaacagtgacagcaaaagggtgc

SEQ ID NO: 13783 - DNA, 1035 bp, Homo sapiens
tgccactgcactccagcctgggcgacagagtcagactgcatctcaaaaaataaataaataataaataattacttcaagatatgaaaacattgataactagatttccttcacatatttatcttggcatgtagagtacatatggcctatgttaccttttcaataatatcataacgttcttttttattttttttttgagacaaagttttgctcttgttgtccaggctgaagtgcagtggcatgatcttggctcactgcaacctctgcctcctgagttcaagtgattctcctgcctcagcctcctgagtagctgggattataggcacccgccatcattcccaactaatttcttttttgtattgttagtagagatagcgtttcaccatgttggccaggctggtctcaaactcctgacctcaggtgatccatccacttcggcttcccaaagtgctgagattacaggtgtaagccactgtgcctggccaataatatcataccatttttctaccctttgaattctgtcttgtacagttgtactcgcttttttgtacttccgaaatcacccattatattcattctcagttaaatctctatacacaacacagagaattctcagaccttctgtggcaaaatattccagatgggttaatgtctcctgaacaaatagagaatcttctgaaagtctctcataaatcactctatcagcccctttgcagtagagccagagccgtcccataagggttcagacaattagagacattctttttctattactagagaactccaggacattaagaatttcaaaagcatttttctcccgtagcttctgtggtgacagagtatggtgttcttgtataaagaacaagccatattcttttgctcctttcactaaagctgctttggctggggaggaagcctggtagattatattatttccatctctcaggaataacagtgtggcacacagataacagggtaagaaattgcgttatatagttttttgtgggatgaccattctcaaagttctccaataatttg

SEQ ID NO: 13784 - DNA, 1049 bp, Homo sapiens
ttctgaacatcttttaaaatctagtttacctccttttccaactgttcttcatttacttcaggaactcttctgatttcctttttgtgtgggtaaaaagtaaatgactttaatcttatttgacaagaataataatcatgttataccattttcagtaacaaacaaaataacaaggaaggtgagaataaaggaaggaaagaaaacaaatgacatatttctagtgaaattttttgaggttagcctgtgactataataaaattattttgtagcagtgtaccaagatgtcagtttgcacagctctgtagaaaacaactattttgtaagttgaaaattttctgcattctaagtattctttataaatgtgttcttatgcttttaattttatggctaaaggctattcattttgtggcaataatttagttatgaggttatctaagtagaaataattcaacatattctaacagtatttcatatacttaagatgaaggcaagattgtattttctagctattttttaaaaagaattacagccgggcatggtggctcacacctgttttcccagcactttgggagactgaggcttgcggatcacttgaggtcaggagttcgagaacagcctggccaacatggtgaaaccccatctctaccaaaaatacaaaaattagctgggcgtggtggcgctgtgccagtaatcccagctacttgggaggctgaggcaggaggatcctttgaacccgggaggcggaggttgcagtgagccgagatcacgtcattgcactccagtctgggcaatgagagtggaactgtgtctcaaaaaaagaaaaaaaaacctaccctagatccatttttaagaagcaaatgactttattaaagatgaaaaacctttagctatattttttcaagtttatgtttgcagttaaatgcaactaatagcacatgatactgtttttcttatttttaatttattttttatgtatttattttttgagtcagggtctttctctgtcacccagcctgcagtgcagtggcatgatctcggctcgctgcagcctt

SEQ ID NO: 13785 - DNA, 1063 bp, Homo sapiens
gcaagcatttaacttttgatcagtttttccttaaaatactttacttggcttccttgacatcatggtttttgttcagatctctgtggttatttctgtctcctttgctgccttctcctcttggtccttgaattttagaattcttcaaatttcagttctagacaatcttctgttcttactcttagctttccctatgtggtctcatcatttctcatgtggacatagtagtctccccacttttatttttgccaccttacaattttatccacagagcagctagagtagtctataaattctttttaaaatacgtaaaatcactcactgcttagacactacataatctagtccttggctgcttctctgaccctgtcttataccagtctgcatttactacagtccatctatactggcctctttgaactgttcttcagatatgataagcttgtccttgctaaaagctctaactgttatttctgcttggaatgctcttctcgtctactcttcctatgcctagcattttcttaatgtttaggtctcacctgagatgtcactttcactgtagtactagtagttgatgttactactgattcgttggcagtattcctgaaatagaatataggataaatgaggacatgtttattttgttcacagctgtgtccacaaaatctaaacagtgcctgtagtactgtaggagctcattaagtagtcggctgattgatttttgtacctaatggttctattaacaatattgacccccaaatgtattttcttcataaccttctcctctgaactccagtctgtatatttaactgtctacctgacatttccacttctaagcttaaaagctcctccaattgaacctgtgatctctttaaatctgggactccaggatttcctgccacagtgaatggatttaccttttatctatctctgtaagctagaaagttgagagtcttcttcaatgccttctttccccctcatattcaatccatcaaatggattctatggactttgccacctgaatatctcttgaatctgttcctacattttaaactaccatcatttg

SEQ ID NO: 13786 - DNA, 1090 bp, Homo sapiens
aggttaaaaagaaattccagtgaagagttgattccatctttatggtatctttattttttaaggttataaggtatgttgatttatcaggaaagttaaatgaagaaatcttcaagaggccatttataattctgtttttaaaagtcaaaattgaaaagagttgggccaggtgcagtggctcacgcctgtaatcccagcattttcggaggccgggtgggtagatcacctgaggtgaggcgttggagaccagcctggccaacgtggtgaaaccctgtctttactaaagatacaaaaattagctgggcgtggtggcatgtgcctgtaatcctagctactcaggaggctgaggtaggagaatcgcttgaacctgggtggcagaggttgcagtgagccaagatggtgccatgcactccagcctgagcaacagagtgagactccatctcaaaaaaaaaaaaaaaaaaaattgatagagtttatactatttaatgtttaaatgttttctgtaaattaaacatcaatagacttgataatcatattttaggaacatttttttccattgaattatttacatatactgttgtactgtaaggctttaaattaattttaatattttattattttaattagcatttgaaatgtatagtgttcaataaatggattgctaaattatgttaagttggatttttttaaccctaattaattttcaggcagtatttcctaaaataagtcaatactacttgtaagtggttttacttacttttcttttatgtccacttgttacgtaagtatgttagtagtagacatcatggaaattacataaattttccgaatatttgaagaattaaaggagctttttctctataataggaactttttattcttttatggaattttaaattaattttctgaaagaacagtaaaagagacagttacttaagtttgctttgtaaataacttaaattttacaaggaaaatcttgaagtacagaattcttactgttgggtatttgctttattttgttttagtcaacttaaaaaaattgaagaactgggtcttgtttggtttctcttaattccttaagagtagtttgtgt

SEQ ID NO: 13787 - DNA, 1695 bp, Homo sapiens
ggccttttttttttttttgagacagagtctcactctttgctcaggctgtagtgctgcggcgtcatcttggctcacagcaacctccacttcataaggttcaagtgattctcgtgcctcagcctcccaagtagctgggactacaggcgcataccaccacacctggctaatttttttatttttaatagagatgaggttttgccattttggccagggtggtcttgaattcctgacctctggtgatccacctgctttggcctcccaaagtgctgggattataggtgtgagctaccacacccagccttgtgacagtgattcttatctcatagtgcaaaagatggcatttggatgggagataatagttcagaaaagttccattctacagcaactcacaatttgaggaccatagttctaagaaatatccacaaagtcagttgaactatgatttttagctacttggcatataaagttttgctggtaagtaatgacttaaatccataacttttcaaaaacataagccttacttcaaaagcattatttgtacattgtagaaaattagaaaatacagataatcatctgcggtaactttcccaaaaaagagaaaatacagataaaatattaaatgaaaatattcttaccacctacaggcgaccaattttaatatctccataagtcttccccagctctatcttttgacttaaataggatcatatttaactattgtcttgtaacttgccattttcatttaataacctccatccttccgtgtcaaaataatttttcacctcttctcttacttagtctatattcagatgtaaattgttcatctcttatatttcccataagtgaaagttagtcctagacttgaagcctttattagctgtaagttcagcaaaatgcctttcagagccagtttgtcaaagccagcatccagtctggagaatgcacctggcatatggttgtgtcctttaattccctttcaatctagtggagttctttttttcatgatactgactgaagagattgcacagttttggttttaagtacagagacgtagtacatttcttaataataaatgtttaacttttgtgtgttttaacctaatttgtttttttatttttaaatttatattttatttcagcaaaacaagctatcgatcagggaagatctccagttataatagataacactaatatacaagcttgggaaatgaagccatatgtggaagtggtaaatatgaaacatgagaaagtttttattttttattcttgtcaattttttcacattctaaaattttggctggttggatcttgattattaaaacatttgtcctttgttttctaaagaggtttgttggtttgcttagtttttaaaaaaattgtgaatgatgttttttaaggaacatgttcatcttgttaatttttgtttgtttttttgagacggagtctcgctctgtcacccaggctggagtgcagtggcaccatcttggctcactgcaagctccgcctccccagttgaagcgattctcctgcctcagccacctgagtagctgagattataggtgcctgcccccatgcccagctaatttttgtatttttagtagagacagggtttcaccatgttggccaggctggtctcgaactcctgagctcagcccatctgccgtgctcagcctcccaaagtgctgggattacaggc

SEQ ID NO: 13788 - DNA, 1028 bp, Homo sapiens
ttttctcattgatattgctctacaagaaacctacttaatacattttttagcggacatgggtcaatttctgtttatcattaataggggttcttaacctgggctacacttttgaatttcttggggactttaaaaaaaagcaaaaaaaaaaaaaaaaaaaaaaaaaaaacagacaaaaagtgtgcctggcctcagccttagatattttggtttcattgatctggggtggggcctaaacattgatactttttgttttgaaatttctccagacgattctgatgtatagtcagaattgaaaactgttgatctgaactataagtaaatacatatgctatgttattttaaaagaatggattgatgattaaacaaatagcttttattatgaaaaattttaaacagattaaagagactgtaatgaacctcatagacccatcacccagaattatcaggtattgagattttggtatatgggcttttatctttttgtttgtacccctttctctttttaaagcaaattctagacatcatactttatacatttcaaaataacttttttactaatcacatctttcacttcagtgccgttatcacacatttaaaaaaatgccagttccttcagatcatgtaacccagtgtgtaattgaatctcctctgttgttcgaaaaaatctcttcacagttattttgtttgaattgggatccaaacgaagtcctcaaaatgcattttgttttatttaattaagttaatccatagcatgttccttcttttaactctcataccattaacttgttgcagaaactatgttgtttgtcctgtagaaagttccacatgctgtagttgtctatttgcttcttggtgttaaccgtttaacttgctcctcttctttgttttctgtgaatggaaattagctctagattagaggcttgattaggttcaacatttttttttttttttttttggcaagcagatatttggttgtcctgttcttagtaatggtgagcttaatcagtagctgcacagggacaacctct

SEQ ID NO: 13789 - DNA, 1028 bp, Homo sapiens
tcttgtaggccttgttttgggaacagattctcttggtttacttgtttcttacgtgagaaattataagtatagagtacattgattactcaaggctgtataacaggttaccctaaaacttagttgtttaaagcaacaaacatatattgcctcgtagtttctgtaggtctggactctggttatagttacctgggtgcctttggttcagtgtctctaagaatgctgtgatcaagatgttggctaggactgtttctggtctgaaggcttgatttgggaaggatctggttctaagagctctctcaagattgttgacaggactgagttccttgtgagctatgttggattgaagacttcagttccttgctggctagagactggaggcttctctcatttctttgctacttggcctctgtccattcacaagacagctgatttctttcaaagtgaaagagaaagcatgcaagctcaagtctaagacagaagctacttttttttttttttttttagtaatctccgaagtgacatcccatcacctgtatcatattctgttccttagaagctagggactaaatccaagcatactgcaggataagaggatgcaaggttgtgagtaccaggaggcagggatcattggaggcctttggttttggggtcaaggaggtgctttatcttagttctcccactaccatctaacttgccaaaattatttcttctcctggattagtttattatcaaattggcaggcttttatgaggattaaatgaggtcatagatttatgtaaaatgtttgacataaaataggctctcaaaaagatagctattgttttgaaaaaatagaaatcaagtggccaatgagcccagatttgatttttttaaattagatatttgacttactcacatttctaaattttgacattctgagaatccattttagtacctgacttgagagttctgacagtctaagaattttgaaaatactgatgttcttaaataatttatttttgctttagaggcttgataagacattcaga

SEQ ID NO: 13790 - DNA, 1057 bp, Homo sapiens
ctgaattggtgttagaactgttggtggtttattgtattacaagatatttcaaattcctttttttgtttacatttttaaactattgatgcacttgaatatgtttatgcagttgtgaaaaaatagtgtaaagaaagcagtacaaattatcttgagtttatataagatgattcaagatttgtgccggacaaggagaaaaagaaaatttgttgatatctttgggtgaggatggagaggtccaagaaaccattttgcaaatgttttatattactaacaagacaatctaaacctaaataaacatctttttcagagaaaagacactagagaaagatttaatttgtgatatttcaagctagattataaactgtgatctttgtgaatgaattaattcattccagaattaaattttggtctttgtattttgattccttttactttagtgaggattttgtagagaagatgaaatttcacctctataataatagaagttaggagtgaggtctcacaaacatgggctgtcttctagatttgggatataccatcagagacaataaataactgaaatttggaaactggataaaagagtctgctagttaggaccacttgactaagagtgggtatagaagaaacctaaggaagaaaagttagatttgagacaacatattggagtatgttgaaattaaaggtgaataaagtagtggaaattcgatagaatttaaaggagacattgtagtgggagatggtagaggtgattagatataatatgtatatttatttgaaaaatagatatataagaatgaaagttgtatgtagtaccaacaagtaccattcgtattatgattcacaatttacagagtattttcatatataaaaatcttgtgcaatgggttgttttttcattttatagaaggagcagaggctaaaggaagttgaggttaagtgatttggaagttacaaaaactagtaagagctcaaactagcaataaaattatagtatgtttttcccttgccttcactgtaatgcttaatggttgtgtagtcttatacgtgactcctgact

SEQ ID NO: 13791 - DNA, 1063 bp, Homo sapiens
gtgttggatgggtaatgaaaatatttgagtcctacccatctggaggagggagaaggatagaagagtcaaagacaaccataaggctttaaggcctgatgattgaaagaatgtggaaattggaggggagaagggttcagaatccacaggaatctgaatttgaggtgccaggatcccccatatgattgcaaattatccacacttagaaattcagacctagaatcatccccttagagccaggaaaggggcaggacccgcagcagcatggtatgtaacagaaagctaaaagagcataggatccaaaacaaatgctgaatttaggtatttgaagcgtttttagtaaataataataataataatggacaggaagtattttctgatggataaaagaacaagcggatagaaagggaactgagacaacatatagagatgacaggcgactcttcaaaaatgatggctgggaaaaaatgttggcatggaaaagaagcttagtaatctaaagttaaacaatgtatacacactggacaccttacctagagcagcatatttaaaacaattctgcagctcaagcaaaacttgttacacctctcacaagcttcagatcattagtaccatctgtttctcctccaccctaagcgagagtaagaaaatgggttcactctaattttaacaaaacggctcttctctgtaaaccccaggtatatcttgtgccagtacacaatggacatggtgggagtggagacgggtttcagaccactgaaggcatgctcaggcttttctaggaacttggatttgctaatcagggccatagtgtggtcagccctggcatgtgacgtcatgcctcctgcatgagactgcaggcgaatccagcatcgatagccccccaggaccacaaagcctggggccagccaggaccccctcagaaggtcacacctcagcccttctggaacagccagctctgagtttgtttttatcatgcactcctgccagtagcaaatatctgaatgtgtatttatgtttagtaatataaatatactggatgtactctaatgtactatgcacatta

SEQ ID NO: 13792 - DNA, 1027 bp, Homo sapiens
caagcacggctggacatggtgcgtagcacattcacctaggaggggatccttggctctagagctaagtgtgtgattgcagaagcttccatgtttactttgtgatatctgaaaaacccattcattgccttcactgatgatctcctggacataaggcatgagctctgccgtagcctcgatgcagtggaccctacaggaaacattgctctatttgtagttctcagttggtttccagggaaggcagtcaggctccaagaaaggaaaaagagacaagtaaagggtgattaattgtgaacagaggaaataaaaataaacttgccataaaataatcctggcagtttgcacagaaacagctgtcacttgtaccttctggcctgatgcaaagcttaccacttagagcattgattcattcaaagagcatttaattcttcaaatacatttctgcttttatttcattggcaaatagaaacaagaatatgcagtaaaccttgtaataaggaattgacagaagcatgttagaacttgaatgtggacctattgtagatgatttggtgggtttgaaaaaatacaaaatgtgtcagtaattgttctatgttttatattatacatatttaaaaaatcaatggtgcttttatgaaatattttagaaggttataaattcatggtcaaatcaatatatgcttctgtattaaaatgtcctttgaaaactacaactggctctagaaaagtaagatagagccaagaaatattgttcttcttttctcccttccttttcctccaaccccagccagatttcttcttcctcttgtaatttttaatttgttttgttttgttggggacttttaagtgttcagcacttgagaaataagtctatcacagttaaattggaaagttgtccacttgacctgaaaacagagctacaaatacattctgggaacgtgactcatgctgtttagtagctagagatagcaagcaggcaagggccacacagagcacagcagtgtcctgtgattaatgcagagagaatgtt

SEQ ID NO: 13793 - DNA, 1060 bp, Homo sapiens
tttccactaggaagtgggttcttgcactaacctgtttggccctatttgtattgcttttagcttcctgcaagtaatcatgtctgttctctggctagctgtctgcctcactagtctatagagtttggggacaggcttgaggtatagtcaggaacagacataataggttcaaagataggggattttgctagtatatattattttgtataaaaaatgattttatatatatttttaatggcctcttttgtgatctttttcaaccaggtactcaggatgacttttatatgcctaagctttcaggaagaatgtgtaagaagatacaaaatcagggaggagattgaggggaagagagagactttatattcttgttattcacttctctatgtatatttcaggtgtttgtattgcattattaaaaacattagcaatgttttaaaaaatgccttgccttgcagatgctaatggctaacatttagtgagtgttcattatgcatgaagttgtgtgctaagctctttacattgatctcacttaattttcataacagcctatgaataacaggtgttgttcagaattgagggtgagctgagtcctcctggtttgagcagctgggtggcagagatacccttccctgaggtggggaacaaccatgaaggaggagcgagtcaggagggaagatagggtgggctgaggtgttgggtgggtgaggtgccaatgtccagtgttcagtagggtgcccggcccggagctggggatggagatgtgaagtcaccagcatgtgaggaggaaggccctgagagtgcatgaggtcactcagggacagctgggacagtgaggagaggactaagagtggatgccggggaatcctctctacgggcaggcaggggaaggggaaggaaagaagccccaagtgaaaagaagccccaaggaaagaagccccaggggaaggggaaggaaagaagcctcagtgtgagtgaggggtgggctcctgagcagccggttcccgcgcggctgctttgctcagccttcagttcttgaccctctctcagaaatcgctagtcatga

SEQ ID NO: 13794 - DNA, 1023 bp, Homo sapiens
aagtacatagaccgaaacacctggagaagtatttatgtcctaacaacttagcagctatttttaaaaacacccttaaattgaaagaaaaataatattttatttcattaataataaccacaattacttaataatgagatgtctgcactggctggacactgcacagtttctcaaacctgggaatcagatgggttattgccagccttattttctgttccacattgattttcacatagcacctgctttttatcacagcatctgccaaaaatccagctagatatggcctcatggaaaggaatgttgttgacaggacctcatgttgaaagcaggaactactttggactagtagtttgctcagtgtctgacagatgtccagtgttgcttgtgagcctctcaagaatttaaaaaatatcccaagcctcctgtgtgagtttgctacagtgccccagagtgccctggtgcacatttggggaactggggactcaagcattcctgatgctagtttgaagacgccactttgaaaaccactgtactaatggcttcaagagaccagaggaaggagttttctgaacatttttacattttctgtgataatacataagatccttaaaatattgaacaggaagaaatgcagataaaaacatacaaattcaccactaatgactttttatttctatagcagaagaactggatatggaagaaatcagagaaggaataaagatatcagaaggagttgtatgccatcattgttatgaatagtttacaaagcaattttttacaaccttctaaagtcataactaattaaacctggcaatcccagtgagccaggtaacaattattttccatgctttacacacaggaaactgatatataagattaggtgacttgcctcaggccaaagagaggtagatttgttggaggcagaatgctaaaatcacagtatttttgctttcatcaaaaaaagttataagaaactagactaacatttcataacattaaaaaagtccctcaaacttcatagttaat

SEQ ID NO: 13795 - DNA, 1048 bp, Homo sapiens
ctttttaattaaattttattttccatttatacatacatgactgaaattgcctagaaaaatacctttgattcagaactaaaactgctttatcatagcttttgttgtagtttaacattaataaaaatgcagtttttattaatacaaaaactgcattaatatcaattacggttttattctattgtgttgaatacccaagttatttcttagctagattttaaacattcactaggttccttttactcattccattgtttctatctttattgacctccattagtgctaagaattaacttagatctactttctatgaatagaggtctgttttgacacttaatagattgtagaaatcaatggccctgaaatagtttacaaaacaatttcatacctgtaagctcatggaatcctcacaacaaattcagaaatatgacagaacacagtttactcatttataatacaatcttaataatggcaccctacacaagatatccaacttgggaagtgataaatgaaagtatctctgtttgcagatgacatgatcttatatgtagaaaacaataaagactccaccaaaaaatggttagaactaataagcaaattcagcaaagctgcatgatacaaaaccaacatgcgaacatcagttgcattgctatacatgaacaattatcaatctgaaaatgaaattaagaaaacaatactacttatagtactatcaaaaggaaataaggatacttaaggataaacttaaggatccttaaggataaaatacttaaggataaacttaaggatccttaaggataaaatacttaaggataaacttaaggatccttaaggataaaatacttaaggataaacttaaggatacttaaggataaaatacttaaggataaacttagggatccttaaggataagatacttaaggataaacttaaccaaaaggcaaaagacttgtacattgaaaactgcagacattgctgaaagaaattaaagatacaagtaaatggaaggaaatctcataccatggattagaagacaagattgttaaaatgt

SEQ ID NO: 13796 - DNA, 1050 bp, Homo sapiens
tcaatagaattaataaaatttttaaaaagatgttgataggggtatgaaacctattgaaatatgaaacttaaatttaagcaggtgtgattgttgaaacaaatggctggttttagaagatgcttgtctgttcctagacatacagacttagacaaagatacagccctgagaagctcaggtggactagagatgtgtgtgtgcctgtctggggtacattaggtgcatagaaagtgaatgaataggtaacgttctagccaaccctgacttgatggtagtgctttcctcttttgtgaagcaacacagccacttattcatcttaagtcacttctccttacctctctttgatgcgcatgtcttaaattataaccctgggatttattatcttttgcttcaagagacagacaaagcatttatgtctatgaacacagtgcagttgcccttctacccacacactaaaaaatgaattaaaaaattgccaagcttgagcttattcattacaatgtttctctggataacaggcccaccccatcccttcctgcacccttcaaatatccttacttgtacggtgaataaaatgtaattttattgtccttaggctatatcattcttctgctcacagtaaccatgggcatgcatttaaaagtagaatctggcctcttgagtttaccagttaatttaatcaactccctataaattactttacaaaaaaggttgggggagaatgaaagaaaagaaaatctattttagaaacaaaaatgtatctgtgcagctttgttttctcatggaagacaaaggttctttccaataggacagaatgacagttccacttatcttggctgcacagaaattagatcagtaacatattttctgttgaagaagaaaccttatcttagtggctccatttcagaatcaatcatctgcatttcagtcctgccccttctcacaagcagggaacattatacaatttgtatgtttcaattagtttgccataaaaaataagtagctcaagggcattagtttattactggtatccagccatgttttcttttgcta

SEQ ID NO: 13797 - DNA, 1044 bp, Homo sapiens
caggcagttaaataggattaggatgattttcaggctcttcttccaaaatgctctcccctttccaatttccggagtgccttttcggtgccgtgtttttccttccctgtctctcctgtgtaatagtgaaaagagtgaaaatagcatcagcttggagatgcacaaaggctctgcacttgcttgctttgtgacttctgtgaatcttagcctcctttccatccaatcagatacctccagtgatagctgtggagattaatgttaaaaaacctaaaatgtgaagccatgaaggcttcagacctggcacatagtaggtgctcaatgctgttcccttctctcctctttcctttcccttctcttttgctgtctttggttctcagtaaccatctgtttatctcactcctgaaatagtcttactgaagatcacaattgatgagcagattaggagggaagaaaagtaggtgaaaactgaacacaagtgccatctgttttcctcatttttaaaggaattagagaggaagagatatggtgtcagtcctggaagatgcttgtgatttgggcactctctccctctttgattccataggacttcatgcactcactggagaagaggaccagctctctcagttgcctgtaaaggaaaagccagagagagaactagccacttcttgattctaatacaacagacctgtctaccccagtggtaattcttctaacacggggactatatgatcacaaaaaagaatttatttaaaaaatacaagtttcatagcaatggcaatactttagcataaaacaaggtactaatgacatgctaatgagaaaataatgttacatatttgctttaaatatagtaccttggaaatacaaaatgacaaaaacatggtgagcaggtacatgaatttatagatactacttgaactatgaaataaaactttagcggccctgtatatgcatacagaaaaccaaatgttgatatgtgatccttcctagagccccttattaaaatgctggctgattttttgaaaaaatgaggcttcattctaagtt

SEQ ID NO: 13798 - DNA, 1114 bp, Homo sapiens
gctccccaaataccttactgcttacttgccaaatggatggcaaggcctgcctgcaggtttccatagaaccctgtgctttaatatgtcttaagacttacagagggtattataattgctgttatttcttgtctactccatgcagggagagtctatgccctttgtttctttatgctcagtatttagtatagttcatagcacatagtaggtacttgctaataataaacaaatcttgattcagaaggtatatgcttattctgtataaagtgtcctgctagttaccgtggaggacacggagatgtaaaagatatgaggctctacctaatccaagatttatctccagccttatatggaacacttctgcttaactcattctggatctttatctgtcagttcttcgtgtgcttagtgacggcagtaaagtaagtgctcattaaatgtatggtgaaggaatgaagaaatgtacctacctggcagtcttgattaatttgacatcaaaagcttgggactgctgtggctcatgcctataatcccagtactttgggaggctggggcaagaagatcacttgaagccaggtgttcaagactagcctgggcaacataatgagacctcatctctacaacaacaacaaaagcttggggctaatatctctcactgtatgaatgaaatcctccaacctctcacaggctgtttcctcagccagttgtgttcaacactcttaatatttaactgcagcatagatccctgaagcaggtactaacattatggattttgttcaccattgcattctcagcctcaaacccatggtagatgatcagtaaatctttgtcagatgaatgaagttgttaatgtttcctttttagcctatatagaggagatgctaaaagtaaacaaataactatgatggaaaataaagagttaaagagaagtaaaacaaagtgttttagggggttcacttgtgggcaaggcaatgtctcgtgggggtacaatatacttgtaaataaaatgtatcaatttttatattatttagggtagatcttagaatgtcagaaggtgtggctatcagggaggacattaacttatatatttttaaaactcatgcattaaagttacaga

SEQ ID NO: 13799 - DNA, 1052 bp, Homo sapiens
gcaccaatgcaagctagtactggggaaggaacccagctgtggtgttctaacagacatgggtttgaattctggctctactgcttagttttctggtcatttctttgtctgtagcatagggataataatactgatctcattaggtgctcggttgtgttattggttgttataagaattaaatgagacattggtttcattcacttatcaaatatttatgaaatgtctgctatatgcataaaaatacttaacaaagagcctagaatatggtatttaatcgcagttgcaattattttggcttttcttccatgtcttgattcagataactggccttctgctataatcccttatgccaaagtccttatcctgataacacatctaagcatttcgtcattgcccatgacattcctaccaccgtggctgtagtcctgctccaaatcactattggtgcccaggagtaactgttgactcttgcctgctttgtctgttgcccttgagttagccatcactgggttttgcccactatggagtttctctgatgccactatctctgctggactttgggtacctatccagttcttatccctcagcttgggcttggcctgacagctaccataattagatttgctcttatctcattccttggagaggggtctctctccaggtgccagcccttaccggtattcctcctaatgtcacagttaactatgccacatctagctctaaggattcacgcactgatggcagggttgacttactgatggcagttacagatggcatgtgaccacagccatgtgtgtgatggagatacatggaaaaggatgaaagtacctaactatcatatcaaaaatataattatagaaaagatggagattagcccaaagaaggtcagagagtattttaagggggtgcaacatggtatctgtaaatgcttgggaaaagacgatgatgagttgttttgctaggcaaaagtaagaggtttcaaaaaaggtcaggtagctatgaagtcagtcagctaaggagagtttaatgattgccctagagtaagaggacttgga

SEQ ID NO: 13800 - DNA, 1047 bp, Homo sapiens
attgcctttttttttttttccctgagacggagtctctctgttgctctggctggagtgcagtggcatgatctcagctgactgcaacctccgtctcccaggttcaagcgattctcgtgcctcagccttctgagtagctgggattacaaacacctaccaccatgtctggctaatttttgtatttttagtagagacggggtttcaccatgttggtcaggcaggtctcaaactcctgacctcaggtgatccaccggccttggcctcctaaagtgctggggttacctcaggtaagccaccacacctggcctatttattattattattcattaatagaaattacagaaatcaggtttactaggtggagggaatgctgtctacaaaagaacaaagggggcgacaaatctgtctcagaaatattcagtcagttttaagcaataataatgttatttctagcaaatacaatacattcaatgttattttaaacatacaatattgaatgatctccataaagttgactgtgtgacttataatagtctctgaaatctagaaattattaatatacatccagaactcatggctaaccttcaatgatatgttaatagtgaaagaacgagcttgtgtttacttgcatagagggagggtatgacaacttctactgaaaatgtgtcaatatagttttccatttagaatggtacacatcggaagttgattttgtttgttttctagagatggggtctccctgtgttgcccaagctggtctcagattcctggcctcaagcagtcctcccctcctcagtatccagtgtagctgggagtaccagtgcaagataccatacctggccaatctttttttattcatttaaaaaatatctgtgggtagaaatatgatttagagaaatatacataaggtatataatctaagtatattttgaaaaattgcaggttctgaaaaaatcatctgagtacacctgagaggaggactgaaaacataggagtcatcttcagaagaatttcaaatgccattttccatgctagttagctagctagcta

SEQ ID NO: 13801 - DNA, 1029 bp, Homo sapiens
tgggaacaagcatcaatcttagaatagatccttcatgttctgctagttggcattactacctggccaaaggggaggaagattctggaaagcaaaggaaaaagggcctggaggggcagcccatccccagccagtctctcctgagcctgtaggctgccaaatccctcagtcccaagggccaaggctgccaaggacctctcctttcagtaacatcaaaaatgagatgacatcaggttaccctttactagtgcctagagagttgtcaattacctttcagtcacttaccctttgctaattgcaaaataaacagactccgcagcctgccttcaatgacagcctcgtctcctgtcctaatatttatatcttagcctcttattaattgcatttcattgatcatttcctgaatactcttcttcccttttgcattttcagtactccaattttttttttttgtttgtttgtttttcaaagagcaggcatcagagtcagattttctaaagggcctgccagtgccacacctgctattgttgatcctcataccctgtagatccctaaggatggctaatccccttcacaggaggcattgtttccagggagaatgggcttattggctttccacacctctgttagaaacaacagtggagaaggatgatgtggaagggaagtgagctggtagcaggtctaaatgcatccataatcagaaagatttccagatttccctaattgctgtttttattcacagaacttctattttaagcgcacacactcacatgtggattgacaggcaccagccactgtaatggctgtgtctgtctgtagcgactgcaaacgcttgtttccatggtgacgggaggcaccacagagacacaattatggtgctgctgggaccagggcactgccacaccaggaggcctctcaagtgtgtgtgtgtgtgtgtgtgtgtgtgcatgcgcacgctgggggcacagggttgctgtcgagtgcggagtgtgaaaaagccaagcggggaaggggttggggagataggcagag

SEQ ID NO: 13802 - DNA, 1036 bp, Homo sapiens
caggatgggtcatttcatgtttctgtgctccacaatgcttgactctaagagatactcagaaattgattaccaaacgaatacctaacactatctcctaactctttgttaattacaacataagcgaaaagatcacagactcctttgcaagggtttatttttccttttagcaatacctgtgcttgaagataaatgccctgttttgttgtgtactttgcagtccacctgtgtagacatgtaaacagtctctatcatgtagagtgtttaaacagctgtccgggcacttctcaaaagaagacattcatgcagccagcaaacatgaaaaaaagctcatcatcactggtcattagagaaatgcagatcaaaaccacaatgagataccatcccatgccagttggaatggcgatcgatcattaaaaagtcaggaaacaacagatgctggagaggatgtggagaaatagcttttacactgttaatgggagtgtaaattacttcaaccattgtggaagacagtgtggcgattcctcaagggtctagaaccagaaataccatttgactcagcaatcccattactgggtgtatacccaaaggattataaatcattctactataaagatgcatgcacacgtatgtttattgcagcactattcgcaatagcaaagacttggaaccaacccaaattcccatcaatgatagactagataaagaaaatgtggcacatatacaccatggaatactgtgcagccataaaaaagagtgagttcatgtcctttgcagggacctagatgaagctggaaaccatcattctcagcaaactaacacaagagcagaaaaccaaacaccgcatgttctcactcataagtgggagttgaacaatgagaatacatggacacagggaggggaacatcacacaccagggccttttaggggcaggggcgaggggagggagagcattaggacaaatacctaatgcatgtggggcttaaaacctagatgacgggttgatgggtgcagcaaaccaccatggcacatgtatacc

SEQ ID NO: 13803 - DNA, 1085 bp, Homo sapiens
ggtacatgtgcaggatgtgcaggtttgttacataggtaaacatgtgccatggtggtttgctgcacctatcaacccatcacctaggtattaagtccagcatgcattagctatttttcctaatgctctccactcccccaccctaccccctgacaggccccagtgtgtgttgttcccctctctgtgtccatgtgttctcaatgttcaggccccacttataagtgagaacatggggtgtttggttttctgttcctgcattagtttactgagggaaatggctttcagctccatccatatccctgcaaaggatatgatctctttcctttttgtggctgcatattattccatggtgtatatgtaccacatttcctttatccaatctatcattgatgggcatttgggttgattccatgtctttgctattgtgaatagtgctgcttaatgtatacttttatatacattatgtatgtatactaatgtatattaaaagtatacgttctgaggatttccccagaaatttggtaggtctggagtaaggcctggacatttgtatttttttggcagacctcacaataggctctattacagagcacaacttaagatcaacagatataggggatgtatatccctcagagaaagatgtggaatacagccttgcttgtgataagttactgtaatggctcttatcaacaagccccaccatatccctgtagtcaattgtattgcaaagtggaagtcctattccttgactcattcagagtcataaaagtgatgacccctatttttctctttctctagttttcctatcagtaccctcccccttgtcctccactacacccaggcagcttggatccttcagggaaatctctcaccagtgcatatgcttagtcagtcagatggatcctgttcctaaagctaacaagactagctggtggtgaaaagaatgggggagaaggtgtagaaacagagaaacattatttaggaaaatacttaatctcatctcaaacattctctggaagactcttgatcaatttgtagaaaaccaattcacaggaagccaatttgccgaaatccaaatccttgaatat

SEQ ID NO: 13804 - DNA, 1105 bp, Homo sapiens
ggggtacttgcccctcctctagaaaagcaggacttgctgctaagagtgaaggagaaggggttgaggggtacttgcccctcccccagaaaagcagagaaggggtagagacaaggagaggaggggttggggtacttgccccttccccagaaaagcgggacttgccgctaagggtgaaggaccaaggcaggcatccctgcgtggtctaacacctttgaaacgtgggtgaataatcagagaggcatccctgcaatgattaaaggtcaagggaaggctgccttcccagtctgtgactggcaccggagttttgggtccacggataaaacgtgtctcctttgtctctcccagaaaatgaaaggaattgaaattaagagaagggagagattgaagtgtggcaccaagattgaaaggagaaagaggtcgagggatagtgagggaggttggagaagagagtaaaaagaggccgcttaccggatttgaaattggtgagatgtttcttgggctggtcggtcttaggacctgaggttgtaggtggatctttctcacggagcaaagaacatgacaggggattgatctcctaagggaggtcccctgatccgagtcacggcaccaaatttcatgcgcgtctgtgtgaagagaccaccaaacaggctttgtgtgagcaacaaggctgtttatttcacctgggtgcaggcaggctgagtctgaaaagagtcagcaaagggagataagggtggggccgttttataggatttgggtaggtaaaggaaaattacagtcaaagggggtttgttctctgtcaggtaggagtgggggtcgcaaggtgctcagtgggggtgctttttgagccaggatgagccaggaaaaggactttcacaaggtaatgtcatcacttaaggcaaggagtggccatttacacttcttttgtggtagaatgtcatcagttaaggtggggcagggcatattcacttttgtgattcttcagttacttcaggccatctgggcgtatatgtgcaagtcacaggggatgcgatggcttggcttgggctcagaggcctgacactgtgattacaggcgtgagccactgcacctggtcagtgacttctgt

SEQ ID NO: 13805 - DNA, 1024 bp, Homo sapiens
cgagcccatggtccagaacagttgttctcaacccagggtagttttgcctccccagagaacatttgacaatgtctggaggcatttttggttgtcatactggaagttgattgctactggcatagtggatagaggccacggatgctgccacacattttcacaggacagccctcatgaacaaaaaaaaattatcctgcccaaaatctcaactatgccaaggttgagagaccttggtttagaagtcgagactgtggtgataatttaagatgtaattccaacagtccaagcagagaaatttaccagaatgcacttggtctaagagtaaagagtgctacataaagattgatgtcagggcattgctgtggatttagtgaggtactctgaagagagtggtccagtgacagtctcgttttaaaagattggatgtaggtataggaagatgagttcttgaaatgaggactcagtatacgttgaatataacaaaggagtttgcattgaagaaagatcactatttaagcaaaacagatgttttgtccacagtccaaataatgtggtttagtaatagcacagcttatctctattcattttctcttttggtattctctcctgttgattcttatgtagtttttatatgaagtcaacttgaaagttgtttaaagacaattcgaggcttgctagggatgtgtgagggagatactttgagggcattattgaaaggaaatatttgatactggacagaaagaatattgtgaatcctgtagattattttaaggaaggagccttaaggttacaaagagtaggcttattgattggggtttgtagtggcgggtgataaaagctataacagtttctactaatagtgttgcactgtaatgatggaataaaaaatctttgggtccttagcaactggagatggggtagtgaatggcagaaatactgtaccgtggttacattcactcatccattgaaatgacttgtactttaatacaaatttgtccttagtgcatttaattttgtttttaatctt

SEQ ID NO: 13806 - DNA, 1047 bp, Homo sapiens
gcaggcaatcaggtttaaaattttttttctgtgtattattgcattgtatgaatgagtgagcatttgggttgttttaaggatttgctttttgtgaatatagttgctgtgaatattgccatacatgtttttggcatgcacatgcatccatttctcttggttatatacctgcaagtggaattgttgggtcattgagtgggtgtttagctttagtagaaactgccggttttccaaaatgttgtatcatttttcagctttcaccagcaaggtagaagagttccacttgtcttcacttagcactaatcagtcttttaaattttagccatctgttaagtgcctagttggtatcactcgattttagtttcacttttctgagggaatagtatgttgaacaccttttcagatgctttttaaagattttcttctgtgaagtgcctattcatgtatttttctcactaagaaaaatggttgttcctttttcataatctttccagagtcatcttagtgggatttggggaagcaacagggctgtgtggggtaacctgccacctttaagtggaaatcaggtaacaaagtttcattcactttttttttctcatttctgttttccccagtctatgattcaattcattttttattggctggatataatctggatttatattataatgaattttagaatgagactcttgtttcaaccataaggatgtatgataggaaactattataagaaaccagaacaagaaaattatttaatagatgtattctgatttattctcttatgtttttaaattaagatattttggaccaagagttttcatttatttatccattcatcaaatacatgttaagtgctttctttatgacagacctaatagtaggcttaaaggatagtataatagtgaacaaaacagagataagcgaggcacttgtcctcttaaaatatattcaggtaggagatacgaatcataagtaaacaatagctaagcaagataattaaatatgtctccaattttgcagaaatggagcaagagccacaaaatggagaac

SEQ ID NO: 13807 - DNA, 1055 bp, Homo sapiens
agtagctggggtacaggtgcatgccatgatgccctggaaatttttttgtatttttagacggggtttcaccatattggtcaggctggtctcgagctcctgacctcaggtgatctgcccgcctcagcctcacatatttctagaagttttattattcaaatgatatgccttatagactgggtcctaattttcttatttattattgcctatttttcatctctgtctttttgctctgctttctgggcattttctataattgtatgacctcatccttcttgagtttttccttcctgcgttttaaatatttaatttcccggagttccttttgtcactcgaatatccttctttcagtatgcacgcatcccactttttattttatggatgcgatattttctttttctttatgttgatataaatgatagggtttttttttttacgtttcctgcacattgtccatttcaaccaaattacattgctcttcttttaatcctttatactggatgtttgcctcatgttttgtgatcctgggctgtgtgtgtgtctgtgtgtgagtgtgtgcgtgtgagtgaagcactagaaagctgatctgagattctatgggtggaacctatcaactatggcttctgaacggtgaattgcttggacagttttccttagggaactctcactgtcactattctttgtgtctttcttcttggtgatgatcagattcctcaagaagataacttccaatctcctttcttgaggggtacctggcagccaaaactctaattaccaagttgtggggaagaaggctgtgggtctcaataatcaatgtgtaacatttcacttaatccccctgcttttggtttttacccttaatcatgcctgatagtttcttatcctcactttattttacactcttctagatcaaagcactcagtctttcagggctgtagagaaacagcgtcctgattgcttggtgtaggaaagatctgagggtgctaatttgtaaataggctttcaaccagtcctcttttttcagctctttgtctacttcctttccataggaagattga

SEQ ID NO: 13808 - DNA, 1023 bp, Homo sapiens
gacttattgtttgttggtagggaggcttttccatcctggggcagtgtaccatagtaagaataggagtgggtgagaagtatgcctttattttgtaaagtggaagattgtgaaaggatcttggggaataaaaatcagcatgataactggacaatgggcatattctcaggcagatcagtttagtgagaagtactcatgggagtaaaggatctggaagcctttttcttaaaattacacatgtcgttggtgtatgtcccatggaagacttcatttgtcctggggggcacacatcccccagtttgaagaccatttagagtggtaattctcagtgggggacgattttgctgcccaaagtacatttggcaatgtctggagacgtttttggttgtcacaaccgggatgaggggtggtgctgctatgggcatccagtggacagagatcagggatgctgctaacaaagcattatccaacccaaaatgtcaaccatgccaagactgagaaaccctgatttagaggatttgttttggaatcagactatttaattctgtaaactagtgcagggtcagtaaactttttttgttaagtgccagatagtaaatattttaggcttttggggccatgtatgatctctgttgcacattcttctttgtttttataacctttaaaaaatgtaaaagtaattcttaattccagggtctttcagaaaacaggtgatctaaggcaattaatgcttgcaaacttcaattttcttctctgcaaagtagtactaatagtaatattgcatcaagaattgtttgtaaggattgagataaacacctagcatactgtccagcatatgttaagtactctaaatgatgcgtggggatagtggtgtcctatcgtatgtagcacaaaagtgggtgccaagtcacagtgttgttcaagaccctgttcaagtcatttggacaaatttaatgatgctggtgaagctcccaatcaactcacagatgcctatttaacctctgctgtctttctgctgccttagtc

SEQ ID NO: 13809 - DNA, 1048 bp, Homo sapiens
aaaaggcaactggtgagggaaaactaagatgaaatccaaagaaatatgaacacatcatctaaaaatgtaaattctcaattcctttcatctaaatttccttctaatcttaaaaaggaaggggaaactctattacctataagcagctttcttatttacttgatcagagttgtcaatttttttaacgaaatggagctctgtattcaaaaaaagtgttttgtggaactccaaaataaaaacacatgaaagatatgcctgtttagatcctggtggggaccgtgaagcctccagtttacactgtaagtttctggagagcagtgattgtgtcttgtttgtctcccatggttcccgaccctgtgcttgcatctaatatttggtattggcatttcaaacacgaatacacattctttaaacatatcatggtacagacataaaatactgtctttaaacatcagcccgtcttagagaagaagtattttcatcatcctagactccttatatttacttgtcagatagttcttatgcatcagcaggcactgtagatacaatgacaaagtttctacttttaaggagcttaccattttgtggagaaaggtgaacaagtaaaccaataataagcagtgtgctgtcagctgtgacaagctgctgggaccaccgagtgacatctacatcaggccctgggtgagtaccagggaaggcttctgggccgatccaagttgccatccttcacggcagttctcttagtaaatcatcccaggcattcctaaagcaggttagtgcctgctgtctgtgttcccataatactttgtgcccatcaatggtcagtatcagttcctgcaccccactgttgtttacttatccatctttctgccaggctgggatgtctttaaggacagggattccatttattcattttcagcattttccagctactgtttgtttagaaaggcttttggggatcacattgtaaaggcagaaatggtagttatttttagctctttctttaaaaatatccgaaagtatttagcttctcctttcaaaataaaaagca

SEQ ID NO: 13810 - DNA, 1034 bp, Homo sapiens
gaccagcctggccaacatagtgaaactctgtctctactaaaaatacaaaaaattagccgggtgtggtggcgggtgcctgtaataccagctacgcaggaggctgaggcaggagaatcacttgaacccaggaggtggaggttgcagtgagccaagactgtgccattgcactccagcctgggcaatagtgcaaggctccatctcaaaaaaaaaaaattctttttattatagttaatgatgagccattcccctacccagtagatatcaattagccttcacaccatttctggcttttattccttgtgacttaaattagctaaatggctggccctgctaaaggaaggtcatgttgccaccctgtcagcactgcgtgcattttgagttttgttttctctagtggtgatgatgggtcctcatttaccccacttaccatctagtgggtatgtccctgaggtagaggggctggtagaaagcatttatttgtagccatgcagcagttaactggtacaaagggactgaacttatgactttgacctcactagcaagatgctttaaatagctactaacagttagcactagcacaccaaaagctaccacttaaatgtcaaaggcaataccttgggcagcctggaacatctcattccagtgtgggatctatccatattcttccttagaaactaggcagaccacttgaactctctacaatgacatatcaaataataataatatgatgatgatgatagctacccccactgattacctaatatctaagagacacgctggtggccgggcgtggtggctcatgcctgtaatcccagcactttgggaggacgaggcgggtggatcatgaggtcaggagatcgagaccctcctggctaacacactgaaaccccgtctctactaaaaaatacaaaaaaaaattagccgggcgtggtggcaggcacctgtagtcccagctactcgggaggctgaggcagaagagtggcgtgaacccaggaggcagagcttgcagtgagccgagttggtgccactgcact

SEQ ID NO: 13811 - DNA, 1035 bp, Homo sapiens
tatcttaagtctgatcataggctttattttttatcattaagattggatttatgtagaaataatcatatttatctgttgtgctgtatctttagttgtttcatatgtaattattttcagtaatgagcactcagtgagtagtttttttattagacttctagagccctcaccatatgtagtccttcctttctatagtagggccgtatgaaattttcactatttagatcctctcaagtttcatttcacttcaagatgttctgtttttgtttttagagaaaaccactccactcacttcagctttgaaattgtttaactttttggtccatgatttaaaaaattaaggtgctaaaggctcacaacgatcatgtagactgactttaaactgatacgttttctgctgagtttatttaagctaatttgtttttaattatttttaaatcacaggttctaaattagttccattctggagctggctacaaatgggtaaagacctactttttatacgacttcgatatttgactggtgcctggaggcttgagcaaactcggaaaatgaattaggttgtttgcagtcttcagttgtgttcttatgcttcagtgtcacatttcatttcatttgaaactaaaattttaagtaaagctgaaataaacttcttgtcattgtctgccttttgataattttaaagaaataactttccataagtaaaaaattatatatctctttggatataaatgatttttaaaagatgtttatttaaaaagtcagattttcttttgtttgtttagcttcattatcattataattctgagaaacataatttttgtagacagaagctattcttaccctaaagtgcctgcataactctcatgaacttaactataaactacaatcatgtaacagttttcagagatttaaaaataaagctagggtataagtttaaatgtacataaatttatccaaatcaaagaaacctatttcagcctatgaaactttaggaaattatatgttaaaggcaagaatacagacttagtcacaaag

SEQ ID NO: 13812 - DNA, 1050 bp, Homo sapiens
atctggatcctctgatggtagaagaaaataggcaaccaactctaaagtaatgtaaaacagtctcaactagagcatctcagagttttgttttatcagctgtctgaatcagttgaaaatgtcagttctttaccttgagctagtccagttaaggttaggattgaaaaccatcaatcttgaaattttccaggattaaattttttcttggaacccatgaggctagttttacctctgtgagtttctgagttgtaatagagatacaatattatgcaatgatattctaaattattatttgacttgaaacttctgaactactcagctttgaattatttgatttctgtgaatctgatcttcagatttatggtataagctttatatctgccatgtaagcttctttaaaacatgccaaggtagagatgtagttgtgttctatttgtctttaaaaataaatatcaatatattttctattttagggcatttgatgtagaactactgtacatagcacagttctttaaaattccaatagcagaaattgctgtcaactggacagaaattgaaggtgagtatattgtttattgtatgattgtcttgagtcagataatacagttgtttagtaaagtcagctggctttaatgttctccttgctcccctcatcaagcccttctcagctgtcttgactcaaagatccagttccaaggagaatagtacctactaataccttccatctggcttgctgccttttatattttttgtctgttcatggggccttcagtaggcctactaccttgtcgaagaaacttcaataaaacttcctacaatagacaaagtcatggtgatctgaaattagaaggttgatagtcttttgagatagataaatttattttttgcatcaccatttcctatattttttttatcactaggtggatattaattaggtacctgcaaaccactatgcaaagctaaataagaaataaaaattttttttatggccgagcaccatgcctcatgcctgtaatcccagcactttcggagaccgagggggtggatcaccta

SEQ ID NO: 13813 - DNA, 1874 bp, Homo sapiens
agtgctcagtatcctcatgtgctgaggggctgttgtattagacagcagttcttgtggggttaagttaaagaacattaatggggtttttttctttttttagtgttaatgttacatgcaagccttttatttattttgtgttaattgacataagattgacctcacttagtggctggggatggtggcttacagtggtcatcctagcactttgggaggctgaggcaggtggattgcttgagtccaggaatttgaaaccagcatgggcaacaatggtgaaacctgtctcggtttgttttttgttttaattttattagggaaaaaacaagattcacctcacttaaaattttaactgctcacatttttctttagggtacattatgtttatttggtgcctctaaaggagaaccaccaagtatacatgtatcagcttaatgagcagtatacccttcaccacaataatacgtcatcagtggtttttatttaaacatctttgttcctgcactttaaatcaagactaaagaacaatataagttacagaaaccaagttgtatatctatgccttatttccaaatgtcacctttgacatttgactattttttcttaaggattcattgaaatttttctcagaactttcaagaaatcgaaatcaaatagagtttctaggtactagaaatctgtaaaggagtatacctaaaattaagacttttggtatcggctgggcgtagtggctcacgcctgtaatcccagcactttgggaggccgaagcgggtggatcacttgaggtcaggagttcaagaccagcctggccaaaatggtgaaacctcgtctttactaaaaatacatttttaaaaattagccaagcgtggtggtaggcacctgtaatcccagctacttgggaggccgaggcaggagaattgcttgaacccaggaggcagaggttgcagtgagccgagatcacgccactgcactccagtctgggtgacagagtgaaactctgtctcaaaaaaagactctcagtatctctttggattcagaactgcagagttgagtataggtatgttaagtatatatattcaaatattaatataaattaaatgggtatgttaaaaacaaaaatagattaaaaaattttaagtaatgtaaatttggccttcaaattcagatacatatatatacagttgtctcttggtatccacagtaaatgaattctaggaacatcacccacagataccaaaatctgtacagatgctcaagtctttgctataaaatggtgtactctttgcatataacctatgcacatactctcatatactttaaatcatctctaggttacttatacctcatacaaggtaagtgctatgtaaatagtatgtgtttgttttttgttgttagtgttttggagacagggtctcatgtcactcaggctggagtgaacatggctcactgcagcctctgccttctggccttaggcgatcctcccacctcagcctgctgagtagctgggactacaggtgcatgccatcacgcccagctaatttgtgtatttttttgtagagacagagtttgccacattgccaggctggtcccaaaatcctgagctcacgtgatcctcccacctcagcctcccaaagtgctgagattacaggcatgagccaccgcactctgcttgtatattttatttgtattattttttattgtggttttctactgtttattttttaatattttcagtccatgattggttgaatttgcgaatgtggaacccatggatatggagaaccaactatgtatatagcttcatcttcagagctgtacttcacctaaattctttccatttatggaagttaaaatacttgggccaggtgtagtggttcaca

SEQ ID NO: 13814 - DNA, 1143 bp, Homo sapiens
ctgcctcagcctcctgagtagctgggattacaggcatgcaccaccactcctggctagtttttgtatttttagtagaaatggtttcaccatgttggccagacgggtcttgaactcctgacctcaggtgatctgcccacctcagcctcccaaagtgctaggattacaggcataagctaccgtgcccagcctagaaaattctttaaagaaaatatggatagctaaaacatcccccaaacgttttatttttttattaataataaagatagaataaccagaactgacaagaatttgatttaatagtcaatatcataccagttaatgggaatgtaagtaacatgttttgttttgtttttttttttttgagacaagttactgctctgttgcccaggctggagtgcagtggttcctgccttggcctcccgagtagctgggactacaggggcacgctaccatgcctggccaatttttgtatttttaatagagatggggtttcgctatgttgccaaggttggtctcaaacgcctggtctcaagtgatgtgcccacttcggcctcccaaagtacttggattacaggtaaagaaccttttaaaggaaaatttggcccatatgcattaaaaaacattcagacttttaacttagtattctacatctatgactccaaagaaggaaatctaaaatacagataagagttttatattcaaagatgttctttcagttgcctttctataacataaaattagaaaggacaacaaataggcaaatagtcaaagtaatggtaaatctgtacattaaaatattgtatagcccttacaattgacaagaaaaagaaaaactaccatgcagcactattatgacaaattcttgaaaggtagtcaaacttgaatcttatcaagcctctgaatctaactaccagtttagaggaagtacaggggacaggagaacatgttaaatgtcaccatgggggtgcaatcagcaacatctaaaacctaggaaactgtagagcaaacaatgtggtttcttcaggttacaagaaaaaaatttaaagaggtcgggagaacccacagataaaagaaataccaactgatttgtatggatttttttggtggtggtggtttgtttttttagacagagttttactcttg

SEQ ID NO: 13815 - DNA, 1039 bp, Homo sapiens
agctggtataagaggcagttatgttgagtttgagccatgttaagtttgaaacaacatgcagtggtatccagaatagcctaggagagaggatgtgagtgagtcatccacatatgtcagatgatagttgaacctgaagccattaaactggcaaagaggaggttacagagaaaaggagaatcaggaaatcttaaggcagtgaggcacatgagaaataatgggtataaaatatgactgaggaaacacaaatgggagttgctatggtagactgccttttcaaggagctgcagcaaagtgaaggccatagacggtagaacaggaaagtaggcttaaacaagtttgatcacgcatcattgaaattagtcacttactggttttttgccccatttcagactaatagctccagtttttttaccacctcagcctcccaagtagctgggactacaggcatgtgccactatatcaggctaattttttaaatttttttgtagagatggagtctcactgtattgcccagactggtctcaaactcctgagctcaagcaatccttccacctcagcttcccaaagtgctaggattgtagtaggtgtgagtcatctcacctagccttttgcatttgttctaatgggtgtgattaaaaagacatcacagatactaactagttagcttattataccatagaataaatgatctgatttctctctacatttgtatatgtcttacctatagtcacactatgttgtgttatcaaagcaattttactatatcaaaccataaatatatttgcacgtaagaaataaggaattcactcaaatacatcagagaaattaaaagttgatgtgcagtttatttctgtatgaaatatgcactcatggagccataatttgcacaaaagaccagccaattcagaattgaatggcataattttgctgtttcaaataccgcaaatggcataacataacatttggatttatgcataattcttaaagtttattgacactttttatttctttaattaatttagtaaactttagatcctat

SEQ ID NO: 13816 - DNA, 1034 bp, Homo sapiens
gtaagccatattatcttttggtagcttatgtgcagttcttcaaggaacatggcctgataatagaatttcagtgtaaatactgaagggtggaatttagctttggaggacaagctggagtacttcccaaactttaatgtccttacgaatcagctggagagcttgttaaattgtaggttgctactcagcaagtctgaggtgctaagatgcatttctcacaagctcctaggttatgtgatgctggggtccatggaccacacattgagtagcagttgccctcaaagcttctcagtctagctcaatcagaagaatcacctaggatatcagttaaacatagagatttcaagccctactcaaaatctacttacttaggatttctaagggacagacatgaaaatctgtatttttaataggtgctccaggtaagtctaaattactcttaagatcgtggttgcctgtaagataataacatttgactcacacagatgcctaggacatgtacagaatatatggtcaagtctgactagaaagtggaaaacgttcaaaaaatttgatcagctttaatattttaccttccctagtctccctcagttttgtccccactgttacatgaccgcttttatttcaagaaaagcctgccaaaaggaaaagatctttatccttatctctctgacattccaattttcctgaaggaaaagctctaaaggaaaaacatatcagcttatggacaaaaaaatgaagaggcactgtctagaaaagcagctgtgtttattaacacttatttatttggtttggttttattaaagttgttttatacacatcagaagacttttaaactgcttaagcataagtagttgataccggtaatttaagaattcttgcgctaacaagtatattgtattgtcgagttacttagtttcttctctttgatcagaatactgattccattttatctgatatggattctattttatgtggtatttcttgatttgattgtttaggtggagaaatatgctaaagtggaaaagtctatcaaa

SEQ ID NO: 13817 - DNA, 1030 bp, Homo sapiens
ttaatatgatgataatgtgaattctacaaggaactcacatagctggaattttgtgtgtgtgttggtaattaattgtaaagtgtaacaccaagagaattttgttctaaaagtgaccacttttcagataaggcaccaaattgtccctctgatttccagattagattaattggtcttcagtgaactttcagttactttgacattggaattttatcatattctgattattttgctttgggctgtggttcagattgtgacgttatgccagatgttttttcataatgtgttaggttttttttttcccccttaagaaggacattaggagggccttttggttttgttttttatttttattttttttgatccttgcttggttgaaatgccttttggttttattatatatagttctttgaaaagccatttgaattatacagctaagctttcagtgagcatgatcattttcaaacttcatgttttaaattaagattccgagaccattcgactgccctatgaagaaggagagttgcttgaatatttggatgcagaagaattacctcctattttggttgatctcctagaaaaatctcaggtacaaaatttttgtctttaaaatgtctttatatttgttatatgtatatgatatatatatgtcacatttttatgtatgtatacatatatgtatataaacgactacatgatgtttcatgacagatgatatttaatttctatcactgttcccaacagcctttagaacatgaaatcaggctgggctttggtggctcatgatgcctgtaatcccagcactttgggaggctaaggcaggaggatcacttgagcccaggagtttgagctcactacagtctcaaacccctgggctcaagtgatcctcctgtaccactgcaggattagagaaggaaggattagagaaggaagaggaaaaccagaattgcagtgattgcaccactgcactccagcgtgggtgatagagcaagaccctgtctctaaaactaataataatagaagatgaaatgag

SEQ ID NO: 13818 - DNA, 1087 bp, Homo sapiens
atttctcgtattttaaagcttttctttagattttattaaaatttaaaaacaaatgtaacctgctaactgcatataacgtatttcaggcagcatcagtgctaatcttctaatggcacatttctgttcactgacttacagtcactaaacatagttaggagtaggcatttaacttttgccattaagaaatgacagactaagggagaaaaacactttttaatgttttaaagaagcagcagcatttgacagagaataaatgaacattgaccaccatgttatttatttagataacccctattctgcgtcacaaacttcagaaaacatctgtcttccttctcctcttggttcttgcctatctactcctcccctattagagaaaagtagaagtatcacagtggggttctgacaacaccttgtattttgcatctatattacctaatcattttcctcttaagtttttgaaggagataatgaatgaatgatgcttttatttatgtatgtatgcatgtctcactagaccctttgaagttttaatttcagaagatgaaatatttacttgagatgactggctgtttaaaattgtcctagactatatatatttgattttgtttattataattttttgatacaaacaaattttatgggcaaaatttaaaagaaccttctgtatttgtgaagtgtatatgtacagaattatgttttcatggtggaacatgggatcagggaaaatgggagtcaggaatcttaacttgaatcctgggaaccagtttcattgggaatccgcttcttataagtttttttttttttttttttttttggtagtgacagaatctcactatattgtccaggctggtcttgaactcctgatttcccaccttggcctcccaaagctttggaattacaggcatgtgccacagtgcctggccaagattttttaacaaagcaaattagtgtagatttattataactgaacgttttgaaaagatggcagatttcagactttgttcacttatcatatttagatatttgataatgtgggttttttattgaacagtgcaagaaggcccactatttttggaattatacaaat

SEQ ID NO: 13819 - DNA, 1051 bp, Homo sapiens
taatctcacagacctgaattaatgctctaccatactatttcactaacaaatctctatgctactgagaaccaagtctttcaagtaagcaatcagattacaactctctctcactgacacattgtagtcacccttttctctcatcatattcaaataaaaataagccaaaattagagctaataagataagcagagccaagtcattgaatatttataagttccatctctactagctctctcatggtacactgtcttctaagttgctggttccagaaaacacatagacagggaaattatggatgtaactgttagactccaacctcatagaaatacaccatctccatgtccaaaaccaatgtaggaaaatctatctagctccacgaagagagtaggattcagaatttcacccactgcattaccaaaccaattttctatcgcatacttttttcataaaatttcaaaatggcattagaagaagaaagctactaattactttctatctttaactgcacagaaatgaactccaaacctaagaaaaacaaaattttgttttataaataaaaaattcactattgtccacattttgtatatttgttagcaacaagtgcagaactaaaaggtgccatgggaaattaaagagataattaaaaacaagtcaaaacaggtaccaaaatactttatacattgttaaataacagtcatggtgctaattagcagtaaagagtcaagagaattcagaaagttcttaaatctttgagctttcttttcatcaatgtgctatggaggagatcaatgtgttttcattaaggtctggccccattagaatttaatttctttctagcagtggtaaatgacaatcaaaatctaaactctttctctgaggtctgttaactgccagttttcaatagaatgcaaaaatcttgcaaaataaagtgtattacagtgaatattccagctggcctttagttgccttaagaaatcagaacagctgtgtgaactccttcataaacgtctcccctttggtgtaaggagaggttacagactgcaataaacaa

SEQ ID NO: 13820 - DNA, 1031 bp, Homo sapiens
ttcccaatttcagtaacatccttattatgtattcccactttggaaaaaaagactttgctatacattataaacagtgaagattccagagtgattagctgaagaaattttggttttaaagttctactaaaaataatgcagggtattttataattgggaggattcttggagatcaacctaatcaatcacctcattttacaaaggagggacaggaaaggggactcaattgtgcagtgggttggccagactgaaaagacctataaattaatagctagcaaccaaccttgatatagtctggataataataaaaattgtatgacaaaaaataacaacaatattaatactagatgatattcactgagtttgtcaccatgccagtaactgtgattagaattttacttgttttatctcacttaatctttatattatcctatgaaagtaggtcctattgctatctccacttacaaatggggaaatgaaagtattaaaaggcttaagtgacgtaataatatgtcccagatcacaaagcaaggaaataccagtgctggaactcaagagtctctgaagacatatgctggtctggctttagccactgcatcgatttgaatgggtgtcatttaaatcattaattacttatttgaattcaggatatgaattagacaaattttaagaagtctctggatgtacacattcagactgtctctatcatgaatattataatgccatttataattttgttgcccaataaatattaattgtgaccccagacactccttaccatggtgttgcactaagaaataacaaagtcattagaagctgtgaagtgctgggaaagagcacagagtgaagtgaagtgacagcaatgctggcttccagtccagttcaccacttactaattggacaagtgtctgaatctctctgagccttggttttttcttggctgttaatcaggcctgtggtctgaatcttacctacttctcaaagtctagtgatgttcaaattctgtaaaagtgtttttataaggtatcatgtaa

SEQ ID NO: 13821 - DNA, 1033 bp, Homo sapiens
agcatgctactgtagtgaatactgtgggcaattgtaaatatacaatggtaggtatttgtgtatttaaacatagaaaaagtacagtaaaaatacagtattataatcttatgggcccaccgtcatgtatatagttcattgttgcccaaaatgttgttatgtgatgcgtgactgtgtatttctctgtctacacatacgcacacatacacacacacacgagcacacactttactgaggtcttaatacataacagtcactctgctagattctgaggatacagagatgaacaagacatattttcctttttctttaatattttaagcaaagtttgttcataagcctcttatcacactccagtgtcctgtattatctaaaacatatttggcaaccttattttctcctgatcctttcccatgacaactctgaactcattaaataaataacataaattatattacaatgagtagagtctatacttgacatttaaaagacaaaacaaaacaaaacaaaaactttgggccatggtggaatcaatctaaatatatcctttttgccactaattactgttttccgtaagagtaggacttaagtttttttactgtaaatccgtgttaaatttaaatagcattattgacactattaaaaacagtgttttccttttatacatagatattaccaaattaccattcacaggctatgtattgtaagaggtaagttgttttccaaagtctggttggatttttggtgttacagtcacatgttaccctaccccacatggaaccaatgaagcaaacctaagaaggcacttttatagttagggatataatgacctggattctcaccaccctacccctttctctagagacagtagagaccttggcttaagagattcttagaaggtcagatcaaatttagagaaatctaggagtactcagggcccactgttagtgttttcttgtgggctcctctgtctacagctacgtctatcgaaagcctagaaatagactacctttctcatggcctttaatcttgaaaa

SEQ ID NO: 13822 - DNA, 1025 bp, Homo sapiens
tcctgttatgatcaaaactgagcccacaagtcctactccctcggccttcaaaggtccatctcattctgggaatccctctcatggcactttaggtttgtcagggacattgggccgtgcatatacttcaacatccgtgcccatcagtttatctgcttgccttaatcctgcattgtcaggtctctccagcttgagtactcctttaaatggttcaaatcctctttcctctatttcccttccaccacatggttcctccactcccattgcaccagtattcactgctcttccttcttttacttctttgaccaacaattttcctttaactggcaacccatctcttaatccgtcagtatctctcccagggtcattaatagccacctcatctaccgctgccacctccacatctctccctcatcctagctcaacggcagctgttctctcagggctttctgcttcagcaccagtctcagcagcacctttccccctcaacctgtccactgctgttccctcacttttctctgttactcaaggacctctgtcatcttcaaatccctcctatccaggcttttctgtctctaataccccaagcgttacccctgctcttccctcattcccggggctgcaggcgccctctacagtcgcagctgtcacaccactacctgtggctgccacagccccatccccagctccagtcctcccaggattcgcctcagcattcagttccaatttcaactccgctcttgttgcacaagccgggtatgtggatagtttggaaataggataaaattattcttcacctaacttgtagttcacatttcatttcaagtcatcaaaatgaatgtcaaaatctaaatgatgtttttctgggtgaaaactttagcactctgaaatgttttatgaaccatgttaagataaatgtataaaatattaatgcctgttgatacaatgtttggatttgtatttgatagttttatttataagacagcagaaaggattatatgcaaaacagacttactgaatttcgaata

SEQ ID NO: 13823 - DNA, 1024 bp, Homo sapiens
taatagtagagttactactatttttatttattttcccatatgtgtacatttttttcctaacatagtccataaatatttatatcctgtgtttttctttttatccaaatatctgtttattatggtggcaaatatttgattaaagtttaaaatgaacttttatttatttttatatagagaatgaagacctttcgaatccgtcaaaacctatacagaatcaaagtaagtagcaaatttgatccagagataacggatatctgtcatggtttgctctgttattcactgagaataatttgagtatatttggaatggttatgttttaggaaaagtttctggttaaagaatataattcatacttgttaaaagtggtttactagtgttacatattatatacataacatgaaatgcacgtgttaactgaatttaaaattaatcttaggacttttatacaatttgcaaaacttgcagtgtaatgtaagtactgcgtagctttgcattcacattcactttacattctgtgatactggaaacctcatttgttttttgatataaacacatgggatgataaaaatcctttttgacaaatgctagtcagattctatttttagagttcattatttcaataagtattattaagcatatcttaatgtaggaaagaacaaggggcaccaaagcagaaaatggaattgaaaaatgaaaatgaagtgtgtcctacatagtgcctccagatggcagcagtgctgcgacgttgtatttttcccctaggtgatgatctgtgtggtcaggaaggagaggctttcttgtatgagacaaaactacatcagttcttgtttagcaaagtagcacaatagcctgaccattgtagtacatagttaggagtctcagtgggagaattccattccctgagaacagtgcctagcaggtgcttctcagctggtagtttctaaaggaggtagcatagtggggtgtaaagaacactaagtgaaatgtcaggacatccagtttcttatcctgcctctggcatcac

SEQ ID NO: 13824 - DNA, 1031 bp, Homo sapiens
gatttttacattttatttgactttaagttatttaaatgtatataactatataatagctattctgttagcacagtttttaaactttaatgccacctgtatcacctgggcctgggctgcacgtgtcgaattataatttcaagtactgaaatcttatagaaatgtttgcaaacatgctgtcattagagctgttagttctttgttttcaggtggttgatttgctgagatatttttcctgggccgagccccagttgaaggcaatgaaagcattacagcatgtaagtaacttattttttccttcagaacgtagaatttaagtatttttaattctcccagttgtgtgtaatttatttcagttgtaatttatttgcattagaaaagcgaactctatgtgttattgtactttgattcaaaatagctatgttaaaaaattaaaattttctaaactgtacatttaaattgtatgctacagtgtcccgattggcaagttagaagaaaacttcaccagcaagcaaaatataggatttgaattcttaatggttttttgcacttctgttttttaatatccatcgtcaccatctttctatttagtcttagaagagttattactgtccaaataaattttcagcgatgatggaaatttttatatcagcactgtccattgtggtagccacttgaatgtgcctcatctgaggaactatatttaattttatttaattgtaattagttcaagtaggtacatgtgcttagtggctactatatggatagcacagctctagaacctaggtcaacaggagcatctggatcacacaggagtatctggctgtgtaggaagatttttgaagcaatatcaggcctggatatcttcagtggaatcaatttacagatccttgactttctaaactgatgagcctaagaaagtgtctgggtctgttagtgctgctttctgacctcctctttaatacttgcttttttactgctttgcaaaagaaagagttatcgcacctgttctctgggggtgaaaatgtttctcc

SEQ ID NO: 13825 - DNA, 1096 bp, Homo sapiens
cgcagtgttgagtttacttgggcgcgactggctttattgtaggtccccatgagctggtgggggctgtaggggtaaccaggcagggcgtctggcgctgttggggctgcgtttttccggagtccccctatgcgaggccgtgcccctcttcgcccggctcctggtgctccccagccgccggcccgctcccggaagctgcagcagctggtaacaaagagcctgccgggccgcctgctgccggggccgaggtatccaggagtcgggcggagcggctggggatgagcgcgagccggaccatgcgtccgggttcgcggcggtgagggtcgcggccggcggccgaggcgcaggtgcgggtcgagagaccggcgcctccctccccgccgcccgtggactctgagcgcaggtgtttctactctgccggccgctccacctgggaaagcgccttcaagagctacctctggcggcacctggccctcagctgcagggaaaccgcactcaaacctgccgccgagcccgggtttttctgcaaaactcagaggacctggctcttgcccgaggtgccctgaaccattgtgtgaataagctggggaagcctgactggagtgttttttctttttaataaaaagagtttttctgaatctcaatttttagaaattttttttgcgaagtttgcaatactctctacctcttcgcatcctctcttgctcgtggagtctttttcctcctcagctataaatattttttactatcggcggagcagaccagggatgaacgtcttttaattgcaagtataactgttaaaaccacgtcgggatagtagtcaagatggataaaaagtcctttgaaatggtgctggatgaaattagaaaggtaattagaccgattccatgaattattttatgagatgaattctcgtgttttagactctctttgaggtactgtatggagattgtgcagaataagggtcctaggattgccaaattggtttgaattttcacgtgtaatggaggagtttatatcttgatacgtttccagtacaaatagaaattaagttacgttaacgccaaatttgagactcagcacggtgtcgtgggaatta

SEQ ID NO: 13826 - DNA, 1035 bp, Homo sapiens
gactattccacttgcttctggtacttttaatcattccaggatgagaagccatgctgctctggaagaacaatacaggatctgaccaataaaattctacactctgaggctttgttggtgtggagaaagtcattccactctcagatgcttaattcatattgtgctgaatgtgatttgattgtgtctcattgtctgctgagcaggggcttctccactctgtggtttccggcagagaagaaaagattgcactttgcttcctcaattagcccattattttcatgtatagctggtgcttttcaaatttcttttaactgcaccttcctgtagagtagtgttgtgacttcttagctcccattatcaagttggagttctctagggaattcattaagatctagttccttggacagatttaatgatgacattgtcatttttatgtagttcatgtgattttagacattagtgagcctcactggaataaaagatcagccactctactggtaaagtcaaatgacaaactcttatatggcaatggcaaattctggctagtcatatcattttttttttttttttttttgctcaagatgtcccagcattttaataggaacatctaagttattaagaattacatatactgcttttgaaatgaaaatcacaattcataagctaataacaataacaaagtcagtgaaaagtatatattcacagcattcttactgatatacacatgagagacaataaaaagctcaattttcacaaccttaaaagctttcattgcttgcacatgcctgtgcagtaaatggggagtttaccttgtttttaggaagagaaaatgacatgcaaagaagtgaattgatgaaatttaattgactctagtcattgaacacctgctacttggtaggtattctactagacataaaacgctaaataaaatacagcccatgctctcaagtcagtcataagctcatggaaaaaaataacaggagcatcagtgattaccaaatcatatgtcaactaattctcaaagacagggaggaagtt

SEQ ID NO: 13827 - DNA, 1025 bp, Homo sapiens
tgctcccaagaaacttacacagagattcagaagtgcataaagtgctatcagccaaatagggtagctctgactgtatatgcagcagtggtttggggaaaggagagaacccgacaaagatggaatagttagaaaaggcttcagagtcacgaaggaggagtctgggcatgaagagcatcatcagctcagaaacagaggttgcagcagagggacctgggggaggtaaagtcactagagatgggggagggttggatctgtggcacagggagaagaccaggttcagaaatcacagaatgagtgctagggagtgaaggacagtgagtttgaatttataaaatgtcaaaacctctgttttactacccatcttcaatctgttactatttgcaaatattgtcaacagctgatcaaacattcgctttatgtaatcacacaaagaccatgcagaatatccccactttgcactggagcaatgggcctcccatttaatgaggccccaaaaacccacatattttgttaaactgggacactgcttttaagcttgtgagtctgtttgccatcatcttgaagggaggaggctcctcacaggttttagattattgagtacatacattcttaaatagtattgttggtgtcccttggtaaatatggtttacagattcttcagacctgcaatattttctttttaccagacttatgttccagagatgttgtagttgatataaattatattggaagcttgaggaaatgcaataagaatgcactttgcccttaattcagtttttattaacatttttacttaccttcagcagaatctctttaggctcagctaccttcccaaattgttactagatctttactaaaagaatttatgccaaggaccaaataattctttggcacatgttatgttattttaggtgccagcctttattcaaatagtatctgtgtaatttaatttagagtttagttttccttttagagttcaaatttttattttaaatttaattaacatgtgctgaaataaaaataga

SEQ ID NO: 13828 - DNA, 1046 bp, Homo sapiens
atgccacaatggtaaagttgagtaattgcaatggaatccatatggcccgcgaagcctaaaatatttactcttaccctaaaaagtttgccatctggagtagatgaataactccatggtagatgaataaatcacattttatattaagatattttagtgtaaattgcaggtatccttacattttacttctaatttctttattgaatatctcaaaaataatgttgctgtataaccaaattgaaatcgttatacttaataaagtaatagtttttccttaatgaaatttgatatcaagtcatataaaaatttcaattgcctccaaaatattatttacaactggtttctccaagtcaggatctaattcaggattattccttgcatttggtgtctgtgtcaccaaagtctcctttaatcaagatatgtacctttcgtcatgacactgactcctgaaaaggccatgccatttgtcccatagaatatgtctgaaatatatttgattgcttttgagtggtgtcatctagtatgttgctctctgacccggatttacttaaactggaagttagatctcaattgaattcaggttaaacatggttggcaagaaatcgtgcaaagggatcctaaaatctgcatcagatctgaagatttgtgtcactattagtgacactaaatttgaccattagcttagtcaacaaattattttaaagataagaaaaatgggctgggcgtggtggctcacgtctgtaatctcagcactttgggatgccaaggtgggtagatcacctgaggtcaggagttcgagaccagcctgcccaacatggtgaaaccccgtctctactaaaaatacaaaaattagccagctgtggtggtgtgcacctgttgtcccatctacttgggggctgaggcaggagaatcgcttgaacctgggaggcggaggttgcagtgagctgagatcccgccactgcactccagcctgggcgacagagtaagactccgtctcaaaaaaaaaaaaaaaagaaagaaagaaagaaagaaaaatggcattcagggta

SEQ ID NO: 13829 - DNA, 1057 bp, Homo sapiens
ggcctgatttaggaagcaaggggatgagttgagttctggacagcttttggttcaagttctgcagggactttaaggtggaaggccaaatggacagttggaaacactgggcatagagctcatgagaaagatcagggtaaaatacatagatttatgaaaacagtgttttgaaaaccttcacgtgggtagatactacttcatttactcttaaaaacacatggcttttgaattttgacattttcttttacatttgattgtgctggttgaaaggcaagctcctagctgtgtctactttaatcataattttaagcctcccctcagatagtgccagctgcttaacagttactacgctggtggaccaggatgatggagaagtttgtactttataggaatagcacttttttttggtttgtttttggtctggaatagattgcaataaaaatcaaagtaggaaaacaattatgatgttcattaacaaaagataccttgggggaaagcagaatctagaagtgaccatgtagttagaaaaaaaaaaaagagagagagagattgtgaaagctgaatattttaatttcttcttcttcttctttttttttttttttgtctcatgcataaagatggtattctattttgatcgcctggtggaagaaagtcagttcgtttatctcatccacccactggtggctatcctgattatagcctcctggtaggaaacatttaaaattcaatttggctgtctgtgcccttggtgctcagtaggtttcattaaattacacagcggtgagctcttcttccctgtgtggcaccttttgatgtacatttgacttcagtgtaatttcagacaattgtactttgtgtggagtggttttaccataataatcttgcagtccagatgaggcagatctggaactctgaatctgatgggattctaagatggtggaaaatattggaccagggaaatattttcatttctctatactttccttatttagcttgttaggcttgtagggtttggcagattgtttctgtagcattacttacagcatgggattagaataac

SEQ ID NO: 13830 - DNA, 1046 bp, Homo sapiens
gtttctctgcaaaataagctgattttttttttccagggtacttctaagacttgtagaagaaaaactatgattaagaaaagtggatggattattaagaaaggctttttattcaaaaggttttgtgattttaatagcgctttgcatttataataccttccatccaaggataccagccacctctgccaacgctaattcctcagcctctccttgaatttaaaagagtagagcaaacctattcgccgtggaccatgcagaagtgaaaagtgagtcccctgggcggggggagtttagttacccaagaccctgagggaacctgttgtaagggaacttcagagataagactttctcaaaatgtgagctactaactgttggcaacagaattacttggaaagatttgtaaaaaatgcaaattccagaacctctgagaaggagaaacagaatcttggatcggggtgtgatggtggagaaatctatattttaattattccgggtgatttttatgaacactgaaatttgagaactgctcttagactacagaaatgctgtaatattttctgccattcattcattcaataattacatttacctactgagtatccgctgtgtagcaggccctatgcaagatgctggggacatcctatgtggtgatcgggacagacgcgctgtctttcctcatgaggcttgcagtcttctgctgctctttagtgtgtagtgtgggttagcagaaagatgtcatgaagtattctgtaaaaataggctccttggatcaaataaatactgggctgatagcaggccatgaaactgaaaatctcatcattcatcagaggcttttccctgcctgacctactgtgggtgctgcataagtgagttggacagcctggcctcctgctccaggagcttgcgcatctgggcctgctttggcctctcctctggtcttgccagcacaaggatcaatccctgaataacactgtggagtggcattgaaaccgtttgagcgaaaggcagatctggaaaccggcttatttgatccggggggaccacatggc

SEQ ID NO: 13831 - DNA, 1035 bp, Homo sapiens
acagcagcagcaaaaaagacaacatgcaaaggtaatctacaaagtaaaaagccccattatattcaccacctggaagcaacattattgtattcatcaaaattgtcttgtaaaagaagtaattgaccatacagagctcgtataattggtaataaagagcaccctgtattttagttgcaaatagtgtgcaataggtttcaggggtgtcatgattgatgttcactgtcaggtgttgtaaataaactttccaatcccagatggtgtttttgcctagttaggttctacactgatcccaccacatattacactaatggggaaaccttgtgtacaggttcctcatcttccaagctctattgtggtgaccctagaaactgcctatgtgctcacatcatggctcctaacagcatgaggaggagtgtcacagccaaggctagagtgttttcctggcctgggagaagtcttaggattgtaccgcccccgccccctttttttttcattctgctgccttctcagcagtcaacttcagaatcactcttctcctgtcttctttcccccttctttgcttgttccttcctataccttgcttgtctttttacagaagcatttaaggagatggaaaagatttggcccattcttctcctgtcataactctgcctgtgtatttctgaagatgatgttgactgttggggaatgggatgtaggagaaagaggtctactgtgggtcttgcttcgcacggagtaatccgacctggcgtggattgtctggtctcctccttcatccatcaaagagtaaggcatggttcaattacttctagcagcaagtcccacagaacacctgggctttctgagctacctagggcaggtgtgttatttggtaggaagtttgggcagcactggggctttcagtgagagcccctccttctaccttggcataatcataaaatctcaccaatacgtagccctttatgctttttgaagcacttatacccattacaattctgtggggcatttaggacagacattgttttcctactttat

SEQ ID NO: 13832 - DNA, 1056 bp, Homo sapiens
gagaaggctgtgctctggaatagtgtcctttccactgagtccctgacttgcctgttggcatatggagcagtaatcttttcaaaactccattgtgaagttggctgtgtgtgtgtgtgtgtgtgtgtgtgtgtgcgcgcgcgcagaggaaatacttacatactaaaggggaaagcgggggaggaaaattccaggaaattgcaaggtgaggttgacattccttattctcttaactcttgcttctgtttttctttctgaaaaacaatgatgacttaaaatttgatcccagaaccaactggctttttatccgtaagattacagttgtgttttttagacatcctttcataaatatctaatgaattgccttttattatttggtgttaatgaccaaaagtaccactaacatagtgtttctcatacttgcctgtcatataagatacttgttaagaatattctgggacttcatcttcctcttgttaaatcagaatctacctggaataacatagttaccttattttcttagaatagtagaactgaaaagaatcttacacatgaaagtagttcaggtgttcccaaacctggctccagtaccatgactgctttaatagattgccaagctgcgcttcatacctagtgaatcataacatccgaagcttcctagaagagtcggaccattagactggagggataactactcgcttattcggttgccttcaggaaaggggaatttatgtgcttggttattgggctgattaatagcaggacaagaaatcttattgtctctgtagattcatccaaataatatccaaatatatatataatgtttgtttgagatggggtctcactttgcccccctggctggagtgcagtggcacaatcacagctcactgcagcctcaacctacccgggctcaggtgatcctcctacctcagcctcctgaatagctaggactatagacacgtgccactgcatctggcttttttttttttttttttttttttttttttttgcattttttgtggagatagaatttctccatgttgcccaggctggtcttga

SEQ ID NO: 13833 - DNA, 1049 bp, Homo sapiens
ccccactgtggcaggttgaacgtttgtttttgttaattaatgtccatgcattctgctctttcagtaactagatttaggtaacctgggcctgtttcccatcacttcctggccttgtgactgggcaaataactttgtctccctgggcctcagtttccttaaccctgaaatgaaggggttagattccagcgctttgcattctctggccagctcttgagcacctgcgactccttcctgctcttcagttcttcctccatcctggctgacttttgcttggctcccgctgcccccattggcccccttaaactccagaagagcatagaagtgatcaggtgggtctttttgttcactatccattaacttttcaaggagggagatgctgtgttcaaggagtcagaggtgaaattgtgagtttatctgattttctgttcacttgataattatatagttgacttggaagtgtttcaaactgaagatattccttaatgaaatatgacctccccactgccccatctttagggaatggcattcaccaaatcctttcaaattcagagaaattagaaaaccttggatcattttagtattaaatttagtcttaaaattgtgggtggttgtcaaatcagacctcgtctaaggggacctcattaggcagttctctataatggtgacagggtggcttaaaatgtcttaactaaatgcaaattatctcagagccaaaagttgagcacttgaaagccaatgaaatatctatttaaggagcacagaaggatgtcagagaaggatccaaagtcctgatttttttgttacattatattggggtagatttactgcaagccagaggattctttacgtaattaactcccatttgaaaaaatagcaaacaataaaactattttttttccctttacctttggtataaatagaactaagccataggttggtatgtttagtaagtaataggtattaagtaagtaatatgtattacttacattttaccatagttgaagtgtgaacttgaaatatttttaaagcacagtctacagtggtaagaa

SEQ ID NO: 13834 - DNA, 1020 bp, Homo sapiens
aattggcagaagagacttaggggaaagttctttctagggcaggacccttcaccgggggaagatgtagggtttaggctccaaccttgactcagcattgccatttaccattttggcacaggaccttgttgaagccatgactaagggcctccaggtggtgggctgtcctttacaggtcctgatcacagttagggatgcagctcggactgataaaaaagggccttgggctctgtcagaaatgtgtgtagttgaattacataggtgattctgataataaagatgtttttgtgttcccactaccctcttattgggaagatgtctgccttagaaaataagagaacaggctccaaggctgggtgaccaggaactcatctctggcaacaaactccaatagcctttgtctttatctgtggtaataataattataatagtcctaatacattctggggttatggtggtgattgattgagaatgtataaggaaagactagatattaaagcattaatcacgtgtaactgtctgtaaacagcggttttgtagttttttgcttttagtaaataggctcccccgtgtgatcaatactaaactgacagcaaaagagcagtccattcttattagaccatgcttggggagataagttgctgctggctcatgaaggacacattcttcttgatgtagggaggtggaatgaggatttaggcgctgtcttcctcccctttggggtagggtaccttgctgtcttttgacagaatgaggatgagaggaggtggtaggaaggcgggggaggatcagtgatgagatggcactggggacagtggagagaatggttgtgcatatgatttacggtctttcttttcagtatactacagtgcttagatgtgtatgcagaaatcaagagttatcagtgatgtttgaaaattagatgttgctggcatggaacttccgttttcattgagaacagagcgtgcttagtgacgtgtatatttagtacagtaagacagttgcagaaggatggccctgatg

SEQ ID NO: 13835 - DNA, 1024 bp, Homo sapiens
ggtcgatgtacgttttctagattattaggctcatacctactacttttcaatacttgtcagctgataagaggtatctcttagtggttagtgtcagcagcattactggtataatttgtggccttctttcacacactagttttccacacctccaagcaggttcagggcttacgtagctactgattcatacgtactgctggcaactgactagagaggtggaaaagggagtaccttgggggtttaggggctagaaaaggtcaccattgggttggaaccaggaaaaaacagagtgcacgcctatgatgagcactgtagtttaggtagaatttcaacaggctgaggctgtatttttgggccagattgagaggagattcagggggaggagcagcctggacaaaggggaggaattgagaagtacagtgtggttggattcgtgtgattggagttaaggctggagaattgggagccatgtccccatcatttctttttgagagtagggagctatcgagtaggaaatgtgtgtgtgtaatgctgacggtaatactgttaggttaaagttttaagcaccaactgtgagcgctggggtgcttagtgttgtaacagagcatctccaggtactctggaattctctcaaaatatcctggaattttccttgatcaggaaaaaaaatgatatggtcgagcagtgaattttaagaattttatttttctatttatttacttctataaacatttgttagtaactgtgttttattatagagttgcccacgcagtgtgtggttttggtgactaaaaatgaggattggatgaccattgactaaaaatatatatttatatgtattttatatatatcaacatatacatatatatgatatattcaggtttttaaaagtaaatgataaagaacatcactaattttattttatttttagtaaatcagtaaatcaaatatgtaccagtttttaaattctggaaacaaagattccaggtttctatagcgtttaacaaattattattcatagcaaaat

SEQ ID NO: 13836 - DNA, 1043 bp, Homo sapiens
tcaacttggcctcccactgtgctgggatttacaggcgtgagccactgtgcccagcctaggttttagggtttttacattttactgttgacagtactgtagctgtgatgggaggagggaaataacagggctcgtgagagagtgctgagcaccgtcctctctcccaaacacagcttccgtgtgttttagatgtgttctttccctatcatgccatccatgtttaggggcacaagaagagtcaggtgaggagggaatgggcatttaagtccacgtgaacccctctagcagggttcccctctgcatcactgtttcaaggagatgggatagaattatggcgtaactgttttaatgtacgaaatcagcagaagcgatgaatatttttatcttcaaatttgtattacacactgaggaccttatatatgattctaaatttattggtcatatcctgaaatacacactgtgtgtacctagtaaccttgtattggttacagtggtgctgtcttaagtttgtttatttgtttgtttgttttaaataatgtctgaacccaccataggggtagcactctagcacagttttgggtaacaaataagattgcattctgacatggtgtcataaatcatatctaaaagccgtgaggtcacatagaacttgtttatgtaacagggtagaacaaaactcattgttctgagaatatattgctcactcattttatcctcagtcacgatgagttttacagcctatgtgcagtattgatgccactgaataagcatttatttttgatgaagatacaacttttctcctcacgttcagttgagagtttgcaacaagtaagactttgcattctggaatttatgtagatgtatgtgtatagatacatgtggtttttaaggcctggcaaccttaatgaatactggtagaagattttggctgtcttttaacagcattaccatgtggttgaccatttaaataagcagcagtttatcttgatgtagtgaatgcatttaattggttatcctggcaaagcagggtattcgttggttacaag

SEQ ID NO: 13837 - DNA, 1032 bp, Homo sapiens
agtgaagacaaagatgactttatcctggtccctggtcagggacctggttcataatttaaaactcttttgtttgaatttaagaatctataaagtaggattgataaactatactgccttggattgcttttgaaaatgtgtgtgccaaggcctgctttcacatggtaagaggaaagtcattacctatcatatgccatgttttcctctgacttatacctaaaatattttagagtgcttattgccttatgtaaaattacaagatcatataatcacattcccaccctgtggaaaattaaactttttttttttttttaaagtgaaagcaagtttattaaaataaaggaataaagaatgactactccaaaggcagagcagcctagactctctttgtaattgagtctaagctaataacggattattgtaaaaaaaacctctgttttatagcagaattttctaccgggccacatacgaattttctgctcttgctgtcttcagtgttaacagtgggaaattgtggacacttaaactgagcagtacttagaatttgctggatatgctgaaaagtaatccatcagcattggagaccacaagcagtataaaattgttgatacccatatttatttttattttctttaggtggagaaagagacccttgagttagagtttttggatgatgaatttagtactcaatcattagtatatttgtgcatgtcatattctaggtcacaataaattatcaacatgccacatttgtggtagttagataatgcttttatttcctcttttttccccacgttgaatccagattaacataatatgttaatttgtgtttttctcaactgagtgtggtaattccattgcattaaagtgttagggacttttgtcttcactaataatccacttaatctctcacaataaaaagtactttcatttctactgacttacatttatccaatcaaaactttttatattactagactttttgttacttttacctagcatccaaaaccatgttttatgattggttggcaaaga

SEQ ID NO: 13838 - DNA, 1050 bp, Homo sapiens
atgtaatgtagttaaaggttcttatcacttgactgctgagcacaagaaaagcccaaaccaggctacttgttgtaggtcctctggtttcagaatgatttatgctcactttactagcacatatttagttgccttgaaccttctcaactgtagcttcctcttacagaacacagtgccccacaaggagactttgaatctgtgatctcctcccaggttttagccgaagcccacaacccactgagcatgtgaagcaagggccattggtggatgggtcttatgtccatatgcaggttgaatattcctaatctgaaaatctaaaatcctaaatgctccaaaatctgaaacttcttgagtggcaacatgatgctcaaaggaaatgctcagtggagggttttggatttttggattagggatgcttaactggtaagtttaatgcaaatgttccaaaatctgaaaaaatccaaagtccaaaatgcttctggttccaatcattttggataagggatagtcagtctgcacttgatatacctctagaggctgtgaaatcttaggcagttcaaaagtcatgttgtttggctgggtgcagtggctcacgcctgtaatcccagcaccttgggaggccgaggcgggcagatcacctgaggttgggagttcgagaccagcctgaccaacatggagaaaccccatctctactaaaaatacaaaattagctgggcgtggtggcgcatgcctgtaatcccagctactcgggaggctgaggcaggagaatagcttgaacccgggaggcggaggttgcagtgggccgagattgcaccactgcactccagcctgggcaacaagagtgaaactctgtctgaaaaaaaaaaaaaaagtcatgttgttttaactattcattgccatttgttggttgggcctcttcaaccattgtgatccaatcctagttcaatcccttgttgaattcaagtattgaggtcttaggatgaatgaacaaggctttgggctggcacataaaggtgggacacccacaggtcctgctctttgggagtttgggta

SEQ ID NO: 13839 - DNA, 1064 bp, Homo sapiens
tctagcctgagtgatagagcaactctgtctcaagaaaaaaaattttttttttttattcttttttagcagagccttgctctgtcacccaggctggagtgtagcggcgtgatctcggctcactgcaacctccacctccagggttcaagcaattctcctgcttcagcccctcaagtagctggtattacaggtgcccaccaccacacccagctaatttttttgtattttcagtagagacggggtttcaccatgttagccaggctggttttgaactcctgacctcaagtgatctgcctgccttggcctcccaaagctctaggattacagatgtgagccatggcacctggcctaaattttttttaaggttcaaggattctaaaaaaactcaaaacaagatttagttgacagtggtcccaagctaatagtgttccaggtcaacaggaaccgtgtgaaggaatccaccataacaacagccttcaaatgacaaaacacacaaggaagcaaaaccatgaatgtgtaccagcagaaacgagaacagaatcagactcataaagcctctgaatattgggcttatcagagtcagaatataaaatatgtgtaagatagaatgaatattgagcaggatgctttaaaagtgaccaagcagatttgaaaaacattaaaaatgttggccttctcgtcccagttcttcccaaagttgagaaaagctgggttgagaggatgaaaagaaaaaaaaagaaaaatttagtggagtttaacagcagtaaagaagtatccatatgcagcagagagaagcaaagaggaaagaaataggaaaggaaagtaaaagagtaacatttgtacaatcgtattgccaataggaaagaaaagagaaaataggtcagaggctaactctaaataattgttttttttttttcatttttttaattgagacagagcctcgctctgttgcccaggctggagtgcagtggcatgatctcagctcactgcaacctccgcctcccaggttcaagcgatcctcttgcctcagcaccccctagtagctgggattacaggcacgtgccaac

SEQ ID NO: 13840 - DNA, 1051 bp, Homo sapiens
atcctcccacttcagcctcccaagtagctggaagcactgactgggaagagttaggtttgggtgactcagttgggtgaaacacagagaaggcagcacagtacaacacatgaaataaccgaagcagtttttttattaattccagagagaagagggcagcacactttgcagggctaactggaagggagagccatcaagaagacctgtgcttgactgatggttggggagcaatagcgagagagagggagggacctgggagtggaagcctttattgggatgtaaggtgctatctgagcaggtttcctacagggaggtccactttggtttaatgcaagcagccgtgagtgtctgctgtgactgagaggtggtcactgatatattcacatggttcatgcggagtatgggggtctgtggggtgagtcaagtaggttatatctagctgtcccataatgaagtggtccccaggagaaggctgaataaggtagataccaggatcagtcacattgagaaactgggaggaggtgaactggaaactgctgagggtgactgaaccccacttttgatatcagaaagtccaatttatatttaaaagggatgctgaggcaacaaaaaaattgtaagaattcactataatatacttgggtatatataggcataggtccttagtagattctgtttagcactatctaaaccagattcaaatatcagcatttaaattaaatatctagcatggaaaaaatactattccttgaaaattttgatagaaacagcaagagaatgcaatagtattttcttaagcctcctcctttgtgtcttgagtttattgttacagactgcagagtgctatgtatttaatggttataattgtttgataaatatataaaggaataaaggaatgaactttaatttctttggaatgattagttcttggtatcagttttattttgaaattttttttttctttttaggatcttcctaaatactatgacaattgtccttttttcttctggtttaacacaccttttatacaaaataacagatatagatataatat

SEQ ID NO: 13841 - DNA, 1059 bp, Homo sapiens
cagtcgataatttttccttccctgcaggagacatgtctatgagtggctgggagacctgtttaattctgggatatagaattaagatggccatctgcctgcaagtagagataagctgcattctccgaaatcaactttgttcatgataaaagtaacattctggcctccatatgccatattctttattgttaatttcttaaacagttaacaaattggttagagaagaggcaggctatctattgccccatcctctacttttttttttttttaaaactaaatacctaatcgttatattgttattcttttgactattattgctctccttaacacatataaaaatagaccaaactgacatgatcatattttataaaaatacgattttcttttcttgaaaaggaaacagaaaaaaggataaatggcttaaattgtctacttatcataactagaattagaaatcccagtctttgtggctgccaaaaaaaaaaaaaaagaataaatgaccaaaaaatgaagtcaaatgcaagtctttcatgactctctccctgtgactgttagtatgaggaaacttaatagttctgaaaataaagatgtaaatttctgcagaatgtaaaacaggataaagtaacaatagccaaaatgtggaaacaacccaaatgttcatccatagatgaatggataaacaaaatgaggtatatatgtacaatggactatgatttagcctaaaaagaagtgcaattcttatatatgctacaacatagatgaaccttgagaacattatactaagtgaaataagccagtcacagaagcacaaatatatgattctatgtatgtgaagaacctagaataggtaaattcatggagacagaaagtagtttccaggggctggtggtaggggagaatagagagttagtgtttaatgggtatagactttctgtttgggatgacttttttaaaagttcaggggatggatagtagtgatggctacataacaatgtgaatgtacttcacaccactgaattgcacacttaaacatggttaggatggtacatttttgtgtatttt

SEQ ID NO: 13842 - DNA, 1031 bp, Homo sapiens
aaatgatttcatatttttcttattatggaaacaattattacatttctttgctcctaaagaaaataaacacttgagaccacataccccacatacatataccatcacttgatgtctgattaaaaatgttggcagttttccctatgttaccactttgttagagtattttaaggtgcaaattttgaaggttttttgctaaaggcagatggtataatcatctgataaaaagaagtcaaagaacctaggggtgaatgggcttctctttttgttaagtctgccttttgatttttaaattctttttgcaaaactaacgatccttttcatagaaaaaattagaatataacattctaattcaattcttcatttaaactgttttatataatgttatggtgcttactttaatatttgcattaaaaatgctgattttagccacttaaaaatagaggtgagagcattatttgaataaagaaaacaaaaagtagatataaatgctatgtgattgtgtgtttaagggtaaggatagactcaggggactaaccttgattagagagtaaaagatgctattaggatactattaatttttaattttaataagtgaacttactccagcattcagaagttgttaacttctgcttctttttgtgtgtgtgtgtgtgtgtgtgtgtgtgtgtgtgtgtgtgtgtgtgtatgagacaagagttttgctctttttgcccaggctggagtgcaatggcacgatctcggctcactggaacctctgcctcccgggttcaagtgattctcctgcctcagcctcccaagtagctgggattacaggtgtttgccaccatgcctggctaattttttgtatttttagtacagacgggaattcaccatgttggccaggatggtcttgatctcttgacctcatgatccacctacctcggcctcccaaagtgctgggattacaggcatgagccactgtgcccggcctttttttttttttttttttttttttttttgagatggtgttttgctcttgttgccccagtctg

SEQ ID NO: 13843 - DNA, 1050 bp, Homo sapiens
gtacaaactactataaagacaaatctgctttttttgttttgttttttaattaagctgaattttatgttactttattatgagggaacaatgaataatttaaattacagtttaagtaagttttagattcctttatattttcaaaatgaaataaaagatatacaatagaattaatattcagataatatttaactatcactcaaaatatgtagataatagccaggcacagtggctcatgcctgtaatcccagcactttgggagaccgagttgggtggatcacctgaggtcaggagttagagaccagcctacccaacatggtgaaaccccatctctactaaaaatataagaattagctgggcgtggtggtgtgtacctgtaatcccagctactcgggaggctgaagcagaagaatcacttgagcccgggagacagaggttgcagtgagccgagatcatgccagtgcactccagcctgggtaacagagtgagactctgcctcaattaaaaaaaaaatgtagataatagtttagtaagaaaagtagtgaactgaaaaccaagaaatctgactctggatctttgcttgccccgtgaatttagtctaggcacaaaatgactatgactaaattttcagtacctttgaaaggaagtccgtggaccaaatgagctctggagtcctttcagctgtaaaattatatgaaggtataatgataaatcagttaatgagaataaatggtataggtaggctttttccattactactccttttttgtgttttatttatttatttatttttgagacagagtcttgctctgttgtccaggctggagtacagtggtgcaaccccagctcactgcaacctctacctcctgggatcaagaaattctcctgcctcagccttctgagtagctggggctacaggagcccaccaccatgcccggctgatttatatatttttagcagagatgggatttcaccattgttggccaggctggtctcaaactcctgacctaaagtgatccacttgccttggcctcccaaagcgctgggattaca

SEQ ID NO: 13844 - DNA, 1072 bp, Homo sapiens
actgatctgtacgtggacttagtggatcctctgttatttaccttaaaattccaggttctatctgctttggttgccttctttttaaatcttgtcatatcaaacttaagaaatccattaaaagcttggccatttgtgaaactaatatacagaggttgcttgtttatttttggtacacttggaaaagtctttatcaaaggagttatgtcttagagtccccagctacaagcctgattgccttctgggggagatctgactttgcataaaggctgaggccctcttcaggttaagtgaaggaacaaccctgcctgtggtctaacatttggcttatctctttgcccattcttggcagcaaggaggctgatagttgttatgaaagaggagtcagtgtggagagtaggaacttattactcttttttgcaaaatcttcctttaactgccccctagccatcccacagaggcccagggataacgtcctgaaaatgaataagatgagatcattgtatagggtagaacatggactagatgggcttcagaaactttcagtggtgaattttagtagctagtgtttagtgagcatcttgccccatgcactgtgctttatagggattatcctatttaattcttacaacaatcctaagaagtaggtgctcctaattctcactacaaaagagtcaagtgaggctcagcgaagggaagcaacttgcctgtaatttcatagctactaagtgataaagctaggaattgtaacccagcctgtgcctttaaccactaattgaataatactagccactgcaacatgtaagtggtgaaaagtagtttaaaatatggaagaattattatatcctgcatttatgattttggcaaaaaagtgttactaattttagctaattagtataattacaggtagatggttcttatgcctggcatacctgtatatgtaccttttaaaaaaaacagctttattgcaatgtaattcacataccatataatccatctacttaaagtgtacaaatcaatggttttaagtttatacagaattgtatgtctgtctccataatcaattttaggacat

SEQ ID NO: 13845 - DNA, 1047 bp, Homo sapiens
tctcaaggtgttgggattacaagcatgagccaccatgcccagccttcatataaataataattaaaaaaaaatgttggccaggcacagtggctcacgcctgtaatcccagcactttgggaggccgaggcaggtggatcatgagatcatgagttcaagaccagcctggccaacatggtgaaaccccatctctactaaaaatacaaaaattagacaggcgtggtggtgggcacctgtaatcccagctagttgggaggctgaggcaggagaatcgcttgaacccgggaggtggaggttgcagtgagccgagactacaccattgcactctggcctgggcgacagagtgagactctgtctcagaaaaaaaaaaaaaagtgtttttcctatttctgtgaagaatgtcattggtatgttgatacagattgcattgaatctgtagatttctttgcgttgtatctaattatttattttatgatttatttttatcatctttcctaatctccttgaggacgtgtcagatttttgtatctatgcagagatatcagtagttattagagatgtttaaggattaaataaaaagcagtatactgtacatgttttactttgtaaaccataaagaacttattagacattaggtattgctagtaaataataatataaataaaccttattgtgatattgtacaattcctggatgtgtctttatagtaaagtatttttttaaatctagtaagtgcccattacatctactgagacaactttgaattcttgaactttccaagagtacaacaaagcgataaagcagaaaacacctctgataaagacccaggttcggcccagtgtggtggctcacgcctgtaatcccagcaatttgggaggccgagcaagcggatcaattaaggtcaggagttcaagaccagcctggccaatgtggcgaaaccccgtctctgctaaaaatacaaaaattagcccggtgtggtggcgtgcctgtagttccagctactccagaggctgaggcagcgggagaattgctggagataatgacactgtg

SEQ ID NO: 13846 - DNA, 1051 bp, Homo sapiens
ggtgagtgactgtagtcccagccacttggggagctgaggtgggaggatcacttgagcccaggaggtcaaggcttcactgaggcatgttcgtgccactatactccaacctgggcaacaaagtaagaccttgtctcaaaaaaaaagttaactgcctatttcagcaagagggattgggtagattcagatgtaagtgttataagactgtgtgtctgtcccaaataactaagaagatctaggcatacttctagatgaataaatagtaatttccagttgagatccattaacaaattggagctttagttacctagaagtaatttagttaggtttcatcttcagaattatcccacattcaaatacttctcaaaaacacatttcaaaacaaaaacattcataaaataattagtatagtattaacatccatgaacttttaagtagctaatagattgttgaatctaaccagatttactggtatattcagtgtttcatcttgcttcctgatcagtgtttcatgtagcttccttagaattcttactgtaatggtagcaatttctgaatctttagtgatttttgttgttgtcattataaactagatatacattcttcaggtaaagctttcaaaatttaacaatgtaaatgtggaaactgctatagaaagtgaaaacatagatcttaacccaggtttttactttcatcatcccttggctctctttcctgaaatacttcccatagtgtatgtataagcagtggcatggacaaagaacaaatggaaatagaagtcataagatttcattgtctgagggttcctataaagtcatgtaattagaggtctcttaaatttttattatataccttttgatctatattattattgattcattcagcaattattgcctgttacatattattcttgatgttgggatatagcaatgaacaaaaaataaaaactattcataaattatatgcatatattttactaattaacctccatttaaaatgtattataattatataaagattagagaaacatagataaactagattagttttcgat

SEQ ID NO: 13847 - DNA, 1056 bp, Homo sapiens
cagaagaggaggtaaagctcttgaatgttgttctcttatgtcccacaatttaattatatgatgtaaaattaacaatacttggccgggcatggtggctcacacctgtaatcccagcactttgggaggccgaggcaggcagattacgaggtcaggagtttgagaccagcctggccaatatggtgaaaccccgtctctaaaaatacaataataaaaatggaaaaattagccgggcatggtggtgtgcacttgtagtcccagctactcgggaggctgaggcttaagaatcgcttgaacctgggaggcagaggttgcagtgaaccaagattgcgccacttcactccagcctgggcaacagagtgagactctgtctcaaaaagataaaaaataaattagcaatacttaaatactgatataaagtaaatacatcttatattacatagtaaaggaataagaggaaagaacacaaagatatttgctttgttatatctatgtatatatacacacaaatgtattctgaacaaaatagggagaatatagtcatgacagttaaaatcctcatttccctaactggtcaggtggttatagctggcattgattactgccttcttgtactacatattctgtattctgtttgccttcagcaaacgccttagctggtcgtggttctttatttggtggggtgacccaaagcttcattcttaaagggtctgggctattagtagaccttcctggattgggttgttgtagtttcccgttgacttatttaaagggcatgataatacaaagagatgccccaagggatctcctgtattccagacatactcttctttatctgcactgtgagttagtagtccagcttcccattcctagtttagattaatcacccccagctatgttgactcagaggcatgaggagcccaaagtggctggatggtagttttgactccagttccatggaatcattattgtgtttcctggtggaagtattcctctctctctggaactaagacttctaggccaaaagagcataaagttacgggaacaggaagtaaaaat

SEQ ID NO: 13848 - DNA, 1068 bp, Homo sapiens
gcagtttcttatttcaccaatatgtgagtgttagatgctgggataaaacaatgataaaagctgacaagatcctcatgaagcttgcagtttagtgggagagacggacatggattgaacaagtaaaaagtgtgcttaagtgtacacgcatggcagggagacccctaacatagtgtagggaagggctggattgagaaggcttccctaaggacatgacgtttctgtagagatccaaaggatgactaagccttatgtaagagaaagggagaaaagggaagagagagtagattgagggagtagcattttgcaaatggtctgcaaggaggaaagagtgtattttgggaaatgaaaggcctggtgggctgtcatgtagaaagtgagatgcaatgggagatgaggctgcaaggtatcaaatcatataagacattctaggccatgttagatattttgaattttatcttcagcagagtgggcagatattgatgggttttaaatgagggattatggaggtggaatggcataggagcaagaaaaatgatgtacttttttgtacacttggtctttaactgtaaactacctgtttagtatggtgcttgaatgttggaggggattgtatattggccaccattgtgagctgttcatatggtaaagtgtacttaaagggtgaacttaagagaattgtcaagggtaattgaggataagtgattttcaccttgatactgtgatttggtagtttgaagccctagaaattgatacttgacttgggagagtctggagtaagaagaagactttgagcttttaggacctctagtggtaagtggtgaggaggtggggcagagaaaactgagaaagagtagtccagaattggggcaaaatcaggagagtgttatcacagaagccaaagaagtgtttaaagtgataggtctaacacaacaagttctgaaagtgttcattggatttagccctgggaggtcattaactttagttagatttagtggcataataggggcagaattaagttagattaggctggttgaagaatgagcgggagatgaagaaatgagtaggtga

SEQ ID NO: 13849 - DNA, 1057 bp, Homo sapiens
aaagcagatgttttggttgttagtatgtgtgttcccagactattttgtagctttaactgcacagtaaatttgttaatgtgatctgcgtgattaaggattaattaggcttaccttgttaaaaagaaagaaaaagcctaagtattttaaatcgtcttcattaattcaaatatttgtgtgtttgctacacaccaagcaccaccacatgcttttgaagttactgatgtttgtattctttatgttagctagtggatagaatactgaatggaataatattttggtctttgtgattagctgtgtgatgagacttttcaccttctctgttctctggctttagagccatacatttttgataacacgtatcactcacaaattttaaatagagttacaagaattgttgagcgattcctgaatagataatgaaagtggaattttcatttaaataagtaatagtgtgtcattattaagaagcagttactaaagaattacagtagttgaaaatttggaaagaaggaaagataactcggataactctgccttaattgtccccagagagggcttaacttttgactttttcttcttttttttgttgagacggagtctcgctctgttaacccaggctggagggcattggcgcgatctcagctcactgcaacctccgcctcccggattcaagctattctcgtgcctcagcctcccaagtagctgggactacagacacccgccaccacgcgtggccaatttttgtattttgagtaaagacaatgtttcaccatgttggccaggctggtctcgaacccctgacctcaggtgatccacccacctcggcctcccaaagtgctaggattacaggcatgagccaccacgccaggccttgaccttgtattttgtaatgagtttacaacattgtaccaaatggtgctaaaatggatgttattttcaactgtgcactcagtaattgcaaatagttgtactatatacctgggggtgaacacaaaggaagtagttgcatcatctctgtataaaacacagatttatctttcgtgtagttgtgcattac

SEQ ID NO: 13850 - DNA, 1074 bp, Homo sapiens
tgagtctagtactgaatgggacttagatggattcagtgagctggactctgagtcaggaagttcaagttctttttcagatgatgaagtctgggtgcaagtagcacctcagcgaaatgcacaggatcagcagggttctttgtaaatagtattttgagacactaagatgtttctactgctacggaatgtattttaaacacatatcgtttctttttcttggaaaaaaagttgattaggaccacagatttggtttagaaagggtaatattttgaaatactacaaggtttagacagtccatgaaatcgacctgtttaataatttaccatcctgaaagtccagaattaaaatatggaagcaagaactatataattgattaggatgcttggtaggtttttttcattgttcaaatattcattgcacagtggattgttttgattagttagtatgctttttttttaattaattcagtcttctgttaatttttaagttttggttagtgccacaaggaatttaactttttgatttgtataatagaaaactgaactaggaattgttagcggggttttgaaggatgtgtactttccttcaaaataaagtggtagattttcaaaattttacactagtcagttctttatattctaagttaaatgtagtttgtaaaattattttggttttcttctacaaaggaaaaaattggatttatatatataaggttactgcataatgatttcattttgataatgtgcagaatggcctcataagctcacagaaagtaaaaaaaaaaaaaaaaaaaaagaaaaaatcaggattccactgttttaaaagaaatctcagtttttattttggaatataaaatgtgtatttggtatatgtgaccaattttctatcccaaaaaacacccattcttagtaatgtcatgaattaaacacccttctaaaccaaaaaaaaaaaaaaaaacggtaacttgctttttatgtttgtgtttttaatttatgcccaatacatgctttactgactcagaggaacaattcctggacatataattgggtaatgcaaatttttatccactggtcatga

SEQ ID NO: 13851 - DNA, 1050 bp, Homo sapiens
tacaataaagatgaattaggaaagctacaaaataccataataaaaattgaagtgggtcaaaaaaataaataagcagtttttagtatataacataaatctatcactaaggcatacatacataactttttgtttttcttttccatatattatatgtaaaatggcatctctcagagtaatgggatttctttgaaaacagaatgggtaagtgtgtatataatgactcagctggatcagctaggtggtgatccttttaaaccactggcaaaatacccctctccagtgagatccattttccctgcatctggtaagtctcatgccatgtgtaaatgctcacagcttggtttgcaccagaaaaattctgtagctataatgcagtccagctcctttacttttctttaagagttttttaaaaaattagttcttcttcccaactagatggatgttggaatccatctgatggaatttttgccaaatactcacagcatttatcaagtccagtggcctgaggttatgtgataccttaaggacttaggagaaaataatttttttttctgtcatgcagtccctggtgtttgtcacaggatagtaaaaatgtctcaattgttcatttttagataacaatcaacagagacagtggtgaagatgtaagctcccccaaacacgggaaggaggacccagacaacatgcctcacgtgggcggcaacacttgggctggcggaacaggttggtagcacaggcattctcctgagtcagccttccccaggtttcccaagcccattaggccagcacatcgcccctgagaagactcagagacgggctttccttctcagcctccctcattactcagttggattgttgtcttgccctctgccccagcgtgacatcaaggcatgtgaagagcctggcatttggagtcccacaggctctgccaccctgtgacctaagaacatgctgaccctcctggagttgcttcatcagtcaaagggggatagtgtgaactaccttaaattgtggtgaggattaaatgagattacgattgttaagcactga

SEQ ID NO: 13852 - DNA, 1049 bp, Homo sapiens
acaactaatgacaaattcttgtcatttcactatatttggaagttgtaatataaaagcatcgtcactaggctagccagaaatcttgagtcaatgtcctttctatcagaagatcttttggctatcaaatgaaaggcttttatgaaagaattcagaaattttagtgaggtattgtagcacagagaaatttcctctgactaaaaattaagaaacccaaatcctctttctggttccatcactagttggttttaagtagtcatttcacctctctgggccttaatttctttttttttataaaataaggtagattgtaagctcatccttcaggtccttccacaaaaggcaacaatgaatacagggtctaaaactaaaagatacacatcaaagaacttctccattgtagtgattcttcttttaattaactgctgagtatgtgctagctgcttctgatacattctctcacatgatcattacaaccaccatttcaggtgtatatattattgctcccattctgaggttgggagtaagtaatttgtccaggctcactctgctaacaaagaacaaagctgagatttcagcctaggtttatctaactcagaagcccgtgtttgtatgcctcttccccatgtggcttccctaggaccaaaagattagttttaatggaagttgtgcccttagagaagaaaacagatgtctctgcttagtagaatttagactaaatgcttataggtgccagacaggcaatgtggatggggacacaggccaggagggtctcaggtgaacaggaagttgtgccccatataggaaggcagtcactacctagctgttgccatgtgagaatctggccccaatttggccttatcctcccattttcaagagaagaccaaaatctagatttttaagtgaaatctcattaatttgaaattttagcagcaaattcagaatgtttcacactgggagtaatgacagtacacacatttgtgggatggcaggacctgctgatatctcttttctcacaccagggtggagcaggattgagaaatgaagcccca

SEQ ID NO: 13853 - DNA, 1046 bp, Homo sapiens
tatttcttaagtattacaatattgtctttgttttgatttatcactataaccttcactgtcaggttgccaagaggttgctgctttaaaaaaaaaaaaaaaaagaacaaatcttgagcttttcactgtttttatcatttgcagagtaatgttatcctgttgttagatactactggccgggcccttcatcgtctcatcctcccttccgagaagtttacatctaagaaacctttctggtggaacaaagaagaagctgtaagaaacaccacatttgtcccacaaattgccaaggatttctatagctttctaaccagaaagatgcatgcatgcccatccctttaagtgccttttttgttgtaatgcacaagagaatttcctgttatgcacgtatagattttaacatgatatatataaccatagatatgtgtataattaaatatcaataaattctttttatgacattatacttgcatgaagatttgccaggactggactaacaataagagaaaattaaaaactatttgaatatcgtatttttaacaaatttctgatcatggagtcaatttaacctgttttccagttatgtagttatgttttggatttatatgatgaaactgtgagtatgatacctaatttcctccattagacaaataagtgttttagtttattaactaaattaaactagtaagtaaatagtttaggccaacacaagagaatttattctgccattcagaaaaaaataatggatttaaaataaggtttaccctctgccctgcaagtcaacatacttaggtcttaaaagactatgaaaagagtgattttttttaatgtcataaatgtatcctaatataagaaacaaagtgtttcccatgtgtttattttatggtgtaaattccatggttaatcatcagatagcctgttatttcttaacaatgtttggtgttgtttttaaaaatttattctgaagaggctttagtacaaagttcacagtaaattttgatatatagtttaatccattttaccataagagtcttagagcagataaatag

SEQ ID NO: 13854 - DNA, 1031 bp, Homo sapiens
gaacataagattagaaaatactaagatgcaactgataaagcagatggcagaaagagagaagactttttttcagtgaaatgtgaagaaagatgaaggaaaggaaaccctggccccagaactagtctggcaacttctgtgaggaggaagagagccagagatgtgtggagcaagctgacaacatctgctttggctctgagtgacgctgggcaacagcactaaactacagtgtcattctgggtatcggggagtatatttgagaagtgcctgccaagaatagcaaatttcccaaaatcttccatctcatacatctagattactctgcatttctgtgatctctgcaggacctaggtgggagaggtatacaagtctaagttatgaagtggaagccataatagctaaatgcagaaccaagcacagaaagagaaaatatgtacaaatactcaggtatacatcatttgcagcaaagccaaattaatttaccaacatcctgtgagatggtagggaagcgacattctgaagtttctagcaaataaaggaagatattactgggaattaataatggtatccattgttactaatttcaagtatgtaaaggggcatttgtattatctctctttaatgtgctggctttttcttttagtacatacaaattttttttttttaagaccaaatttcgctcttgtttcccaggctggagtgcagtggcgcgatcttggctcactgcaacctctgcctcccgggttcaagcaattctcctgcctcagcctcccaagtagctgagattacaggcatgcgccaccacgcctggctaattttttttgcatttgtggtagagacggggtttttccatgttggtcaggctggtctcgaactcccgacctcaggtgatccgcccgcctcggcctcccaaagtgctgggattacagacgtgagccactgcacccggccccatgtaaaaatattttaagggatttcttggtttacttctgacctgctctctctaaaattttttctctctcaggtctttaatg

SEQ ID NO: 13855 - DNA, 1033 bp, Homo sapiens
gatgaaagaggtagtaagaactagtgggtttatttcatgtgagctagttgcctaccctttattttataatcataggctactacttaatgttagttaagaatcttgcacatatggtgttgatcagaaaagtaattgacagagttttttagtagagtaattaagtcagcacaaattcactagaaaatagttttcaatatgcctaacttattgataatgcatctaataccatctttgtctataaaaatagttaattataaattcataggggataataatcacttttaaattactgttcaattttagccccaaaaggagacactatctttctgtagaaaaaaatgtgttaaatataaatataaatcactgattatatattaaatataaatcagtgattagcaaaaaaagttgcatatatatatatatataatctccaaagtgtatactcatccatatttattgattctttgaagtcattataaaaacttgtcaggatatatgccaatagaaataaattattaaagtatcaggaatttctaaaagagaaacaaatatttcccttctgtgttaaaagaataagatggacttatcttagaaattatattatccgtgcattggtttatattattaatgaataagtaaattattttccagaagaatgactgggtggcagttgcaaatgcacacttttttttggcacaatgctattttactgatggattagcagtccttatgggcatttgaaactaggtcagtaatttaatgggtataacaaattgtctgtataagagagttcaagagatcctctttaatatgcaaactttctattataaattttctttaatatgcaaacttaagttatttacttcgtttttgtaaactccctttatttttagctggaaataagatggcttttattaccattaacaaatttatataattagagtactggctttatggaaactaagctcatgattttaaaacaatttctttttctactcttgcatgactataaataaaaattaaaatacatatt

SEQ ID NO: 13856 - DNA, 1032 bp, Homo sapiens
aggggaacacatagcaggggcacctaagctgctctacaaaaggtcagggaagggatctttcaagaagcaccatctctgctaaaaaactgaagatcaagtgaaaggtaggcaggcaaggaactttcagtcacagcaacaacaatagtgacaacaaatatctaaagctggtatgtaattacacccctgctatctgccagatacggcgttatacactttccaagtgttctatcagcaatccttttgggtgggttttattacttacccacaatcacatggccaataaggggcaaaaacaagaatttgaatcctgattgatatgactccaaggtcttctttgcactactccacagctgcctctcaaagcaattagctgatttttattatatttcttctactaaaagcaaaacagttatttgatgacgttaagtttatcttgtattttattgtcaagtgctatttattcctttttaaaaaacagatacacattttacaattttaatagattgtagtaaagtttggcatttggtgtacatttcacaagtataacgtccaggtctgaatatcactgtccagtagtgtcttatacatagtagatagtcaaaacaacacaattgcaactttgtgctttactttgagtaagaagtagggtagtttgaaaaaatagctgaactcttcaaagacgctacttatatttttaaagtagttctaattctctatgggaaataatcttagatagaaggcaaagatacaaaattgatccccttaaaaatatctgaccctacatatcacctgcaactttcttacacacattttggcaagaatatccacacttgatgtgaatgttacatctcatcatgtaaggaggttcttaacatcaggatagccaactgttaatatttttgaagatcctgatctaaaggagggtcaagtaaatagtaaaaagtagatttaagaaatataatggattgccttaatgccagcagaaatgttcaaaatcccataaagtaattcttgagtattcttggcaagcgg

SEQ ID NO: 13857 - DNA, 1050 bp, Homo sapiens
aagataacatcaccaattcaggaagctcaatgaacttcaagcagaataaacaaaaaaaacactacatagcatataatcaaattgctaaaaaccaagagaaaaatctttaaaattaccagaggaaaaaagacgtattacctataggggaacaatgataaaagtgactgctgacttctcctgagaaataaatatgaaccacaattcaattgaagtgctgaaagaaaaaaaatatcagtatagattagtatatttggcaaaaatattcttcagaaggcaaaataatgacattttcagacaaaaactgagtttttttatcagcagacctgtgtaatgcaaaaaaataaaattacaattcagaatttcctatgaacatagatgcaaaaatttttaacaaatgttaacaaatcaaattcaacaatatataaaaagaataatatgtcataaccaaggaggttttatctcaggaatgcaaggctagcttaacatttaaaaatcaaattatataacacatttacagaataaataaaaaaccatatgatcctctaattgccaccagaaaaatcatttgagaaaattcaatatccattcctgataaaatatcacataaattacaaatatcaggaaacttcctcaatcaagaggcatctataaaaagcctatagctaaacttcatatttaaaaatgaaagactaaacatttttctcatgattaggagaaaagacaagaatattaactactcatattatgctggaggtgccagctagcacaataaagcaagaaaacttaataaatggcatgcatgttatagatgacacaattgcatgaatgtgtatataaaaaaccttaagaaacatataaaaaaagcattagaactaataagttaaacaaggtcataagatacaaggaaaatgtacaaaaatcaattgtattccatatatatatattccatatattccatatatatggaatatatatactggcatatatatattccatatattccatatatatggaatatatatactagcgtatatatatatatatatatat

SEQ ID NO: 13858 - DNA, 1040 bp, Homo sapiens
agaatgaagttcaggagaaagtaataagttgagttttagatgtgttgaatttaggtgactggggaataacaaagtggtttgatcactcagaaatagagggctgtagttgaggaggagttttgctgttgaagattggtgtagagctggtcattgaagccatgagatagatgagaggatttaaggagagcagggtcagaagtgggtctttgaatgctgacatgtgggtatccaactctgcacacagccctccctcaaccctcaggtgggtgcctgggtacagatagtcacaacctgccccataccatgaatacaaggggaagcatgtaagaaggtagaaggaaggaattgctacaggaagatccagctcagaaaactatgggagaaattgttagggaggtaggaaggaatcaggggaaatgggtaactgggagaggagacttttaagaaattgtctgcagtactaagtggtcaagaggctaagaagagaattgtattggcggtgactttagccttagctaaggtttgttgacttgaataatctagttagatataatgagggcatgaagtagaaggacatgagaattgtaaagaagaacacagatatagtttggattatttttcgatatttacattgcttttttctttggctattcaggtacttactccaacttttcaacgtagattagcccatttattactggaagagcttagtgttttctggaattggcactgacttttcatcttagtgaaaaggaagaggtctccatgctatattcccaccagaactcagcttaaaatgatgtatatcttggtttgcttaacatagtttctgcttatacttgttgtcccagcataattattaatagtgtctctttttattcttaaaagcatacaccttatatccatttaaaagtattcaagaatagacaattatatactcacctcacttcaagccttattaaaactctagctccatggcatatctgaaagcatttttgaaaataaaaacgaccaagataaacatagggaatactcatttg

SEQ ID NO: 13859 - DNA, 1030 bp, Homo sapiens
atcatttagttacttggaggcttagtagaaaacaccaaccttgaaaaccaatctgtggcaaatacttttacaagatcagtacactaaatatcctatctgaatatttggtcattgtaaaaagtaataaaccatatctagggggaaaaaaccataagagatttggcagatacaacatttagaagaaatagaacttcaagaactaaaaataatagaacaatttgagactatcaaataagtatgtttaaggttattaaaacttacgaggaattaaaaactggatgactgtgatagaggagaaaatgaactgatagatctgaaagaaaaatcaaacaaacagaactttttcaattgaagaatatagtcattgaaagaaaacaaacaaatgggcaaaccatcaaacaaaattcaataagcacttaattagtaaattagactattgaaaagagaatgaagtggagggaaaatagcctgggatgcagcacagcaaagtgaagagataggaaacctgaaagggttgttaatagacatgtagaataagataagaaaatccaacatatgtctaataggaatttaagaggagagaataaagagactgagggagaataattgttcaaagaggcaatggttaggagaattccagaacagaaagcagaaagacatgagtctacagattgaagaaatatatcagttcccaagtaggacaaataaaaacaaatcaacacctacatacattgtgatgatactgcacagcattaaagacaaagagaaaaacttataacggaaaaagatacaagagaaaaaatatcaagccgacaactttacatcagcaatagtagattccaggattggatagtatcctgaaagtgttgagagaaaataactatcaatgccagaagtctttgcctagcggaatacattttcagctaaagactgagcttactacgtttagtagttttttcagcactacttaaagaactactaaaggatatatttcagtaagcaggagactgaatgcagagaaaaagactgg

SEQ ID NO: 13860 - DNA, 1042 bp, Homo sapiens
ccaagaatttacagaagactttaaatatttggataaaaatgactgtaaatgtgtttaacttttctttgctataagtcgcacaaaatgtatctgaaggtgatagaaaagaaactatccacattagcacatgtaagaaaaaattgttcatattatatagctccagttttttacagtagataaacttttatatgccacaactattaatagtttgcttaagtctgttacactattttattgttagcacattgtgtgtgtgcttttaaaaattgcttttaagtgctatgctattgtttcccaattcctgtacctcatctgatgactgtcctcttcaatttcctccattatcaagcctctttaaataaaatgagtcattgtgatggtcctagcatagcttttcaggaaaactcatcaactgctagaaaatgcacattattgataaacatctctgcatgttgagtttgcatgatctctcattttaaaattgagtcaacacatggatggttaggtcaccataaaagttggcatatgaaaacacaggaatagagctgattgagttaaattctgttattcaggtggaaattactgccattatgtaaacgaacattttaaaagcggaagaaaatgctaaatataaagtagggaaaaaaacctctcactcttactatattatgtaatgagtaatggaaaaaaatcctaaaatgaccaaaaaaaagctttctgaagagctttcgttttaggaattggagaagatgacttctctgttactatatggaatgttaagttcagacggaggtgactctataaagccatgtaagctaccttgcatgtcttaaaaattaattcgtcatgttctttgttgggtggtggggatttgttttaggatatgacagcgcgtgatctgctacagcagagatacacccttccaaatggagacactgcctggcggtcctcaccccttgtgaatgctgctctggaaggcaagctggtcctgctggatggcattcaccgggtgaatgcgggcacgcttgctgtattgcaaagg

SEQ ID NO: 13861 - DNA, 1028 bp, Homo sapiens
catattattttttccttagtttcatctttccttgtttagttttccttgtccacttatgtttaattttataatacattatattaagcatatttttgcaactcaacttaaatactttctgaaactgttgggtttatatatgtggtagaaatgcgtattttttaaacctggttgaagtcatactctatatgtactttgatattctacttttgctacaagcaatttaatttcctataagacagttatatgtgcattataatgtaaaattttactttagtatcagtaagagaggtagctcaaatttctttacacactaacaatgtactataatattttcagatttttttctgaatgacattatgccttggaaaaataattctaatgatattctagatactgtacacacaaccactttgtacagttattttattgagtattgactgtatctggatttctcaagggaattctcaaaaaaattagcttagatcatttaaaggtactaaaaacatttaaagcatatcattgctttaaggctcaaatttatgttctctgatccatttcttgagttgtgcttctcattttaacaggatgtttttattttcagtagagtttctcagttacaaatcaaaagaacataattccaattgacatggaatcgtaagagatacatggatgttttccagggatctgaatgaaagtgaggtgttcaaggttagacagtggtagacctaaaggaattaaatttcatgtcctgttattttaaaaatgttaaggaaatgcagaaagaggaagtggatcaggctctatgatatcattagtgctatttttattctcttaagttcaagagtttcaggataagaaaaatatatgcaaaaataaggatgttgatttttcttgatttttattagggtgtttcccaaatgcccgtatggaataagcacacttttaaaaagaaatttgcatttctgcttactaatagcaatgtgcatgtagatgggaagaatgaggaaatgatatatatttttcacaac

SEQ ID NO: 13862 - DNA, 1058 bp, Homo sapiens
caattcaagttgagatttgaagggcacatagccaaaccatatcactgtcatttgcaataatgtaaataaacctggaggacattatgctaagtgaaataagccagccactgaaaagcaaatactacattatctcacttaaatgtgaaatctaaaaaatcaaactcatagaatctggtggggtctttcatttggcttgctgctggagtccttaggtggactggcctggtgcctgactctgcagagaatagggtgctggttgtcaggaactggggaatgggaaaaaggggaaagtgttagtcaaagggtacaaagtttcagttaagcagaatgaataagttctcaagatctaatgtacattataatgattataggtgataataccatattgtatacttaaaaattgcgaagacagtagacctgaaatgttcttaccacaaaaaatatgtaactatggtttctatctctttgttgagcttttcactttgtttgtatattgttttcctgatatcatttagtagcctgtgttctctttagctcactgttcctttaagaccatcattttgaatactttgtcaggtagttcgtaggtctccatttatttagtgtcagttcctggtgctttattttgttcttctggtggttttggttccctgattgttagtgatcctcatgggcttgcattggtgtctgtgcatttgaagaagtggacatccagtctttatagactggccttgatagggaaagctttttaccagccaacccagccagacattctgggcagaccatctggtggggtctttcatttggcttgctaatggagtccttaggtggactggcctggtgcctgactctgcaggtgagtgggcctatcaactaagtctctgagggtggctctgaagcctgagttcatggagaacagcctgaacttgggttgatgggacctaacatagtgctatggcagaccttgaggctgagtcttcagagtccagtgtggcactatggtggtcctggaaccagggtacatgggtatgagctgggtcctggtccctgagtctagg

SEQ ID NO: 13863 - DNA, 1049 bp, Homo sapiens
ttgatgagcctttttaaaatatattcattggctgcatgtatgtcttttgagaaatgtctattcatgccctttgccaattttttaagtggggttgttttttctctgttgaattgttctttatgttattagacccttgtcatatgcatagtttgtgaatattttctcccattctggaggttgtctgcttactttgctgatagctccttttgctgtacagaagctttttggtttaattaggtctcacttgtcaatttttggttttgttgcaagttcttttgtggtcttagtcataaattctttgccaaggcccatattcagaacagtatgtcctaggttttcttctaggtttttatgttttaggtcttagatttaagtctctaacctattttgaagcaatttttgtatatggtgaaaggattggttccagtttcaatcctgtgcctatggctagccagttatcccagcaccacttattgaatagggagtccttgccctgttgtgtgttattgttgactctgtcaaagatctggtggttgtaggtatgtggctttatttctgggttccacttcccattccattggtctaggtatctgtttttgtaccagtatcatgctgctttggttactgtggctttgtagtctagtttgaagtcaggtagcatgatgcctcaggttttgttgtttttgttaaggattacattggcgattcaggctgttttttgagtctatatgaattttaggatagttttttctaattctgtgaaaaatgatgttggtaatttgataggaatagcatttaatctgtaaattgctttgggcagtatggccattttaacaattgtaattcttaggagcacagcatgtttttttcacttgtttgtctaatctctgatttctttcagcagtgttttgtaattcttgttgcagagaaaagatcttttactttcttgggtagctgcattcctaggtattttattctttctgtggctgttgtaaatgggattgtgttcttgatttggctttcagtttggatgttattggtgtatacaa

SEQ ID NO: 13864 - DNA, 1066 bp, Homo sapiens
tctcatgagaactcactatcatgagaacagcatggaggttaactgcctccatgattcagttgtctcccactgggtccctcccatgacacgtggggattgtgggagctacaattcaagatgagatttgggtggggacacagccaaaccatatcagtatgcaacttctaagaattaggacattcttctacataaccagaacaacattatcacacttcatatcatgttaacagtaatccatagtatcatctaatagatagttcatattgaaatttcactaatctttcttgtcaacagacttttaaagtggggtgaacagaattgacagtgcagataatgtgaggaaggatttgaggataatgaatactttctaattttgtagttataactgtgaagctaagtgaatgtggatgagattaacttaggaataaaaagggatcaggtactttgggatgaataaggtagagacatgtattctgtttcaaatgggggtctatgggatattcatatagtcacatgtaatgaacaattgagggttcaggtttagagctcaagaaagaagtcaagaccagacatagaagtgtgggagccatcaatacatagaagataaatgaaagatgggaatgggtaagcttacccagagaaagggcaaggaatgagaagagaaaataatgaatatttgcttttgtagacttacagaaaataccagacacctattggttacttttataagtcaattttaatgtcatatgtacatttcagatgttttctgtgattattttgaattttgctcattcctatgtatttttgctcctacataggattcctttcctatgatgccaatcaaacatgcaatccagtggctttatccatatagtattttactaggtcatgaagggaagatggctgtggaaggtgttttaaaggtgagtgtctgcttccctttctttcctttcttttcccattttcccttcccttgccttttcccatcttcccctcactcctttccccacctttcctatttttctctccccatccttatttctttcctttcccttcccctccattc

SEQ ID NO: 13865 - DNA, 1085 bp, Homo sapiens
agccacagcgcccagctgattattgggatttttaccttgttttcacatttggtaaagtacctaacatactgtatacacttggcaaacattgatccatggaataaattaatctaaatcacccctttataaaagatgaacattacttacagaaatggctatagtttgtgggcaaaccaaatagtaatactgtcaaattattgctcattatatttggaaataattctacaggaaaaattaaggtttgtaaaattggattttgattattattgcttaagtagtaggattgagtgccatagaagaagagctctgaggagatatatagatattttgattaaagttcaatttatttcttttttctcaaacttagattcaacaagtttcaacccaaaattaggtttaacaatgcacttctcatgggcaatggcattgtcagataactagttccaaatcatatgctggaaatttgattttatttttggaataatttcattctcttctctacaggagctgaccaaacgggaggtcgaatacattgccctgtcaagggacaccactgaaactgatctcaaacagcgacgagagatccgtgcaggcacagccttttacattgatcaggcaagttctgtcacactctagcccatgactgtgtactccaggtctatacaagattgatttttaaagtagaaagagagtagctcatataacagtaaaaggtagttgtattgtgctctctctagacagatttaatttagatttttagtttcactgttcttggaaatgtcttcttggttttgtactaaatgagaaatcctagatgaaattaatggttctaaaacgttaaagatcaatgtgctgatttcataattttaaattgtttcctactacttgcctatagaaatttgatttattaaaaaatgaattaaggagatttgatataggagattctctagcatatttattaaagtattttcaatctataggtcacttgggtaaaggggtattaaaggtagtgagagtatacacttccagaaactatagctttttctctggtgggagagtatcttaggtacagattaccaactaac

SEQ ID NO: 13866 - DNA, 1025 bp, Homo sapiens
tatatagcaacattttccagaatccaggcagcgagtgattaaactgaaaggcattatctaatgcccagcctgattttgtgattttaacaggtcagattacgcatctcactctttgatttgaacactgattgcttaaagatacttaaaaagtttcatatcccagagctgagccatttaatacctcaaagtaaaggtattcctttctcataaagatttaacctcagagccagctttgcacttctgcaatcacctcttctgaagagccagtttcaacgaatccattatttaagatacctgacttactagcctcttctcggtcttatctgtaaattagaagtttttagaatgaatatctaatttgtgcactgtgtacctgcaatgtacttcaccttcctcaagagtattacaaggtcaaggtctcaatctttccaaccatttcaaccatgtagctcaaaatagcaactgaaacaatttcaaatatgtggtatcttacattatttatttgatttataagaattccttgatcttttccttacttagtgatttcagatttttcagtaattgcttagatgcatcttacatttttattgttactttgaaatctctgttcagaacatgtgacaaacacactattaaagacttcaacataagctgtgtagacactgcatttagggtgaaatggaaataggtggtagctacccctaaattaggtttttacttaatagagatcctggcccattaaaacaaagaacacctattagactgaagatgtgtaagtcacagccaaatttcatgtcaactttatgaatattcgtgtattattttctacagaggtattttgaattgtatttttactgatcactactcataacaaaaggggttttatacccattggcaactttcaaatctcacatattctatggctttatcttaaatattacgccataaatacgcagaatgttacattttatatcctgaagagttcaaagtgttctaggacttgtgttcctaatcaataaggaacc

SEQ ID NO: 13867 - DNA, 1048 bp, Homo sapiens
attggtgtagatctaggttttttaaaccaatctgttggaacattcgtgttccactgttgtaaggtagagtggaggtcacataagtattatacttaggtggcctaacaatggtggcaaactctgggttaaacgtagataaattgctttctttgtaggttttcccaaggcctttactatgctaatgtgcaataagtagttctcaaagagtgggatctactacgtacaattcctaacttaatttagcctttaaaaaatgcctgcattaggacaaatacctaatgcatgcggggcttaaaacctagatgatgggttgataggtacagcaaaccaccatcgcacatgtatacctatgtaacaaacctgtacattctgtatcccagaacttaaagtaaaatttaaaaattaattaaaaaacaaacctgtgagcctctcgtgagacgctagaatattcactgtggagatccttctccactaccatccatccttctatgcctcatatgatatcctctgcatgatctagttcacaattttgtttatgtttgtgctgaacagtgtcactccctaatctcaaatttcaaaatttgggtcaggtgttgcctgaaaccttcttctcagttttctgtggcacacgttgtcccttttcagaaggccccacctctggtgtcacaagttgaaatctagaatatcaaatcccaagctttggcacctcttgtgtgaccagctgctctcttcctgtataacttaatttcttttccaaagttataatcatcaactggaaggagagctgaaaagcaggagctgagtacccaggttttaagtttcttgcccaggcctgcatgggaactaatagtgctttctggatattctctggccgtgagataataccttgcttttctataaactttttgaaatctcctttcctattgtcaacaatatttctttagccattattgactctggggtgatgcacatcttttactccaagcttcttagcatgccatttgtgctattttaaacacatgttccaaaaagacatcatacttggccg

SEQ ID NO: 13868 - DNA, 1048 bp, Homo sapiens
aaagtagatatcctccaccaagtgacatcgacatacttttctcaacaaagtcatttcagttcagcaaatatttatcaagcctactatatgtcaggcactgtgctgggcccttgggatatacacacgaatcagacagtttatccagaagaatcttacaatagacagtcatatcctcaacatttgcaatgtgttatttaaaagacatctttctataatttgccaattttttgagctcctattttgtaccaggcattactctaggtgttcaagaaatattctagatgttttctttctttggtattaatcagaggccactatgttctcatggccctctaaggcaaatttcatttgccagtattctgtttgagctaccccacttgctgattaccagttcgtattgtactcaagattatcgcagcttccagacctggattgagattagggtttgactggtaggacaggactgaccagagactatcattctaaactttagtcaaagagtactgtgcccccaggatgggcatggagactgtggaataggaatatgggattgttggatgagggagttaaggacaatttggggcacatgagaaccaagctgatttggggatgtggatcacagtagagacagattaaactggcaagccaaggctgaaggttgggcagaagttagatggggcttataaacaggagaattccaagtatttgactagaaggtaagcccagaaggcagaatagccatggagggcatagagaggtagccagttaggagagatcaacgcaggttaacaagcgggtgagttagagccatcagcccagtaggcatttaagcattctagaagataaggagccactgggatgtattcaaccatcaagaaactcaggtttaagaagaaaaaaaaaaaggaaatccttgccactgaaaattctggtaatctgggccacaaagctctgagcaataggcagtgagatggagaatttctgagtccaggctcattttgttctctcagcccagacatcattaagacagtgtctggcatgctgtagt

SEQ ID NO: 13869 - DNA, 1098 bp, Homo sapiens
ataactgctgccagggagcagctagtgtgttaccaagcagcttcccttcccacatttgcatttacctcttgtctcttcggttgtagaaagaatcttgatatatggaagtgagctaactgaagctgaggttaataaaagcaagtattaaaagaacataaaagggacttttctccctgtgactcaaacaaacaaaaaaaaaacaataagaagtatctattttagaagtatttcatgtttgttaggtaagactgtgagaatagaagatatgaacttttgccttatgaaagttactttactacaattttattaagaaattaaaatttgtttaacaccttttaattcaaaatattagaaaaggaaactttctattgattgttttatgatcatcagttttgtttccataagaaatacgcccatttattattaccttaaaaagaaactgcaggtagcaggattttgctccccataactagccctatcagattcaacattactgcccaaccagtgtctaaaatttgacttgtagcctgcataaatcacaatgtcccctgaaaccacttgtttctaggaggtattttgtttgatcgctccttgacccttttccaagaaacctaatttgcccaagggagtctcacactggaaaacagtgtttgcgtctgcttagggaaatgtgcgtgaaataatgacttatttagaactgagaacagaatggaatggaatggattgataagccagtttgaacaggcagagagcaacttgggcctctaaactcttataaaaggagctctgcagcaaagcactttgcctagactgtatctggcaaggcccatcttcattcaacaaacattgtctctgtgaactctgtgcaaaattcttactcttataaatgccttaaggcatgccatttcattttaagtttcacttacacttctaagatggtgcggatttctcgattcagccctgcagaccccagtgtagaaattgctctccaaggtatgttacccgttttaaactcagttgcgtccttttagatggctgcagaatgcttgttggtggcgatgccgctctgagttaaagtgctttcttggttgccaggag

SEQ ID NO: 13870 - DNA, 1069 bp, Homo sapiens
tcagtgtgactggtctaaggatgatatggtttggttgtgtccccacccaaaatctcatcttgaattgtaatccccataatccccacatgtcaagggagagaccagatggagggaattgaatcataagggcagtttttcccatgccattctcatgatagtgagttctcacgagatctgatggttttataagtatttggtagttcctccatttattttccctcctgcaccttgtgaagaagatgccttgcttcccctttaccttctgtcatgattgtaagtttcctgatgcctccccagccatgcagaactgtgagtcagttaaacctgtttcctttctaaattacccagcctcgagcagttctttgtagcagcgtgagaatagactaaaacaaagggatacccagatagctggtaaagcattaattattctcagtgcttcagtaggcactgagcttgtccttctcctgatgaaagggaaacccagatggactgttttggcatttgattagaatgataggcctgcccccaggggaatctgtgaaggtgtttccagaagagattagcacttgagtcagtggactgaatggggaagatctgccttcaatgtgggtggttactatccaatcagctggggttcccagatggaaaaagaaggcaaaggaatggtgaattctcgctctttctgggagccaggatggccttttccttctgctgttggatatcagaagtccagactctgttgtccttggactccaagacttacaccagcaatgcccctaggctcctgggcctttgggcttggtgtgagagttactactttcttggttctaaggccttcagacttgaattgagccttgctatcagcttctcttgttctccaacttccagatggctggcctatcatggaacttctcagcctccataatcaagtgagccaattcccctaataaatcccttattatacatctctctctctataggtcctatcagttctatctcaacagtcaaggttctccagataaacagaaccaacaggagagggagtgggaggggggagagagagagagag

SEQ ID NO: 13871 - DNA, 1033 bp, Homo sapiens
attacacagttattgatgtgatagtttactttttatattgtgcattaatatttttggtaatagttattcttaaaactaatctttttactttatattaggattataagtaatttatacatcttcattacaatatacattgttatgtattagtctgtgtatttacctttaccagccaagatttatattttcatatactttcatgttgctgtttagtatccttttgtaacaacttgaagaactccctttcacacttcttataaggaggacccagtgttgacatacttccttagttttcatttgtcttggaacatctttgtctctcatgcatttttaaaggacatttttaccagatatagtatttctagatggcaactttttttctctttcagcactttgaatataacatcccactctcatcttgcctgcaacatttctgctgaaaaatctgctaatagttgtatggagatttatatatgtgaggagtcctttttctcttgctttcaaaattgcctttgacttttgacaatttaatagtaatttctcctagaactctttaggttccacctatttgagttctctcatgaatttgaatgtccatttccgtcttcaggttttaaaaagttcagccattatttctttaaataagctttctgttcctttttctcttcttctgagtgtcccataatgcatatattagtttgcttgctgatgttgcttgctagtccatatattagcttacttgctgattagtctgcttgctcttaagtctagtggaatttcctcacacttttctttcttctttaataattcgaaatgacatatccttgagtttattctttcttctgcttgattgaatctgctgttgaaaccgtttaattttttagttcagtcataataactgcagctccagaatttctatttggttcttttttatggtttctatctctttgttgaacttctaattttgttcatttattttcctgatttgttctcttgtagctcactgagcttctttaagataattgtttgaatt

SEQ ID NO: 13872 - DNA, 1075 bp, Homo sapiens
ttggtagacagccgtcatcctcctctgctgtggcaggctgcttaaagcataacagaataggagattctgtgccttttatgaatttaagggaggaagataatgagctagtcatgttcaatttcttctcccaaactcaaaaatcagataaattattccttcccaagaagaagtgaatgagaagccagagactgtatcttctggtggagttgatgttctttcccctttatagaaacatgagaaatgagggaataggcatttatcaacaaaagggattatggaaccatttgcctagggacatcttgcctaaaatatacaatatgtaaaatgttgtcgtgcaaacagtagaatccttcctgctttgcccattagctgattccttctcaccacacctttccatccctcttcccctccacttctcacccagatggccactgagggcttcttgcttaagccacagtttctgtaatgagtctggatgaaaggcactcattcactctgactgactgcagtttgttctatcccgggcttttgcctccactgaaattgctctcgatgtcgtgctttgccctgcacacccctttcttcatattagaaaattcatctcatctgtttagctttcatcccacttaaccattatgagatgctaacatgatcgataccccttcttatttgaaattttaatgtccttggcctctgaggtcctccaggttcttccttatcattcttcccagtcttcatctatccacatgttcttcattggctcctaaatttggggccaaatttttagtgaactacagggttcttgccactttttctagtttttcatttctatgtgcatctatggcttccgctactgcctatgtgttgctgactctcagatgaccatcttcagctccaaacccctttcctaactctaagcccagatttcccaaaccctctaatttcttctgtggtacatctaactgggactttgaaacgtgactatctccaaatgaaacaaatggcatctcacaatgcagtctgctcctgtttttcattttcctttcttggataatattatcactattcccttttt

SEQ ID NO: 13873 - DNA, 1046 bp, Homo sapiens
atcccagataatgttctgatgatgtacatgtagaagcccattgactcattctcattctcaagtctgcacctggatttagatttttcaggtctctcttcttttttaaaaaggcatgattactatctgcttgcatgtgggtgcacccctttccacagccctcaccaccctacccctaccctccttgctggctgtattggtgggcatctggaagaacaccttgaactctttcctactgtaggaccactttgggaaatgtcagttggtttccagtgtcatatccctccacttacagtagaatatgggctgctttgagtttggataaatttaagttcttcctttctaattaagaattgtagtgtttttgttttgttttgtttttgacttatttgaagatctcaaagtctttgcaattcctccccttcaggtttgccttcaattttctttaccatgagccttctgagcaagcatagctctcagtgttctgtctcccagaatgcctgtgctccatttcccatgttcctccaccctgattccttgtggtctcatggggagatcaataacatagacatggatagtgaaagataaacaggaagttctgcaagtatggagaagacactgaatcccttgtgaaaatagtagaaatgcatctgctggatattggagactgaaatgctcattgtctttgcatctgggaagtgtactgtgtacttctcagcttcagttcacaatgggagcttagcactgcaagagtagaaagggagctgttaaaagttatctaatgtaattggatttctgatacataaatcttctttctaatatctccatcaagtggataattatttctgtttgaacacctctgggtacagataacttactcctaaaaccatctgtttctttgagaggatagaaaatcccacattttgttaagccaccattcttcctcatttactacttcaacccattatggaatttacatttaatgtgtgcttagtaggtcccagacactattctctacactttgagtcttcaagcaaccctatgacata

SEQ ID NO: 13874 - DNA, 1038 bp, Homo sapiens
tttttactttgaatgaaattgttatgtacccacataaatatataacatgtttaaaaataaaactcagagaattttcagaagctctgatttcagtctaatggttccaattatgaagtggaacatcaagtcaagatgagctatactgtcagtgcattagacagctctttgcaataggtgatgtttttattattccagaaaaaatatactgatagactatcctagccatcataaagattggaattgacatgtaagtactctataggtaaaaagccattctcacctgtcagggatatgtgtcagcaatatagggctgttatcaagaaggtgaacatgatctgggattgcattaaccagaatgtatgtagtacacaagaaccatgaaatttactcactgtgttcaccattgataaggtctatgttagagcctaattttgagctccatattttaaacacaatattaggaaattggagatgggccagagaaaagtaatggatgatttgaaagtaaaaaacttatctatgctgaaaattgaaagaaagtggaattctttataaccaagaaaggaaagcatagaagtagttttgcgtgggtcctcatctggagcaaaattgagactgacaagtgcttcttaccctaaatctatcttttaaaatgaaggtcttagcattagatgaagtggccaggatatcagagctgattgttcttttactatttcttttttttttttttttctgagatagtctcgctctgtcgccagactggagtgcagtggcacaatcttggcttgctgcaacctccaactccctggttcaagtgattctcctgcctcagcctcctgagtagctggaattacaggcacgtgccaccacgcccagctaaatttttttttttttttgtatttttagtagagacagggtttcaccatgttgtccaggagggtctcgatctcctgatctcgtgatccacctgcctcagcctcccaaagtgctgggattacaggcgtgagccaccgcctcttttactatttcttaaatctt

SEQ ID NO: 13875 - DNA, 1010 bp, Homo sapiens
tttgcaaaaaaaatcggacctttctagctgatgacaagtaggcaccaacaaagatgttgcttctatttatgtagtctttttgccaatgaaaattcagttccctttttgatctttctcaattatcaagaaaaactctgtctctcaaatatgatactctcaaactagtgactgagaaaatatgagggtaatccatacagggggcatctgtattttcatgactaacaatttcaactgctgttagctgggctggtcactgtgagatctactctgttggctcttcctagctgtaatacacaccatcttattcaaaaagagcttgcctggctccttcatctgttctctctgactgctttccagaggtcagcttccagagtagttgaaatgtttttcctttggcttcccttcctatagtcacccctcatcaactctacccacaaaacaaattaccaggaactctttaataatatgctattaacattcatatgtgaagatgcctgttgacagcaattggttggatatgaatgactgtaaaaaactgctgaattgcaacaagggaaaaaatgtgttaaccctgaatgtgatatcagactcttggagagcatttagggaatctgtgttcataaggccagtgcattagcaggctagaaagcaatgtgaactcatagaaaagagcaaggtaccatgccaagggcaagcctaggcctctcagccaagctcccagctgctgggaggtttacttgttttgcaaactgtacaagtaattggttgttaagtcacattctgtggtttctggaagtgttgtataatttcactttacaaaaaaagtattgccagaatgcattagaaataatgatttaagattgaactggctctgttgaaattacctaaattacatgctgcaacattgtttttcctagatggccaaaatcactgacttaagatatttaaaatgtcagagatgtatattcttaatggagttgaagaatcagcagtacttcagggagtattgt

SEQ ID NO: 13876 - DNA, 1063 bp, Homo sapiens
tggtgaaactccatctctactaaaaatacaaaaaattagctggacatggtggcaggcgcctgtaatcccagctaattgggaggctgaggcaggagaatcgcttgaacacggaaggcagaggttgcagtgagctgagatcacaccactgcactccagcctgggcaacaagagcaaaactccatttaaaaaaaaaattaagattataatagaaatacattattataatcttataaggctatatatataatacactagaaaaagaaatacattaaaaaaagaaaatataattgatgaatatatatgattttcaggttgagatgatgtcctaattttgaaattaaaacaaatgctaaagtagacaacattatataatgtactaaatttaaatatttctgaatggtaaaaaaaaattcaccatctatgagatcagatggcaatgaaaagtgggaaaaattattttaaacaaatatgacagacatagacatagggttaatataatcagtacttaaagggctttctcaaattcagaagaaaaaaacctaacatctcaatagaaaattgatcaaagggcatgaatggataaaacattaatcctttcctgctcaggctgctccaagaagggcaaacagctgatgaatattgggtgttttaaagtagggtgacagatgaatgcttcttttgtgtaaagttactgctgtttgtcttgacggcaatggagaacactcttgttttaaagaaaagtgttctttaataattttagaaggtagtatacaacaagccacgtttttacaatttaataactttccagattaagaaagaaaagcctcagaaatgccttaatgacagcaacatgtgatcagagatgaagcatcacgatcagataatgtggtaaaacaatatagtgcctaaattttagccaaagaaaaaagaataaaagaaaaaataataaaagcctacttgcgtgtagatattgtgttcccgattttgttttaaagatactgtttcctcgtggtatggaaactattatatttgttctaaaattaattagcagacaggggttctt

SEQ ID NO: 13877 - DNA, 1175 bp, Homo sapiens
agaattagtattgctgtctataaaaaaaaatcaatctgttgttcttgcagaagaacatcaatcagtctgtgaaattaattaactggatttttttacatttggcttctaagataatgagacaaatgatgagaaaagactgcatgccttgcatatagtagatactcggtaaatgtttcttgaattgaaaaccaaatgatatcacagatttagtttaaaaactacttcactgtaagtccttttatcagtcctaattcagtcccgtttcttttactgggctgcctgtatctatagtactgtaaatgtagatccctcatttttattgattcttgctctgaagtgagttctctcacatttttactgccaaggaatccaggccagcttcacatgactttggatctctgtattatttagtgtcttaactgttttctgtgaccagacttcctgccctatacagtattggcagattacattttttgaaatatcattttaacaacattactctttattcagaaaacatcaatgtctctttgttgtctacaaaattgtgggctcattgtactttagagttcattccctactacttgggtttgaaagcatctgtgttcagacttgtccagacacccgtctatacttaacttccaccggcctcctacccagaccctatggggaagacagattcgtctcttcattctgtcatcccattttgcaacgcgcacagtattctgcatcaaatcctctcatatctatatccatccaattaaagtcagttctgctccaggcaatatagtccttaaaactgcacattatcaaaacctgtgctataaagacaattatttcagtggcataaatagtgttggagacttgagagttgcaggggcacaataaacaaagttgttttacctgaagttatttaagtaataatggtattttctatctctgtaaaagtataactttaaaacctgaacatcacgaaaaaatgcattttattgtatctctttttataagatggtagtgaactaagctggtattttaaaaaattgtttcaacatcttaatgatccactattgtgagaaatggagaataaagaccttaaaacagctgtgttgtaagcagaagagcttttttttcccttatgccaggagccctagtctgcataaaataaattgtattcccca

SEQ ID NO: 13878 - DNA, 1048 bp, Homo sapiens
ttctaaatgaaacagaggggagattagcagagtggtatgagggggcagggcatgtttctgtattccatgctgtttaggtactgctggagcataaagtgtgaagagggatatagggctggatgagactctataggaaggcagaaatcaaatcttgaaggtcctttgacacattgttgaagcttcttttgtatgtcttcagttcatcctgctccttgcagggagaatggctgtgtgaaagagtgcttatatcctgccaaactcttcctttatgacctttgtcctggtctcactgcttcacccttgtcctggtctcactgcttccaaagggaagtcaagctctctttaatttactccattgaatcatttactctactagatttgcctgctttgcttttcacacagaattggttactttgctctcttagattccattttcaaaatccttccctcctttaagacctcactgaaattcatatcctttatgaaaacttttctctactcatgaatgattttatcccttgtgaattccagaactttgaatagatgctgcatattgcaattttcgcatgcttctcatatatcacaagttatttttataacattcttagactatccacatgttgaagggaagggccatatacctatcttgtatcctatttatgctggaagtgcagcttcttgcatttattaatagtagacattgcatggatgtttgttaaaacggtagaggaaaacagagttcctttaatttgaaaggctgctacagaggtagaactgagggattgattaattgtcatctggaaggggtagtagttaacataatgtccagatgaaactcttagagggaagaataattgtcagtgaaggtagaaggattacattaaacaaaagtcagaaatatgtacagaaaagagatgcagtttgaaaatcagttaaactgcccaaaggtttagacatgggaagaagatacttagaaagccattcagcatgtgtgattgtctttgacagtgagtgacaaatggaataacagggaaaagcacctatattg

SEQ ID NO: 13879 - DNA, 1073 bp, Homo sapiens
catatattcactttctgtcattgggccttactaaaggaatttttcagttccagtaattttatgtgtatgtacattccttaaaattttcactgtaagcaaccatgttgtctgggtcgggagtgagggtgggggcaaaaaacagttttacttcttctgttctaatgtttatgccatatatatatatatatctttcttgccttactgcactatccaggactggtagttcaatgttgagtagaagtggtaggagtggatattttcctgactttaggagaaaagcattcaatatttcaacattaattgtgatattagagtgagattttttttagatagttttatcaggttcccttctattactaggagcttgttttttttttttctttcttgatcatgtgctcaattttgtaaaatgtcctttctatatctcttacaatgatcatagtttttatttttacccatatattgttaatatttttgttaatcagatacagttttgaatgttgaactaatcttgtatttttgggaaaaataccatatggtcaagctgtattatctgtttatgtattactgggcttgatttgcttaatattttgttacagcttttacatctttctgagtgatattggtttgtgatttttcttttttgtaatattgctatcacattttgttattagggtgataattgtaaattgtgttgtggtatgctccttccgcctctttctttctttttttttccaagaacccaaattggccctgctgatattcattactgtctcttttctatttcattgttttctgctttattttattgcttcctcctttctaattactttgtattaatttattctatctgtagcttcttaacttggtagcatagatcattcactttaaacctttcttacttttttaaatataagctttttaaatctacagatttttttctaagcattgccttagtaaatctcacacatttttatatgttattattatttagttctaaatattttctaatttcacttatgatttctttgtacccatggattgtttagaaggaatattctgagaggcctggt

SEQ ID NO: 13880 - DNA, 1045 bp, Homo sapiens
aacttgcatcccagatataaagcttacttgatggtgatggataagctttttgatgtgcttctggattcaatttaacagtattttgttggggatttttgcatcgatgttcatcaaggatattgacctgaagtttcctttttgttatgtctctttcgggttttggtatcaggatgattctggcctcatagaatgagttagggaggagtccatcctcctcaattttttggaatagttttggcaggaatggtaccagctcttctttgtatatctgatagaattcagctgtgaacccatctggtactgggcttttttcagttggtaggctatttattactgaattaattccagagcttgttactggtctgttcagagattcgatttcttcccggttcagtcttgggagggtgtatgtctccaggaatttatccatttcttctagatttcctagcttatgtgtgtaggggtgttcataatattctctgatggttatttgtatttctgtggggtcagtggtgatatcctcctcatttctgattaggtttattttgatcttctctattctgtgttagtctagctagcagtttatctgttttattaattttttcaaaaaaccagctcctagattcactgatctttttgaagggttttttttttggtctcagtctccttcagctctgattttggttattgtcttctactagctttgggcttggtttgcttttggttctctagttcttttagtcgtgatgttaggttgttaaattgagatctttctaactatttgatgtgggcatttagtgctataaatttccctcttaacactgcccttagctgtgtcccagagattctggtatctttgttctcattagtttcaaataacttcttgatttctgccttaatttcataatttactcaaaaatcattcaggagcaggttattcaattttcaatttccatgcaattgtgtggttttgggtgaatttcttagtcttgatttctaattttattgtgctgtggtccaagagattgttatgagttcagttatt

SEQ ID NO: 13881 - DNA, 1023 bp, Homo sapiens
ctatttttgtggatattgaaatttccaaagaaatacaagagagtagtgatagaggaacagtaagtcagatgctgtaatctaggaatgagccttccaagacctgtaagacagctgataacagcaaggaaagttaaagcctatatagtctatggcctgaatttcaaagaaactagagagggttttagagagaagaaaaggaaatatggtggcagtggaatggagaacagaaaaaaatgtttcatctccagacttagtggcttgaggatgaggaagctgtatctttggacttcagttaaagccaaaaggtaaaagggaagttcactgaaaaggttgacaatagaaaggactttgctgaagatggcccatgaatttgagaagtcaaagtgaaaggatagaaaagggttggggagtgggtaatacagcatcacactaaaggacttaccaagctgaataaggatgggttcttatgatgaagaatgacctggtttcttctgaagactgaagttaatagggatgtagaatttaatgggaattatgcccacaatattttaggcagcttatggaaattgcactgtgatttgggggagagagaaatggggactcgccaggaaagtaagttacctagcaggaatttactgctaggtaagagcatgaagaactcattggattacctcttcaggcatgcaaattgtgtcattaggccattggaggtctgttggaactgcagcagctctataaatgcactttaccagaatagtttctcgaagaagaaatatagatggtagtagtgggaatagaaagagtaagttgattaaagtgacgttttagcatcataggaatacaaaatatagtggacccttgaacaacacaggtttgaactgtgcaggtccacttatccatgagtattttcaaccaaactagtatcaaatatacagtatacgcgggacttgaaacccacgtgtaaggaggacgaagttttcgtgtaagtcagctccgaagcactgactttgggacttgaatttg

SEQ ID NO: 13882 - DNA, 1134 bp, Homo sapiens
aggcaggaggattgcttgagaccaggggttttgagaccagcctgggcaacatatcaagacccccatctctacaaaaaattaaaaaattggtggcatgcacctgtagtcccagctacttgggctgctgaggcaggaggatcacatgagcccaggaggttgaggctgcagtgagccatgatcatgccactgcactccagcctgagtgacacagcaagaccctgtctctaaaagaaaaagaaaatataaaaagaaatttgatttttaatgtagattgtaattactaactatagaaaacagccatcataaaatttccctttgactcataattgtctatgatttttaaattaaaggttgacttcaagtataagatttatttttcataattcaagtgtcagatcatgcagtttatgggcactcttgataactttctttttttaaaatagagcacatcatccctgtttttgtatattgatattttttattagataataatcaacaaaaagaaaaaaatcacttcattattctgtttatttcaagttacaaataatttatataattgttgactgatacagtattaatgattctgttttataataaacataatgtatttttatatttaaattcctggacacaacacaagtttccctacagtttgtatatagcttatataactattaaagtagaaagttggatagactgggagtaatacttaatttatgtatatgtcaataatcacatctcagctaatatttgaaaactccatatcccttaagatgtaaacagttttcattagaatattagtttttattaattataatccatgtagcccccacctaatgtgggataccagtgcctcttccaaatattttttggagtccccagagtatattatatggttcatgcagagctctgggtgtcaaccacatggcattaattttaatttttttcttctggccatgtactaaggttttgtcattttcactggagactgccacttttgttgggctttgttgttgatctttcctttggccattgcagggactggctgagctgggtcacttagtgctttgtaggactttttggtggagctatctagtctgggagttttatttgaggaaatatttttcactatta

SEQ ID NO: 13883 - DNA, 1028 bp, Homo sapiens
tcctttttaaattgaggtgacatttaatttataaacaacataagattaaccatttgaactatataattcaatagtatttggtacatccacagtgttgtgtaactgtcacctttatcaagtctcaaaacattttcatcaccccaaaagaaagtggcaattcccagtttgcctctgccccagcccttggcacccaccaatatgctttctgtttctatgaatttacctattctgaatatttcatatgaatgaaatcatatactatgtgaccttgtatgtggcctctttcacttagcacgatttttaagatcatccatattataatacaaatcagtactttatttatatggctgaatgatatttcatgtatatatttaccacattttgtttgtttatctactgatggacatttgaggtgttttcaccttttggctattgtgaaagctcctgtgaacattagaacaggtagtgtcttactacccattttcaattattttggtaatatctaagagtggaagagtgactcataattccatgtttaattttttgagaaactgctatatatatatatagcacagcagctataccactttacactctcaccattgtatgagggatccagtttcttctcatcctcaccaacacttgttattttccatatttttgattgtagctatcctagtgggtgtgaagtggtatcttgtggctttgttttttgagacagagtctcactttgttgtccaggctggagtgcagtagtagcctcacactcctgggctcaagcgatccccctatctttgtctcctgaatagctgagactgcaggtgtataccactatgccccactaatttattttttattattattactatttttttgagacagagtctcgcttttgttgcccaggctggaatgcaatggcgtgatcttggctcactgcaacctccacctctcgggttccagtgattctcctgtctcaacctcctgagtagctgggactacaggcgcttgccaccacgcctggctaattt

SEQ ID NO: 13884 - DNA, 1027 bp, Homo sapiens
ttttttcacaaattaccacgagttcttcagaaacattgtgagtttcttataaaaaacatatggctgggctggacatgatggctcgtgcctgtaattccagcacttgggaggctgaattgggcagatcacctgaggtcaggagtttgagaccagcctggtcaacatggggaaaccctgtctgtaccaaaaaatatacaaaaattagctgggtgtggtggtgcattcctgtagttccagctactcaggaggctgaggcaggagaatcccttgaacctgggaggtggaggttgtagtgagccgagatcatgccacttcactccagcctgggcaacagagagaacttgtctccaaacaaaacaaaacaaaacaaaacatatggctgtaccagagctttattcttattgcctgatgttcatttcattttctactatatttataaatagtgctgtgaagaacattcatatttgtgcattaatctttttagacacttaggattatttcgttagagttaattcacagaagtgcaattgcagggccgaagagtatgaacattttttgttttttttttgagacggagtttcactcttgttgctcctgctggagtgcactggcgcaatcttggttcactgcaacccccgcctcgcaggttcaagtgattctcctgcctcagcctcctgagtagctgggattataggcatgcgccaccacgcccggctaattttgtattttttttttttttttagtagacagggtttctccatgttggtcaggctggtctcgatctcccgacctcaggtgatccacccgcctcagcctcccagagtgctaggattacaggtgtgagccaccgtgcctagcggagtataaacatttttaagactcctaatatatgctgacaagttccttttccaaagggccttgactatagcttcactagcaaagtacatgagaactcattttccttgcccaggttattttttttttttagctttttttttttttttttttttgcttattttctagtttg

SEQ ID NO: 13885 - DNA, 1037 bp, Homo sapiens
gtgtgtgtgtgtgtgtgtgtgtgtgttttgtttttgtttttacggtaacgatggttactattgctctctgttttagaagtaatggtcatacataagagcacattgtgtacaaaaataaatattagtttgtaaaataggttgtagtacaggatgaatagagaggtttgaaaaataggtccgtttccattatttcctttaaaatgcatatacacacatataatctagatcaaatttttatatacaggtatacatgtgtatacacacaaacacacacgtgtatatctctgtgtaaacctttcattgatctcagaccaggaagggaacatgatggatcaggcagctgtacttccaggttgcttttttaggattgttgccctggtgtagagctgagatcagcaggtggcaggaagaaggcggggtgactaactgggcaggacttaggaagagactgctatccctttcttcctccatcttataggtaattgatctgcttttgctgaaatgttttctgctttgataagcttctgttgttagtagtgttgctgtttccagaaataggaggagaaatgaagggaattacagagggaaaatttaacttttaaaaatcctgcctttgagggaagaaaactaagtgcctcagcctcatttcttctgcttaatggattcttgatggggtactttaaaaaatgtctctttatacattttgctaattttaacaaaggtagatcaagtgagtattcacttgtaatattagtttgcttttttttccccccataaaaagaatatttctttactggtataatgcagtcactggtgtgctttgaaaatggcctgggtgtctttgatgtgttggggtgtcctgggtttcttttctgtctgatggccaccatgtggctagtttccataagcctttatgccgaagtcccctttgggagcttgatttcaagtcttcaggaacttttatttattaagagattttaaaaagactattaagagaatttgtttttaaaaagcaggttcttcagaattagagggag

SEQ ID NO: 13886 - DNA, 1118 bp, Homo sapiens
tttgagctcactgattcttaggccatgtgcagatgatctggtaatatgcattctttttttctgttgctgtttttttttatttctggcatttccttttgattctcagaattttcatctctttgcttatattacccatcaattcttaacatgttctctactttttccactagagcccttagcatgttagtagttatttgcaattgttggcctaataattgcaaaatatctgccatatctgaatctgattctgacacttgctttggatcctcagactgttttatttttcctaaccttttagcatgtctaatggtgttttttgtttgtttgtttgtttgtttttgagacagggtctcactctgttatccaggctggagtacagtggcacagtcttggctaactgcaacctccacttcccggtctcaagagattctccagcctcagcctcgtgaggagctgggactgcaggcgcaagccaccaacacctggctaatttttctatttttgtagagatgggtttttgccatgttgtccagactaggttcaaactcctgagatcaaggcagtccgctcaccttagcctcccaaaatgctgggattacaggtgtgaaccactgagcctggctattttttttttttttttttttttgttaaaagctagatatgatgtattgggtaaaaggaactaagatcagtaggacttgagtatgaagtttcatgtttatctggctaggggttaatctgtgtttatttgctgttgatgtcagaggctagaatttcctatagtgtccttgatcttgtctactctgtggtatttgggtttccctagagactcccttttatttttacttttttagagacagggtcttgctgtgttacccaggctagagtgcagtggcacgatcatggcttactgcagccttcaactcctgggttcaagggatcctcctgcctcaggctcttgagaagatggtactacaggcatgcgcctccatgcttggctaatttatcttttgatttttgtagaggtgggggctcactgtgttgctaggctggtcttgaattcctgggctcaagtgatcctcctgcctcggtttcccaaagtgctgtgattacaggca

SEQ ID NO: 13887 - DNA, 1029 bp, Homo sapiens
gatatatgatgttgaacatcttctcatacactttccactcaatctgctgagtgtctgcttaaattatttacccattttaaaaatcaggtttgttttttttttttgagttttaagagttcttgatatattttggataccagctttttatcgggtgtttggtaaatgttttatcccaatctgtggcttgtcttctcgttctcttaatattgtcttttgcaaagaaattttaataaagtctgcctttactgggtcatgattttggtggtgtatctaaaaatttaaggccacctagattttcccctgttttatatcctacagatttttttttaagttttgtgatttacatttagatctatgacttggtctcagtttttgtgaaaggggtaaggtttgtgtttacattgatttttggggggatgagggacatatgatgtccagttgttccagcaccatttgttgaagactgttctttctccatgaattgcctttgctctcttttcaaaggtctgttgactatatgtggttctacatctgggctctttattccattccactgatcttttctttgccaatatcatactgtgttgaatactgaagctttttactaagtcttgaagtctggagagtgtaaatcctctgacttggttcttcggtatcgtgttggccattttggaccttttgcttttccacatagactttcaaatcagtttgcctgtatccaccatgccaggattttgactgggattgcactgaatctaaagatcaagttgggaagaattgacatcttagcattattgagtattcctatctataaacatggaatatctctccattttttcagatctttgatttttgattagcattttttagctttttccttatatagaccttatatgagatcctattttgttagatttataccaaagtgtttaatttcttggtgttaatgtaaatggtgttttaatttccaattccaattgttcattgctggtgtatgggaaagcaattgacttgtgtactaaccttata

SEQ ID NO: 13888 - DNA, 1538 bp, Homo sapiens
ttttcttttctttaatatttggtaattgcagatttgatggttaaattcataggttttctttacttaggccaaactgtcatttctcatttgtacagaattggatatgtccctgtgcagaagggttagctcattcttttcatctttaagcttttaaaattacttagtctaaatgttgttaggtaatggaataaccattccttttcagcttttggtacatttccaaactggctggcagagccaggaggaagtgaaggcattagaaacactaactttggttggttgctaccgtcttagtgctgagactataacctttgttggttgattgatagagaacaagagaacacaatcctcgttccactaacaggtaaggaacccttgtgataactagttggtatgagagggagattacttgatagcatttcataaaaactttatcccaaaatataacatgtcctagaaataggatactgtgactgactgtactccgtagaacaaggatacgcagcacctttatatttagaataagatctgaaatttaatagggatgtattactctgtaccacaaagcataattgatctgttttccaaaggcaacactgttaaaatttatcctgcagtccctgtaactttaaatatgtatctgcctatcttattctcctttcagcttttccttgatcagatgctatgtgctttgaacttccttctcttatttattcctataataaagctaactattttctagtatctttgccatcatctataatttgggtatatcttactgctttaatttctatgttatagccattaatgattattcctggttcttcttgacccaaaagaaaatgattatgcattttaaaaaggattttgagtctgtattgcctatatccactattctgccttcccagttttaaagctgagtgcttgaagaataaatcttttcagtgacagtagtcataagctttcataaaatataggcttagctttgtattgctataatatgggcctatagtgtgattaattctttaagttaatgaagacttgaactcagagaagaaattcagcttcttagactttcccaaagtttagtagtattcctgttaatatacttggttttttctgtttctacttttcagtccatcttcttttctttgacagaagaattaactgggactcctcctttgatatatctgaggttgtgtgccttttccctgtcccttaaagacaactatgatcttgtttccagtcataatttatcatttttgatttggtcttccactcagagttgagtggtttatcacagagtgtgttatggcttagaccaatacaggtcccttcttaatagttactgaggaattaatcatttgtggtgacagacttctaaaattcaaattaagaaggcactaaagaaagtatgcccaaaggtagctcctttttatcctgaggattaagccattacaaactcaaatgaccagagaatgtaatttcttaataagaatttttccttaaatctatattcagctctctatttcagtgct

SEQ ID NO: 13889 - DNA, 1050 bp, Homo sapiens
tacactaagtatttatttatttgagatggagtctcactctgtcacccaggctggagtgcagtgacgtgtctctattttagtagagacggggtttcgccatgttggccaggctggtctctaactcctgacctcaagtgatcggcctgcctcagcctcccaaagtgctgggattacaggcatgcgccaccgcgcccagccccagtctatatactaagtatttaaaaagaagtactcagttgttaatcaaaataatatgatttggaaaaatgtaaattaaacctcagagtcctagagtcaaactggttttgaatttcctgttctttactagacatgtgatcttaggtgagttagttcaccactttgtgctttagtttccttatcaagtaaagttgtgataataatattccatatatgatagggttatgctaaagattgaatgaggcaatatatataaaatgcataatacagtgcataataataatgcacacagtggcaagttcctgtagttccagctacttgggtagctgagacaggaggattgcttgagcccaggagttcgaggctgtagtgtgccgtgattgtacccgtaactagccactgcattccagcctgggcatcataggaagaccttgtttctctttttttaaaagcataatacattacctaccatatactaagctctcagtaagttaaaaattaaaacaaaaagttatgaatatttacctgtaaccaactttgtaagtgaaggtattaatacattggagtttatctcttgaattttaatttaaaaaaaggaaggaggatatttatggcactaaactctatttcctgcgaaaatttttgaagaaacaaatgaggagaaggtcttcagttttaataatgcaggaataaacatacatgataatgtaaattggaaagaacttttgcttttttgttcacctgttctatgatatgcttgctgtagtctggagttaatttccacacttgctatttaatgtaaacattgtttttctatttgtaggaaagattttcccttttgatctctcacat

SEQ ID NO: 13890 - DNA, 1072 bp, Homo sapiens
acagctagtaaatgatggaactaggatttgaacctaacagtctggcaccagagtctgcttttaacacttgtccctatacttcttttcaaatataatttctacattcagtcctatgtaatgtttgagtattatgggttttgccactcttgtctaggcaattgaaccctgtctcccaacttctagaatagaattctttatatcatatcacactgattcatagtaagtaaatagtataactattggggagtggggagaggtgaagattctgagcttaaaatttgtgaattttcaactgttcatatggtttttctcctttattctgttaataatggtgaaatgtcaattgattttcaaatgtcaaaccagcctgtattcccaggataaaatctacttggtcatggtctattacccttttaatacattgatggatttgatctaatattttattaaggagttttgcatacatgttcatgagggatattagtctatggttttcttttattgtaagagatttggtatgagtagggatctatttcctcctcttttttaagggtttgtgtaggatttctaccagtttttctttttgtttcttgtttgtagaattcagtagtgaagccatctgaacctggcattttgtttttgggaaagttttaaattatgaattaaatttcattaataggtccaggactattcatattttcctatttcttcttgagtgggttttgatgatttgtgtttttcaaaagaatttgcttcacctaagttgttaatttattggtatatagttcataatatttcctgtgatatctgtaggatctataatgatgtcctcctcttttatttctcaagttgttaattgatttttttctctttttctcaaaaagtcttggtgcatttattaattttattaatcttttcaaagaaccaacttctggttttgttggtttttctctgttgtcattgattttcactctaatccactgattttcactttttagtatttcctctttcctcagaccctacacattacagtagaagcatagataattgattttagacttttctcatttct

SEQ ID NO: 13891 - DNA, 1031 bp, Homo sapiens
ttcttctttttagacacagggtcttgctttgttgcccaggctgtagtgcagtggtgcaatcatggctcactgtagccttgaccttcaagcaattctctcacttcggcctcctgagtagctgggactacaggcatgcttcaccgtgcccagctaattttttaatttttttgtagagatggagtttcatcatgttgcccaggctggtctcaaactcctgggctcatgcaatctgcccactctgaccttccaaagtgttagggttacaggcatgagccaccagggcccagccctacgtatccattcctacctgggtattgagtatcaatgattgttaatatcacaaaaagagagacaaccaagtatctgttacatacttcctgatggaagaacacaccaccaactatgaaatggccttgtcaaaagatcaaacctaaagctgattgacatccgtataccaaattatggcaactgtagggacagagggcatattatatgacactacagtgatgccattgctgaagccctgactggggaattctaaaggacaaacaacttgagtttgtttttgttttttttaacaaataaatcaaaagaaaaaagaaacagataaattctagattaataagagatttaaaagatcaaccaatcgcaatgtataaaccttatttgtgttaccggaaaggggttccaatccagactccaagagagggtttgtggatcttgtggaagaaagaattcagggccagtctgtagagtaaagtgaaagtaaatttattaggaaaggaaaggaataaggaatggctactccatagagcaggcccaagggctgctggttgcccatttttatggttatttcctgatgacatgctaaacaaggggtggattattcatgcctcctctttttagactatatagggtaactgcctgatgctgccatggcattagtaactgtcatggcactggtgggagggtagcagtgaggacgaccaggggtcactctcatcaccatcttggttttggtgggttttggc

SEQ ID NO: 13892 - DNA, 1112 bp, Homo sapiens
tcatggcaacccccacctcccgggttcaagtgattctcccacctcagcctcccgagtatctgggactacaggcacgcaccaccaggcccagctaatttttgtattttcagtagagacaggtttcaccatgttggccaggacggtctttatctcttgacctcgtgatctgcctgcctcagcctcccaaagtctgggattacaggtgtgagccaccatgcccagccagcgtacatattttttaaatgttttctgtgacatgggagcctttgtaaggaaatgaggacccaaagaaacaggtgagcttgtgtatttttctgttttggtttaatgaagagtgaacagttgtgcaaaagtattggacaaagcggatgatctaatggtaaactggggggaacttagcaaggcctgtttgttcagattcttctctgtgtttctgtgtcttcagagatgaggatatttattttccctgggtatatggagggtacctctcgaatgagagtaatttctttctttctttctttgagacagggtctcactgtgttgcccaggctgaagtgaagtgctgtgatcataattccccgtagtctcaaactcctatgctcaagagatcctcccaactcagcctcccaaagtgttatgattacaggcgccagccactgtgctgagcctacaccacacctattgaaacagaatattcagcatttaatatttcgggttttttgtttgttttttgagggagagtctcactctgtcacccaggctggagtgcagtggtgcaatcttggctcactacaacctctgcctcctgggtttgagcgattctcccgcctcagtctcctgagtagctgggattacaggtgcccaccaccacgcctggctaatttttgtatttttagtagacacggtttcgccgtgttgcccaggctggtcttgaactcctggcctcaagtgatctgcccgcctcagcctcccaaagtgctgggattacaggcatgagccaccgtgcccagccagaatatccagcattttaaaaacccttctgggatttcagctccctgctggggattgaggaaccactattgtagcaggaagcatgggaaggaaatgagctc

SEQ ID NO: 13893 - DNA, 1044 bp, Homo sapiens
gttgctatctgctgctatggtttccaccacagatgcaagaagaacatgtccttgcgctttccgtctgtctaattgtggcagctgagattgaatagaggaatacaggaggaaaaaaagcgggaagagtttttgaggcaggtcggtcacccaggcttgtagtgcagtggcacaagcaactcactgcattctctgcatcctgtgctcaagccattttcccacctcagtctcactagttgctgggactgcaggcatgcacccctatgcccagctaatttttgtagagaccgagtatcgcttagttgcccagggtggtctcaactcctgggctcaaggagatctgcccacctcagcctcccaaagtgcaggcctagcctgggaggggaattttcaaaacgtgagttttgggaaatagtctatcagccttacctggttgattacacttgtaaaagaaagattaaaagcaggccagtgactctggtctgcttgaacatgtgaatgtagtggtttgagcaatctggagtttgccctagtgtcaaattccagactgtccatagtgtccaaaacctgaggcagatactaatgttaacccccagcaccccgtgattggaaacaaacctaaatacgtattgggaacttaatagcaattttaagcattctgatagattttttgtagggatggggtcatgccatgtggcccaggctggtctgaaaactctggcctcaagtgatctcaagctttggccttctaaagtgttgggattacaggtgtgaggcattgcacctggcttagcgttctgatttgacattgtaatgaaaagtgtgagtctcatctacagggccttttgtcctctgaaatgatagcaggaagggaattttcaggcagtggtcaaagctggggaaaccaggatagtgaagaaggccttgaggtgagagatggaagctaattggtgaactagccttggaagcctgaaacagacaagtagcaattcagagactttgtgggctccactgctccaacttgttttgaagattttcagttctgca

SEQ ID NO: 13894 - DNA, 1332 bp, Homo sapiens
ctagatatggcctcactttcacttcataatcatattttgctgtatacgtatggatcagtatcagtggttttcactttggtttactgataatgggcagctgatcattgaaaagcctagtgcagtactagcttagtaaatagagctgactgctgaactggtatgcaaattgttttactaataataaataacttggtgtcttctatggaaggaactgctggaagctgtacagaaacaaaggcattcattatcctagttttcataggcttctgtataaggaagaagaaaaacataaagctatactgaacaagattagagtcaacagtagacagaaattacttagaacagtataagatgacttaccaaaggggttattcagacagtatctgaggtttttgttggtagagcagggtgtgggtggtacatgccacagccttctgaaaaatgagctaccgctgatttggtaagggtgttctgcatccactgatagaccttgaacaatttactgttgttcttttggtttgcactaggatgcaaaagaaagaaatccctgcgctttctgtctgtctttgtggcggcccagattgaattggggaatacatctttagcctggaaatgtaggctgcatgttaatggtaatgtaacttttgcagtgtaatgtttgaaaaatattaatgtagtttttgcttttacagtaacaaatgtggcaattattttggatctatcacctgtcatcataactggcttctgcttgtcatccacacaacaccaggacttaagacaaatgggactgatgtcatcttgagctcttcatttattttgactgtgatttatttggagtggaggcattgtttttaagaaaaacatgtcatgtaggttgtctaaaaataaaatgcatttaaactcatttgagagaatgccttttagtttaatgcatatttaaactaaattgatcctgtagtgttcctggagaagctagagcctgattgtaggctactactcatcaattaacttctacagtggagactacttctgggactggaatataaaaaagaatcaaaggttctgattttgagttgcaataaagggaaagaccatgctcatagcagtgccaacatctgaagtgtggagccttacccatttcatcacctacaacggaagtagttaactggaagagattaccaagagaataaaaagagactcattcagtggaagcaactttgtctcagcttatttcacataaagagagcgaagtcttttgggatgaatgttaattaaactccctggtaactagaacagggactggcaaactagcctatctgaccacctgttttg

SEQ ID NO: 13895 - DNA, 1044 bp, Homo sapiens
aaagtctggaaggattatgatagggacaaggatgataacatttcctgggaagaatacaaacaagccacctatggttactatacctaggaaaccccgcagagtttcatgattcttcagatcatcacacctttaaaaagatgctgccacgtgatgagagaagattcaaagctgcagacctcaatggtgacctgacagctactccggaggagttcactgcctttctgcatcctgaagagtttgaacatatgaaggaaattgtggctttggaaaccctggaggacatcgacaagaacggggatgggtttgtggatcaggatgagtatattgcggatatgttttcccatgaggagaatggccctgagccagactgggttttatcagaacgggagcagtttaacgaattccgggatctgaacaaggacgggaagttagacaaagatgagattcgccactggatcctccctcaagattatgatcatgcacaggctgaggccaggcatctggtatatgagtcagacaaaaacaaggatgagaagctaactaaagaggaaatattggagaactggaacatgtttgttggaagccaagctaccaattacggggaagatctcacaaaaaatcatgatgagctttgatagacactcaccagaatatggcagactgtcataggcattctgttattgtcttggattgttgctacaactgtctaatttacagcagttgtgatcccacaaaaagcaagtttatacctcagattggggtataaaaattgtttttcgctcagtatttactggaaaatggacatcactagtctttcagtaagatttctctcaaaacacgtgaaaaccttggtaaattgcaattcttgctggggatatattggtacaacatgacttaaaactttttttttttttctattaaaacttaaaggggaacaaaacttgaaaaagccctgttcttcagaagttgagtgggttgagggaggcagtaatatgaagtgactgctgtgtattttaactaccagattttttatatttgccactg

SEQ ID NO: 13896 - DNA, 1047 bp, Homo sapiens
acatgaaaattatctgttatatgatattaaagtattattaccttctactctgtaaaaattgacctaagacacttagaatttttccttttacattttacttaaggttgaaaggccaataaaatgaaaattatagcctatatgcctactcctttttaagtaggcattgtctatgaattagaaagggcctcatttaaaatagcaaaattctaaagtttattttccagaatttaagaatcatattatatgacttggaatctaaacaaatactgattgtctagcaatgttctttctacatggtagttatatggtacaaagcttcacaactgtggtgacacaagccaactttttaaacaacctgtcaaaaatttacagtagttgaaattatatttgaacactatatacctctatcaattttctaaatttggtaattattttgacttacagtactttgtgtgttgctggaactcattccagtgattataccatgaagcaacaccccttaatattcctcttgaatcattccaattagtgtctgattgttactaacaacttttttaaatcacagtgaggatcttttctttgattatataaaatatgaaatttttattttaatttgctcttatattttgcaattttttctactgatgtagaaggtatgtatgattgttatctttgttattttctggtatcaggtatttctaagtagaacattatttcttcaactgttccttcgcagtggatggattatttgctctcagtgttaataattgtcactctctgactcttaaagggatttcataatgaaatagttgtttttaaaaattaaaatgtatgtgtgcacacactgcaaacacatgtactcctagatttaacccttaaaaggattctggtaccaagtttcaaaagatcagacccaatctgagtgaaatcaatagagttctttcattggggatctcccatggagttaaaatgagttatttgtatgggtgggttgggttacctgttttcttttggtgggaaggttttttatttgtcagagtccttaga

SEQ ID NO: 13897 - DNA, 1430 bp, Homo sapiens
ctgctattcttcatgcagtcaaggctgcctcttttgaccacagaaaataagataggggagtaggaggagatcaaataatggagtgattagttctattaatgcctaatcattttatgtacttcttggaagatattttatggttatagtggaaatagacaaggaaacttttttttttatttattagaactttgagagaggaatttttcttaaaatgatttatatatttggatatttatagagagaaatgtatatgtagaatatagaaatatatagaacatatagagacaatatggaacatagaaagttacatagaatatggaaaaaggtaaattatgttttaaaggaccttgaaatgaagcattttgtttctattttatcatgtgctaataactctttatatatggtatatttattttagatcgccaggattcaagaagccatagttcaagaagaagttctccagagtcagatcgacaggtccattcaagatctgggtcatttgatagcagagacaggcttcaagaacgagatcgatatgaacacgacagagagcgcgagagagagaggagagatacgaggcagagagaatgggaccgagatgctgataaagattggccacgcaacagggatcgagatagattgcgagaacgagaacgagagagagaacgagacaaaaggagagacttggatagggaaagagagagactaatttctgattctgttgaaagggacagggacagagacagagacagaacttttgagagttctcaaatagagtctgtgaaacgctgtgaagcaaaactggaaggtgaacatgaaagggatctagaaagcacttcccgagactctctagccttggataaagagagaatggataaagatctgggatctgtgcagggatttgaagaaacaaataaatccgagagaactgagagtctggaaggtgagtgctacctctgttgtctgtgatactgctttatttcttttcagatttcgtgggaaacaactattttcttttgaaagggcacccactaatgggcaaattgactccattctccattcttctatagaggaagtagatttcagaaggaaaaggcctgtaagatagagatatatatatttttttaatgtggtccccttagcagtaccattaaggcagatttggttcacataaacctaaatgaaataaaagattgtttagatgcagtgtgtatagatgttgaagaataaccatcacatccttttcttagatgttaaaaaaataagattacaaaaattgaaatgacttcttagttcagagagggattcaaataattattagtgaatccctattttctagggcagttgagaacaaatatatgaaacaataacactacctaaaactgtatttaatgtaggattgactagaatcccactggtactccctagtc

SEQ ID NO: 13898 - DNA, 1004 bp, Homo sapiens
ataattcttgtcttttcaatcagtgattaggaagggaaatccagaatactgtattgaacccttcctagaaacatcctaaaattgttctgcttaatgagttgatgttagatgttccacttaccaacctgttggcctgattataatatgatctttatcaaaaaccagtagatatatagtatgtaaatggaaacatcacagtatcctagatcagaccgcagtagttgctttcaaaaatggctgtctctttgaaaaagttcatgccatcctcttaaacgtttttttatcccagactaattttctgctcaactgggtatttgggcagcatgcattcatttactctgtgtttatgtgatttgtgtgtacatggaaaaaatttatataaaatgtgatgaggttatcagttaacattttaagaaaacagctcttcatctgagtaatcatttatgtaattaaagctaatttattagtaattggttattaattacaaatatatatcactaatatgaaacactttttacatttatttcaagattgctagacatcagtacccttaatattacagttcatgttatattgcagcaacaaattctgacatatgttttgttctactatattttcctcacataatagctgcactttgatgtgtatatattttggcctgaaattagaggtgtgacttacgagggaaattttttttttccttcagctcctatgttctacacctcctgctgcccctatcctttgccaccagtgttctcaggtcctgctggggggacagagaagatcagaggtgaagggtagagatggcagaaagtggggttggagcagtgggctggaggtagggtagggagcatgcagagaaagatcaaagattgatcagtgggaggggggaagggggttgacggggagcaggaaacatggtcgttagagggcaaataaaaattatctttaaaaaatttaaggtctaggggcgattgttacttggatattaagttaaaattaaa

SEQ ID NO: 13899 - DNA, 1043 bp, Homo sapiens
agaattttataaggacttccagaaaggaacagtaaaaaaaaactgaatgatagggctggggattgtttagagaaatattttatttgtattctgtcctgagaagatatggtatttgctttagctaattttacgttcttatatgtcttaagctaaaactttttctgttcatctatcaggtgatctcttaaatgaattttgaagcaagattactaggaagcacttaagaagggttgtaaatactttctttggcaagcttttatttctgtacttattagggcctttaaacattaaaaattttatgaaggtcttactaaccttggctgaagtaaggttcactataatgctgagattaatatagcatgaaacttgatggcccagagaattgaatattgatactttactatgggctgaatcaaagaggtaatattatatcttgattggttagtagtgggagaagaataaagtttctaaggcatcatctacttttgggagcatagataggatcagaagtaggagaattgattaggttgagtttataaggtaagcctaatgcattttggttaaaagatgtgtagaatttccttagttacagatagggctggagtttctatgttctgtgttgatatctgaaattttttcttccctgggacttttagaactggtgatgcttttttttaaatttcttttttcctttttttctattttcatatccttgctcagatttttctcatctcatgcctgaattcaatagtaacatttggtttcaatcttatggttagttcaaccacatgtattgatcttctactaggtgccaagaactttgatagttgctttacatatattctgacttagtctttacaatatccttgtaagtgtaggtatgataaaataattcatgttttcacagttttggggattagatctaagagtagtaagattacaatattatagagaagtaggttccagagctggaattcaaactcaggtcttctgaccagaagttcagttctctattttaattttactgtaactacttcaataat

SEQ ID NO: 13900 - DNA, 1031 bp, Homo sapiens
gtgaacatttgtttcccacatctgttaatgaaaattttcacatacagtttaatgttgtcattaaccttggtgttctatgttggaatgttttcactgtaaactgtatttaagcaataatacgtacccatttttttctttcattatttttatatatctgtgaattaaatatgaagaaatagtttttattttttgttttttttggggggacaggttaattttaatgaatcttattattttatgattttatcatatgacttttatataggtagggaaaactgggacttcgtctactcaggtcagtcattggacaccttggttgttctgattcattgcttgatactcttttcaggagtgattaccacactttggaatattaaatatatatattagtgatgtttaggaggaaagattatgactgatgaaatttgttgaataaagtgtatgtggtaaacatttgtgtgtctatcctttgtttaggaagtcgaggctcaagaggttctcaaattgatagtcacagtagtaatagcaactatcatgacagctgggaaactcgaagtagctatcctgaaagagatagatatcctgaaagagacaacagagatcaagcaagggattcttcctttgagagaagacatggagagcgagaccgtcgtgacaacagagagagaggtttgtcaaacagaattttattaaatagtgaacaatatcaattgggcgaattgttttttcaaacagttaccaatttactttttaatataaaatatactttaaggcttgtgctcgatgacacatttgaaactattatatatactcatataatctttgttcacatggtttaggagggattatgtcaatagctagtgaccagtacctactggcaacaaagtgcaaaaacttgggtgccctactgtgtgtttctcatcttacccaaatagcttacaaacctttaaagaatgtagatggttgggttctattccaggcaattctgattcaagaaatacctaaacctttacatctgagtatcctgtcta

SEQ ID NO: 13901 - DNA, 1048 bp, Homo sapiens
tgacattttaaaatataatcacttacaaatccttccattgtattttattcattttaaactgtcttttccccagtggttttcacgtggaaacttactgtgtagctgaatgtcacaagtttgttaaagtattagatttgcattgtatatttttacatcttagctactctttaatatttaaagtttttgttctttagtaaaatagatgtagtatagtctacatctcttttagtttttgttgtttagtagtttttgttctttagtaaaatggagtatagtcttttcattgtggtgctaaactagaatttgtcactttctctacttagtggataagtgactatttacaaaactgattctttgatgaaacagagatgaatgaaattaaaatgttctcttattacaataaactacctcataatttttaaaaatatagtaatctgaatgtatgtatgtacttttttagaaagaatcttcaagagggagacatagggaaaaggaagacataaaaatcactaaggaaagaactccagaaagtgaagaagaaaatgtagaatgggaaactaatagagatggtgagtttcagaatcttggtttaaatggcgaattcttgattatttactttctagagttttcgtgggcttcagaacacctttcgactgtgatccctctcgtttcagaatcattttattgacatatttctatcttactgaattataaggcaaaaactggcatatagtagctgtacaaaggcagagaaagtggtttgcattgcatatttttattttcccttcctagttttccctctagaactttattgtgcagcattacagcccttcaggattgtattgcatatgtaaatttaaaaattcctaacgctaagcttaaaatgaaatctatatttgttttacataaaatattataaatgagatttttaaatcttaaggacttgggaaagttatttccaagaaatgtttgacttttatctttcagaagaaatcaaaatcagattaagatagagacctggatttattaataaaaaattagcaaaaaa

SEQ ID NO: 13902 - DNA, 1022 bp, Homo sapiens
aaggaaggaattcttatttgtgcttgtgggagagatacactgaggagacccagattgcttcttattatggtaagagataagctttaatgtgaagtcaacattaggcagagcggagctgtgataaatgaaaacaagagtgaatatttggtctttgatgatttcactgttactaagtcacttaggcctgaagtttaccctatatatagacttcattttatgtgaaataatagttcaaatttgtatagtttaggagattatagtttcttagttgaagctccatttttctctgctaaaacaagttagacttcattaatacaagtataatttcaattctaagtcaggggagttggaagctgtatgctttatgctgttctgacaagactagattaatttggggtatcatgtttcattgaagcacactagccgattaatatgcccagagaagatgacagaatgatgaagaaagggctagcacgtgaaagaagtattagatttgttttgcataattccagaggttagaactattcccaatcagtagaaattgtagggaggtagaacctctagagaggttaagaaagatgcaatgggcataagaaataattttctaataattagaactgtctggaaatgggaagaaagggtgcaacagcacagagctaagatttttgcccccaagagtcttgtaatagagggcttccatagctatacaaatattgtggaaaattgttctgcatagggtaggaggttggattatattacttacacagcctcctaaccatttttatactctagttactaataatggttctcaactctcttagccttgacacttcctatttcatattctttgtaatgcttgctttttatctaaaattaatgatgaacataatctgcccacgcatataatgttcaagaaataaatgtgcatatgagagtggaaatgaaagtaatataaacatctaaaatcatgtattacatttctgaaattcaaaaaacttcaaacatttttcctaagacacaga

SEQ ID NO: 13903 - DNA, 1054 bp, Homo sapiens
aaactaaatgtttatggtgatgtgagaggtaatgatgggggaactaccttaagcagaaaggtggttaggaaagatatctttgaggaagtaatttataaatcaaggcatttatgacaggaaggagccagatgtgtcatcatctgggggaggagcatttcagaaagaggaaacataaaacagcattcctagggttagaaggagcctatagggttcaataacttgcagtgtggttggggcttatggatgctggatgaagataagtgagagaggtttacagggacagcatcatgtcaggccttgagggcaaggtaaggagtctggattttattccagatttgatgggaagcctttgggggatttcgattagggcaatgacatgatctgatttaggtttataaaagatctcttgaatacctcttgattataaatgggcaagagtaatcgcttctcggccttttggctaagatcaagtgtagtatctgttcttatcagttaatatctgatatgtcctctatccgaggacaatatattaaatggatttttggagcagggacatggactaggagcttgctccgtccactccatgcatcaacttggtattgctgtacccctaggaacggcgcacccctctgggtgttaaaacacggtgttactggccgggcacggtggatcccacctgtaatcccagcactttgggagtctgaggcaggtggatcacaaggtcaggagttcaagatcagcctggccaacatggtgaaaccccgtctctgttaaaaatacaaaaattagctgggtgtggtggcatgcacctgtaatcccagctacttgggaggctgaggcagagaactgcttgaacctgggaggcagaggttggagtgagccgagattgtgccactgcactccagcctgggcaagagtaacagcagagaaatctattgggaagctatggctgcacgtccaggtgtgagaagacggtaactcagactaagacagcagctatagctataaacttgctgatggaatgaagttggagagctaaggaaagataggatca

SEQ ID NO: 13904 - DNA, 1072 bp, Homo sapiens
aggtgaatctttatcattatggaacttatggtcatttgttttggattttagatgtcttgtcttgcaatatattcctgggtttaccttgggacttctctaataataatgatggctattcatatgtgtctgatggctcttaacacacaagaaactaaggataaaaatatggcatactcagtcacattggaacttggtcacacaagtcttttgagatatctgtttccctgcatctgtacccattttctatcagatccatcttttgatctgtgaaaaatggcagataatacttggtacattttacaggtttggtggcctaaaactccaggcctgtttaacttcttaacaattcaagaattatatggatggaaaatgtttttctttacatttctttctttatataggaaactgtaatttagctctaaattcaactagccagctgggactagtctaatcattgagagacatgacaccaagtaattccgaggctcagctttaatcttgacaacattcctgtcacattcacttccatgatagaagacagattgctttagaagacttaagttaccttgaccttaaactagaactttttattaacagctgttcccaagataaacatttaatacctctctggaagggagagattgagaacatttactgattcatcaaaaccttggggatttccttgttctctgaagcgtcagtgatatttttattagctctatttttatttcttaggtgcttagaaaaattcccatcttttcccatcagtgaccattcactagttcaaaatgggaaaaacaaaatctttgttagactttcatttctttcggtttattcaaccttgtattttaattgtagatagggataaattatctggtgtttgatacccttagaaagttcttcccacctggagtgtaaattagtttaaccattgtagaagatagtgtggtgattccgcagacctagaggcagaaatgccatttgacccagcaatcctattactaggtgtatacccaaaggaatataaatcattctgttataaagatacaagcacacatatgttcactacagt

SEQ ID NO: 13905 - DNA, 1050 bp, Homo sapiens
taagaatattaaaggtttagaaggaaaaaggccattttcttaagaatccctgagatatgggattcttgccactagtctaggactgcttgaaagtagggaagagactattattagaaaatagaattccgaagaccttgtaaataaaagcctggcaagtcagattttgaaccaacttaaaagcatatttctgatttaatcagcctaagagcttaaataactttaaatttctgtttggtactagtatagtatatcctgaagagtatctttgaatttatttttcaatgttacttctctttttacaggcttatgatgctacccaccttgtgaaatcctatccaggatctcagctggacatactaattgatcaagggaaagatgaccagtttcttttagatggacagttactccctgataacttcatagctgcctgtacagaaaagaaaatccccgttgtttttcgattgcaagaggcaagtattaggaaactttagcttgatctagataatgtaactatgaaaaattaggattctgtgatattttcttaactttattttagaatataaaatgctacttctagtaagtttttaattatattcagacacttgaagtgaaaacctgcctataaaattaattatatctaacactaaatttgatagaaataggaaagcttttggcagtgaaaaatattgttttccatcaaaccagtaaataacaagatttttaatgcttgaatgatgattaatcttcagcattagcagatacttctttctttacacatggacctttgctgcagtagaataaaaaggacaaacttctacctaaattactccttattttatgtatatattttagcctcagaagttaagtattatttatcacacatgtgctttatattatttgactttcatattaatctattcattgtgctacttgatatttctagttgtttaagaataattactgaatcccaatgggcttgcaagttttttttaactaaaatatttttgaccgtccactactcacctaactctatatatgctaccatagtcc

SEQ ID NO: 13906 - DNA, 1044 bp, Homo sapiens
aatcccagcactttggtagcttgacgtgggaggattgcttgatcccaggattttgagatcagccagggcaacatagtgagacctcacctctacaaaaaataaaatattagccatgcacaatggtgtgcatgtgtagtccagcaaaatttaggaggctgaggcaggaggatagcttgatctcaggaggttgaggctggaaggggccatgttcacaccactggactccattctgggcaacagaggaaaactctatctcaaccccccaccccaagttttaatgttatacttctaacagtaacataattatgtatgtgtttgctttgagatatatatcaatattttaaatcacttttagtgcttatcatcatttcttctctttcatctttcctctggtaaatacttcaatagattttttagtacagatctgtgaatgggttagtccttctagtgtttctatgtcttttaatattatcattttattctcattcttgactaatttactatgttgactgtcatttcccctcatcactctgaagatattattcagtcttcagatagagtgtattttatttctactattctatcagaaataatatcttcagagtgatgaggggaaataacagtcaacatagctaatcccatctctattataactaataaaaagtctgcttttcctctagtcctctatctgtgtagggaatatgcttttttttctctgatggtcttcacagttaattcttgatttttgatatcctgcaaagtcattttattgccatatggaaagatatataaagatgtatgtttatgtttagatttgtatctagttttctattcagagtgtactctgaaggtcaggattcatgtcattatttctggaagagtctcagcaattattcttatgcatgtttcttctccattccttgttcctgggaatttacgttaaaaataatccactggggctgggcgcggtggctcacgcctgtaaacccagcactttgggaggctgaggcgggcagatcatgaggtcaggagatcaagaatatc

SEQ ID NO: 13907 - DNA, 1049 bp, Homo sapiens
tggaaagtagataagcccacaaagatgagaaagaatcaatgcaacaaggctgaaaactcaaaaagccagagtgcctcttctcctctaaatgaccacagcacctctctgggaagggcacagaactgggcaaaggctgagatgcctgaattgacagaagtaggcttcagagagtggctaaaaatgaactacgctgagctacgggagaatgttgtaacccagtgtgaagaagctaagaatcatgatagaacaatacaggagctgataaccagaatacccagtttagggagaaacataactgacctgatggagctgaaaaacacaacatgagaaattcacagtgcaatcacaggtatcaatagcagaatagaccaagtggaggaaagaatttcagaacttgaagactgtctttctgaaatacaataggcagacaagaatagagaaaaaagaataaaaaggaatgaacaatgcctctgagaaatatgggactatgtaaaaagactgaacctatgactgattgaggtgcctgaaagagactgggagaatggaaccaagttggaaaacatacgtaaggatatcatccaggagaacttccccaacctcacaagacaggccaacattcaaatttaagaaacccagagaaccccagtaagataccccatgagaagatctataatatcatcagattcttcaacattgaaatgaaagaaaaaatattaagggtagccagagcgaaaggccaagccatctacaaagggaaacccatcagactaatagcagacctctcagcagaaaccctagaagccagaagagattgggaactaaggggactaatattcaacattcttaagtaaaataatttcctactcagaatttcatatccagccaaacaaaacttcataagtgaaggagaaataagatccttttcagacaagcaaatgctgagggaatccaccaccaccagggctgctttgaaagagctcctgaaggaagcactaaatatggaaaggaaaagccattaccagccactacaaaaacacactgaaatacac

SEQ ID NO: 13908 - DNA, 1044 bp, Homo sapiens
atctgcaaacagataattttacttcttcctttcctatttggatccattgtatttttttttcttgcctaatttttctggctaggacttccagttctatgttgaatagaagtggtaagagtggccatctttgtcttcttccttaagctgatagacatttaatttgttttcacttttctgtttattgtaaatagtgtgctataaacattcatttacagatttttgtgtgaatatacatatgtatttctcttggttatatgcctaggagtggaatttcaggttcatatggaaactctgtgtttaaatttttgagaagataccaacttgcataaagataatgataataatagccactatgtatgttgtattatatctctgctgcagacagtggttaaattataaatgttatatgtaagtgcagacttaaagtactagtttataatgagttaagttggcttgaaagaaatttaagtgtggggatgtttttgtggacaaaagcaagaagatgctattgcaagtctgtaggaagagaccctcacaggtaccataaggaaaataataggctagttaaaagaaccatcaagggttaaaactcctgtacagagcaggcacttagaactcactcctggggaggtaaagactacagtaaaagtttattgcatgaacagaggcatccaacatgtttgttgcatgaacaaaacaacttcttttgcattaggaaatatatgtatcatgtttaccatagtccaaataacatggaattataaaaatatatacaaaaattctctgatacttcttctttcaagagttaaagcctaattcctctccccttgagtgtgagctggatttagtgacccgcctttaagaaacagatagaagtggaagtgatggcgaacactttggagaataggtcatggaaaggcactgttacttctgccttgttcactttctctagaattattcgctttgaggaaagccagtttccatattgctctgtgaagaggcctacatgatgaagaactgaagtctccaatcaacaatcacata

SEQ ID NO: 13909 - DNA, 1034 bp, Homo sapiens
aatgcaaaaacgttaagaagcagtttggtaattttttcaccatgtttcagtttgatatggctgatataaactttaaaagctcaacatcatgccatcaataacattcaacttcaatttaaatgattaactgtttcctaataattgcatactcagagcagtaaattgcacaaaagatccattggtctactagggcgtgtgctagccgttcaaacataaaaaacaaaaagaaaaacaaccctaaaaagaactatgagctggcagtgccccaagtccaatgggggttgcatttcaccctctgggcccttatgaagctcaagacagaagggacacatatagatagtattgaaagtttcaattcttgaacttcataggtctagaattctagaaaggttcagcaatatattaataacacatttgataaaaggtctaattcagtttttattttgcatttctaaatatgtaatactttcggcctggcgcagtggctcacgcctgtaatcccagcaatttgggaggccaaggcgggcagatcacgaggtcaggagattgagaccatcctggctaacacagtgaaaccccatctctactaaaaaaaatacaaataaattagccaggcatggtggcaggcgcttgtagtcctagctacaggggaggctgaggcaggagaatggcgtgaacccaggaggtggaccttgcagtgagccgagatagcaccactgcattccagcctgggcaacagagtgagactccgtctcaaaaaaaaaaaaaaaaaaaaaaaaaaagatgtaatactttctttctccaatccagacagtttcactttgacaatctcaggttgccttttcattgccaaattgatttttatggccattttgtttatttccccttttctatgttgtgtttcaatcaaattatgaaagcaagagtgttggtataattctcagctttatgcaaaaatcagatagttgttttggcttgtcagttatcaactatagcagaacttttctttagaaccacttctggagggagaggaa

SEQ ID NO: 13910 - DNA, 1073 bp, Homo sapiens
tgtgttctctgccctctctgtgttctctgccttgtgtatttcctgtaaactgggagttcagtctgtaggcttgaccatattcatatttgattttggggagcagggaacaagaatatttcatagtaggtgtttaatttcatcaaaacgtatacaatgttaatctttttgtggtattactagccattgacatcatagcttagatccagtattttgtttgtgttgcaaagcgttgctattgtaattctgtcattcttcacttattatatgtaatgcttctaaaaagtaatacttccacgtgtcaaccatttgttaccatggagtacattttgcataggaaaagtaggataattacctgattatttgcctttattgaccaattttcaaaataatgtttgttctattatgtccaataaaggtgacctagggttttttttgttttttgttttttttgtattttgtttactttttgttttcaggtgtgtgtgtgtgtgtgtgtgtgtgtattgtgcgtgtgtgcatacacatgcatacacatgtgtgttccactggcatactgttttgaacttatgacttaaaacattgatgtagttcagttcatgtaagttgtgattgaaattgtccaacctttggtctttgggaacctcttcaggttaactgttgcatccttctgagaagccctctatctggtatgataaaatgtttcaggctcatctttacgtttcttgagtcagaacttgaatgggccaaatggtatttagagagcacaatttggccttatgagtattcatagatactgggttgattattgtttctgagctttttaagtggcaagtctgagaaaacatgtattttttaaagaggtaatacttgagttcatactgatattttcaatgcaagtccaggagtatagatttttttttcttatctgacatctgtttgtaccttcgttcatgccatactatcataattattcatttgctttgtcccttagtacagatatgacagttttataataagaataccaacagtctgattactgaaagcaattatatctgcatttctttctgtccttt

SEQ ID NO: 13911 - DNA, 1058 bp, Homo sapiens
ttcttttgaagtatattttcactggatatagaatcttggcttgatatatttttctttcatcacttttttcctgtcccattctccttttcttccagtttcacattagacttcttgatattgtccaagaggtcactgaggtgcagtttcttttttctttttttttcttcctgcagattggataatttctctttgtcttcaggttcactgacccatcaccagtctgctgttaagttcatccagtgaattttttatttcagatattatactttttagttctggattttccatgttgttcccttgttttattctctgcttagattacctgtgtgttcatttattatgaccatattttctcttaaatccttaaacatgttttaaaaagtttataatagtcttctgattattctaaatttgggttactgtgggtttggtttcagttgactgtttcttctctttactagtggttacatttccccgtttcattacggatctagtaagtttgactcatacactgtgcattttgggagctatggtgtaaagactgaattctgttatcttcctctgaaagaatattgacttttggtattaagggtacttaacttagctgggctccaaactttttctcctgtgttgggcagcagctgaaattgcttgcttctttcaaccctgtatcttttcaggagctgcaaggagaatgttgtggttagattggagtgaggaaggggtagggtactgaaaggtgaagtcagagaggtgacctttgttaagagccattttggtagagtgctgggagtaaaagcctgattagagtgggtataagagagaatggcaggaaaaaaatttggtacaaggagtttaagcacaggggttggcatttaataagtattttaggctttatggatcacatatagtttttgatgctgctgttttgcttcttcttcttctctttcttttccccttttgacttcataatcctttaaaagtgtaaaatccattcttagcttacaggccatttgaaaacaggcacaagttgggctcagttgctcacacttttaatc

SEQ ID NO: 13912 - DNA, 1052 bp, Homo sapiens
ctattgtctaaactcttctgtgttctgttttctctttttgtgcatgaagatagactatacactggaaaaccagaaaagctacatatgacttacacagaccatccatgacatgcctgggctttccaatcagtaccagatttttttcctcttcctcctcctccttctcctgggctttccgatcagtcccagattttcctcctcctcctcctcctcctcctcctccccccgctccccttcccccctcctcctccgcccctcctcctccacctctcctcctccccctcctcctccttctccctcctccttctccctctcccttcttctttcttatttgtttaaataacatcattttactccaggacagcaagatcttttcacatacaaaattattatctttataaccttccttaccaaaaatacatgatcatcatatacataatttttttcatacctttctcccccacttgtttccttactaccttgtttcataaaaaactttttcaagcccataatttgaattaacttttagataacttctgaattaaacaaaattattatttttctcataacattttttggggcacattttttaaacagaattatatcttatccttagtaaccttaaatgttagtgaaaccctagaaagcagtcctgaactatattagcattttatagatgagaacagttccacaatttttagaaacgtatttccctatatcacaaccctttcttaactggaaatgacccagatatccaatgagcatcaaaaataatttcaaaattttaaattacacaagaagtttacctaaaacatttatcccaattacaagtattcagttctttcattttaaacagtttatctagattacttctgaaaacatatattagatgccatcatttaaagttatttccttattaaccattttataatctatgaatatcagtcattcactgaaataagaactttaaagttaactacataggcattttcaccaataactattttcattaaaccaataacttaattactcttttcaaaaaatttgcacaa

SEQ ID NO: 13913 - DNA, 1026 bp, Homo sapiens
acttgtgcaaggcacaatggtcatatttgttattttttgtttgtttgtttttttgagacagagttttgctcttgttgcccaggctggagtgcaatggcatgatctcagatcactgcaacctctgcctcccgggttcaagcgattctcctgcctcagcctcccaagtagctgggattacaggcgcccaccaccacgcccagcttatttttgtatttttagtagagacagggtttcgccatgttggtcaggctgatctcaaactcctgacctcaggtgatccacccgcttcggcctcccaaaatgctgggattacaggcgtgagtcaccacgcctgaccatttgttaaatttcaaagtggtatttctcaaagtgtaaccatgaaccatgcatatcagaatcacctgggtgtttgttacaagagtgattcaagaacctgttccttaccatctgaatgggaagttttgtgtgagaccctatgcatatttgagcactggagccctgaagcctttaaggacctgtcttagtcattgccattcactatctgagaatcttagcacctctttcccctaggcgtttttatttataagccaacatagacaaagataacaacaaagaaacccaaacagaaaaacaggtagaactaagaatacatagattacttttaagaagcattaatggggagtgaatttaaaaaaagaaatgggaatttcacatgtgcctctaagaaataaaattgctatgtacatgttcatgtgtatttatatatatagctccataacccctcatccaaaacctttgggtctaaatgtatttcagaatttgaaattctttttttgcattttggaaggttaataggatttatataccatgtgttatatgtccccattaaagccagcagcagcaccttataagtcaaacaagcatatgaaaatttgtttggcaaaaacacatatactccatgacccagccttttcactcctaggtttatattcttccaacagaaataagcacacacgcacatgtaaa

SEQ ID NO: 13914 - DNA, 1026 bp, Homo sapiens
gccaccacacccaactaatttttgtatttttagtagagatggggtttcaccatgttggccaggccagtctagaactcgtgacctcaagtgatctgcccgcatcagcctcccaaagttctgggattacaggcatgagtcactgtgcccagccataaggataaactttaaaatcgtgtcttccctaggaaatcactaaacttgctcatgttgccatattgctagttctgaaaggctagttttattttgttttgtatgaaagaatatctgaaaaagtagaaaagtttgatattaatgtttcccaaaataatcataggtaggctctttttattcttaacaagaattaggaataaaattttgaaggtgttgaaatttatagcctagccaattcagttacggattctttgtttcattggaatgcagcctttcagtagtctattgtctgatttaattgactgttatctgacaggtcctggagttgttaattcaccgagatggggaatttcaagaactaatgaaattggcacttaatcagggaaaaattcatcatgaaatgcaagttttagaaaaagaagtagagaagagagacagtgatattcagcagctacaaaaacagctaaaggaagcagaacaaatactggtaagttgacagaggttggttcttaaggttaaaaaggatgttgtttaatctgtttctgaaaaatctgttatcaatattttgaagagcagaaaactagactttccaagtctaaaggtgatatcttgtcactcaccattgccagtggttaaatgaaaggctattgtcattctcttttttacttactgttttcaaatagtctgcattacttgtgagccacattttcgatgcttaaagattttacagtattgaattatagaaatggaaagttttacttttatcctggtctgatataaattttaattatcagtagtctaaatctctctttttttttttttggtctctgatccttagcataaaaatcagggaaatttttcattttttatatattt

SEQ ID NO: 13915 - DNA, 1022 bp, Homo sapiens
cctagccacctggctgctacatcctcactttgctttcctctccccattgtgccaggccctggctacacctcctcagctccatctttggggcactgaactgtctgtgtcttctactgtgctctttccttccagacatcttggctgacttctctcatttaatccgtgtcttatgtcaaagctgtgcccttaggaagaccttctctgaccaccctattgaagtagccaacccactcccccagtagtctctaataaaacattgctttatttccttcccaacccttatcactctaggtttatttcttctcttagttcttcttgtctcttgtattagaatttaagtgccattgttcactttgataccccaagtatctagaaagtgcctggcacatgataggcactcaataaatatttgatgaattagtgaataaatgaagactttgcattcttatatctacttttttcattcattgattaattcataaataatggtatggggaagtagtagtgggaagggttgggtctaattgacatgatccagaaaaatgatatgatgctagctggaaggaaggtggaaatttgaaggtaaaaatagcctggtagccagtgagaaagtacaaatgctcaggctgatcagagcagtgtcaggtagctagttgtgaagctgccccttctgcataatttctcaaaagtcccatctatcaacaagtttgaaactaatatataaacattacctgctatacatttttcccaatcttattttgctcatcagatactaattttcatacagggaaattgtcatatttattaaatgagcattctaaaaggatatcattttattatgtgtaaggatccctcttagttgatgtttaatttaaaaaattcaaataaagtggagaatcattaaaaaatggtccatgcatcccttaattgttttattttaccttaaaatatataaacatatgttcattcactaatcatgttatgtaagacaggagtcagaaaactttttctgcaaaggccag

SEQ ID NO: 13916 - DNA, 1097 bp, Homo sapiens
atccttttatattggccgataccagttttaaaaggcatcttatatcacttttctgcagaaaaattatataaaagctacctcattggtaggtttgcgttgtccagtgaggtaaagttcaaattctttagtcagacttccacatcttcagtgccattcccagtctactcccgatttggtgaatgattcatatatccttcagaatccagctcaaatgtcactttttctatagccaacattctttgacagctttagaataaatcttacctgttgtattttaaaatatacgtgatataatcagcactttatttttggtgtaaatttagtccttgccatcgtattgctaccaagttaccaggtcagcacaatatttaatgatggaagaaaacccgaaaacacctagacagcagaaattaaatggcttatgtgtttgatccactgtttaaaataaactgtattagggccgggtgtggtggctcacgcctataatccgagcactttgggaggccaaggcgggcggatcattggaacttcttcacagaatgaagctgctctggtggtgtgactggcttccagaaaggtctcatgtgttcactcagaggtagttatgtgtactgattctgtgatctgtgaagtttgtcagtctctgaatgtaatttgtgtctggcttgcatttatgaaaatgagaagaaaaatcacgaatataccttacatatttttagatttagcctctttaaaaatagtggatttataacttaggatctttttttttctattaacctgattatatagcctttcgggatatttattagtttataaaatgtaatgcaaggagatagtcttaaaaagttgaaacacaggttgtaggctaaacgttttttttaacccatttgtaactcaaaactcattgttccacagaaccatgttgataggaatcttgagttttccacaccagcctgttaattctgtttacctgaaaagtgtattactgctaataatgtaggctctaaccgctatggaaattttatttctatggggaattgtgtctggattctaatgcagtatgctgggaatgcaccttctttttagcaggacagggc

SEQ ID NO: 13917 - DNA, 1050 bp, Homo sapiens
cctggcgcacctccccgctttggcagctgtggcctccctggccagtgcccttgcaggaggccggccggcagcctgatgacccgtactctttagtcactgacgtcagattatttttataacgttccctgacagttcagagtcccttcgaattgcacttttctggtttcgcttatttaattaaaagagatgagtgtaagtataaaaaatgaaggtgaaataaccattggaattgtatttggttacttaatactgttccacaacatcttgggacgtctgttttcctttggagagtgaggccttgttattattcttttctgataaagaaaacattttatttcctttgggcttgcattagctctttcctagcaacccattatcccagctcagtacctttcaaacagaaaactagagtctggggttttgttgtgatctgaatttgtaagttattaatgtgaaagggggagcaggaagctccccctttgcacaaagggggatttgtttgcacaaagttcactgtaaatactgtgagaattgaattctgaaaaggtcatatttagtgatttcaaaagcacacatttaaatgaagactgactaaataaaaggtaccacacacttcttggttggtttcattccattgcatgtgtgtggctgtgtttgttcttgccaccgttccaggcagggaaagccttatgctgccccagggccccagcacaccttcctgtatgccccaccaaccagtgaccctgcacccgtcccatcgtcaaggctgtgaactagggatggtccagggcatcagaaaccatgtggaactctcccccactgctgcctgggaggttccccagctggaagcgtcctagcgttaggccagtagggactgagatcataatgttcttggacgaggctcttggccagagccaggcatctgcccagaagttaggattgctcctggagaaaacactcaggagcaccctccccttggaaatgtcccagaccctcagcctcataggcggacctcctttgatggctctgggggagcaatgtggctgtcca

SEQ ID NO: 13918 - DNA, 1033 bp, Homo sapiens
ttaaggtgaattttttgggattttctttcagagcctctgctctgtcacccaggctagagtgcagtggtgcgatctcggctcaccgcaacctctgcctcccaggctcaaacgattctcctgtctcagtctcctgagtagctgggattacaggcatccaccaccacgcccggctaatttttgtagttttactagagacggggtttccctatgttggccaggctggtctcgaactcctgacctcaagtgatccgcccgcctcggcctcccaaagtgctgggattacaggcgtgagccaccgtgcccggctgggattttctttttaatgtgccactttaggttgaccatatctcttcattacctttctgtttcttaaactaacccacatcttaattcttttctctgatgtcttgaacgtgacaaaacacattctgcagactaaagtggcattctgccttttacaacaatgtctttgagcataactagattatgtgataatcgtgcaggaaattctttcccttgtagatcttgcgtgtgtgtgtgtgtgcgcgcgcgtgtgtgttttgaagagtcgtactttgagttagaggaccattgcttttactgcgttgaataaatagtatgtgtttttctcacacctacctgtggtcacctttttgcctagttttaggtatctggcctctcaaatatcttttctgggggagggtgagagatttggggtaaagggctcagagagaagtaattcaatcaaagttgcctaaaaaagccatttttgtttttatttttgttgtgtgtccaggatttagaagaattctgctttaagttttgcatcaatcatttgacagaagttacacagactgcagcattttggcaaatggatggccctctgctaaaggaattcattgctaaagccagtaaatgtggagcctttaagaactgaagcgcaaggctgctgggttctgtgtgagtgctctggggcactgttgaggatgtgtccagtttgtgctctacgggtgatgtgattctgcaggtaaaa

SEQ ID NO: 13919 - DNA, 1050 bp, Homo sapiens
gatgtggccttggggctgtgtgtggcagagctgtggtgtttggctttgtgattcttctgtttattaacattctcattttggacaaaagagataaccttcccttctcccttcccccttcctccttctccctccctgcttcccccttcccccttctccctccccccttcccttcccttcccttcccttttttgagacagagtctctgtcacccagactggagtgcaatggcacgatctcggctcactgcaaccttcacttcgtgggttcaagtgattcttctgcctcagcctcctgagtagctgggattacaggtgtgtaccaccatgcccagctaatttttgtattttttagtagagacagggtttcgccatgttggccaggctggtcttgaactcctggcctcaagtgatctacccacctcggcctcccaaagtgctgggattataggcatgagccccaccgtgcctggcctatgcaaaagtgttttgagtagtagccagaatgaacatgaggttgatatgattcttatgtagctctctgaaataaccacctgtgattgataggtgtgaatgcatcttggtataattactgcagtcttgctgttgcccttttagtatggaagacaagtaaggtctatggccatgttgatgtttatggtgtaatataaacttttactttgagccaagtaaaacaacttttaaataaatctgctcttgaaaggacattatctgtttaaatattgatttgatataatatgtgttactggaatagatgcttgatgttgttcagcctaattgtaaggtcttacctcctatgtcctggagtgctgacttctgattatgagaccttacccaagaagcatactactgagaaatatagtaagtttggcttgttttccttttggattggaacgttcagagtccgtgacccccagccaatgcttatcagcccaatgagtgttctgagctctggtaggagatgagagaaaaagttacatttataaagaaatgggccaggcacgatggcttacacctgtaatccccagcactt

SEQ ID NO: 13920 - DNA, 1022 bp, Homo sapiens
ctgtagtcccagctactttggaggctgaggctgccatacactggacccgagatcgtgccactgcacttcagcctgggccacagagttgagaccctgtctcaaaagagaaagaaacttaaatttccatcattgtaaattaactgtttttgattgggagtagactttgttatttccagatagcagaggagactcatccattttttaaatcagctttcttttactcgaacaccccttgcatttcatccattctcattataaagtcattgctggacctggttcctgtcagcgtgatgtactccaaggattccaacaataaggagtgtggtgtgactggtttctgagtactttggaatgaatgggaacattccattatctggacttttgattctattaatgtggggggagtctttcagttattttaccagcttcatcataattaggtttgtgatcaagtcacaccctctttatcatcagctctctttaacccaaatcgttgggcatctacccttttcaactctaaacataagaataaatttcatatttacttcagcctagtttttctcatgagatcacattctacatatgtatcctttcgatgtcttcagtcttatataaataagaattctgactaagcctttagaaacattcgaatactgaatactctgtcccgtgccaggtactgtgctatggcacaggatacttgtaaaaataacaggaataaaaaaaaagacaagttttgacaaatgttagaaaaaaagaggtatacaatgatacacatactagaggaaattggctactgagaaaggtgataaccaggctaatgttgagcccttaaaaagtgccagccaaaatttcactgatcgtggtgaaaaggcaggagtttattgggcacattgactggaaaagctttccagcagtgggaagagtctgtacaaagccttgtgggaagcaccatggggtatttgaggaagtgaaagaaagcaagtatagctagatgaaagattataatggagaggaggatt

SEQ ID NO: 13921 - DNA, 1102 bp, Homo sapiens
cacatgtatacatatgtaactaacctgcacattgtgcacatgtaccctaaaacttaaagtataataataataaaaataaaataaaataaataaataaataagttctattctacttctacctttaggaccctccagttgttcttttttttttttttttttttttttttttttttttttgagacagagtctcgctctgttgcccagggtagagtgcagtggtgcaatcttggctcactgcaatgtctgcctcccgggttcaagcgattctcatgcctcagcctctttgagtagctgggattacaggtgtggctaatttttgtatttttagtatagatggggtttcaccatgttggccaggctggtcttgaactcttgacatcaggtgatcctcctgccttagcctcccaaagtgcagacattacaggcatgagccactgggcccggcctagggccccttgtttgtggccaacttctcttcttctttttttccttttctttccagtcttttatatgtagactcatttgtgtgtctgtgtctatgaaacataacatataatacagaaaaatatgctaaaatatatacagcttaatgaataattatgaaactcagacctctgtaaccaccacccaaagcaaaaacagaaaattttccgtgatttggatctgactttatggatttgtcatgggaagttgtgttataatgtaaaaggccatatactttggagccagattgactgtggttcaaatccagggtttgctgttgataaaaatccacgtggcttttgaacctcagctatctcatctataaaaattaggtgatggtaaggaatggaaataatacatacaaagcactctacacaatgtcaaacttatgataaatgtccatttattttttatttttatttatttatttttttgagaccgagtctcgctctgttgcccaggctggagtgcagtggcacaatcttggctcactgcaagctccgcttcctgggttcacgccattctcctgcctcagcctcccgagtagctggggctacaggcgcctgccaccacgcccagctaatttttttatttctagtagagatggggtttcaccatt

SEQ ID NO: 13922 - DNA, 1045 bp, Homo sapiens
atgtaaattagtatagacattatagaaagcagtatggggaagttcctaaaaatagaactaccatgtgatcaagcaatcccactactgtgtatatatccaaaggaaaaatgaagccagtatgttgaagagatacctgcactcccatgtttattgcatcacaatacccgagataaggaatcagcccaaatgtccaccagtagacaaatagaaaaagaaaatgtggtatgtatacatagtggaatactttttagccttaaaagaaagaaaccctctcttttgcaacaacgtggatgaacttggaggacattacattaccagaaataagccaggcaaacaaggcaagtatcacatgctctcacttatgcatggagtctaaaaaagctagactcatgtaggatggtggttaccaggggctggggccaggggtggggggtacagggatttggggagatattgattcaaagtataaaaaatttcagttagataggagggataagttcaagacctttactgtagaacatggtatattggtcagttttcacgttgctgataaagacatacctgaaactgggcaatttacaaaagaaagaggtttattggactcacacttccatgtggctggggaggtctcacaatcatggcagaaggtgaaaggcacatcccatatgacagcagacaagagagcttgtgcaggcaaacttgtttttaaagccatcagatcttgtgacactcattcactatcatgagaacagcgcaggaaagacccacccccataatttaatcacctcccacggcacacgggaattgtgggagttacaattcaagatgagatttgggtgggaatacagccaaaccatatcacatggttatgaactatagttaataacaatgtgttatattcttgaaaaatcactgacagtagattttaagtgttttcaccacacacacaaaaatgaaatgtaaggtaatgcatgtgttaatttttttttttttttctgagatggggtctcattctgtcacccaagttggagtgcagtggcacaat

SEQ ID NO: 13923 - DNA, 1073 bp, Homo sapiens
acaaacccaacagactaaaaactgacaaactgactctttttttttttttttttttttgagacagggtctctctctgttacccaggctggagtgcagtgggacaatcacagctcaccacagcctcaacctcttgggctcaggcgatccttccatctcagtctcccgaatagctgagactccaggtgcacagcaccacacccagctaatttttaaaaatctttttgtagagatgtctcattatgttgcccagcctgttcttgaactcctgggctgaaacactcctcccacctcagcctcccaaagtgctgggattgctggtgcccaccacctcacccagctaatttttgtagttttagtagatggggtttcaccaagttggccaggctggtcttgaactcctgacctcagatgatctgcccacctaggcctccaaagtgctgggattacaggtgtgaggcactgcacctggccagtttttagtctgttgctttttgaagataatctgtttttctctggctccttctaggatattttcctcctgggaaaagaaatctttttattttcccacttggagtttgttgggtgtcttgaatctgtggtttattgttttttatcaattctggaaaattcttagctattatctcctaacagttgcttctgtccagaggaacccaaacaaacactgttttgtattttttattgtatcctttatgtttcttaccctcttttctatatttgtcatctttggccctcttttatttcataattgacggtttcttctgacctgtcttaaagttcacagaatctcttaaactactttaaatttgctgtaaaacccatctgttcagttcttaattttggttatgtgtctaacttaataattattttttcatatctcagagttctgtttggttcttttcatttttcagatctggtcatttctgatcatttcttctggcttgctgatatattttacttccatttttctgttcctgaaatatttgctgtagttattttatgttgtataacctaagtgttaatttaggtttaactctccaacctggcatcagggg

SEQ ID NO: 13924 - DNA, 1040 bp, Homo sapiens
gggaggagtgcataggttatatgcaaatactatgccattttatataaagggacttatgcatccttggattttggtattaggaggtcctggaacctgtatactttctttgcatttcctgtttcagaaacacaaaaggggtacagatccaactcttcagcatatctttgtggtgtttacagagggtgttaagacagatactgttgttatttttctttatgcaaaatgataataatagggactgaaaggtagaaagctgaatagagtatggaggaaggtagctgaacaggcattgaaataattagagggattggatattgcatgtgcattcctcaacatttgaatcagcaggaaaaaaggaattcagtagactgagaaggatgatcatgttggctaagtattgggctacagattgtagagatgcatatatgggtggtagagaaaaagtagaaaccagcttttatacagtgttaacctcagctagcagagagcaatggactatacagttagtatctttttataaatttgaactgactgtaaatttgaaactacttccatgactatatgtatcttggttttgaaataatatatacttgggaatgcttattgaggtgctttttttgtctttttagattatgcataaataaattttagttaacttcagcatctggtattttaaacaagggtcagaaaaacatcagaaatggatagaagcatttttcaataaatattttgggaatgatccttgtataacttaatttgtgtactaattcatattaagtattcacttatagttatttttctatttattctacttactagtagttaaaaattaactattttttaaagggaaggggaagatgaaaataaaaattgtgattctaaataaaatcttagcattcagatagattcacagatattacagagaaaatttataagctgataattcctagttaggattatcatactatttaatgataaaatgcgtatttactcctgtataataagaataaattctcttggctggaatccttcaatagatg

SEQ ID NO: 13925 - DNA, 1085 bp, Homo sapiens
atatttgctgataagaatgtaacccgtgacttttagatgcatgaaaaagagcatggttgctaagccattcagcctggtattggtcacaacattacatttctcgggattctatagtgtaactaaaacatgaaatagacattcaaatggtagttctaatgtggcagacactgttacgagcttcatgataccttatttaatctgtgtaacaagtatatgaagtgtggcattatccccactttacatgagtaaagtattttttgagacggagtcttgctcctttacccaagttggagtgctcaggcactcatagctcagctgcaagctcaaacttctaggttcaaggaatcttcccaccatggcctcccaagtagctgggactacaggcggacaccaccacacctggctaattttttaatcttttttagagacggggtctcgctttgttgcccaagcttgtcttgaactcctgggctccagtgattctcccgcctcggccttccaaagtgttcgaactacagatgctagtcgtcacacccagctggaactttagataaaaaacctcagtgtgcttatgtagcctgtgcatgtcactcagtggatatgggtattatttattcactaattgtctattgggtatctatcaatgttaggtcttggggataaggaataagatgcagtctgtacttcagggagtttacagtccagtgggggtgataattacaatgcagaacaacaattgttacagtatagtattccgaaaatgcatgccaaaaaaactacttggaggtgagcagaaagggaagatactctggttgatttctaatggatgaatgggagtgagctgattgtgaaggatgaaagaaaggtggccaggcaaagggcgggagaaggctggtggaagaaaggggcattccagactagagggagcagtaattgaagagtcctgagagaaatgtaggagagagagagactaaagggtaaactggggtcaaatctgatgaagggcctttattggggatttaggcatatctaagagtagataaccatgcttagtcttgtccattagaaacagtacaacttagctc

SEQ ID NO: 13926 - DNA, 1059 bp, Homo sapiens
caaagtgtgggattacaggtgtgagccactgcacccggctcttgtaatgtctttgtctaatttgaatattagggtaatgccagcctcatagaatgatttaggaagtatcccctctgcttctgtcttctggaacagattgtataggattggtataatttcttccttaaatgtttgatagaattcactaatgaatccatgtgagtctggtgatttctgttttggaagtttattagttattaatccaatttttttaatcaatataggtttattaaaagtattgatttctttttgtgttaattttggcagattgtgtctttaagtaggttatcaaatgtgtggacatagagttattaataatattcctttattattcttttagtgtccatgggatctgtagtgatgcttctctttcacttctgatattagtaattgtgtcttctctttttcttagtaagcctggctagaggtttatcaactatattgattttttttaaactagattttggtcgtgttatttttctctattggttttctgcttccagtttcattgatttctgctataattttcatttattttattctgcttatttggatttaatttgctcttctttttctagtttcctaaggcagaatattggattaattattttattttacttttttcttcgatggcatggtggagatggctggtgttgtatgaactcagattcatgacaactgaagaaagttgcaccttggccttctctgagctaaaagctgaaagctggattaatgattttaaatcttcttttctaatatatgtattcaatactataaatttctaagcactgcttttgctgtatcttagacattttgataagttatattttcatttatttcaaatatttttaactctcttcatcagactttttctttcactcatatattacttagacgtatgttgtttaatctgggaggctgagacaggtggatcacgaggtcaggagatcgagaccatcctggctaacacggtgaaaccccgtctctactaaaaaatacaaaaaaattagccaggcatgg

SEQ ID NO: 13927 - DNA, 1049 bp, Homo sapiens
aaattaagtatttactggccagacgaggtagctcacatctgtaatcccagcagtttgggaggctgaggtgggcagatcacaaggtcaggagttcgagaccagcctggccaatatggtgaaacccccgtctctactaaaaatacaaaaattagccaggcatggtgtcacatgcctgtagtcctagctactcgggaggctgaggcaggagaatcacttgaacccgggaggcggaggttgcagtgagccaagatcgtgccaccgcactccagcctgggcaacagagcgagactccacctcaaaaaaataaaaataaaaaaaataagtatttactatctgccagggactatgttggaaatttttcttgcattacctcattttacaagtcacagtggggaaactgagggttggagtagttcattaacctgcccacagtcacatagggcaggttacccaggtcagtcttcattccactgcagtcagaagtgaatgaagattaaggaagcagagacaaggagtatgaacaattctttctggaagaatgatggggaaagaagagaaaggattgataaagtatagtgacagataatctctgcttttataataaaaataaagctcagctcctctgaggttgacactgaaaaagagtaactgcaggggccagaagcagagagaccaacaaaccctggcccctgccctggagattcatctttctcccgagactctccctctgatgattttggctccatcgaagcctccttgggtcatttcttccttcatatctgaggtacaggcaatgggatgacaaaaggcatttttcaacatctctccacaactaagtcaaagctgaaaagtttaaaggacttttctgaacatgagggcaatgtttcccaaccttttgaggtcatagaaactgctctggacaccagtttaaatatacagaatcttgggggacatggattttgaaggtctgcagtgggagcctgggaaaaggtattttaaagtaataccggttacccttaaatttctgcaagttctagtatcactgtgct

SEQ ID NO: 13928 - DNA, 1025 bp, Homo sapiens
cctttgcttcaagtcgtcccaccttttctggactgaaccagtgttcatcttacacacgctgattgatgtctcgtgtcttcctaaaatgtacaaaaccaaactgctctgaccacctcgggttctgacctcctgaagctgtatcatgggcacgcatcctcaaccgtggcaaaataaactttctaaattaactgggacatggctcagatttttagggttcacacgcaaaacccacaaattatccttaatataattatataatatatatttatgtagttagatctggttggtggtagatactaatacacttttgcccaactaagtgtaaaacacattaaatctgtatagcaatctctagactattacacaaaattaactactaactagaaaacacagtatattaaattctcttaagtgtggaaaaatggagaaggaagaataaccttttctctcctcccgtggtcctaatacacagaacagcgactgggaaactgccactagaaaaagatgactgtccaactaaaacctgcatacacagctacatccttccctggaagagcacagtggaactagatcctagtacagatagcacagggattgtcaacattcttgtcacactgaaatttccttctactgatctccaagtaagtaactaacagctgaaacttggaatttatatatcagcacagcacgaagactatagatatatctagtcttatgtaagtttcatattgtgtgataaatgtattgccccccccgcccccgaatgccggccccttgagaaatatatttttacagggtagaatttctaatatatataaaatgcataatgttaaataatgtttatatattaatatgttatatactaatattaaatataaaatatactgcatattatatttttaatataaaatgtatattattgcattgatttacttcctggtgttgttttcattcctgggccttgacaaagataaaaacttctcagccttcctccccacctacccagacagaaatgatcagatgtt

SEQ ID NO: 13929 - DNA, 1082 bp, Homo sapiens
cagaacatctcataaaagaattaagatacaaatagtatatacagatagtagattgtaacaaagtggaacgtacttgcaagacatcacctagctaaaatacttgattccctatgaggacaaactgaaaaataaaatatttcaagcacacaaagaaaggacaaaataggggaaaccaatgggaaatataaagtttaaacttatttttaacatttaaaagcaactacacttttccatttgagccagttcaaaaaggagaagtcaaataaagactttagaatcctgtgaccaactataatttgagcttgataacatgaatggcatctgaaagatgcaagccaagtatttctagtactgtgaccttgagagataataactgagcaacctgctaggttaaccttgaggggtaaatcatattgatagaacaaactgaataaagtgaatgatacaccagacaattaggcaccaattaggctcacttctccattttccaaacctaccaaaaaatatctgaatagacagatagattcagaccagggagtgagcaaaaaataaaaatgattgctaattaggcaattatatactaaaagtggaccttttaaggccagagttttcatcccaatcaccagagatccccataatttcaccgtattcagattggctatctctacttttaaattggcactgtctaaaaattcacaaacatttatggaatggtaaaaattttgagcttcaaacaattgaataccatttggtgatgcaagaaaatgctaattttaaaaatagcttctgattttggaattatggaagtctaaatataatgttttctcactttaaaatggaaaaaactttcgtgctgtttctaaaacacaacataaaaagggaaaaccatttggcactgtgtacacacaggaacatcccagttttagtttttaatcatgtttttcaaggaaacaattactttctccaaatgcatggtttttaaagagtacttcatatttccaggacatcttcttttgacctagtgtgtttcttcttaaaaatcaatgacagttttgtctctaggtttctgactttttgaagca

SEQ ID NO: 13930 - DNA, 1089 bp, Homo sapiens
agactagcctgaccaacatggtgaaaccctgtctccactaaaaataaaaaaattagccggttatggtggtgcatgcctgtaatcccagctactcaggaggctgaggccagagaatcgcttgaactggggaggtagaggttgcagtgagccaagatcatgccaccgcactccagccttggcaacagagtgggaatctgtctcaaaaaaaaaatatatatatatatacgtgtatatatacacgtatatatatgtatatatatacgtgtatatatacacgtatatatatacacgtatatatacgtgtatatatacacgtatatatatacacatatatatacgtgtatatatatatatgcgcacaccaaatgtcacttaaggacactgtccctctggatgtttaccaaaatctagaagagaaaatacaccttttgcaactaaaaggctgcaaactaaataatccaaattctagacatagaattttcttaatatttcatgtcaatttaaagatctggacttatgacaaggcttaataacaatcactaatttcattctatctcttctagagcaataatggtagtgtagcaaattcctattcatccttcagttttttaggtattacctcaaaagggcaaccccatctcccacatatatacacttgtgttaaaaattaataactgctggctgggcacagtggctcacgcctgtaatcgcagccctttgggaggccaaggcaggaggatcacctgaggtctggagttcgagaccagcctggccaacatggtgaaaccccatctctactaaaaatacaaaaattagccaggcatggtggtgcatgcctgtaatcccagctacttgggaggctgaggcatgagaatcacttgaacccaggaggcggaggttgcagtgagctgaaaccatgccattgcacttcacctgggcaacaagagcggaagtccatctcaaaaaaaataaataaataactgccttttctgtactatcacccttaaaacagtctcattattgcttatgttaaatcatcacatgatttacatgcttctatatttccctgctattagcctgtaaggctaa

SEQ ID NO: 13931 - DNA, 1028 bp, Homo sapiens
ttacaggaccttaaaatgggtaaaatgggaaaaacactcttaatcaagataataaggcattttttgaagtgaagcaaatcaccatatcagcttgaacaaatcctagctttaaaaatgtaaggcagagccacgcacggtggctcaaacgcctgtaatatcagcattttgggaggccgaggggcggatcaggaggtcaggagtttgagaccagcctgaccaacatagtgaaactcagtctctactaaaaatacaaaaaattagccgggtgtggtggctcacgcctataatcccaggtaatcaggaggctgagacaggagaatagcttgaacccaggaggcggaggttgcagtgagcagagatcgcgccactgcactccagcctgggtgacagagcgagactgtctcaaatatatatatgcaatgaaaatactaggagtagagacataatttttaaatatctttagagatatttaaagcttttgtaagttagcgcttgtcttaagaagatttcttggaggcagtaggaaacccagtgtagaactggattattaagtagtcatttcccttttaagaccataaaagcaaataaaggtgaagaatctggataaacaggaaggaatcaattccacaaggatatataaccatatacttttggggagaattgagttagtagtatcaaaggaggattttttgatgtttatattctaggacgcttagacattaatgagactacggagccatagcttaggtttagaaatactacccttggaattcttgttctgtagtaaataggaatttagcttcaattagaggtgtgtgtgtgtgtgtgtgtttcccactaccaggcacataataggtgttcagttattgattaaaagaaatgtctttaatttcttcagtcttctctgaaattggcagtgggtcagttgattctggcatcatatatgcagaaaatactcattctgtactgtctttgccagtcttttgaacctaaattattgttgagagttgattaaacaatatcacttg

SEQ ID NO: 13932 - DNA, 1926 bp, Homo sapiens
aggtcaggagttctagaccagcttggcgaacatggcaaaaccccgtctccactaaaaatgcaaaaattagccaggcatggtggccggggcctgtaatcccagctacatgggaggctgaggcagcagaatcgccttaaccctggaggcagaggttgtaatgagccgagatcatgccactgcactccagactaggcgacacagtgagactgtctcaacaacaacaaaaaagaaattgtattcaaaagcttaaggacctttttgtttaaattctaatttgaagatcaaatattatattaaagttctcattttttatccagcaatattttgttcccaatataccatacatagtggatagaactaaatgccagcgtttgcatggaaacactgtcttggtgcttttaaaaatcatttatcaatctcttaacttgttttatttcctttcaaccattgcatgaaagacttcaccaaatatataatttttgattccactaaaaatattccaggacttaacacaaatgcttagaatatttattgaatgaattacaaagtttacccaatactgtctaatattttttagaacaacccaggagttaggtgttttttgtttctttttctttgtattcctaaatgtatctgaagtcaggttttagaaaattatattcaatctgtcttctaaatgacaagaaaaaatttgcattttacatttaccagatgattctttatatctttaagtgctcttaagtgtgatgaaggatcatttgcagcttttatagctaaatgaagacttttcttatttttaatcctgacaatgaattaaaggaaaattgaaatatttgagaagtaagaaaatataggaaaagtgttgcattaaaacttatagtatgtacattccagtctcttcttagagaagaggaggtggcctgtcgatatctaatgaaaaataacatttaggaaactctcaacagtgctggatgttttatttgtagagttataattttgaaacacataaggagccagcagtaaaatgaaagtttataccttttagtgttaatcttattttggctttttgttttgcaaaacaaactgcacatagttatataggggtatatattaagttttcattttttcttgtttggaaaaaaatactaatctttttcatttaggtttcttttttaattgatgccaaagagttccaatattgaacatcttaagtctgttacttggattacggattgagtttggagcttactcagaggactacaggagagtatccaggaagtagcaagaaatgtatttcagtcattctatttgcatcttatattcaagtacaaatctctcaagatcacacattaatatgtgatagtagatttgaaaacttagcctagctgtagactaaattccgtatttaacattaaagattttcttcagtcagttatgtatctttttggttaatatagagttataggtgtttttaagccactaagtgtcattactgttacatgcatcagttagccctacttggattagcaagattatgctttcataaactattctttctctaaattaatatatttatatatttagaagttgacattctaaatcaaattgtgtttttttccttttgcaggtggataattactgtaccttcctcatggaaaaagttttatttaaagtgttatttctcattgaatactatcaaaaaggaaaaaaaaatgacctaaacttttgagatagatttggctctagtaagtatttagttatatcacttgcatatctgggagaagaaataagagactatcatcagtacattcccatctactaaaaaaatttattttacacatgtcaagggattacttataacttccattttattactaatagcttgaacccttttaatgaagacctaactcctccaccagaaattta

SEQ ID NO: 13933 - DNA, 1267 bp, Homo sapiens
ccccatctctactaaaaatacaaaaaattagccgggcgtggtggcacatgcctgtagtcccagctactcgggagactaaagcaggagaattgtttgaaccggggaggcggaggttgtaatgagcccagatcgcgccattgcaatccagcctggacaacaagagtgaaactccatctcaaaaaaataaattaaaatgtaaaaattaaaactaaataaataaataaaaatagagacagggtctcactatgctgcccaggctggtttcaaactcctgggctcaagcagtcttgccttagccttccactgtgctgggattataggcatgagccaccacccctggcctaatttaattaaaatctgaacaaaaggccgggcacggtggtggcttatgcctgtaatctcaggccaaggcaggtggatcatgtgaggtcaggagttcgagaccagcctgggcaatgtggtgaaaccctgtctctactaaaaataaaaaattagccaggtgtggtggcgggcgtctgtaatcccagctacttgggaggctggggcaggagaatcacttgaacccgggagaatcacttgaattccagtctgggcaacagagcgagactccatcttaacggcaacaacaacaaaaatctgaacagaaatgctctatttacgttcttttccttatctgtagtgttttaaagtcattaaacttaaaaatgatgttcaggagaagatgagtgtatttgcatagtctgtcataactctggtattattttgtacaaggagtgtgttagggttttcagttgtaaccatgcagaaaatctacaaaataaaagcagttgttaattagtcctttacaatcagaattgtctattttggaaatttatgaagtacttcagatgtaatttaagaaattgtatttgagccaagcgtggtggctcacacctgttatcccagcactttaggagcctgaggcaggtggatcacaaggtcaagagttcgagaccagcctgaccaacatggtgaaaccccatctcaactaaaaatacaaaacttagctgggcgtggtggcgcgcgcctgtaatcccagctactcaggaggctgagtcaggagaattacttgaatctaggaggtggaggttgcagtgagccgagatcacgccactgcactccagcctggaaaggaggggaaagggaaaggaaaggggaaagggaaagggaaaggggattgtattcgaggctgggcacggtggctcacgcctgtaatcccagcactttg

SEQ ID NO: 13934 - DNA, 1072 bp, Homo sapiens
gtgtactgcaaggaacaaaatgtttgtaaattctccttttaccaaggtaaagatcaaattttataaatttacttgtttgtttatacaaggaaaaataacttcatatattgaatatattcaaaagtttaagcatttagttgtattgccctgttaagttggcatagcaaataaatgcttttcttttcctcattttattctttgtgtttcctaacctatagcactgtgctgggcacagaatggacttcagttaagtttttgatgtagaaatgttttattattctacttaaaatctccttaaaaataattatgcatattacatcaatgttataatgtttaaacatagatttttttacatgcattctttttttcctgaaagaaaatattttttatattctttaggcgcgaatgtgtgtttaaaaaaaataaaaccttggagtaaagtagcagcacataatggtttgtggattttgaaaaggtgcaggccatattgtgctgcctcaaaaatacaaggatctgatcttctgaagaaaatatatttctttttattcatagctcttatgatagcaatgtcagcagtgccttagcagcacgtaaatattggcgttaagattctaaaattatctccagtattaactgtgctgctgaagtaaggttgaccatactctacagttgtgttttaatgtatattaatgttactaatgtgttttcagttttattgatagtcttttcagtattattgataatcttgttatttttagtatgattctgtaaaaatgaattaatactaatttttcagatgtatcatctcttaaaatactgtaattgcaatttaataattgtattgaatgccatcaagtttttttaaaaagcttatgcagcattagaggaatttattttaatgcacatttatattcaacatagacattaattcagatttttacttgggataaaacaaattctagttttccctttgttttgaaattacttttaaaatatgtctttacagataaatataaaatatattaagcattttgaacagagcttagaagacaatatttagtactgtttctga

SEQ ID NO: 13935 - DNA, 1034 bp, Homo sapiens
gtggcgctggcctgtaatcccagctactcgggaggctgaggcaggagaatcacttgaacctgggaggtggaggtcacagagagccgagattgagccacagcaccccagcctgggcaacagagtgcaactctgtctcaaaaaaaaaaaagcaaacaaaaaaaaaaactcccatgataaaagtttacctacataacaaacctgcagttgtaccactgaacttaaaataaaagttaaaaaataataataataatttttttttgtagagatggggtgttgctatggtgcccaggctggtctctcaaattcctgggctcaagcaatcctccgacctcagcctccaaaagtgctgggattacaggcatgagctacctcgtccagcctagatacattcttgaatatgtaactttgggaagatttattaattgattaaggactaggaggtccagctaaaatgcaattggatttataaggtacttaaatccagatttaaggtatgaaatcaagaatggcgaagaaatcaatgaactgaggtcttaaagaatcaattcattttattgactagctgaatacaagggatgattgacacaagatgaaaattgagtgttaagaaagaataacaatgggcaagtatgaatgattaggacataaaagggagcaaaagaagaatgtaagaaaaaatgtaaatagcatatttatcaaacctttttatattgcatttcttgactaacatgatatatttgtaatttagtcatacttagtatttaggaagtaaagtcatcaaataaaatatgaatgtttgatttctaagaagtttaactttttgtataaggaaatgattataagagaatctaatattaaaataacatttggggggcttatatatatagtctgactttctggaataaattttccagattgaaatctacttcatacacagtttttaagcaatctttcagtcattttttcatcagaagaaatcaaggcagtttagaaacagtaaaactttatatttgcctaaactcaacaactaggtt

SEQ ID NO: 13936 - DNA, 1035 bp, Homo sapiens
tttgtaaagcagaaattgtaaggagcaccttctactaccatgttgttcaaaaacaagcaataacaaatatggcatgcttgctgagcactttcatactacatcatttgttgttgtgcatttgtatgatgattgtatatttgacaagtttttattttgcagtaatttacattcattcattttccaacccacttactccactttggggttgcaggtggctggagcctatcctagaagctcaggatgcgaggtgggaaccaaccctggataggatgccattctatcacagggtgtcctcctaccccgacactcagccatactgagacaatttagatgtgctaactaacataacatgcacatctttgggatgtgggagaaaacccatgcagacatggggagaacgtggaaactccacacactgtggccccagacagaaatctctatatttttcctcttcagtattaaaaatgaaacaatgttgaatgaaacatcatttgaagatctgtttataactttgttctctggccctagatctactgtctaaaaattgtttttatgtcttttctctaagctgtacattctgaggtccttccactgttgccatatagcattaatttctagaccatattttttctagaccatattaatttctagaccaatattttctggataccctactttggatctgttacattttgttagtattcctttttaaataattgtatttagaattaattgcaatatacttaatgtagtataggtacaaaacacactgcatctatgaataaagttctatagtgcagtctgattgcactagctttttttttcatcaatactatcgggtcatgttgagctgcagttcactgaaacacttaagtgtgttagaatttcaaatcctgtaaatttagattcagtaggcatttgttgaacacctgttcactactagatgtgcttgtataaatttctgctgtttattttactgatagtaagtttaaaatgtagaaattgaccagtagatttattgtactgaggatgatt

SEQ ID NO: 13937 - DNA, 1027 bp, Homo sapiens
aaaaagtcttggttatttttaataggaaaaaaatgaaagcaatgtaaatgttaagcaagaagagaatggcaaattgtgacatagtcatgtgatgaactgtaaagctactaaaatgagagctgtgtttatcatcatgggtgaatatcctacttcagcaaacaaataagttgcataaaggttatatacagagtaacgtatataaaatatgtatgatattataccatttatcaaaagcttgaaagcaatgataaagtttaaattcttgaattggtagtaatagtgtaaaaacataggaaataaatatcaaattcaagattatgcttgcatctttggaaagaatggaatggaatcagggtatagctcacaaaggacatcatctgtatgtgtaatcaattttcataaaaaacaaagggaagtaagtatggcatagttttagatttcagtacagctggattgggagtccagagataggatatggaggttcattttggtattcccttgatttttctgtgaattttgaagcaaatgattttgaaatttttaaaaacatgctgttctttttctgttaagattagtctacaataaagcgtatacttgcagtgctctgttaagaacatggatgaatttgtcatatcctttctattctgtatcttatagtaagtgcttaactattagttgatgtaacaactacaacttagaatcatgacccacagaagccaaacatgctaaccaactcagattactagcatatctttaaaaatgtcatatattccttcctttgtgtacttggaattgtgcaatatacaatacatggattatagatgatgcaattttatgtgtgtgagagagattaatcagtcttggaatatgatcttgaatttatcttaaaatatctgcaaatatatgatgtcctccagaagctcattgggctccaagttagagttttagctttgactaaaatttttgacttaaacttcaagagggcaattgtaatagaatagcaaattttaaaagccagtgataagca

SEQ ID NO: 13938 - DNA, 1046 bp, Homo sapiens
ttatgaaaatttcatagaaggtgctaattatcttctctataaaatttgatttaatgaaattttaggagatctcatttctattttaaacgtaattatacctaaagtaccagaactcctgggttttgctttttactgatggtttttgttttgagttttgtattctcattcaaattacgtgagttttgggaagagttgggggcaagctttaaattccaccaggctggttaagtataaccatacatttttagcactttggtttatgggattttttgtttgtttagggggtaatgggtaaaggattgtttgtttaataagccatttttaaaagaagtgattcctttatttaaaatacatcacttcaaatttgagaatacactagcgcctaaataaaatccacagcattcaaaatattttcacttttatgtgatgctatataagaggaagattttggttttagacttgtgggcatataggtataagttacaacatatgtgtattttttaatgtttatgtgcacttatccatatttctctgtagaaattgacagttgtaatttattttgtattacaaagtcatttattaccataggaaagcaactgcggggtgtggtgttgctataataggtcacccctttttaaagttatgtttacctattgtgggggaaaggggactggtaaggtatcagtcttcctggtagcattgattttcatttgtttgcccccacactatttttaaaaattcaaataaaagtgcagtttcagactttttaaaaaaatactgttgacctgtcttagttgtacattcagaaaatgtagcctcgggtgtttgtatgtaacactgcatattttttctaatcagattaatatgagttttaatgtttagcatgaactacagctaaggataaaaattttaaagtagctttcatagtctagattcctggtttcatcatgctttatgtagtacattttcgtttgttttgttttgtggagacttgtgtgtatttttgtttgtttgtttgtttattggtaggtagtaactatttggaa

SEQ ID NO: 13939 - DNA, 1047 bp, Homo sapiens
aggagggacgagagttgttatttgtctttcccttcggtgattttttttttcccccttagctggtggtttctatcaattcttactccacagctcttgagtgatgtgagccagtgacggcattaactttaggtaatacttctatggcctttgtaaaaatcccgcgttaaggatgtattagatcttgagttcttttccgcgctggaggcaccactagattaaccctttgccggtgtattgcgtgtggggcgcacggctctgggttgcaaatattccggagatgctttctgcagcagctattctgttcagttgttcgcaaagaggaataacgcttcctgggaaccgcggtgacacgcttctttaggactgcctgcctacagagtttttccccgtggaattgatgtaacgattgatttatttcttatattctatgaagactgggggacccgccctcgcttagaatgtttcccggaggagaatagaagagtgcaatgtgatgtttttcaaattgtgtctaacggagctccctaaactctggacttgttaccccctgattggctggaaggaagcgggcctggggggtttgaatgttgaacgctaaactataattctcgactttacgaaaaaatatacttttagccagagaaccacggaaatagctacgaaacgttaggacgagagtttagaaaaaaagttggtttttaatagttttttttcctctcagaaaggattttcgtgtggttctcaaatgtatattaaaagtaaaactgaagaggctgttttcgcaaaattatgtttctgctggttgaaattaacaagacttttatatatttgtcactgttctttattggttaaaaactgagtgaaaaatttagtttttttcctttgataggaatttttcaccttaaactacatatatttgttggatgcagattaccggacagttgtttcttttattttgatgcaaagaaactaattttcttaaggttcacgaatgatctttttaacattttccataaaaattgaacatcttatttaaaaaacttttcg

SEQ ID NO: 13940 - DNA, 1053 bp, Homo sapiens
ggacccaacgtattgggtcatgttggtgctcaaaaaattttggattttggagcattttgtatttcagattagggatgctcaacctgtactgttaatttggttacagtgttgcttgagtttactatatccttgtaagtttctacttgttttagcaatcatttaaagaggggtattgaaatctctaactatggatttgtctgtttttccttgcacttctgtcagtttttgatttacatattttgaagcttttattatttgagacaaaaccatgtaggattattgtatccttctgattaaccagcccttttattattataaaatggccttctttattcctggtaatattatttgctctgaaatctactttatttcatgttaatatagccacaccagttttcttttgactaatgccagcatcagtatgatatatctttttccatccttttacctttttttttttttttttttttttttgagacagagtctcactctgtctcaaagtgactgtactttgagtcactccaggctggagtacagtggcgtgatcaccactccctatagccttgacttcctgggttcaagctatcctcccacctcagcctcccaagtagctgggactacaggtgtgcaccaccacacttggctaattttttgtggagacaggatctcaccatattgcccaggctggtctcagactcatgggctcaagtgatcctcttgcctcaacctcccaaagtgctgggattacaggcatgagccactgtgcctggtcatccttttattcttaatgttattatgtctttgtgtgtaaaatgtgtttctttttcttttttttttttttttttttgagacggaatctcgttttgtctcccaggctggagtgcagtggcatgatctctgctcactgcaacctctgcctcctgcattcgtccaattcttctgcctcagcctcccaagtagctgggattacaggcacccatcaccatgcctggctaatttttgtatttttagtagggacgagatttcgccatgttggccaggctggtcttgaac

SEQ ID NO: 13941 - DNA, 1045 bp, Homo sapiens
caatataacaccattccacagaaatttctatagaaattccaagaaaatatttaaactgaccagtccagaagttttacgttacttcaaatatttctggagaaatgttacgaacacataggtgtctctgtaactttaaaatgtttttctttaggaaactgtttctctttagtttgtacttaaattgaacactgaaggaacaatttacagtcacatactataggagtgaagtaacaaaaaatagagcctgtctaaactcccttgaaagaccacactgacccagaaaatatggcttaaaagacaaaaaggtaccccgattgtttactgtcttttttttttgcagcatatgaggcactgttgagtggcacatacaatatatataacatttgaggcattatcttttgattgaaaatacagaagagatatgggtgtatgtgagaagtaacataaataagggtaggttaatgaagtgcaaactatacataattgctaaagggatgtggaaaatcaagtgatttaaatctagattgatattgggtagaagtctgctggaataggcaaatcttttttttttttttttggagacggagttttgctcttttgcccaggctggagtgaagtggcgtgatctcagctcactgcaacctctgcccccctgggctcaagtgattctcctgcctcagtctcccaagtagctgggattacaggcgcctgccaccacgcccggctaatttttgtacttttagtagagatggggtttcgctatgttgagactggtctcaaactcctgacctcaggtgatccacctgtctcagtctcccaaagtgctgggattacaggcgtgagtcactgcgcccagccagcaaatcttatgtagaatttttaaggagtggtgaatttggattgccagagagaaaagataaccattcattcattcatcaaagatttattgagtgcttactgtgtgccaggcactgttctaaagacacagcagcaaacaaaactgttatagaacaggataaggcaggtcatctcccagatacgacac

SEQ ID NO: 13942 - DNA, 1060 bp, Homo sapiens
gccaggcttggtggcgtgtgcctgtaatcccagctacttgaaaggctgaggcagaagagtcccttgaaccccagagtcagaggttgcagtgagccgagatcgcggcactgcactccagtctggatgacagaatgagactccgtctcaaaaaaaaaaataaaaatacaaaataatagtttgcaaaaatgcaccacacaaaccagctttttaatgtcatattatattgttaaattcttggtgggagagttgctgacagactcaaggaacttggtaaattaattgaggtatcccttctctaattatcttcatcatcaactaatatactgaaagcctgctatgtcagaatacttagtacattgtattaaaccattataattttataagttgtaggatatgtatgcgtttttttggaaatttcattatttggatttaagtaatatcaacttttctcttggtcaacaatgtacacacacatacacatacacacatatgtttatactcgtgatgatactgaaaacatatcattaggatacaaacacgtatctgattatagaagtagtacatggtaagtgaagaaagtgtgaaaataggttaaaataaagaaaaaaaaatttaaaggacaccaggaaaaaataaccaatagttcctttatttagaggcaactgttgagagttgacatatttccaggcagttgtttaagctgatgaagtttaaattgcttgtgtacactgcctttttatatgacaacgtatcataaatgtttcctcaaatgtatcataaattgaaaactcctcaaaagtttcagtgtctgcataatgttccttgtaagtggttatttattttctttacttacaaataatattgccatgagcttttttatgcataaatctattttcctaaactagaataaattcctagaaatgagctaaaaggtcagcatttttaagcttcattatctggtaaaaattttgctgtaaaaaattaaatttctcttttaattctgtatatattttaatatcaaaaataaatctaaggagaaaaatttatgtggactaccttt

SEQ ID NO: 13943 - DNA, 1049 bp, Homo sapiens
cccagtcccagcatcacaaagcagtgtttatggaaaggtttattgctgaaagataacagcttaataactgggataaagaggaattaaggacgatttctacatgtttgcccatagtaactagaaattatgccatatattgacatgagggaagacttagggagaagtaaaatgtggaggagaagaaaatcaagagatttattttaaatgtgctaactttgaggttctctttagacatttgagcggagttgctggacaagcagttgtatgtgagtccagagctccacagagggatcagggatagaatataaatgttaggagtcctatgatggtagacagtatttaacaccaagagattgaagacatgaccttggagggaaatgttgatggtgggtatgaggaatatgtctgggactcgcagacatttgagaagaggaaaatgatctgtcaataaggtagttggtaatctcaacaagagcactttaagtggtgctgtggagacaataatccaaactggaatggattcaagagataatgtaaggaagtgaagattgcaattatagagtctttgaagaactttgatataaagggccttctgttccctttgtaagcagatgtggatatggactgtagggtgatgagggagaaactgaggatgcaggatatggaggggataatcacaggaacaaaatgtttgaatatgcaagagaagatgggacctaggacacagtagaggggcttgccttagataatagcaaggatagttgatctttgtaacaggaagaaagtatatttgagtacagataaaagcacattggtagatttgatatgggaagataagtttctcttgtaacaacttctatttatcaatgaaacaagatttgaagtgaggagcatagagatgtgggagatttaggagagaagacatgggacataatcatgttgaagaagaaaagaatgaattcattaggggaatgttctgggactgccagtcttccttcttggtgagaatttgacttttccagctatgtcttatttcatttcttgctgtt

SEQ ID NO: 13944 - DNA, 1766 bp, Homo sapiens
tcctgcctcagtctcccaagtagctgggactacaggcgcccgtcaccaagcccagctaattttttttttttttgtatttttagtagagacggggtttcgctgtgttagccaggatggtctcaatctcctgacctcgtgatctgcccacctcggcctcccaaagtgctgggattacaggcatgacccaccgcgcccagccgagaacatcacagtacttttaaattggaaagtattaaatttaaaattattctaatttggtggaagagaaatggaaggaactgctgaatttttgaaaatgtttcgtcatcacaagagagcttagttcctaaaatacccaagattttaaaaattaaggctttagagactttttaatccgtatgtttcaaattcagaaatgccagcagactctgctatgaaaaatatatatttattggttatgttattatttttacaaagtcaagttttaaggtttatttgttttgtaactttcatttctttagttatctcatcttgatctgtacttaaaaatccagagcttacaacatgccttgcttctctatatcttccttattaattttgattcatcacttagtcatctgctctttactaagaagttttttttcccctacatggactcatagatgctatatttgcctttttcgttaattcgtgaacggtacttatttagatataatagttttgggtcatgctggctttgccttaaaactgtgcagacatttttcctttgttttctggcttcgaatattgcttagaggaagtctaaggccagcttgatttcctccctcttgtaagtgatttagttttctgccaagagatttgaaaagttttttcttcattctttatgagcatatgcctcaatgttgaatatacgtccattttacattgaacattttattctgcagacttgtttattttgtggaaattctcctctattacatctttaagtgccttttctgattcatttgttgcattatatatgcagggagatggatcagcttatattatgtcagctttgtcttacttccacattatcttctttgcaatttctttggtctacttttctactacattcattacaatttattaatttctagaatttcttaaattcatttattaactagaatttgagtacctactatatatgccaggcaccagtgataaatatgatcacatccctgcctttatgaagcttacatttcagttgaggatggaagaggaagaaataaacttgtagtgataagaaaaagaaatggaggtaaggaattggggcgggttgggggtgggtacagagaggattgtgcattttagatagagtagttagggcaggcatctctaagaggacatttgagaataggcctgagtgaagtaaggcagtgagctaggcaaagacctgggcagtccaggtatgagaagagcacatacaaaggccctgaggtggaaaagcagtgtgttcaagagagagtgattggagccaaacgagtaacgggaagcaggtgggagatgagactagagaaatgggtaggccagatcaccaaaggagctgtacaccctaggaaagaatttgatgtttgttctaagtgtgatgaggagcaggcagatggtttatgccatagaagaaccactctggctgctgttaagtatttcaagagcaatcactgagtataagagattggttaaatgggtgttgcaggactgaaaaaagcgaaaagagagcactgagataacagagtaacttggggaagcag

SEQ ID NO: 13945 - DNA, 1067 bp, Homo sapiens
attcttcaacagtgtataaatgctacacaaacagttttggcttcactttatgattttgattcttttttcccacctccaccccagtttgtaaatccaggaggtagatgttaagagagagcaattgccaggttagctgcagggaggcaagaggccaggtcgggcagggctttgtatataccctgcatgctgaagaatttggactttagcctgagacctacaagttttgggggaaacacataccttttgaggaaaataaaaagcaatgggctctttctctaggaaaaaaaaatgcgcttacatacctatactaaaattttgcatacaattttaggggggttacttgctttatgagtaaattcctattctgcctcaggactaaaacataggaaagggagagccatgaaaggagttttggaaatgtcatattgaggtgtacactggttgaagtcctggagacttgaagatggaatgtaaaacagcctgtgacctaagtaacaatcaattaggaccaccgctgtgtacctagggatagtggggatagagaaaagaggaattcaaggaagtaattaaattggtggaattctgttggtggaatgggaaaactggttggctgtaaagggcaagagcaagagatacccagatttctggtttagggtgtggactaaaaggagaagtaggcctcaagtctaggggaaggaactctgttttgtccctgtagaatctgaagtatcagagaactactgggggagcagggggtgttgaagtagtttggctctctggagtcattaaaatgtaggtgatagctaaagcagtgggaggggcttagatggaccacaaagggtgccctgtaagaagtggtctgaggagggaaccctgggaacacccatattcaggggaagaaggggagcagaaggaatctttgaagaaccgtgatgagtgactaaagacagagcagtgtccgtagcatataactgatgaataaaatcctgcttccttgataatagaaacatgttgctgctttgttccctttatatgactgaaaaagctgtgttctctttcagtgaaaa

SEQ ID NO: 13946 - DNA, 1047 bp, Homo sapiens
atgaatgtggtgtattctaacaatagaatgctattcagtgataaaaataactactgatatgtaagacaatatagatgaatctcaaaaacattatgttgagtaaatgaaaccagatataaaacagtatatactataagattgtacatatgtgatgttctggaacaggcaaatcattctttggtaaaagaaataaaaaaggccaggcgcagtggctcatgcctattatcccagcactttgggaggctgaggcaggtggatcgcctgagttccggagttcgagaccagcttggccagctggccaacatggtgaaaccctgtctctaataaaaatacaaaaattagtcgggtgtggtggcgggggggcacctgtaatctcagctactctggaggctgaggcaggagaatcgcttgaacccaggaggcggaggttgcagtgagctgagatcacactgcactccagcctgggcaacaagagtgaaactccatctcaaaaaaaaaaaaaaaaaaaaaaagaagaaatgagaatgtagttatctctgctgaagaagatggggagagagcttaactagaaggggcacaagataattttgcaaggtaatggaactagtttacattttattttgggtggtggttacagggatataagcacttgtcaaaactcatggagccaaacactttaatatctttttttattttatgtaaattatatctcaacttacaaataaaatcaagagtattagatggtctcttttcagtgatgctgtctctgtacagctcagagtggggatccatactggaccagtcttagcagatgttgtaggagacaagatgccacggtactgcttgtttggtgacactgtgaacacagcttctaggatggaaagtcatgggcttcccaacaaagtgcacctcagtcccacagcctacaggtagccttccatttattcatgccttcctttgtcccttcctctttctagaacttacagagtgcctagcagccatgggttggggtagtgcaggaaactcatgtttttccttccatgtctc

SEQ ID NO: 13947 - DNA, 1043 bp, Homo sapiens
tcaattaacaggtgaaataaccagttagcatcataaagacaggatcaaattcacacataacaatattaaccttaaatgtaaatggactaaatgccccaattaaaagacacagactggcaaattggataaagagtcaagactcatcagtgtgctgtattcagagacccatctcacattcaaagacacacataggctcaaaataaagggatggaggaagatctaccaagcaaatggaaagcaaaaaaaaaaaagcaggggttgcaattctagtctctgataaaacagacttcaaaccaacaaagatcaaaagagacaaagaaggccattacataatggtaaagggatcaattcaacaagagctaactatcctaaatatatatgaacccaatacaggagcacccagattcataaagcaagttcttagagacctacaaagagacttagactctcatacaataataatgggagactttaacaccccactgtcaacattagatcaacaagacagaaaattaacaaggatatccgggacttgaactcagctctggaccaagcggacctaatagacatctgcagaactctccaccccaaatcaacagaatagacattcttctcagcaccacattgcacttattctaaaattcaccacataattggaagtaaaaactcctcagcaaatgtaaaagaatagaaatcacaacaaactgtctctcagaccatagtgcaatcaaattagaactcaggattaagaaactcactcaaaactgcacaactacatggaaactgaacaacctgctcctgagtaattactgggtaaataacaaaatgaaagcagaaataaagatgttctttgaaaccagtgagaacaaagacacaacgtaccagaatatctgggacacatttaaagcagtttgtagagaggaatttatagcactagatgcccacaagagaaagcaggaaagatctaaaattgacaccctaacatcacaattaaaagaactagagaagcaagagcaaacaaattcaaaagctagcacagaaaa

SEQ ID NO: 13948 - DNA, 1055 bp, Homo sapiens
ccattttttcagtggttcattttcagaaatgattctagttaaaactacaatccctccttcagccagtatttcctaaacttcagtgatcatagggtatgtgttaaaatgcagattctgtagcccgggaatcattttcaccaagcttcagagatcatttcccttgaatgcctttttggactgcactttaagagccacttttaaatgacaaagtcacaggtttttattacaggctttattgaggcacaattcagagtaatatgaatgtgtctagtgttgcatgactgtattctgtatacttaggtgtatcagttatgcaattaatttgcctcatgggctagaatctacaaagcaaatgagaggttagtataaatgttctatgtgctaacagtttcacagattataagtttagcaaataggactaagtgataatttagaggaattggctgatttttgtaagctaatcattaaccatttttaaacagctccaaagatgaaaggatacttgatgacacagtaaaaaatgaaagatttagaaccagaagaaacttaggaaatcattcagtccaatcctttcattttagagtgagctgtgaactcacctgagatcacacatttgaaaagcagagttgagaatattctgattgaaagcccactcccatcccacccctctcctccattcaaacactgccgcctttcagaaagtgtatgctagtcagctccaacatgccactgggaggtatctgtggcatgaatgttaaaatgatcagtttgatgaacacatattgtgtgagggagctttgtttcatcttagactaacgcttaaattggtttgtgtttgtcacgcacacacaggagatagcccatgaatgccatgagagaataaaaccagaccaaaataaagaatatgcggcattccatccatcttgtaagatgtgcacaggatgttgggagttggctatattcactgtaaggaacagttattttccagcatcagtgaaggggacaggaagggccagaggaagtaaaaatcaatagaaacattcactagtgtcact

SEQ ID NO: 13949 - DNA, 1031 bp, Homo sapiens
ttatcagacatttttttaaatttcaagggtatagcaaaatgaaattataactttatgaagaaaagcattgatgaaagtggagaacatgcatttagtctaggggatttgaaactctcccaatactgaagacaaaccctgtcaagaaaaagaagaatttaatattatatagtattttcatatgcagttctttaagctttgtttacttctatacaaatacttttaagtaatgcaagataacatttaatagatggaattgttaaggtaattgcctgtagtcacattgctaaattcattgagagttacacaaaatccagaatatattgtctgttcctaaattatatatatttagattctggaattactaggaggaattagaagtcattcagataaaaattcatacttaacaagagtatctaggaaagagattcagcccatcccaatattgagcagctttccttatcagaaagttttattttctgtttcacagattgctcatgacctttaatacatttttctgaatgaaccctggagggaggtgagaagtagcagttttgttcatctcttctttttgtcctttatctctctgccactgttctcacctcatcctaaaacctggtcaggagggtttgaaacctatcagaactaaaggttaatatctcatctccctcaggcttttttcatttaaaaaaaaaatgggtatattagttaaattagaatacttgttgtagaattattgtcaaaggggaagggaaatacatctaggggaaacatcatgtcttttaggccctttatgtcactgaatgacttaaggctcgacaaatgatattcttggaaagtttaatcttgaggttttcaaatctttttttttaatgtctcccatgtttctcatttgctgattgattcattagttgctcttagtaagatttgtcagttggaaataatgaaggctgagactcatttctaaactcttccataaccatcaccagaagagcagccactgtgttgtgtgatgtaggctaatgcctcccaga

SEQ ID NO: 13950 - DNA, 1035 bp, Homo sapiens
tgggagttacaattcaagatgaaatttggatggggacacagccaaaccatatcaatcaccattattattattgttattatataaaagagaaagaagtaaatgtgacaaaatgtaaactgtctatgaatctagatgaatgggaccctggagctcatagtacaatcactgcaacttttctgtgagattgaaatttttcaaatagagagatttttaaagaattttttttttaagtgaacggttctgtgccatttagtacatcctttcctttaaaaaaaaaaactctcatacttgtcagggtattaagttgctataacagaatgcagtagttctttaattgtgagtttcttatatattctaggataggcagatctgtttagtatacctttttccactgcatcatttcagtttggatattcttgactttcgaattgttcttggaaataattagaaagaagtagggattgggattgttggacggtgaaatcatagggagagaaaggaagttgaggaattcaatcttgagtcttagaactgtgtgtgtgtgtgtgtgtgtgtgtgtgtgtgtgtgtatagaagaactacatacatacatatatagaaggaagaaacggaaatgaatctataaaggcctgatagtacttacatattttcttgttattgtctgttatgttatgaataggacctgcggctgtattatatttgagaaataggatttaagaaatacccactcagtttcaccaaaaatgttaaaattttatttgctttaaaaaaagcttttattaagcttcttttccatctacattatccaagcaaatctgaataattgggactagagttggactagatgttggagggaccaactttctatttattaaatcacggaaagatttagcattagtttgattagaatgggtgctttcctgcccttaacacacatacagtgcctctttgaatgcatattttctgcaacaaagaaaaacaaattaacaaacaactagttgaaccttcaaggattctgaaaagcttctggcaagg

SEQ ID NO: 13951 - DNA, 1815 bp, Homo sapiens
gtgggctatagtttgctgatcgctggtgtataccctgttttgtagactactgttctagaccttggagttgtattgtactacttctgttagatccttttcacattagttttagagagtggactttatggaattgatttttcctttatgaagtgggtagaacaccactagtagagagtattcagttaaagtgaacagatgcttattgaacagtagtgaagttcagatgcagggttaggtactggctcatgagtttgatatgagaggtacagttatggcatagtgtaagatgtaaaattattaaagcacaagctaataagatggtacagttgagaaagtgaggccggagctggctctaggaaatgtcttgagttggattttgaaaggttaattcaagtttgtgaagtagatgtatgcaaagacataaaggtcactgaagagagtttgggagaactgtatgtacctcagtattgatagctggcaaagtgttcaagaaaaacagcagcaggaaatgagactagatagattggcatggcacgtcctatattctctgccaaggagtttcgactttgtcttacagattgatgaaaaccttatagattgaaccttacagatgggaaccttatggattgaagagattttagtagaggagaaagttattagatttgcattttagaaagaagtagcgtggactatacaaagagcaggtttttttggcacctcatctgttttcacttcctcataaaagaggacatgattgtaggttgaactataccagacataaaattaagaaacttggagtgctatttagcaataaaaaggaatgaattgtgacatgctacaacatggatgaacttgaaaaacattaccctagatgcaaaggacctcatatagcattattccatttatatggaatgtccataaagttgattagtgcttgcctggaagtgtttgggagactgactgcaaatgggcacagggatctttttaagatgttggaaatgttctaaaactgcatggtggtgatggttgtacaactctgtaaatttactaaaactcgttgaacacataaaatggatgaatttctcaataaagttgttaaaaaattagaaagactttacctttgcaatttgttggggtaaaactttgttgaagaaagtatttcagtattgcaggttgtcaagtgattgctctttcctctgaacaaatattgaccttaaactactagaagctaaaaaaaagttttgattttttaatcaaaaattccttttggatgtacattggatattcctaaggatacacatttttaactgtggagtgtaacaataggaactaacaataaataattgggttggcattaagttttatgggattcactttgactttaataattttttttgagacaggatcttgctttgttgcctagaatttcttaattttcctttccttaataaatatgatatgaggagaaccttcttcattgcttatattggataatagtattaaagttagaaatagcctaagggaaatttacttgatttttttttttcaaggaaatatactaaagaaaaagctgatataggatgcttttaaatttataaattgtttcctcataatcttaacagttataggaaatgaataaagagaatgcaaaacaattggaaaatggttaatttcattcaataaatatgtatttagggcttaccatgtgcctaggcactgttcttagaaacagattgtgaaggactgttactgtattactttcttttattcctggctactaaaataatgtatgaggttgagcttaattattttaaa

SEQ ID NO: 13952 - DNA, 1048 bp, Homo sapiens
cgtatgtgacatctgcttcttcatgaagtgcatttctaaggtaaaactattggtttatttgtatgtatagttaggaaggcttataaaacttttttttttttaatgataggcacaagtattatgtagttagattttttttgtttctggaaaatgttatctactttgaaaattttaaatctataaacacttgggaaggtgtttagcacaagcatcaataaatgtttcaatcagaatctagcaagaaaggattcttagaaacttttactcctgtacatgtactgtgtaatggatttagagaaatttgtttcctcctaaaaaatcttagcaatgttgggttagtaccatttctttccttgaaaacaaaaaaatccacattttttacgaaccagggccccttaaaactaatctcacattatgtcttttttttaattattattgtttttgagacacagtcttgctctatcgcccaggctagagggcagtggcatgatcttggcttactgtaatctctgcctcccaggttcaaacaattcttgtgcctcagccttcccagtagctgggattacaggcaagtgccaccacacctgactaatttttgtatttttagtagagacagtgtttcaacatgttggccaggctggtctggaactcctgacctcaagtgatccttctgcctcagcctcccaaagtgttggattacaggtgtgagccatcacgcccggcctcacattatgccttacccaattattttcagattggccttcagccatagcatatgggaaacaatatactgttagagttttccaagtgcttttcatgaattttttttccctttttaaaatttaatgctttattgctaactttcctgatctgaaacatttattaggcagttcttcattttcagttgtagcctttaagatatttatatagaaggctgtcatagaatgccatcttcttttgtaggacagttgtgtgtgtgaattgattttttttttttgagaccatatttgtagtgtgatgtgtagaaggaagtaaccagaatggtttt

SEQ ID NO: 13953 - DNA, 1577 bp, Homo sapiens
actatgagctaggcatgatgcattaatagcatagagatgaaagtactcactttctttgcttgcatttgagtgggggagtcagaaaagcaaacaagcacaagaaaatgtcacagggacggtggcaggtgaggagagcgacatgctcacgcaggtgcgcagcaggagacctgcaaaggcaggtcaccatggcaccgtttgctcgggacacagccgagacgtctgcttagggaagtggacagacaacttgcgatgtgtgtcataagagaaagtatttactctgcagcattcagaatgaaccaacaggatctgtgtgtatcaatatggggaaaacacagtgttgagtgaaaaaaattacagatacttaaagagtcatgaagattaaaaaaaataattttatgtattgttctagacaccagtctctgtggtcaaagtacaaacatggtctggggctatataccaagttcagatcggtggtttcctatggggagcaagagaagagaatggggtctgggagaggtgtgtcggggccttcagctatatttgtaacttgttatttctaaaactatgaagcaaatgtaccaaaatgtcagcactggttaaatctgggtagtgggtcagggattttgtcttcttattctctgtatttatatacatatttaaaatatgtgtaaatttttaaaaatacacgtgggtctggtgtttgtagagagggcaggactaaagctatagcattggctcaccttcacagcaggctcaggtgaatcagtgggctggggagtttcacctgggcctcggcactggccactggcacttcacacagaggcgagcaagggccttgggaagcacttatttttcacaaagcaggtagagaaagagaaggaaaagatgggaataggaggtttcagaaaggagcagagccaggagagatgtgtcataaggaggtccaggaaagaaaaataatttctaattatggggccggtcatggtggctcatgcctgtaatcctggcactttgggaggccaaggtgagtggatcacttgaactcaagagttcgagaccagcctgggcaacatggcaaaaccctgtctctacaaaaaaaaaaaaaaaaaaaaaaaaagaatttcaaaaattagccaggcatggtgacgtgtccctgtggtcccagctacttgggaggctgaggtgggaggatacttgagctggggaggttcaggcttcagtgagctgtgattgcaccactgtgctccagcctggatgacagagcaagacgttgttccaaagactaactaaataaataaaaatagttttaaaaattacatggaaaatgtcaattgctttgtatgtagaaatacagagactaagagtgaatccccatatacccaccctgaacatcttgaattaaataattgtcaaggttttgccatatcatttttgcttcttctattcctccttttctttctttttctcttttttatttgctgaagtaatttaaagtaaatcccggatgccatgtctttccaccccttcatactgccttgtgcaattctaaaatatccagacactgagaaagattttta

SEQ ID NO: 13954 - DNA, 1087 bp, Homo sapiens
gtgggggactactaagggcctggtttcactgtcagtttcagttgattgcaagtgatcagaactggccctggaatagcaacctccttgctgcaaggtgtggtgaactctgtgtctccaatgtgcatattgtttaggttaatttacgtttgttgctggaagcaacaactggatcacccttgagcccatgccactcttgagtgttctatcttaaaaggtggagatatggtccttgtctttcaggaagttataatttaaaagagaaaggcatgaaacgtctgctttggtggtgatattaaggaactagctgtgtgtctggtgggaagtgtgccctctatgtgtatattttggaatataaaactaaatccctgtcctaatattggaatgtttaggggctatttgggggcaagcattggtaggctggatttttttttttttttttttttgagacagggtctcaccctgtcacccaggctggagttcagtgatgtgatcatagttcactgtagtcttgaactcctgggctcaagcgatcctcccacctcagcctcctgagtagctaggaccacaagcgcctgccaccatgcctggctagatagggtcttgctatgtgcccaggttggtctcaaactcctggccttcaacagtcctccaagctcagtctcccaaagctctgagatgacaggtgtgagccactgcacccagcctgaatttgtgtttttctatattttgtttgattataagtgtaatgtacacttattattaacaattcaaaccgtactgaagtataagaagaaaagaggaagatgccctttcactgatcacattctgcctcccgcccaatctcattccccagtgttgctatggtgatattaatagttgggcattaatctctccaaatctttatatagagaaaatgcacacttgcgtgtatgtgtatgtatatgttcacgtaatacagatacagacttttttaactgaaatgggatcatacaagatagactgatgtgcagctggctttttcacttaactatgtattagacatcttttatgccagtgggttatagatagagcccattctctttaggga

SEQ ID NO: 13955 - DNA, 1055 bp, Homo sapiens
attcctattagttcttagctttgcatagaaataaattctgttctttgggcacaggctgaaggttagcttttttacagatgtacttgagggcacatagagctcaggagagggtgaatggttgagaaacaatcttcaccactaccagatgaaagtagctcaaactgaagacacctggtattaatgagaggttatcttccttgaatataagtggtttataatgatagctacacagttagaacaacttggggaacctttaaaatgctgatgcctaggcccacagcacagtgattgaattaaaatctctgaaaatgtcctgggcattaatgtttttaaaacaggtgattacaatgtacagcccaagttgagaaccaccatagtctacaaataaaattatttttaaaattccaacatcttacaattctttacttcctgatgtatctttttcataatttacatgtatacgttcttcttttttccagcaagaatgagtattaaggactatagtgccctgaatatttggcatgagatctgtcatcccttgtctgctcgaagacaaaagttgttctcaaacctttaggaaacacagatagttggtgtaatggttaaaaagccagaggcaaagcagattcagtagtatttgtcattatcacaatctgtcctttgttatgtgttgatttttctttttcatatattcacttacattttatattcataggacaatacactttttaaaaaataaacttcttttaaattttaaaacagttttagatttacagaaaaattacaaagataatacaaaaagcttctatataccccacactgtaattaacatctatcatagccttgaggtgtagaatcatttcttaagcaagattcgacaagcagaaattattaaggaaaaatgatgaataaatttgactatactaaattttaaattttgcatagcaaaagataccataaataaaaacataatatgcagatcagcagaaaacattttcaaacgtaactagcaatgaattaataaaatatcttatttaaaatttttattttaagtt

SEQ ID NO: 13956 - DNA, 1022 bp, Homo sapiens
atttgtggacgccaggcagggagcatttgggtatacacagcacaatgctaaattaaagtttagcagaaatttagtaaattgatcagtgtgaaatgccaagcagataaataatgtgaaaatgtatccaaattggctattaactttgataaaattaagcaaataacaataaactctccacgtcaggatgtgctgtaaagagaagagactttggtgttgtgcaaagataattttagtgggtgttgggcatacctgcatattcttgacctgtgagttataatggaatgaaaaaggcttgtataattataagtcattgccccagggaaaattagtgtcctctctagtttcctttcaatatcacttagaaagtttgagttttagaatggttttgtcatttaatgattactattttatcaatcacattgaacggagccatcattttttgaggttctaatttcaggtgtttttggggaaaaaaatcacaatctggacgtgagaaaggacatgaggagactaaagacctgggattttgtcaatcagaatgaaaccaatgttgaaagacttttcaaatctattgttggtggtactctgtgactatggtgagtattgtgagtatacttaacgctactggtagcaataagacataaagatgacattataaatgcattgatgttgatgactcttcctgaaggaggcagggtagggtatatagtgcagtgctttctcaactgtgacccttgcaaccctgggttctcttatgcttcagtgattctgcatgattgattcgtatttcattttatatttttaactcttaaaaaaataaaaaaaccaactctctcaaattttaacaaattggaggcaagcatgttaccttgagttctctttgatttcccagtaattaagtgtgataaatcacttcatacacacatgcaatgatgttgtgtatattagggttctacataagatttcacttgaccgagttttggtgctaacatacatttggacccaatctgaatttcaatcct

SEQ ID NO: 13957 - DNA, 1003 bp, Homo sapiens
ggggtttcaccatgttggtcaggctgctctcgaactcctgacctcgtgaaccgcctgcctcggcctcccaaagtgctaggattacaggcatgagccaccgcgcccagaccgctctggtttcttttagtgggaaatgatatttcagaaccacaatctgcctgctagtaatattcatcagtattgggttgatctttgtttctaggctttttcaatggacagagctagaattttgttgttgttaatataaagtgcctaacaagagcgtacttatcttttctattcaaatttaagatgacactaccagataattactaaagcagttgaaaaaaaattttatgtgttttccccattctttgtacatttgaaaaataggtgcactgtgtttacgctgtctgagcatacagccactacatacactctctgcctcagctccagctctcattgactcttagttttataagtacctccatgtttagtaccactagtccttatgctgagctctctgtggtcgctttggttgtctgaagcctcattctgtagtagatttttaaggaaatgatcataggaacaatattccctgtatctgccatgtttgtcttccttatacatgaaggtcagttttcttggatttaaaatcctcagctcacattttctttctttgagtgccttcattatattactttctttcttttttttttggtctggcatgaagtgttgctatcaaagagtgatgataattttattttttccccttaaaagacacttgctgtttttcctagatgggcaaaggatttttaaattttactttaaagcccagtaattttactagaatgtgtctgtgtattagtcattctgagttgttattcttaggtgcgtgctgtgctttttcagtatatagtttcaggaattttttaatttcagggaaatttttctgcattataacttactttttttttttttgagatggagtcttgctctgttgcccacgctggagtgcagtggc

SEQ ID NO: 13958 - DNA, 1036 bp, Homo sapiens
aaaatatagattactgttggggaaccaagggcatttgacctattaagtgcccatagtaggtttttctggatatgtatctgtggtgaagttgtatattttcctcaaccctgtattttccccaaattggcagctggatccagaatctctgtcacactcatgttctgtccgtttggcaaaactagaggtgatgctgtgttctttcgtcagaggcacatcttatctctgtcatgttagcagctgttaatattcagtgcctagatctattagttcattggtggtggtaaatagtgataattctgtgtttatttttcatttattagttggaatactttttaaagaaatgtttcccttatctactatttggttgtccagttcatataggaaaggcaggataattgcattttcctttatcatcagggtaataaattgtttccttattatcttttgacgatgactaattaggtttgtttgtttttttgttttgttttgttttgttttttgagacagagtcttgctctgtcgcccaggctggagtgcagtggctcgatcctggctcactgcaagctctgcctcccaggttcacgccattctcctgcctcagcctcccgagtagctgggcctataggcgcccgccaccaaacctggctaattttttgtatttttagtagagacggggtttcaccatgttagacaggatggtcttaatcttctgacctcgtgatccgccgccgcggcctctcaaagtgatgggattacaggcatgtgccaccgcgcccagccaactaattaggttttttttaacatgtcattatgaattcatggagtttagcatatttgatggatttcaatcagttataattattatcctatttgaagctcaaattgtcccatctttggccagtgggagctgcttcaagttggccctctaagtgcttttgttgtgactaggtgaactttgctagcttcttcactatctggtgttgcaaaagctccaggaccatcttgtacatttcctgcctcagatccggaatcaacc

SEQ ID NO: 13959 - DNA, 1028 bp, Homo sapiens
gggaaataaattagtaagtcagattggatgagataactcttctcaaaaccctccagtgaagtaagagaccaagggccaaaccatctgtccccatcatctctctgacctcatttctgctactccagccctggctcactccccttcagctgtcccagccatcttgctattcccagaacacatcagtctttgtacttgctgcttctgtctggaacatcttcaaaatatatgtatactcactccatctattcctacagatctctgctccattatccctttgtgagagaggcctactccaaccattctttgtaaagtagcaaccacaaccctcagcatgttgacactgcctttttctccaatgtactgaccaccctataacatatgtgtttacctgtgtgtctcttgtgagctgcctcctgccttactcctagaatataagctccatgagagccagggaccttttcaactttgttgtctactattcctagaacagagcttgacccatattagaagttcagtatctgttgaattaataattgggtattaaagattatcctttgcaatcactaatattttactcttagcatgttttaataccaaaaaggagagaggacataattttaaatttgtataaatttaacttcccgaatcattatttttctcattttgcttcagtgaacacatgtaagctgcagttggggaccactgcaccatgccatcctaattcttttaggtctgttaatccttgccatccagtatttgtgttactcataggaaatagattacttcaagctgatttaaggaaataagaatattgcttacttcctattttttaaggaagcaggaatatggcttattgtgctattccttttggtaatactttttcatgcactaatttagcaacttttttgcacatttgttctaatatttatgcaagagagattttaaaaagatagatgaaagggatttttgcttagttaagtattgttaaataggatttttatattcaggttgcttcagcaactgttgtg

SEQ ID NO: 13960 - DNA, 1258 bp, Homo sapiens
ttctgccaggttgcctcatgccaagttcacactgcctgtggatcagataccatcctttgtccattgagccatgttacccaaaggatgacaacttttatttattcgtgcaacaatttttttttagtgttaactctgtgccaaatgatatgctaagccatggaaacatgtgccttggagttattcaaactttgatctgaattctggctttcccattcacctaatataggaacataggccaaaaattattaagttctctgggccttgatttcctcatcgatataatggatatagcatatcttgaattgttctgaggactaaatgaagtaattcaagtaaaagacttagtttacttctagctcatcattagtggtgttggtaagagagggggtagtggtggtgatggtggtggtggcaacgatggtactgatagtggtagtaagagaggtggtggtggtgtggtaatggtgatggtagcaagagcaatagcatcattgtggtaataacaaaagaagtcattgagtcagtgagaatggtgtggtagaaatggagataaatagttcttgatcatgacagttgtggggatggtggtagtagattatagggaaaaaaaaacctgctgttagctgcaggatgctcagaagggctgtggataagaaagccactccaagcttcaaggactgtccagtacaaaggagtttttaaatgtggttgggctccattgttaggaaacaaatcactatgctcacttaaacttggaccttggggagtgtattttatgagttcagtacttaattactttcacggttcaagaacactggcaaagtgacttaaaagtacacaacaattatctaactatttcataaagtcaatttaagggtggaaagtctatattaaaatgacaagaacagtgctcacttgcatgtactttaaagagcaaggtaaagcctcgcttcttggccagggtgcattatagtcattcagttacatcctctgagtgtttttgtctttttgacagaagaaactcatctcaaagtattgttttgttctgtataataaattgtgttgcttaaaaactttcaagctgaactcagagctctgtgaattttttttaacttgtttatttgaatagcttttgtgaataaacctgttctgaaaaaggaggtagtaaaacagtttaagaaattaatacaaaggcagtaatagccaacatttgttgaaaaggcctgatactctgctaggatatttacgtatattatct

SEQ ID NO: 13961 - DNA, 1049 bp, Homo sapiens
actgaaaacaaaacctaatcatttatggagcttttaaaagttctttaaatacaatatttgtattgtataatcatttgtaaccgaataggagacatgtggctagaaagtaagacttatcccaaatggtctgagtgagtggtcagactgtacacactggccttggttggaccaggaagagtgggctgttgggtggcaaattaatgcaagacttgaaagtagaggaagcaacagagaccagaagttcctgccaccatggatcactggatggcactgaaggtgactagttggctgatggccaccccatctgcacactgtcaagtaggcccctgagaagatacttcaaaatacttaaagtacggaaaaagtacttaaagcttaatcggtatgtatagatactattcttatttaaaaatttaactgctgttttataaattcttaacattttaatgattttttaattccttcccaaactcggagtagttctaaggtttcgttaacttactgggtttaataatttttttctaatgtcaaccctcctggactgctgcattgcagatcttttgaatatattttgtcactgtttttaagacagtatgtacacgcttgacactatactgttctttgtttctgttgcattttatgatagttaacacagtacatgaaatttttaaaaaattaagtgagatttttttattcttactacttttttttttaataggtccatctgtcattgtagttacagaatcatcacaaaagagtgctgacgtaataatgtatgctaccagagtcaggtattcccttgttgatagataatctcatttaaagcagaatttaatgagtgatatattttaaacacagtaattgtgtcagacccacccattatatgtattaagggagcaaataaagggagtctaacatcaaagaacagatttcaaatccagcctcagctgcttataatgtgatctttttttgagttatttaagccgtcttacattcagtttcatatttgtaaaatggaggtgataataatgtctacttcaaaagggttt

SEQ ID NO: 13962 - DNA, 1050 bp, Homo sapiens
atgtttatatataagtcaacttgttccaattaaccatgattatattcattttataactttatttttaataggtaatacattattatacctaaaaatggaaaatttacaaaaattttactcctacctatgtcccttatacacacaatttctttctacagtgtcaattaatgttaccactatctcttctatcttttcttttttatgtaacttaaatctctttatatctttataccttaaatctcttttcccatttttattgggttattagttctttttcctaattatttccaggaattctttatgtattaattcataaagatgtcagtcaacattaagtcatttataataaaaattatctatagaagttttcttaggaacagataagctaattcttaaaatggaaaagcaaataagcaaaaactagataaagtaacaattaaaaataaaaagagtaaccagtgggggtgtctagccttaccagatactacaacatgaagcaacaaacaagaaactaggagaatatatttcaactcatgtaggactttctcctttatttttatttatttgttttttttgatgccctgtttttttttttgatgccctgtcagactggtctagtaaggactttctttaagtttccatgtactactctaggcatttttaaatttatctttaaaagttgacaacaaggtatcccaggcccattttgactttttgttgttgttgttaaaccctgctgcaggacttagaatcaattactgtccacactcaccttctttaatggaagagagtgtctgagaccaaaatacgggtattagggctgcatgtcaaattgtgtatggtggtagaccctctgtatgaagccgcagccaggcctttttaataacagactagacaagaaattcccttttcaagttcacaagttcatgatggtttatttattttctctacatcacgtcttcctaaccatagaaataagagccaatgcttatatagctcctactctagataggcagtgttttgcccttatatgtaccaacttacttcatc

SEQ ID NO: 13963 - DNA, 1144 bp, Homo sapiens
aaattcttggtgaatctacagttttagagacaaataaattgtttaacctaaacagttacaatccaacgaggtggtgctactgtggaggttcactgagcatacagaggaaatgacgtcatgtgtacctgggatagtctttggtcttactggatctctcaagctggaaggagtgcagggctcatctgggtcatacaacttggaaggagcaagaaagagaaagagaagccagaggaggagcgttctcccctaggagccaccagtgacaaagaagttgggaaagaatagtcaccaaagccacatgttcagaaaggccaggtacaaaaaggatggataagcacccgagcacagattggactgaaggactcgggtatcactgcttaccttgagaaacgcagtattggtagaaactgaagccaggtagccttggctggaggaggagtggagctttttttctttctttctttctttttttttttttgaaagcctagatatgaagaaaagaaaaagtaggaaaatagctgaaccaaatggtttgtgatttaatgagcatattatgtttctttgccattcatatgacaaaggctttactgtctttgtattctgaaaggaagtattaatagttctggaggtgtggggctaagacttaggggagcagtagcttaggttaggttcccggggaatgggatatgaaagcataggtgcagagcacctggacagttacaaaggaaggatgtttgaacagaagtggatgcagacagtaattgagggaaaattctgagctcccatctgataacacctgttttctctgagaattaggagataagatctcttccttaaagtcatagtctctggctgggggaaggaggcaaggtcattggggctgacagatctctagggaatgtcagaagaaagtgatcagggagacacaaaataatttttacattaatggcccagttgcagagggagatgattacttatgtagtgatagtatagtgtgtgaaatccatggtaagaaaagtagccaaggtgcctcccgggccctgtgaaaaagggcaaatgatccccagcagcctaaaggttctaaaaagtaatcaccacgtgtgaccacaatgctcaggcagtaggcagactgggtgtgctatag

SEQ ID NO: 13964 - DNA, 1054 bp, Homo sapiens
cttaatttggtgggcttacaacttgaaaattgtatttggagtcttttcacataagacttatgtcttcattagcacatttgttattctgagatcaaacttggagctaaatgccacaaacctagaacaaaataaatatgctaactataagactgtttttcttattatcctttagtatttgtttatttaaggaattagatcaatttcaggtgctgaatattttgagtttgcaactttgaaaaataatttaattctgataggttctcctagtctttactctttaagttcttcacagtaaaaacagacctttactaattggcttacttttctttcttggtaagatttattcgtactatgcattgctaaatgggataataactggatttgactgccaggttctgtatgactgctaataactgctaatttttatttcttttccacattttcagtattttgtttgttccctgaaataacgtagcaaaaggtaatgcctagattattctaatacggtagtgagaataaaaatagattgataatatagggaaaagaaatcaacttaataactaatacataataataagatatattaactcatgtaattaaaaaggtgacaacctagaataccacaaaaaaaaatgaataaaatggtatgttctttgtacatcaaatgcagtggccttttctagattattctcatacaccctcacatagagacaagaggaaacagagagatagaaggagaggatacatgttaacttaaggctattttttatgttacattttaaacataattaggttcatatggctaggcctggtggctcaggcctgtaatcccagcactttgggaggccgagtgggtggatcacgaggtcaggagattgagaccatcctgcacaacatggtgaaaccctgcctctactaaaatacaaaaaaaaattagccaggcatgttggtgcacacctgtagtcccagctacttgggaggctgaggcaggggaatcgcttgaacccaggaggcggaggttgcagtgagccgagatcgcaccactgcactctag

SEQ ID NO: 13965 - DNA, 1042 bp, Homo sapiens
atattagtaaccaatgtcaattaaggtcaattagcatatatcagaaatagtttgtatactggaaatgtcttactttttttttttttttttttttttttgagacagagtctagctctgtcaccaggctggagtacagtggcacgatctcggctcactgcaaccgcctcctgggttcaagcgattcccctgcctcagctaccttagtagctggaactacagcttggtgcacaacaccaagcccagccaactttttgtatttttagtagacatggggtttcactatgttggccaggatggtcttgatctcttgaccttgtgatctgcccacctcgatctcccaaagtgctgggattacaggtgtgagccactgcacccggccatatgtcttacttttatcatgtatcacttagatacagttttctagggctctatatcctgtagagtatggtatacaaatttactgtgggaattatgtcaatttctattaaattgtatatccttgaaacttctaaccactaaaccatgtgatgtgcctaatttttcacattttctgtaatatagactttcatgttcatatttatgtctctgttgaaattggaagcaaaattatttaatgctgatattacctctctttctaattaagtcataaatgtatatgtagtagacatggatactttttgtggtactcagttcttagttgttcatctgtcacttatatagtaattcagaaacttaagttaccttcttgaactgatctccttgtggttcttgtcactggacatgcactcatttgatcaggatagctctcaaggtgttctagagctgattatccatgagtggggtaaagtagtgctggtaacatgtggtcgtaagttggcttgtacctattaggattgaaatccagttatatgatttcaaggccttagagcttaattatattattgacttttttttgtagatgatcatatatttatatgtcctgtgttttctaggagattttggtatatgaaaagtaacacatcaaaaatccaataaactctca

SEQ ID NO: 13966 - DNA, 1143 bp, Homo sapiens
taatgatttcatatttaagacttcttgggttcagaactgtgtgtgttggtgatatgaatacagatgatgcccttgttaatctgtaggtgatacatgatattctcacaaatcaggaatacaacctcaatacagaaaagaagtagatcctgtttcctgagttttataaaaaatagtcatcctttgatatcagagggattggttccaggacccctgatgaataccaaaatccacagatgctcaagttccttatattctgcttttatatccatggtttctgtatctttagattcaacctactgtggattgaatttgatccacagttggtcagatttgtgaatatggaacccacagatatgaggtgctgaacatagtttctttatctagaaatacacataccagatgacatagaaattcattaaataaaaagaaaaataataggctattgatttgcaggtgctgagtatggttaagaagtgacatcttgaatgtaaaaacataatagtacaataagggttgaactagcaaaagcgttgtatctgttgctgtgaaaatatccttctacttcagtaacttttgaaaaaatcattataatagttgatataagagccatcaagaaagatgtttagaattctcagtaataacatattatactatctagtacatttggataattttcagtgagaatttgttttctaaaactggatattttaagctttggttacatgtgaaggtttccctagcatactgtttacaatgtttctgaatagtgaagtgctactattacttgtaaaagtgttaatgtactgcttagcagttttcttaaaatactttttcctgaactctttcctaaggctagaagagatacaagcaaataatacatatgcttagacaaatattacatgcacatactgtggttttcttattattttcattacaatgtgatgtttttatagtgtaccttatttcattttttgttatcacatgaaaattgacatcattcctatggtagataaataactgagcatttaaaaatcaaccttggatccagtgcaataacacaggactgttgtttaaacactagttctaaaactagagaagagtataaaatgtagtaatgaaagtttcccccataatatgtttccc

SEQ ID NO: 13967 - DNA, 1050 bp, Homo sapiens
ataaaattagaagtgattattagaggaggtgcacagatatcactttagggacacacaaaaaaatctgaaaaagaaaggaaacatgatacctcaaaggaacatagtaattctcccataacacaccccaaataaaaagaaatttataaaagacctgaaagggaattcaaaataatgattgtaaggaaactcagtgaagcgcagagaacacaagtagacaatataaagaaatcaggaaaacaattgattagaatgagaaattcaacaaagagatagatataaaaaaagagccaaatagaaattcttgaatcaaataattcaataaaggaaataaaaaatataatcaagaccttcatcagtagactagacaaggacaagaaataatttctgagtttgaagataggtttcttgaaataacccagacaaaccaaaaaaagaaaaatagagaaaaagatttaaaaagtctgcgtgacatgtgggataaaattaagcaaatatatatttgtgttttgggattactggaaggagaagagatgggaaaaggcatagacaacctatttaatgaaataatagctgaaaactctctaagtcttgggaaagaaatagacatccagatacacgaagctcaaagattcccaaatagattcaactcaaaaactcttctgtgagacatattatattcatattttcaaaaggcaaaggcaaagagtgatttataaaaatagcaagagaaaagtgtcaagtcacatataagagaatgcccatcagaccaacatcaattttttttagcagaaaatttacagactaggagagaattggatgatacctacaaaatgcttaaagaaaataactgtcaggtaagaatgctttactcagtatagctgttcttcacaggtgagggagaaatagtctttcccagccaatcaaacactgagggaattcatcactgctagactccctgcttaagggagtcatatatctggaagcaaaagaaagctgtatctaccactgttaaaacacataaaagtaaaaagctccctatagagcagacac

SEQ ID NO: 13968 - DNA, 1050 bp, Homo sapiens
acttagagtacgtctttcaccaggcattggagagcccacctggattctgcccctgtcctccacattccatgtagttctctttctaccttcaaacagttgagcccttttttctcagtatctggaaaatgctgaagcttctggaaacattttattctcccactccttggcttgccaacttcatttcctattacctctctttcaattctttcacttctaccatactgggcaaccttcatgatgtaccccagatatgccaggtatactcctgccatgggcttttccctgccaggaacattcatgctccagatatgtgctccatgagccccttaccaccttcaagtcttaactcaaatgtcgctttctcaatgaggttcccatgctcaactcccaaattaatcctgccatgttttcctttgtcctcacgccatccccattttctctactgtgttgtagttttcatgtcatttatctccttctaacatactgttagctacttatatattcggtatgttgtcttattctctccctactcccactggaatttaagctcctttactaaagagctctttgtttcatttactgatgtatcacaagcacctagaagaatgcttggcacatatgggcattgaatgtttgctggataaatgaatgctttttcatttctttaaagcagaaatgcaataatttcagcctcctcaagcaaactgtcttttttcattttaagcaaatggaaattttggaaggggagtagaaatatttaaatgatctagattccaattaactctgcctctgatgactttagctctgagtgaatagcagactcttgtaaattaggttaaaaaaattcagagaataatgaaggtggttgggagtggaataggttcaggacctagatgctaaaatgattcaccttttttttccttctgttttagcagcaaaaagtaagaaggaggaaagtaaaaattataggtaaattctgtgttgttgttggatgcaccctgattggtgtctacaaaccaggagcaattaatagcaaacatactctaacac

SEQ ID NO: 13969 - DNA, 1027 bp, Homo sapiens
acaaggttataaaaaaagattgtttatctatctctctgaaatttaatcataatattcatatattgaacatttggtatcatcaaaataatgctaatgacctatgtatttttttttttttttttaccagattggaagcatctgttggttaatttttacaggctgttggaaaatggattagagtatactaacaggttattggtgttggatttgtcaagtaaaattaatattaactactttcattattcacaaactgttaatagggattaaagggctttctgaaagtatatgaatagtctaattcacttagactaatttattatgaaaatgtggttccacaattgttagctttctgaagtaatcatattttataacaggtgtgtcatttttgccagatagggcccataaattggtttataaattatttctcaactgaatagttatggcatatggaaacagttaatggattatccacttaaaaacaaatcaagcttagatttctgacatcatagttcagtggacaaagaattgaggaagtaggtgataaacgtggattatcccagcaacttggcggtgttcaagatgttgcattgtgtttgaaacataatttattcctctatacaaacaaatgtgtataaaattttttaaactacctcacaaggctacattaaggtgaacacatagaaatatgtttttttgtaatgcatgctaataaagagatgatgccaaaataaatgcaacatgttttatagatagtaaagtttcctgaaaagaacagaatatttcacaaatactgatttggaaagattggggagaaagtcagtagagaatgaaatatttctctagggacatatcatttggttcttgtctgtggctgaatctcaaaagtagtaaagacttaaagaaattatgaaatgggtcaagaatatcttatcttcccattaaaggatcttattgttaccagttatagtatattctctgttggggtgcggaagaaatggaaatttattttgaaagctttagcgaaatg

SEQ ID NO: 13970 - DNA, 1036 bp, Homo sapiens
tgctcaaaaatttacttctacaacagcttctgaacttgaatctattgcctctgttattgtgcccctgttgcataaaattccttatgattttcactatttctggttgaatctgaattttgtgacttgacacacaaggctatgccctctctcctgtctccttgttcaacctcatttcttgacttcttcccgttactcccctttctaccttgacaaaccgctcataaaatttgaattgcttgtaatttaaaggttccatgtctttgaacatgttaattcctcggcttagatcttccttcttcacttcttcatcaggccattttattaatcctttagttagtactttattcagctgtcttagttctcatttagcatctccatattcccattatttaccaaacatatttcttacagtatatagtatatttttatcattttactgatatatcttcattggacaggcaaaatgtcctgttaacctttgtagttttttaacgtttctcgatatctctaggcgttgattgatatggcataaatgctgattgacactcccttctgctggtatgctaaattattgtgaaattgtgtgataccgcaggtatgtatctcattatgtataaaacctacaaggaactccttggtctttaccttgattatagaattatttatccataaagaaacaatgcattttagtgcatacctatgtgtattcacagacatgtttgcatgatttaaattaaatagattgtaagccatgctaatggcaaattatgattagaattgggaagcaattttataaatttaacttgaattcattatttcaatttaatttcctattttttttcttctatggagaatcacctttttgaatagttcccggaaataatttggattatcctttcccttatttctaaatttcatgctactgttgtctacatatatgtattttccatttaggtaatatttgctgctagtttttgtgttccttgtttttgctactttctgtgagttatctgtaatttgtgtttttctagaagcc

SEQ ID NO: 13971 - DNA, 1098 bp, Homo sapiens
tcataccataagtcacatgtgtaaagacagaaaaacttgtgacaagcagtgagatcagtgtactcatttttatcaacatgatctgaggaagtctttcaagatcagaaatttgaagttgctaatactttgacttactttaaatttttaaattagatattaaacatttccaaaagacaatttgtcataacaatataacatgcatctccttgcctactaatgaggctgagacatataatattgcctatagctttgaagcttcctttcatccctttttaatcctataccctcattcattcctaaacaccccttccccctactattctgtggtaaccactatcctgagttttgggtttatcattcctttctattatagttttagtatatacatattcctaattaacctactgtttggttttatatgtttttgaactgtatgttaaccagtcatcttccatgcattcttctgagagttgtatttcctctcaatattgtttcatagatttatccatcttgatgtgtgcagctgtttacatttttcccaactaatcattttcataccttgtattttaggaatatctattataaatagcatatgaataatttttttatcccgtctgataatctttgtctttatctggtagttttaactttttgtatcaattgtgaaaatatgttggaatttatatctgatgtttcattttgaatttttaatttatgctactttttccaggttcatcatccaaactgctcctgctcctcctcatttcttctttctgcttcttccttttctatattcatccttcctctttattctccttaacttcttttggattgatatttaatttcttattttatttttcctcatttactaatctaattctaatcttagaaaagaaatttaacatgaacacactttaaaaagaaatttaacttgcatgtacttcaaaggtacaaaagtaagcaatatctcttctcttgaaccaaagaatactttaaaatcttttttcacttgtatgctagttttgagtgaaatttcagtgtatctgttttcttttaataagttagattttactattattgagtcatattataactgtg

SEQ ID NO: 13972 - DNA, 1035 bp, Homo sapiens
gctggagggcagtggtgcaatctcagatcactgcagcctccatctcccgagttcaagcgattctcctgcctcagcctcccgagtagctgggattacaggtgcgcacctggctaatttttgtatttttagtagagacaggcctcaccatattggccaggctggtcttgaattcctgacctctaatgatccacgtgccttggcctcccaaagtgctgggattccaggtgtaagccactgtgccaggctcaagaagatacttttgaatatttctttgtccagtgttccaattagagaaatgacttagctggacatgtaaaacttggaagttatgcctgtgatcaaatttttggactttcctgttagttatgatatgcctgctctttgaatcagtttttaatttttatacagtatgtgactaaaaagaatttctaatttttcttaagtttgagatcattgttagacctgtaatatcattaagtaaattagagttaaagtttttaaaatgtctgaatagaacaaaaaagaaaattgaactgattgatggttttccaatgctggtgtaggttcaggatttatttaaataaaaaatgaaggaaggctgagtacggtggctcatacctgtagtcctggcactttgggaggctgagacgagcggatcacttgaggccaggagtttgagaccagtctggccaacatggtgaaaccccgtctctactaaaaatacaaaaattatctgggcatggtgatgcatgcctgtactccctgccacttgggaagctgaagcacgagaatcccttgaacctgggaggcagaggttgcagtgacctgagatcatgccactgcactccagcctggacaatagagtgagactctatctcaaaaaaaaaaagagaaagaaatcaaggaaaaagtagactcctctgtactcccaattagctctcccctcttggctctggatatgtaatatttttagagccactcttcaacttctgaaactgcctagcaattgtgagccatgtcagccttttactctct

SEQ ID NO: 13973 - DNA, 1037 bp, Homo sapiens
attttcatattgaggacatctaatgttttccatcactgcatcttatgccaggctaccaacaactcttgaccagacaatgcagtagtcttctaactgacctccttgtttcacgttgtttctgtctgttgccacacagtagatagaaaaatccttaaaaaatgtttatttcatcttatactttctatgctcagaactctccaatacttatccatcccactcagaataaaacctaaagtccttaccatggtttataagatcctatcaggggatggcatactttttcttaaatgtccacacagtaaatattttagactttgtcacatatggtctcagttgcatctgctgctgctgctgcttctgatttcttcacttcttcctcctcctcctcctcttcattctcttcctcttctttttaacaagcatttgaaaatgtgaaaattattctcagccccaagatcatacaaaaacatttgacactcaggctgtagtttttcagctgcctgcctagaggatcggagccctgccttttctgtctgtccttgtcatctgtaactcttgtcgtgttcactgagtcttcttactgtcctctaaatatgccaagttcattcctgccacaaggctttgtattttctcttctgtttgctagaagttctttttctcagctttcccatgtcctctcctcttcattctggtctctgcacaagtgatattttctttccttctgtcttttctttttttgagacacagttttgctctgttgcctaggctggagtgcagtggcacgatcatggctcatggcaacctcaaactcctgggctcaagtgatcttccaacctcagtctcctgagtatctagatctactggcatgcaccaccatgctgggttaattaagaaaaatgttttttgtagagatggggtctcactgtgttgcccagtatgttttcaaactcctggcctctagcaatcttcctgccccagcctcccaagttgccggaattacaggcatgagctaccatgcttagccgcacaagcgttat

SEQ ID NO: 13974 - DNA, 1049 bp, Homo sapiens
gcttgaacatataaagatctgtgtaccagcatgttcttgcagcactgtgtgaaatgtcaggaaatttaaaaccaaaatatttatcaatagagacatgattaagtaatttatagtacagtcatgcagttgatggataatacagctgttaaaaccaatgacttagatctgacttagaaagttacccaatatttaaaaaaaaaagcatatgtatagtatgaaccaatttttgtttaaagacattgtgagtttatactgtgaatgagtgggtgtctgtgcatatctgcccatgtaaaggaaaacccttgatggattctaaccaaacttgtaaaagcatttgcagtgattatcttgcactagggctggagaaactggggcaagaactttcatttccttgtgtacttaaaaaagagtagtgagattatgggtgactttttattgtggtatttttgcatatctcaggatagtattttttgacacacacacacaaaggataatgtggtataaagagctagaggaataggaagggcagccatccctcggatcacgtcaatcttctggagtggtgagatgtaaaccattgcataaatgactgctccttgattttagcctaaaataatccagtctttcttctgttaaatgcaagaaacttggggtagttaatgtgaataagataaggtctatagcacttcagagagctcacagtttagtagagacaaaatgtataagcaggtaagaggagtacaatgtgatatatgggccctaagtatgtgctaaagtgctgaattattgccaggacagtgttgaaaatgcagtactctgacttattggagttaatgggagagaccctggattgtcgtcagcatcttagcaggcaacctaagcactgcaacaagcatctcctactgtggcctcctttatcaaagttttcagcattagtaccagaaaatatccctttagaataatgttttcttagcagaaacagaatctgatattgttcctaacagagaacaccatttttgtcttgtttaccaggtcattttgccacagtg

SEQ ID NO: 13975 - DNA, 1028 bp, Homo sapiens
aaactataaagtgctttgtcttttgctggaaccagtactggatatttgatgtggctatcagaatctgaaaattggttggtttatttaccttttaatttttatgacacacagagcagctctttcaaagcagtggaagatagcttcaggtgcagctgttgtaaaaataaataaatatattgaaattgtgtgaccttatgaatggcagaaatctgcaactgtctaattatctatagttatgtgaatataattttatttgcctgctgtgaattttaaaagttcttttagtaagtgttttacctgttaaaatgatctagaatactttcttctctccctctccacctcttttctctctccttccttcaggcagaactacacgtaaatcattccaaaacaattaatgctgctttagtcacaaattattgatttttccatttgtagtgcatgtagaattgctgctctacttagattctaaaatgaggcattttaattgtgttttccaggaagatatgaatttaaatgaagataaaaaggcaccattgcgggaaaaggacttcagtatcaaaaaagaaatggtgatgcagtacattaatactgcttctaagacagtaagtaaaactgtcaagttgaaaaatactgccgaacatgttttaacatggaaaacagcacatttatctaatgaagtacttaagtttgtgggcaactgtaatcagagggcttctgaatgtataattaagggcacaagtatattatacatttgtttaaattaaaaatatttctcatcttaaaacttttaagctgcttctgttttttagctagttacattgctaagaaacactgggagggggtctactctgtcacctttccttgttagtgaattaatatagtcattgatttttaatgtcacttataaatcacagtgatatctgcattatagaaaagtgagaccgattttactctgtctacatcaaggtacataatagtggcttagaaatgtctttaatgtgagtctccctatgaataaaattatc

SEQ ID NO: 13976 - DNA, 1042 bp, Homo sapiens
gttcacgccgttctcctgcctcagcctcccgagtagctgggactacaggtgcccgccaccactcccagctaatttttttgtatttttagcagagacggggtttcaccgtgttagccaggatggtctcgatctcctgacctcgtgaacgaaccgcctgcctcggcctcccaaagtgctgggattactggcgtgagccaccgcgcctggccaatcactggcagtgttcttatctgcaggattacacagcagttgtttgtgattgtaggtgcttatgcatacacttgaacaattctggcaaggttacattccagaataaattagagttgtgcagctttctgaatattcagctctcttcttgtctgttctgctaaaatttacagtatatgaaagaaaagtgatatttaaatttctttttttctcatcgtgtgtgtgtgtgtgtgtgtgtgtgtgtgccttgatactgcattaggataaactgaaatttgtttttcaattaagatagtttacactcttcccatattctccagttagaatatttggccaaaaaatagtgtttatgagttcattatcagtctctgggtaaatgtcattctttggctgctgttctattaatgagctagccatctgactttcttttaattttaatgggaattgagtaatccagtgtctactggatagtacagtggaaattcaaccccactattggtaaaaccaaaaaatataacttttaaataatcatatttctgttaaaaatgattatttaaaggtttatataaggacatagtaaagctgataggcaaaatattttatagctgttttaagctattttatagcttcaatgtatttatagacatcttgaatatagaaaagtagtaataaagttaattctaagttccaggttcttggtagtatttatcttttagttttctaattatgtctaaacccaataaaatttattaaattgcagaactagataagattcatttagtctgccctgttcaacagtgtataatgaccttgaatgaggtcatgaaatcttctg

SEQ ID NO: 13977 - DNA, 1022 bp, Homo sapiens
ggaccaacactaaattatctaagtaatctttctaaactgcttaatttgctaatatataaagcaaaggtcacctgtcattagaagctcaaatctatgtgtggttttaagattagaaggaatctttcaatgttgtctgagctctcttcaatctttagatagaatggttgctgaaaaattttcaccactctttattattattaattttaaatattccaatgctgaatgcctcttgatgaaatcacaatgataacacgattggccctctttgtttttctcatttttgagatgagataaatgttgggaaaggaaatacttacacgtgtgtcattctgtctttctttgtagctggacaaatttgccagcataagaattccagggagcaagaaagagagacctccacttcccaacctgaagactgcatttgcaagcagtgattgctcagcagcacctttagagatgatggagaactttccaaagccactgtcagagaatgaactcttagaactttttgaaaaaatgatggtaagaattttgattctttaggaaatgtttgaggaaaaagccttagcttttgctcatgttaatggaactctaagcatttttggtagtcatactccataggctaatttctgatgtcacttaagatagcacttcagccacaaagagtttttggattacaaaaatatgaaatctgaagaaaaacaacataccaggttttggttttgtaaagagtatgtgaaaacaaatactccaaagtatcgaacggtatatttttgtcttgagtagatatttaagtcagcggtccccaacctttttggcaccagggactgattttatggaagacaatttttccatgagcgtttggggggtggtggagatgattttggaatgaaactgttccacctcacatcatcaggcattagttagatgctcataagaagcgtgcacagttcaccatggagtttgtgctcctttgagaatgtaatgccactgctgatctgacaagaggcggagctcagctg

SEQ ID NO: 13978 - DNA, 1031 bp, Homo sapiens
gtgcagcttaggtgctagggtaataaataaaggtgaataaatgtttagcttataacttccattgcttatacctgggttttgaagaaggttttcctcatagaggcaaaaaggttgggaggaggggggagtgaggggagacaggtttgaaaaggtaagttggaagacattgaatgtggatgtgacaatgctaaattatccatcagtgtgtccactgagtgtttttggagtataggagttgtttttgacttgctgttttctctcctgtccttcataaccatttgtctacagtatagtacttctatgatcctcatctctttgttcatctgactgcagcctgctttactgtttggcctgcagcaatggttttcaaatctttttgactagatactgcattaagaaatatattttattttgtagcctggcatgcataaactcctaaactctctgcttctcagttgaaacaaaagtttaaaaaccagtatttaacatttctaagcaaaatgaattctgatctttttatttccattcctttctaattttcttcactcctctccattccttaaaaaaaaaaaaaaggtaattgaatccactaaattgatttcatgacccacaaatggttaacagctatagctagaaaaccaaacattggcctgcacagaaactagaggaagtcatgaggtctttgcattagtgtctattctttattatatgtagttgcatgtaggaaagccaggttagaatgccacctctgccatttactagctgtgtgactttgtgttagttatgtagcttttgagccttggtatagagatagtttaagggacaaattaagtaagatgcttggtaaaccgtgcatttataatttagtgctatgtttagtaatacacactttcaaaaaatgaggtatgatccagcaatctcattgctgggtatatacccaaaggaatataaaattttctaccataaagacacatgtacacgtatggtcattgcagcactatttacaatagcaaagacatggaatcaatcta

SEQ ID NO: 13979 - DNA, 1067 bp, Homo sapiens
tgaattccttgcataatgacaattacaattcttttttaatgaaaaaattgacagcctgggaaatgaacatgaaaaatggagtgcatataatctgcattgagaaattcaatatgactatttcacttctttataaaaggtgacggtctccaattaaaaccatgttctaactccactcagtctcttttgagggtataattttgctcttattgttatgttatattgaacctgcttttagttactttatacatgtgtttgtaagcttttggaagtcactttctgtgtggtgcctggtatagacttgtgcttacagtaggaatctgaatgtttggctaattgaaaatcaaaacaaagtactcttgtaactttatattgcctggttcattaacccattcatgatgaatttgtttaaatgttattaataattactcatttctttttataaaagatcctagtggtggtgggcaagggtatgtaaagactaccagaaacatatgtgggttattgaagaacttgggcctggcaatgtggctctgaagtcccacccttaaactgtgataaaaagacttgagagagactcaaacgtgtctgtatatccttgggcaaattatcaacctttgtgcctctgttttcccttctataaaatggaagtaattagtctgtttgcttatagattgttgtgaggattagttgagttaacacatgttacgatagcttaggcacagcacaattaatatgtgacaactattattaataggggagacctcatcactatagtgttaagttctcagttattgacagtattttaacctcttcttcctgcttcctacttcctttatcctcatagcttttttttttttttttcctgggggacactggtattgtgtccagggactcagccattcattgcagtgggacacacaccagaggtttgtttggtgcctggatatattcccttcctttctgtttcatgtagacctactacagcctctgtacattgcctctctttctctgtctgcctcctgctgtcaacatttgctccacactaaacccacactccacaaaagtaa

SEQ ID NO: 13980 - DNA, 1037 bp, Homo sapiens
acatgtttacctttttaacaaacctgtacatcttgcacatgtaccccagaacttaaaataaaataaaataaaataaaataaaataaaataaaataaaataaaataaacaaaaagtaacctgatgttaccttaattttggctatcatagtcaattataatctgggctcatcaatatttttatattcaaaacctgtttatttttcttaaagtaagacattggagtggtagttgcacgtttctttcacagaaattttccatctggatgatttttcacagggccatggctggaggttttctttgctttttgcctttgattcgaaagatgatgttcaaatgttgtggctggctaaatagaatactgttctcctgaaaatgttatggatattttttcatctctgtgccctcatataacacatttcttagtcatattattctgacttcaaaaaatattctgtcccaatgcatcacttctaaattagcttaactttagtgaagctctatttccaaatagatattttgtgtagtcctgtggtatgttgtattaaaaaacagtaactgtgtcacttatgccatatcacgtgttgtccaaaacaccactattcctgaaaaaaaactaatgattaaagactataaaaaaactttatatataataatattaacctcttcatgctccaaattctgatgagtactatctacatattctacagatgtgtagaagaatttgatgtcatgttgaagaaaattattaacaaagtacaacaaattacaaatcacaaatcaatttcatcctttgaaaaattatttattctctttggttttcaaatacaaacatatatttaaaaataaaacaaaagcaaagattttccccttcctgcttcaaaaagaatgttttccacagatatttgtaattagactattaactaatgcttttgaggtactggagaaatagattttctggctctatgaccattgtcaaaaatttttctcctataagaaaaaccacgaggtattttaatgttttctgcttcttacaaatg

SEQ ID NO: 13981 - DNA, 1043 bp, Homo sapiens
aatactgctgtgaggatagtagctggataagttaagtttgtttggattttttttgttttattttgttttgatttttcccttgagcctttaagatactgacttggagcccagcaaaaaaaaaaaaaaaaaaaaaaaaattactgtttagctttgtaccctgggagatgatagactgaagtttcaacctgaaattcagagtggaagtcagtgagctagcatgccaattccaaaacctaatattaggaacaataggaagatgctgagcatgctggacgtcacgataaatgcctttacaaatactattcaacttaactatcaattcttattatgtgtatattgttattctatattatagatgaggcaggagaaagtcaagtgaatcatataacttacccaaggttaatgctatggtttgaatgtatcccctttgaaattcatgtgttgaaaacttaatctgcaatgcaacagggttgggaggcgaggccttttgagagggatttagttgatgagggctctgctgccataaatgggttaatgccattataaaaagggcttaaggaagaccttggctctctcttgccctaccaccatgtgaggatgtaacaagaaggccctcatcagatgctggtggcttgatcttggacttcgggattgtgaagaaataaattatggtgtttataattatctaacccaaggtatttgttctagcaacacaaagtggatgaagacacttgctaaatatcagtatagtacaacagaaatttgcacgaactctaggtctcctgtgcctacactgttccctctttcaaacatgaaccaaaatgagggtacaaaaaggttgtatattatcaacttctatacctttatctttggagaactctcctcttttaataagtggattaattaccttgatatgctttcatactaaacactttattactgtgtcatagttaaatagaaggcctatattccacataaaaataggtagttatggcactgggtcgccaactgattggatgaaggggaagaaaaattctcttttg

SEQ ID NO: 13982 - DNA, 1062 bp, Homo sapiens
tggaattgaatggcctgttggtacattattagtattctcttgtgaggcaaatgtgtccacatacctgaagtgtccattaatgcccataatgagtacaacggattttaatgtgcctgtaatatacttaagggtcaaatattttaaccacgtctaaaaattcattttaaaatttttggccatgtttccaaactatttagacagtatcttttggaaaagaataaaactttattttatgaagcaaaaacttcataaaagtatgaagattctgttttagggatatacactgttaatttttaatatatttgcaaaacttaatgagaagaatttgatttaaagatcttggcataattctttctcttgtatttgtcctccttctgtagttctcgtctttcctgcaggttctcaccacggcaaagtgattgagaacatgtgctgggctttctttcttagtacttttgttcaacacctgttcatttttgctactttccaggcaactggtcagctttcaagtttatttgcatttttaaaacgatgcacaaaataaaacaccctcagatctgattaatgcttcctagtttcacttctaaaacaaacaaacaagcagtgcagtccagccacctgcaaaacactaaatgagccttgtgattagtgggaaagagagaattccagagaaattttgggggcaggaaaaaagtgggcagagtttgactatggagaaaattagtttgctcacacattttggataaagtgaaatatagcaaacattctaaatgtccaaatacattttgaaatgtgttttgatagtgatgtaatgagatattgagagtaaatcatccacaatcacatctgttattaaataacttaaaggataacacaaccaccaaaaagaagcctatgcagattttagaataaagttggtcttgtgtcaaaacatctgatatttgcttttgtcttttcacgccccccacccccctttttgaggagagggaggtgcctggcatgaacctcaggaactgaatggttctgaatgacagaagaacctcagaaatattgccattgtga

SEQ ID NO: 13983 - DNA, 1070 bp, Homo sapiens
aggtcatagtcctcacatttaaaaactattattttatgtagttttatattatttcacacagcttattatgtttgtaagtggtagataattatagatttctgactgttataatattttaatgtaccttttcttttttatgtgctgaaatgtatcctgaatgccatgctttttgtactctacaaaaatcctccattccatgtctcgttattctttagtgtatttagtatatttcaggtcatagtaattatattacacactgctaccatgttgttcaggctggtctcaaactcttgaccttgtgatccgctcacctcggcctcccaaagtgctatgattacaggcgtgagccactgcgtctggccttacatgtgaacttctttaaccacccatgactctcagattgtgttcatgactataaactgccattttcttagtttctgatttgtagactaggtccagactggccactgcaggactgtaaccgagaattgctttctgatttatttcaatgcagtgaaagatttagatataaatgtaaagaggggctgtagatcacaaatattactttatttaaagaatttaatacattaaatagctgctgaacttctagaagttccaagctgctgtgtttcttccttacaaagatagtaaggcatggttcataccatcaaggcacttaaagtccagtggggtcatggaatattgtttcggaagagctataagtaaagaactttttataaaagttcacaagttggaaagattacagaagggatatattatgaggcacatttgggatttgagcttaccattttatggccacataaggtttagaaagatagaaagagaaggagggtattgtaggaagagcaaagacagagttgagaaacatgaaacttttttgaggaactgtgtgtcagtttgaatcctccaacagaagcagacactaagatggtaaaagacctacaaggcattcattgaagaataaaggggaaagagctgaaggaaacagggtgagccttgagattaatgtgggtttcacacttacaaaagaagaggtgggcaaggaagga

SEQ ID NO: 13984 - DNA, 1027 bp, Homo sapiens
tggaaacgcataattcttagacatgaactcaaagacatgcaggcaggtttacttttagctcatggcatatgcaaagataggcatcaatttgtggtgaggatatgaggaagtttttatctgtacatttgtttaaagagtcatgtttagagaagcattttttaatagatactcttttcaatggaactcatatttaattagaccaaacataaaagccaacactttaagtaatctctttttagcagattttcatggaagagtgccaaattgttttggtttcactataggtttacagtcttctgatagaattcccagttgggatttgaaaaccaaactgtgtcatacagacatgaatacagtggcctaacgtgatgtgttgaattagctttctagatgacttaaagtatagctggggttttcctttatccagggactaacattcaaggttttgtgaaaaagaaaattaattttgcattgacattctggatgttggtgataatttgtagtgacattatgcctattggttgtgattgtgacaggcaggcagactggatccaaatggacattacaagagccaaattaaatagtctgagcattggaaatttctgccttaaggaaagcagaagcttttcagcatgcacttgttttctacctccacaattatggattaatatacatcaattctaggcagttgaggaatgacatgagaggattaatggaactggacaacattacacaagtgaagtgaaaattctgtaatgatttttctgaggtgatgtagtagacaaggcaaatgggcatcagctcctagactttgcacctttagaatttcaagaaaatgattgaaaagagaaatggaaaacaactatctaactaaagctggcataataatttttctcatcaaatatatacatcatttttcacaaataaggaggagttattcaactgagtaagccagtactgtgtgcagtgtatgattttatccaaaaattgtggccacttttatctcttaaaactgtttagagaaaaa

SEQ ID NO: 13985 - DNA, 1096 bp, Homo sapiens
tttgaaggcggtatatgacaaccaatatttgttagagacctcttctttgttggactatgagggcaccaaagaattcagctttaaaattgttgcctctgattctgggaagcccagtttaaatcagactgccctggtaagggttaagcttgaggatgaaaatgacaacccaccaattttcaaccagcctgtaattgagctgtcagtttctgaaaacaaccgacgtgggttatacttaacaactattagtgccacagatgaagacagtgggaaaaatgcagacattgtttatcagcttggaccgaatgcctccttctttgatctggaccgaaaaacaggagttttgacagcctccagagtatttgacagagaagaacaagaacgattcatttttacagtaactgccagggacaatgggacccctcccctccaaagccaagcggctgtgattgttactgttctggatgagaatgacaatagccccaagtttactcataatcattttcaattttttgtgtctgagaatctgccaaagtatagtactgtgggggtaatcacagtgacagatgcagatgctggagagaataaagctgtgactctttccattctaaatgacaatgataattttgtgttggatccctattctggagtcataaagtcaaatgtctcatttgatagagagcagcagagttcctacacttttgatgtcaaagccactgatggaggacaaccacctcgttcctctactgcaaaagtaactatcaacgtcatggatgtcaatgacaacagcccagttgtcatttctccaccgtctaatacttcctttaagttggtgcccctctcagccattcctggctccgtggtagcagaagtttttgcagtggatgttgacactggaatgaacgctgaactaaagtatactatagtgagtggaaacaataaaggcttattccggattgatccagtaacaggtaacattactctggaagaaaaaccagcacctactgatgtgggattgcatcgtttggtggtcaacataagtgacctggggtaccctaagtctttgcacacgcttgtgcttgtattcctttatgttaac

SEQ ID NO: 13986 - DNA, 1074 bp, Homo sapiens
actggaacataattcttttgtgtagctcactattagccagctaagttcatctttttaataccataaaaaggttatatgtacagttcctattttagcttgcttacaaagggagcattatttttatttaaagtattgctagtaaatgatttgtagaaacttggttttctaagcatagttcttccataaccaccttttgttgtttgagcacaagggattcttttcctagttctatgtgtttgtttccctatatgcagtctttaaaggattacaacacttaaaattgaatggacttgtgtcaagctttttgcatcatacattttttgaaagatttttaaaaaagcctacaacttacatatgtagtagaatcagccattgctctgctcctggcatagagtcacctgtttgttatgtggattaaatagttttaaaatacatatttgaagacctttgagaatgctttagtgtttgatttgaaataaaaggaaattttagcaaggattaaagaaaaaagctatcagctgtatgttaagagagactcttactaacatgttgtaaatattacaattcatgaaatgttattgtaagtctgtaacttaattttttccctgttttagttatacaggttggtttggaaatttgtgttttggcataaacaagtaaaatgtgcccattttatggtttccatgcttttgtaatcctaaaaatattaatgtctagttgttctatattataaccacatttgcgctctatgcaagcccttggaacagaacatactcatcttcatgtaggacctatgaaaattgtctatttttatctatatatttaaagttttctaaaaatgataaaaggttattacgaattttgttgtacaaaatctgtacaaaaatctgtttttacatcataatgcaagaattggaaatttttctatggtagcctagttatttgagcctggtttcaatgtgagaaccacgtttactgttattgtatttaattttcttttccttttcaacaatctcctaataaaactgtctgaaatctccctgtgactttatttacagttcatctttattaaat

SEQ ID NO: 13987 - DNA, 1046 bp, Homo sapiens
ttcacatagcaatgacactcattttcggcttggagactcataaatgaattagagctatgcagagctgataagaagagaacagggtatcaaactatggcaccctgtgatggtgcctagcatttctcttcatttttgctttacttctaaagtcatattaactttgaaaaggccttggatttatgagacaactcttcctccctccccccgaaaattctcaaagcacatttcagaaactcatttttggcagatgtaaatttaagtaaattggccaaggtcacagcacaataagggcagagttatcaagggaatgcagtttcctgctttttccaccatccatgaaattagagtaactccaccccttaaaataaaagggtctacttttttttttctttctgaaattataaaccttgatttggaaattttttttaatcattaactcagactttcaaaagtggtcatttagagctgtggaatgtttatgggtgcactatgcatctactattactattactgaacatcttacgacctctacaatttgttttaaaagggagtgcattttttgtttgagctgaaccatcagattttcttttcatgcggtatgacatgaggaagaatctatctgtaggcacaaaactggttcactttctatgggcaagcgcagactttaaagtagattattaaagtacacagaaatagaaaattagatcagaagtgatgttttactgtgaggtcttctttgggccttataaaacgagaaagaactaaccttgttctatttctgagttctgaaaaaaaagcctcatagcaggcatatcacctttaattaggtttctgcttttgggaagcattttaccagccccctttcatttatttttaatgatgttatcactaacaggcaaacagtcccttaataaaacaaaaacagtttctatataaagcctggtgtacatgttctgagtcagtcatctaaaaacaaatgttatgattgtttccgttgtgctcttagaacacttaatggccctactgtgcagatatgcaaaacatca

SEQ ID NO: 13988 - DNA, 1003 bp, Homo sapiens
ttcttgtaaagaaaaagttttattcagatcttagagtcaagcaatgaatttatttctttaattgatgtttttataattgatacttttattgaaggtgtttcatagtttatttgcataattaaatattaaggcaaactatgccagtttgttttataatcatgatcattatgtgaaataagctcaaacatacaataaagtttaaaagcccttacaaaagacatttcaggaaactataaaaatacttctttgagtaactgatactcattgtcaaggaagcaatatttctttggtgttggttagtaaatctcttgcacctagttgtaaagtattctgaagtaaaatttctatagaaccataaagaatcaggttttttaaaaaataaaattacatatgaacttcattatccataaggaatagcatcataatttgcacttattacttatgaaaatatttctaggatggtaacgtaattcattattacataatatttatttctctcctacttgagaaaaagtgctatgtaacatgataatctaaatttaacaatacataaaataaaaaacatagcatttcctttataataggcatattaataggacaagtatatgtgttaaggaaagggtttatgggttaatagataaacaatcatatatttttatgttggtgatcatttaatcagtgactttaaaatttctttccattttaatttaggcaatattatagaagttgaagttgagtttgttcaatgtgatatttttgtcatagactaaataccctaagtcatgagagttacataaattaagataaaacaaaaacctacaggttgctgtaatgttcagagctctataaggtttcaaaatgatctttactccattgtaagaattatgatgtcatatggaatgaaagctccataaaaaatctggattttttgatatgtagtatcagtttcatttattaatgatagttatggtgatatatgattctgtgataacccacatataat

SEQ ID NO: 13989 - DNA, 1050 bp, Homo sapiens
ttctgaatacaggattccaattctgctatttgtcttctttgcacatttttccaaagcaaaggaatttgaacaccactcttagtgtcaatgatgttgcatttcactaacaacatttaccaggtgtgatatatgctccatggggacaataatttttgtcagttttgtttaattttatgtaaccagaacctagatcctgcctggtacatagtaagtgttcagtaaatactcattgaactaatgtatttgagcctgagttttcttaaagctgagaagttttggttatataaagtgctggtcaacttcatcaattttataaattaaaagttatatgaagataacatttaggctgggcacggtggctcacagctgtaatcccagcactttgggaggcctaggctggtggatcacttagaccagcctgaccgacatgctgaaaccccgtctcagctaacaatacaaaaaattaatcaagtttggtggcagacgcctgtaatcccagctactcagaggctgaggtaggagaattgcttgaaccagggaggtggaggttgcagtgagccgagattgtgccactgcactctagcctgggtgacagagcaagaccctgactcaaaaaaacaaacaacaacaacaaaaatttaatattacaaattgttttcccacttctatatcctgttcagttagagaatctctattgaaaaacaaaaaatgaagagaattaaaaggagagcaaaataaataaaaactaaatgaaataatcctttagagaaatgagttgtgattatacttaccctaagaaaatattttaatttgataaaatataatacatttttaaggtgcagagaggagaactgagataatgaaatttttaaaatgtttaatcacatgtgtgtagtactgaacattttacactgtttattttagaatttgagtatgttgtttttgaattctatttttgattctgaattatcctacacaccaaatacttcttgttcttcccagaggcaaaaatgcagcttttccttttttgtcctccggttactattagtt

SEQ ID NO: 13990 - DNA, 1058 bp, Homo sapiens
tagagaaacagaaggcaaagtgggtgtagatggctttgataaaaaagggttaaggagaatagaaggtcaactcattattaagaaaaaaaggaggcagttaaaattagatatggtttattgtaattaaagaaaacacacacagattttccttctaacaatgttttctatttgactaaataatttagtgacttgcaattatgcagtttattttatatttacttagaaaacactttaagaactgtgcatgcttggatacacaaaataaaatttaattattaaaggaaatgttgaaaatatacaggaaattttgtgttgctttccagaatgtaaaacatattttttgatagtgccatatttatagagtcaaattagctcaatgtagccagctggtcaggtatccatagcctgatattctgattttactgtgccttcaattaacaattagtcaatatatttgcatgagccaagggtattcaatgcatactattgaatgtttattaaatttgtaactgtttactgtatgaaaatatctagctcactcatgcctcattgtttagcattacacaaattacataaaagaatattgcataatatatataaaatatgtacaagagtcaaatgttgaaatagcatattctggcaacccataacatgggttattgtactattttaaaatatgctatatgatcagtggttacattagtttcaaaaatgtgaaatgtaattattctcatcttttacttttagactacaaactgtaaaacattttgacctgataatagagtactgacatttactttatttcaatcagaaaaaaagtcctcagaaatctttaaaacaaagtataagtttttgtttttgttttgtttagaaaaaagacgggcagagattttgttcctacaggtgttcctccaatagcacagaataagtaagaatacagaaatgtattctacttcactctatatctgaagcataaaattcatattaactagaacaatacaaggcaaataaaagaacagaaagcaagaaaaagtcataaattactatgtagtgatgcg

SEQ ID NO: 13991 - DNA, 1025 bp, Homo sapiens
gtggattttagtaacaatcattttcacaagagctgtctggaaacatacacagacatgaatattagagtaaaatatatagacaaaacacaaaatactgtttcagtgatgctaaaaggcagcttttgtaatgtaaaaaggggaaaaatgcatcttttcagcacaactatgtaagggaaattgcaaaggaccagcagtagtggatttgaatggagagtaggtgtgagtgcgagttcctagacggatgaaaagacatggaagagagccaaaagagatggccctacaactgcagaggactaaggataatatctgtgctcatgtttgtaatgctcctggagggaagacagggagggatgaggattgtttcggtcatggtttacacacatatatttagacatttaaaaattaaaacagaattgaagcaaaatgcaagaattataattctgtttttagaactattactttaaagtaaaagccttttattagactgagaaaatggggcactgttggacactttttaaaacaagtaattagccacttatacattatatctattattacaaaacaatctggattgttttcaaaattttagaaaaggaggctgttcatgaaggctgttcttaatagttggttttatgagaagggattcttaaaataggcaatttaacaacatttaaagcaaaacacattaaaacatggtatctctgtttgaattttccagagcagaagttggctttgcagaaatcaacaggcataagataaagagaacatggttcataattaagcatcaacatatttttcatatttgatagtacatgacaatatttgcctactaaccaaattgtagcttactttaattattttggtacgtagcctatcgcaatgacttaaaaacaaacaatttgaattttcttttgtattttagctggaataaatgactttttttcattaaggtatgcagttgatggatattactattttttagttttgacaccccccatccaacgccaaaatgaaccaagagcaga

SEQ ID NO: 13992 - DNA, 1052 bp, Homo sapiens
tgccttttgaaattcagcagaatccacaattaaatggatattttattgcaattgtctttcagagtttaatcagagtgtatttattgctgcaaatgcagacttataaataattccacactcactaaaatgctcaaatatggcattcttatcattatcacaaattgaggtaccttgaataaaacaaaataagtacggaggattttctattttccactaaatggtatataagaattactttttagatatatttagtgtgtttttgaacaaattgaagtttttcatgtgattaaacttgatcaaatagatggatcaactttctctgtaacaatgagtaaacttgtagatagtgttcacatttttatgtccaaatgtagaaagttgggctaatggatcacttctgaaattcttcatgtttttatgacatgtattagactctgcaattatcaacactactttttccttattagtaacttttgagtggctgaagaaaacaatttgctttgactgtatcactgtttaaaagaaaaacgattacagaagggttgttttttttttcttttttttttttgagacggagttttgctctggttgcccaggctggagtgcaatggcgcagtctcggctcactgcaagctctgcctcccgggttcaagtgattctcctgcctcagcctcccgagtagctgggattacaggcacccgccaccatgcctggctaatttttgtatttttactagagatgggacttttaccatgttggccaggctggtcttgaactcctgaccttgtgatctgccttccttggcctcccaaagtgctgggattacaggcatgagccaccgcacctggccgattgcagaagttttatatctcttttggtcctgttaaacaggaaagagtatattccagtctcaaaggcaatttcttgaaggacttttcaagacagagttcagtatctcagtttgtttccaaacttgaaatttctcaagtttcagaaacacagacttattaggccaccaggctagtgcagcaatgtttagatatttcaatcaa

SEQ ID NO: 13993 - DNA, 1028 bp, Homo sapiens
aagttgaagttaatgaaagaaagaaagttctttgtagagtcacacaaggcaatacctcctgctgtggtcactgcatttattttgactgagcacttgtcataaatcatttttgataataactaccagtttgaaataattcatcctagcaacagacttccaataacattcatactttttataagatgacgtctatttaaaattaagaaaggggttatttaggaattcaaaatactcccctcttgtccaggaatgcaatttggatagtgtatttgccaactttctgatttcatctttaagtcagtatgcaaattaattttgaaatacaattttcataaaaatactaagaattaattgagtcctcagtatttgcctttgacatataaaaattatttagtatcttaaaaatacactcaaattaaatgaatgaatgatttgtagttttgtctgttggatatgtcttttccctcactgtgatcttgtagacatataactaatacgtattcaggtaaagaaagcaattctacacacataccttatgcttaaaaggtaagaatttataacttgcaaatttatcgttttggaaaaaatactggaccggggcaatattaatctagaattaatcccattgaaacattcttatctttaaaaaaatttagagaaaaatgttctcatgtagtgaattcataaacatatttcaaatttaattttctttttttctactaaatagtaaacagcaacaatatctaaacaacctcttttgtaatattagcatttgtaatagtttaaatgcattaaacatttcaacttctcaggagaaaatttacaatgtaaaactgtgcctaggctgggcacgtggctcatgcctgtaatcccagaaatttggggggccgaggcgggtggatcacctgaggtcaggagttcgagaccagcctggccaacatggtgaaaccccatctctactaaaaatacaaaaattagctgggcatggtggcaggtgcctgtaattccagctactcgggaggctgagg

SEQ ID NO: 13994 - DNA, 1033 bp, Homo sapiens
tctttctgtgtgctctgatataatcatggattaatcttatttcatatgtcataattgggtggaagtttcttgacatcaatgactgtctctaactcatcttcatttttgcagtaatgtctaaacagttcattcacctttgtggatatttaacaaaaatcattgagtttaatttgtagctatttcggctatttgttcattttatatatttaatatttttttcagcaaggcctcaataattttaattttaattttaatttttgtttttaagacaaagagtctccctctattacctgggctgtaatgcagtcgctcagtcgtggctcactgcagcctggacctcctgagctcaagagatcctcccacctcagccttctgagtagctataactacaggcacaggccaccatgcctggctaatttttgtattttttttctagagatggggtttcttcatgttgccctgtctggtcttgaacacttggactcaagtgacccatctgccttggccttccaaagttcctggattacgggcatgagccaccatacccagccaccaaaggtttttaatagtaaataattgaaaattccatgaaaatatttttatactaatttcatgcatgaaaaattgagatatagaaaaatgaaatcaatagctgaaaactgcccaatttcaaggcaactatcgtcattttactttatttaatcatgtttttcaagtaactgaatcctactgcctgatattctaattccaatttgagatttggaaaaatcaaataggtagtacgttgttaatccttgctcatttatgtttaactgaatgataaagatttctgtttagaaaatttgggacttgggaattacataggaaaatcttttatactacatatgaaaatcttaacttctcttttccgtttttttttttttttttttgagacggagtctcgctctgtcaccaggctggagtgcagtggcgcgatcttggctgccttagcctctggagtaggtgggatcacgggcatgtgccactacgcccg

SEQ ID NO: 13995 - DNA, 1031 bp, Homo sapiens
ttagactataagttgttaaacagatatttgaaaatccagtcatatatattcctaattagctcctgaataagagtggcaagtctctttaatatgatcctcatataacctcttggaatgttatggtctaataattttttctcttgtgcaaaattcttgtgaattgattaaattgactttagaagagatctatttttttctcactaattttaaagaagtaatttatggtttaatcctttaaaataaaattaactctcgatttggcagcatcatttatgctgttgtcagtaccaccttttcctaagataattattatcatgtgtttcaggaaagatgttagggtatatttcaatgcttttctttttttaatcagcattgttccctgtctcaataaatctctattattatacaagttcaatgctaccttttgcgtgacaatattttctgcttcaatgtagaggaaaaataaatttaaagtaattactttcagaagtttattgttttataggactgttgtaagtatataggatgcaaagcatttgttaatgtttgcttgttaagctcactgaaggtagatgtttatacaagcccagaattattttctttcttccctgttccaaagtacttcaagctaatcaaggaaataattcactggtggcaaactttggaaattgtttcataagaaatctagatttaaatatgctgtatgattttcattttaatttagtaagttaaaggggaagtttatataaaaatgatatgcaatttaggatcattttaaagttgagaacttcatatatttcaagtctttagatgtgaataatttgagcttggtgtatacatttcttgtgacttgcgtaacttttaaaactaaaagttagaataaaatggaaaaacatggattttgcatcattttatatatgtgttaaatactttatttatttatttttttggataagaagaagaggaaaaagagaagacagataacagaaactgaagctttcccatgcacacgcaggcatgtggagttggta

SEQ ID NO: 13996 - DNA, 1035 bp, Homo sapiens
ctattcaactttgccattatagtgtgaaatcagccacaaaataaacaaaaggttgtggcagcattccaataaaactgtatttacaaataaaggtaggcaagatttggcctacagactattatttgctgacctctgctctagagaagagggacccaattggtgactttttttttttttttttttagaaatagtctcactcttgtcaccgaggctggagtgcagtggcgtggtctcagctcactgcaacctccacctcccgggttcaagtgattctcctgtctcagcctcccaagtagctgggattacaggtaccgaccaccacacccagctaatttttgtatttttagtacagatggggtttcaccatgttggccaggctggtctcgaactcctgagctcaggagattcatccgcctcggcctcccaaagtgctgggattacaggtgtgagccactgcgcctggcccagttggtgatttttaggcaaaaaggagaggtaattaaactaactgctgaactaggacagtagaagaggtaatgaaggaagagatagattggacagagcttttgaagtagacattatagatttcatgaaaaattcaaggaaaaaaataagtcgtctttcatattctggagcctagatggagctatagataatggtggaatcaagatcccccaaatattggcaggctggaatgatagatcaaatatagttaacataagttttataaaggtcaatgtatgatcttcgttgaaaggattcaaaatggtgtacttagcagtttacattcagaaattatttgaagattttagttgactactctcaagctcaattatgagtttgaagagacagcataatgaagcaaaagagtattgaaatgatctcagaagaacccttggaactataaaactagttattccattggatccttaaaataactgctgaagaatgtaaggcatgaacttttctctatagagacagaatatttgggaattcagatctaagtttctttcacaattggatccagttggattg

SEQ ID NO: 13997 - DNA, 1054 bp, Homo sapiens
tatacatatatatatacacacacacatatatattcaagtgtgtttttattttgattttattttattttttgagatggagtgttgctctgccactcaggctggagtgcagtggtgcaatctcagctcagtgcaacctccgatccccaggttcaagtgcttctcctgcatcagcctcctgagtagctcggactacaggtacgggccaccatgcctggctaattgttgtatttttagtagagaagggtttcaccatgttggccactgactgtgctttggtttggcttataggaaataatttttatgaaccaaaattacatataacattcattttaagagaataatatgaattatttatgatgacaagtgaaccattatgtaaaatgctactgtcattaataaaatggcaccttatgatgtgaaattgcaaaatgactagcttacttttaggaagtcaccaacacactgggataatctgattgacaattacatcatatttttatatttaaggagtccttgctcctgtgtgctgtctaaaccactggtggatgaatacttttaacaattcttaatatatattagtgcagtgctgaagttatcaaagtgggtccgaagaataaatatatcaaatagcagtaataggccaggtgtgttggtcacacctgtaatcccggcagtttgggaggctgagataggcagattgcttgaacccaggacttcaagaccagcttgggcaatagagtgagaccttatctctacaaaacacaaacaaacaaacaagcaaacaaaaaacttggccaggcatagtggcgcacacctgtagtcccagctactcaagaggcagaggtgggaggatagcctgagcctgggagacagaggttgcagtgagtcgagattgtgccactgtactataatcttggtgtcagaatgagactccgtctcaaaaaacaataaccaaaaaacccccaaatagtagtaataatttaaaattagaataaaacgtgagcacttatgatgtattgtttttcaccatttatgaataccatttttttttaag

SEQ ID NO: 13998 - DNA, 1023 bp, Homo sapiens
tcattcgcctctcgctttcccatggcagcatgatagacgctcaatcaaagaaccccctcctctcagcaaagcaacaattttgtcaccacgagcaaatccaattgaaaagtcccttggactgagaggagaactccagttgtcagaatcagcaaacagaatgaaaagaactaagaggagtaaattggcacctggggccgccgtggtagcctgtgataggctgtggcattgtgttgggtagacattcagccattttcagatataatgggagaaattaatgcaaatgagtcaatggaatgaaatgcattttaatgcagatttgagggactatcctgaactgcttgataacaagtcgctttaagaaaaggcttacattgtgaggactcattttttccccatttcttctcactagtgcctcataagggccctttgttctctaagtaaactctttctaaactattgacattgctcatttatgtgaatttcagattttttttttctccctgacaaagtagccttgggtgatctgggaaaacgttaattgcaagaggacaaggaaactggctgaaacaagaaatgcagtcattaagtgtaatgttgcagttgtccatgcctcattataacatgcatacaaggcaataaaatgcatgtttcacaaacaaatcttttgacaactatagttcaagagcctccagctgtcctgcttttttacatctatttctcttggtttagtaatcattattgaagctaaactttaaattcccagaacagtccttcatattatgcaagaaccatgaagatattagagttaaaaattgtttactttaatatttaaaaatatttgctttccaaagttaactggaatttctcactaatgttttgttttgaaaatgacacttaataatagtgagggcagcgtgggggttggggggaatgaacttaatcccaaaaaaggcactcttttataaaccaatatttaaaatatttagctcccttaggctgtctttccatgaagaaaaaataaag

SEQ ID NO: 13999 - DNA, 1045 bp, Homo sapiens
tattagtaagtcctagtacagggaagttaacacaaattccaatctaatgagagtggtgtcacagcaaaaaccatgtagtcaaggaaagatcagtattgcactggagggaaagaggcacctggctattctgtacatagttttgttgccataagtctttgagttctgagttacttaatgcttacatggaatttactagatttagttaattcagtttcttatggcctttaaaaggcaaaaaaacttaatgaaaacaacacctactttagggggacgttctgagaaaataaattacgttttctacccaagcacattttggtacacataattttcttataataaagcctattatgtcacttagttttaatttgttacaagagcatacataaaaattaatctttaaatgcgttctttccttcttgagcttcagattgaagaaaatgaaatgttactggattacggggcatgtgaataatataactgatagaattaaaggatgatttaagactagcagaatgatggataatttcagctgatattgtataataggataatttttaaaagaggtgacaaaatagtctgattaagagccaaatattttaaataccgttaacttactattagaattggtttaaaataacattgttgatactttagactgttcggtgagtgtgaagatttcattgcattcaaaaatgaaaacaagataagaagtaagactctggtagagaaaacgtacgaaggcaaggatttcaggccttgtaatgaaagtgcatatctgccaagttcaggttataatcttttaaactttttattacttaatatgacacagtgacatttaaaatatggagaaattgaagataaataatatggagtgaatggcagaattgatttaaaattttaaagctgtactaaaagtattctaatgcactgaaggacatttgtaagttatacattgtttataggtttctgatgagaatcccaaagcataatgtattagagcttgcctttgccatgagggcaaaagaatattgtccatagaaaatag

SEQ ID NO: 14000 - DNA, 2074 bp, Homo sapiens
cttaggaattaagactgttatttctccttttttattgcttattatagcatcacccaaaatggaaacaatgaattagcattaactgatctaattctttattaatcaatatattaagaaaatattgcattaaaataacatctaaagttataataccatactatttaacttttctttaggtatttccaaaattaataaactcaattatacataggtgttacatgtcaaaattagccatggtaactctcacttctataatctgacctttctaaaaacctgaaaatcaaaagtttatcttgaatacatcctaaaaatagcagtaaaaagtgacttcataatggtgttgccaaccttggttgtgaaacattttactatggactatttccctcatagattgtgcccattaaaaatggttctgctaaaatttatagtgtaatagtgactttgagaaatacacaggaaggaaggaaatgtttggtcaaattactgcttaattattccaaagctggagtgactggctttgttttgcgcccttttactgaataacttttgataacaatcaaactgaaaagtcaagaaattaacttttatggaaattgagtcatgccttaaattcatttttaattcttatactgcttatttagtaaccaataaaactaaaccaagttgtgctatgaagtgaaggatcataacttcaaataagcaattccattttctccattatccctacacttggctggcaaagagtctctaggaattttttaatgtattatttaaaattgaaaatactaatgttcatactaatatgatgttagatttttcagttatgtttactggcaataacaaaaaatttaaattcagttctgtttactgcctatcattgtgttattttttccttcctctgtcagtgaccttcaaataatcttaataatataaaggaatgtctgtgacaactatattcagtttagacttcacattttacaactaagacaatgttacatataaatacataagaacatatcatagctaatgtatatatctttgtgtgaatatgcatttgtttatatatgtatctatgtttatttttagagacaaaactttaaaaccaatacaaagatattaaatcattttgcgattgtactaagacagtagaaagtgaaatgaacataccattatcttttaaaaatttatatcacagccttaattacctggtttgtctatatggccatggcaccagaataactgttatctgtctgtcttcttcagtttgtcaatttgaggtggcaattgtttttcttgaagagacttgccctgttgcccaggctggagttcagtggcatgcatttatggctcactatagcctcaagctcctgggcttaaataatcctcctgcctcagcctcctgagtaggtaggattacaggcgagcacctagctaatttaaaaaaaaaaaaaaaaaaaaaaaaaaaaaaagcttgtgttgagatggagtcttgctctgttgcccaggctggtctcgaacttctggcctcaagagatcctccttcctccatctctcaaagtgctgggattataggcatgaaccactatgccctgctaggggagcattcttgtagcacctttcagtgatatcttttggtaagcaagatggcaccgatttcacatcacttttggcctagcgatatgtttgtaaagacctaggaacaatgatctttctaacaatggcctgtgttgatgaatcatcaatttagtttcatagaaaatgacagtgacctattttgtccctgtctaccataatgccttatggttttctgaagaagagttggatttgttagagattatagtgccttttgaggacatgtacctagaaagtgtgttctagaatggacagcattctgatctaatacaatgagcacactgactttggagtctgattaacccaagaatgagtcaaaagttactaagcttttaaaatccgtttccacatctgtaaagcatggattataaataatgacttcctcaaagggttggtatcataactaaattatacggtttctaccatataatatgcactcagg

SEQ ID NO: 14001 - DNA, 1030 bp, Homo sapiens
ttatttttatacctcttaaaaaaggaaacaaaaaaaaaaccttaaatcaaacctaaattattttgtgtcttttatgtttttttccattcattctttaaatgccagctccagtgacactttctctgtgaaactctccctgcccagtcactctgagcaagagttaagtataccatagaaagatatttaaatttcaatcactcctcttaagactccttcttataatctattgtaaccattccttcttctctgcctttcctactaaaggcaatgctcttgggggcaggtatcgttggttatcgtttctgtattctggttccctggtacaatatctgagccataagagtacaggagatatttcttaaattaactcaatcatcctataattactgttatcacattatttttatcttacatttttggaacctctgcctgtcctttgataggaaaacataagcggggatcttgatcttgtttgtatatgttagtgactaaatttcatctctttcttttctgtaggaatattaagtaccttttcctagactttagttataagtttatgttcagaatgagaatggaacttgatagtgattagccagttttcaccgtattttgttcatcttgagttgccttttattgttttatgaaggcatcactatggatctaatacagctatctttaggttttgatgttagacctccaaatcccttacatgtcataatctttctggtgatagtgttgtaactcctttctctgtgcaggaacgtgtgtacgtctgtgtgtatagccactgactggtcttttgaagcaatgcctttatctttgttgttatctttcactgtcaatgccagtttcttattattgatccttccctctttcactgtcaatgccagtctcttattattgatccttcctgtgataatggcttgagggactttgaggaataatttttaaaaaatatttttggtggaagaaatcttcttactttgaagaaattagataaaataatttcaactttggctgacaaatcctg

SEQ ID NO: 14002 - DNA, 2037 bp, Homo sapiens
gtgccactgattctcagaccttggaaagtaacttaactactttatacctttttttttaaggaaaaaatggataataattggacctaattatagcattaaacacagcaaaatgcctgccccttataaagtctcaaaacatattgaaaaaattattaatggaaataaggaggttttaagaccagaactgtgatttggattctagctccagctcgccctcctactcattagctgtacgaccttggtcaagttacttaaactttctaaacctcaatttttttcactaaaaaagagattaccggctaggcatggtggctcacgcctgtaatcccaacattttgggaggctgaggtgggaggatcgcttaaacccagtagtttgagaccagcctgggcagcatagtgagacctcatctctacaaaaaataaaattagccagacaagtggcacatgcctgtagtcccagctactcgagaggctgtgcttggaggattgcttgcagccaggaagtggaggctgcagtgagattgcaccactgcactccagcctgggcaacagagcaaaaccctgtttccaaaaagaaagaaaaaaataaatagagagagatatcactgggttgagaagtaagtaaaatagatgttcacatacttacttcccttttgtcttcaatctatagcaaggaatctggagacttggaaggagggagattgaaatgaaaagggtgtcttagaatggaaacttaattcagattcttccattttgaaagtcgctgaagagtcttctaccacttctattttcttgagtctcaaagatatagttaagcagctttcgactgaaaatattagaagttcagttcttcagtaaatacatgttctaacatccttaaagtataactcaaagataactgagaattctggacatttaagtaaaactgctaactagttttactctttttcacaatttctgcttaactatatgctacttttggaacaagttaaccagtgttttgttatgattgtcattatttcagttaaaactttaaaaatgtatttttcttaatatgtttgatacttctcccattgaagaagtgaatttagttgaattgaaagaggctaccacacaggttaaaagctgctccaaaagagaggacctttacaataatattcttaggaatatagtattttgcagctctcatattagtccactgtaggctacttacctctttctttcattctgtcctctcctctttcatgaagagtcaggtaaaattaatgtaggtgctcctagctctagtgaccaattactaatatttcctcccaactgaatgtggcatattaacactgagagcaaagaacttagtgtctacaaaataaagttagggctagataaagtcgaatgatggccagccaccactaagagtatatgcctccttctagtggcatgctcagtttccatttaatagagggtgatattgaacatacagtgaccacggattgatcatatacaaacatctgaccaggttgaactctcaatttaacatctcaattttaaatttttacaagttgagtttgacaatattttttgttcaccctgtattgtataaaattattttcagaatttattgtctattatcaaaactaaaagtatcctttgactttgaggaaaataggaaccgttagccaccatcttcagaataatgtaaaggctgattgataatcatccatcttgtttttttcctgctgtctggattccaggggtgtgtgtgtgtgtgtgtgtgtgtgtgtgtgtacaaaacacttattttagaactcacatttcctttaaatacacaatttgttctgctttaaattatacttaattatttatttctatctacatcacattttgcaaactagagttgagcttaatatgtcatttattcagagaaatttactgggcggaaaagttagagtaaaatgcattgggttgggttatatatgaaatgttaacaagtattaaagtggtctcaataccacaatccggtaaggaagcaagatctaca

SEQ ID NO: 14003 - DNA, 1449 bp, Homo sapiens
tcccaagagtaagatactaaatttagtcatttaagtctgcttatggtgtttggagaggtgacatttttgaaaccctggatttggagacacacagcctgctttctttcttaatttacttttctatacctatttttattttaattttgaccaggctaagttgttctgtgtttatatatttctacttggttccccttaaacggttacatttcatctggggacttaaagtggagtttaaaaatcggagcaacttctctggaaaactcttttgaaattacagtgaaactgttctgtcactttaattaccatgaagttgcacagaagtactgaatttggcaacagatccttatatagaaggaggtgctggagtaggatgctgctattgacattgttctgttacagcaattttggatggacaaattgcagttgagaaaatttcatgactcggtaaaatgagcaatgatgacatctgtggatgcgggtctgttcatatccttgcagagcctttagggaaataaatatctcggaacattcggtgaagtgaagctcactcaataaatcaacctgacacaataacacttctggcacatgagccctacttctcctcagcaccaactacccctctgtgttcctgtgctaccaaatggtgtctccccataggcctctaaatcaaatcatagcacacaaatacagtgagaatttattgggaattggttttgttcggcaaaaacattacttattagatgaactgaaatgataataaattttgaccctttaaggactgagccagttcagtcaatgtactgtttgatggaaggcatctagaattatcttaagggtatcatcttaccatgagctgttttaagttttattgggattacttttctaattttcagcttaatttttttgatcacatcacatggaatgtactgtctgcaagtaccacgttttcttttctaaatccttcagggtgaaactgggacatttgttaggaatatttaaagtaatgagcaaaagctaaagtgcgtgtatattaaagcagctttgaatcaacacaaggtaagtacagggtggttcaaaaattacaatatgcaactaaagatttctaccattattagtaaaatgatcatacctgagttaacaaagtgagaaaggagaatattatcattaataatattagaactattgacacatacgagaggattatgttaacttaggtgtatttggaatttctatatgtgaaaaaaaacaaaacaaagaaatataatattaatatttcttaccatggagaaataatagctggtttctatttttattatttctttcactagagatagtagttaacaaagaggatcaataagagaaaccagtttcctaaccctaagtgtccgtagatgtccttgggaaataaaatatttttctacaaggcaaagtttactggtgaattttcta

SEQ ID NO: 14004 - DNA, 1030 bp, Homo sapiens
agcatataaatggtctatgctttagagaatccttcagaattacacatatgtcaagaaatctaatttgtatgcatcagctttcattcctgtgtttgtgttggctttaagtagcagcacagcttttaattgtgaggttttaagttctgcaattaaaatgtaccctttttactaggagggttgagtgatagtttttgatttactttagacagtttagacaaattatatttaaaagaacataaagatgcacagagcatttcctgattcagagaaggtcaaagtgtcttacttgcattttttgaaagttttaccttgaataactaatgattcttcttactgtattgactaaacttctctaaagacatacaagcaggatgtcaaactgctttaaaacatcaacttctttgaaatcaatgaccaaatgaccttgaacagaatagggaacatgatattttacatctcatgatgttttattaaaattacttctatgaaggatgcagaaatagattacattagtgcctccaaagatgcttatatttctctttttattagttatgtgtttataaaaataatgaaaattctttgcaaactactagaaaatttgtttagagctttgatcatagcaaaagtgtagtagaaattctgcagacagatgtttaatttgatcaagggagaccataaaatggataatcctggtcaataatgaaagttgaggtcacagaaacaggtttgtggaataatgaccacaaaaaaatctcatggagacctttgagaagaagcacagtaaagaggcattacaactatgaaatagaatttaaattaattccaaaaattctggggatatctgtgtaagccagaaagaaaagcatttcaaagacacagaaatataaaagaaagcaatttaagatctgcttggtgtaagtgggtatggtgaagacgttggtccaggttgggtggtgatgtcaaggagagagtaatggtcagatcacaaagaatcttatgtgtaaggatattaagcaggggagatgtataa

SEQ ID NO: 14005 - DNA, 1034 bp, Homo sapiens
taagttacattcttcctgttaaagtttacaaattgtagttccatatgacaaaaatatctctttgcccgtactctttttgtaaagtgtagtgtgatagtaaggacactgctttggcattagataaacctgaattcaactcttggcctcattcatgctatttaacctatctctcagctgtaaatggattaattctttctaagtgataacgtttttgtgaactagataaaaactgaattatctagtacagcgcctggtatttaatagtctctcactaagttgtggttgtcattatattaactagtgttaacctctgaaaatttgtgaaattggtaacattggtcttcaaaatcagctttctctttctacatttttgtatgttgttttctttcaggacagtgattcagttctctgtctacagcatacacacacacagcattgtctactatggccttccagaataccagaaaaatatttaacattcaccacacctgtctcaatctctttttcttgaggactctgaactttcgggaattaacactcaaaaagtgtggtgcttaaaactttacctgtttagcttcctttagaactgagaccttcatattagttaatttttgattatattattactccatccattgcatcctttctacctctacacttataaggcccagtagttctggtattgaagaattatatcatttgagcacatacatttgctgtgaagttattatcaaataagactatgttccatataaaaggcaacactatcttctttggaaaaaataagaaattgatgttactatatgcttagcagcaattacattcatttaaaaaaatattccttatatgttgggtagagtttttgcttaagttttacttattaatttgtggcaccattttcaacttaatttcaaaagtgcacatcttaaacactattaaaagattctaggctgggcatggtggctcatgcctttaatctcagtactttgggaggccgaagtgggaggatcacttgagcccaggtgttcgagaca

SEQ ID NO: 14006 - DNA, 1069 bp, Homo sapiens
tattattgaaaaatggcaatccctttaaatattgatatgacatgcctcatagaacttgtgcttttgagtcttgtatatattcgcctaggtgaacactagtctatttattagatgacttgcatgagaactagtcaaatgagatcatattataggtttgttcttaaacctattctgtgctatgattgctttattttcccagttgtactgtctttgagctggaggaggagaatacatcctccctcagaatgaagaaaggcaacctcattagtggaaatataggtaggcatctgtggatggagttgataacgcaagtctagatgttagaggagttatgggaactgcagcttgagtctgaactcttgggtctgactcacctgcattgatcactagctcgatcacatcctaagaacttgggcaagtgactcaacacatagggccctctggtttctttatcctaaacatagaatagtatctaacttgcaagactttgtgatactaaataattttatgattatgggtaaaatgtctgactcttagtgagagctctataaataatagttctaactactaaaatagtaaacttgggttactttaaagttcaatttaatctcttcttctctgtgaaagaaaaataacatagtaggtactcagttaatatttttcaatgaataaagtccattatatttgttagaccattgttaatatgtttaagatgctagacatatcagaaaagattttagtataagccatgcatgaaacctattggaagaagaatgacttaggcagtgatggtatgaaagggcagtgatgacttttcacatcttgcaaaaagctgggcttggggcagacccaagcaatttgaggctgcctgactgtgctgttatttagcacttaaacttatatggaattgtgacttaaataccagtcacagtttaggagatgtagatatttgaaatataaatttggtcatgggggtcaggataagtgcatttgaggttttttcctttttttccgtgggacacaacattagcctcttcttattaagaggaatctcaagttaaataatagc

SEQ ID NO: 14007 - DNA, 1757 bp, Homo sapiens
cccatctctacaaaaatacaaaattagtggggcatcatggcgggtggctgtaatcccagctacttggtaggctgagggaggagaatcacttgaacctgggaggcagaggttgcagtgagccgagatcatgccagtgcactccagcctgggtgacagagcgagaccctgtctcaaaaaaaaaaaaaaaaaaggaagaaagaaagaaagaaagaaaatatttagtagccacactaagaatgttaaaagaaacaggtgagattaattttaatcatatattttatttccttaataccttaaaaatattattatcttaagatgtagtcaatataaacaaatattcaatgagatgttttactttcttttccataggaaatctttgaagttcaatgtgtcatttacactgatagcatgtgccacccagacatttcaagaagtcacatttcaggtgctcactagctacatgtgactagctgttgcgacattgttgagtgcaggcctagttccctggtgtgtccctagaactaccaacacctagagaagggtttgccattttctaagagaacaataagtattcaataactaatacatcaactggcaggatcacattgtatcttgacatcttggtgtgtggagctgtaatgatggcaaagagaaccagagtgttgtacttgtaacagcactctacacaacttacagtcctgggagctggcatatgggccatccacaactctatgacttggacagttccactgatctgtgccatggtttgtccaatctgtggagtgataaggttgaactatttgatcttcaatgtcatttccagttctaacattatatatttcctttctcctttatatgtcttatttttaataattttgttttactttattcattcataatttttgtagacgtatgcttccatttctctttttaaaaaacttttattctaaattcaggggtacaagcgtaggtttcctacacaggtaaacttgtgtcatgggggtttgttgtacaggttatttcatcacccagtcatcaagcctagtacccattagttgttcttcctgatcctctacctcctcccaccctccacccactaaaagacctgagtgtgttgtttccctctatgtgtccatgtgttctcatcatttagctcccacttataagtgagaacatgtggtatttggttttcttttcctttgtgagtttgctaaggacaatggcctccatctccatccaggctcctgcaaaggacgtgatctgttcttttttatggctgcatagtattctatggtgtgtgtatatatatatatgtgtatatatatatgtgtgtatatatatacacgtgtatatatatacacacatatgtgtgtgtatatatacacgtgtatatatatacacacatatgtgtgtatatatatacgtgtatatatatacacacatatatgtatataccacataccacattttctttatctagtatatcattgatggacatttaggttgattccatgtatttgctattgtgactagtgcagcactgaacacgcacatgcatgtgtctttataataggatgatttatatatattcccagtaatgggattgctgggtcaaatggtatatcttctcttttatttttcttcacatattacaatcttgcctttccccaagaagtagagtccaggcaaaaatgggataaagggtcacatgcccctgatctaacagcttctccttatatctgtcacatttagcaaga

SEQ ID NO: 14008 - DNA, 1039 bp, Homo sapiens
ggagccagatttttatggactgccttcttggcctaccttaccctgtagcttctggatgtgttcattctatgcaaagtgccagctggatatcaggaggagagaagtaggggagagtgaggtcaggacatttaattctcttccttccttcctgctgccttaatgagcagtggcttcatccctcttccaaaatacacagttcttgcagggagactttcctatagcttcagctccatgttccaattgcagcaactggttgatctcctctcccttttaggcctcccacacctggcagccccaggatgccaccttctcttttattggtttacttcaattctgctgatactttagcgaatactccctacatcatctaactctctccagttaataacatctgaggggcttgtgttctctatagagaccttgatggattcaggtcccttcctgggagtttcatgattagcaaagatgtatttaggaaactagaatgagaatctaaactgaaaatgtgctttgggaacttgctatatattgatagacacagaatagcatccaagtcaaaactaagcttctttattgtccacactccaaaggagaatccactttcaactaatgcctgtatttactttacctttttgtttgtttgctaactggaagataaaaatatgtttagaaatttagtggtgaatattagctacgatccatgcctaacctggaggatggactgggcagtgcaagagtagagacaagatgaccaaataggaagtggcttccttgaagaggcaagttatgatggtgatttggacaagggtcacagccccggagatgataattaacaacctacagtgacttctcacaacaaccaaagtaaatccaaagtctttattgggactttcagggcttgcatggcctgtcctttactgtcttctccaaattcacctaccatcaagctgcatccgtaataacctattctctggtgttgcattcactgagctcatttgtctgttttttcattatgcaaatctcctcttacctcttcaga

SEQ ID NO: 14009 - DNA, 1026 bp, Homo sapiens
aaagcagaagaaatgatgtggagaattgtagctttagccaaaagaaaaactctagttgcagacctaggaaaaattaaatatcatcccttccctctctcactcattcattcatttatttttcattcattctgaacatactcattgagtccctgccatgtgctgggtgattattactcatgcatattactctggcaagaatgtttctttttcttacttatcatgtttatgtgacattcagcaattaatggggcattttttcagagtattagggaaagttcctctccatctcttccttaatttcagtctgtcaacttgtttaaggacatatgttgccttattttatttttttcattttctgagtacttatttgatgttgaatataactgagtccctcctgactcatcttttaaataataataataccaataataatataaaatgttcatagttattacgtagatcaaatttagtgattaatgtgtagagtttaaatcttggctcattgtagacagcaagtgacaactctgttgaagagtctcaacgtaggtaacacatattctatattattttttaaattgaatataatataattgtattagttcttttattacatggcatgtggcaagaggtttgaagaattgtgaactattccatatagaaaaacattagtaagctatttctccttgatatccagtaaattaacagaatttacataacaaaatttggcaagtgtttgatataatttctgataaatacttagccttgtattttgagtgggggaagtgtatttcaataattatgcattatttttgcagatagtaaaacgtcaagacaaatagccttcttttgtttactgatttgaaatactttcatatgatcatttatcatttaacagtgcttatcttataacgaggttgtcattgaaataattttggtttgttttttttcaactttatgataacttggcttgaaatgccttttcaaacaatcaagaaacagataaattttatctacaattgctttctt

SEQ ID NO: 14010 - DNA, 1080 bp, Homo sapiens
attctaaagtcaaattaattgtgtttgaaaattaagtccaaagtcattctattctatttttcaaaaataatttcctaagatcaggattttatttatttgcatctagaaactaccatatgttttgtcttacatttaaacacacacacaaaaccaagcccgatgatgacttcaatacatatttatcttatgtgatttgtagatggagattatacttggtcaaagcatgtatataaaatagaaccacaaactattaaaacttccccagtctaaagaaattttatttaaaaggtacaatttaaactaaaatatttaagtttttgaagaggttaatgcttttaactttcttacgttagtacataaatgtgaactgaatgtcagattagacaactttactcagtattgaaaagaaaactactggtcttcagataacaggatttaagtgaatttttgtgggaggggagtgaggaggaagaaagtagaaagggggtttagtgagtacaagcatggcaacagtataagcataaggcaacagccgtagtgatgtctggataaggaacaccagaaatgaacctgaaagactgggggccttagagaccagagaagccaggatggaagtgaggaagagtgggttactcaaagatgggaaccagcaggctaaaaggaaagatcaaaccacagaggcaccatgtaatgaagacaaactcagggtttttcttaactttgccttgagcctaccctaaagtctgtgaaaaacaaagaacattttaaatagtctgtcttattaaaatgatttgctttagagatggcacattatgcttacgctaatgtttcatggttgaatacatgcttttgtgctacaaaccgtggtttatagtttagaaaatataaaagttgaaaaagatgtttaagaacattattttttattaccctactttatatttggatgtcgatggcacgggtgtaactggcttaattcaccaatgaagaaatgtaggtttcacagaggttaaagaactcacttaaggtcaggaacagtaagctgtggagagagaagcagacacagatcttatcactctgtcc

SEQ ID NO: 14011 - DNA, 1034 bp, Homo sapiens
tttacctctgggataattttaggagacaagacaaaattaccttacttggaggcaggccaagagaacaggattcttacccttgttgttttattttcattttaataagcattacagagtttctcatgaatgacagtgattgcaaaattgattgaaagctcattttaattcagacttctccatacaatattttttctttagtttacttcttccagtccttttgctctgtttcttgtatttgtatacatctcagtaaacaagcctttatttgccttggcaagctctaggtattttattcattaagtgaacaggccggtttcttttctaacagactggtggttaccatttcaaacagctccctttggtctattttggtcttattgtgactctctgagccaacatttccaaagttttcaccagcaaatatgtaggaagaacaatgaattttggtggggagttgaggagaaatgggaaaaattttggcaagcttgcttttctgtcttcttatctgtttggcaaattcctgggctgagcctcaacactaaatttctctccctgcacatggacaaacactgagagaaagacaaatgtgggaaaagggagaagtagaaaaagcagaggtaaaaatgcaatgcctgggattttcagaatgccgacaaatatgtgggtatctattcagcttccaaaaattatgcatcttctctgattcccaatgcaaaaatgtgcacatgatttctttgatctcaaatgggtattattcccaatatcgtattaaagtcccaatttttgaaatgggaaaacgaaaccaatttaagtagtgcatcagatgccacttaaatgttaaggtgggtccaccctttataaaatgagagaattggtcaaacataggctacagcggggtgcggcgaggcaacagagccgttaaaaagcgtgtggaattctatgctgaattcttcaagttctgacttcattcatgggactactttcttttatatagatagtgattccagaaataatgtcccataatagtatttcag

SEQ ID NO: 14012 - DNA, 1069 bp, Homo sapiens
tgaggtcctcagcaggctttctccctcattgattacactcattcatctcagatggaggggtggtcgcgaagagcaaggaagggactgaactgtcaggactccagcctttgttaagcagcgggtagtcactgcctctgaactcggctggctcctgcttcccatctgcaggatgatggattgctatgtttaatacatttgagcttttgtctgtcatagtgtggacagacagtactatcagtgatttcaacagtgattagaaaacagtttcaaaccattcctattggccagagagcttccagaaatgtctgatgaaacatactcattggtactctcgccatgtaaacgtgtagtttaactaggcggagattgtacactcactgtttaaactgatgcagaagcccactgagaatgactaaaccacatatcaacttttgaagaaaatacacaagacaattttaagaatctctggggtctcaaactaaaaattcatccgaagtagtcccaagtttcagatgaatttgtattctttatatagtaacaacatgtgcttgatggcaggactgtattccataaattatgatgtcagttgttgctatgctcatcagtattgagctatctagcaatattggggtgggggttagaatgtgaggactatgtgaaagcagtaagacaggacttggcatgtgctacgctgggatttgctgagctgtgggggctttgtggttcacaagtccaaagggtgaatgatttcaacaacaagaaggccactatataccagctcagtattctccctggagtgtcttattctatttacaaaactgctgctaataaatacaattagctaaaggaaaagaaactattcttttaagccattaataatataggcaaagttttatttcaagaagggggcataataaataaatcaaaatggccaataacatcattatttactagttataatgtaatatactaaatgtaatgtaaattataatgtaaattataaaatgtgtttaaacatggagttttaactgtagcagtaaataggtaattattaaaataataatccaac

SEQ ID NO: 14013 - DNA, 1048 bp, Homo sapiens
ttcttacatacccttgtcatccaaattatcataacccacctttattttttttttgaaactctagtgaaattgtgcatgaaatagaaacattttaccatgaaatttacctataaacatctagccaaaaacagaacaaactctggatttttgagctattgatatttagaacagatcccttaaattcaaaattgtgaaatataatacaattgtatttaattacagtattttattccaagcttaggaaataaaattaaaatggcatatttgatctggagtaaacttttttgctctcttttttttggagagtgggttaaataagggcccatgacaggaatgctgtttgtttttcacaaaagttgtttgtgatttcaggtacccttgggaaatctcttgatcagtttcacatctgttcctgtcaaagtgggtgctaagataccggtcacccagcaaccatgtccaagagggaattgggccgataataacttcaaaaaggaatgacagatgctagattaggatgaaagacaaaacgcatgaaaaatgagcttgttagaatcaaaaatttgttcaagcacctttatgcaaattaaatgaatattgaatatttgcatgcagtaatttctactttttcatttgattgaaaggaaaagaatagtgcatttaaactcacaaatgtgacttctttcttttgtactaattaacatacaaagcagaatctcttttttaaaaatcagattagccacctgggttcttagagctccactaagtatattataatgtttttcttatgaaaatggtacattttaagaggacttggtttatctaattttttaataataaacagtgtcatgtgaattaagattattttagatgaatataaatccatttcttgagaaagcctttcaaaagtaaccttatcctgttgtccttgaaattggttaatgtacattaataaaagatcactcaagatgagttcacaccaaaagcacagacttctcattgactggttaaataacaatgcattaaagtaaagcagagtggtgtgccctaa

SEQ ID NO: 14014 - DNA, 1016 bp, Homo sapiens
attactgcatgcagcagtgtagaaaaattttactttttaaaagaattataaaaccatagctttataaatcagtggaaagtggcttacagagagaactatcagatgtgtttacatcacatcttattcactttttttaacagctctaatgctttggcattgctatgttcatatttatgtattccttatttatagctctgatagctttaattttctaagcagtctgtctatcagatgtgcacatctgctgtgccaggttgaagtatagtggaacccatcagtagtaatgtgtagtagttatgacttgttgacatttccattataaactttaattttgaattgtttatgcattataactgtggatttatattgtattgggctgaaagttgacaggatttcagccaccacttgtgaatttttatttagattcattatgtatatcagaatcttgttttttgaaataagagcatggaaaacatttcttgtaatctactcttgaacaaagaatatttagtttttcaaacagtttgttgggcagctaatagtgtgaaccaggtcatttttgtattgagtaaaaaaatcaaactttgagaaacttggattttaaaagtaatgacaatgcttaggttagtattatttgtaatttgaatcatttacatctaatgagaatgttagttgagaatgttttcttaaagttttatatcctataaataacggaataaaaaaatttgtaaaatgaaacaacaaacatgcaaaattcctatttacttttattacataaaagtaattttagtgcttacctaataaatcttgaatggttatttaataaattattagatgggtgatgtgtttcaaaagatacttgctattttttgaagaaataaggatttccagtcattaaacaaaactaaacaatcttattagatgggtgatgtgtttcaaaggatacttgctattttttgaagaaataaggatttccagtcattaaacaaaactaaacaatcaaatgttctatatta

SEQ ID NO: 14015 - DNA, 1029 bp, Homo sapiens
ccagacgcttataaaaccttcagatctcatgagaccggctcactatcacaggaacagcatggaggaaaccgcccccatgatccagttacctccacctggtcccacccttgacacgtggggattgctacaattcaaggttagatttgggtgaggacacagagccataccatatcagcccagatcaagtagtgacagagtagggatttgaatacaggttatagtcactattgtgttatttcttgacttttgtactattaaaaaactgtagccagtgaggcttctacccttagtacccagaactccttttaggtatagcaattgtttttaggtaaatttatattgagtttaacacctgtgtgattaaagacaactttccaatgtagtatctgtagccatgtcccctaatggctattagtgttcatggttagtgtgttgaagatgagccaggtacataacgcggcacattttctgcaggtcagcagtaaggtttcaaggtacagttatggaggaaagaagaaaatgacacattgataacacaggtctttattcccttttgaatgagacagtttttaaaagttgatttataaatacaaaaatacattctccaaagatagtatttccaaactgttatatacccatctactcccaacatggatataagttttttaaaaaaatagttgtatataacatacatatctgccccagtgttacttcacaggcctatgccctacgggaactccactctcccagccccactttttctcttggttctcccacattcttattctcccacatccctacccacgtttgagctggaaaggatgtccctaccctaggcatgaggtatattttattctgggcaccacacatttgccccatagataacaatacacgtgatgatgtcactagtactacctttctagtatttacatacttaaaagtagtaactagaacagttatcactggaactaagaattttccccacagaggtgaacagaccaagaactaaaatttcaggaaacctgttta

SEQ ID NO: 14016 - DNA, 1035 bp, Homo sapiens
ttcagatttattgcataaaatcatagttctgtatatttaacgcatgtcatacacatggtttttttctcttctatgtagttttcttttattgtcttaatttgctcaaataaatgggtttaaatgcaaacagactgttagtatgagttaatacaagtatgaaactgaaaatctgtgacagtcaagtatattattagacttagtgagatttaagtaaatatgtgtttaacattttctgaaatgctttaagtaatgttttaggaaatgttttagaaaatgctttaggtaaaattcccttaacataatagacgtaattctgggccattatatttgggcaacttatctgataccatatttattatgaagagaatactttcagttatttcttatgatatgcgctaagtctacttgatatggcctatttctgtattttataattacaatattataaatagttggaatgcatgtaacagttttttattcttctttttccatcatttatattcattgctctggagtctcactataaaattatccatggagagtccaggcctttggatagtgttaagaggtgaaataccataggaacttttgtaatttctaatagcagaccctctttatttgggtttttattttttataaggaagaacctttagaattaataaataaaggtccaaagggaactagtcaccataccacatagctaatttgtacaaactagtactaaaaccctaatctaattcccagacctgtgtgtgtattttagtcagtaaatcctcatgttaatcctgaaaagtgttgagttctaacatacgtattcagttatatttatttatttgtttttgctttttgattgttttgtagtactttattatcaagagagaatgtctgtggtttggtttggcatgcatgttcttgtctagaatgttgaaacatcaacattctgtagtcttatgtcataatttactgcctgaatggattagtatccatgtatgcattttgattttgaaaggaaattgcctgataatacttagagga

SEQ ID NO: 14017 - DNA, 1050 bp, Homo sapiens
agaaataggttttaagtgataggacattatacataaatccagtctttacacttctgtcatcccttcttacctttatgatactttatgaaaccaaaaggaaatgagaagataaaagttgggtttgatttttgaaatacagatttagtattgccctaatatgtagccacttagttatatatgactatttaaatttaatatgtattaaaaattcagtttcttggtggtactatctgtctttcaagtgcccaagagaaacttgtgtctagtggctaccatattagagatcgcaaaatgaatacttccttcatcatagaaagctgtttttgttagcactggcctataagaaacactgctatcttctctcctattcagagttgtgtatatcataatgtagatttcaaaaattctctgatattaataatagttgtgtattgagtgaacagaagacttattagcggcatcttttggtttgcttctttcatagaatgaaatagaaagtggaaaaataatattttcagagcatcttcccttaagtaagctacagcaaggcataaaatctggtacataccttcaaggaacatttagagctagcagggaaaattacttggaagctacagtatggattcatggcgacaatgaagaaaataaagaggcaagtatataaataaattccttatacactaaaataaagatgatattttatatattatgaacacttaatggtaaatactatttgtgtaacatatgaggcttcacatactttaaagcaaatagtaacttttttctttttttttttgcagtgctcacaatttgtcaggtagttttttaaatctttgcgcatggcatttcatttaatattcaacccaacctataaaaactaggtagtgtactcttatttgaccaatcaggacttgagatttagagagcataaataatttttccaaagtctcttgttaccagtgtaagttatgatggagccatgaacacagcctgtgttttctgacttacattttttctacctggtattgagaaattaaagttgtggaatta

SEQ ID NO: 14018 - DNA, 1050 bp, Homo sapiens
cttcagctattagtgtttaccatggataatttatatgcattatttattaatgactgtagaattctgattataaatgatctaattatactatttgtagcttttaggaattgctattaacctacagtttgaatgaaatctgattatcatacctgtgaaattgtattataatttgtcaacaaactattatttagtgtctcaacctaaagtataaattctgatcttgaatttttctttttaggaaataaaattgtattagcctttttcttgtccccttaataacataattttcttcttttccaagcaaattgtttcttaaaaacttaattataagaatcttgatttcttctctgaggtgtacatctgaatacattcaagagaaaagatataccattgactttttctagtttagtggttaagcatttatgtgctaagagttttcacatatccttgtttctactgatttccttttatttcgttttttctttccatttagagaaacctatgtagaacaagaacagggagaaaatgctaatgacaggaatgatagagcgattcgagtagcagcaaaatggtacaatgaacatttgaaaaaaatgtcagcagacaaccagctgcaagttatcttcataacaaatgacaggagaaacaaagagaaagccatagaagaaggaataccagctttcacttgtaagtctaaatgtagaagtacttagtgcatgtttgcaaatgcgtgtaaaaataatcattaggcctatagtcagatgttcactttactatttagtattttcgtagtcctatataacttcatgtgatatttttgtatttttaaatttcacatagtttttaacctaaatatgttgtgcccagtggctgttaattttcccctcactatttgcaactggtttagcaatgaaatctcataaatatactggaacccctgcttctgcttaggtatgatcacatcaacagatttttgggttttgttttttaaataaattgaggccaggtgctgtaatcccagcactttgggaggtcagggcaagaggcttg

SEQ ID NO: 14019 - DNA, 1800 bp, Homo sapiens
gccaacgtattcctttattaatacccttaattctacgaagtcttgtgattggtctgtttaagtgtgctttttttaatagatctgaagggtttagtgactattgtctcgttttctatagccaaatagcttcttggcttaacttattcagtgtttttaaaacataaagtatttatgcccaacataaaacaggattttatgtttgacagagctatttacaaatgaatataggaaaaattaactttatctttctttaagattgatgttcttgaggaccctgccatcaggaatgtaattgtgctacaaacagttcttcaagaagtgagaaatcgcagtgcccccgtatataaacgcatccgagatgtgactaataaccaagagaagcatttctatactttcactaatgagcaccataggtaggaggaatattacgttaaatatcagaaaaccacaggattagcaaaattcgggagagggttcctgtgagtaatttatgacattgtcagaagataagtgatagatttcataccttatttaattcttacatggctgtgcagaagataatgctaagtggatctctctaaggtcacacaggcattgatgggctcaagcctaaaaccaaggtctgctgactcctagactacaataggtactttaatttccaaaatgttttcattttgaattggttttagcatgagttggaccatagaatcttggaagatgagatttgcttaagttcctggaataccatattatgtgaacaactaacagagggtaataaaatatatgagtttgtgaagtttctattttgtttaaaaatagaaagtagatttattcttaatggtctttttaaaagtttaatactttgcagctgattacattgagcaagattaggttaaggaatagaattctttttttttttttttttttttttttgagatggagtctcactctgtcacccaggctggagtgcagtggtgtgatctctgctcactgcaacctccacctcccaagttcaagcgattcttctgcctcagcctcctgagtagctgggattacagtcacgcaccactatgccaggctaatttttgtatttttagtagagacagggtttcaccatgttggtcaggctggtctcgaattcctgacctcgtgatccacctgcctcagcctctcaaagtggtgggattacaggcatgagctaccgtgcctggccaggaatataattctttgttgtgcttttagattcaagacctttgaactcagtgtgtggtctcaaaaatatgatattgcctattacgttatattacataaataatctatgatgagtatggtacttttattggattagatcagggcttctcaatcttggcattatagatattttgaactgaataatttttttgtggtggaaaggctgttttatacattgtagtatgtttaacagtgttcctagcctatttggcaggatcaccaccccttaccccccccaccaccaccaccaccaccaccactcagttgtaatgatacaaaatgccctgaggggtgaattcactcaattgagaaccattggattagagtgtagacttctggtaatgaaattccatcagattatgcacatttttaaaaaccttaatatctcaactttcttgattcttatatctcaaacttcaatgttcttgtaaagaataccagtaaagcccttgtaggcttcttattgttagtacctccttgaaatccagaaatagcaacatcacttgtttttcagtgcagaaagacccaagtttaaaaccaattcaaaaa

SEQ ID NO: 14020 - DNA, 1068 bp, Homo sapiens
tgaatatttgaaatcaggcctttcccggaaaatcatgcatgaaggatcattataaacaaacaatagcaaccagttgtctccccgaacttgtcacttttctcataaatgtctggcctggagctccaaaatcatccaaatacttagtagcattttagcctgagtacactttctcagttcctcaactctttgtatacctttccaccaatatagacattctagaatctgcttcagatgcatttgaaattttcacccccatggaactagtgattaatatcagagcccactcttgcagttggtaatggggtggcaatcaaacgttcagatgatgataaaggagagataatggataattctttttcagagttctcacttaacagctctgttgtggaatgttttaaatagtcttataaataatttgtttatagtattgttgttagtttaattgaattttatgtaagaagctgtccaacatcagagaaatgaaattcctcccactttctgtgtagaacaaggtctctgacagtattgattcatggaagtactaatggacttagaaaacattaagagaatgtcatttctcatagtgtttctgtttctgaaaatgaatctcctgaattattatctttctccctgttacttggctggggaaagagatagaagctgtataaacaaattctcttccatgctcaaagcaagtgttccatgtgcacaacctgctgcagactggggcccttctcagttaattgggtttcacaagcaataatttctccacaacaaaaaccacaacttgaagtgagttgaaaagagatcaatagtggaaacagtcgcctcagtactttttctttctggatttcatctctagaaatttgaagtgtttgagacagagtccaccctttgtgcaaggcgagaaccaatgaatggactccttgtgtgaattattgcatcttcttccaaagcaggttcatcaagactttcacagagattcatttttgttgagaagtaagggttaataggaggatagaatttggatccaaatctagtgataaaagtgtccaagcaatcaaaaag

SEQ ID NO: 14021 - DNA, 1044 bp, Homo sapiens
gtgacctaaatgtcaaatgatttaatacactggaggaggaaaaccagagcctacttctgagctactgacacaactccattcatagtgagctctttcacaacgtcatgattttagttgcaattggataagagtagcgtcccctctttcctacctaaaacatatgctttaaatgtatgtgcatttgtaatatgtgttctcttatgtccccaggtggtcaaagagcacatgtgcaaaacagaaccccatcctgcagttatgtgtggtaatgaaccacggcttaaacaatgaatacggatgcattaaccacaaattcttataaacaataaatgaataaataagttattttaatgggtacctagcagctataattttaggtactcataaaagtgactgattacattagcaggccttggtctaaagagtgcagctggctaacactagaaggctctgtagaactagaaagtgcaaccatggcctcagaatttaacaccaggatgcatgaatgttgagttcttttctgacacactagccttcatcaaaggtaaactcaactagccaccatcagaaattaatgaaccctaataatgtagagacatgcgtatgctcacctatgcgtagacatgcatacgtcaccttgcagttttattttttcatgtcctgatgcaggtttggcaagtgctgagcatcgttttgtcatgctcatcctaggcagcaggctttccttccctgcgttgctcctcagtgtctacctacctgctcctgaagccctggggctctatagcagttcctcctgtgttgctttttctggcttcatttgctgttgctgccaccccccacaaccccccattactagaccaccccctgggtagctgacccaggctccaggatgtccatcacacaggccccagtcacctgctttttgctcctaccaccagcgtgcctaaagggtttataaaggcctatcttgaaaagacccctcctgcaggagacctacactcaccctttcaaaacgccctttcatccatgccctcatgagaaattcac

SEQ ID NO: 14022 - DNA, 1033 bp, Homo sapiens
tgcaaatgggattgctcctgtctttacaactctgtggtagtgtgccatgatttagaagtccaaagcccttaacactacgtatgaggccctttgcatcacataactctttccatctcacttctcacaaattgtttccatcttcccgtggaccctaaatttcagccacactgaacttgttacatttcccaaaacagcttgatcaccaaggaaactaattctcaaaaactcagtttaaaaatgttcttctgcatcaggaaaaaaatagctaatgcattctgggcgtaatacctaggtgatgggttgataggtgcagctaatcaccatggtacacatttacctatgtaacaaacctgcatgtcctgcacatgtaccccagaacttaaaattaaattgaaaaatgcttttctgtgaagacttccctgcagtccccccacccatcagcctcttcttcctctctgatccaatgccaccatatggagcatagcatcacttttatcatgatttactgtatttgttggcccgtgtgtaatgttctttccaccttctcctcaagcctgaggccctccagtatgaaggctgtccttgcctggctccaagcacagcacatgtggcagcaggttcaaggcatattgatcagtgaaatgaagacatctcttccactatcctcatctattggtaggaaaactgaagcccggagtttgaatgattttgtccaaatttgcacaggagctaggattagaacttagaacttctgccgcctgactttggtggttccctttccacattttgatggctgtttcccattccttagtcaatattttcagaaaagtagaaatactcaaattcagaggatagcaagacatattttcacattacagacatctttaaacattggttacatcatttctgccctttctctgtttatcgttgttatgcctgacaaaatgtttgaagaataatggtgactactgacctgaatttcagaagctaagattttagacctgttctgtcactctctaattatgtgatctgg

SEQ ID NO: 14023 - DNA, 1050 bp, Homo sapiens
tttagtaattgtggagttattttaggttaatcttttcttcagcaaatgtagtaaactgagttgttaaagtatgtattatgtttaatgctttgcacaatgtatagataatcatttaatcattaacctaattaaaatataggttaatgattatataacctaaatggttttagaaaaagaacgtatttgtacataataatttcttataatcttggtataaaatatctagtcttgctagatgagtaatgtcctacaagaaagatttcattggtctgtggaataatcatttattctcattcttctcagtatgaaacagcctctctaatttatggggtgtgagcacaagtggactcacatgttattctaagggtttttggcctgagcaactgagtgaataattccaacatttttgaaattgagaagataccagaaggaacatctttttttttgtttgtttctttcagagaaaggttgatattaagaaacctgggtctggttttcagagaagatctaaggctggaggtagacatttgggagtcgtgatgatgtggatgggaaggtcatgatggtagctcagttggagcctcttttagctacagagtgagtttaaatagtggagaggaaaggttataggacagtgacaactagcccatgccaacatttagagtttgaaagaatgagaggaggaggttcaagcaaaggagaaagaaaggaggaaagccagaagaatgtcttggctgctgagtaaagaagctgttcaagaatggagtgataatttatgtcagttgctgctgagaagttgaggactaagaattcaccattagatttgaaaacatggagactattgatggctgtgatgagggcagtttcatcagagcggtgtggataccaactacattggattctagagaaaatggaatgtgaggaagcatggctatagctagaattaatttctgccctctaaaatttacatgtgttgtacattatgtatttaaatagcaatgctaatataacaaggaacattcataaacaattaaagagataaagtatatt

SEQ ID NO: 14024 - DNA, 1051 bp, Homo sapiens
cagggaaagagtcttaataaacagaggtgatagaagtcaggcatttcttatcagaaataaacacaatttgtgtttataaaatgctcttgggagtcttaagtacattgagcagcgttctgtggacttgtgacattggaggtgttttgacaggagcatatgtgtacctgtggaaatataacatgatagcccattctaaggaagcgtttgtgttagaactgtgtccggtttgccagtcattacagtcatgttaaagttcacaaagatggtacgatttataaaaggtactaggaagaacaggaaggcataatttgaatttaatattgtgcaaagatatttccaaattgcatactcttggggtcattcatggtcaaggtagaaaggggttatacaggccatcatgagactacactggcatttcacagcaattcacattagtaaaatagaaaattgctttaaaaattttttaattcatgcataatacttgtacatatttatagggtacgtgggatattttgatacattcatacagggcataatgatccaatcagggtatttaggatatccatcatctcaaacgtttatcatttcttggtgtcaggaacattctaaatcttttgtttcagttattctgaaatatacaattattctttattctagtcaccctactgtgctctatcaaacgctggaacttattctatttagtttatgtttgtttgtacccattaatgaacatctcttcatcctcccctctacccactcccttcccagcctctggtaaccatcattctactgtggacctccatgagatcaacctttttaactcccacatatgagtgagaacatgtgatgtttgtctttctttgcttagcttatttcactgaacataatgacctcagttccatgcatgttgctgcaaatgacaggattttatactttttttaagcctgtatttatgtaagcccttcaacccttatattggtcattacctgaaaaagccataatgtaatccatccatgatttgttttgtgtggtgtggaatgattccagcagg

SEQ ID NO: 14025 - DNA, 1034 bp, Homo sapiens
ttttggaagatttaaatttggaaaataatatgttcatcctttgaaaagtagtactcatatgttatttttaaatgaatcttttctctgtccttttacctggaccgcagggttagatttcagccctcgtttattgaaaatagctgcttttctatcagtcaaccttgtacctagaattgaacctaaatgattgaaaaaaaaaatccatgtttttttttgtagaataattttttcagctttattgaggtctaattgacacattaaactttatatacttaaagtatatgtgctgatttaacatacatgtacatagtgaaatgtttaccacaattaagttaattaatacattcctcaccttacatagtttttttttttgtgagaatgcataagttctacactcctagaaaatttcaggtatacagtacagtattattaactgtagtcaccatgctgtatattaggtcctaagaatttcttcttcttctatctgcaaatttgtaccctttgaccagtatctcctcttttctctgacaccccagcctctggcagccaccattcctctctgttcctatgaattcaactttttaaaaaatcttccacatataagtagtgtcatacaatatgtgtcttctagagtaatttttagtaacataatcttgaagatgaggagggtttaaatagccactgttattgctgacatacttgttaatgaacagttcactcaaaattatcttagttacctttacctctgttatatccatttattttccccaaatgttgattaaatacctactttgttttattcattaggctttgaaattaaaaaacaaagaaaagagagccttggtattgcatttcagaattcacagcataagtgtatgtctgtgcgtatataaaatgaataatatatctatgttatagagataatttgtattatatgttgatattgtatatgaatatacatataatacatcagagaaaacaagatataattgatctaaaatgaagtgtggagtcagatctggatacaaatttcc

SEQ ID NO: 14026 - DNA, 1053 bp, Homo sapiens
gggtgcacacgaggttcactagatgtaaattctttcctaaccaagtgtagttagaaacgtgatgaaatatgttgaaaccgtctaggtatagtttttctagccagactgtaaatattagacacaatcatccgaagttgccatttcgtgggtaaaaatggtacattctcagcaattccatgtggttcggtgtaatgtatgatacacagtaaccaaaaaaagtgatttgagaccaaaaaaatgaaattatgaaatgtacccaaatgtcattatgaccatgatttcacctgcattttgccttcccccgcaagcagtggtggttttagaaatcttaggcagccatacaatttaacagtgtgggtgtgtagctcatgtggtacttttcattgaaaagatatgcctagtttgtgcgtgaagcgagggctgatagaaattctgggcagtggttgctaaatctcttcacagggagaaggagatggaaatgaaatgtaatttttaaaaatatgtgttaacatatgttgacagtaagtaaccctctcatttgaaagatctgatagtcttggtcaacaggggtcagaacattgtgccgtttcctgctttggcaaattcacgattggagaagaatcatatctggaaaagtaaaacaggatagagttcaagagcactgttagcacatataaacaagatttctaaaatgctaccacttctgccatttttatgccttcaaatcccaccttatagtagtaatgaacttggaaacagtgattcactgaagtaagaaaaatacgtatactttcttttagtcacgcaagccctgttcttttaacttattatgagagctataagcaactaatatctcctttccgcatgctctctaccttccagggagagtgctaatgagcagtgaaatggccagagctctggcagcagaagcaaggaggaggagaaaccagagggttgaacagtagctcaggagctacgttatcagcttttgaccactcaggagttggtaatattgtggatttcgtagtttctattctataaccataccctgaa

SEQ ID NO: 14027 - DNA, 1036 bp, Homo sapiens
aagttagaagagtgtttggtctttagacagcaggcaggctggggtgaggggaggtgagaatgaattagtgtcccctgcatctgtgtcagtctactattacatgaggggaggaaacaagcaaagtttaaatgtctcatgtgagctgaagagaaaaaacatgaaatatacctttgggtgaccatacaccagtgagaacccacccatatgagcatcctatcaagtctcagctgaggagaagagctgaaaaagtgttcggccggcgcagtggctgtcgcctgtaatcccagctacttgggaggccaaggcaggagaattacttaaatctgggaggcggaggttgcagtgagccgagatcgcgccattgcgctccagcctaggtgacagagtaagactccatctgaaaataaataaataaaaataaataagtgttgttcatcataactaaatggccccttagggcccaagaagaaccttagctgcacaatactgaaggatcaaagaagatactgcaaaagccaaaacacctgtaaatacatttgaatattttgaattgaaaagtaaatgatgcagaatgcagtaggtagcttttatgtcactaaaacaaggttggttcttgggaggagaataaagaagaatgttgttaaaagtaaacaaatctaattttgcacatcttaattggctttaatttgattccagaatcagacaacagtctagaccaaaaatgttcagaatgcttcaccctacggcatatgcagattatatttatagccaaagaaaaggaggtgacatgcagaaaatggaagtgaggtacagagacagctccgttggttaaaatgcagcatatgccttaattgaatctggtttcaacagttggccatctttgattgaccgaaactcagctacttgttgcaagaggaggttacggtctgtttccacgtcaagttaggttacagttcactatgtacagaagaaactttaggccaaacttaaaacatgtatagaggcagctttaggccaaacttaattcaatttaata

SEQ ID NO: 14028 - DNA, 1026 bp, Homo sapiens
tgttccacattttaatagagcttgagatgggagttgggtgggcgagcctggaactcagaggaaagaggagacagatttggagaaataaaatttgggtaccactagggatcatctcaggagagccaaatggagaaggagaagcatggacgactggacacctgagcattgtgaggttagaaagtgaagagggatgcaagagtcagcatggaaactcatctgttcatgaggaaagtggagtaatgttaaagagaatgcaggtggagcgtgttttcaagagcagcttgtcaatggtatcaaatgctgctcagggaccaaataaaatgaggaccgagaattgtgcatttggcgagggagtgttcatcgttgacactgacctgcagtgtgtcagtggaatggtggggacaaaagactgcctgaagtaagttggtgttcagatgagaggtgaggaagaggagactgaaagtctcgatagttctttggagtagttttgctttaaagagttgtagagaaatggaatgagagctggagaggcattaggttctcaagggaggggttttaaaagaaggagatagtatagcaagtttatatgccatcaggaataatcctacatcattatcttctgttttttgtagttcctttcattttccattatgtatctttttcctaacaattttgtcaacataataaatagactttagaattcagattaattactgcaagatgcaggtgtgttcacagtacaatataagcaataacgtgcaattaaggactttgcttctataattcttcctgtttaggattgtccattttcaactctttactggattattagcaaacaagtaaaaataaaagtaaaatttgagttccattgataattataaaaatgataccagaaattataagatcaacattttttcttcattgtttagtggaatgtgcaggataactgaaaataaaccatgagtcccaaattattactttgtcctttaaaggcatttttttacatttaaacattaataggtatta

SEQ ID NO: 14029 - DNA, 1050 bp, Homo sapiens
attctagaattaggtgtttgactatagtagtatcatgtagcttgtgttactaacttcttataaggctaagttattattttaagggacaggatgactcaatatactggaaatatttcaagatgcaatattaatattcccttttagggtagaaggcaggaagataactttgctacatgactatgtgtaatcatcactagttatttcattaaatttgatagttatgcagctggtcatgaagttattttcttcttctaagttcttttttttccctgaattttactagaagaaattgcggtggcatcatgctgtcttttctctttcttcactacccatgaatctaaaaaccaagccacccctcaatagaaatgcagaatgcccataatcattgacttattcccttttaaagtaaataatatgtatgtactttgccttcagagcctagaaataatgatggattaagatttatgttgtattactttttgctttgacactatattactactgaggcctgtaattaaaatatgatcgatgagtacataaaacactgccttctcataaaatgctagtaaatatggttgttttggttcttgtatgaggtgggaataaatacatttgattgattgtgaacttacagaaatttttgcaggtatgaattacaaaattgtgcattcaccattagcaaggtattgttttatctgcagtgagtttctttatcacacgtgaaataagtttcaccttcctagtttaatcaaactaaaatctgatgattcagagcatacaggctttttagactgcaaacttgagatgcagacactcgttgcttacttgataatctctttcctttgttctctaatggtccaggagctagtcccactattctctagtgaaaacgtagaggaagaagaggaattagggaaacttttcatggattttacctgagccaaaccctctttgatattgctgacacttctgattgaactgaacaaatcagatttgaataataacaacataactgcaggccaaatcagatatttattttcttttacaatt

SEQ ID NO: 14030 - DNA, 1045 bp, Homo sapiens
atcgtaatgaaaataaatttgcaggaagctgtcaaactggtctttgtaaccttaaaagagaataaatgtacatattagaaaagacaaaaagctcaccatgggagttcatgttattatgcttcctaacttatattaattgtattcttttgtatatttcaaatattacaaagtaaatctgttcaagttcttttttttttagtattgattggcgagtgatcttcctaatttggcaataactactacgttcttttcacttaagtattcttttgcacatgatatatgaaaatctaagatgaccagtgttgaaacataattgtaaaccatactcaaattattcctgattatatttttatatctcataattaaaatacctatttaaaatatggtctttagtaatgactgtagatctttgaaactttgtaagggcaaagagctataattcttaaaatttctctttggttaatatctaatccaaaaaacatattagtgagatttacttaaaacctgtaagtgaaaatttcagtatcaaggaaagtgtcagttctgaagaaaatattattttcaaggtgatgatcagttggcccatgtttcttagtttcagtcacttgaattgggagtagttaatggtttcactcaaggtaagccatctgccaaggtggagggtggtataataggatgtacttgtgtgatcttcaggcctatatgactatgtaccacacgttagtgttaagtgccctttgctgaagaaaacagaagtcaattattggattgattccaatttagaatagacagacatcactgcagtgacattttcctgaataactgagtttatcaagactgaacttattgtaaaaagggcatcatgtgatttactttacatgggtctatggctgctagtaagagtcactaattgatttataatcttttctaatttatggtagtgcgtaattgcttaaacgtattgaacaggcatgaaatgtttcacaggggaagtgtcaccaccaccttccctacctcagcccagctttctcttctgataatgcaa

SEQ ID NO: 14031 - DNA, 1160 bp, Homo sapiens
caggggtttatatgagcacaggatagagtcgtggcaggccagagtagtcttggaaaaggcaacatttgggcgtgaaaacagggaatacctgttctctttagagctgccagtttccaggcttgaggctgaggcctttgctggggaaccaccctgttctacccaatatttccttgcctcctgtccatatcaataataataagatcttcatagaaatgaagaaaacaacttttacaaagccaatagttaatgacaatcatttgatcacttatttttcatagaaatgctacttccagcagtatggaggagtaggtactagcaagaaggtgacatcagtttacaaagaaaacaccagtagactgacagccaacctgtcaatatcaacagtggcagctagaagacaatgggataatattttcaaaatgctgatagacaatgtccacataaagctgtgtggtcactcactataattctgtgaaataccttcaaaatattgacaaaaataaggacagttttgaacaaaaactgagagactaaaaggaaattctaaagcattcagctaaaagattccaacttattattgctgagttaaaaatagaacccaaaatgatgatctgagctgtaatatggaataatgactaaaaaaaggcattttataaaagcgtgcacattttcttcttaaaatactattaatacggtctgattgataggatttttatacaatgatagagctgaagtattagactgtaataacatttaaatttggagaggacattgggagttagtttctaatgtccttatatagtttgttaattatacttgtttaaaaaaaattgagaataactgctgaaagaacagaggttcaatgtataatttcccaaagaaattgaatgggaatagaatgtgtaagacagcaagcaaacaaaaaagtatttcttttcttttcttttttttttttttgagacggagtctcactctcacccaggctagagtgcagtggcacggtctctgctcactgcaacgtttgcctcccggattcaagtgattctcctgcctcagcctcccgagtagctgggattacaggcgtgtgccaccatgcctggctaatttttgtatttttagtggagacagggtttccccatgttggccaggctggtctcaaa

SEQ ID NO: 14032 - DNA, 1238 bp, Homo sapiens
ctattcttcatttatagcttgtggtccttgcttttctctgttcctagaattctcttttcctagatatcagcaaagcttgatccttcctctcttatttcaaatcttgattcagatgaccacttgtcactaaacttttgtgtgaccacctgttttaaagtacatctgcatcattgatcagcagttgcagagactgggtggtgatgagggcaagtgtgaatgcagaagatgggtctggaggccactgcaaaaatcaagactagagatcatggtgactgggactaggtttgtgatattagggatgaagtaatgtaaaccaatatggggtgtatttggaagtttaattaaaagttctcacttatgaattggatttggagtgaggaaagagaaatgaatcaaagattagccccttagttttgtcttgaattactaggtaggtgttgatgcaaaaatgacagggggaagattgtaagaggagatggctttttgcagaggtgagaaattaagactgctgctctggatttgttacatttaaatgctaagtgaagatttcaaatacactgttggctatgggaatctgtctttggacatagagatttcatagtgaatgacgtattgacatgtgagattacctaggaaagtaattagagtagagagtacaggactgagtcctaaagcatctcagtactgagagtttgagcacaatgggtagagccaacaaagaagattatgaagactgccggagagatacaggcagaaaaacagggaagtatggtgccccagaggtcagaagaagcaagtacttcatgaagaagtggttgcccagctgtgatgaacatcagggaagatgaaaacaaagaagtgaataatggattggcaatcaagatggcctcgaccatataattctctgtggccagtattgtgaacactaatctcctgtggctctttaagtttaaatttacattaattcagattaaataaaattaaaaactcttcagtcatattaggcatatttcaaatgctcagtagccacatgggcgtagtggctgccatatgggacagcacagaaagagggcatttccatcatgcagaaagttctgttggggagtactgtggatgggaagtacaggccctgaatgggcacatcctcctctgtcctgacagactcctcattctgtggtgaggggtatggccagaggcagaccagagcagggccctcgatggcattgggtccagtgttc

SEQ ID NO: 14033 - DNA, 1051 bp, Homo sapiens
ctgatctttattgctttgctgcattagggaagttttcagttgagccaagggagcaagaacctattagtcaggggctgctgtcaccaggaagatttgtgtgctccattttggggatttttttttttagaatgaaggaccacaatcatttataaccatcaggacagagtgagcaatcctataatttgggctaatatatacctccaatctagcccaacacacatacacacacacccttaataggaggctaatgtaaagataatgtttagtgctgaggacaaggtggactgaagatatttctatggcaacaaaaaggcccctccagacatctgtgttctaaagttgatgctgtttattagagactgcctgttctacagactgtaattatcattaggtagaaaaaggttgaatgtgggtggactacttggctgaagctttctgactgatttgtttagcccagctttgaagtaaatttcaaaggaatattaggaacctgacattgtgctacttgtctctgtaggtgaagtcgtagctaattgtaggatgtttgctgaatgtggatgaagtttttgaacaaacaacataaacagcaacacaaaaacacaattaagagtgacccatgtatgttaaatgagtttagtgtatatgcactgactgtttacagaggtctatttctcttaaagaaaaagacactcctatcaaatcgtcttgaaattaagttaccctggaagtggtttccaaaggctaacagtctatgattcagaatttatcttctggttttaaaactagaactcagaactttcaagatttttcttggtgtaaaatttaaagcagacgggcccacaaaaatgtaaccctgatgagaatgtgtgtggaggagtatattgttttcctccatttatagtcatgaggaatacatctagtgagccaatacagtgttattgttaaaggaaaaacatgtagacatttgactaattttggcagcagaatgaattcactttctttcaagaatgcaatttcaattgtggtgttggagaaacaatttttttactat

SEQ ID NO: 14034 - DNA, 1061 bp, Homo sapiens
tgagtgctgttctgtcatgttctcagttgtcttctaaaatggggtgaatgtgattatgcagactctccattttactgaaatgatacaattctacagatatgcactgaatgtaccctgatctgcagagacacaattacttgagtaattcacgcagagaaactacgtgtgcttaaaaccgaaccatttattctgtgtctaaaaaccatgtgttagagtgatatagtttgattagttctgaaaagtaagttctacctttggttctcctttatttatgttaaaaaaaaaaaaaagagagagagagaaaaggagcattgaagaaatatcctgaagatacagacacacctcagagatattgcagagttggttccagagcaccacaataaagcaaatattgcaattaagcaagtcacacaatttttttttgtttcctagtacatattaaacttatgtttatgctctactgtattctattaagtgtgcaagaccattacatctaaaaacaatgtatataccttaattttacaggactttattgctaaaaaatgctaacgatcatctggactttcagcaaatcttcatctttttgcttctggagggtctgccttgtgtgttgatggccactgactgatcaaggtggtggttgctgaggttggggtggctgtggcaatttcctaaaatgaaacaatgaagtttactgcatcagttgactcttctttcataaaagatttctctgtagcatgcaatgctattcgatagtgttttacccacggtggaactgctttcatgattggagtcagtcctctcaaaccctgcctctgcatgctcaactacgttcataaagtattctaaatcttttgttgttgtttcaacaatgtcgacagcatctttacctggagtagattccatctaaagaaaccatttgcttatctggaaaaagcgactcctcatctgtgaaaattttatctgagattgaagcaattccatcatgtcttcaagctttacttctagttctagttctcttgctatttccaccacatctgcagttccttcctccgctgaag

SEQ ID NO: 14035 - DNA, 1158 bp, Homo sapiens
agagtgtaaactcctagaggacaaggactatttcttatatttctggtttgtatctcttatagtttctggcacatggtgaatacattatttattcagcttgtctgggcattataattagcatggtgaaaaatataaaaccagtcaatagataattgtcaacctgctctatgtcatagggttattgtgaacataaaaatcaaaattgtaaatattggaaatacgcattctcattggtgacaggagtcctcatctcgtagccatgtgaaccggataggtgtggtagcatatgggcaccacctctgtgtgccttctgtttggagttctctgactcttgcatttttagttaagtgaaagctaggtagataattattgcagtcacctgaaatgtgacttcggttttcttgcttgtcggtaacacagcacatgctgctggcagcctctaggaagggcatgtgctcttgtgatacgcttcaggggcacagcaaggagtgcttgaatgactttgtctgtgactttggtgcgtgcgtcctgctgttacaagagcttcccaaatgctgttagcctttggatgttctaacatgttactaagcaaaggactgaaacaagaagagtattagaactatcacacccagagataaggtagtatatagaggatactgccccagagatatactatgtgattttattcctggccctgcagttcaccagctggaatgacattgggaagttattttctatctccaggcctctatgccctcatccatacagtgggggtgctggagatgagggcttctctcccaggtgaagtctgccattctatgatcctggtgaggagcaaggggtgagacagagcctttctgtttatgcatttatgagtcttactgcagtgaagcttcctgtgtatggaagtgtaaattcacagacttcaaagtgagaaagacctgagttcagatggtattcagcctggtaccagctgtgtgggtcatgcttagtctctctcctttaatcctactcacctggaagatggaattaaccacccatcttcacaggagcctgcctgcctttggtgggtactgagtcagtgttcttttgaagaaaaacaggagaaaaaggccctattactttcgtttatgttgctgcaattctcatgaagtatct

SEQ ID NO: 14036 - DNA, 1033 bp, Homo sapiens
gtcttagttctttagagttctgttttcttaattcatttcttaatctagttgcattatcatgagtttagtaaaataaacttctgctcagctcatatagagcctggcgtctcattcagaaaggatagccttttcccactgctcatgggaaaaaaaagtgaaaaagcagtctgcatttcacaataatttcttcaacttgaaataacaatctgttcaaactgtgcatgttggaggaaggcaaaaactatagcaaaccagtcagaaacttagccccagaccaatggtcaaagccaggatcgtgggttgctgtcaccagtcttggtaatctttaacaatatccatatagttctttcccctttattttttggtttcaaggtaaggtctacctgaaatatttaggtgcacaaaaaacaaaagccactattcccagcagttttgcagtgtgaataagaactccatgtcacattatttatagaaagcattttttttgtccttagagagggacatgaaaagttgtgggttcataggtattgcctaatgcctgttcatgaaaatcgattttcctccttgtgagtggagctgatgttggtattttaactcttatttagattctgcatgttggagggaaatagaacttttttttttcctttgggtttatgtgtacctcttaaatatatgacagatacaatttcattctcttttgtagcaaagcttcaagagaatcagcctgtagtgtttaatgaaatgtataatgatttaactctattagaatacaataattttaacaattttgtaatgctttaaatcaactcttgtttgaaacaaagtctagaattttggtgactttcatttttggccactttgctgggtttttcattgagaagatgcgttgggtgttatataccatataatgttcagaatcttagaactatttttagataaggagagccagaatttggaatatttcatgacttcctcatttatgacttaaaggctggttgaagtttaattctttgtaagaaaaacacattagtga

SEQ ID NO: 14037 - DNA, 1065 bp, Homo sapiens
ttataaatatacaaagaatactacattactaaaattgataactgtaattttattcatctcttaggaatcagttgagctattgattccacagcaaatgtgttttgattaagatcatggcaagatatgtttgacagcagttccagattattagaatctagtacatatttaaagtctacattcatctgagattatatgtatctgatcttagttcagtgagatacatctatcaatattttgcttcaaggactgtattgtcaatgctgtgtaattaccatgtgttgtataaaaatcacacaccttcctagatagtttggagcatgctgtgatactgaacgcttttgtttatgaggattgaggttagatccgtgaatgcagagttgaatatgcttcacatgtgtttgcaacaggcatatatacagattgaatctgcactagttgaaagagtttaacagttgaagcttagttccccagctgtgaacattgttatttatggtgtttattatagttgtggctgtgaatgattctagaaaatcatagaaagatttccaggaaatcttgatttcttaaaaaaatcgagaatgttttatttttttcacttgtacgtgaaactaaaccgtacatcttgactttattgcatgtagaattattcaagaacaatataaatttaaagaaaaaccatcatgaatatatagtgatacttaaatgtgttaagtggaacacagacccagtcaggtttttatgatttatcagtttttaacttcaaagactctggttagcttccattttttaaactaatgagtttatcacagccagtggggaaaatggttaaagtatatcagctgtaaattggtacaaagcactaaaagggacattagcctctaatcagattctaacagttcattaaatctgcttttccagaatcgctctttgtcttttctcctcttttgcttgggccttccttataaggcatcttcttgccttctcatctgggcaagaactcctccagggtaggaagcaatatcagctcatccttcattgtctaccagccaaacagcctacagggtg

SEQ ID NO: 14038 - DNA, 1033 bp, Homo sapiens
ctcacaacccccaagtgtgtgcagtttttcagagtatgaatgacagaaatacttttctagtacaatttgtgtaaatgctggggtgaaaagtgttattcggaagctcagatgtcattttaaccatcctctgcccaatgaacaaaggaaagtaggcatgcatctgttgtaatccttaaaaatgtattgaggcctttggaaatgccaatagtaaattttggctcccagtttggattggattggttgcccttttgaaaagcatccatttgcaacttgaataagaacatctgcttttcatggctagttcagcaactatcactaataggaaatattttttaaaatattagtataaactgcacattgttgtgatagcttggcactttaccaacataggaaacagactgataattgctatcaggaaattaaaaattgctgcattacatagacagttttaccagtctttaggagagatactgttccatatgcttcaatgtgaggattttaatggaaggattctgtttttgaaaccgaagacaaatatttcagaagaatgtaatttggatcattgaaacatatgggggattttagttgagagtcccaataggcctatggttttggctcttatttctgttaataaaatacagttattgacattgatatccattctcctaagatgcaaaagaatgtaagatgaaaggctgggctagaatggcaaagtctgtgtttgaagggatgtttattttgtcccacttctggtactttgattagttatatgccctctatgaaactgagttatcagcatgaggatatgtgagtagagaaaaggatgtttttacacttagccattataaattaaatgtaatgctgagaggcatctgtcctgagtataaaatgtagaaggtgaagttagcgtttcattgaaggccatgaaaccattttgaaaatactgagtgagccaccaaaggcaagaatattttttaaaagctgggtagcaaatgaagttactggctaaattaattatgagatcttcctagga

SEQ ID NO: 14039 - DNA, 1841 bp, Homo sapiens
gtaaatgcagaccggcagaaaggcacttctccatacagtgtgggaaagctttgattggaagtatgtggttctgtgactgcacatagcgggatcgcccaacctaaatttggttggggttggggttctattgtgaagatttttcagtgcaaaggaaacttaagctaaaagagacagacctacagatgattagaggtaagccaaaggagggttaggagtggtggagaaagaacataggccaggaggaggtacggcacagttgaagaactgaggaaagactgattggatttgagagtaaagtgctcagagaaatatacctgttgaagggaagaggagcccaaagtataatgagacttataacctaagaaggtgtgtttgtgaggagctttcggaaagaaatggagatgatgagatttgcattttaaggaactctgagtgcatataaaaagcactggatcgagaaataaagtaggacaagagaattaaggggctgatggtgatggtgtctttagctgtgcctaagcttggctgtagacatggaaaaaaatgagtagatttggagcatgtttaggaggcagataaaatgaagatttcattattgagtgtatgcggggttgaacataagaaggaagtaagaaattataccaagaaaatcaggtgtggaaaatgagatctttttaagcctgtaacaaaacaaaattacaacacatatagtttaaagatctaactggattttatttgtaattatagaattggacaatacctcattctatacagtagaacgagtgttctcgagctgagcagagattggccttataggcagaaaagagctgaaaaaagcagaagcacaacaaaaaaagttacttttgaattacatactcaatatttagttagatttttagatgaacatacatcttttactaatggaataatagtttttaaaaataggaacgtacagtgataaagctacaataaaagttgctcttgagttttaagattcccttttactgatttattgaggattaataaatttacgagctaactgctaatgtagaactttctacctgatcctctggaaaattaagaaacctgtactgtgctcttaaaaagagtttatctactaaacaaacagcaaataatagtgttgcatttaaatctgtttgatgttaatccctggttctttatcatcacttttcatttgcagttatttgtcaactaggtttcattgtcaaataattttaagaaaatatcacaaattcttctttccctgagaaattttatatttgagtatattaaacagctacttttctactctaagttccaattgacttaataaagtaatcggatcacactttttctcagaattttagtgtcaaagtaatccttttgccatagcgtctctgttaatgactcatttgactggattttattattaaagagtttattttatgaaggtcttgtggatgctgcatttcctgacttcttgcatctttaaatatattttcttttatagtcaaaaggtatttggccttgtgaaattcttgagttgcacttagaaatctgtagacgatgctcctttgtcttctggcattgagtgttcctaatggaagggtgagaccagtttgacttctttgttcccccacataagtgaattgctcttttctgcctgaacacctgcagaattcttttttttttgtcttgaagttcagtgacttaaggatataactttttttggatcattctgtaacaatttttcctggaacactgtctgttatttcaatctgttcttcgtgttagggaaagtttatactatttttacttgaaatatttttctatccaatttt

SEQ ID NO: 14040 - DNA, 1028 bp, Homo sapiens
ggcctctcagagtgctggaattacaggtgtgagccactgtgcccagcctgcaacagttcctaaatagtactgtttaatagtcccattttaccacgtccgtactaactgtgggtgtctgctgacatttgaagatttttcaatctggtgtgcgttaaatagtgtctcactgtagttttaattgcattttgttattaatggttcatatgtttattgattatttggacttcagcttctttggaatcatttttgtcttttgaccatttttctattgaatggtcatcttttttggtagggatgatggggtagatattcaggattgattaaatgtatagaaattattttctctgagatggtagatttttactttttattttgatttaatatttagttttgttgaatttataaatatgtttaatgctttttctattcaacttcatcatgataattttatatcccactgggatatgtttagtaatattttatataggatatttgcatctattttcataagtgagattggctgtaacttttaaaaaaatattctgactgggttttggtagctatgttagaatctttttctatcttttggaagaatgtgcataaacaattatctactctttaaggatttggtagaacccatttatctgggatgagtggctttttgtgggtaaaatttgaacttaaaattcaatttttaatggtaataagaccaggttttcagtttcttcttgagtcagatttgataaattgtatttggtttattgtaagctttcaaatgcattagggtaagattgtactagtttgctagggctgcataacacagtaccacagatttcatgacttaaacaaccgaaatttattttctcacatttctgagggctagaagtccaagataaggtctcagcagggtggatttttttctgaggccccctctctggcttggaaatggctgtcttcaccctgtgccttcacgtggtcttttttttctgtgtgtctttgtgtcctaatctcctcttcttataagaaca

SEQ ID NO: 14041 - DNA, 1050 bp, Homo sapiens
cacttaatatgaaagtgaatttatttttattaaaggcttttaatttgttttctatggccactgtaacaaattaccacaaacttagtggttttgaaaaaaaaacacaaatttatcttacagttctggtggtcagaagtccaatggtctcactgggctaaactcaaagtattgggaggattatattcccttctggaggtcctaggactgattccatttccttaccggcctctagagcctactcaggttccttggtccattcaactccagcagctttgggccaagtccttctggtactgccatctctctggttctccccttctacctccctccttcacatttaaggactattgtgattactttggcctatcctagataatccaggatgatctccttattttaaggtcaggtgattagcaactttaattccatctgtgactttcattcccctttgccatgtaacctaacagatttcagggattaggacatggacatctttagggggccattactctgccagccacaggttttcaaaaacgtaagtgactgtgattgcaggtacatgttacctttgtcataaacatgtggttgggaattttgaaagaattctcattttgctaattccattaatagtcaagcaaattatgatttatgtcaatcaaaatataattttcttccttcttgtgattggaagaaaaaagtccattcaaatcacttttgcagctaaatgaagcaagtgataatattaaaatttcccattataaaaaatctaataaatatctaattttttgcaaacagtagattgtttaccacagtttcacatggtgatactatggttttatgtgccttcaaagctagatgaactacttttagaattcatcagaccttttggcctaacaaattttcctttgtttttgaatgttgttatttgtagcgtatctgataaaactgaaatctagtttcaggaaacatgtttggttatctcgttaaaagctcttgaggtgatagcatgcacttacttacaacccatacacttactaagacatcctgtat

SEQ ID NO: 14042 - DNA, 1060 bp, Homo sapiens
tttatttttttatttgctttgccctttttcagtgggttttaaaagaaggctgtaaaaatgcctttacattgccattttgaataagtaaccttttaaatggatttaaggggcacatggagaatattgaacttgctgtggtgtttaaaaaaatgactttgtactcagattgtctggtttccatcctggttctgccagtgttcaactttgcttgtatatttcagttgccatgtctgtgatatggcaataacagtaatagttcctactccataaaattattgtgaaggttaaatgagaaaaaaattctaaagcatttgcatattgcctggtagttactagtgctcattaaaatagctgtttttatcattttaagctgtgttagtcatgtttacagtatagtcagtttagctttaggaaaattggctacttagaccagcatttgtatattttatttcctttgactgaagagcatgctgggatgggtaccaggtgttcttcttatatggcagcttctggtgttggggtctgactggggacttccaaattgttctactctgtgttgataaagaatagaatcatcgccaattctcttggaggaaataacattggatatgctgtggtagttggggcatatgttattggttcacttacagaatgttggcaacttctgtcctgtggtgttgcaaacactacaattcaaacatatatttagcatttattatttgttagacactgggctagaaagacaaattgtatttagactctgccttgaagacttcattatctcagagatgggcagataagtttctacagttgtatgtgattggtgccataatatatttattagagccagggaattgggatgtgggttctggaaggcttcacatttaaagtgacatttgagctagaccttgagttgccagtatgacactgactgtaagaaatgggagcagccaagaaaagttagtttagaaaaaattcttagcaaatgcaaaagggtgtattttttctttgggcacaaaagtgccctgaaaaatttcttcttaaagataaatgtgtgata

SEQ ID NO: 14043 - DNA, 1035 bp, Homo sapiens
attttatctgtattcattgcccagtccacagatcatccctcatccatgatcagtttacacattttctgtttaaaaaaattatcttaaagttggctttcctagagtaatgaattgtcaacattatcataatgggagtccactcctattaatcagaacttagagaccacatgttgtgttcattatccagaaaatgtatcaagttgcaaaacttaagtagaatgctaaaaattgggatccacagtattaatgagctaaaaattgacaagtgcatcttagaaaatgcttctgtgagcaaaaaaaatttgcaggctcatacgcaatgaattggagtgttcaacacggtttaattggcggctgtggatgtcttgtgcataattgaggttgtaaagatggatgcatgtggtaggcatggggggtctaaatgggtgagtgtgtattgtaagggaatccgtcccttccgacatactgcaggctgggttgcagatacagtgatccatgtttatgtaagcaaggtggaaacttctgatctagaagggaaaaaacaggtgcttttgtatgtttttctttcaggaaatagttcacattttccagaaagaaaagtttttttttttttttttttggagacggagtcttgctctgttgccttggctggagtgcaatggcgtgatctcggctcactgcaacctccgcctcccaggttcaagcagttctctgcctcagcctcccgaatagctgagattacaggcgcccaccaccatgcctggctaatttttttattttcagtagagacggggtttcaccatcttggccaggctggtcttgaactcctgacctcgtgatccacctgcctcggcctcccaaagtgctgggattacaggcgtgagccacggctcctggcccaaaagaaaatcttttacgcttatgtgaccaagataaaaacagacaacatggtcaagtttacacttggtttataaatttatcaaaatgagagctgtcttgttggcataaaacagaaggcactttttctacatcctc

SEQ ID NO: 14044 - DNA, 1045 bp, Homo sapiens
aaatttacagaattaatgaaaacatagtatctcatgaagggaatctgtttaacctcatggagagatttttcagtctgtccgatcttatttatcatgtgtggaatctttttgccctttcttttttgtattaatattggaataatcttgtgaaagatccccactaaactttgctactttcttgaatccttattcctatttccctaggtttcttcctactttgctgtgtctcctgggatattgaggtactagaaaggcttcttgcccatagagattcactgtgctgtctgttttaatttgtgcctcagttaatgcttttttcgtattcatttaaaagctttatgagttcctgttctctgaagcatagatcttatctgtctgattgaatgacacattgcaaatatttaatatttcatatttatgaagacctgctgaattattttattacccttttggacatacttatcggatctgtcttaattgatgttaagactcggcaatccattaagtcgttgagtcaattcacattcagactgtacctaggattcttatggtcctaactccagtgattttcaacacagctcaatcaaggcagatactcttctggttttgcttctaaaaagaagctaaaaagcaatctttgggacactctgaccttttaatgtctttgttacggtaaaaacatggagtgttacctggcagggtgaaatgctaccaggtcagatacattttcaagattgggtccttaacgctgaatgcacgtgtgaccttatctattcagaattggccagtagccagtggccagtagataacctcatttttttttttttttttttgagatggagtctcgctttgtcacccaggctggagtgcagtggtgctatctcagctcactgcaacatccacctcctgggtccaagtgattctcctgcctcatcctcctgagtagctgggattacaggtgcctgccactatgcccagctaacttttgtatttttagtggagatggggttttaccatgttgggcaggctggtcttgaactcctca

SEQ ID NO: 14045 - DNA, 1028 bp, Homo sapiens
cacagtaaattacttcagaacaaccccaaagtggaagaaaatacttgtaaattgcatttttaagcccttaagaacaagttctatcacttgtttaaaaaaattgttttgtaacatgaagtgcattttaattgtctgactatgaactcttgccttatgggctcagtcactaaagatgcttaagagaaaagcataaatgaatacttgattgatcataaaatcatctacaggatgctgttttaaccacttccgaaacgatctaaaagtgtacacagcttcatccctttagagacttagaaaaagtccagatacatcaaccaaatagagacaaatatagagaaaatgagagactaagttttgagtgtaagaaattaactcattttgagcttcactgatgaaaagcaagattttaaaacaagaggtgctccatgatgagtcgttttttacaataaggaatgaagcaaagcagacactctttaacatgggtgcactcaggggtcagggctatgaaagctgccagaattcaaccctgatttagcaatgagaagccagagacaggaagctgccttgtttattagaaatagggtaaccacagtctcaagacaactgaggaagactctgctggcacttttcttctgaaagcaagcactagtgcaaaaaaaccccaccaaagtatgtagtataggtgtttatatgtgactaaggcttatgtattcatatattcttttgtttacttcttaaaatttatggttagaaaggcacaacttttatattttttccagttaaaagtttcagaaagctatcatataacgtcaaggtataaaaatcatgtgtgaccttgatttctacaatactttacgtattcaaagtagttgaacctttatttaggaggatgcttccttcaaattaaagacttttgctcagagagtgccaccatgtttcagtgggaaaaggatcagattagcctcgggatacttggaagttatggcagaggttgcagagtaatttttcattatttgctagaacttggg

SEQ ID NO: 14046 - DNA, 1061 bp, Homo sapiens
ggtctaaaatttgatggttagtacagtcagcatcacaaactactcagcctatttcattcctctgtgaattattgtgtctgtaatgacatttataattgacctttcagcattcagaatctccattgtgtctttgtttattagcctctacagcagagagacatgataactcttaatttcagggtcatgtctctggactatgtccaaaatgtccctggttattataattctggactccaatgcttctttggatgtatcatcaacaccaaattttgtaagtcactggattaacataaacaaaacgattgcagccacccatgtctcattttgctaaagttatgtgactttataatacttaatattgagtgagtgaaatccacgaagacactgttcatgcctgtagaaaatcatatgtaatacctgctacatgcaaggtactaggcaaatgtttatggaatgaacaaatcattgtatggtaaaatgcattttaaaaatatacagttatatatgagcctatgtgttctctgagaatccctgtgatgtttttcttggtgatggagaggggtggttttccatcatcaccattgcaagatggcagtggtatttagatgctgtttgtaatggacagatagtgagaggaactgaggggtgctgggaatagaatgtttgtgatttttttcctcttttggggacagggatattgcaccccttttagaggaaccatcttaaaccagtgaaccaaattattttattagctcatgtctatagaatcatatggaagcttcttctttgggcataaattttgtgtccacagggcactgaagcagttaatctaaatgctgtcttttggaatcaaagggcagcttgggcacagcactgaattaggaaactggaacatcagaaagttctagttttcttgcagtatttttttgctagtatgtggtaattacaaaaggaagtgaaaaactataagggaaaattataaatactaaaataaaatttggtagtctaatacagaacaccttttttagtgcatgagtaccttatactgtaaaaaaaatttc

SEQ ID NO: 14047 - DNA, 1028 bp, Homo sapiens
actcgtatcttaatttctttaagctactacttgtttctttgaatccatttcggtttgccattcagtcatttcttttttttcttttttgagacggagtctcgctctgtcgcccaggctggagtgcagtggtgcgatcttggctcactgcaagctccgcctcccgagttcacgccattctcctgcctcagcctcccgagtagctgggactacaggcgcctgccaccacgcccggctaatttttttgtatttttttttttagtagagacggggtttcactgtgttagccaggatggtctcgatctcctgaccttgtgatccgcccacctcaccctcccaaagtgctgggatgacaggtggaagccactgcgcccggccccagtcatttcttaaaacttgatgaagttttaaaaaattttagtcttgcggattataggtttaacacctgccatatgaaatagcaattgattcattttctttatattatttgtatttgtctcaggttttaataaaatactcctgtgtgtactgttgccaggatgagatggacaaatggtgttataaaattcttggcaactaggattccatagattatttagtttatgtttctagactgaaactccatattatttttatatagtactctccattctcatgatgaataaagtgtaagtagttgtcatctttaacatgcattacttattagggtgtggtggttaacattatgaagagcatcacagttctgtaaaggtaatttttgttttgagttctatttggtaatgcttatattttgttgatatttgtgttgtgttaacagtattagagagctgtcttctataagttgttcatagtgactgttggacccacttcctgtttattcacaactgccatccatgttcccacaaacttcaatcaattatttttttttcctcatgaaatatcttttacttatctataagggaaatgttacagacccaaccccagagtctcagaaggtctgctgcattgcccacccagggagctttaaaact

SEQ ID NO: 14048 - DNA, 1450 bp, Homo sapiens
ttagtctttggggttcttccctcacactgcattcccccctcaatccttatactttgtatttgggccatttgactccttattccattttgcaaatagtgtattttgtggacatgtgtgttggtgtgtgcctgtttaaaaaatattttgtttggtaaccctttgggtataccaatggagcttctgtgtggccaccactagaacaaaacttcctaatttcagtgtcattaagtcagcagctggtgcagctgaactcaaagaaacaagcatagttattgactgttttctctaaaaacagcctgaacaaagcatttccttaagcagcattgagcaggatttagaacttcctatgcctcaaaaaagtcttagagagatttacggaagtacaaaggtcaacattactgcatgtgattccactgtcctaccctcaatctatggcaaataactgattttttaaaaaatcttgtattttaaaatcatgtgatcagaattcctgagcaaaaaagaaaaaaaaatcagtcaaatagatggctgtattagtccattttaatactgctatgaagaagtacccaagacttggtaatctgtaaagaaaaagaggtttagtggactcacagttctacatggctcgggcggcctcacgatcatggcagaaggcaaaggaggagcaaagacacgtcttaacgtggcagcaggcaggagagcatctgcaggggaactgcccttataaaaccattaaatctcatgagacactcacaatcatgagaacagcgtgggaagaacccaccgccatgattcaattacatcccaccgggtccctcccatgacatgtggggatcatgggaactatagtgcaagatgagatttgggtggggacacagcaaaaccatatcaatggtcatattagctacttcttgacaaccttcagcagtgtctgaggagtgtgacaacacagatgctgggttatttaagaaaggagagtttcaaaaattgtagcttacattgtagtcattgtgtgctattttttgtatgtatgtatgtatttatacacacagaaatggggtcttgctctgtcacccgggtggcgtgcagtggagccatcacagcttgcagctcaggatccttctgcctcagcctcccaggtagctgggaccataggcatgtgccaccacacctggctaactttttaaatcttttgtagaggaccttgctatgttgctttggctggtcttgaactcctggcctcaagcaatcctcctgccttggtctcccaaagtactgggattataggcgtgagccactgtacctggcagattgtatgctatttttaacgttgtttagtttcttgtagataatcttttatatatatatatatatatatatatatatatatatatatatatttgtatttcttaattcttaaaaagatcttggaaatagtagacatttagga

SEQ ID NO: 14049 - DNA, 1055 bp, Homo sapiens
tgggattacaggtgtgagccagcttgcctggccgaaaatatttttctttatgtgaatttcttttgttcttgaatcaataattttgcagcaaattacttttaattaggtaacaattctttggttttacattggctcttttacaagctaatgggcatgtacagacatttttcatttttagaccaacccattgtttgagggggctggaacatgagacactatagttgtctacgtagttgaaattgatagttttaataattaaataaggtgacttattttctgacattctctggcacgagtaatataggagaataggttattgtaaatctatggaaggaggcgttccatgcctgtatgcaaagatatatatgtgtttctgctgttgcaataaataattcaataaaacagaatagattttattgagcatggatcataaactcaggggtagggatcagtgtattctagtgcctaggatgatgcgttgctcatggcagatccattgtctgttgagtgaatggttaagttgataaataacatgtctactgattgcttagtaccatgtgatgagcttcaaaggacatagaaaaaaatgtaatactattaagcatggtccttgaggtaaattaggagtagaaacaaaaatcagtacatatttagggaatgattagtcctgaaatctatagtacttaaggtaatttttataaaagacgagatgaaagaagcatcagcagtgaaaatgtcatcttttgattactgaatacctattttacaccatttattgtgctaaatgttttacatgtgtattatctcagtggaagtttcatgacaaatctgcgagtaccatccctgttatttttctgtaatgtaatcaaagtcagtatcttgcttaagatcacctggcagttatgtggcagggctagattatgagacctattttatttgcctcttttactacactgctgtttaattggttgactagttttctagaactctctggaccagggttggtactggttggtcatttcgtaccagaggctttctgaatgtttgcacaccca

SEQ ID NO: 14050 - DNA, 1092 bp, Homo sapiens
attagtcatcagggaaatgcaaattaaaaccacagcgacccaccagtatacatttattagactctacatgcattttagaatcagcttgtcgattttgatagagaagtcagttatgattctggtagggattacattgaatctgtagattaatttgggagtagattcctcaattgtaacatatgtaccactctgatatgggatgttgataatgaaagaggttatgcatgtgtggaggcagaggatatgtgtgacattttaacaatcttgagtcttccaatctgggaatacaggatgttttttctttcattcagatctttaatttctttgaataatttttttgtagtttccagagtataggttttatacttcttttgttaaatttattattaagtatctcattactttttatactattataaatataattgttttaattttgtttttggatcgttcaatacaagtatataaaaggtgtattgatttttgtatattgagttagtattctgcaactttgctgaactcatttattagttgtaatgtattttcagtgtattccttagaattttctatatacaagatcaagacatctacaaatagagttttattcttcctttccaatctggatgccttttatttctttttcttgccttactatcctggctagaacttctagcacaatgttaaattggagtggtgagagcagacatgagtattttattcctcatcttaggggtaaagcatctatctttcacctttaagtatgatactagccatggttgtttttttttttttttttttccccctgcatgttacgtcgtgtcaaggaaattcctttctattcctagtttgatttatgtttttttttttcaataaatggtgttttgtcaattgcttttattgcatctttccatatgatcctgtggttttgctatggtgcattacattaattgattttcagatgttaaaccaaccttgcgtacctgggatgaatcccagttggccatggtatataatttaattttttcatgttgctaggtttggtttgctattttgaggatttctgcatccatataataagaaatatctgtttgt

SEQ ID NO: 14051 - DNA, 1049 bp, Homo sapiens
tgattctcctgcctcagcctcccagatagctgggactacaggcacccgccaccacacccagctaattttttcttttttggtatttttagtagagacggggtttcaccgtgttagccaggatggtctcgatctcttgacctcgtgatctgcccgcctcagcctcccaaagtgctgggattacaggtgtgagccaccacgtctgggtttttttttttttaaaggttgctttgttttagagcagttttatgcccacagcaaaattaagaggaaggcaaaaaagtgtcacacgtaccctctgcctccacacatgcataacctccttcattatcaacatcccctatcagagtggtacatatgttacaattaagtaatctacattgatgtattatcacccaaaataaatagtgtacattaggattcactcttggtgttggcttttcatagcttttagacaaattcacaatgatacataaccactaatacactatcatacagaggtttttttttactgccttaaaatcccctgtgctcttcctgttgatctctccctctccctaatcctggcaaccactactccttttacatttatagtcataattgctaaaagtttagaaacaaccaagatgttcttcagtaggtaaatggatgaagaaactgtggtgccttgagacaatggaatgttattaccactaaaaagaaatgaaatattaagccatgacaagacatagaggaaacttacatgcatatcactgagtgaaagaagcccatctgaaatgtcttcatactctatgattccaactgtataacattctaggagagtcaaaactacggaggtattataaaaagatcagtttaactttttgttacttgtggttttggtgtcatatctaaaaatcattgccaagtcataggtctttaaaatttacccttgtattttcttctaagaaatttattgttttagttcgaatgtttgttctttgatccatttttaatttttgaatatgttatgaggcaagggtccaaagtcattcttttgcatgtggatttcc

SEQ ID NO: 14052 - DNA, 1087 bp, Homo sapiens
aaacgtagttcttggagattctttagagacaaaattaatcctgaacttggtattttgtatttctttttaaattgtattcatatactgcaacgtgagctaggtcttttctccttattaagacttggaaactgtagttcagagaggtgaagtaattttaatttacccaaggggaaaaaaatttggaatttgaacttggaagtgtctgacctgatgtttctaacaaatccaggcttttaactcctttgtttcaaaatgtcatgctctgtgttgagcacataataaactagattataaactgttttccacctttttggagctctctgtgcaggcatttattctgttaattctctgtcacacctgagaaggagatgcagtctgagaaattggcattctatgtatctcccttctcatttcattgtgatattcaatgatactagaaggtaatttttttcttctagtaagcagtaaccacgttgtgaaccaaggataaaaggaaaatgacactggtagagttttctcgtcataggtattacctagtttcctaggaaacagaaacatgatttatgaatattgattttcaaaagcttaaaagaaaccctaggttattgtttctgccattaaaatagtttctctgaagagatcaacttacgtaattgaatctcgaccacattttatttagtgtacatcttgcatagtagatgattctgtgaggtttgaattgaagttcattgtgattgtaatctttggtccctgtctttgttttctgtgctggagagagaggggatttcttcctgtagttatatgtggtctagttcacttttagattttctgggcaccatgctgaatatcagtgaaaggggcagtgggtacaaaagaaggtaaagataatttacgatgaagcttagagtttagttagaatgatgaactcttgtagtccattttgtggaaagcttttggaattgcttgaacttggtacttttcagtatcagcaattcaaatggaagttttctgagctttctaactaaaagggaaagaggagaatcttcagaaagagcctatgtgcactcaccagcaaataatgtgatgg

SEQ ID NO: 14053 - DNA, 1045 bp, Homo sapiens
tcatagcagcccaaaaaatgtaagacagcatctttaattttttttttttcctttgagctcttttgaattggacctgactttcttaccaagattttaccatcataatatagaggaagcataagaaagtctttaatgaattgtttggcttggctgtgggcagatagatttgagttactacacaccttactgtctttgcaaatagagtaaaatacctaacaatagttgtgttggagcaggtgtctaatgatcatctgtttagcccagtgcagtcatctgttttctaggcagttacgttttgttgaatattattaattcatggtcttgataatccagtgaaaatgcagaattcctgtgaacacagttgttttaagtatgcactgatttttatctccagaaaatagcattattgcttagcaataagatgaatattttgaaaacattccaagaaaatttataccttgaagtatagtgttgagtaaaagaagtgggaattcagttacaaagttccccagattggtctgaattttattatggtagaaactattaatttcctcttgtagtgaagtatattaatcacaatttcaccagtatttaaagtaataaatgatgtttttagataattaaattttaaatatttgacaccacttttagtgtctaagatatccagttaaaaaattggtacagacagctgttgaattacctgtgttatcaaaatgatctcaaataccaatttggatgggtacctgtttaaggctctccaagcatttcctgtttacaggtaaaatatacatggagcctttaatagacagtaggcatcaaatgtgattatgaaatataattgactgagagtgtcttgaggacagtcacagtgctttataaatagccttgaattcccacttaatgtggtataagctatataggggaagggctcaattaagttggtgaagttcaattacaccatttctttttaaagctgacaagaaattgccatgtcattgctaccttaatttcattacaataagaggtgacactaagaatatcagtg

SEQ ID NO: 14054 - DNA, 2033 bp, Homo sapiens
tacaactgtgagagaataatttctgttgttagtcatcaggtttgtggaaaattgttagggcagccacaggaaattaatcagctcactatgggcaatgtattatgtgaaatgttagtggttataaggtctttgctaccaggaattcaaaaatctttgaaaagtaaacaaaaatataatacagtattacaagttctataaaaaataattgtacagaaagttctgaaagctttgaaggggataactaactttgttaatttggaggatttagaacagtggtccccaaacccttttggcaccagggctggtttcatggaaggcaattttcccacagactgggaaagagtgggaatggtttctaccttagatcgtcaggcattagattctcataaggaacatgcaacctagatccttctcatgcacagttcacaggtactggtccatggccccgggggttggggccccatgatttagagtattcattgagaaagaagcatttcttctgtgtttgaatgacgtgtaagactatttctggcaaaaagggagtggaggattagagggagggggacatgtgtatgaaatagcacgttatgctcctttaaaccccatctgtgagatgaacacccatctaaaacttcagtattttcaagtattgagggtagatcaatttctggaacccacgttgacaacttgatgctgccatatctcagattttaatagtgtgtctctgctgtaaatattattaaagatattttaaaaattgcctttcattcatacttcatccattaatcttctgactcaatctctttggcagcttagagtgtagtatgatgtcagtgacccacatataagaccttaattataggcatacctcagagatactgtaggtttggttctagaccactacaataaagcaaatatctcaataaagcaagtcactagaattttgtttatttccccaaagcataatagttatgtttacattataatgacctattaagcacaaaatagcattgtgatgaaaaaaaacctacatgccttaaattaataatacttcattgctaaaaaatgctaacattcttttgaactttaaatgagtcataatctttttgctggtggagggtcttgcttggatgttgatggctgctgactgatcggggtggtggttctgaaggttggggtggccatggcagttcatcagtgttcacagcatcttcaccaggagtagattccaactcaagaaaccacttactttgtttgtaagaagcaactcctcatccatgaaagttttattgtgagattgcagcaattaagtcacattttcaggctctacttctaattctatttctcttgctgtttctaccacatcttcagttacttattccactgaactcttgaacttctccaagtcatccgtgagggttggaatcagcttcttctaaactccttctaatgttgatattttgacctccttgcataaatcacaaatattcttaggacatctagaatgatgaatcagttccagaaggttttcaatttactttgcccagatccatcagaggagccactatctatggcaagtatatctttacataacgtgtttcttaaataataaggaaagttgaggtaactccttgatccttgggctgcagaaaggatgttgtgttaggcatgaaaacagctttaatctagttctacatacgtctgtgtcagagctcttgggtgactaggtgcattgtcaacgagcagtaatattttgaaaggaatcttttctgagcagtacatctcaatagtaagtttgaagtatttaataaaccatgctgtaagtagatgtgccattatccaggctttgttgttccatttataaagcacaggcagggtagatttagcataatttttcagaatagtgagtgagcattggcttcaatttaaagtcaccagatacattattccctaacagtcagcctgtgctttgagattgtaaagccagtcattgacttctcctctctaactatatgaaagtcctccatggcgtc

SEQ ID NO: 14055 - DNA, 1022 bp, Homo sapiens
tttttcatttgctcgtgttttattttttatatttcaaaaatatgcattgcttacataagctttgatcttatgcatagctggatttgatttttaagagtgtttttgtttgcttgtttgttttgttttgtttaatgggataatggtcattagcttttttcttttcttttaatgtattcatctgatactggtttcagggtattcataacgtcgtataatgagttgggaagtttttcattctcttctattttttggaatactttgtgtagaattggtactatttcttccataaaagtatgggagaatttactggagaattctatattgttctatattgttactgattttttgactccttattctgtcagttattgggaaagtattgaagtacagttgtgaatttctgtaattctcttttcagtgctgtcagtttttgctttatgtattttgaaactctgttattaggtgtgtgcacatcaggattgttgtgttttcttagtgaattgacctctgttcttaccatctctaacttttatttggagtgttttggcaatttaatgtaaaatactttttgtataattgggtttctggaacttgctatttgttttctatttttctcttttgttccctcatagtcacctgtatcttgctctatttgggcttgattattttttagtattttatataatcttctttattggcttattagttaatctgtttgttttgtatttttagtagtgactctaatatacatcattaacttctcacagcctaccttcaggtaatactttaccttactgtatgatagcagaatcttagtatattgccatttttttctctttcattgtttgtgctattttcttcatatattttacttatacatgttatagcctatccatcctggctactgtgtttgctttaaataataagttacctttaatacagattcaatatcagacaaaaatatgttttaaaattcttgctcatatttttgctagttccagggttttttttatttctttatg

SEQ ID NO: 14056 - DNA, 2063 bp, Homo sapiens
gtgggatgggatcctggagtcaaccctccaagggtactgaagaatgactacatactgtatatacatatatattcatcatcttatatatctatatgtgtatgtgtatatttagtatttatctttatatgtttttacatgtgtttttgtagtctatatctatattagtacataacccacccacacacaccatacacaagagcaagaattacagtaaaatttcatgaccgagaaatacagtaaaaagccacacgtgtgtataaaaaagggggaaaaacagtctttaaaaaaaattctatctttagtaatactgtgctcactttgaaattatcgagctaacttgtaacaaaagaaaaacaaccctgccttaaagaaaacaaacctaaatggcaaccaagttaaattattcgaaaacaatgtaaagaaaaccttccttcatttcacaatgaatggtaacctctaagatgatacatccttgaatcacaactaatttcagtggcagaaatatctcagttcgattcttactctcttgcttgctaactatggatgaccttggtcaaatttcttaacctctctgagtttatacaatggaaaaaataatatgtagtttacagggctgtggtgagggttaaatggggtaatgtggccaaaagtcactttgtaaaactacaaagttcttgtgtggcaactgatttgataggaaaagcactccagccatacctccaccgcccccacactgccctcccctgaaagggataaactttcctgtttctcaaagtgagcatataaattacacttatggggaaggaatttccgagtgtgggtagaaaactctggcagtcaaaggtcatgaattccattcctgtctcaccagagatttgctctgtgaccttgagaaagtcactcttaaaaagtttcaacgtagctggtataaaagttactgattattaacatttatataatacaggtgaagtatccaagcttgtcaaaagaaaaacacatgaaattacagttcacatgatcatttacagaaaattgaaaataaagatgaacaatgattagagattgaaaatctgcaggctacttctttaatgagtcacctgaagcttctatcaactggtcattaaaaagaatgcccttaattttaaaaatagaattattaaatttgtgatatactataatttcaagcagtacattgaactgcaaatccccagttaaatcaagattgtgttgattaagctatgtctgatttatggcttaaaagtcacttggttagactcaaacattgttgcaacatgctatatgttattcttaactaacattatacaaaatgcacaataaaggtagataatgaggatcttacacgttatttgtacatttattgaatacctatttataatcacgcatgatttctccgcaactgcattttctccagttaaaaaagaaacaaaaacaatttttttaaacccttgcaagagcaaagaaacaaactcaaactatctcttcaatataactgatttagactctttccatgttacaggtatcttgcctgactccaattcatgttacaattatcactgcaaacatcagcatcactttttgtgggactctcttatttatcatcccctgctttaagaatacactgtgttccggttggtattctcgggccccacaactcatagtattccttctggtgttaattgcttgttgatttgccttgttctaaatgcccctatcatggtcttttccaccctaagtagctaaatatattcaacgctgtcaaccattcctcgattcactttatttccctgaaaaaattttttatgtcttcttgcaaaaagaaatcttgtagtatagtagaattaaaccatgctgcatttataaatatttgctctagtgtattgatggctctcttaaaagctgccattcaggccgggtttggtggcgtgtgcctgtattcccagttacttgggaggctgaggcaggaggatcccttgatcccagagttcagggctacaacgagctatgatcaattgagccaatgcactccagccttgaaaaccctg

SEQ ID NO: 14057 - DNA, 1034 bp, Homo sapiens
caatgcagtcagctgaactttattgtggaatgctttttattactgtttattgaaaaaaattgttgtgctaatgagtccttaatattctccacctcccactccccagaagttctttttacagcaatgactatcatttgggagtaaatggtcctggtatagcatttgagaccttgaccttagcaactcttggctggtggttgtttactacagctgcagcctatgtgtgtgctgaaagggaaggtctgcaaacactagtgtactcactctccccaggccaaagggagaacaaatcgggatgcttgacgttcattctgaagaacatgcatctggcctgtaatatccatcgtgttctggtcatgtgaaaatatacatgttgctcagggatattttccctgactcctgttcagggaaagtatgcactttaacaggctccagtgagttttagatgttacagtatatcatgaaacaggctgttatcaacttactgaaataatttggccttaaatataggtgtgttttatctctgcagagacaacgtaagtgcttaggcctctaggcctatgctgagagcattttgaattcaagccagtgttggttaatctagagtttggggtaaccttacccagtgaaggcatattgttaagtagatgaacatatagaggtcctggacattttttccattgtacaacatggaaagcatgggactttatgtttttgcaaattaataatattacaatgatcacattaaattggagtgtcaaatggtttgttttctttatattgtgagagaagcagtcaagttcataaatctagctgtagattgtgtattaaactataaaactagtaatggcacaaactcatttgaaaagtttttgtttataagtttttctgcttgccacttgcatgctgattaatgaacatgagctaaaatcccaagacagttttattcaaaatcaacaccattattaccttttctgcttagaaaacagctttttttttttttttgagttgaggtctcactctgtcacccaggc

SEQ ID NO: 14058 - DNA, 1025 bp, Homo sapiens
ttaatgctaaatttctaaaactaaatcctagacattagacaggagtattgatcaaagctcaggcagccaacctttgcaggcaccaatcttttctccaacattcttctaattcctgtcaatcttggctgatgatcacagcagcagccattcaaagtgagaagaactgttccctcttgagctctatggtccatttatggccacctcaccttttctttacttattcatagcacagctgaggtaaagcctgcatatttcagcgaggtttattaataactaagggacaaacaacaaaagagaaataaacacacacacacgcacacaaacacacacacacatacacgcaaaccatggcatgtgatggtgtgatttagaccatatatgtatttattctgtttaaggagtcacttccctgtctagctccgagcctcacatcacacggaagaggctacctataaactttaccaccttagaagcacagttgagaatttctagattcagcaggcaatggacagaatggttgtgatcatgggctttgaggtcagttagaaatgagttcaaaacccagctttgctatatttctgtgtagatttcagctgtaagtatctataatcctctgaaaattgcattaataatgcctgccttattgggttgttctcagaattaaaagaaataacaagtacttgccacatcacagaccataactgcacaataagtagtattaatgttatcatccttataacaatgatcatgtaaaagcataagagatatcaaaacccaaggtgaatggagttatctcttgcttacctagagcctaccatccatactttcattttctgtctcatggcctgttttatcctagttaattggtaccaagaaagtccactccaatcagtaaagactatgtggacatttagcaacagcactactaaaaggcaaaaacaaaataatccactcagtaaataaaaacacacaatcctgcatgacatatacatatatggaatgcatataattatgcatgaagggtt

SEQ ID NO: 14059 - DNA, 1291 bp, Homo sapiens
aaaatttaatttaggacctaaaatgtctagattagctttctgctttttttatttgaataactcattcagttgtgaatgaattcctctttatttggtgccacagtcaccaaatgacaaggatttgccactttcccaccaaattgtgagtgcttgtaatttaggtctctctaccttaaattcagtataaggaaacgtaattatgattgattttttccaaagatgacaagctgtgttgaaatacattttttcttttgaccaattgacagaatctaataagctttaataatcttccccttttatgtgaaaagttttgagaactgtgaaatgtttaggaacaaactgttgaaatccattggaagggaaaaaagaaagtggtaccagtgttaccagctcaactaaaacctgcaattctgcatttcaactcttcacttcctcagcctacaaatagctcattagatgacattcacgcatgctgggtataggcaaggaaagtaattttcaaagtacatttgcagttctctttttcagagatgattctatgatagtgcctctgaaagttgatgcagcatttttgcctttccaaaaagtatttatcctcactgctttttgcagtacttgtattttcacagatggattatctggggtaattttcttcaaagggagtttgttatacacagtgaaaatgtattatagagtagaatagtaaagctctaggggtttcagaaagctttgatgaacagatgacaaacatctgaaaccccctccgcactgttacccagtgtgtatataatgacttgttatagctcagtgtgcccttgaatccatacagtttcttaaaagacaataaaatcttattaataaagttaatgtaacttctaagttctagaaaatgctgattctgtctgccccattcaattgggggctactaattgatttgttgcttggatttcctgagaatttctctatttgtaggaggggttttttctttttacggtctgttgatgacaattactttatgggtgtgatgcaccgatggtagccaaggaatctgttggggaagttcggaaagaaaccttttctttcttttattcagtttaaagtaaactttatcctggatgtttagaatcaacattaagagttatattatggtgttcagagattaagctgacttggatacaatattttcttttgaaaatgaattttctttttcatttgtgatttttaaaaaatgttgcaccagttatgcttcatgcatcgttacatcttcatcaggttaatgtaatgtctagtt

SEQ ID NO: 14060 - DNA, 1131 bp, Homo sapiens
ctcttttagcactgcaatagtgtcaggaatctcctgtttctccttcagccaggccagatcccactcactcaggggaacaccagtgggtgtagaataaggattcctactgttggtgaggggggtgatttagtattgaattattcgtgtgttcagtgagaagagatgaagcatggtagttccatagttacatctttgtgaaacctaataaatcatcgtttcctgtaggttttcagagtatttgcttcacataatattttattaagtaatttgaagtaattggttaatatgtgtaaggactgtctcctactataatgaatcatttgatttggaggattttttcccccccaaacaggtagctcatactaaaatccaggccttggaatcaaacctggaaaatcttttgacgagagagaccaaaatgaagtctttaatccggaccctggaacaagaaaaaatggcttatcaaaagacagtggagcaactccggaagctgctgcccgcggatgctctagtcaattgtgacctgttgctgagagacctaaactgcaaccctaacaacaaagccaagataggaaataagccataattgaagaggcacggcctcagcagaaagtgctccttagaatactacagagaggaagagcctgcatgtcgctggcccaaggctggaccctgaagctgatggaaccacctaatactggtgctgagcgcctagtcacagcaggtggacctcgtgctcatcagagcatgccaatcctaagccattggacatatgtagactggtttttgttgttgctatgtacatataaatatatatataaaatgaacatagttcatgctttcagataaaatgagtagatgtatatttagattaatttttttagtcagaacttcatgaaatccacaccaaaggaaaggtaaactgaaatttcccttggacatatgtgaaatctttttgtctttatagtgaaacaaagccagagcatctttgtatattgcaatatacttgaaaaaaatgaatgtatttttttctccaaagaacagcatgtttcactcaatggtgaaaaggtggaaacatttatgtaactttatgtgtatctgtcttgatatctactgacattgtctatatga

SEQ ID NO: 14061 - DNA, 1028 bp, Homo sapiens
gactagtgtgcctggtgatgcattgctccatgttgcctgtggcttgtgcttgcccgtgacagaacttgtgaatggcttgtgctaccagttggttgtgaagtgccatgatgtgcagctctccttataagtgatatgtttatttgctttcaacagtgatggagaagggagaaaaaggacctcatctacctgcagcaatgagtccctaagtgtgggaggaacctctgtcactcctcgccggatctcctggcggcagcgcattttcctcagggttgcttctcccatgaacaaatctccctcagcaatgcaacagcaaggtctgtgttgcactccctaaggaatttatccctctgagtgtcagaaattagctaatggaatgcacgtgctgtgtataaagagatttaagtgattacagtgtagaaatatctttctgtatgtgatacagtggtttctctttcaggtatcattagaaaacattaggcattcaatacctgcttgttgaatgaatgaatgagtgagacagtttccaaaaacctgtacttgggcctactccacaaggtagacggaactgtgatagtgctaggaaagaagctgtatgtcctttttctttctttctttctttctttctttttttttttcccagagattgggccttgctctgttgcccaggctggggttgcagtggtgtaatcatagctcactgtagccttgaactcctgggctcaagcaatcatcttacctcagcttccaaagatctttttattattagaaaagcaacatagccttttataagagccacacataaaacaaactgacatagaaatattgagcaataaaggaatatatacaatatactaggcaaatactgagcaaaagagagcacaggcagctctctttgagtaattgacctattaaactaaagcaaaagcatccaaagaggcaagcacatgtaacagtaaacaaacagatagaacaatcatgagaacatacataatgatgtagctttgagagctagaaaataacacctaaaa

SEQ ID NO: 14062 - DNA, 1132 bp, Homo sapiens
agggatgcgatctcggctcactgcaacctttgcctcctgggttcaagcgattctcccacctcagcctcctgagtagctgggattacaggtgtgcaccaccacacctggctaatttttgtattttcagtagagacaggattttgcccatgttggccaggctggtctcaaactcttgacctcaagtgatctgcctgcctcggcctcccaaactgctggaattacagatgtaagccattgtgcccagcctcagggagtttttctaaaaaaaaaatttaattataattttattttgacatggagcctcgctctgttgcccaggctgaaatgcagtggtgcattctcggctcactgcaacctctgcctcccgggttcaagagaaccttgtgcctcagcctcccaagcaactgggattacaggcacctgtcactaatgcccagctaatttttttttttttttttgtatttttagttgagacagggtttcaccatgttggccatgctactcttgaactcctgacctcaggtgatccgcctgcctcggcctcccaaagtgctgggtttacaggtggtgagccaccgtgcctggccactgcctcaggagttttgaacaatggacacatattagggttatagtgttatccaggatgcataataaccagagtttgactatattgagatatatgtatcaagtactgtactttctaaagtatcacgtcataatacttactctctgcatagcagctcagaagtcttttttttaactttaatttagccaatccagaagtaatgtttccataaaatagatccagactagaatgaactgaattgcctgagtaaataaagatacgataggcagatgctgaattgctcttctcactattaattgcctcaacactattgagttcctttgagtatctgagagtggctgttctgtctgagctttatttctgacctcagcactgaccttttgattccatcaaaagtcttataccttcatttgttggtatcatcacctgtaaatattggtatccttattgttctctcaggcaaactcagactgtgaaacttaaaaatgtaagatattcctgccactaacagcaacaattattgtgaggtcttccagcagcaaatat

SEQ ID NO: 14063 - DNA, 1090 bp, Homo sapiens
gagaaacaccataaaaacaaattaagttacctcatttactaggcgaaacaggcaaggttaaggcatacacaaaaagaagagttaattcgtttgggtggaaactcttttgtttttcctttcagaaaaatagaaaaaacaagataaccatgcagttgttttgtctgaaaacctgctgataacacgttacgcagtgtcttgatgatgattctagagaaacaaagtcagcagatttgaaaataacatagcattagaacttcctgttagcttatgataaaataccagggttttaaaagtcacctaagttactttcatacatgagataatatttggctatattttgttacataataaattaaagctgaatatgaaaattgttataaattgtatctagaataaggtgatatgtataaagaagagtatatataccataattgacaggcagtgtccacttagaaaagatcttacacagtatttaaaacataatttaacaaaaagttgcttgatatttggtgagaaacagtaaagaggataaacttggaatgattttcttctttctgtgtaacacagatcaaatttatatcttagaactcattttgtttctcttctttacctatgaatttgttacggaaaatagggttaagtaaagatgctcgttggagagaaaaaaaaaaacacaactcgatgtaaaaggagaaggctaatttttatatcgtgtgttacaaaatttgcctgcatttcttctaaggatacagttttattttcattgttgttttctgaatgactcgaaatttaaaaatgagatattttatgatacaaaaaataaagttaacagagttcattattctcagatttttttgctgtgtgtgtaaaggatattaagtagtcatatgtatatcaagatatttaaatgatcacttcatatatatttactcaaggcaatagaactctttttttttccaggaaaaattattttcaataattaaagacatcaatcattttagactataaatatctcaatccttccctctgttttccacattttataatgtataagttcaaacaatttctatcactataaaaagatgctctc

SEQ ID NO: 14064 - DNA, 1041 bp, Homo sapiens
acctataggggagctatcacttatacaaaggactccgtgtagacatatagctggatcttgattttctggagactgaagtttttatagttttaaatatcttttttttttttttgtattttcttagagacggggtttcaccatgttgcccaggctggtctcaaactcctgagctcaggcaatccgcccgccttggcctcccaaagtgctaggattacagttgtgagccactgtgcccggccagttttagatacctttttaaagaaaaagaaaagtaataaacaattatgaattcagaattgttagggcccttcccaaaatctcgaagggactctgaaacttaagctttatgcacttcaaggcatgcatgtatctgaagggagtaaaaagaaggacttgtgagtcactcagggttgttttcctaagtccctggatcacactctctgataggattttttccttcctcctttttatgttgagtaaagatagcagtaagacagcacagtactctgatattaatagtaagaacaaaggtagtaacagtaaggcagatcctctgtaggcctctccatgtgcgaggcactattgtgtttcacatgtattagcccattccatccatatgaaaaaaactgaatctcttttacacatgaagcagctgagacactgagacccgtagtggggtaataactgctgtattcactttgcttagaaggggcagagccaggatttggacttgcctaattggcttccaaagcacctggataccttttctctaagagagtatccaaaggcagggaccctcagggcctggaagcctcctggtatctgtgtgttttccaaacagttactttcatttaagtaagataactgttaattctaagtttgttttatgcttaggtacaaagtacaaagctggaagaaggatcacatttagataaacacaaattaataaaagtattgttagtgaggaagatattttaaaaaaccagatagtagtattttatttcactcattcagaattgtagtattcttgtcaatacattt

SEQ ID NO: 14065 - DNA, 1085 bp, Homo sapiens
aaacatttttgaatgttgtacagggtatagaaggtgtcaggttccgcttaaaataacttaattcctaacaatactctgtagagagtctttaattctcagcttgtgagatttgagtttccttggggggaaagaaaagagtgactgtcttttttaaacctattttaaagatttcctaagaaggagattccggagtattttggtaaatagtaccggtgtgtaatatcagaagtttgctttatcggaagttcatgaggctttttttcacaaatgataatattttattatagaaaaagcatcccaaatgcaggatttcataaacactcgtaggtgaacaagtacagcttcaaaagtaaattcagagtaaagaggcaacacttacaaacattttgccttaaggagaaaatgtgatgttctcctgcagaagtaatcccacacagaacacaaatgtggctccatatcatgaaggcatcagatttgctttctgagctcagtatgcccatttcaacaattgaaaatgatggcaagaagtagcattgaatatattactacttgattaaaaaaaaacacacccctgattaaaaaaaaaaaattaagagacagggtctcgctctgtcatccaggctggagtgcagcagtgtgatcacagctcactacagccttgacccctggaagttcatattttttcttttttgttggtggtggttttgtttttaatgaactcaaggtatgtcattaaagcctctctagtctttggtgatgtattaactgaatttccccttttcttggggttatcagatttgttctttttttagttagtcacagtccttgttgttaatttttctgaatgggttattttcaaagattttaattcattagcccaattacagatacatccttttgctgaccatttagaagaaagtatgattataacttattttttaaaattactatttttagaaatcatgaagtgaggaaagtttgcatattttttaaaaagacagttgtttctaatctgaaaaatatttgtatcttataataattgaagactaacttaattttcatacgttttttgacagaggaaagaa

SEQ ID NO: 14066 - DNA, 1071 bp, Homo sapiens
tagttagtagagtaaccgaatgtcttgtttttgctcatttgtgtttgaggtatagttgtagtgtccatgggatggtgcagtggtatttgcatcacataattgttgcatgtgggcccttttgttcccattgactttcagggccattttgaaacctgcattaaagaaaatttctgagacattttcttctagaaacaagcatggtgttagcagattcaaagcatggtgttagcagagaatcagaaaataatttgtatatcagacctcttcgttctatggttttggagaacaaagtctcacaagtagcagatggccctagctgtcattcacatagagctccagctttcataaaaaggtatgtttcccggatacaatctggggcctatttgccatttaacggcctcactctgtttgaagtttaaagttctccactgtgctgcgccaacagtttttgatatttatttagcagctggctaggaactagagaatcttgtgttgcactgaagacttgatgttcacactttgaatcagacagaaaaatttatattatggctaatatgtactgtttatgaagacagagatgtatatacatgctccaaatgattaaaatgaaaagttgtaaacaacacagttaaccctcagtggctcgtaaatttttgtgacaggataaatgctggttacacacgtggtgctattctctgtgtttggcctattggaatgcattgatctatatttgtaagctgaaatgaaattaagaaatttaatttatattatagttattgattaattacattgctctgtgactgtaccagaataatacatacagaaacatattactggttgaagtaagttttagatggttacttgtgggttattgccctattactgtttctatagaaatgtaaaagtttacttaaaagtcaccagaaggtcaggtgcagtggcatatgcctgtaatcccagaactttgggaggctgaggccggcagatcacctgaggtcaggagttcgagaccagcctggccaacaaggcaaaaccccatctcgtctctactaaaaatacaaaaattagcca

SEQ ID NO: 14067 - DNA, 1046 bp, Homo sapiens
accgttgggtttagcaatgtggcagtcataccggctgctttgctggggtggcgggagtaattgcctgatgttatatgggttcaagaaggaaagggaggagagaaatcacagatagcaaatgcaggcaactcttttggagtttaactgcatctaggaggagagaattggcgtagtagttagaaaaggaagtggggtcaaaagaattcttttaggatgagagataaaaatagtgtgtgtgtgtgtgtgtgtgtgtgtgtgtaaactgatggggaggatagagtagagaaggaaaaactgatgttgtagaagagagaggggagaactgctacagcagtgtcttaagtgtgcaggaggccatgacatctgatatacaagttgtttgtgtgtgtgtgtgtgtgtgtgtgtgtgtgtgtgtgtgtgtggtgggggaataagtggccttagctagtgtgtttgtgcatagtatcaggaaagaaggcatagtgtaagcacagttagatgtgaaggtcagaacttgtggaagctctctttggatatgtatccaaagataatatagatcctcaccttccctcccctcccctcccctcccctcccctcccctcccctcccttccttccttatctatctatccatcctcacacaaatacctatacatacaacatgattttcacgcactaaatagaagagaaagatgaggtttttctcttttgacaattgctgccttatattccttgaagtttgctgttattttctggtctttttgtaaatctctttgaaggtcacatgcagcatccttaagcttccatcattccaagtcttgaggaattactgttagcaaggcagagcgttagattccagttccctttcatctttgtgttttaactctggggctgccattactaaatgagaatgggaatctgtaagtgagtgaattgctgaaggtgtcagtgaaacagtctgttagtgtcagaaattagtattagcacctttgagaatactcttcagcagccatggtgtaagccctatttttaggtgattccacatcc

SEQ ID NO: 14068 - DNA, 1023 bp, Homo sapiens
tatggtaataaatcagtgacctatcctcacacctcatactttacttttttttttttttttgtgagatggagtcttgctctgtcacccaggctggagcgcagtggcatgatctcggctcaccgaaacctccacctcctgggttcaagcgattctcttgcctcagcctcccaagtagctgggattacaggcatgtgccaccaggcctggctaatttttgtgtttttagtagagatggggttttaccatgttggccaagcttgtctcaaactcctgacctcaggtgatccgcccgcctcagcctcctaaagtgctgggattacaggcatgagccactaggcctggcccatactttcgatttgctttctttccatcccatttcagtcttcacattgttgactttgaatggcctttctatgaattttttcctattcacttctaaatccctattttaaggatcacctcatatctggattattgacatagcattctgactggttctaccctgctctattttctcttcccccaaaatacacacacatgcatatacacacagaccacacccacacagaccacacctacacaccatcctgcataccctttcttctcccaacataaacacacacaaacaccaacatccccccatattcttcctccatataatacacacatgcacatacacacttcattaattgatctagttgatggtcacattaattgtcctaaaatacttcccctcatttcagcttactaaaaacttttcgtgggtagctcctcatgcttatgggatgtggtctggacttctcagtctgactttgtaggcagttcacctttcagttcactttgttgagaattcttcctctgctatgcccttggctttctgtatgcaggaggagatttatgtgcttgttatcaagactttctacagagtgacctggcctttgtttaaccaagtcagctgttttagtggtgtcatctagaactcattggagattgttcagtggcctaggcctaccaccctccctc

SEQ ID NO: 14069 - DNA, 1012 bp, Homo sapiens
cttaataggtaacaagctgttttaaaattttatgtgcacaagtccatgtcttctttcatatcctatttctagaatataaattatctgaatctttagtaccagtacagatcctgaaacattatagatactcagtaaatgttaattcagtgaaaaggcaatgatttgccttttgaattccatgcaaatagttacttagtaaagatctttggtaagaagaatgcaatatgaaattctttttattacttttcatcattacagttgttacctaactctgatccttagaccaacagaccaaaggttgggatccttagtcccaacagaccaaaccaaaatggagttactcatgctgaagttcccaggcaccaagtagaaattaagttgtttatccaaggaagatgttcttatctgaattttatagatgtgaaaataagcttttgtgtgacagttaggtatcatactgaaggtcacctgacagctttagcgacataattgggattagaacaggggattaagatcatttaggaagttaaagaaaatagtacaaaagagttttctataaccctagcacccatatacttgacaggttatggaaactgttttctcaaagttcttcagaatgaaaattgcatggaaacaaagccaaaactcaggttgttcataatgataatttgcatgtataattactagcttctttatatcaactagctaattacaccagttataatttctagataatcttctataattgattgtttaaaggaatttagtacagctgttgtaaagcccattgatgcctcatttcccttttattctccctgggacacctccagaaatagcttagcttaagcttgccaggagtgttcatttgctgggcacccctcaggagttgagtttgagtccagcttattttaaccacaaagctttggttcaccttgtctttcactgaatggttatcagcaaggacattctgagttacactggcaagattgtgggtggagtggcatgggaaggt

SEQ ID NO: 14070 - DNA, 1554 bp, Homo sapiens
aggaaatgtgctgttctagatattttgagacattaattattcaataaccacttgagtatttttgagaatagttccatgcactgttctatgtgttgtatggaatagagtgatgtacagtatatacacatagattatttaaatttctgttaatatgtaaaactaagaaatagcagttacctgtgtgattatcttctctggtgtctgcgtgatattattagaaaattccagtttcggtgtagtatgaggaaaaagcatgggctttagggttcatcttgtcctggggctaacacttgactcttccaatggttaagtgtctgtgaccttgggcgagtgacttttttgggggtgttatttggaaaattgagattaatatagctattcttatagattttatgagggtaaatgatgtaatgtacataaaatgcctagaaaactggctggcccatagtaagcaattaataaatgaaagccattaatatcattttttccaatattgaaataaaaagtagagaaatgtagacccatgggtcatgattaatttatattataaaataaaatattaacacaccaccaacacagaatttgaaatacaggtttatgaacaaacatccagactgcagtgataaatgatcaaccccagagccaggggtattgtcttttatttactcgttgtcctttgagttgttttgtaagtgttaaggtggcttacagaaaagctggagaatgtaccattgttgttttaaatccaggattccagatttcatcagggtgtgcagtaacaccaaaagacatgaaacatgaacaacaatgtcttatttataatgtgaaattattaaacttttgatcaccttgttttttccattcccttggactttattattatcttatctaaattatgatcacagcatttaattttctactaaagagttagaggccaggaaaggtggctcaagcctgtagtcccagccctttgggaggccaaagaggggcgatcgctcaaagctgggagtttgagaccagtctgggcaacaaaacaagactctacaaaaatacctcaatgagccgagcatggtggtgaatggtggtgagtgcctgtagtcccagctatacaggaggctgaggtggaaggatctcttgagctcaggagttcaaagttgtagtgagctatgatgacacctgactgcgctccgctttcgcaacagaacaagactttatcttaaaaaagaaaaaagaattgtatcatttgcttcttacagctacatttttccacctttccctccacaactaaatgtatgttctttagcttttgggtatatccaatatcagcagttactttgcctttgtcctctgttaccctagcatctacagcttttttttttttcagatggatatttttttctactatctgcttataaaatgctttaagaagactatgaaagttatcctgttgtcacgtctgtatcttcttctgattcccagtacttggatttcaaagtagctggtagtcgttaagtgcttggcaaggtaggtggaagaccatgttaaacattcacc

SEQ ID NO: 14071 - DNA, 1034 bp, Homo sapiens
ggtaacaggatccacatatgatttttctttttcgatattattaaataagaatttttttttttttttgagacagagtcttgctctgtcctccaggctggatggcagtggcactatcacggctcactgcaacctctgcctcccgggttcaagagattctgccatctcagcctcctgagtagctgggataacaggcacatgccaccacccctggctaatttttgtatttttagtagagacggggttttgccatgttggccaggctagtcttgaacacctgacctcaagtgattcacccaccttggcatcccaaagtgctgggattacgggtgtgagccaccgcgcccagccaagaatctttttaaaatagaaaatgttttttctacctagtggaagtatacatacatatatatataactacacttataattaatatttttaaggagattgaataacttggtttaaatatgtctgagtggaactcaactatttggcagtatttatgaagaagaaaacatgactcggtgaagaattcagatttaagttttaattgcataatgttattattgtattaaaaataaaggctatgatatatgaaatatattgcttgttcgatatcctttggaaatttgaatggtcagaaacaccttgttaaactaaacatattggttaaactctaatgtgctgctcagtgcttgaggatacttgaaagcaagaaaaatgctacctaaaaatcttatttatactatttataaagtaatataatataaaatttaattaattcaggaattatgtattatgactgctttgtgccaggaatgttagaaatatgaagaataaacctcacagaagctgataggaattttaatgcatttgaaaataattttcttgaaattttgcttatttttggcagaaaagactaaaacctaccattgccaacatttttataaatgtaattttatgggtttattaaacctgtatttattgagccctaggccctcgagacgctatcccctgacggccgcctcaggcttcct

SEQ ID NO: 14072 - DNA, 1100 bp, Homo sapiens
aggcagtttgggataaatattgcctgtgtcaagtgaaagacttttaagtccttcttgtaggtcaaggattatagtgcttaatttctaagtcatggtcttgattgtactccggttcctactttgagaggttacaaaggaaggtttactgtattctcccatttctaccagtagtttaacacaggggttctcaactccaggtgattttattccccagtggacatttagcaatatctggagacatggagacacttttggttgtcaggctgttcatgtgggcactataggtgtctaatgagtggagaggtcagggataatgctaaatattctacagtgcacaggacagcctcctacaaacaaagaatgatctgggcaaaagtatcaatagaggaccctggccctaaggtctgtcagtattaattaatacataaaccatttaattagttaataaaatcttaaattgatgtataatatatatcccatgtcaccgacatccatattaaaatgtagaatatttccagcactcagtgctttcttgtaccctcttccagttgatacccattcccccttagaaatcattatcctgatttctgtcatcatagatgacttttgcttgtgcctgaactttatataaatagaatcatacagtatgcactcttttatgtctgacctcttttactcaacattgtgtctgaaaggtatattcctggtgttgcatacagcagaaacttgcccttttttattcttgtagtatgtatactgcaatttagttctccatttactgctgatgggctttgtattgttacaaacttgtgattaatatgaataaaggtgttatggacatttttgtgtatgtcttttggtggacgtaggctatcatttctattgcatatatgcctaggagaggaattgctaggtctttggatagcattggtttgggcttactagatactgccaggtttccagagtgttggaccagtttctactcccaccagcaatgtgtgacagttctaatagctctacattcttcttagtatgtaatattgtaagttctttcattttagccattcttgtagggaatgtatttgtatctcatggaggtt

SEQ ID NO: 14073 - DNA, 1021 bp, Homo sapiens
tatgtctgaatgggtacagcctaatcttgtatactgctagtatccagtctgtaagattattgtcattgaaggaataaacttggctcaaccatttacttcattccttatctctctccttttttgttgtttttttgaagcaggatcttgctctgttacccaggctggagtgcaatggcgtgaagttggctcactgcagccttgacctcccaggctcaagtgatcctcccaccttagtcaccctagtagctgggactatggacatgtgccaccatgtctggccattttttttttatttttagtgaagatgaggtctcgctgtgttgcccaggccagtgttgaactcttgggatcaagcgatccttccgccttggcctttcaaagtgctgggattacagacgtgaaccactgcctctggcctctctctcttctttcttataaccagtccagttactcagagaatgctcaagctccataccgtgggttggtagttctcatccttctctttgtctgaactccatctctgctttccagctctctgaacttctcatcattcctcgtgcccacctggccttccacatctctctctacacacattggtctttttgttgggaatgccctcttgttcacctggtttcctgatctttacaaaccctattcacaagtcacttcctttgctgtagtcttcttgatatcaatccccatcctccagatgaaagttgttccttcctttgtgcttccctgtttatggctttattgaggcagttacagagtatttttattgttgatttgtaagcctctcttcactagtttgtaaactcactgaaagtatagatagggccatttttgtatccttagcatctaacacaatgactaatatgtattattattattttttttttttatttttatttttgagacggagtctcgctctgtcgcccaggctgcagtgcagtggcgcgatctcggctcactgcaagctccgcctcccaggttcatgccattctcctgcctcagcctccca

SEQ ID NO: 14074 - DNA, 1026 bp, Homo sapiens
tttctacatttcttcaatgtttggtcccttacatggtgtaggagagtctcatacagtaataagttctaaacagcttttctttttacaccattgatgaagcagtatgtggtttatgtatgcgtttctctgttttgtcattagtttttataataattgaaatgatttttggaaacccgctttccattataatcttgacccaaaaacatagatattgctgatgatgtgttgttcaaagcagcaaacacagctgcttgttaaggcaaaaggcaaatatgaaaatagacagtttcacaacatgtttgcttatttacaaaggctgttttcttttgttcttggagtagaggataaacacatcatttctgtaaagggacaagctgtaatgtacatattgagtatgagagttacttgttagcattgatttgagtcataatatattaccccgtttacttaggaaccagtcaggttaatagattttttttgtgcctgtgattgtaccagttagtagtttctctggaaatcttgttcgctatgatttttcttctgaaagcagaattgattctagatattggcagtggaaactgacatatatatgtcctgtaattgttttttggctgcttacatttttcagatgttttttttttaatttttaaattattattatttttttttgagacagagtctcactttgtcacgaggctggagtgcagtggcatgattttgactcactgcaacctccgactccctggcttaagcgattctcctgcctcagcctcccgagttgcttgggttacaggcatgcaccaccatgcccagctaatttttgtatttttagtagagatggggtttcatcatgttggccaggctggtctcgaactgctgacctcgtgatctgcccgtctcggcctcccaaagtgctgggattacaggtgtgagccaccatgctggccatcagatgatatatttttaaaagccacgctactaccgtgaaagagaattacaacaaatgctttgcatatatttagatct

SEQ ID NO: 14075 - DNA, 2005 bp, Homo sapiens
atttttggtagagacggggtttcaccgtgttagccaggatggtctcgatttcctgacctcgtgatccgcccgcataggcctcccaaagtgctgggattacaggcgtgagccactgtgcccggccagttttcttacctgctacactagaatgcagttattgaaaattagtttttagttgttggtcttatcagcttttatactatcactttttcctactcatattaaaaatctccacaggtaaatatgcttattaagtttgtaaaataataattagtgctgaatgcacacttgggtatagttatgccagtatgtactttccattttaaggggaaataaaaaaagtttgtttgatttgttgggctggtaaggctgaactctggtgtacctttgatttagtgtctttaagtatggcgggggaataaactatgagtctatagtatttataaccattataattttaggttagaataaaagatcattaggatctacatttaaaaacaagtaaaccatgaatttgaatttattttattgaattataaagtatatgaatatcttttaatatgtctttgatatctgtgattatatgacagggacaaaatataggattaaaactttggttggtttcatttcagataatcttgccataggtttgtgcagtctcagcagaaggaaatcagggttgttattactgttttactgatctcttccaagtttcacttcttgcaagatgttggggttggaaagaggatctctaagtaatggaatctttctggctaaaaataggagcctacattggctgctgctttagcgtttttattttgtggatacccttaaccagttgaatagtcttcacttttaacttttgtgaattttcacacaaattttaaaaattctctaagttaggaccatggaaactttgtgctatcaatattacataatttgtgaatagtttactatcagtctcagattctaagtcaaacacagtgcttctggtcgaacaaatctagaaatcttctgtatctcacaattgtatcttcttttgtatcttacaattgtatcttcatatatatttttaataatgggttatgtaacttggacaaatacatttatggctgggaccttttaaaattcagtaaaaattgggaggccgaagcaagcaaatcatttgagaccaggagtttgagaccagcctggccaacacagtgaaaccccatctcttctaaaaaaatagcaaaaattagccaggtgtggtggtgcatgcctgtaatcccagctacccaggaggaggctgaggcatgagaattgcttgaacctgggaagtggaggttgcagtgagccgtgattgtgccactgcactccaacctgggcgacagcttactctgtctccaaataaataaataaatatcaatgagtaaattgtttttggtccttacatggctcccagctttttcaactcatctcttgccttggtttcagtcatttaattcccattggctgggcagtctgagagcttttcctgagtttacctgaattaaactgatagcctttctccttgattctccaggtaattattgctcccagatttccagtagcaagttctttaggagactagtttggatccctcattattctgtgttggaactccctgattctgctgctccctttgaagaccacccaatgcttgttgcctaactctttacagattgtgcactacttgcctgattggatttctttctagtcatggaagctggccttctttttcctgagagagtatctagttatggtcctcgccccttcctgttagctccttctaaggctgttaacagattttatttgcagacagattttattttgtacagattttattttggctgtcgtatggaattttgtaaaagcctgttggcatgaacatagtggtggtggtgggcatgacccttttaaatccatccacaattcttttttttatttttattttttttctctgagacggagtcttgctttgtca

SEQ ID NO: 14076 - DNA, 1182 bp, Homo sapiens
ccagttgcatttttccaggactttaaggaacttttcatgactctcgggggtttctgttaaagttatttccccccagcgacatctgatgcatgacacattgttgctaatctcattgatggtcctggcacctttagttctcaacagctgctgttgagttcctcttggtctcattggtaggaagtcaattataaacattcctttattttcctccattatatatttaagcgttagaggctgaactatataaatattaatatgtttaggctcacttcccccttttagtccagtgggagcagtggtagtcatatgactttctcataaaagttcaagaaaacctctaactttcctgtttattgccttttcccagatgagtgtttgatctaaagatatgaattactatttgctcttaaccaagagatttcctggcagagggttattaatttgaagggccagatgtagcgtctctagagagcatctccagccattaatcggtggttacaaactcaaataacaaagaagagggttgagtgaggaccatggaggactggatagtgggtggcctttctcaaggtgctacttagctccacttggaaattgcatgaataggatgcaagtctagcgttgctagagctgctgatttcccaagagagagtggaaatctgaatttttatatatgaccccgcattttaaagtactggcaaatattgtaaacatttaagaatcctatctgggccaaacaatacacatctgagagatggctttagagatccatgagcggccacttttgatctttggcataaatatttgttgagtggacaagcgcagtcattgacactatgtgctgtttgctgtatttcctttagagcatccaggttcatttgatatggctgtcatagtaggggaagctgggaccatcctttttgaagaatttagcagaaaaattcccagaagtgttgattctgcagctagacatgttaaaggggtcagttcaacatattatcatccagcagtatgcttcatgcagagttggctgtggatagttctagggacccttgaaatcagaaggaagacctgctgtttgctttgttctgagttctatatttgaagtggagaattatttatttggacttaagatcattgttaagagagtctcctaagtgtttccctcagtcctcgacagag

SEQ ID NO: 14077 - DNA, 1044 bp, Homo sapiens
ttcctagaggtcctcactagttctcaatcgcagtcaaatccttaaccggtttggctggtcgcgtcatcttcgcagcagcacctgcaggtctccggtctgggaggcaatttccgagcggggcttagggaaaagttactagacatcgtcagattgtctgcaaagaaggattctacatttggatattgaatggaaagaagccctttttttgcggtttttaaacacacttattggaggcagtgtagtagaacaggtttctaatatcattttttaaatgtttttttcacttttgtttttaatattttttttccagagtcttctaaatctaattaccaaacagtaaactttacttccttaaaaacagatatggtccttatggaacagggagaggagaacttgactatgcagtgattgtgtctttgaaaacagagttttccccctttaatttgtaatgagttttctccccgccatatcaaaagcttccaaaatgctgttttaaaaatggttatttactgtttgcacagtactttaggttctttggaaaaatagtgttgtctaaatataaataaagtctcaggttgcaccatgtggctttcttttggtaactgggaaattaatcgtagtcagatgagaaaaacatcctataaatatggctttaattttttttatttcacaattcttctgtctgtaattgaaagacttagttcaacagttttcacaaaaggcttgtagttgaattgaagaaaataatagttcattgtcttagatttcatcagttactttgaaaaataggttttttttttttgagacggagtcttgctctgtcgcccaggctggagcgcagtggtgcgatctcggctcactgcaacctccaccttccgggttcaagtgattctcgtgcctcagcctccccagtagctggcattacaggcacccaacaatcagaactcctaatgtgaagttatgtttatggcataactgttatgtttatggcaaaatatcgtactaaaattatttcaagatcctaaccacgatttaatgaatttc

SEQ ID NO: 14078 - DNA, 1050 bp, Homo sapiens
acaaggaaaaactgaacaaactgaaaaatcaacaactcctcttggatctgtcagagaagcgaggtcacagggcaaattgctgtcccccaaattggtgagacagactgcgaatacagagaaccacagcttagagcagaagctccacagaaaccagtgcctaaactgaaatcgacaaattactggaggctcccaactctccctcacacctgacatacaatcagatcagcatattgttttctctcactctaaattcacctcctcttgctgccacctgggtccaagccgccattctctttcctggaataccgcagtagccttgtaacagggtcttccaacttccttaaactttgtgcctcacctggcggtctggatgagccttttgcaatgtaagttagaccaggtatctccgctactcagagctttttaagagattcttgtcacactggaaaaaagtcgtaggtatttactgtggcctacagggcccttcgaagatggattcctcatctcttaccactcttcctagctcatgcccctccagccacctgggcctcattgttccctgaacacgccaagcatgcttctccctcagtccagaatgctcttttctccaggtcctgtggctttttcttcattttattcgagtctctttctgttcaaaagccgcatgaaagaggtcgtcccaggttatatctaaatagcctttcttgtcactctgtcaccttaccctgcatttcgtcacgctataatactaccattacattatatttttgtttattgtctgccttccccactagaattctgaaggtcaggaactattttttacatccctaattcctagaatatagtattgcttagtatatactgaatagtgaggcctccctctcttactcaaaacacataggaattaccagttttatctatatagacagtttttatagtcatgtttttatattactagtaacttcagcctccacatcaatttttagtgtgactacagctaatttgtgtgtttacctttttatatatttactttctgattattctttatat

SEQ ID NO: 14079 - DNA, 1037 bp, Homo sapiens
tagaaagggtgtcctgggcagccttgatttatcattttgaaataagcatttattgggaaacaatgaagaacaagatactaattcttcaagaatgattaaaacatagttcacaccctcaaggagatcacagtcatttggactaaagacacaacatcaaaatctccatctgatctgcttgatggagagtttatgaggtgcggctaggaacaggtagagcagagcacctaactgtgatattggggatgggaggcagggttagaggaaggctatgaagtaaagatggaccaagatggactttacctcaggaatgagatatgcacaaggaagcagaaagtcatttccagcagagaaaatagcatgcattaagacatgtgagcatgaaaaagctaggttttctggaaatgacaagaaggtcaacatggcaaaacactgagtggtagggggagaaaacagtggaaagtgaggtaggaaaggtgtggtggaaccaaatcgtgactcgtgataatatttagaattttctgaacacataattatattgatatctaagtgctgtacatgtatcagctcatttaaccttttcaatatccatatgactttggtattattgattatcccttttttacagatgaggaaagtgaggcacaggctcacttttggcaaggggcaggtcctggatttaagtgaagactagctggctccagagcccccctgtgtcttcacgtgccatgctgaatccccacagaatccctgcaatcaaacatttagtttcaaagaagccacagtgtggagaaatgactttggacatgaagctagaatcccgggtgtattagtctgttctcatgctgctaataaagacatacctgagactgggtaatttagaaaggaaagaggtttaattgactcacagttccacatgctggggaggcctcacaatcatggtggaagatgaaggaagagcaaagggacttcttacatggcactgggcaagagagaatgagaactaagcgaaaggggtttccccttataaaatcatcaga

SEQ ID NO: 14080 - DNA, 1030 bp, Homo sapiens
gccgagatcacgccactgcactccagcctgggcaacattgagcactgagtgagccagactccgtctgcaatcccggcacctcgggaggccgaggctggcagatcactcgcggtcaggagctggagaccagcctggccaacacggcgaaaccccgtctccaccaaaaaatacgaaaaccagtcaggcgtggcagcgcgcgcctgcaatcccaggcactgggcaggctgaggcaggagaatcaggcagggaggttgcagtgggttgagatggcggcagtacagtccagccttggcttggcatcagagggagaccgtgcagagggggagacggagagggagaaggagagggggagggggagggggagggagagggagcttgaaacttaattcttatctaatcttaaattctgccaatgtgtaagatatctttaaaacaatcatgtaagtaatcgatctgttctgctttcaatcaacacagcataattcatttatctggtcaccaatggacaatgttctcttcctaaatttgcatatgtgaaattccgttcaaaaacaaaactgtagaattgtctgccactgtggtcagctacctgatgaccatattataagatgaatatggtaccagaagctgggtggggaatatttcaacttcaaaccctaattactgcttttagttttaaagagcataaaaatatttctcatgtctccctctgacaagaaaataactcctttcttgatttgaagaaaagcttgacccaatgatatcttagacaaatggtttgatttcctcatgctttgaatctgataaaagtaattatttgacctaatcacttgtttgtaaatagcaaagaaaaaaaaaaagaattcaagctaaatgatgccatcagattgagtaagagtcaaggcccttgtaggtccccatccagcttgcatgtgagaccttaacaatagtgtgcattcaaaaggagttgattacaattttccccaaactgtaagtactaataaaagtttattatcttactaagtcatag

SEQ ID NO: 14081 - DNA, 1049 bp, Homo sapiens
tgtacacttcagtggcattaaatatattcacattgttgtataactatcaccagaactttttcttcttcccaacctttctttccttcgcaaactgaaactctttatccattaaaccttgactccctattcccctctccttccatcccctggcaaccaccactctggtttctgtttcaatggattttactactctaggaacctcagtgatattgtttggacgtttgtaccctccaaatttcttactgaaatgtgctgttggaggtgggcctagggggaggcatttgggtcataggggccgatccttcatgaatggctttgtgctgttcttgcgataatgagtgagttctcgctttattagctcatatgagatctggttgtttgaaagagacctggcacctctccccaggttcttgctttctctctcactgtgtgacatgctggctctcctctgccttctgctgtgattggaagctttctgaggccctcaccagaatggatataggggctatgcttcctgtacagcctgtagaatcatgagccaaataaacttcttttttttgtataaattacccaatctcaggtattcctttatagcaatgtaaatggactaacacactcatataagcagacttatacagcatttgtccttttgtgactggtttaattctcttagcacaatgctgtagcatgtgttacaatttccttcttttaaagcagaatgatattcttttgcatgtatataccacattttgtgcatccattcatctgttgatggacatttgggttttttcccaccttttggctattgtgaatagtccttctatgggcatgggtgtatgtttatgtgttgagtccatgctttcacttcttttgggtgctggatcctattgtaattctaaatttaattttttgtggaaccaccatagtgtttctacacatgattttaaataaacctttttattatggaaattttaaaagactacacatagtaaaaataataaaatgaattctcctgtgcacaacatcaggtttcaatagttgcttaggat

SEQ ID NO: 14082 - DNA, 1050 bp, Homo sapiens
gtggggaatggtgccactcccctttccctttttgtgccagtggtgatctgccttcctttccacctgaagtcctctgagagattgggatctttcatgttgacaagttcagcaattcttctctacctaaagcaaggggatggagccctgagacactttgaggaaagagtccctctggggcttcagggagtgtataaagcactgaaattgcatgcaaatctttttgcttatttacaaagaggattgatagctttcctcagattctcaaaagtctctgcaacaccctccacacctgccctctaccccctaccaacatcacagatgctccatgatggcatttcaggtagcaggcagcaggtggaagaaattacttgaagtctctggggccttcctggtgcacagctcacatgggtcaacggtcaggtcctgctagtgcttgtcaatgtacagtcatccattaatgtcttcctacggtggttttctgttgaatgtagactcagcatgaacactgtgaacctcttaattgagcctcaccgtagctctgggaatcccaagattgatatctgaattgttcagcactctttcagttgcaagttaatttaaatagaagggcatatttactggctctcataagtgagatattttggaggaagacatggagttcaggggtgagtcagccagtgtcatcaagaatcactttctctctcaaacacaaagatggctaccaagactgcaggcttttattcagctggtttagtagccacaaagtaaagactttccttcctttggtttttttctttctttggtcctccctcccctccccctcccctctcccctccttcctttctcctccccttctcccttccctgcctcccccctcccctcccttcccctccactctcctcccttcccctccactctcctcccttcccctcccctccttccctcccttctcctcccctcccctccttccctcccttcccctctcctccccttctttcttccttccttccccctttccccctccccttccctcccttcccctccccttct

SEQ ID NO: 14083 - DNA, 1088 bp, Homo sapiens
acataataatggtacatgtttgtggggtacactgtgatgttttgatatatgcatacattgtataataatctataatcaaattggagtattagcatgtctgtcacatcacatttatcatttctttgtggcgagaacattcaaaatcctttcttctagctattttgaaatctaaaatataatattgttaatcacagtcactctactgtgcaataggacaccagaagttattcctcctactggtaactttgtacccattgatgaacctccgaattaatattaaaatgtccacattatcccaagcaatctacagtttcaatgcaatccctatcaagataccaaagatatctcaaagaaatagaaaaacaatcctaaaattcatatggaactacgaaagactccaaatagccaaagcaatcttgagcaaaaagaacaaagttggaggcatcacactacctgacttcaaaataatacaaagctatagtgaccaacacagcatgagactggtatgaaaacagacacatagacaagtggaacagaatagagaagccagaaataaatccatacacttttactgaactgatttttggcaaaagtgtcaagaacacaccatggagaaaggacagtctcttcaataaatggtcctgggaaaacaagatatctacatccagaaaaatgaagccagacttctgtctctcaccatatacaaaatcaactcaaaatggtttaaagacctgaaactgtaaaacttctagaagaaaacatagagaaaatacttcatgatatggttgtggacaaagattttttttggataagacctcaaaagcacaggcaacctaagtaaaaatagacaaatgagatgacatcaaattaaattgatgtcacggcaaaggaaacaaacaacggagtgaggagacagcctacaaaatgggggaaagtatttgcaaaccatatatctgataaggggttaatataaaaaatgtgggaggaactcaactcagtagcaaaaactcaaataatctgattaaaaatggcaaaagacctaaatagatatttctcaaaagaaaacataaaatggacagtgggtatat

SEQ ID NO: 14084 - DNA, 1062 bp, Homo sapiens
aatgagatatttgttaaaataaattttccaattttgcagatacaaaaacatcccagtctagtcaacaaccttatattctctccatgtactctttgagacaaccagattcctctttcaacataagttcctttgtctgttgaaaaagaaatagaggaagaatggagttactgaggcattgagtagtgggaatgtatgaagcataactatgaaatgacaaaaacgtttttattttttgtgtttcatttcattgtaaattgacatacaaagttgtatatatttatcttctacgagatgatattttacaatatgtatgttgtgaaatggctaaattgagctatttaatgtgcattaccttgtagttaccatttttatgctgagaatacttaaaatctacgctcttaccattattttttaaaatttcttgtccacagcatgaatattcccttagagtattcatgtattttaaagaatacaacacattattattaactgtagtcaccatgttgtacaatagatctcttgaacttaactgaaattttgtctcctttgacaaacgtcttctacccaccgacccctccccatcccccactgctccaggccctgggaaccaccattctgctctctacttccactagttcagccttttcagattccacaaataaatgacatcatgtggcatttgcctttctgtgcctggattatctcactaaacataatgtcctctagattcatccatgttgttgcaaataacaggatttacttctctttttatggctaaatagtactgcatagtgtatatacaccacattttctttatccactcatctgttgatgaacacttagggtgattccctgtcttgactgttgtgaatacagctgcagtaaacacgggagtgtagatatctctttgagatactgacttcatttcctgtggatatataccccggagccagattcctgggtcatatggtacttctatttttaattttctgagaaacctccatactgttttccataatggctatactcatttacattcccaccaacagtgtacaagggttt

SEQ ID NO: 14085 - DNA, 1034 bp, Homo sapiens
agatcaggattggttccactgtctggggttagtgttttacaaggtcattacacagtctttttgacctcttttgaaggtagagttttagaaggctggatggaagattctgagcctggaattaggaccccatggaggcagttcagtaactaaactaataaagttttgaaaagttacacgtaaagtagaagaatctagtgcgtgggacagtaaaggatcctttctcgtacagaataaaaggtctcagcctgtagcttaaacttatagaaagtgatccgcctgcctgcagaggcgcccttttcagctgctgctcgccagaagcccttgattccactggttgacatggcagcagttactggcaagagggagaaaggacgctgccgcctaagagtgcaaggctgctcaggtctccaagcgccgtaggaggtcacctggcagtgactgtagggagctgggtcatagtgcacgtcgtgggtattaggaaagcctgtattctttcaatgaatgtcagtaggaccttcctttagctgtaagacttggtgggcggggtggggtggggagggaggaaagggtaggaagggtgggaagggagaagcagacatagtcatttatgatttgaaagttggaagtttgtaccatctgtttgagtatatgcacatttaaaaaatatcatatagtaaatgcaaacatgccaagtattttataaagattaataacagacctactcttacctggcagtttacttaacttactgttttgagtcctaaacttagagttgttaatgcttatatataatctaaccaaagagttacccagtagggttttagtttttgaacttttattttcttgttgattataaatcctgattttggaatctattgcgcaaaagaagtttcattttggttacttagacctaagatcacttattaaaaatccttattttctccaagcccagcaaacgttgacttctgggcaaacctgaaaacctgaaaatgccactttcatgcagtttgtttgaagttaagtggaatcctttc

SEQ ID NO: 14086 - DNA, 1029 bp, Homo sapiens
ccctgggtttagaacagagaaaaagtcattgtctttggattttaaggatacctggagtttttaaggccctctttagaacacttctgctcacccctacccagcctttacctcctagaggttgccaatagctgaacttttagttacggagataaaactatgccaactgtactttgagttgcaaagtctaggatgagaaataagccctggaattgagggttcccagctgtctagattttgactaaattttccaaccagagagtaaatttgtgttagatgtgactgactcctaggaagaaatggggaactgctgaggaagtgccatttaccctgtccattttagttactgttaaagagacatcatctaagagagagtgataaacagattgaagaatgaggtaagcaaactcaccaaggaactctgaattatagaagtgcaatggcaatgggggaatgaaagggtgggagcagaaacctacatgcatgatgtcatgatgtatccgttatgtgccagacattgtggaagaaaatgctttgtatcatctcatttaatctcacaagagtcccatgaggttggtatttttgctccattttaagataaatatctgaagtttagaatatttaaataactatgaccaatatctgattttaaataaaaccaggagaaggatacaggttcatcaaactctaaagtgtatgattttcccatctatattttactgtaggaaaagaaatgtattttttaaaagtaaattataccaagtaatgtaaatttaaagtttagcatgttttgaggcaattttcttactgtgaaatattatgcatatttctttagtaactggaaagcaaattggggaaatatatttttcccccttaattatatcaaataaatgatcttacaattacataagaaatcaaccattacagtctagccagtggcttggcttcttgtgcaaacctcacaataaaatatgcagactttctggaaccacatattaaaatctctgcagttgaatcagcccttctttctaa

SEQ ID NO: 14087 - DNA, 1047 bp, Homo sapiens
acttcagaagctatgcccttaatcttagcactatccttcctctttcctgtaatatctttcctttgtaccgaatcacatcgtgtcctcctggttctccttcatcctctctaactgtgcttctcagtgtcctccatgactccttttcctctgccaggccgttttacctggtgttctccagagctctgcctaggctttcttcccacgttgagccctctccaggggttctctgaaggtctcatggtccctgattaccagtcaggggcagacaacttgcagatctgtctccttagctcattctgcatccccaactttcaggctcagacgttcagttgcctcttagatatctttacccaaatgtccatacgcatccagtgctctatgtgaagtatactgaatgcatcaactttcttcctaaattcacttctcctatgtagtccatatcttacatgggaccctatccatgctgaaaaactaggagccatatttgacttttgtcttatcctgcacagtcaatctatatgggaccccatccatactggaaaactaggagccatattctttgaatttctgaagatagggcccaaatcccttctagcttgtagaggttctgctgagaaatctgctgttaatctgataggttttcctttgtaggttacctggtgcttctgtctcacagcttttaagattctttcttttgtcgtaactttggataacctgatgacaatgtgcctaggggaagatctttttgcgataaatttcctgggtgttctttgtgcttcttgtatttggatgcctaggtctctagcagaccccatgcaccattcatctttctatttctagggttgggcaccatgtctgatccagcagatgctcaataaataagcttttgaaataaatgtatttattgaaatagctaaatgaatagaaacggttagtgtggcatgacacggggaattgattaagtaccaaggagccagtgaaccagggattacagattctgcttgggagacccaagtaggcttcacaggagagatgacatttcattaa

SEQ ID NO: 14088 - DNA, 1043 bp, Homo sapiens
acactgggtctcaacagtggtcttaaaacattcagtaaaccatgctgtacacaggtgctgtcatccaggctctgttccatttatagagcacaggtagagtagatttagcgccattcttaaaggctctagattttcagaatggtcaatgtgcgttgacttcaacttcaagtcaagctgcattagcccctaacaggaggctctgcctgttctttgaagctttggagccaggcatttacttctcttctctagctgtgaaagtcctaggtggtaccttcttccaataaaataagggatgcctgtagttgtcttcagtttcttgaaggattgttatcttctcaggggtatagaagtaggctgggtagctctataagattgaattaggatcagttggtaaaaattgcagggaggccgccttgtgttcaagatctaagaataaaataaaaccttctaacagagaaatgggctgggagtgggttggctgtcattggaagttgagttttatggatgtcatataaagtttcttgcattaataaggacattggactggataacttttaaagtctcttcaactctaggattttttaagcacattaaatgtctttggaaacaaccaaaatagacttttctgactttggagaaaaacaaacttttttctcagaacgttgactccgtgggtcaaatctctgactaactattatgacaaaagatgctctggccacgtagagggtcctagtagagtgattttattcaacaactatttcctttgtgcctattatgagttatatgctgtggtaggtgaatgagatacaaagaagatttttaaaaagtggtctctgtggctgggtgtggtggctcatgcctataatcccaacaacttaggatgttgaggtgggagaattgcttgagccctagtttgagagcagcctgggcaacatagtgagaccctgtctctacaaaaaataatttaaaaaatttagttgggcatggtggtatacacttgtagtcccagctactagaaaggccaagatgggaagatcacttga

SEQ ID NO: 14089 - DNA, 1042 bp, Homo sapiens
catgtagggttaggattatttcagttagctggtgatttgaattttttatcgttacatagtgacactatttatagtaatgcttggtccaatactaacatttatttgtccagttttcttttgttaatattccatccgtatatcccccatcttttataccgtcaacccttctgcattttttatttgtcttgcataaagtatataattggattttagaaagtcttctgatgacatccaaagccagaatgataaattttttttaaaaaatgaaaagacaaaccacagagtgggagaaaatttttacaaaacatgtatctgataaaggatttatacccagaatatataaagagctcttatatattccaggtatacgtccataccataagaagaccacacaataaaaagaactggaaaaatggaggagaatgagtcattagggaaatgcaaattaaaaccacaatgagataacattacacactcactagaatggctgaaataaaaatgactgacaattctaaggtttggtaagtatgaggagaaactggaaccctcatatattgttggagaaaacgtaacatgatagagctactttggaaaatcgttttttataaagttaaaaatatatttacccagtgacccagagtcactcctaggtatctatcaaaaagaaatggaaacatatgttcacacaaagacctgtacgtaaatgctcatagaaacactattcataatagcccaaactggaggcaacccaactgtctattaattagtgaatgggtaaacaaacattggcatatccctacaatggaaagctgtccagcaatgaaaagcaaaaaagtgctgacacatatgtggaagaatctcaaaaccattatgccagtgaaagaaggcaaacacatatgactgcttattatattatttgatttgtccgaaatgtctagaaacaacagaattatagagatacatcactggttactatgggctggaggtgggaatggggattgatcccagataatatgagaaaatttcttggagtaaaaggaag

SEQ ID NO: 14090 - DNA, 1519 bp, Homo sapiens
ttctcaaatgttacaaagctgtttaaagaaaaaggtatatataagtaatcagaacacttagaagactgatagatgtcacacagtggtattatagaaggataatacagagccaagatcaaattaaaagacaataaatggaacagaagggaggcagtgtttagctttgtataaacttttaggtttgctctgtaatctgctaaaccatatacattcttttgtgatatgttattatgtatgtggcacttgaggcactgtatgtaaagtaaggaatgctttactagttctccttggttttatctttgtttaaactagctttaaagtattaaacaataattgaaatgaaaagcttacctattttaaaaagccaaatttaaataaatatagaactttaaaatgtttatcagttgtttccatgaaagaatattagtttccagtaaattttagtgatggctcactcacttttctattttggaattacatagttatgtaagtaaaatttttaaaaatcataaagggagcaccattgtacagtctagcataaacagcaaattttaaagaggacatatttaagttcataatcatatttttcagtaaatattgctcagtgaactggaaaactttaatagaaaaatgtctgcagttttgtgattgttaatttggttaaaccgatattttatattatttaagttaggtaacattttatattactttcatatgaataaaagtaatccatgcattgtagagtctataaaatgttgagttttaaaagatgatataaactttgatgctgggcactagtgctagtagatattactaccctcctgagggaaatcagaaatgatttaaccccggtggaatacattaattcttaaagcggctcttttcagtggtgtgacttttagattgtgtctcagtggttgaggaagctaacagtcttagatctacttttaaaacggatggccttcttaagaataaagcaaaaggtgattttctacataatttttgctttccaaaagtgatgatatgctctcctacagcaacatatgagaagaaaaaaggcttatctagattcgaaaattaacagcaattatagtaatatatcccctccttctaaatagtaaaaagctctgattgtacaagaattacctgtgctagtcaagttgttgtttttccttgaacaactttggaaaaatggatttgacagtacataatcagttctactaaccaaagcttgtatttggaaatttactttttgtacaaattgaattatataatgcttaaaatactttgtcactttataagcaaaatgcatagtacttaatttgtttatactgtaaagtatatgttaaatgcttttatcactttgagaataaaaagttactaatgctgttgtattttactttttaaaaactacacaaacatttgactttaaacttaaaaatgtttcaaatccatatttgatggatataatatttaatattaaacaatgtttatgatagactcgcctttttgaagatac

SEQ ID NO: 14091 - DNA, 1028 bp, Homo sapiens
cgagaccctgtctctatttaaaaaaataaaaaatcacagtggtttgtgtgaggcttgtcatgttttgtttgggtgatgaataatgaaatatggacatgtttactggatctttaaacaccagattttgtggtagcaaataacttattgaaaaaaaaaaacaatgcatgaatacttgatttatctggacacaagcagttgctgaatagtccaggctaaacctaggcagaacagtagttcttaacccagagcttctggccataactaaaatcttgtcttccctcgaagaatgtaatttcctcttaggtggagattacctgcttattctcccatgtctgtccaaggaggaggagagaattggtggtgggaatggttggatatgtttttgccttttttttcccagaaaactgcacaaaggcgcttaggccactgattgccaggttttacaaataaaaatgtaagatgagtatttaaatttgaatttcggataatcaatgaataatttttagtatagttacatcccttttaatgtttaggacatctttaatgctaaaaaatatctgttgtttacctgaaacttaattggtgtctagtatattatcttgcgatcctaactgggggcaaaggtagggggatcaaacaaaaattcaggactcatccccatacccccagggaagaaggctaaagaggtttctgtttggttttagttatctttgaattgtgtaagagtgttctaatggtaaattgtatacaaagatgagtataatacaaatacattcctctgataggtcttaaagtccagttccacctagtagatttgctgggtcatttttatagccctgtgatacaattcaggtgtatctagtataaccctcataaaatcatttgtgcaaaagttgaacatttttagtagggttttttttttaattttcctgaggaaataatttctgatttacaaaaaagagtcacatcacaggattcttctgggctctcctgatagtcttcactgattatagaccaaggaggcttat

SEQ ID NO: 14092 - DNA, 1027 bp, Homo sapiens
ggcttttctcctcagtattttctgatatttgttcagtgttgtataatttttcacattatttcatatatattatttcctttgggcgatatttttattttataattttgtcttccatgaaatgatcaccatagttaaacaatgtaataaattttcttattttcttagtttcttaaacgtgcagtgaaacttttaggttttcccctcttcagtgaaatgttcacagtacatctgtgagattataagagaggttaatttcattaattttcagtttgaccagccataaaacattcataaagaaattaagtaccttgcttattaaatcagatagattatgatggaaatggaattagaacttggatctttgtccagaccttttggacaggccacatatttatttgttagttttcaaacatgtgtatcatcagtttttcaatcaatttttagagttatgtaggccctcaaaatatgaattaaggagctgtctatgtatatgcctatcttaagtgtgattgaaatagtctcactatgatcttgtgtctgtctcttctcttttgctatagatgtgtcccaaacatggcacagactttttggaatataaatgtcgctactgctgttcagtggctgtttttttctgttttggaacaacacatttttgtaatgcttgtcatgatgattttcaaagaatgactagcattcctaaggaagaactaccacactgtcctgcaggtatgcttttaatattttaaaatcacgattatgatctatataccatagttttatgtaaacattatatgaaagctctgtttcaagtgacagaaactcaattcaaactagcctaaagaagcaggaggaattccttgatccttgtaagcttatgactttctgggtgaattaggaagcaggctcatcatcatgagtgagaagttagctgtgacggagcagatctcatggggagtgagaatgaagtctactaaggattggtgaaaagatggctgttcagcactaaaaagtcatatgaagttcaata

SEQ ID NO: 14093 - DNA, 1035 bp, Homo sapiens
gaagccaagggtacactggttagaaaaggctaattacattgtacattgtttgcgtgttgtctttctaatgatctgtttgctgtagtttaccacagtaagtttagtgccagcattatgctgtgatagaccgaaggtcctttggagacaagacccctgcctatgcctggttgttcctaatgtagagccctgtaacttacttacaggatttataggtcttacttctaaaaagcaagaagtgcttgtccagggcagggtcagggtggaaatctttgaggaaatgagattgcattcttcagatgacacatttatagtaagttttaacctgctagatttcatgtcccatatacttccagaagagatttgagatttccttgaaggagggcagtctgacaacgttaggaagaagtgaatgctggtaaaaattgcttaggttaatcctcagaaatctgaagaagataaactatatatccctagggcggaaaaagtcaatttatgctatcttgctattattgactgtgacacctgaaataggtatttttgacagtaatcctttcctaccactcatgtgttgctttctttcagtctgcattccccttcctccttgcatgcattatttctttttctatttttctgtccctattttaacatctcttgctttctgtatccaataacactcacatgcacttcttagagttgagctagttaagtcattttctattcttcattaatgaggggatatatcattctatataaaactgaagcttaccctttaagcctcagaaatttttaactatttctgaaaacagttgtctttttttttttttttttttttttgagacagagtttcactcttgatgcccaggctggagtgcaatggtacgatcttggctcactgcagcctccgcctgcaggtacaagcgattctcctgtctcagcctcccaagtagctcggattacaggcatataccaccacacctggctaattttttttgtatttagtaaagactgggtttcaccatgttagtcaggctggtc

SEQ ID NO: 14094 - DNA, 1030 bp, Homo sapiens
gaaagtgtaaatatgagggcatatcttaaaaaacattgactatgtaaaaagtaatgatatgtcatggtgatgtacaaaatgataaaagatcaatcctggatatgtatctacctaatactgtaaccttaaaaaaagtaacaattgacagactgcaaggaaaaataggacagtctacagttacaatgtgagattgtcatatacctgtaacagctatctgttcctgcataactaccccagaactcactggactaaaacagttgtttatttgctgacagtctgtgggttggcaattgcagcaaggctccactgagaggaatgactctttcctgttttggttacatagtgtgcttcaagtggtaccccctgagctcttttatcctccagaatgctggcctaggtttgttcagatgccagaagcattcaagaaagagagcacagaagctgcaaagccaaaatggcgaacactaaactcatatgccatgcttctgccaccttccattagctagtataattcacaaggccggtcaaattcaaagactgagaaataaactccacctgttgatggaaagagcgacagagaatttgtggctgttttgtgtatagtaccataacactctttttagtactggataggtcaggcagagaaaaagaatcagaaagtacacagatttgaatgattgacagtcttgatagaatatacaaaacattgcatatagttgtttacattcttttcagatacacacaaatgtctatggaaattgactgtttactggacacataaagcaagttttaacaaacttgaaataattggttttcttcccaccatgtcctcagtctttattgctagtatataagaattagataacaaaacaataacaagaaaaatatttatagggaaattaagtaacgcttccaaatgagttgcatcaaagaagaattataacagaaaatattttaaatggaatggcaataatagtacatctcaaaacttgttgtttggcagagttctagttatagttacgatgaaaca

SEQ ID NO: 14095 - DNA, 1055 bp, Homo sapiens
caagcaatttttttttttttttggtaaaaagtcactttttaaatttgtgtaattttttttaagttagtagaaaacttcctctgaaaacagaacaaatgtctgtgctttatagtaacaccatatataaagtgaattaagttaatgtttccctgtattctagtcattctggaaccaagcaacctatactaacacccagggacatttactgccaatcagttatgtacagtatttatagtctattcaaacaagaatgtacataagcttagagaagtggtgagtaaagaaaacacctaggcagttagccgtctattagaaaatagataattttaccaagggacacaggatttcaaacctggcttgaatgatggaaaaaactccagaaccaacggtgagcaaaaatattccaatttgaattcaggtgacagaaaaaggagctcacgaaaagaatagtttctaaatttgttttagagaaataagaaagagaagggatttctctttttttataaaatgtgtcaataaaggaaattgtatagctctcttaataactttgtaagtatttttaaatgttgctttaataaatagaaaagctgttagtttacttaagcctgaataaaaccattaagttcttttatagagtgtaaatacaacactggtgccaaaaatcagtttgttacctctcatgacaccttgatgcagccatcctccaagggctttgggcaacatttcccaagagtgagaaacctcacagaacactgaagacaccaaaagaaaactttggaaccaaattttgcttcctgttttattaggttttcatgtgtacatatccattttctttctatttggtgcacttacgattatatctgactgtttttcctgaatattatgatacatgaattccaccccagtgcttttgattctaaaaggagcttggaaacctttcttctttttcatttaaaatacaaagtagatttaagaaaaccataagttttaaggtacaatgctgaaatcagtcaaaatgttactgcatttgaaaagatcaaattatgatttaaaga

SEQ ID NO: 14096 - DNA, 1029 bp, Homo sapiens
acaatagatctttagtgtgaatcacaccactcagtggacttaggttagcaactatttgttcattttgaaaaggaaagaatcaaattgtaaaacgtgaaaaatgctaacacagcataattatagatttttttctttttagctgtctggggaatgggcaccccttccaccctgaaccacagaaaatttcatatatctaatatttttcaaatatgatcttatgtatgttcctacccaaaaaagtaactgcttgtatttcagtggtctgtgcaagaaataataagcatgaaccaaggcagtgatgatagggaatgagaagagagaatggctctgagaggaaacctaatatcatgggcttgaaagatgatgatgatagagggctaagcctactacaacactggaaatattttagcttaagcaactggatggttggtgggcttattcaccaaaacactggaagatggaaaagttctcaaaaggaaagaaactgagttcaattttggatttgaaatgttcgtggtacctggaatgttgatgaataaaattatcagacttttattttcacctacctacatctacgattattttaatgctttgcctttaactatgatttacatgtgctgcttttcctgttatgaaagagattaaaaatggagaggatctgtattgccatcatgctttaagttattgggtttgatttaatgcaggcatcatcatgaaaattttgtgggctatcaagatgacaatctattccaggatgaaatgagatatctacgttcaacatctgtacctgccccgtatatatcagtaactcctgatgcaagtcctaatgtatttgaagagccagagagcaatatgaagtctatgccaccaaggtattttagttctctcctgtctgttgaatagctagtgtttggtggaagaaagactttgaactagaaaagagtcctgtagaagttctttaatacatctgtgagccagttttgctaactgctggagcagtaagaaaaagcatacatgtatgactaaggt

SEQ ID NO: 14097 - DNA, 1034 bp, Homo sapiens
catgtcttagaaaataagactatagctatcttttactctttggtaggctgacttcactctgttagtgcgaaatgctgaagtgtaaagaaagtgtgtttccttagcagtcttttatttcgtaaattattcattctgttagcatttaaatgaataccaactgggcacctaccagccttgtgctaggccctgaatgtatgaatataacaaaatcctggcttctatgtactcatactcggatgtcaagtcagacatgttagtgaaacatttgaaatgccatgtgaggagtgctacaatagaagtatgtatgtaagatgctgttagagcataaaagatggagagtatctgaatcttccccaggaaatcagaaaaggcttcccagagggtctgagcctttagtagagtctcaaaggataaatagaaatctgtcaggcaagcgacaggaagaaagcgactcttggaagaataacccaggtgagtaaagacacaaatgaaatctcattacacatttcaggaatcacgggttgttaaaggactggctactggaggaaatatgtgaaagcccgttcaaagtgattggttcacccaagtaatgtcgggctctgtagcccaggttaagattgcattttatcccatgagcagaggaaacagtggaagaattttaaacagagaaatacatgaactggtttgcaattaaaaaatcactgtggaatgtggaagctaatgtggagactagataaaagtgcattactggagatagaaacctgttagtattctgttttcatatattggacctcagtggtgcagcctgtactttcacacatcatgcactgacactccaaaagagcctttcatataccaaaaccaaatttttttcatcagctgacaaatgaaggtaatctagatattgcccactgacatggcttgccgaccaacagttccattttggaaattgtcctctttgtgtagcagagttgtatggtttttaaaattttgtgcttactattacaataaaatgaataagcaacaaaaatgaa

SEQ ID NO: 14098 - DNA, 1032 bp, Homo sapiens
agctctagaatttaaactaacgtgtctatggttgtacagctggtgacatagcagatgtaagacttcagccagaatcttcattcgtgttttaaatgctgtactcattacaccatgctgtacacattgagcacaacttgagaacctacctcctctccttgtttttcccagatagactttttttagtctaagatgatatggtcataaaataatgtcctgaaacagtagaactgttcatttgaaaaagataagggttccgcttgatgtaaatcagacatttactaaatgactttttcacttactatgtgcttattatatattgctgtatatttacttcatattcataaatttttaaacatttttctttatataggaatattcagatataaatgaaaatacctaaggggagatcagctttatttaagataagttaaatatgagaacagcttaggtgacttctaaaggacttttctagcttaatccttaataattttttaactggcagtacaaaaaatatgtaagagtggattctgaagcaggactgccagggtactgatcccagctgtgcaactttttactcatgtgaccttgaccaagttaacctaatatctctgtgcctcagttttcccatttataaaatgaccttataggtcataaccacataaatttgatatgaagactaaatgagcaaataacagataaagctaatggatggtaagttaggtcttattgttaaaatgcaaaatgccttccatgctaaggatcaagttttaacctgggaaattttattcttataaacttagaagatagaagcttctttcaagataaaatgcctcttaaattagagtatcatttaagaaaagtttaaatttttctctgtaattagttaatcatcttttactcttgatgtatagatacagacataaatatggatatttggtgatcatgtgaatcttactattttaatataaaacctggagtgataaggaaagaaatgatatgaagttagtgcctttaaatcactaagattagttg

SEQ ID NO: 14099 - DNA, 1966 bp, Homo sapiens
atttttccaactttaaatattgcattaaagataaaagtaaaatcaaggatgattatatttctcaaattatggtgggcagaagccagaggttgactggtttcctgctatattttcttgccttcaactttattttaaatagcattgttgaaaaactgagattctttaattagtgctaatgactaattcttcagttatctttagttatgtgttttttttatattgacagtactgtagacttgctataaaagctattaataggaaggctttgaaagtgataatagattgtattttgtttatttttctttcctattcaaattttcaggaatctaaaactaatactgatgactttttcaaagacataaactcctgctgcccacaggaagcaacaatgcaagaacaagatatgccattcttgcgaggagggccaggcatgtacaaggtagtgaagacgggaccttcaggtcacaacatcagaagctgccctaaccttagaggtatcccaattggaatgttagttctgggaaacaaagtcaaagcagtgggagaggtatggattcttgtagcttcatgacttctaagatactcatttttaatgtaatacaaccaaagcatctcttctaaaggttgccatttctaccacaggtttttcaatgttaatgtattttatctttacttgtattgcaaatacataatttttctgtgcttctgtctaatgatttgcataattatccttgtgtaaacaatatattaacaaatgatttgtattgtatatataaatgtttggtatttgcacatattttttcattattacaaatgtactataccatcatggattatcatcacttaaaatattctatgtgatcggtatggagatgtggtcatatgcaaaaggtttcatttctttgttcccattcataggtctcactgaagtcctgagcaaataaaattactctttaggctactgtggcatttgcctcagctgataagcttgaagatgtagtgtgtcatgctatttctcagtaagggtcattttcaagttacactatggatactctcaacctaaataatagcaagtcggctgtgttaggacattttagatgcagaaaaaagaaaatgagccatgtgttcttgggtaattcttaaaattatttaggtgttatctttgtgctttgaaagttattattttaaccaaattcataaataagcagtattttacagaactttttattgacttctgtcttacctcaggctgtggccttaatttcagaaactaatttcttagtagaaatgtattggaatgattacactattcagacacgtaagatttttactggttttcagactgagttccctgaaagaatcaagccaatcaatcatgctttttgttatgtaccaggtaaccaattctgaagggacatgggtgcaactggatcagaacagcatggtagagttctgtgagagtgatgaaggagaggcatggtccttagctagagacagaggcggaaaccagtacctccgacatgaagatggcaagttggcttaaatttgtgatttattccaattaagctttcaaatacagaagtttaatgcctattgtattgcttttgttttaaagagttttttgtgtgtttgctttttaacaagcaaaactaaaagttaaaaaatcttgcaactgttaaaattggtttgtaaaatacgtgagtacttaatgcacattaaagaagaaaattaaaagaaaattcgaaacatatagactcatctttataaaacaggcttttaatttcattaatataaatttatatacctctttcttctgtaccagtccaggactgaacgttctatcccttctataataaaatgaaacttcggtattccaactaccaatctcagtacttctcccaggcaacttcatttgattgcattttgtcttagggaaagagcattgaataaatgcatagtgtcttta

SEQ ID NO: 14100 - DNA, 1028 bp, Homo sapiens
tttctgtattgaataaagcatgtattttactattgcttgagcatgataggcacagttctatgactttatgtctgtcagtgttttatactgtttagcacaagaattggataaactttgttttatacttattaatatagttttattaccttttcaataaaatattattttaaatttttaacaagttttcataattgcctttcagtgactagtttgcaattataattagttgtgccaaggcttaactcccagtgttaccctgaatgatcaaaagttagaattattgttataattaattaaatgcactaggaatattattaaataccagtgaagttgggtttttttgctaaatctatggatatttgcttttttatgttgccatgtaatttttaagaatcagttgtgagtgggattaaaacttgccccttccaactatgaaatggcatgatgtatttatttattaaccatttacaaacagacattttaaaatgtttacagaaaatcttgtgagtgtaatagcaagtactatgtaaagtttagacctgtgttactctcaatttttatcttgagtgctctctgtgtattcatgtaggtttgcatatatataaattcttacaaatatatatgatgagtatataaaatgcgtattttacatttattttcggttgtaaatctaagttttttgagtgtttaaaattctcatttccgttaaatttccaatatgtaaccaaagaatattggtaaataaaatataattacagtaaatgtaaattaatttttcttagtacatatttgtataagtaaaaattggttattcatcactatagtgagattcacaaaatattatgtgaaagttaatggtgactttaacattttccctgaccagtcatgtatggaattaacaaagtagcaggtatacagaattcttgaatctacatatttttaaacctgaggattctatttttaatattctactgtgttactgtgtgtatgaacatgtatacatatctcttcattatgaggctactggt

SEQ ID NO: 14101 - DNA, 1033 bp, Homo sapiens
ttgttccttaacaaaacatttttagacttaaacttagagatcctaaatgctctgcatttcctaaactttgagatagagaaaagtaggcctgtcttttgataaaattgattacatttttatcttttgataaaaaattgattgtatgtattatgtttttcttatcaaatttgttagtagcattcagaaacatttccaaatgaattttttcctacttataaagggaaggaaaattgaaaaaaatgactcagactttttattttttacttttttagtttttatttttatttttgtacttcaaaaagtgataagttcacgtaaactacatgccattattattcataatgataattgcattttctatacaatcgatatcatttccatttttattataaaacagcagactggtttctgtcataaaacaaatctggcttgtattagaacaaatacatcctcatttaaagaattttaaggtttctttcttgcattgagtatcttaagctttataacaacgtctggctcttaattttagtaaatggcatgacacactatatccatggagagcttctgacaaaaacttacttatcagacagaatttcttcggtgtgttgtttactcagatggcttcagtttctctttagtaaaataatatttccatgttggtgctagagtacagaaaaatgttgttactgtgcacgcatcttctgcagatgatatcctgttccctttctttgttgatatttttctttcttaaactttgttgctcagaatatctttaatgctagccaaggagtcagggatttggacgtattttcatggacttccaaagcttttttcccccaggtgagttaactgtaaggaacaataatattttattcaggtatttcagcatgtataacaaattttgtgtctttaaaacctttgcttaagattaataaaaccttttaaccaaaaaaagatctatatgaagtgctgcaattgagttttctcactcctgccaaaaagaatgtattattagtttaagtgatacttccac

SEQ ID NO: 14102 - DNA, 1034 bp, Homo sapiens
attctttaatccagtcaagtggacacctagaagtaatcatcacaaccattaactttgaaaaacatatttcttttgttttaggcattaatcttttctttacttttaaactgtctgtataataggataacaaggagaaaactctagtacttatcagtgtgaatttcttgtaacattatttttcctgatgctcctcaaggaaaggggtttctgtgatcagataaatttcgaaaacctggtttgggatgagtatcttttatctgaaatgcttggcaccagaagtattctagattttggactttttctgattttggaatagttgtattacagttaccagttgagcatccctaattcaaaatttcaaaattcagaatgctccagtgagcactttttttgagcatcatgtcagcacccaaaggttttagattttagatcattttggatttggggttttcagattagagatgctcaacttgtatatggtagtctcacttgagacattcacacaatctacattaacatattagggattctgagaagttctgaaatcaagaaacttgtctgactatgtttaatccttatcgtgggaccccttgcaagtggagaagagagaaacagggtggagatagtaataataccaattaatatttcaccaaaatatttgggaaaccctgctttaagtagtttgctttggcagtggaggtaaagaggtactttacattgatgtaattgtatgttctcatacattaatgtaactatatagactcagatatatccagttcatctgtaccattctagagaccttcaccagcagcctttgctgcactcttctttatttcaatatattcataaagcctttagttcagcaaatgttttttggttctgagcatacattttcctgggtaagacaattcctgtcaagtgttaacactttaatgaggattgtgaaaataaaacacgcaaacaaaaatcttatgaagtagaatataagtagtgacacacaagacatacaaattacagtaggaattcgaaagtag

SEQ ID NO: 14103 - DNA, 1050 bp, Homo sapiens
aagaccttattagagggggttgtaataccaaagggaggtgttagtgaagattctaaagtttgtgtgctaatcgaaatgattcactaaattgagagtaattgatgatgcatgagagagaacaaggtgattgcagcataaaaatgttgagggaataagattcacagcacaaggggagggactagctttggatcagatccaggacacttcctccattctaccatgagagaaggcaggggaaagtaggtttattaatcacattgcaactttgaggttgtatctgattgcttattgtctcacagaagaaagaggtgaggtcatgatcacctgagagttaggaagagaggtgatgcaggtttgaggtaagaaagaagtgaaattcaagcattttggagagtaggcaagcgtactatggcagggtggtaggattgccaggaggtatgcaaacaaattaaatgtttgctgaactatcgtaatgatgttgactgcttaaccaaaagtaaaatttccaatatccatcttatttcttttcagacccagtgagaatatgctgatccgtgtcaataatgatgggacttattgtgcaaattggactccaggggctattggactctacactcttcatgttaccattgatggcattgaaatcggtattttctttaaagccatgagctactacttacttcaaataactagagtcaaaattatttttatcttctagttttgcccattaacttgcactagacatatggataggtttcataacttatttgaggccttgttttctctttcataatgagtatttaattagtgcattaacattttgtaataatttctggtgtccgcccaggcactgtagccctcatgactctctccctccatttcctgatgttactagtcaggtgtgctctcttccacgctgctgttaccctgtctctcccctgtgggtgtgtctgtgcctctcctgactgtgagcagaaagcattcatgtttggatcttccagtgtagctcagtgcctggcacataatgacagcaaatatggatgaatgaat

SEQ ID NO: 14104 - DNA, 1112 bp, Homo sapiens
gctaaaaattcttctctattccaacacttgcttaaggaatttagtttctagtctccttacctccctaatcttttagtttcctatgaacatgcttcagtttgtataatttcttttgcaaattttgttaccacaacggaatgcaatatttcaaacatgttctgagtagcctaggtttagagcaggtatggaataccattcccaaacagtatctgtgaaatgttaattcaggtcccaggaaaggaaattttccttatcaaccattcacagatactatgtattcactcagtagtgagccaagtattgtagaggatggaaagatgaaatatggtctcttctttcattactaagtgtgttaataatatgaatttgagggagagtgatgaaatagaaaatacattgtactgaaagtctagaaacatggatttccttttctcacctttgtatggctaaagactcagccttaacttgcgtttttctcatgtgtaacttttgagtaggtaaagtcagctagatcatttctaattcatttttatgaaaacaaaaagggtagagagaaggaagggggctttgagtttgcttccttttactgtaagtacaggaggagttagaagtagatgagcagttggacatcttgacctgaaccttgaaagataatgatttctttgctaatgttgcaggcatacagaagtattcagaataatgtgccaagtttcatgtacctacagcccatttttgtctttacattttaccataattgtttcaggtcattttgttatttttttattaagaaacagattgctacaggtacaattgaagcctgcctaaacccttcctcagacccattaccaccccttccttagaggtaaccactgccctgagtgtagtgattctcattcctgtatatatttttaggctcttactgaatacaaatttattcataagcagtatattttgggttgttcaatacgttttccagaagtttataaaataatatcgtattgtatgtatcattttgccagatttttgcttaatgttgtttttgaggttcagccgtgtagctataggtcattcattttaactgctttaaagcattccattggggatctattcca

SEQ ID NO: 14105 - DNA, 1060 bp, Homo sapiens
tcagcatttgtttatttaaccaacatttcagtgattcagatgcagacatgaaattgtaagtccaaagagcatttgatggatattaaatttgcagcaacacttattaagatgatgttatcctgtcttcagagaggattttcattggtttttggcagatgtccagaggggatcaccaattacagatcaagttaatcgaatcagagatacagatggattaggctgagtttcagttcctgtgaaagtacttgtctacttctgaccaggaacagtggcccacacctataatcccagggctttgggaggccaaggagggaacatcacttgaggccaagagttcgagaccagcctcagtaatgtagtgagaccccatctctacaaaaaaataaaaataaaataaaatttctaagtacttgtctatttgcagtttactattcttgctagaatgtatctcttcagggttttggggtttacctatgcccccttcaattttgggttctctcaaatgccagatgtatctcctagaactctttgggatttttagctctctaatacctttagacatttaaaaaatatatattttggatgttttagttatcttcagaggcaatgttaatccgaattatcaaggtagtcattatttgaagctgaagtttgtaattttggcattttcagagagcagtggtgagccattgaaggcttttgggtagaggaatggcttgattagatttgtgttttgtaacgattgtggtggaatatggacagtgtaattgggcagatgatcaagaaacatgacttggttttagtctctttaggggactattgacttaatttggtgagatatgctgatcagttggactagtgagttgtcaatgaggatagattcaatagaatcagtagaacctggtagctagtggaggtggagtaaagaagaaaggtaggaaataaaagatgaaattcacatattgagcttgtgtccaattgataatggaagaggggcaggttttggttgagaaagatagcagattcagttttggatgaggtgagttttagatacttctga

SEQ ID NO: 14106 - DNA, 1040 bp, Homo sapiens
aagggtctagctctttctcattcaccaactatattagaagcacttgagggaaatttaccactccaaatccaaagcaatgaacagtcttttctggatgattttattgcctgtgtcccaggatcaagtggtggaaggcttgcaaggtaaatgtactttaagttacttactttattttagggctttcatctttcttcatttctgaaagaggggagtcattagaatattaaaatactactttaaaaaagtctggtttatgtatgtttaacttgctgaaatataaaatgatagttaatatttttgtttggcggttgtttgtttgtttgtttttgagagagagggtctcactgtgttgcccaggctggagtgcagtggcatgatctcagctcactgcaacctccacttcctggactcaagcgattcttgtgcctcagcctcccaggtagctgggattacagatatgccaccacacccggctatttttcttttttgtattttttgtagaaacagagtttccccatgttgcccaggctggaatagttatgatagtatatgataagaccaggtgcaatggctcatgcctgtaatcccagcactttaggaggctgaggtaagtggattgctagagcataggagttgaagacaagtctggccaacatggtgaaatcctgtgtctacaaaaaatacaaaaattagccaggcatggtggcacactcctgtagtcccagctacttggaggctgaggtggaaggattgctcaaaccctggaggcagaggttgctttgattgtgccagtgcaatccatggtgaaaccctgtctctgcaaaaaatacaaaaattagccaagcatggtggcacacacctgtagtcccagcttcttggaggctgaggtgggaggattgctcaaaccctagaggcggaggttgctgtgattgtgccactgcaaccagcttgggcaacagagcaagaccctatctcaaaaaaaaattaactaattaaattaaatttattatagttgttaattgattatttttgttgctttt

SEQ ID NO: 14107 - DNA, 1037 bp, Homo sapiens
gtgaatcattttcattgacataagatttgaaaacatgtttcttaaatttcttatttcctgtaatgatcatgttgtttttggtatcattgttttctcttcttagggttgttttccagttcaagagttcaaagaaatcaaataatggtacagatgttaatgcgggtcagatacctcagttattatacaggtatttagcatatttatactgaattagtatggtttattattttgctataatgaagtagaatcattacaaaacgtggcataatagggagaaattatttgaagcattcagcaaattataatatgctggtagaactataaatatatttaacaaaaacagttaatattttgtatatttttaaacattttccatacaggcttaactttaaactttgcctgattactcagattatctgtattataccaataacaatattttactgactttaaaaaaaatctatccattgattttcttactaatttcaaatgttgtaaaagaataaaatttgtcttggagaagtgagattgcagggaagatggggaggactatagatgcaggcctggttgatatattgtagtctcataagactgataaaatgagttggaaaattccctactgttggtaaattttcacctttagctaaaataccaaataataacttgctcatataatatttactatatttttaacattattgaaaaattttaacttacaataatttaagcatgtataaaggcatatgcctgtgtttaccttatttatttctagactactgcaatacttttagaataaagaattcaaatggatataaaccgttactgaaaaatgttgtcattcgttaagcagtaaaaaatcaaaggaaatggtctagaactgtgattctatctccctatctttctttctggtaatcactttgtggttacaaacattatttttccccaaaaggttttttcgtttgtttggtttttatgcaccgtgcaatctgttatagttactgtttgtaatatgtagctctacaaacataacgtgttgc

SEQ ID NO: 14108 - DNA, 1029 bp, Homo sapiens
cctgagaaatggagataatactactttatgggttttggagaatttaaaagggtaatatatattaaaattatatataaatatttttttcttaaggcttggtacctgcttctatatcagaacctcctccatttaaatgccttctgataaataaagtggatgggagttgtaaaacttttaatgactcagaacaagaggatctgcaaggatttggtgtgtgtcttgatcctgtatatgatgtaatttggaggtaagcatctcagtttataaaatagtcaataagttttgatgcagttatactcttatggtaatataaactttatttacaggtggacttttcacatgtgagtactctcctgtttatctaataactgcaattctgtctcagtgattcacagggacctttatactgtagcatagtggttaagagcatgcattttaagcaacactacctaggtttatcccagctccacaacttgctttctgtgtcaccctggagaagttactttgactgtgtgcctcagttttctcatttatgaaatggggatgctaatactacagaggtgcatactaggtgccatataagtgtttgctattatcattataattattaattttactgttgagagttctgttgttatttttagtctgtcatcaatcctgtttatattgtatagaattcattctattttttgttctcataattattattaactatgaggaggaaattatgccaaagacaataaagaataaagaagataattgagcttgccctttaagaatgtgcattaaaaaatactcttactggtagagaaatatacaggattatatgcattctggaaattataaaaacatagagataaataaggcacaaaagagactcaagaaattatgttgcatttgtttgaaatttattgtggtgctgggccgggtgcggtggctcacgcctgtaatcccagcactttgggaggccaaggcgggcagatcacgaggtcaggagatcgagaccatcctggctaacacagtgaaacc

SEQ ID NO: 14109 - DNA, 1032 bp, Homo sapiens
tatttacttttttttttctttttgagacagagcctcactctgtcatccaggctagaatgtagtggcatgatgatctcagctcactgaaacctccggctcccagattcaagcaattcttatgcctcagcctcctgagtagctgggattacaggcccatgccaccacacccagctaattttcgtatttttagtagagacgaggtttcaccatgttggccaggctggtctcaaacacctgacctcaggtgatcctcccatctcggcctcccaaagtgctgggattacaggcgtgagctactgcacctggcccctgtttacatttttgtgctctcttatttttgtcaaaaaataaggacagatcttaaaagagtatgagaaataaatgttgagtgttttggctgcttctctaatcatgtgcttgccatgtttccttccctggttctgtccagggattgaagctcagttgcttccacagttagtttgtggctgtgttttcttgctgtgctacctggtggttggatgagaacgtgaccagagtgttcgcagtgctccaggctcccttgttccagaatgctgtgaggggagagaggtcccgagccaggggtggaagaatatctattgagtcaatgtcagcattcttttattctttttcagctacaggcttactagtgagaaacttcctattactttttaaattaaactcttacctgaccaggtccctatagagagccatacttttaaactggttaatagttatttacttaaaatatcatatcttaccattgattgtgctgtttattttaaaacataaatgaaataatttagggacatatcatgtgaaaacaacattacatatttttctaattgtattcacagtttcagtatttattttggtctttttacatggatattctcagattatatgagttcaatagtgactttcttttatactatcaacttactatgtcaaagtgactttttaaatgaacaatttggaatactaatattttaacatattgtgtgtatttgtcgt

SEQ ID NO: 14110 - DNA, 1081 bp, Homo sapiens
tattttcttcattatcatctttaattatttgggtgcctagattatctccgatttggccagcagtagccccttcaagttggctcctgtattcttgtgacatgccccttcattttttggagtgcttcctttctttccagcataacaagttgttcagggtttatcttgtacaggccctgtatgactgtcctagaatcagccatttctccaagaaccctgattctttttagtggggaatagtattagacactaactgggcactagaagtgttcattgctacaggacgtctttggatctctggtatgcatatatttatatgtccacatatatgtatgtattttagaaatcataggccaggtgtggtggctcatacctataatcccagcactttggcaggccagtgtaggaggatcactcaagcccaggagtttgagaccagcctggacaacatagtgagaccccatctctattaaaaaaattagctgggtgccgtggcacatgccagtggtcctagctgctcaggaggttgaggtaggaggatcacttgagccctggaggtcgaggctgtagtgagagctgtgattccatcattgccctctggcctggacagcagagcaagatcctgtctcaaaaagaaagaaaaagaaccccactgtgacttctacttccaatccattcccacaaggttctttcttacctgtcctgttctatatttatgtactttcttcctcagtaagaatctttcctctcaacaatatcaatatatttatttctcacttagtccccagatatgtctaaaatagttttatatttgctttgcctgtacaagttcaaaaaaacaaactcactgaaaggtcattcttgctctttcccctcccacctgctccccaccccaagtctgaaggtgtatagtcaagcactgtccatgagtggcctggattctctctctcactcctttcagtggaaattgtgattcctttggaatagagtggggctcatttgtttcagtttaagattcccctcaccctatcctttgattaagttttatttcatttttaaaatatatagaacatttacatgttgc

SEQ ID NO: 14111 - DNA, 1050 bp, Homo sapiens
tgaatccattagcaattttttaaaaatggctagtactaacaatatcactaagtttaaaataattgttaaatgactttgcatgcagtaattttttatggaaactaaattttcccatataaactgttacattttaaattttgttatttctataacttaatgacccgtttattacataaggttttatccataaccagatcttatctctgtttttattaatttagtgatatttgcaaatggaagtatatagtctatcttttcaaaattccttctttgcaggtagattcttgatctatcacttctaacagctacagattcttcttgcttgttccttttaacatttttctcttgttcttccataataaactgatttaaatttttattttgaagatgaataatggcttaatcataattcacaaattataacacttgcagatggaagtggagaaagaggcgaaaaggatgcaagcaaaatcacaacataccctccaggctctgtgcgatttgactgtgagctccgggcagtccaagtcagctgtggatttcaccattcaggtagcggctggaactttagggtataactgcgtttttacaattgtgctcagtaacttatttcttcagatttgatgaacatagcctgttaactgtgtgttaaaagctgtagcgtggcagtctctcaaatctgtaagacctttgtatttattacagaatctctttaaacaactatggcatgatggaacaggtacttgtctagagatctaacttctagtctgtcttcctgtggacttcttttataattcaagacagtctggaagatgaaataatcctttaaatctctttcagttctagaatgctgtggtttttgtaacatgttcccatattttgttaatgttcagtgataaatgtatgtcaacaaatttactttcttaaaatgtagaaaataattaaattcttagtaaattattggcatttgggttagcttttgctgtactgttcaacctttataaaaacaaaaatgttaaattccttccttgaagattatttgataaggta

SEQ ID NO: 14112 - DNA, 1034 bp, Homo sapiens
gaacttctgggtgattggagaaaattcagagaaggtcagaattcatcctatacaggcagatattgactaaaggcaaagcagagtatatagactgaatcaataagtaaaattccatataaaatacagtaaattattctaaaatgtgcctataaactatattcgaaacagaattaacatttgtttcagctattcagtaccttacacagaaaaatgtgttaatagtgtacatagttaggaacatctgaattgttctagagatagtcctaaaatctattttaaaatgactgatttgaaaatctgaaggcacactgataaacatctgagtctattttactcttactttctgtttggaaatggtgcagtgtgatgaaaatattatagcctttggaattaggcttcaattttatttctgaatttgtcatttactagaactacatggctgtgcaaaatgtcttaatctctttggcttcagttttcttattttaaaaacaagaatagtaattcttaactgattgtgttgctatgaagattaaaatatatgtgtgtagtctttgcacacccacatatgtagtctttgcacatataaatcctccatgaatactagctttaatattttgaattgaattatttgttttctctttcagaattatcttaaaggtacaatatttgagatttattaaatgcatagtttatttttacaaaggatttaaggtttcaaccatttggtggtggtaaaatgcatgagccttatttatgattaaactctaaatttgtcctaccatttatgattttgggctggttacttaaccccttaacccttcaagccttagttttttcatctgtaagatggacaaagaatacctatattatcagattgctttattcattaaagaaagtaacaatagtaaatattgattgagcacttttcatattttatttaattctcataggaacctgatgagttacatatcattgttgctatattatagataggaaagctaggaccagaaggtccagtgtccagttgtcataca

SEQ ID NO: 14113 - DNA, 1066 bp, Homo sapiens
gcctcgaacaactgggcccaagtgaccctcctgcctcagcctcccgagtagctaggactgtacaggcatgtgccaccacacctgggtttagttattctttttaattcttggaaaacagtggtgaacaatgttatctcattgttaatttaaataacacaaaatcatattctgtgtaaaattatttcataaatctcattttaatggctgcgtattattccatttagtagatgtattatagtttttaattactttcatttgggtatttttaaaatgttgctataatgaataaagttgtagtaaacacctttgaggtgaaatcctttaaaaatattttagagttttctttaggatagattcctagggtgcagttactagatcaaaggataataatttttatgatcttgaaatatatcaccaagagctttctgaaaggcttgtactatttaacactgccacttattccatgctttttctgcctacctgcctacagatgaactctgaattacccattgtctacacatgagtgtagcttctatctaaacctggttatctcatacccctattttactcactcctctcccaatgaaagaaataaatcaccaagttctatttatacagccttcttaattctttaatagctttttaatatctacttttcagaatcttactgtttccttagctgaggcttcttttctttgcctatctgacagcaaaaagccttttaactggccttacctccagtcttatcttctaagccattagccaccttctttccagaatattcattctgcaatacagatcagatcagtagcacttctctgtttaaaaccaaaaggctattcatagtccttaggatgaaggatatacttttatctctacagcctcatctctctctattctcatttcttttcccttgcccttcctttttttcccctacctctgaacctttatgctacttgttacctcctttatttgacctcatcttatgtggtggtttcttttatctctacactgtctaccttcccaccctcaagttttgttagcttctcctctagtttgtgtgcct

SEQ ID NO: 14114 - DNA, 1082 bp, Homo sapiens
tgcctcagcctcccaaagtgttgggattataggtgtgaggcactgtgcccaacctattttattttaaatgaatatttttgcatttggacaagaattctaactatgtattcattttttaaaaaatcaaacttcagagtcattcagtgactttggaaatccttatactgtattaagtaattaaaaatctattctgatatgacacttttatgattttatctttatattattcttagcactccattaagcaatttttatttaaaaacaaatttttataagaaaacaaaattagatgaatatgatatacttacacttccatagagataaaacaagaaagataaataccaaaatattaacaatgctttttcctgacaggtgagtttatagatattttttattttcttctttacaatttgtttcctaaatattctccaataagcatattagtgtataaatagagtaaaagttatgttttacaactgaagccattttaaaaaaatactgattaggtttaaggcatccatactttgcttacctttgctttttaaaaaatatttttattttaattggatggaggactctctttcaggtgctgtgcttttcattactttctggccatggttctcaaggtggtctcaaagggaccagcatcacttgggcacttgttagaagtaccagttctcaggccccacttcagatctctactgaaacaaaaaactgggggagtacagccagtaaactgtgctttaatagcgttccaggtgattctgatggtcccaaagtgtgagacttagtgtgctaggtcagttgtttgcactttgcggtttgatccaatgaccttctgcatcagaatcacctgggcctaatgaatcagaatttatgggtcaagggtcttggaaatagatctgagtcacttgcacagtgttctaaggctcttctctggcactgtgctagaaaagattgtagtggctttgctcccatgaggaatagaaacatcaaataaaatgttagtgttccggctgccatacatacagatcttttatttctttggcctgttgatactttttagaaactaaaaatttagt

SEQ ID NO: 14115 - DNA, 1051 bp, Homo sapiens
tatatgttgttgttgttgttgtttttggccaatcatctagctgtcccagtgcccggggttaacattgaagaacaccttcagttacgacaagaagaaaaacggcaacgtgtaatcagaaggcacagattagaggaaggaagaggtaagatgtagctacagagaaaaagtacatgaaaatccactttcctaccctatcctgaaaccactgaaaagttcacacaataaactaatttggtaagaaatcatcaaaattaaaattagcaatattctgataactcatataatgggaaaatattcagggtattcatgcttcttctaataacatacgtttaggtatttataattgtgctaataacatacttttaattcagcagggtgtttatggcataagtcagccatattaagaactgtgccatctgcctactatcaataactattagaaatggcaactttttaaaaatagatattctcacaacttgtccttcacccggactttggactcatctatttgaccgtggaacaaaattcaatttagtctttttcatttctattttcttactcatttatgctcattatcatttggacatagtcctgctatgctgccctccagttcagcacataactatgctttcatgtgtccttttttggaaaaacctcattctagttatttacaggaagagtaagatggcaggtctgcaggtttcatttgcaaagataggtctattgtttatcttttcctcattgtttatgagcttaaaagtttcttagcttaaaaatacatttaactggccaggcacggtggctcacgcctgtaatcccagcactttgggaagctgaggcaggcagatcacaagatcaagagatcaagaccatcctggccaacatggtgaaaccccatcactactaaaagtacaaaaaaattagctgggcgtggtggtgtgcgcctgtagtcccagctactcaggagactgaggcaggagaatcacttgaacctggcaggtggagcttgcagtgagccatgatcgcaccactgcactccagcctggcgaca

SEQ ID NO: 14116 - DNA, 1283 bp, Homo sapiens
tattagtataagcaataaagtcgtctttatcaaaggataatatttattctgtagtgctttatgtttggctctgttttctgttttttaagcacctaacttctttatttttaaatttaatttggatgcagaaagactctgattattttttaacaatgttggaattgaaatttattctcctggatctctccaacgctatttccattaaaattcagtgttagctgggtgtagtggcccatgtctgtaatcccagcactttgggaggctgaggccagaggatcacttgaggccaggagtttgaaaccagcttcagcagcatagcaacacccctaactcaaaaaatatataataaaaataaaatttaatatccccactctctgagcttaagcagccagtatatatcgtgaacaaaatctataaattatctggtcccttttgaaattaattattcttcgttttttcctccagagacttacataatttataataattattcatagacttacatggacaatactaaccaagtataataattgctttatgaatgaagcaaactgaatatatcagaatattaaggactattaagctgacttcaattattataaaattgtgactacatatcttattatgataaagtacatataaaattgaccagcttaaccatttttaagtagacagttctgtggtattaaatccattcataatgttgtgcaactattaccaccatgcatctccataacttttcatcttgtaaaactgagactctgtaactgttaaacaatgactcctcattcttccctctcccctgcctctggcatccactattcttgttttctttctgtgtctgattgactactctaggtacctctcatataaagagaatcagagtatttgtcttttttgtgactggcttatttcacttagcataatatcctcagttcatccaggttgtcacatatgtcggaacatctttgctttttgaggctgaataatattctattgtatgtatattaccacattttgcttatccattcactcactgatgaacactttggttgcttccacattgtaactattgtgagtaatgcgctgtgaagatgagtgtacaaggagctctttgagaccctgttttcagttcttttgggcatatacccagaagtggaattgttggactatatggtaattttatttttaatcttttgaggaactgccatactatttttcacagcggccaaccattttacattcccaccaatagtgtacagatgttccagtttctccacatc

SEQ ID NO: 14117 - DNA, 1035 bp, Homo sapiens
ctgcctcttgctgagttttgttcttctgaagaccttggaaggtcactggaggtttgtaaattatgaagttgtcatgtgctttgggagggtgattggtggcagtaggaggatgatctagagtggggaactcttggcttggagcatggttgggaggctttctttggtctgttgaatgaaagtgttggtagtgaggatggaaaacaggaaaagatttaaaagtatgattgacagaaggtaacagccaagagacatttgacaatagccttccttgccttcttttgcagaaatgaaatggggagagtgtttattagtggtccctaaattaaaatttatttttgttactcaaatttaagcatttctttgtataattgcttggattagcatgctgtcattttttaaactgggaaatatagtcatccatcttttatacatgaaagtaacctgtataaaaattacaaattgatctgtcaaatagggtttggagttgaaaatatggcaacagcaatggatgaagacctggaagaagaactagatgaaaaagatgagaagtctatgatgtgccctccaggcatgcacaaatggaagctggagcagtgcatggtttgcactgtctgtggagactgtacaggttatggagccagctgtgtcagtagtggacggccagacagagtccccggagggtaagagacaatgattcctactaaagaacatgtgcagaacacatttctttgcaaaatcattccggagtatactctactattaatatttttttcttaaagaccagtggcatcttcacttgatcttagccaaaaggccaagaaagtattataattcttataattgttttctgttataataatttataatttaatgtcatctctaaggttgcctttctttcatttgattcatttaaaccattatttaaaaacagaccataagtttttcaagacttggggctgtacttttatttgtattatttttcaaagcctatttaatgctagatatctattatatttctttctgttgaacatgaat

SEQ ID NO: 14118 - DNA, 2541 bp, Homo sapiens
tttagtatacctaattatgtttctgggaatatgttacatcaattttcaataatgtatgacttttcctctaattgagaggaatgttcttatatttttaatcattaatatcttttagacatcaatattgatgtattattgtacctcaaaaacctgtaatatggagctgtatggctgctgtttctgctgaattagtaataaatattttaacaggaaaattttttgctgttatcagggttatttattatatagagatgtgaataaccacagcatgacagccataaggataagccctgaaacactggagcaagatggtactgtgatgttaccaggtatgtttcaagtagtcattttttctccacaagcaattttaagaaatgtgcatgttaagctatttagacacataaagaatgattagcaagggatagtgcttgcttataaaagggttttaaaaatcttgacatacaaagcattttatagtctacgtgaagttaatacatatcaagagaatagacatagaaatataacaagttttaatatttgttttcaaacttggccgtctatggcctaatctctgacctcaccccaccactgctgaattagtggggtgatgtaactgtgttgctcttaataaaaatcagaactctggctctcatgtgactcagtataaagaaccttctgtttatttttactttaacaacagtgcagttgggttttcctccttatttaatttaatttaattttatttaatttaatttaattttattttattttattttatgttaaaggggtttcagagacagagagtttagggtaggtcaggaatttttttttttaatttcatcatttatgcttcttatgcttcttaatactttgataaaggtctttggacacagtttattttgctttaattttgaggcttttatatattcacttaaatcactgctaaattatcaggcagtaggtctccaattttgatgaatgctggaaaaatgcatattctttattgtaagatctttgaatttgtttataatgttgatactttctgaggctgtttatattaaaatcttgagtgtctaatgtgtctgtcaataatttcatagtagcaatattacttgtaagcgtttgaccatctgaaagtgagagctacttctgaagagtgcattgagaagaataattgctcctgggctgcatgtttatttttaaatataatcttaataatttcatcaaacatttatttgaaccttactacatatacatagatacatattagtgtacatgacactatgttaaagtaaatatgacatttcatgtccatttcagaaatagaggagctttggaaagcggatgacttaataaaatcattttgaaaataaccatctattttcagatatgtctacagggttttttttttttttttttttttcattacaagtcctggaccatgtctttggtcataataataataataataatgacaataatattaaaaaatacttttaataacatgcacactccccccacatatttatacatatattgaaagtaatcatgtttgttgtataaaaatcatatgaacaaaaaagaatgaattgaaataattataatcccacttcccatatataaacactatgaacatattggtaaatatccttctcgtatttttcctttgtgtatatgtccatacttgtaaaaaagtgtgatcatatgctacatattgcttttttaatctatctctttcacttaatattctgaaaatatttctaggtcattaaatagtcttctacaatgtcacttaaatgttacaaaatatattccattgattaatgtttgagaatgaaagccttccagggttttgctatataaattacactgtaatgagcgttcctatcgtgctgtctttgtgccagtcattttaggataatgacatagaagaaaaattctaaattgacacatcccatccgctataacacatgggtactaatatcaaggatttacttctgagaaaccctgcacatttaatagagactgtgacttattgataagacaatttgaaaatatgtgcctacagctgttttatttattctgccttgataaaaaaattactcgttaatgtctttattcagtttaaatctcgttgctttgtttaacttgtgaaatgcaactttgaacaatacaagtgtggctttctgtgtttcataagtgtgtgctgtattagtggtgaagaatgaaccaaacttcaggaagatagtcccatatttgtcttcagaactggcagatgttgcttgatatattcctgaagatacaagcttaaaatattacatgatggataaagaaaggataaagagaaaatcttgaaatcacgtggcagaagactcctccctcaagcctgaagaagccttttgtaattttcttgtttctttgacctggactgaattttcatccaatagcactttttgtttttcgtgggtaggaatagctctgctctgtagccttccaatcaaggagcagaagtaaattgtcaggtttatagatggtaatgaa

SEQ ID NO: 14119 - DNA, 1050 bp, Homo sapiens
aatccagaaataatcctcaaaccttaaggtcactattaactgaaatcgttcttattaaacttttggccaaaatagctaacattcactttctctaacttgttactctcaatagttttaaaaaacaggggaaaaggaaataaatgccacaaagccaaaacagtacaattagtttctaaattgaggggacttttttttgtattcatcataaataaaaatctatttgtgttatggattaaacttctgacttagcaactttcattaagtaaataaagtgttcgcttttcttaaagtatgttccgattcttgcctttcatatcagtgacccagactcaacatgtaatcctttaaataagataggagcttttacttaaaaggtactaaggaatagaaatatagatggaagcataatttttaactggttaattgctttttttctccgatgctaactatgggtctttaaactatctaaagttttctagatccttctattattataggaaaattctcagaagtactagagctgtggttctcattatgtggttctcaattctcattagcatgtatcagagttatcggggacttccctatggtgtttctgattccatagacttggggtggggcccaaaagtttgtatttggaattagtttcttggtgatacagatgctggtttgaggagtacactgctggtttagactaaaacttggtcctttttttccgacttggctatttagattttgtaggacccacctgtgagaaccaaactgcatgaacctaactacatgtcagatttttcttttttggtcgcatgtggggactcagttattgtgtttgacttttgtttgttttaatgagagggaggatgctggtcattgaatcaagctgaggattttttaaaaccacccccctcacatacacagttattaaaagctattaccaaatagaagctgtcatgttggcaggcaagcaccgtgttggttattgttatgatagcaccagtgatcatattaatattgtgaagtgctgcttggcttgacagcattttactgaag

SEQ ID NO: 14120 - DNA, 1026 bp, Homo sapiens
aggagtttgagaacagcctggccaacatggtgaaaccctgtctctactaaaaatacaaaaattagcccggcattgtggcagtcgcctataatcccagctactcagaggctgaggcaggaaaattgcttgaacccaggaggcggaggttgcagtgagccgagatcatgccattgcactccggcctgggtgacagagtgagactgtctcaaaaaaaaaaaaagaaactggctgggcgtaatggctcacgcctgtaatcccagctctttgggaggccaaggcgggcggatcacgaggtcaggagatcgagaccatcctggctaacacggtgaaaccccgtctgtactaaaaacacaaaaaaaacttagcccgtcacggtggcgggcgcctgtagtcccagctactcgggaggctgaggcaggagaatggcgtgaacccgggaggcggagcttgcagtgagccgagatggcgccactgcactccagcctggacaacagagctagactccatttaccaaaacaaaaaacctgtattatagaactactctcagtttactctgttctgtttaagtattggtatatttaagactggaaggtctatatatatatatatatatatatatatatttttttttttttttttttttttttttttttttttgagacggagtctagctctgttgcccaggctggagtgcagtggtgccatctcggctcactgcaagctccgcctcccaggttcaggccattctcctgcctcagcctcccaagtagctgggactacaggcacctgccaccgcgcccggctaatttttttttgtatttttagtagagacggggtttcaccgtgttagccgggatggtctcgatctcctgacctcgtgatccgcctgcctcggcctcccaacgtgctgggattacaggcgtgagccactgcacccagcctgttatatatattttttctatatagtagatatagttaatatttacaacaaaagaataggtgaaaatatagacatttttaaatggt

SEQ ID NO: 14121 - DNA, 1293 bp, Homo sapiens
gatatactactcatttttatatagtaattttatatcctgtgattttgttaaatctgcatactatttctggtaacttttttgcagattccttaagattctctacatgtttttttacaagtaaaaacatttcttttttagaaaatacttcttgcctttttcccttggctggataggatattttccttgcactagataggatatccagtacaatgttgatgagttgctgagagtagaccaatttgcctggatcacaatcttagagggaaagcattcagtctattaccatgttagctgtggttattttgtagataccctttatcaagttgagaaaattcccttctattcctaacttagactttttttttttctatcatgaatcgatactggatttttgtcaagtgatctttctgtgtttatttgaagtataatatattttttctctgttacaacagtggttgcttttccagtgttgtgccagcattgtccctgggttaaacctcagttggtcataatgtattacttttttatatattgttggatttgaatagctaatacttgtaatatctctggatatttggatgagatatttgtaatatctcttatacatatattcataagttatatgccatgccaatttaactttttgatgtatttcttatttaacaagtgtattttttttttccaattctttatggaagaagagtcgaatatttgggaccaagtgtttttggtacttgaggtatcattttgtttatcttagatacttcctggacatactctaattattggaagttgaatttctaaaatattttaaaacagctttttatatttataatataaatgttgatcttgaaattgtagttgctgtctgatgaataaaatattgggcataaaagagaaactgtttagtcttaacaaattaccaatcacatgatttttagcctttatcaatactgataggtgagagagagcttagggaagcatctacagtttacttggcattactgttacttgaatgagaatgaaatgagctgatgaaaattaagtgtttttttgggaggccctcatttctgtgtaaacttctatatctacttttaaaagcattcaaaatgcaatctaatgtttgtagtaggtcattgagactctacagtgtgtctagagtctcttaggaagtcgtaaaatgaatttcctttgatacagaactctaagagttaagctttgttgagtctattcctgtcatggcgatacaagaatatttctaagttttttgcccatccttttccagcccttgtc

SEQ ID NO: 14122 - DNA, 1035 bp, Homo sapiens
catatatatgcacttgtgtgtgtatgtgtgtgtgttcagttttcttgggtgcatactgaggagtggaatgtttaggtggtttttcctttgatttgccagaaggactcataaatctcacaagcaatttatactcatggctaagatttattacaacaaaggatacagagcaagcagcaggaaaaaggtatgtgtttgtgatgtataggaagttatggcataggcttcctagttcttcattgactgagctttcatgtcagaaagaaagacatgctttctctctggcagtgaactacagagaaatgtgtatattgtttttgctcaggtgagttttagaattcaagactttgtgggtttggtcacacagacatatcttgttagtcaatcagacatggtaagtgaaactcaggtacacattgtaaagcttgatgttcgtacatgcagagcagtctgacaggccaggaggcatggtccattgctctgtgtgttcataacacaatcatcaatcactaccacaaagaaaactctaaacatccacattcccaaaggttagccaagggtcaatcatggtttccttggggaaatacaaggagtaagcaatcatgcctgcagcgttaactttttcctcagagtgggcacggtaaatgtacgtttagtttagctttttttttttttttgagacagagtttcgctcttgttccgcaggttagagtgcaatggcacgatctcggctcattgcaacctccgcctcccaggttcaagcaattctcctgcctcaggctcccgaggagctgggattacaggcatgcaccgccacgcccggctaattttgtatttttagtagagacggggtttctccatgtggaggctggtctcgaactcctgacctcaggtgatctgcccgccttggcctcccaaagtgctgggattacaggcgtgagtcactgcacccggcctgtacatttagctttttaagaaactagaaaactcttttccaaagtggttgttccaatctgtagtcccaccagtggtatatga

SEQ ID NO: 14123 - DNA, 1050 bp, Homo sapiens
atctttatttttgtcttcattcttacaggatacttttagaatcctttatgtgaattatatcagctttcatggatctaaaaacatctttatttttgtcttcattcttaaaagatacattcttaaaggttacatgattccaggttactttcccccacctctaacccccatccctccactctaccacctccccctccccaccccccagcccttttcaacacaaagaatggaaactatcaattttattgttcctttaagcatatctcttctctggctgctttaaagattttctctttatgctttgcttttagcaatatgaccatgctgtgcctaggtatgcttttctttggattttcctgcttaaagttccctgagtttcttgaatctctcagttgatttctttcttcacttttgggaaattgtcagtaattatcttgtcatatattgcttttgttccattcttttttctctctttctgggattccaattatatgaatatgagaccatctgactttgtcccacatgtctcgttctctgtttggttcatcccatttttgtttccgtgattgaattctgttatttatttatttatttatttttggcctgtttgcaagtctgtgaaacctgtttttctgtaacttactctgcttttaaaatcatatgagaagttcttaatttcagatgtttatttttcagtttcagaatgtccacttggttctttttttataaattatgttgaaaattgccaattgcattattttacacatattgttaatctctgcatctcaggtacttgcctcctaacgttaatatctgggttttctgtgagtctgactaattttctggttttctcttgattatgtgtctgccacatattttgcttcttttgatgtcccttaatgtgtttacttagtgtccccgaactagactaacactgtgtatgaatgaacatgattttctttcagatcatgtgttttctcctagagaggtgtgctctttgctgtgtcagacagatagaatgaggagtttgattatctcaatccagtgagggat

SEQ ID NO: 14124 - DNA, 1048 bp, Homo sapiens
gataggagtatcattacattaattacacagaatgaatctggcttctatggaaaagcttcagtttacataaggtgcttcatagattgatttttaaaagttggtcttgtatccagtgaccttgataattcccttgttaattctttatttgtggattattttgtattttctataaatataattatctacaaataaaaaatgctttacttttaatttttaaccattatgacttttatttcatttgcatcacttactgaccttcaatattgtgttaacagaagtggtgatagtacaaatccttgcattttcctcctatgcctaagtggaaatacttaatttttcaacattcagtatagttgaatacactgttaaaagtaggttttttatagataatctgtattagattaagtaaaatctgttcctggttcaccaaggagtttcatcactagtggttgttgagttttaaaaatactttttctgtttctattgaagtgatcatatgttttgtttcttttgttctgttattatattgaattatgttgattatgtatttattctttccacatgttgttagacaaaattatttgtaggtaaatggctctctctttttttaaaaataaaaggggtaatacacataccataaattcacccttttatacaacttattggtttccagtatattcacaaagtcatacaactaaacatttttgtctctccataaatcccaaagctattagcagtcagtttctattctcctttctatcagtttttggcaactactacttcctgtttttatgaatttgcctacctagacattacatataaatggaattatacaatttatgaccttttgttgccattgtttctttcacttagcataatgttttcaaggttcatccatgttgtagcatgagtcagtacttcattctttttttatgggtaaacaacattctcttatatggaagtgctacactttatacattcattagttggtgagcatttgggttgttgctattttttggctgtgcagtatttttgcttctatgttcat

SEQ ID NO: 14125 - DNA, 1977 bp, Homo sapiens
tgcaaaaatcagtgtggaacaggaaaggagggtggcatgttcagtctgattccaagtttgagaagttgttctgtgtctaacaggcacacatgtcatattatcaagtaattgaagtttttgtttgtttgtttgttttgaggcagagtctcgctctgtcacccaggccagagtgcagtggtgcgatctcggctcactgcaacctccgcctgccaggttcaagtgattcttctgcctcagcctcctgagtagttgggattacaggcgtgtcccaccacactcggctgatttttgtatttttactagaggtggggtttcaccatattggtcaggctggtctcgaactcctcacctcgtgatccgcctgcctcgttctcccaaagtgctgggattacaggcgtgagccactgcgcctggcccagtatttgtagtttttaagaaggaaataaaaatatttttcttccaatttatgtgttattttttcaaatgtctactcatttgttaggacatgaattcttgttatttggatctaactacttaataaacactactgtttggtatttcttttggcctatgagtgcatggaaaaattaccgatgatggctgtgcatgggcccaataaaagggttttcattcaccagtgctgatctagcaactgctgctgctgaatatccagcctgacagcagcagagatcaatcatccttcaagcaggccaaccagtccttatacagtggaaaggaccatgattcattttgattggatttgagacatattctgggtctgaatttgtctttccagcagggtctcacccaggactactgtttgagggcttgcaggatgtttgatcctctactacagggatcatttcagaataagggacccactgttatgttatgttatgttatgttatgttatgttatgttatgttatgttatgttatgttatgttatgttttgagacggagtcttgctctgttgcccaagctggagtgcaatggcgtgatctcagctgactgcaacctccgcctcccgggttcaagcagttctcctacctcagcctcctgagttgctgggactacaggtgcacatcaccacgcccagctaatttttgtgtttttagtagagacggggtttcaccatgtggaccaggatggtctcgaactcctgacctcgtgatccggccacgtcagcctcccaaagtgctgggattacaggcgtgagccaccgcgcccggccgggacccacttttatagaataggagaatcatttgtcccatcttgcaccacaccgtccagaagctgatgacttgatagagcagtaaaacagtcctttgatggcacagctgatgatgagatcctgcagcttgggcatgatgccctgcaagggtgaggcgcccattctccagtgttcccagtaggaagatcacatgaaattaggagtggctccgcatagcatcactctgtgaatcacctgggcagtttctgcttcccatctccatagctctgatggcaaggggttaaaagatcctggttctcagaagagaaacatttccaacagagggcgctatgagaatcctgttatactttaaagtacagctgccactaggatttggggctccttttctaaataaagaagtcaccaggctgggcacgatggctcacgcctgtaatcccagcactttgggaggccgagatgagtggatcacgtgaagtcaggagttcgaaaccagctcagccaacatggtgagaccctgtttgtactacaaatacaaaacaattagccgggcatgttggcgcgtgcttgtaatcccagctaattgggaggctgagtcaggagaactgcttgaacctgggatgtggaggttgcagtgagccgagattgcgccactgcactccagcctgggcaatagagcaagactccatctcaaaacaaaaaaaaaacaacaaaaaaagaagtcaccatttggacagggttaatgtc

SEQ ID NO: 14126 - DNA, 1091 bp, Homo sapiens
tttcagatcccgctttcaggcacatgttcccctagctcttggcaatattggcagctaaaactgattgcagctgagtcccactccacgcattgccctgagccaagagttgcctcccccagagtcatgcctcctcttcaggggcagtttacatctaatatctatacagtgtagggatataaatgcctagcgcttttgctataagacaagccaaccttgaagtctatcccaacaccagagagctctcccatgggtctggctgagggcttcctgggactgcattgcagatcaactccttcctctgttcagtcttacgtctttcactgccccacagttgttggttcggagggcactccgcaataaacttccggtgtgcacatctgcatttgagagtctgtttcctgggaaccctcctacccaaagcagttggtgccaggagtggtctcagaaagtagactttacagtgaggttttgaagctggattattggctggctggctggcaatgagaatcgattctggtgctagatggagcactaatactgataacgcttggcatgcactgtagctatgcaacttaaaactttcactggtggtgagttggaatgctattcctgttgaagggaatgcactggtgagtgcactaggcttttgagaagttcagagaaattaattatgaggacaatcatcagatggcttttggtaaataacattgatagattggagaaagatgatgcaaggtggaagataattgggggcaaaatgtaaaaggaaatttatttagcatcatgtaaagaaacacatatacagtaagaggaaaaatctaaggcttcaacccaaaacttaattttaagggtagcagagcaccaaggtaggtagaattctctctcagctatgctaaggtcagtgttctggttgggcaggaatcctgacccttaggatggggcatctgagtgcacttgaaaaccctgaaaccccaaattcctcttaaccctctgggcctgcagaagtggccttcttctactagctagaggggttgcttgcagactgtgctgtccctcttacccccagctcctcctctctcgcctactgacta

SEQ ID NO: 14127 - DNA, 1033 bp, Homo sapiens
gttggagacagttgtaaagctggagctttgttcacactttttctaggttaaccagttttctcatgtctgtgattgtttacaggattgggcacagcagtagttttaccatatggatgtaaacgtgtgtaactattttttgctatctgaactgaaggccagaatggcacaagtctgtttcttgctaatgcttttgaaaatagcacaaaactacgtgagacagtttgccctgataattaggtataattttgatctgtaaatctctaaattatggcaccgcaggaacatctttacaaactcctctcaaagaatttaaatttattttgtgtatggtttccagacttatgcaataatttttgacttgtatattcctgttttgacttcctactactagtgtaatatgatttctgtgtatctagaactatattaacggttttagacaaaattaacatagattaatcatataacatttgtgaatgattttttagcccttggtccatttttgtacaagccgtcaatgaaaagtaatgaagaattagttcaagtatttcaagaactactcatggaaatcagcattatgttatgatattgcctgctaatgcttgttcaacgcaacattattgtttatttaagttcacattattttattacaaaaagtagcctgcaactactctattgatgatttgattaagaattaaatcacatttcttattaaagatgttgaggaaagtagacttggggtttcggctctgaatgaatgatagaattatttgtatagggacacaagttaaaggagaagatgatatcttttagagagactgaatggagcaataatagagaatgaagctctagtgagcatcaggtttaaaggtgtgagagaaaggagacagtgaaggaaacggaatcaaaattaagaagaaaatcatgaaacagtagcctctgtggctctaggagagtggattgaaaattctcagaagtggtaaatgttgaagaaagtgagaaccgttttcaggtcattgataacttttgaggaagt

SEQ ID NO: 14128 - DNA, 1096 bp, Homo sapiens
ggagcacttatcgagataggagggtgcggtggctgcagtttctcgtgtgtgtgtgtgtgtgtgtgtgtgtgtgtgtgtgtgtgtgtgtctgcctgcctatgtggggggatagtgaggggtggtaggggaacctgtgatgctggaaaaggcgatggtgctggtcggctgtgacacgtgtgtgtatcgttgaggtaggaggtggcatgggtagagagggtaagaggatgatacacgaagagaattgcaacagtggcaagggaagtggcgttttcagtgtctctgccgcaatgttatttgcacgtgccgcctctcccatgacattccttccagccctttccacctcccttcaatctgcctttcaccaagaggagtcatggtatagattggttgagttttggataagcaggcccgagggataggcgtgaggtttgctttaaaaagatttatgaataagggacgcagatggagatctgtgtggatgcgaaaggtgtctgatagagatttttagagctgtactttgataaccgggccttttggtcttctagaaatgaggttgcagttactcttgtgatctgatgtcccatcggccatttctcttcatcctctgttcgatttcctctgttacttacaggctttagagtagagagggttttgtagggaaaaggggaaaactgcagaacttcagaatatgacagctggtacagcgttcaactgccactagctagaaaatctgaatagcgcgtagatttgtctcttttacttgggttggctacaccttcagcttccttgatgtagatgttcagttggtttcattttctttttcttaaaatgtgggtgcttttttttgctgagggctctcctattgttttcttttccatgcccttacatgccgcataccctgaaggttggtgactgacttgtttcaccagctttgacagtggtaattgggagttggcttcatcttttttttcccacagcttcttgcagtacatggggaaaacatagtaggaaactgtcaaaatgagttaaagagtttactgttatttattgaatgtgcaatttattaggcaattgttaggtgtctttttctcccatt

SEQ ID NO: 14129 - DNA, 4203 bp, Homo sapiens
agcggcggcggcggcggccgggcaggtggcagcggcatcggcggcggcggccgtggtgggcgcagcgggcctggcgtccatctgcgactcggacacggacccgcgcgagctcgaggcgttcgcggagcgcttcaagcagcggcgcatcaagctgggcgtgacgcaggccgacgtgggctcggcgctggccaacctcaagatcccgggcgtgggctcactcagccagagcaccatctgcaggttcgagtcgctcacgctctcgcacaacaacatgatcgcgctcaagcccatcctgcaggcgtggctcgaggaggccgagggcgcccagcgcgagaaaatgaacaagcctgagctcttcaacggcggcgagaagaagcgcaagcggacttccatcgccgcgcccgagaagcgctccctcgaggcctacttcgccgtgcagccccggccctcgtccgagaagatcgccgccatcgccgagaaactggacctcaaaaagaacgtggtgcgggtgtggttttgcaaccagagacagaagcagaagcggatgaaattctctgccacttactgagggggctgggaggtgtcgggcgggacagaatggggagctgaggaggcatttttggggggctttcctctgcttgcctcccctcggatttggagtgtccgttatcctgcctgcatttggggagtcccttctcgctctctttcctccacccattctctgattttcctgcctttgctgtcccctagccttgaggactggggtgctgggtgtggggattggagtatagggtaggggagaagggggggagcattcgggggagtggggagtggggggaaggaaagcggagacccgagcaggggttttaaggagcaggatggttctggggtttgggtggggggagacgcgggaagggtaggaaaatggactgtttctgaccagagacacttacctaaatatcctggggaccaaggaactatgtacaaaaacaaacctaccaaccaccaaaaactagacaaataaagacaaactaaaacaaaacagaacaaaagcaaaggaaaatgctttagaaattttaactccggggagccataatctgcaacttcattttcccccatagaagagaaaaaagagcaccaccattattaccacctccccaaccctacacgcacgaactgagtcgaaaaacgaaaaccaaacgagcgagaagttgaagttctgggtatcaaagctagttgttctgtctgcgtgtttaatttttccctctctcacctccaccccatccatatcctctttatttcctccgttccaatgagaggcctatggctgctctccaatcccgggaagtgagtgggagcacagctgaaaagagagggtcagggggaggctggctgcttgcttaggtggaatccaagttttcccgtggccctgcctatactctggtggcctggtcctgttggggtgggggtctttggagagaagggcatagtctttgagctactaaaaagcagaattccggagcttcgagatatcttattctaggaaaatgaaacaattttaacaacagttttttttcctcttatgtcgaagatctagttttagacaatttcaaaataagcttttcccactcatagaactttaacttgccctttcagttttatcttttttttagagagaggtttaaactactgatttttcctgttgattcaaatagactaatggggtgaaagttattaggagagatactctctcctgttttctccactgaacgagactcatcttgctcttctaggtcccgtttcttcctctcttggaggacatgaaattatagaaatgttgagaagttcctgctttcttttgcggtaggacttggctgtgagaaaatcacctaaatcccagaaaagaggaagacagatttaaagtgcccccacccccatttgtttcaaagaggtctgcatgttgggcgaaaacagaacaactgtgtttccttttacttgttcttattattcaagagtcatttattacaggggataaatgttgggtagcaagaactttaatttgcactaccagtctcccaaatagaaaatcatgtatagtatttcatagtaataatcaggtaccttacaagctgctggtggattttaaaaaattaagatagttgaaggtggttaggtaaaatgcctgctttgtgtacaagatactctttggatctctcgtagagatggtttgttaccatcctttaatcataactaaaacattgaaaacagaacaaatgagaaaagaaaaaaaacctgccgattaacaagactgaaatcatgcatgatctgaaaggtgtggaaagaaacacaattaggtctcactctggttaggcattatttatttaattatgttgtatatcattgtttgcagggcaaacattctatgcatttgaaactgagcactaaactgggctagctttctggtagaccgttttgtggctagtgcgatttcacagtctactgcctgtttccactgaaaacatttttgtcatattcttgtattcaaagaaaaaggaaaaaagattattgtaaatattttatttaatgcacacattcacacagtggtaacagactgccagtgttcatcctgaaatgtctcacggattgatctacctgtccatgtatgtctgctgagctttctccttggttatgttttttctcttttacctttctcctcccttacttctatcagaaccaattctatgcgccaaaatacaacagggggatgtgtcccagtacacttacaaataaaacataactgaaagaagagcagttttatgatttgggtgcgtttttgtgtttatactgggccaggtcctggtagaacctttcaacaaacaaccaaacaaaaagaaaacacaaagaaatggggggagggtagggtgttgaagggggacaaaaaggggagagattgagaatgatgtatttttttgctgaatcagaattcactttcagataactcatgaaaagtggtgctctaaataaaatgaattctatattagttgcctgtgtttataaaagttattattttttaactgcagaaactcttaaaccacagcacttgatccagagtggtgaaaaccaataaataaccaggcacccaaaaaacatttaaatttagggtcagggacagaggaatttggaggtttagatgtgatattctaccctaaaaacacctagtaactgaatggcttttctttggagggtaatacattttaaaacatttagtgtgccacctactgctccacagtgactagagagcctctatttcttggtgacttgggactagatcagatgccaaatgtacaaagtttcttaagagttgagattatatcatctgaagtcatcttattttagccaaatctttttaatttcaccggcaaatctgtgaaggaaaacacttgatgttcaaaaagaatagtacattttaaaagctgcgattttaaacagttgttaatgttaaaaaaaaaaagcactagaggtatttttaaacatagaactcttccataaaaagttgatttgtttttgctgttattgacttgaaacatcatcagttttaaataaaatgcatttgtaaaaaaaccgttattttatagaaaagtatgactggatttcattgttggaaaaacaggacagaacaaatgaaaagatttacaaagggttttttttaaagtctgcctcaagcagaaatgttgcaggcaaacacatgtgtattatataataatgatcaatgtaggtattaagaatttaagaatttgctttaaataaaacctttaccacataaaaataagagtattatgttaataaaacatcatgaaaatgaatttcctattttatgtagtaggaaactgtgcaaaacaaaaaaaaatgctttgctttctggtaagcgaatctatatatggcttgaaggagtagtaagactattctaagacgcctttaactgtcaatccatgaaaaaaaaacaaaaagggacctcctgaagaggccaaactatcattgaagtgggtgtcaatgagtgatagtttggcctttcaaagttttctagttctgaagagaagttcactctaagcggattcctccaccagttttggggtgaatatgataaaatgtgtgtctcggattcttttaaagaataatctcaaaataagtttgagagagtgggaa

SEQ ID NO: 14130 - DNA, 1027 bp, Homo sapiens
acggccgcgagaagtggggctcaggtgttagaggagtgcatcccgtcggcgcgcggggctagagctgtcggagaagcgggaccgcgaggccggcgcgcggcgctctgcgcggtcagagggagcgcctggcagcagcaggagcagcagcagcagcccgcggcggggccgccgccagccgccgcgaccgccgcggctgcagcctccgaagggaggccgggtgagccggcgtacgcactttcccgcggactttcggagtgtttgtggatatacatgccaagccgccacgatgatgtccatgaacagcaagcagcctcactttgccatgcatcccaccctccctgagcacaagtacccgtcgctgcactccagctccgaggccatccggcgggcctgcctgcccacgccgccggtaagcgccccacgcccgcggccccggcccgcgcgcccgcccctccccgtctccgaaacgctgcatgtcgggggctggtgtgtgcaggtcccggtgcggggaactgcgggcagggggtgtagagcagtcccgcagcgaggcacgttttgtccggcggcccttaatgtcgtgttcctgtctgcctctgcctccgcgtcaggcgcctgcgatcggagtagggagcgctggggccaggactctcgacttccctctactttctctgttaatttcacgcctcagaaaggcagtctctgtgcgtgctcgggtgtgtgacacgggtccccagctgcgagttacatttccatttcttcttttccctctttttcgtctcccacgcccgtttccggaatgtgttcttgtgtccccctttctccctacttctgtccccctctccacgctcccatcccttctcgtctgccccctccctggtcgtcaatgtgccccctctccgtctttcccgctctccactgcccccaaacccgttgttattttggttgctttgtgtttgcccttcgcatgctgtgctttccggcctgtgtgtgtgtttcttctgttgttttgttttgctcttttggtttt

SEQ ID NO: 14131 - DNA, 1573 bp, Homo sapiens
tttgaagatcaaagatttgggtcatctttgtttaagatgtcctcagagatgcacagtcttcataaccaccttcagtctccttggtctacttcctttgtgcctgaaaagaggaataaaaatgtgaatcaatcaacaaaaagaaaaatccagagcagcctttccagtgccagcccatcaaaagcaactaaaagttgactcattagaaaggtgtcatttgtggttttgtcctgagagaaatagaaaagttgttaaagttaccttttttcctcataaaagttctatacaaattggaattgataatctttagtcaagtatcaagtcaggatggtggattaacctgtacccagaatacttattgttcattttgaaaagactttgttcttttcatttttatttgggagtctttgtgaccagagaagttagggaggaggttatttttgtgttttggggttggttggttggttggttttgtttttggttttgtttttttactgaatttgatatgtatctcggttggatatacattgtttttttaaaaaatgttatttaactgttagatacagtggcctgttgataagccccacttgtcttcagaacttggatttcttaaataaaacttttagtgttgtctatacactgctcaataagacacttgagtttaagcttttcccagggtggaaattattttacctgtccctttttatttatgtttagtgatggcctagtttttctgcagggccatgatggagaaatagcactctagccttagtccaatattgatttactttctttttttaggttttatgtatatgtttgcattttttagcattgtgttttgtccagttttgtgaaaatgttctgctagtatgaaagaaaacattttctatatgaagacatttgttttatgttaggtagcttacattttctcctctgcgtgtgtgtgtatgtgtgtaaaatcagaaatttagcatactatggaaagaaggcatggagcacttgggtttagaggaacctaaaacatcatagcttcattgttccagatgtaacaggtttgaaagagctcatcgccaagttcttgatccacttgcattccaggggagttttcttttgagtagtatgtttcttgtttgcatgttcctgttctttgtggaaactatgcatggtagcatttttgcttgctgtgttttccatacttaagaaaaagaggtttcagttggctgatagaatatcttttatgtaggacaaaacttttctgtgaagagtgttgagggggtgaagataggtaagaggtaagcacaatttttaatttaggctctgaaaaagtgtattgttctaaacgtatttggtatgcctatataggtctttaaaaatgggtatgtatgctgtttaatgtgcactgaacattttacattaatattgtactgttttacattaatactgcatgcttttctatgtgaattgaataaagaatgtcataagcactgtgttccttgatgtcgatgatgattctttgtctcgtatattgaattagcctataaagaccaggaaaaactacttttttttttttttgaga

SEQ ID NO: 14132 - DNA, 1090 bp, Homo sapiens
ctgcctcacctcccaaagcattggaattacaggcatgagccatggaccaaagcagtcttagtaattaatgggaaaaatcacaattgtttgatgacctttagcaactttgtcaaaacatttaactcttattatcaattacatatgtatatggataggcaagaacagtaaaagtaatatttagtacattgatatttatgtagtacaatttgaaacatgagaaatattgagaattcgtggtttttttgtgaaaaacttctggagaataatttgaatagtgcttcccttctcatataatttatgatatgaagctagcatcatttctgataccttgatgaattttcacactcctaagtttgcatcaacttccagcattttatcgtttgctctcaatatcgtgaaagagctccacattgctttagtgcgaagtgttttgtcagcctgtcattttctctagacatcttcatccttttcaccaccacttttctcatccatgtcaataagtttgcctctacaaagtgcttctggcatatctagaatttcttgaatggactgacattgttgtaatattcccacagtcagtgatttcttccataactacatttacatttgatttcaatttcacttccaatgttatcattgtttatttctttgttacaccttcatctttgttgaccagttctgtcgttttattaactgtttttgtgaaatgtcatgcgggttttttactgggagacaaggagcagcccagctgcacactttgctgtctgtatgttaactgaaaaacaggtaaatgcacagtgactaatcactgactgaccttgaaagaagtgacttgatgggtcactgatcatgaagcacgtctattatttatgtagtgttttttgaactgaaaagctagaagtgaaggttttacttcatgcagttactcattaataatggtgtggtaactgaaatttgaaccatattgttgggtgacttgtaaattaaaccatggtaactgaaatttgtgcatattggaaccatataaagcaaggatatcaacactgaaaacctgtcagataggccacaccacaaaagctggtccaggtcc

SEQ ID NO: 14133 - DNA, 1227 bp, Homo sapiens
tatttctccacctggatgatatcttaaatagaatcaaagatttggcatttttaaaaatcacaactaacattgaattaaaatgaaggcaacataaatcccaatttttatcagtcaggccacattttgagaatttaaactgtatgtgactttctccctgcaaaactcttttgatatgtaaagaatctatgtatctacagaattttaagtacaaaattcaaaccatgttggcttcagtttagcatatgtatgtatgtgtttagtgtctatgcctgcctcatgactatgcaatgctttttcaggacgaaatagattgtttacagaaagaagtagaagagcttaagagtaaaaatctcagcttggagtcacagatcaaaactattctggatcctttaaccttggtgcagggcaaccaaaatgaagacaaacatctagtcacagataatccaagtaaaattaacccagaaactgtagcagagtggaagaaaaaactcagaacagctaatgaaatctatgaaaaagtgaaagatgatgtggataagctaaaggaggtaagttgtggtttttaaaaatctattatggttgtttttaaaataagtaccttcaaaagcataaatagccatattatcttgactcatcatcagatgatttgtgaggaaaggacagaatctctggatgagcatttatatgcaataagaagactttttcttatttaaatatcattaactgccaagaaatatcaggtggttccatgtgtgactataattagagactgttgtgcttctgtataagattgcatcttcttctagaagaataataccaatttaaaggatgtgtttctgtttcgtcctctttgtggtttgccataggttttttaagcttatatcagcgacttcccctgtgtacctaaaaacaaacacataaccattttcgcaccaatgaaaggaaaagttttgaccttatcttttcttttgctaccactctcttatttttaagattgtagatagataaagacttggtgactaattccaggacagcaataagcagctgcttcagagtacctcatgcaaaagaatgttgtgatttatgaaactggttcatttttttcagtttttctttgaacgagatacagcatggtgaaaaaggcaaacctctaggatttttcggcctagaaagggagataagatccatgccatcagcactagatgttacaggcaactcctacaacac

SEQ ID NO: 14134 - DNA, 1589 bp, Homo sapiens
gctgggaattacaggcgtgagccaccgtgcccagccaagatttttacaaaggaaatagaaaggaatatatatgctacagagcaaaagaagaactagtaggacttaggaaataagagatctgaaggcgcaatcagagttggctcttggtacctgggtgaagtctggtagaggactggttctctgctgtgttgcatgctacggggttaacctctatctgtttttttttacctgctgaatttcaccaaggagtcaagtcttttcttgcagaatatgagctttgatgatttgaatattttcccccagcttttcttctcatcccatatcctacctttattcattcatacctaagtgatatttcataaattctctcaaggaaaatagttcatccatttttgcatttggatagaacatcctgaaaaagaacacctgtaaaatacctttgctattattataatgctaaaaaatacaaagaaggtaaccagagcatcagtgaagagctctcaggaagaattcattgtgagtgcatttgtaacaagtcatgacatagagttaatgccatgacttacagtccattgtaactagcctgttagaatccgtgaaaagacacattaatctatatacataggtatatagcagtaatactttttttttttttgagacggagtctcgctttgtcgcccaggctggagtgcagtggcgcaatctcggctcactgcaagctccgcctcccgggttcatgccattctcctgccttagcctcctgagtagctgggactacaggcgccagccaccacgcccggctaattttgtttgtttgcatttttagtagagacagggtttcactgtagccaggatggtctctatctcctggcctcgtgatccgcccgcctcggcctcccaaagtgctgggattacaggcgtgagccactgcacccagccagtaatacatttttatataatctcttggttaaatgtaaatgtaataattggttttattatttaaatatagtctagttttcagaatttgaagtagtccaaatgtgataattacagccctttcctccactgagtttgctgtgataagatatgtagatatgtaaatacaatatgatgtgttactgaaggtatttcttatggtgttatttgatatatttttttttcctcaagattagggtagagaaaaggcctagatgtaagccccaagtgtgtatgtaaggggaagggtagatgtgaagctgggaagctatataaaacaatatgaaaaaggatcattttcattcttcccgaatcagaatgaaaaattaggatttttttttttttccctacaggaggaacaagtgaaagtgaacctatgctaagccatacggtcaggaagcatcttcggaaaactagacttgaattactacacaaagaatatgaggtaaacagtaatcaaagtttaaaattatgttagcagtgaattcaaggtaaaaactgacctacctcagtccccagacttcttagagtaaatatccaatgaaattttattttaaaagcctataaaaagaaattgtttgataaattcttttttcttttttcctttcgtattt

SEQ ID NO: 14135 - DNA, 2039 bp, Homo sapiens
tttctagtgtacaatatttgtaagacaagaagaaaatttccttttcccagatctcaggaactaccttgttcctgttaacttcttgaactggctagttgctcaaaggtatgtatacaggcctttagggaagagcagtttttaaaattttcctttctgatcattatatacctgtcagatgacaatagataatcttccaaagttgctacttaaaaatcctaggaaagaaactttggtgaacatgactgccattcccattaattgctaatgaaaaacatcaaacttgcttagtagaaaaacacctaatttggtataactttcttgcagtttatccatattatgtgcttgttacttaatgtaattaaaagcattttaaaattctacttttttcgtatccactttttatacttgctacttcctaaatcctccctcactgtttatttcatccatctactcatttcccatcatccaaagttagcctctccttgtataccaggcactgtctgatttccatgtattccttttatttttactgtgggcctttgtgcttagtatacttttacttcatataatgtgattaacaaatgaagtgattatcatatggagtttaaggaaattagatgtatcttgcaattactttgaaatctttgggaaaccttaagaagattgtatctgttttcatttttatttacaacatcttggaatttgttcatgatttcctaaaatttctttgcctacccacatctctgtgaaaattttccatatcagttaagtagttttcgcaatgaaaattttagaccatagatatgttgtatgctgtgatcttttgcagcctaatgtttgaagggagtatgatgcagagaggttttggtaaaatcattttagcccaaagctttgtgtaattttcctgcaactttgattttgatttctttctcaaatagacttttttaatgtttagaaaagttggaggtcaatttatgatgtgattcaagttttagatttatttgctattttcaaagttttttttaatagtcttctctttttccagcagagagagatcatcattgcctgaatttagctttgtgactgcaagagcaagaccagttcctgtctggagacgactgttacaataatatcatcctattattttatgttcactctttatcaatttgaacagatgtttacatgtactataattagcattttatctctacagttctctaagagtacatctgagtccaaagtgtatctgaatgtgtgctctgaccttattcttaaatgttttctccccatactttatagccatttattttttaaacaccttaagaaggaacgaaaaagttctcttggatgacgtatattcaagtctgagccaaattgaggattgtgtctaggaaatctgtaaagccatactactgtgttcattagcatgagcaatttaaaatgaaaatgaattaaaaagttaaacatgagtttggttttaattttggggggatcttaagatatatttctgggagtaggatagccactgaaaataattttgaatagatgataaagtacttttttatgtactgtaatagcttgtgcatttcttctgaatatactttctgatgttgccaaggtcatttacccaaatatttttttaaaaattcttagcccttcaaaaccaacaaagaaaataattttcttccaagtgacaaatgatgatctgtggattataaatattttaaaaattatatgtcttaacataattttttcacatttttttgactttcaatcaagacatcgaagacgacctttaaagcaagaggaaatagtgttgtgtgcctaacattggtaaagactagtttttaaccattttaagaagtgtatgtccaaattatttataagcagtatgacttaatatggcttagaattacttataaagaatctgattaaatctcatcctaaatatgtagccacaatatcttttttataatgggactataagaaatgtttgcacttagtttctgagtattccttcatagattctcaggaggcat

SEQ ID NO: 14136 - DNA, 1089 bp, Homo sapiens
agtggatttcttttgcaagtgaacatgatcattgaaagttgatatggcagtttccaggaaataaatgcattctttgtagaatgggggtgggagattacatatttatattttcaaattcatcattttgattgcaagtgtttctgcctctcttgagattatagtgataatattaaaaaatcacatttaaaaaattactttcttccatattggggtcctcacaatcaaaagctgttgttccaccaccaccatagtcttctgccagtggagtaacttaaggatgctgttctttttcttcttccccatacacccctaattggggttgaagttgtgtgtattttcttgatggtaacactatttcatagaaatgctttgccttgcaattcgtgtctacgtttatatttaaaatttcaaaatcagatttcagttgtcaaaatagtgactttgctcaaaaagtcactatttttacttatatatttaaatcaaagatctatttttatgtagtctcttgtatgttgactatgtgctattctgattcattaggtaagtttgttttcttttctttttagtagtcgtgaaaggtgccaaattggcagaggctcacgtttcttctctttacaccaaacaggtattacaaagaaagtaaatctttcaaaggccagttaaatctccatgctgatttttggctttataatttgattagtatgttttagcctgatatttcaaaaattataaaattcccttacaatgtaactgaaaatacatattctgtttatttcagtccatgaatagctaatcagttttcctagaacttaaaatgttttaagccatgttgctttgaatgaatcagaagacaaatatatttcagcgtgatcccaaagaatggagattaaatcttaccaacattaattaggtttacaattatattattcatagtattaatattattttaattataaatattacttagtattaagttgctactgaattttttacttgtttataaatactagcactctacatgtactttcatatgttttcatttaaaacttaggaaggagttgttcatttccattttatagataaggaaac

SEQ ID NO: 14137 - DNA, 1151 bp, Homo sapiens
atgaatctcgttcttggagaagatgatttgactgatcattgatctgcatatgctagaactctacctgtgtttcattagtattatctaatgtacttttacatatttgtaaaaacaatttttggtaaaatgtgatgaagatggatttcacaaatagacaaaaaagaagaaaactaccttctgatcttgtattttgaaagattgatgtttgcattttacttcagtaaacaattgctaaagacatcacactagaaacatatgcaatgtttttattacatacttctactggacatcacagaattctttgggttctttgtaatttaatgaataggtctgaaaacttatgaccaatacttgttataacttagaggactttgttttattccaaataaggaatgaatttgcatttaaaatcttaatgaatgttttcaaaactgaatagataacatagtactctaactaaagtctccaagttatgtattataatattacatagtagtatgcttaggctttactatgtattagccttttgttggactgtgtatgtattttaccatatgggttttaatgataatggtgtatgactgctttacatgagtccttatgcatccagatgttataataaagtggaatggtctctttaaaaaaaaaaaaggaaagaaaagagaaaagcaatgacaaaaaaaaaaaaaaaaaaaaagccaagacaatgttccttgatttaaaaaaaaaaagaaaagaaaaaagaaaagaaaaaaattaaaatagaccattccagatggtgatctacccttccccccaattatcacaaaaggagctataatcactaacttattcttaataataatggttactggtacccttacaataatgtacaatccaatgtttaaaaattataccacttgagtttggtttgatcctataaattttcaacaaatgtcttaaaatttaaaagcaggctgattagtttggaaccagactgcaagtagagctaacatttggtgaataagaaaacatcacattacattttggatgtatgaaagaaaacttgaccatttgaagatatatgaataaagaaatgtactatagatactactttaggaaaacactgtttggtaagtgttccagtctgatattttaagtgtgtacttcct

SEQ ID NO: 14138 - DNA, 1065 bp, Homo sapiens
acaataaaaaataccagggattaatgtataaggaagactttagcactgaattacatgaaggttgaataagtgacagaataactaaggccaagttaggtctaatgagaattacctatttagaggaaatagctttagttggatttacttaatagactaaaaagagtaatgaccactgctatgataaatgtttagatttttagttacaaaagttgttaaagcataagcatatccttaagccagaaagtttcttaaaattttgtaatgttgaaaagaatagaaaattaagttgaagcttatcttatacaagcaggatacatatagagcagtggtcttcaaacttttggatttcagggaacagtaaagtttaggaatttaaaaatttgtgtgtttgtcatagaggtatcaactttttattttgccagggaagaatactttaaaaatacaaaaagattgtcatgttctatcaccattgttatataaaataaaggaaattttaacactgaaaatgtaggagaacatgaactcgcagtaaaggataggccttcccaagaaaaaactgtcagcccttgccaatgtttactgtcaaacattacattgttcttgttttctggaccattatcctagatgactgaatgaatttattttctataatcaatagatgcatagtatttcaagatgaaagtacaagaataaataaggtaattgagacattcagatataactgaaaagtgagaagttttcctcaggaaaaatattgaagcattttaaagaccatcagtataagcagaacactgttagctttaggttaagatggtttatggtttgactctgccttgttacctagaagatggttcctattaccttattttctatttttttgtctatcaccatgccaaagtactaaagttggataagtactcagacaagagtaaagcagtcgtctcttccatgactgatttgaatattatcttttctgcactgaattgttactgtacctttgtaggagcccaagatcctgttcagaataggaataattaagttgctgttttagaagaatcagaacaa

SEQ ID NO: 14139 - DNA, 1604 bp, Homo sapiens
attagtatttaagaatgaggagtctaaagtcctgttcttggtggatttaaagggataaagaaaggaattaagagaactagaaaggagcttggaaataaatcttgcccatcttttccctgctgtgtaccccacttccacaccttccacaagagaaaggagagccagataatttgtatgttgtgtatagttttacagctaatcaggaaactaacaatgaatgtgctaaaataatccaaacagacaaagtgagtttgttgtgatttatgttttggtgagactaaggtgcttttggctgagaagtattcagagcctctaaatgaaaattctgacatgcatttggacattgaaatttcactccaaagttcacatttaaattattagtcttaagtatgagcacaggtttagttgaagtttagcttcttttctctcaacctatgatttgaacacatgatggatgtcagaggaaaaaaaatttacattatttaatatatgtgatgttaaaggaccattaactattacaaattgtgattaacaaaaatgctgtatcttccagtaccagtagtaatagtaataaaaattataactaaaaacctatagagcacttactttgtggcaggtatgccctctgagtgccttacaataattcattatgaattatttggataaccctgtgaggtagatacctttatttacgcccattttagaggtgaagaaaatgatgcatgatgaggttaagtaacttgtttacacagctaataactggcagagctagaatcttagtggctctaggacattctctttactgtgctctacagaacatttctatgatatgtgtggagctaatgagattacagttataatttttgggggggataattaggaaggtattgataatgatatataaaggactagaattttgtgggataaaggttgctgtttgtagaaaaatcctcccacacatgagggaaaaaaatccaacaaaccaaaaacaggaataatataatgtgtttagcttttaaatgttctaaacaactataaagtacagtagagtgtgtagtaagcaaaaccatggtcagttagggtgttaaacttttgaatcaagagacctggaatctcttcccattaattaacaattaactttggggaagttacttaaattttctttttctttctttccccatttattgagaatgataccaaaaactcacaaattctgaggattcagtatgttgcttaagaaagagtttatcttgggattggtttagtgagtataagaggaaagttagttagcaagaacgctcaggctttgaccattatttccttcatttaaagcatagttcaattgagtataagttttactaattctgggaagtgtgaattgtatgtaagattggaagacaggaccaccttttatcttatcaagtactaaaataaattactcaccatacttttctgttaaccattatgaattgttatgtattctgggttatatttattagtattttaatgttttttaataccattaggatttttggatatttcaaaatatttatttggaggaaatactttttttttaatttaaagcaatatggtgaaattgaaga

SEQ ID NO: 14140 - DNA, 1046 bp, Homo sapiens
ttgtcaaattgcattaaagttttattcatctgccagagtgtaatgcttggcttgtgttagtaatcacagcattgtttaacctgtgtgtctaatctcttctaggctgccaaacgagggattctttcatctggtcggggcagaggaattcattcaagaggtcgaggtgcagttcatggccgaggcagggggcgagggcgagggcgaggtgtgcctggtcatgctgtggtggatcaccgtcccagggcattggagatttctgcatttacggagagcgatagagaagatcttcttcctcattttgcggtactttcttactgctcaacaaaacaaatgctgataatcatcattggggatagtagacataattaaagaggaagttatgaaaaggacataagtaatttcaactcgttaatctgaacaaagagtttaatctttaatttttttgttaatttaaaaacaaactgtaggatttgtataattatctagaagagacattactattcttacacttagtaggccatgaaatactgtgaaatgaacaatataaactttgctgtttcagagagggaagtcttgtagtttagtttgatttgatatttacttttaaagaaaaagttaacatattgcatgggccatccagatttttaaaataaggtttgtgtttgttaaaaatgtattcttgatctagctgacccagtattgaaacaagataaaattttgacctatgatcttgaagttgcctccgtcagtgtcaggatgtaatgaaaaagactttgtataatggtaatatattgacctacaagaagggagaatgggattctagtctctgttaatccattatttaacttggacttcctgggatttattaggctcatgttcaaaatgaagattatacctgctgaatggccctttcatctcaaatgctgtgattcttagtggtatcccaaaggttggttactaagcatcagttttaccctcagcattatatttaatagtagttgctctggagatatgaaggaaataatcagttctttatcctcaaggct

SEQ ID NO: 14141 - DNA, 1044 bp, Homo sapiens
ggaggaatagagaaaaactgttttaatttgatgaaggaaatctgcaataaaagaaaaaaaactacagctaacataatattcaattgtgaaatattgactgtttttccttgaggttgggaaagacaaggatgtccatttgcatcacttttattttttttagtattgtactggagagactcatgggtgcactaaggaaggaaaatagaataaaccatataaagattggaaataaaactgtttacttgcagatgacatggttgtagatatagaaaattcaaaataattcacacagttgggattaagtaagtgtagtaagatgtatagaagtaaatatgtaaaaattatagcacatatagaaatgcatttggaatatagaaatgtggttgtttggagaagtcactgtctctgttcttaggaattggagtatcttcttttctgttgggctcgttacttccctccactaatttcagttttaatagattttcttcttttgaaaatacatgtgtctcttactatccaaactgtctaatctccagaaccagatagattcaaatagtgaacaatatagttcattgtttataagtcacatttttacattttaacacctctgacgttgggctgtgtcttataattgttagacacaggttatgattggcagcctttttttctttagtaggggtacataaatgatagtttgtcttacagtcactgagttgtagccttagtgagtcacattcgtggatgttctagttttacagaaggatgttcctggataaaaaaggaaatgggaatacttctaggaataaaggagtcttatcattgtcagatacttttattcactttgaaccagcactccttagtctgatactacatgtcaaaaatgatttgaaaaggagtattctcactgaaactggagaaatacttggttaaataaattatatgggtttgttcttggcttctcactgcttttattatgaagataatataaattaaaaactggaaaattgggttacgatattcattgtttcacacttaaataattag

SEQ ID NO: 14142 - DNA, 1046 bp, Homo sapiens
tgtgtagatgctaagcaaatcttaatatgtttccttggatttttgaaatttgaatttgttgtgtaactttgctagttaaaagatttagagggatttggctgggcgcatggctcacgcttgtaatcccagcactttgggaggccgaggtaggcagatcacgaggtcaggagttcgagaccagcctggccaatacagtgaaaccctgtctcttctaaaaatacaaaaattagctgggcctcgtggcgggcgcctgtaatcccagctacttgggaggctggcaggagaatcacttgaaccagggaggtggaggttgcaatgagccgagatggcgccactgcaccccagcctgggtggcagagctagactctgtctcaaaaaaaaaaaaaagagtgggatttatcatagtttttttttcttaactgttattgactatttttaatttttattttttaattcagtggcctctcaggattattacctgcatttttttttcaggaaaatatgaaattaatttatttgagtgtattagctttgctgaactttgtagtaactaagctatttgtgtagcaaaaattcattactagctgtacatattttttactttgatgtttgttaaaatatttctctgcaagttttttaatctttgtttcttttaatccctttgtctatttcacttatatgtggaatcttaaaaagttgaactcatagaagcagagagtagaatggtggttaccagtggctgaggacaggggattgggaaatgttggtcaaaagatataaaacttcagttagatagaagaaataaattaaagatatctatagtacaacgtggtgactatagttaataacaatgtgttgcattcttgaaaattgccaagaaagcagctcaccacaaaaaaaagtgacgtaatacaaatgttaattagcttgacttagccattttacagtgtatatatttcaaacagcatgttgtacatgataaatacacagacagtcatcaacttacggtgacttgactaacagtttttcaatttgatgatgcattt

SEQ ID NO: 14143 - DNA, 1781 bp, Homo sapiens
tctctgctcagtgcaaccactgcctcccgggttctagcgattctcctgcctcagcctccctaatagctgggcttatgggcgccagccaccacgtccagctaatctttgtatttttagtagagatggggtttcaccatgttcgtcaggctggtctcgaactcctgacctcgggtgatccacctgcctcagcctcccaaagtgctgggattacaggcctgagccaccacgtccagccagattgtcacatttcaacatgagatttggagaggataaacatcctaactatatcagtatgttaaatatactatcactttacaagtatttatattactggagaagatcaggtagctcttgggaaatggttaattatacttttgtccaatattaaaaatattcatatttttaaatattttacttttgctaacttagagaaaatatatatttccagtgcttttgacatttgtttctaactattccttcctcatagaaaagggtttttgtatgagaggagacatgtgtccttttgatcatggaagtgatccagtagttgtagaagatgtgaatcttcctggtatgctgcctttcccagcacagcctcctgttgttgaaggaccacctcctcctggactccccccacctccaccaattcttacacccccacctgtgaatctcaggcccccagtaccaccgccaggtccattgccacccagtctcccacctgttacaggtaagtaaatctgtttgtttccctgtatttatctagccattcttagtctatttttaaaacttaatagattcttaaattaaaagtatctaaaggaatcccaaaaatgcctgatagaaattaatagcagtatacttccatttggaatacacctccactttgtagcctgtgccaagccagttactatggtttggagtgaccctgtgaattaagtatatcactggtaaaacccagctgcctgcaggccttcatagcttaaggcaaacctgctttggaatgtattaaaaggatattttaccctggatatctaattcagttgtaagggcttggtgtttgtagatattatagtttgataaatgagaagattatgttcggatgtgcaataacttgttttatttgtttgctttcagatgatatttcttattctttggttttgacaggaccaccacctccacttcctcctttgcagccatctggcatggatgctcctccaaactctgcaaccagttctgttcctactgtagtaacaactggcattcatcaccagcctcctcctgctccaccctctctttttactgcaggtgcagttttggccctttttatattcgtaatgtaacacagttttagatgaagaattttaaaatgtctagagagaattgctctgtgaggactacttttctcactaaaattatgtagccgtggtgaatgaacattaaataagccctcagttttgaatgttttcaaaaaaacattttctttttaataacttttttaaataaagttattttctttttgatacatatagagcatgttatatgttaatatgttatattgtttactttttctcttatcaatattaaaaaattaccaagtggagttttataattgttttttaattacagtttttgtattaccagatacatatgacacagatggctacaatcctgaagccccaagcataacaaacacttccagacctatgtatagacacagagtgcatgcacaaaggcccaacttgataggactaacatcaggggatatggatttgccacccaga

SEQ ID NO: 14144 - DNA, 1118 bp, Homo sapiens
accatgcctaattttttttttttttttttttttttttggtagagactgggtttcgccattttgcccagactggtcttgaactcctgggctcaagcgatctgcccgcctaggtctcccaaggtgctgtcattacaggactgattcactgtgcctggcctcaatactgtttattgcataatttatctcttcttagttggtttggatgccacttttataaaatctgaattcctagtacatttggatccatttctagactttctttttttgctgtttaaactaatatactgatgggtatgtttttaagaaataaaatggctacacatagcattaaggagtgttagtataaagagaacttaaatttcttcaaggtcctctgtgacccgggtgctttttacatgtattaactcacttaactattattctcactaattcagtttgtaactggaatttgtagaatgtgcagttggctaaattttcttcaacattggtttttttctttagctgtgatgcagatccatccgccctagcaaaatatgttctggctttggtaaagaaagacaaaagtgaaaaagagttaaaggcattatgtattgatcagctggatgtatttcttcagaaaggtaagatctttggtttaaaaatactactatattttaaaaagttatttaaggcttggcatggtggctcacgcctgtaatcctagcactttgggaggctgaggtgggtggatcacctgaggtcaggagttcaagaccagccgggcaaacatggtgaaaccctgtctctacataaaatataaaaattagccgggcatgatggtgggtgcctgtaatcccggctactcgggaggctgaggcaggagaattgcttgaacctgggaggcagaggttgctgtgagctgagatcgcgctactgcactccagcctgggcgacaaagtgagactcatctcaaaaaaaataaataaagttatttaaaataagtttatccacagaatattaaaggaactcggtaagaagccctaattttaacaaagttaaataaacaatattattattgagtatatccatagcttatttaaaatggatgccacctctcagtaatgtccatgtgcttattc

SEQ ID NO: 14145 - DNA, 1030 bp, Homo sapiens
tattggcagattttgttgtttgtgggagctaagaaatacttttcaaaacttgattctttttttccccgatctataaggcaatttcaggtctgctttttctttcacacattttcaggatgctagcagtatatagcaggggtaaagaaaagtctagctctgacaagatatagatcattcaaattacaaaccttttatcagcagtggcaactggtaaagtacctcgaacaatcttgctagccatggagataatttttaaaaataatttgctatatgaatatagtttttttaattagttaatttgaatgtttatttaattgactttgcataacatcatcactagaagttcagataatataacatttaagacaaatagaaaagagaacataggttttgcctttctgttcctgatacataacatttcagtatattattaaatttctgtggtccatattttttactcagctttttgttttcaaaaatattgaagtaaaaatggaacttcttgtaggacttaagaaaaattgtttcccaaatgcaaattcagttgttttgccattaaatgtgaaattataacccctgcttctatataatttgaacttttaacaaatgttaaaaagtcatctgcctttcaaattatttcaaggatttagaactgtatatggtagtatatttgttgtggctaatcgttttttattcagttcagattgcttctacagaagatgttgagcagagattcttctttaattctgtcttgctgttttatccaactgtggtttatagaccataataattataaaaatcatgaaagccttcctctagatttttagctgctaacattttaattcagttttaaaatgtcctatttaaaaaataatggtgcaaaaatgaaatagatttggtatttcgttgagagaattgaaaaatgacaggtaagttactggaaaaaccactaataagttaaaaattcaccacaacaatcaaaccaatattaaattacagcatttagactcagtgtagactgaatttatat

SEQ ID NO: 14146 - DNA, 1048 bp, Homo sapiens
aaagctcactgaagcagttaatttgaaatccttggagaattaaaattggaaaccccagtgttcgtgaatgctcactttgctccatttcactggactcctgtccctcatatgtgtcaagaaggtcaagtaggccttaggctctttctgatgggttcccttggcctgggctttttaaaattttttcttttccggatagccataaagcatatttgcattccatttccattcctatctaaattcagatccctgtttaaatgtcccttcaacagagtccttccttgatgatcttaaataatacttgttttatcttttctgttttctttctccttacctttcttcctttctcctcctttacactttatcttttcaacctggatttttcctcagagcacgtgtctacatgacaatacatactataaacgtatgtttgtgtaatatgcatattggttccccccaccccccaatgtaaattccgtggcaacagtgatgtttctaaaagttgtattttcaggatctagaacagtgacagagtaggtgcttttaaaattttcttgaataatgaatgcgatatttggacgataatcactaaacccaacatacttattttcttattttattcatcaaactttatatgaagatgaaagattccctgacagaaatgagccattgatctagtgagacatatatttgtatgtatattctctctcttagtaactattaatatgtttcagatcttttgtagtgtgtattttatctacagtgtaatttttaaaaaatgcttttctattactaatatatgtagatcagtaattgaacagactaatgtgttattttatatttcatatatttgcacagtatcttatgaacagatttaaacctaatgattttactcattgatacttgtgtgggatttactatccagtccagtgcttatttgccaagagctgttcagcctatgcttgaaaccattctaatgaaggagaaccctcaggcagtttattctgcctttgggaggcctctgattattttaaaaaaaaaaagcctatct

SEQ ID NO: 14147 - DNA, 1030 bp, Homo sapiens
aggaagcaagagaaatactcatggaaagcctttatatgcttccaaaaacggcactttgattccagagggcaacgtttatttgccctcttgacagaaagtagtaacctctagaggacttagggcttgaggtaaggactcgcaaatggcagaagaatttctcttcctaccaaaggggtgctaactcaaaaagcaagtaggtggaatcattgaagggccagagtgagcctttatggaggttgacaaactgcttcaaaagccaccagaaaactcagccatggggctggaatggaaagcatatggtaagtcgtaaggagctagcagagcggcagttccagttagtgtttgtccccacaatgtgccagcagaggggaaggttggaggtcatttgagctggtagggtaagaacaagtacaaatctcaggggatatctgcgggggatcccggctttgctactgtgtaaacacagtaaaagccgcaggcgcacaaataataggaagtgtgtgtttaagaagtcacgtggcatgtagagtgaaaacagagaagcagacttgcccccaaggtgaacagtccagcacgtgcacaaagccatttcagaacacacacacacaaaaagaataggcagtgcagcttcttggagaaaagctgattttagttgaaaaaacaggaaaccccaagcactgcacggttttaggctttaaccctatcattctcgtgagcctcctgcccaggagggccattagtgcctcaggtccactcggtgcagaccccaaggtccttcccacccccacaaggtgatctcagtggtcatacggggggaggagagccacttgtgaccaagaggaattgttctgagggttgattagtaagccagacagcgaatgggagaagaaaactgtatgggggttgaatgtctccagccgaagatggtactgtgtacaggtctcttacaagtagggaatgtactcaagtcatgcggaactgatgtatgttacctgctgcaaatccatatggatctgcagcaacctcactt

SEQ ID NO: 14148 - DNA, 1215 bp, Homo sapiens
aatcttatttggcctttccatctgaatgctgagtggttaaaatgcatttagcactttttttctgtatgttttagcacttccttatctttggctgacagtgcttctcaaaattattttacatgcttaaactgagagatagggactgtattatgagcaaaatgtaaaatattcccatgttagttatgtacataacctaagcttgagaatgactaactgaagcttgagctaaatagcttgtaagatttttttccctcttcttgcttcctttgtgccagagaaaagaatgaatgagagaaatgaatgaatggtaagctgttcctactagacttactcattactctcctactactttatttctgtggaaaaagtcttttcaatttacatgcagtaactttgaaataggtaaaagtttatttttaacttagggttttattagtatcttttatgtgtgtattaaataatggagtaagttcaagatctgttacttagtgattcttcttgagatattttacctatgtagaagcatttcttttgttatttttttctgcgacatgttttacaaatgcttttaaaattttgattttctgatttttattgttagtatatagaaatatatttgtatattgacgttgaattctgaaattttaccaagtgtacttattctagtagctattttatagattctgtggaattttcttctaccaatctcatcatctatgagtaatgacaattttctgatttttataccttcatttctttttttttttttttttttttttgagatggagtctggtttgttgcccaggctggattgcagtggcgtgatctcagctcactgcagcctccacctcccgggttcacgcgattctcctgcctcagtcttccgagtaactgagactacaggcacgtgccaccacacccggctaacttttttttttcatttttagtagagacgacagggtttcatcgtgttagccaggatggtctcgatctcctgacctcatgatccgcctgcctcaacctcccaatataccttcatttcttatcatgctggctagaagcaatagtacaatgttgaagtagtaagagtggacgtccatgtcttgtttccagtctaaagggaaagagattaaatgtttcagtattactgatattggctctaggtttttagtaactgccttttaccagattgagaatttttttcttaatttgctt

SEQ ID NO: 14149 - DNA, 1031 bp, Homo sapiens
tgttgaagtctgggaacatcaggaaacacttccctggtgtaatgtttatctcagcttggaaggatgaagaatactttgctggggcaaaaggatgggattggagacctgtgaaagcgttataggtttggtgaacagattgtatggaggtcctaaaaatggacaaaaaagatatgttggaggaattgaaagaaatagaaaaaagcaaaggagaagaatggcagtggaaagctccagagataggagccagatcacacaggactttgttgagtcatgtttaagactttggatgttattgaaggatagtgggaagccagtgaagggttttagggcaagagggttttcagatggatgtttaaaaaaaaaaaaaaaagcctggctgtgttttcagcgtgaaatagaagtctgcatatctgtatttactgtttcataacttctgtacatgtatcagggttctgagtttcataaattattgaaaataattttcaatgtctttttcataaattgagaattttgaactttattaaaattgtcatcttgaaatgcttaagattgatgttttgttatctcaaagatttgcttagtcatacttgccaataatatgaaactaaatgttagtcttttttctaacatttcgttttgatgatgagaagtcctgaaaaaaaaattaagctcctttgttgtagtaaacttttaaacaaacaaaaaaaacagaaaacactttctactgtatttaaaacttttaggtggacttacacatcaaagtcatgtttttttttttttcctgaagagacacctaaacatctaatgaaactttaattttttagaaaataaaattgaggggcaggtggatgtaatgacgtactgaggttttgtgagttgagtagtaaagaacaaaatgcctagtgttgtgcttctgccactgtgtagtgctgtggaggaagtgtgtggtggaaggaagatctctgtgtccagatcagtattcaaatctcacttctgccatttattagctgtctaggcaaagaaacctcctc

SEQ ID NO: 14150 - DNA, 2369 bp, Homo sapiens
aatataattcctgaaagcaaggccacgtctcccatgtgctgtctggctcatctgcacctctcttcactgattgaagatgtaacaggtgctgaggtggccagtaaaattcccctttcccgcctacgcgttcgttagcttggagaggaggaagaaaattgaatcttcatccatatggaatatttagcagttttaagtgggatgctatagatagattttgtgttgggggctgcggttagagtgctgaaatagtcttagattggaaaatttaaggagtgttttgacgacttgttaatacaaaatatgacatggaccaaagtgcttaatcagaattggttgatttacaataatgcaatggggaaaattcacgtatttaataaagttattaggtacctactgtatactacgggaggctttggggatagagcttttaaattctaaaatcgacaagacataaataaatccagatattaatagagttgtgactattgtaataatagagaatcatgtaaaagtgattatgaggggggctatttcacattggtcaaggaaggactctcagagaaggtgacattggagtaacatctaaagagaagggaccatgtgtgtcaaagtcttggaaaagaacattccttgcaaaaggaagagcaaatgaaaggccctgtagcagaagtgattgtggtgtgtttcaggaagagaaaggccactgtggctggaaagagccttgtgatgagggagaggatataaaggcaacaagttggacaagtaggtaggggccacatcatgtatgggaagacgtgagatgatttaaagcagacaaggactgatttaattttgttttaactctgcctattttgtagagactgaaagggcaagaatggaagtaagaagattattcagaagtgtgttgtaggcagagatgtggctagtttgcattagagtgatggtggagacaggcagatccaaatacatttcataagtaaaattaatggattaaatgcgggagatgagggaaagggaaatcaagggtggtgccttagataacccaagcaacagaatgggtgatattagagaaggcagagaacaggttaaggggagaaggaaagtggatggctagttttgataataataaatacagtaagtatgaagtctgtgggatacagctaagtgtgatagcagatcattgaatatatgagtctaaaactcaggacaggactggagaaatctggagtcatgcagatagtatttaagacgatgacattgtgggaaatttcatagaaaaagtgtgtaggtagggaagagaagagggcctagtactgaggcaggaggaaaactgggctttatgtcattaaaaaacaagtgtatggcaaaagagaggagtttatgaaatgctgcagaatgcatgaaaaaatggaggcaaataggtagcccttagatttagcaaagtggaagtcattggtaaccttagcaaaatagtttcactggagtagagttgtgcagatggaagtcctatttcggtgtattggagagtgggcatcatagtatagcggtgaggagaactctggagcagaatgtctggctttgaattctgcctctgccacttaccagctgtatgatattgggtaagttacttaactcagggcttccatttcctcaactgtaaaattgggaaaataatgggtgtatattaaggaaatcttagactactgtctggtgtgtaattagcattcagtagttattaggtgaatacaaaacttataaatgttttggattgaaatagctttcctttaagcgttcagtttcatattagatttactgccgtatccctccatcttacctaaatgagaagactgtagctacttagagtgtatgcttgtaatttttctttagtcttaatgaaacatattccatgtatcataaagcctactctcgatggctgtagcactgcagtcattatgttgtaataaataaggctctgctagtagagcctagacactgggaattgtaattggtccttttctaatgtgtgtagctgtggtaaaattgagcccttattcaagttcttgtccttttaattgcatttcaggtggattcttttgtatgatgacttataaaagctgatcccaattatggatcagtggtttctaacgttggttttgtgaaatgttatgatctgttatctaaaaggaatttttttttttttttgctttaacattgtaattaccaaacgacctctgtttgagagaggaacatacagaggaccaagggtaagctgtaacttgaaacttacataaaactttttagttacctgtggtggttaaatacttcatggttttggacttactccacattttgaatgtgttaattcagca

SEQ ID NO: 14151 - DNA, 1029 bp, Homo sapiens
tcctgagtagctgggattgcaggcatgtgccaccatgcccagctaattttttgtatttttaatagagttggggtttcaccatgttagccaggatgggtttgatatcctgaccttgtgatccacccacctcagcccccaaagtgctgggattataggcatgagccaccgtgcctggccagtaatttttttgtaaacttttattggagcttcttcaacacaagttttcccaattggattgtcagttcttggatggcaaagaccatgtctcatttttctttatatttctcagtatagtaaagcattttgtccatagtagggtctcaatttaattggtttaatgccttaatataatagtagggctaagtactcctgttttaatgctttcagaatattggattgtccaagatttaaacagatatataggtatactcaacgtaggtagtacaggaaagataaaggagataagtgaggtacctagatttacacccaactaacctatgcaggaaacaaagaaattctcattccatctggcacagtcaatatagtccccttttgagtgttcaatgcatctaacacatgtgataagccaagtcaaagaaataggccacaatcccctccctcaataaatgtgccttcacagacctcagtgcttctatttctccatcaggtatataaagcaaaacaattcaattttatgatacacaggggattttgaggtggtttccctccatttgatataggcttaaagggaaaccaatgggctgagcgctgtggctcaggcctataatcccagcactttgggaggccaaggtgcgaggatcacctgaggttggaagttccagaccagcctgaccaacatggggaaatcccatctctaccaaaaatacaaaattaggcaggtatgatggcacatgcctataatcccagctactcaggaggctgaggcaggagaatcatttgaacccaggaggcggaggttgtggtgagacaagatcgggccattgcactccagcctgggcaacaagagcg

SEQ ID NO: 14152 - DNA, 1049 bp, Homo sapiens
atttttttgtatttttagtagagacggggtttcaccgtgttagccaggatggtctcgatttcctgacctcgtgatccgcccgcctccgcctcccaaagtgctgggattacaggcgtgagccaccgcgcccggcctctaattcagttttttaatgggctctgatctctaaagtataactcattggtttgaatattgagcataaagtgatagtcaactgaaatttgaagaggatttgaattaagtatattaagtcctatgaaaataatttgtttaaagataaataagaaaattggagcccaggcatggtggctcacgcctgtaatcccaacactttgggaggctgaggcaagtgaatcacttgaggtcaggagtttgagaccaacctggccaacatgatgcaaccccgtctctactaaaaatacaaattagtgggcatggtatcaggcacctataatcccagctacttgagaggctgaggccggagaattgcttgaacctgggaggtggaggttgaagtaagccaagatcgtgtcactgcactgtagcctggacaacagagtaagactctgtcttaaaaaaaaaaaaaaaaaaaagaaaattggatttttcaagaagcttccaactaacctgttaaatgttgactttatctatataccagcatagaattaattttcaaaatatggaagattaaatatttatgtctaatagattaaaagcaactggcactcattcactgcattaaaaataatttcttatttttatttttattttttgagacaaagtcttgctctgtaacccaggctggagtgcagtggcgccatctcaactcactgcaaccactgcctgccgggttcaagagagtctcctgcttcatttcagcctcctgaatagctgggattacaggtgcgcaccaccatgcccggctaatttttgtattttcagtagagatggggttgcactatgttggtcacgctggtcttgaacacctgtcctcaggtgatctgcccacctcagcctcccaaagtgctgagattacaggcatgagccac

SEQ ID NO: 14153 - DNA, 1038 bp, Homo sapiens
aaattgttgcattgatactaatttacctaaaaatctctttcactgagtggaaggtttttcagagacaatttacacaaactaaagctggtaagcaaggaatagggataagtttgctatatacatttcatgttatcctcttggcaggaagaatcatttccagatcatttcagctgagctgaaaatagacttctgctgagcatttcctaagttacactgctaaaatattctccttagctctggtggcttgatgttttactcatgctatctcctacattgttgagattgaaaagagatgatatttcttttttttcatacatacagttttaatacaaatgaacttattaatatgacatccatttattaccaggaaaagagatgatatttcatatcattgataccccactgcattcaactatgagagcagaatgttgagcttaagagatactaacataaatattaattgattgtcacagaattgtttgcctatctgactttaaaatgtgtgtctatgtgtatgtacgtacttcaaaatattcaagattatggaacagagtttttttgctatcattgaaggtaaaattcatgtgaaacctgaactagagctctcagtattatgaatgatagactccatctatccaagataacatgtagatgaacatgcattttcatatattcctttttcctcaatatcaggtttcttattgcttgtcgaacttttcacctccattatttacttaagggcttcattaatattagtttatctcactttatttctatccccatattaaacacagagttggaaaaataaagctttatattaagcagtgaccaagaaagaagctcttaattatatctacctcctttttggcctcaacaaggccattttcaaatgcagcaatattgtttatcatgtttaatactgtcttgaggtttgtaaatatgatagaatttatgcttcttctatccattcaaaggaaaaaataagaaccatgcacatttatgcagataggcaaggggaaaataatatcatagtaaatt

SEQ ID NO: 14154 - DNA, 1043 bp, Homo sapiens
gcaaatcccagaaatgcagagaaccctggttagatactatacaaaataaccattcccaggacacatagtcatcagattcaccaagatcaatgcaaaagaaaacattcctcaaggcagctagcaaaaatcgtcatgtacagagggaatcctatcaagatagcagaagacttctcagcagaaaacttataaacccaaagggattgggggtcctattttcagcatccctaaagaaataaaatcccaactgagagtttcctgtccctctgaattaagctttataagtgaaggagaaatgaaattatcagatagcaaatgctgagggaatatgtttcatctagataagcctttcaagaggaatgctaaaaattgaaacaaacgaaaaatacttgataccacaaaaacacacttcagcacctagcccacaggcaatcaagtccacataacaaccaactaacaacaagatgacaggatcaaaatcacacatatcaatactaacactgaatataaatgggctaaatgccccacttagaagatatagagtggctgaatatataaaaaaacaagacccaaccatctgctgtcttcaagagaccgatctcacatgtaacatcacccacaggctcaaagtgaaagaatggagaaagttctatcatgcaaatggaacaaaaaagtacagaagtagctattcttatttcaactaaaacagattttaaccaataaaattaagaagcaagcccgggcacagtggctcacacctgcaatcccagcactttgggcggccgaggcaggcagatcacgaggtcaggagattgagaccatcctggctaacacagtgaaaccccgtctctactaaaaatacaaaaaaatagccaggtgtggtggcaggtgcctgtagtcccagctactcaggaggctgaggcaagagaatgatgtgaagctgggagatggagcttgcagtgagccgagattgcaccactgcactccagcctgggtgacagagctagactccatctcaaaaaaaaaaaaaaaattaagaaacaaaa

SEQ ID NO: 14155 - DNA, 1073 bp, Homo sapiens
ttgtcattggttctgtttatgggatggattgcattattgatttgcatatgttgaacaaaccttgcattccagggttgaagatgacttgaatatggtgggtaagctttttgatgtgctgcttgatttgatttgccagtattttattgtggatttttttggcaatgttcatcaggaatattggcctgaagtgtgtgtgtgtgtgtgtgtgtgtgtgtgtgtgtgtgtgtgtgtgtgtctgcccgcttttggtatcaggatgatgctggcctcataaaatgagtttgggaggactccctccttttcaattgcttggaatagtttctgaagaaattgtgccatctcctttttgtacctctggtagaattcagctatgaatacatctggtcctgggcttttttggttggtatgctatttattcctgcctcaattttagaatttgttattgatctattcaggaattcagcttcttcctggtttagtcttgggagggtgtatgtatctaggaatttatcaatttcttctagattttctagtttatttgggtagaggtgtttacaacattatctgatgggagtttgtatttctttggggtcagtggtaatatcctctttaacatcttttattgtgtgtctacttgatcttctcctttttcttctttattcatcttgctagtggtctatccattttgttaatctttaaaagaaaacagctcctgcattcattgattttttgaagggttttttcacatctctatctccatcagttctggtctgatcttagttatttcttgtcttctgcttttggaattgtttgctcttgcttctctagttcttttagttgtgatgttagggggtcgagttgagatctttctagcttttggatatgggcatttaatgctataaatttccctcttatcactgctttagctgtatcccagagattttggtacattgtctctttgttttattggtttcaaagaacttcctgatttctgccttaattttattatgtacccagaagtaattcaggagcagtttgttcaatttccatgtaattatgtggttttgactgaa

SEQ ID NO: 14156 - DNA, 1034 bp, Homo sapiens
gttggatggattcacaaaaggccattagttagcaacaattttccaatactccaagaaacaacaatggaaaaatcatttctgagtgcttaattacacttatactctttcatttcgtatacaatgtcattatctatcctcttcttgtctgctgtgtgaggtaaatattattcatccatagctgaagcaactgagcttcacataaatgatgatgctagcaaaactaacataatactttagtgttgcagacatgaaacaaaattgaatactttgaactcattcactcgttaaataaatatgcaccaggatctaactaaacccccattgatcatatttaaagttctgtcatattcaccatttcatgtgtaatatctaacacaatgcctggcaaatatccagttctctaaataagtgttgactgaatcgatatgccaggtattttactatgtcctctttcttcctcttatcataaaaactcattatctttcatatcagtgcagattatgtaccaaagagtgactattgatccaataccacaattcaatatattttagaaacaactttttttctaaatactgaaaaacctcaaactcctatttttattgaaatctgggtgtcaattatggagtgatactttaaagcatttcttaggttattatcttaaagatatcacaaagtctgtatttcacagcccaatatgcatattttgaaaaatatgatattaaactttaataaattaccatctgtttagaataaaaccatactaactagaggtaatgaacaaaatagatctataatgatgttgctatgcttgtgaatttagattggagaaacttttctctggaattttctctaaaccctaccttagcataattgtaacattttacatttgcttctcatattatttgaaacttatgccactattctggattcattgaggaagctgcaaggaagcaataaaaattctttctagcaacaactggaaattttggaattatttacctcttttttttttttttttttttttaaagacaggg

SEQ ID NO: 14157 - DNA, 1052 bp, Homo sapiens
ctattcccatcaaaccacaaatggcatttttcacagaattagaaaaacctattctaaattttatatgaaaccaaaacatgccttagcagccaaagtgatccaaaaaaaaaaaaaaagctggaggcatcttattacctgacttcaaactatactacaaggctgcaataaccaagacaacatggtactggcacagaaacaggcatatagaccaattgagaagaatagagccaattgagaagaatagagagcccagaaatagagcgacacacctacaatcatttctctattcaatacatgactctgggctaactagccacatgtggaagattgaaactggaccccttccttacattacataaaaaagtcaactcatgatggattaaagacttaaacataaaaacctaaaactataaaagccctagaagaaaacattggaaataccattctagacacaggctctggcaaagattttgtgacaaagatgccaaaagcaattgcagtaaaaataaaaattcacaaatgggacataattaaagagctttgcacaataaaataagctatcaacaaagtaaacagacaatttacaaaatgggagaaagtatttacaaactactcatccaacaaaagtctgatatccagaatctataaagaactaaaacaatgaacaagcaaaaaacaaacagccccgttaaaaagtgggcaaaggacatgaacagacacttttaaaagaagacatatgcgtctaataagcatatgaaaaaaaactcagcatcactaatcattagagaaaagcaaatgaaaaccacagtgagatgccatctcacaccagttagaatggccatattaaaaagtcaggcataatagatgccggcagggatgtggagaaaagggaattcctatacactgctggtgggagtgtaaattagttcagccactgtaaaaaacagtttggagatttctcaaagaatgtaaaacagaagtactattcaacccagcaatgctattattgggtagattcctcccaaaatataaatttttctaccatgcagaca

SEQ ID NO: 14158 - DNA, 1080 bp, Homo sapiens
gattagtcactatttggaaagaaacaaaattgaagcagatccagttttatatataggaactggagttaaagaaagacactgtagattataattaaagtattaccagtaggtgagccttctatatgacattttctgcatgttcaaatagataaattcaacttcccaggagtaataaatttgtttgaccagatatagcatcaataaaaaatcaactgaccaccaattcatttttttctatatccatcttgagaaagaaatcagaaattatgatctattttaactgggacataggctatgaactcctgaggcagaaatttgtgccactatttttttttctcaatagcactaaataaattagaatatttttctcatgaaaaaccttcaaattaagaaggatcaattaagtcgattcctttgagagtgagaagaaactgttttctagcatttttaattatttcagctaatcaattgtgtgtccaaaacattgctttaactctattaagacagtagaaattgggaaaaaaacaaaaaactatgtattccctgaaacagaattggggtaaaatatattcttatttcttgttccttactaaataaatttatcatatatcaatgtcctttgttgtgcttaaaaaactccagacccacaaggatcttttgaatttcagagtagaatcatgattaatatatttatttttatctgattttagtctttagaaatctatggaaatctctcctgtcgatatgggggagatggtaaaatataatttatcctcatgataaatatagcataatgtattccagtgaaacccattatgtgagcttgagataaacttagttggcaggcacaaacctcaaacataggaccaatctaaaatttaacattagaagttaattagcctagaaaattaagtagaaaacacaatgtgtatgcatacaaatggcataactatgttaacttttagaatataatttatctgaagtaaatgtaagcgtagtctcagaatggatatcagctagcattaacaaatctcgacagctggaatacagatattattttaaatagttatgatcatggat

SEQ ID NO: 14159 - DNA, 1027 bp, Homo sapiens
ctccagctgtggcacaaaggggcccaagtacagcttggactgccatttcagatgctgcaagccataagcattgctggcttccacatggtgttaaacttgtgggtgcccagagtgtaagagttgaggcttgggagcctccagctagatttcaaacaatgtttgaaaaagcctgggttcccagccagaaaactgtttcagtggtagaaccctcacagagaacctctactaaggcagtgcagtggggaaatgtgaggttggagccctcatacagaatcctcacagcagcactgcctagggcagctgtgagaagggggccaccatccaccagaccccagaatggtggagccacttacagcttgtaacctgtacctagaaaagctatgggtacttaacaccagcccatgagatcagccacagggatgaaccttgcaaagtcacaggggtgaagccttccaatacctttggagaccacctaccatatcagtgtgccttggatgtgggactgaattcaaaattttggagatttaaaatttaatgactgtcctcctgggttttgaacttgcatggggcctgtagccctttgttttggctgatttttcccttttgaaatgggagtatctacccaataacatacctacattgtgtcttgaaaataactaacttgattttataggatcagagttgaaagggcctagccttgtctcagattagacttcagactttggacttttgaattaatgctggaagaagttaagattttgggaattattgagaaggcattattgtattttgcaatgtgagaaggatataaggtttgggaggggccaagggcgcaattatatagtttggatatatgtccctacccaaatctcatgttaaattgtaattcccaatgttggaggtatggcctggtggggggtgtcatgggggtgagtttattatgaaggatttactaccatcttttttggtactgtcctcatgacaatgggtcagttctcacaaaatctggtcatctaaaattgtgttg

SEQ ID NO: 14160 - DNA, 1050 bp, Homo sapiens
attttatcctataactgtgtgggatttattaggtgctgagagtttatcagaattactgttgtatagagaacactggtataatggttcttagatttaaaccaggcatgggaaaatataatccagaaataattttataatactgcttaagctagcacagatgcccgtgttggattaagttggatataaatttaaagtaccaattaggtcatgttacggacattgccaatttgagcaggaaccatacgaattgctaaaaagcgacttgacataagcatatgttttaaatgcagtcttcacctgtatattagcagatcaaccttcacctaacaaatgtgtattttcctgtttacattagattttctgcttttaatggaagatattagctgaataatacaattgaggagtatataaatgcactatctacataacatatttcagaaccagagggtgtaaaagtgactataatttcatgggtgtattccttgctttcatgtttaaagatacatcatctgtgttgactaaaaaattgactttaaatttctgactaaaatgatcacttccatagataagcaactcatctaactcaactattttgccccctgtctagaaaagtagcttgagaggatattataagcaataatttttggtttcgtcaactttgatagactttttctcaaactaaagcaactccaaatgtttcatttagattaagtttacctctaaagatacttagcgtcttctaaatgttgtcttccttatttactgttaggatcccagggttgtttcattgctattattattacctgtcacagataaatccaagaatactgattcctgctatttgattcttattgccagaattgcttaatttatgagcatgaactaatagtttaccttttctgttctcacagactcagggataaagccacattataccctctaattcatagaccacctccaataatactggcaattatatataacgaaaagctatgaatccatttgtatctatgtagcccctcttttacgggctgagttagtatgagaggg

SEQ ID NO: 14161 - DNA, 1025 bp, Homo sapiens
tttttcactaaattaattatgaactaaaaatttcttctgatttatactgatttataaatacacaaattaaacctataaacttctgcgttttttatttctttgtttttattactagcttaaggatgaaaaaaatttttcctccaaaaaatatatattttcagaaacaatgtgagccctgggtttcaattgtagtaggtacatgacatccaaattgtatacattaaaaataattatgtctatttgtgtttgtgttacaaataattcaatattttaagtttaaatagaaaacatgtttctataaaaaacataattagcaccattgtagtcagaatgaagatttttagatgaagatttgctgttctgtgataaaaattcccagaggctagctacataacctttcgaaaaatatagtatcttaccaaattcctaacagaccaatgggaagatacttattcagatttgggggttgtctatttataatatttgttttacataaaatgtcttttttaaaactgttgagacaatgactgcaaaagagcagatattcaaaattctaaatgaattttataaatgtgaatgcctgaaatgtagaaagaacaaaggaagatcaggtatatatcttctactatttttatccctagatctagaattataaattttgatatagaagtcaaattagtgaaaggaggaaagaagtaaactgaaaaataatctgccctcagggctttatgtaacaaagcacatgttttatatctgggcagtccatagagtagtctcaagctctgtgtagattctgagcacatgaactgtggctagtataattgggaaactgagttctaataatattttaatttttaataaactttattttaaaatggttgtagactttcagaaagaaaaagtaaggatagttcagagttctcatataccttacactcagttttccttagtaataacatctcactttggtagggtaaatttattatatttaatgaggttatactactatattattattaacttaa

SEQ ID NO: 14162 - DNA, 1086 bp, Homo sapiens
tctttgagctctgagattattccttctgcttggtctagtctattgttaaggcttccaattgtattttgaaatttctgtagcaaaatttttaatacaagaagttcagtagggttctaaatttaaaaaaaaaaatgtttaacacatgttctttggacattttagcaagtgacacacatggaaatatcttgagtatcaatgctaacttttttgttaatttttttttaaatcttgggtttatggggcagctactgaaattgaggcatgagaatagtgtgtggaggcagggaacctaagactgacttgtgctgacttcctagaactgaatcaaaaggaaaaccccacctcttcacacccaagtaagaaaaggatcagaggctactctctctgcactacatgccagaggaaaaatggaaagtacctctgtttggtcgcctcccacaaccaatcagactggtcgtgggccaagtcttcatgtgtaactttgtaacttcactttagcctctgatttgaccccttttaaaaccaatcagatgtttgcataggatggaactctgttacttcacgtcagcctcagattggtcatcttctgcaaccaatcagactggttgttggccactccttcatttatatagagttaaaacaagtaaccaacgggaaacctctgcagaatatttaaaccccagaaaactctgtaatcagtgctcttgagcatcttgcttgagtgtgctacgactctgtggagtgaactttcatttcaacaaatctgtgcttttctttcattgctttgtgtcttgtccaatactttgttcaaaacgctaagaatctggacaccctccattggaaacaaaaccacattaatttttagatctgcttcttaaagacctacaacaatttgctatgtataaatcacctgctaaaataggtctgtatcattctactgttgatcttttgattatatactcatatttccatccgcagagtagttgctgctttatttgattaccctcactgaaaaagttaccctgaagcatggtagggatcctcgacagtaaaggatgtaatgtagaaagggacgtttaaacacag

SEQ ID NO: 14163 - DNA, 1047 bp, Homo sapiens
acatgctccaaggagtcccactattctttatgtatacatcaatgtatcattatcatgcaatagtttgatctgactcttcagagataccaacatattctcatgtctggaccttgttttttcccttgtttaattgattacaacataacaaatgtgtcatcagatatatcttaatgaatcgagttctggtgacccaacacaaacattaaaaaggcaactgttttatcttaatcagctccagagtaagcaaacagcagatacacagaaaaaaatcaatggattaatggagactggactcccaatactgagctgactgctggaatttgctcagttgtccctacccagcatcttcccttcccatgtgtgttgttgatattgatattgttgttgctaagactaatgagtccataaattatttgaaaatattttgcttctggagttcatggactgtaattcataagactatttctcaacctatctgaaagcagaatctcaaaattttaaaataagaaagaatgtcttcatctgaagatgtaatgaagaagaatactgaatatgatactctaaactatcactttggttgtactaacctgcaccaaatgcaggttgaatggttagttaaatgtactaaccatttaactaacctgcacattgtgcacatgtaccctaaaacttaaagtataataataattaaaaaaaagaaaaagaaaaatatacaaaaaaaaaaaagcagaagagaaaatggcattttgaaattccttaatggatggaagcaatatgaagagatatttaatagaggttaagtcaatactggctcaaacaggaataaaagatatttcaattgttatagatacaattgaactgtcaaataatttcaaacatagtcaaactcaatcactatttttttaaattttacttcagttctgggatacatgtacagaacgtgcatgtttgttacataggtatacatgtgccatggtggtttgctgtacctatcaacccattatctaggttttaagccccacatgcattaggtatttgtcctaatgc

SEQ ID NO: 14164 - DNA, 1049 bp, Homo sapiens
ataaatagaatatgtctttatatattgaagttagacatggctctgtacaaaaggtaaaagagaataacttggctaatgaaaacaaacaaatataggtacatatctctcctcacctgttttcaagaaacactggttctgactccaatgacagcaaaaattacaaaccacaatgatcatccagttattttttctttttcattttttcctcaaccagtatttcttaatgtaaggttaaagtatcaacacggtagagttctacttcgagattctctttaagctctttactaaaatatgggaggctgagcgtattacttgaagtagattaacaggtaatccacctcttttattcatgttatattttcacctaagttggtatcaattgttatccatgcaaaatgtaatttcatactgataacagggtgttttaagtcacaaaacagaggatttgaggacaatagagaaaaggggcacatatagtatgggatctattaatatcagcatcaggtcttaacttagttcatttcccaaattaatagatgagcgagggctcagaatcttctgcaatccacgtgagaaggttttttgagacatggatttgtgattgcaggtattactaattcacagttcatgtgttaaaaaaaaacttcacctacaaaatcaacccagcaatgtactatccacgagataagagtatacagattcaaagtgttgtttgttggtaattaggtaaacattagcatcttcatgatgtggaaagtgactgaaatgtttgacaccagtttggcagatggtcagcaggtacagagaaagggcagtgatcttgcatggagactgctgctaatggaccattttgtgggcacaggtaaagtagccctttgggaactcataaataatgggagaggggtgaacgttgaatgagctagtctctatcaggctgctaggaattccattaactataatgggatcataaatagcaatgaatgcagtggtgcgatctcagctcactgaagcctccacttcccaggttcaagcaattctcctacgtcaac

SEQ ID NO: 14165 - DNA, 1018 bp, Homo sapiens
catacaattttaatttatgctctctataaagattatgttgctttacataatgtattggtcattgtattagtcagctcaggtttccaaaacaaaatactacagactggatggcttaaacaatagaaatttgttttctcacagtcaggaggctgaaagcctgagatcggtgtttccacatgttcagggtggtgagggctctctcactggcttgcagatggctgccttcttactgtgtcctcacctggtgtggagagggagagaaagaaagagagatctttttgttcttataaggccatagtcttttgtaacctctgtctccaatacagtcacactggaggttaaggcttcaacttacgaatttgggaagagtactgttcagttcatagcagtcattcctgaatagttactaccaaaatagtaacgtattggcccttgatgaatatttattctctgtatagttaacatttattgttacagttttccttcattttgtattttaatgttttgaaatatttgtaactgtttgctctgaaaatgtaagaataatttttatggatcaatgtcatgaaaatgtgtgcaaaaaattatttacattatttaaataacagaaaaatatttaaattatttttagtttttcatattaaactccttttgaatatatattctagtaaataaatttgttaatagttaataaaagttagtttttacataaagtaatgatgactcctaaacattcttactttaaaatgtccatcagtttttcttcatttacttacttcttctgaagcatctattagtaaagtgacacggtctgtgaaaaaaatcacctaggaaaagagcaatgttaagtgatgttaggatgtagtcacctatggtccagtcaacaaagaatatctgcaaaactaaatgtgcacatcaactactcagaaagcatttacaaatgcttcctaaagtccattctttcaggattctaaatagccaatatctacatagtcaaattaacaaataaatttgatat

SEQ ID NO: 14166 - DNA, 1048 bp, Homo sapiens
gttgataatggtgaatggtcttttaatgaactgtttgatttggtttaataatattttgttgagaatttttgcatctattttcatatggaatattatcctgtagttttctttttttacagttttcttatatggcctttgtatcaggccaatcccggtctttaaaataagtttggaagtagttcttctttctcagttttttttaagagttttagaataaatggtattactttttctatgattgtttaataaaatgtatcagagatgtcattagctcttgggcttttctttgataaaatatttttagtgcagatttaatcctatttcttgttaatgtcctattttggctttctatttcttcataattcagtgtttacaggttgtttgtgtcaaggaatatatcaatgtattctaagtttacaattttgttgttatataatttttcatagtagcctcttctgattctttgtatttctgtagtgtcggttgtaatgtctgctttttctggttgttttgtagattctttgttctcttttcctctcttgctgtttcatatatggctaagtgattttctttaatggaatgttttgattcccttgtctttttgtacctctggtattggtttttgttttgtggataccattaggctgaaaaggaaatcttataattacagcaggttgtcttaaacctgctgtttaagatatctgataacaacttaactttgattagaaaatttaaaaatcacttgtgcagtaatactccactatccccacacatattttgagggtctaatatcataatttacatcttttttgtatttttcttaataaattatagtggttatgattttaatagctttgtcctttaacatttatacaaaaaagtataagtaatttacacaccacccttaaagtattattctatgcacttgcttttaccagtgtgttttacactttcctttttttcatgttattagcattttttaaatttcagcttaaaaacctccctttagcgtttcttgcaagacagacatcatagtgatgaattccct

SEQ ID NO: 14167 - DNA, 1009 bp, Homo sapiens
gatgtataataatagatatatagacatcatatacaaacatacacatacatgcatatgtacatagtggaatggtgccaattaaggagaccagagagaataacctttttcatctttgaacagaatgaatcttacttcattctgttttctgaagtgcttcgcacttattgtatggtttaagtaaatatttcttgattaatttgtcaaagaaaatttgaaaatttgagcagtttaacaggcttactatttaggaccaaaaattattaaataaaaaattctgctttaaatttctctatcatctagaacttgcattcacttatttgcttcaacaatacttaattttagatctcctatcctttctcttttctattaataaattctattcttatatatgcaattatttgcttactatcagactcttgggcctcaatggaaatacaaaaacaaaatatttaaattaattcatgggacacccattaatttaatctgctgatcttctgtcattgatacacatacctggaaaacttagttgaaatctcaacaaagagtagtcttctgtcggaaactcataacaaatatttgggagtgactgctatctctctttctccacacaatcaccttttatttctttattccatccatgaattatttttcaaatttgtctgtttttcatatagagtgacatgatactagtttgagccactatcctctcacttaaacctgtgtaatatgctgtaaacctatcttccctgtcctttcttgtaacttttcgtttgattcatcactgaatatcggaacaatctttacaactatgatttaggtaagagtatggtcttgctgtaaactttacaatggcatcctcttttcattacaaaaccttgtattaaatggctacaaattatcttcaaatccacttcattctgttttaaaaggccttcatttcctaacatatacaggcttcgtatttccagaatttcaaatcctcctctgccaagcatgctttttctcttct

SEQ ID NO: 14168 - DNA, 1032 bp, Homo sapiens
taatgaagccatatagactaaaaactatttagaccatctgatacaacctttcctctgatagaccaggaaggtctggaaaaatgtaatgacatactaaaattatgtgactaattattgagatcatttgaattcatttccagattttgaaacccatgtcctaaattcaaattgtctttcaaatcagctaaaagaagaaagaagaaaacttatgtaattacactgcattttgaattacataattacctttactggtgcttattgtttgatgtggatttaaatttttctctggttttgttgctttcagcctcaaacttttcctttagtatttcttttaaggtgcatttggggtttattaatttttctcttgtctacttttttctttgttctgtgactttgctggactatctctacgaaatctgttccccttgccatggaaaggcttatacccttaccatgttgctcctcagtgaatagtattaaacatctatagagtcccctgtgttggcaatggttttagataagctgtatttcacagtctctttacctgatctctgttaagctgtatgcctctgttagcaacacacctagctgttagataccgctaattgctggctgattgctttactgtttttgacaatgccctgatcgaactccacttgggctcatttgcaaaggtagtttttgagcccagtctttcttttccacttttttattatttgtttatttatttattttgagacagggtctcacttttttttcttttttttttttaagacagagtctggctggagtacagtggtgtgatctgggctcactgcaccctctgccttctggttcagggttcaagcaattttcctggttcagcctcccgagtagctgagattacatatgtgcgcaaccatgccccgctattttgtgtgtgtgtgtgtgtatttttagtagagacagtgtttcaccgtatggaccaggctggtcttgaactcctgacctcaagtgatccgcctgcctcggcctcctaaagtgctgggatta

SEQ ID NO: 14169 - DNA, 1079 bp, Homo sapiens
aaaaatcttacaaaggctaacttacttaagacaatatgtaacatttagcttttatacttaagcttttataacattcaaccacgttgctgaatatgtgtatatatgtccaaaggaaatgaaaccagtatgttaaacgagacacctgcacttccatgtttattacagtgctattcacaatagcaaagatatggaatcaaactcaatgcccatctaatgatgaattaatacagaaaatatgatgtatatatatatataatatgcatatatttgtcatatttgttctgtttctctgaagaactctaacatgacaactaagatatgtgcatttatttgaaaacattttgggggtgcacaagtctgttattctagtaaacgttgttcaccaactacatgccaggcattgttttaggtacaggacaaaagaggaaaggtatataagacatgggttatgcttttaggtgagttgaaagtctatagtgagagatatgaaaacaaaaaatttaaattaagtattaataggaatatgtttaaatacagataacagagcgttgaatatggaaaagaattgttctttcaatatataaaaaaacctgttaaagagtaaactatgaaataaaattatccagaaatgaggataaaaataaaaagcatagaagattatgaatgccatgaaaagatattgaattttatcctgtatttacagcactcattgaaagttgttaaatttgtcaattaaatgttttgattcagatttttggtttctctttctgatgataatgtagatgatggatttgtacagggtggaaatagaataaagaaaatatgggaaatttttgtagtaacctaggaaacaaatgataaatacctgaactagtagagatggagttcagagaacatatttctaaatattaatgagattgatttgggtagattaattaatgaggtaatgggaatttgatctataattagctgccccaaggtaagtacttcagtatatgaagtctggccagtgaaacagaggtcttttcaagtcataaacaattgaaaaattttctgttattctttgaataaaaaattca

SEQ ID NO: 14170 - DNA, 1039 bp, Homo sapiens
ggtaatgcctcactaagctgaggatataataggacatcacttccctggttaggggctgtttttttattaatgcagaataaaatattttgccttttctgaggaaacatgattcacaaacaatctaatggatatttccatttttaattgtgtctattttgccaaagctaaaatcagttttgccaagtgtcaaatatcaagaattttagagccttttaaactgacatttaaaaaccaagaaaacaaaaaaaaagttgttctaaataggttaagattccaaaataaattcagaggattgacacaaaatgagatcctgctgttttcacaagcgagatcaaaagaagcttccaaataattcatgagacttctgatttaatgccatatggctggcatctttgcaataatcagcttgaacttcctatttaaaaaatgataaagaccttcaacggaagaaatgaaaacaacagaacctaaaattgattcacaaccaatggttagaatctgttaaatttgtaacaattatttcccttttgggttggattaagactacctttgtttcgttccgtatgtcctactcatatttagactctaaattctgtaatgtctagaactttgttaagaatatcaccacagtagtcagatacactgggttcaaatcacagggtcaaccttgttgattttaaggcaagttatttagcattttcatgcctcagttttctcatttgtaaaataagagtattaatagcatcaaatcagaaatacatagaatgtacttaaaataatgtgccatattactcagtaagtataaaacaggtattcaataaaagtaagcaattgatggtgaggttattattatagaatagaatattttagtttgcttgaagacatttagagatatagaatcccttcaccaatggcttccctattggctaagaaattcacattttagtaccaaaattttgtagttctgttgctctatggaaaaaatttacctttggaggtatctgggtcaccatcaccgccgtcaccacctccactactc

SEQ ID NO: 14171 - DNA, 1050 bp, Homo sapiens
tttgggagagtttcagtactggcatagaatttaaatgtcaaaattctttctgaaaccctttctcctagaaactaggaaataataggtgtagaagactctccctaagggtagccaggaagaagtctcctgattcggacaaccatgaggggtagtggtgctagggagaaggcaaccttcactggttttgaactcagtgcctaagaaagtctctgaaatgttcgtttttaggcaatataggatgtcttaggccctaattcaccatttcttttttaagatctgatatgctatcattgccttaataatggaacaaaatagaagcatatctaacactttttaaattgataattttgtaaaattgattacgttgaatgctttttaagagaagtgtgtaaagtttttatattttcacaattaacgtatgtaaaaccttgtatcagaaatttatcatgtttactgtttaaaatgattgtatttataaaattgtcaatatcttaatgtatttaatgtagaatattgctttttaaaataatgtttttattttgctgtagaaaaataaaaaaaaatttgattatatatttttaatccttctttgccctaaagactttaagaagacttgaaaaagtaactgattggctattgggttgagaaagggaaaagaaactgggtggccctctattaagaatgcagattttggtatggaggcatcataattcctcattagaaagtcttatactttaaaaatacccttaaataccagcctcccactgtgcttagggatccctgagtccatacctcttctattcaatttctccaatttcccctttctggagagaaagagagggaagacaggtgtgtcagttgagtcttacaggaagcagatgcagagagaaagtaatgactataacgataaaagaaggaggaagcaaaattgggcaggctgtgcgggcagaaaggcaaacccaacccatgtggagaaaatgtctattgtgagaatcagctactagccctttcacagtggaaagggcccaatggagttcatgtcccaccagg

SEQ ID NO: 14172 - DNA, 1026 bp, Homo sapiens
ataactaggatccattatttcccctgaaggcttcttgttagaaaatagtacagttacaaccaataggaacaacaaaaagaaaaagtttgtgacattgtagtagggagtgtgtaccccttactccccatcaaaaaaaaaaatggatacatggttaaaggatagaagggcaatattttatcatatgttctaaaagagaaggaagagaaaatactactttctcaaaatggaagcccttaaaggtgctttgatactgaaggacacaaatgtgaccgtccatcctcctttagagttgcatgacttggacacggtaactgttgcagttttagactcagcattgtgacacttcccaagaaggccaaacctctaaccgacattcctgaaatacgtggcattattcttttttggatttctcatttatggaaggctaaccctctgttgactgtaagccttttggtttgggctgtattgaaatcctttctaaattgcatgaataggctctgctaacgtgatgagacaaactgaaaattattgcaagcattgactataattatgcagtacgttctcaggatgcatccaggggttcattttcatgagcctgtccaggttagtttactcctgaccactaatagcattgtcatttgggctttctgttgaatgaatcaacaaaccacaatacttcctgggaccttttgtactttatttgaactatgagtctttaatttttcctgatgatggtggctgtaatatgttgagttcagtttactaaaggttttactattatggtttgaagtggagtctcatgacctctcagaataaggtgtcacctccctgaaattgcatatatgtatatagacatgcacacgtgtgcatttgtttgtatacatatatttgtccttcgtatagcaagttttttgctcatcagcagagagcaacagatgttttattgagtgaagccttaaaaagcacacaccacacacagctaactgccaaaatacattgaccgtagtagctgttcaactcctagta

SEQ ID NO: 14173 - DNA, 1029 bp, Homo sapiens
ttatatattaccacataataatagaaataaagtacacaataaatgtaatgggcttgaatcatcctgaaactacctccatcgccatccatggaaaaattgtcctccgcgaaaccagtccctggtgccaaaaaggttgaggactgtgttctaatccacttgtttgttttcaccaccttctggattcacagcaccctccactccacctgtagcacatgcctgccactgggctgcctctggcggaccccattctctgccccaatccttggcctcattatgcttcctcagagtcagttgtgattcttcctcaacgtattcatgctacttatccttgttactgtaattttgtgatggcaatacttatcatataaactgatgaaacaggaatgccacaagaaagatttgtttgacaagtcgaagccttgggaaagaaatcttcactttaaaaaattgttaacaaattatgtgtggatgagaataaatggggtggagatgagaattggaggaaaataggattgtgtgctaatagcttcacatgtgtcttaaaattcatagatgatgtattatgtgtgtgatatatacataagaaagaccatgaaaatctccaacatcagacccggacatgttttttcatgcctgtaatctcagcactttgggaggctgaggagggcagatcacttgaggtcaagagttccagactagcctgaccaatgtggcgaagccccatctttactaaaaacccaaaaattagctgggagtggtggtgcacacctgtaatcccagctacttgggaggctgaaagaattgcttgaacatgggaggtggaggttgcagtgagtcaagatcataccactgcactccagcctgggcagcagagagagactccatctcaacaacaacaacaaaaaaacccaaaccaaaaaaacctcaaaaccaactttaaggattttgtattgtgtatcccttatttccatgctggccaaatacaagttcacatcacagcagcaaagggctttgtctgttgccctgctt

SEQ ID NO: 14174 - DNA, 1042 bp, Homo sapiens
ttttttaaatttacttttgaatgcatttaacaaactggctaggagtcctttaaagagaggtaaatgcaatcgtcaacagcatctgcaagctaaccccaaagaacccattttcagccaacttcgtgatctctcattcagattcaaatctacaatgaagtgccaaaatcatgcttttaaaaaatgacagcattagtgaaactttggaggtgcttatattgctagtgtaggcaaaaacgcacagcaatacagagctaggccgttttccttgattctttcaccataggaagaaatgaacttccagggaggtaatggagtccttctgagaaccatgattaaaagtctttgggaattatcagccaaacttaaaatggatctctaggttttcatggggagttgtgttaaaaagggactttttaatttaaaggaaccaagttgataaggtaggttcagggaaccaaaaatgttgaacagatttttgctggattgacaacttgtacggatggtgggtttttagggtggttaatcgtctgcgtctagggaaatggccacagcttgcctctccttcggggtgaaaggtaggttctgagtctgtgatttttccctgctcagagtgaataaatattgtaagtaggtgtggtcagctgtccagctctttactttttcagttgggaaggaaagagttgcacagctatgatgttcagagccaacaaggacttgcagacgccctgtgcataggagcagctgaacacattcagaatcatgtaattgagcaggctgctaagtaatggagaaaagaatatcatgcacagagatttgatgtctttttatgggagaacaaaagagtttcgattctttcacattgagtttagcctagccattgtgtggcacaggaggtttaatgaatcattgtttaactaggatcctgccaagtatttgaccattaaatagactccaatgtgtatagagttcttctctgacagactcttatttgactgtgattaattggcatcgaattgttatttaattacctccacagaaatct

SEQ ID NO: 14175 - DNA, 1055 bp, Homo sapiens
ggtgggtggatcaacttgaggccaggagttcgagaccagcctgaccaacatggtgaaaccctgtctctactaaaaatacaaaaattagccgggcttggcagtgcatgcctataattccagctactcgagaggctgaggcaggagaatcacttgaacccaggaggcggaagttgcagtgagccgagatcacgccactacactccagtcttggcgacacagtgagactctgtctcaaaaagtaaacaaataaaaaataaaattatattggaggatgtctgtatgttatatgcaaatggacttgagcatttgcagatattggtattggtgggaggtcctggaaccaatcccacacagatagagagggacaaccaactgtaccatctttcgtttatccattcatttgttattgatgtcttgggttgcttctgccctttgactattgtgcatagtgctgctgtgaacatgagtgtgcgcatatctcttttagacccccgtagtctcttctgttgtgtatatatgtagaggtggaattgctggatcatgcggtaattgtgtgtttcataatttggggacctgtcatattttttttttcattgcacctggaccatttttatgatcccccaactatatacaagaattctaattccttcacatccctgccaacacttggtattttctggttttatgatagtagccatgctcctgggtgtaaggtagtgacttcctttattttcttaaatcaatgaatcctacaaggcagctttgagttgttaattgtggggagtgccaggtcgcctgacatctttgggcaactctttttcttttctcttctttttttttgagacagtcttgctctgttgcccaggcaggagtgcagtggtgcgatctcggctcactgtagcctccgcctctggggttcaggcaattcttctgcctcagcctcccgaatagctgggattatagtcgtgcaccaccaagcccagctaattttttatatttttagtagagacggggtttcaccatgttggccaggctgctctcaaattcctgacgtc

SEQ ID NO: 14176 - DNA, 1061 bp, Homo sapiens
ttgagagttttgagttggtaagtcatgcccaagtttgatttttgtctttgttgtttctcccctcctaggttgcctatgtgcttcaagattggtggctttcatactggtaagttatttctggtctgatgtatgaaatactccaaaatcagtaagaagactcgcttttccatagagttagagggaggtgtttgttgatccttctcttctaatcctcacttcgtttacccgaagaaaaattagagtgcttgctggtggagtgtaaactgcggtggtctccacccatgtctgatccgcggcatcatgttcacagacagtttcgggaactgaaagttgtgatttaaattgaatttttataaggtagatatacacaagactaagtgagctgagaatcattttccagcatgaagcgtttctcccaaattgtggttcatttttaaaaaaatgtatttatctaaatttcatatatagcttaatatttttttctccccatgttccatagggcaaacaaacaaagtatgctaaatgtcactgtaaatggaggaggaaatgtaaccgagaagctagatcttaactggtacttaggaatttattcaggtaaagtttaatcatttggtgtattgtatgagaggctgaggtgcttacaatgagcctgtgtgagtaactagggcttccaggagtcattcagtaatgtcttaacagatcaggagtctcagtcgaatttactctgtgaattaattagaataattattttaaaaatctactagaagagaggttgactgaagactcttaatttgctctgtactggattttgaaagttaaaccaggattgagcattcagaaaatcagccactggaaatatgtggctattgtctattctaataggttgctttagctaaatcttatatcattatacggatgggcagggggattagaaacggatctccaccctgtggttcggatggttccaattctgtctaaataaaccctggcttttattgaacttggatgaaatcctctggcagcaaggcccccaaaataaaagcattattccctcccaggta

SEQ ID NO: 14177 - DNA, 1047 bp, Homo sapiens
ctttattggcttatatttgtatttagtttgtatttaacctctagatctttgactactgtgttgtctttgactacggtttcaaaatgtatgtttttcaatgtggagcaccccattcatgcattttttcaccctgtgccttttacatttataggtgtatttgtcaaattttgcatgagaagatcacaattttagtgactcatcagttgcagtacctcaaagctgcaagtcagattctgatattgaaagatgtaagtagtttctagaggtctcccgaacttgcaagtacttgggtgtgttgaatccccttcttcttcctccatttcatgttcctttcttctcagagctgggattcatgtttttaagtattaactcaaaagacttgtagaaatgtcattattacatgctaaaccatattaccgtaaagtatgtaaaattgctacctcaaggttactacattgttaaagaaaatgatgctgttttaatttagaactttttgtttacctcttccatgacttaattcaaattgtattatttggaaattacagactctaagacctgtttgtatccctttaattgtcatgcatagtttggctaaagatcctcttctattaatagcagaaatggctgggcacagtgactcaggcctgtaatcccagcactttgggaggccgaggcaggcagatcacctgacgtcaggagttcaagaccagcctgtctaacacggtgaaaccccgtctctactaaaaatacaaaaaattagcccagcatgatggtgcacacttgtagtcccagctactcaggaggctgaggcaggggaatcacttgaacccgggaggcggaggttgtagtgagccgagatcatgccgttgcactccagcctgggctacagagtgagactctgtctcaaaaaaataaaaattaaaaaataataataatagcagcaacacagttggataactgagcaacccctagtcacagcacccactttcctggaatagccagcagttagtgtcactgcacaggaatttttgagtgcctgatatgtgt

SEQ ID NO: 14178 - DNA, 1073 bp, Homo sapiens
gttccaacgaattggaaatggttcattgtcaaggttgtcagctggatcgagatgagccactgttggaagtgcattgagttctttgttttatgcttttgcttatggtgtattttctacttggaccttcccctctttgccatctggagaaatagtccttgtcctttgaggccccgttcaaatgctcctggtcctctgaagcttttttttttttttttgctctcctctttcccggtggagttaacaaacagccctttcttttctgctccccagcacttcattcccattttagcactctctgaccactgtgttatcgtcaggctcgggtgcctttctgcctttcctgcccacctgtgagctcctcgaggggacagatgacatctgactcattttcatgtcttcctcagcagatattacaaattctccaaaatacttgttgagttggtatagattgttgacttcctaatcgaagtctttttctatttgtattttgagtaggacctgtctgtgttgtcggaagcaaaagcgctgtagggaaccatgtgatgcaggtccctgcctgtgcctgccgctgataagggcaggctgtgatcgctcaggctcatctcccgtgtctggttccccttaggagtaaaactgcaactttcacggatgccaggatcaggaccatgaatgaagttataactggtataaggataataaaaatgtacgcctgggaaaagtcattttcaaatcttattaccaatttgagaaagtaagtttttgtatacattgtaccatatttttgtatttttctatttgctattcttgttgatggttttagaagttttactatgttttcacattatgggaagttcagtacaatccatcccagtccccacgcttggcagttgggttaagtagaatggtagagaacgttattttcacttggtcttccatttaccatgttcttaaacagaaagcatgtatgcttcttactaatacaaaagtgaaattccaaatgtttctgaatatcccaaatcccaacaatgagtctaagatgttagtatttgagaataatggtgtttaaaataaaa

SEQ ID NO: 14179 - DNA, 1022 bp, Homo sapiens
gccttcctgggtcctgtctggagcctccgtttacccttaaggtgaatatgtgtcaccttcctcaggctgcccctaggctcagcctaccatggtggcctgggggaaactcctgttgcctgtgcctccgtagaggtcaggggagccagcaccaaaggcccgagatgcctgaggtctgtccctctaggtggaagtgttgtggttggaggaggttgtctggcttatctgtgctactgatggggcttcaatccagtaaagcttggcagtaacttgtttccccagacttcccctcaaggcctgtttttctgatgctccagattctgtaccacacataaccttcaggagccctgggagcaattagtagcatttatgaaatcgtcacaaaatgccctgtcttaaatgcatacctgtcactctgccatctcccctgttttatattgtggcagggttcactcttatttacgaagctttttcctcattgtaggttctgggataaagaagttttaagagctgagaatgacgcacagaagccttctttaacaagagcaatcataaagtgttactggaaatcttatttagttttgggaatttttacgttaattgaggtaaaagcttttacataccatgaattgtttttcaggacacatagagtaaatgtgctcgccattgactggtgctgtaatggatgggggaacagaagggagaagtggccagatggggtttgaaggtattttaaggtctaaggattaaacatgtctaggaagtattaggtagttagttcagtgagcgtatttatccaggtgaatacttaagtgactgaagttcaaggtcattattgtttttcttgtaaccaattaaaatgcagtgtcatggaagaagagtattttattctatggtaggacaatgttggtgctcggtaaatgttttaaatgctaagagtcactcctggtcaaaagaggatcctacagccttgaggagtgcgtgccctgtggtttagaggaagtgattttggatcggagcccaga

SEQ ID NO: 14180 - DNA, 1027 bp, Homo sapiens
aagtaatccctcagattactgtcttgagagacggagagtgcatacagtccaacagtgtgtactcttcctctttaaagacagtagaaaggtatccatcttgttttaaatagtagcagggaggtttatcaatggcttaacatggtaggctgggcctggagagctctcaatgtaacagagctcaaatgtggcatttacatgaattctaagttgattaagcgacacaatttgttcaactataaaacataatacattcttaatagattttacctattattgtatatgtaagttcctagtacatattaggctgtaggtaaatgggatgatgagggttcttgctaaatttatcccccatccttttttttttgagtcagagtcttgctcttgagcaacctccaccttctgggttcaagcagttctcctgcctcagcctcccgagtagctggaattacaggcttgtgccatgacacctggctaatttttgtatttttagtagagatgggactttgccatgttggccaggctggtcttgaactcctgacctcaggtgatccgcccacctcagcctcccaaagtgctgggattacaggcatgagccactgcgtccagcctaaatttacccttttatcatgccttttttattgtcttaagtctttaagtcttatttaagtcttgactcatttgcgacttttttactaaattgttagctctattaaggcagaaaccagtatcttcaatgtcttaatctctcagtgactggtttaacatcttgcaattaatatgcttaattaatgtttataagctattactttagtcttaatctcaatttcttgaatttagagttgctgacacctgtgtcttaggtaggaccaagtgagaagctagttattgtgacagcctcagactggagccagaagacccatgatcttgtatatattagctgtgtgtgaccttaggcaagacacatgaccactctgggcttcagtatcctattctatgatttagaaaaattaaacctactcatggcatg

SEQ ID NO: 14181 - DNA, 1050 bp, Homo sapiens
ctgaccctagtagatattcctgtcttaggttctcttaggatactaaaaaccctagcccagttgttcatcacctgtgtgctactgatttagttgattactgttttaagcctgttttcttatctgtagtatgggatgttttaagtctcaatttccttatctgtaatatggaataatgctgcctttttcacgagatagttctacaaattaaatgggaatgtatgaagagggcttggctcagtgcttggcacttgtgggtactcaataaattgtaggtatattgttactaattatgagtaagactaattttatcatgaataatttaatcatcattgccttattctggagatattgatgacataaatatcttttcattgaggcactgtgtattagagacaataaacaatgattcacccttcaaaagcacttttcttatacgtaatctcataggaagagcattatttcttgggatgtggtgtgaatgaatcaacatgtacaagactgacacgttgtctggaatttaggtgcccaataaatattatttaaatgaacgaacactgctttgaacttctatttcaccttaaaatgggggtaataattcatgtgataatacaaatgagattgtgtatgtaaaagctctttgcaagaaggtgcagtataaagaagctgtaagtaatgacacaattttaaaacatggagtggttttactgaggaaatgtttttcttaggtgtgtgaaaaccaaaattattaagaatatatacacatttgggtttagaggagacaggccccggcttcagcccattttgataaacatgccccgtggctggcagagatctgggcgtgggaggatgctacagccgtgggtataacctctggcctcgccgccatcttggccatagccccaaaggcacttgtgcccactgagaattacctgagaaaggtgccaccactttaagaggcacatctcttaatattataaatcctaaagcgttacgaaaacagcgcccctatctcggtgttgatttgtgtaggacccctccttttagttcaga

SEQ ID NO: 14182 - DNA, 1401 bp, Homo sapiens
ggaagtgcactgtatcagtctccaagatgaaggtgagtgaaccatgcaccaactttgctggttgcatttcatcccatatctaatgcctgaccaccatcattaaaccttcacctaaaacctgaccttcaccatgaaggaaatttccttcagttggtaggatagggcttggttttatacctgctgctggcaggcttccttgtgtatgcatataacatttctctgggaatagtcacccaaagacctcatctcccctgagtgcggttgccattctggggtgagattgggaagagtccttcctcatctgcccagctgtggggctagggcattctccagccccagaactaggtcgtgaaatgcatccatgcaggtgtcgaagaatggctctcattcttgctgctgacctctcgcctgtcgttccccttttatattctgggtcttaccacttgaaaaccgtggggttagcacccagaacaagtgggaatcccaggaccttgggaatttttaatgtttttgtagttgaaatattttcattaattttctgtttagccacttgattgaaatactttataagtaatgaagatcttttgcagttgtgcccttgtgtcttaaaaggctaccgtgtactaggttgatgaatgagaaactttaacttaattatttaaaactataatttctgtagagtgtagttaatggaaagtacatagaaatcgaagatatgatgaaaaggtgaccatctatgactgattgcctcaacgttttttcctcagtaaattcttgctattcaggcatgactaaaataccatggaatgatatctttcaaaatcatttgaaaggaaactaatgtaactttgctgttgtcctgtttgtactgttcttatttttccttgttaatagaacaggcattctcgtcgcacatactggaaccaatagaagaactttcagaggaagaaaaaggtaacaaagggcttgatcaggtttacctgcacagattatatttatatgccaaaatctaggcctggaaaatatgagccagtggtttttattccactacatcaaaattaggaaagacatttagatttggattttactttcaacccacatagagtatcctgttatcctattcccctaatattctgttctgttttcccctgctttgtggtattcttatgcaagcagataaaataagaaattttttgtgtcagagaacttgaaaaaaaatttgtctttattttaatgcagatttttctgatgagatgatatatagacacacacgtgttgtgtaccagaagatctgaaaatatttgtatcatagtggtgatttatcatacccttaatctgaaatgaattggtgaagtgcttatttccaaattatttttaatagcaagaaaagcatcatgtcta

SEQ ID NO: 14183 - DNA, 2067 bp, Homo sapiens
taaagtgcttacagtttttatagtatgttctttaatgtgatgttttcctgtgctctgttggatattacaaatgaattaagacgggagaagggccatctttttccagtctcacatacagttgctctggaatccaaggattatttcactctttcatttttggtcttttaaaaagattacacttaaatccatgatctaactggtcagtatggtggcactttttgtcttcatagatattgtgatctgtataccatgaactttagtaataatcctttttactcatcactgactcttgaagtgtttattgcaccttatttttttcccgaagatcatttcaggtgggtcagttgtcttgagtatgtgatcacaatacgtaatgtgtaaattctccacatattgatcttcttatttacaagtgttcagagcatgcagttttttcctttagaccagtaacagataaaagcacactggacataaataaatttgctttaatattgaatatataagaaaagtatctagcaatcattctgtattcatattattttatgtcaggtctaaaatctctctgttgcgtccctttgtaaagcattgctggccatttctcttttgtacttcaacagtgtattttagtttcttttacttccccacccctccactttgttattgttagctttctgtatgacatcacacaaggttcctagtttctttgtcatatatttttgttgctaactaaaggacaccctggtaggtacattaaagctgtctggggttgattcaagggtccggacaaatcgatcatttctaaagcatgtgttcatggggaccctaccctcactagcccagagctgcatgaatcagtcatgcccccttcctggcatctgctgggattgaaatgctagttttaaatgccagccagacctggcacagggcctacagcccttggatggggatcaaagcttatttgtgagcatctcagtgggcaggagctaggaagagacttggccagggcccgccaacgtcccccaccccgtcaggccagcttccccagggcggcaggggcagggcaggttagtcatggattgcgtaatgtttattcgcctgttcactctctgtcctttgttccatctcgaagcttgatgaggttctttaccatgaaaaatctcacaatttcttaccattgtaggtcgggtcccctgggaaacagactgatgcggaagtttacaggtgggaggtgggggtgcccttggacagcacctgtgagagaagcagggttgggcgaagggaacgttgaacctagacgcagccacagtggaggcctcagccagccctgcttcagagctgcagagctgggatgagtgctctggcttgtcctccactgaggcaggggtgggccattgccccttgcactgatttgtcatctgatgggggctgccccaaagagagggtgagctaaagcagcctggaagggactccactgtgagctgctaggagccaacattgccagcacgtttgtcctgggaggatctaggtaaaatgggaaccctgatggctccctgctttcaactctgctacacaagctaaacggtacaggcagtaggttctgatcctaaggcagttgataggatgaaacacgggttctggagaagataaacaatcatgcttgattcccatccccagtatgcattttttttctggacaaacctcaaataaatttttgtagtattttcaccactggagaccactttgctctttgctcatggagtagtgactaaatggtggtattaggatgcccagaaaataaagtatactttgttgctgttaaactgacccatacaccaattgcttaggttgcctgggctgataatgtggcccacttttagagcgacgagtgcagtgaggatgcaaaataaccgcttttcccaaagtctgtgggcacctgctaggttctatctacatgtaaagccctcctttaatttggtctataaattgtgaggggcttatgtatgcatgactttaattgtatatagctacagtgaggaccacaaaaactggaaactctttttttttttt

SEQ ID NO: 14184 - DNA, 1040 bp, Homo sapiens
ttttccttctattttccagctcagcatttcccagactgctttggaggccacttttccaggggcctgtaaagatgtagtgaaagctcttgacaatgccctccttgggggaggttcttagtatccactaggaaaggaaagattctttttaggtttcactcggaaaatctttctagattggttccacccagtgtttgtccagcctcataggagcacagagcatttcagaggcaaggctgtgcaggatgctaagacactgcttttttttttttttttttttttgagacagggtcttactctgtcaccggggctacagtgcagtggcttgagcatagctcactgcagctccaacctcctggggtcaagcaaccctcccacctcagcctcccgaggaactaggactacaggctaaccccaccacacctagcttaatttttaaaactttttgtagagacagggtcttactgcattgcccacgctgaactccaactcctggactccagtgatcctccctcctcggcctcccgaaagagcactgactttgaaacttgcatgtgaaagtttaagtctgggctctgcccaccttcggctgtctcaattagagccagtgactttacctttctagacttgagttttcctatctgtacgatggggccaaaacatgtgtccataacattgtggtgtggattcaacaaaatgaagtgcatctagtacacaatgagtgttaattttctaaaagcaagcaaatgaggaaatgctggtctaggtgcccttatatactcatctcaggcacggacacttcctgctcctttatttgatcaggataccctgtcaccacttccaggacatagacttggaatgttcttcaccccaattatgaagccttttttttttttgagacggaatctcgctctgtcacccaggctggagtgcaaagacatgatcttggctcactgcagcctctgcctccggggttcaaaaattctcctgcctcagcctcctgagtagatgggattacaggcgcccgccaccacacctagctg

SEQ ID NO: 14185 - DNA, 1043 bp, Homo sapiens
ccaggagtttgagaccagcctgggcaacatggcaaaaccctgtctctacaaaaaaaatacaaaaattatctgggtgtggtggtgcacgcctgtagtcccagctacctaggaggctgaggtggaaggattgcttgaacccagggggttgaggctgcagtgagccatgatcatatcactgcactctagcctgggcaacagaatgagaccctgtctccaaaaaaaaaaaaaaaattagactcgtttaagattagaaagttagattttccttccccttttttcaccctgtacatattctgataggaagaccagcaagcagtagaaacaaaccagtaaaaccacagggaagcagaagcaggagaagcgtccaagagcgtccaggagcgtccaagagggcagtcagatttaaaacacagctatgtgctccctgattttattctctgtttccatcttatgaaagtctaactgtagtactgagcttgaattttatcttatagcaactgtcagaaatccagaagtccaatatgcagatcaagtccaacataggcacattaaaagatgcacacgagtttaaagaagaccgttctccatatccccaggatttccataatgtcatgcagcttcttgatagtcaggtacgtgcaagtgggtgacagctgcagtggatgccttcctttttcttagtgaagtaatttacagtgagtgtcatctgcagaaaaagtgtttgtcttttttagtaaccctgaaggtgactagctgttatttttctcctacagcatgcctaaatcataagaggtgtttgttacatgcttgctgttggcaaatagcatacacaacagttggcagaactgttttgtttcttctctccataaagtcaatttgaattggttagtataacctagctattcatttttcatctttcagatgtagctctcaatttcaaaaggtgtagaagggcatattgaagcaccagatttaattttagagtttaaatatactgctaactgtatttttagtagaaacggggtttcaccatattggccagg

SEQ ID NO: 14186 - DNA, 1053 bp, Homo sapiens
atattctttccgcctcagccttgcaagtagctgggactacaggtgtgagccactgtgccacacttaccctatcagattaggccccccgccttatgatcttatttaaccttaattatctcattaaaggcctcatctccaaacacagtcacagttggagtcagggcttctctcccagtttggagagttacactatccaggttggtaacattcacattctcttactcagccataatgtcttacttgtttttttcattggttttatatttatgtgctcattcaaaatcctttcacctcaacatctccattcttgagtttctcattttgaattatctcttaattcataggattgtcaaaatgatttgtcttacccagaaggcccaagagtgctgcatttcttcaactctatcaagtttgaaagacatattggatgaagaatattcttagtcacactttccctctgaactttttgatgtggttcctttgtcttctggcagtaaatgttgctgtgagaagtttgagggtggcctaaagtttttttcttgtgagtgacttgctttttctgcctgcatgactgaagagtcccttctttctgcttgaagcctagtagctttctagggtatgtcttggtgttgagtgttctgtatcagttttccctggaacctggtgaattcttaatctgcagattcagctttcactgcacttcagagaaacactcttgtattcagtctttaaattttgtttcatttttggcttctctacttctgggaaaccagttacctttatgcagtattgattttgtccattagttctccgtactctttggtttctttctcattgctttaattctttccttctaatctacattcactgtgataaattatgtcagcctttcctttagtgagcaattcagttttcaacagtgtctcttttattccttgctttctcttttctttttttctatttttttttttttttttgagtcaaggtcttgttttgtcaccctggccccgagtgcagtggcgcaatcttgtctcactgcaacctccacctccc

SEQ ID NO: 14187 - DNA, 1030 bp, Homo sapiens
gaacccggccttctcccgctcctgagggctgtggcggcggcggcccgggaggcggcccaggctgggtaaagaccgcccggctcctcctatgcaagctgaggcagcggattggttttcaagcatggtaagaggcgggaggccggggcgcccccgacggggatgccgggctggggagaaccggggcttccccggacccccagctccccagcctgcccgccccccatccccgcctcccgccgcgctctctttgtgccccccgcagcccttccagaagcatgtctactacccgctcgccagcggcccagaggggcccgacgtcgctgtggccgccgccgccgcgggtgcggcctccatggcctgtgcgccccccagcgcggcttcggggcccctgcccttcttccagttcaggccgcggctggagagtgtggactggcggcggctgagcgccatcgacgtggacaaggtggcgggggctgtggacgtgctgacgctgcaggagaacatcatgaacatcaccttctgcaagctggaagacgagaagtgcccacactgccagtcgggggtggacccggtgctgctgaagctcatccgtctggcgcagttcaccatcgagtacttgctgcactcacaagagttcctcacctcgcagctgcacaccctggaggagcggctgcgcctgagccactgcgacggcgagcagagcaagaagctgctcaccaagcaggcgggggagatcaagacgctcaaggaagagtgcaaacgccggaagaagatgatctccacccagcagctgatgatcgaggccaaagccaactattaccaggtgggcagctgtgtgtgagcacgattcataatccagtaaacaactcagttcccatttgataggcctgtcccgtatcaccactctttcttcttaaagatttatattgtatatcagaagacacagtatatttaagcaaaaacagtcatttaaccaacaaatgtcatggttcattaccttctgcagacaatcaggggattaataattaaa

SEQ ID NO: 14188 - DNA, 1031 bp, Homo sapiens
tgttatatttttggtgtcatatgtaagaagtcattgccatgtcagtgtcatgaagatttttccctatgtgttcctcaggagttttataatttcaggtcttatatttaggtttttaatccatttttagttaattttcatatgtcatgtaagataggagttcagctttattcttttgtgtgtagatatccagtttgcccaactccatttatgaaagagactgttattttcccactgagtattcttggcatccttatcaaagatgaattgatcatatacacaagagtttatttctgggctctctattccattgggctatttgtctttatgccgggaccatactgttttcattactgaagctttgtaatatgttataaaatcaggaaatgtgaatctgccaacttcattctttttcacaatattttcggcatcccttgtgattctgtatgaatttcagaatgagttttcctgtttctataaaaagcatcattggggtttttatagggattttgttgaatctgaatctgtagattgctttgggtagtatagacatcttaatattaaatttccagctcatgaatgtggaatgtctttccatttatttgtgtcttctttcatttctctcagcaattttttgttattttcagtatacacatgtatcacctcctagattaggtttattcctaattattttgatccttttgatgctactgtaaatagaattgtcttcttagtcctatagatcttttgtacttatattttctcttgtttatcttttcctttcatttgtgttctgaaaaaattctttgacattatcttcaatctttctattcatttattttagaggggtaatcacttcttaatttctaacagatctttcttttccctgcttgcttctttttaatttcattttgttcttgttttatggtttcgtggattttttctaatatcccctgaaataccagttagaactgttttgaatattgctttagttcttttcagttcctttttgtttaagctgtcttatgtattca

SEQ ID NO: 14189 - DNA, 1002 bp, Homo sapiens
atgtattttttcattgtggttaaaaaaatcacgtaacaagatttactgttttaaccatttttaagttcagtaatgttaagtatattcacattgttttgaaatagaactccagaactttttcatgttgcaaatctgaaactctatactcattaacagttccccttccccctctctccctgcccctggcaaacatcattctactctgtgaatttgactactctagatactttatataagtgggataatatagtatttatttttttgtgactggctgatttcactcagcataatattgtcaagatttattcatgttgtaacatgtgacagaatttccttcccttttaaaagactggataaaatcccattgtatatatatattgccacattttgtttacccattcatccatcgatggacatttggtttgctttcaccttttggctactgtgagtaatgcagctatggacatgtgtgtgtatatctctttgagaccccgctttccattattttggatatgtatgtccagaaataggattgccaaatcatatgaatatttaaggaacctctatttttcatagcagttgcattattttacactcccatcaacagtgcaaaagagttccagtttctccatatcctcaccaacacttcttattttctgggttttttttttttatagcagtcatactaatgggtctgaggtaataatttcattgtggttttgttatgcatttctctaatgattagtgatattgagcatattttcttatgtttgctgactatttgtatatcatctttgaagaaatgtatattcaagttctttgtccattttttaatcaggttatttgattttttgtttttgagttgcagggtttctttatatattgtaaatattaatggcttatcagatacatgatttgcagatattttctcttatttgctaggttacctttccattctgttgatggtgtcatttgatacacaaaggtttttaggtttaatat

SEQ ID NO: 14190 - DNA, 1026 bp, Homo sapiens
tttgcgtaacaccaaaacaccagtgaaattctggttgctaaaaaattatctctcaccgacatttaaagtaagtacatagctttttttgtagaatggttaatgtttgaatagtaaattatttgtatcattgtaagtttatatgatatttctcttttcagaataagctttttgaaaaaatggtatttagtatttttatgtagcttaagaaaaattctgtacaatttttatttagagatgttcaaaggagaggacagaagactgtatatttttaagtaaaatcaaaatcagaatggctagtagtttttcatgataatgagtaattaaatacaatttggcaatggaaaatatatacagattttcaattaaaagaaatggattctgtcatttttgcaaagataggcagaaacagtagtagtatcaagaaaatacaaagactatacctataccgtagaaaatagttttacagtactgaaacaaaaaagctctttcgtctgtgtagtgtattgattgctgggcaccatgatctgaggcattttatatttagaagatttcaggtgatcaacagctattaccctttactcagccctatactcctgctacaaagtatactctgtttcttcctattctccctacagcataatcaaattccgtgaaatttagtgtctccgcagcaatttggtgtctcattcaacagcatttcaaatgagtttgttttttctagaccaaaagcagtgggaaaacagaagtaaaactagccaagcatgcttttattccttaatatttctaggcatgatgccaagtgtttaactgacgttattcaattgtttttcataacaatcccacatgataagaaaaccaagattcaaaagttacgtaactagcttgcacagttgagaggtacctgagaccacttttagattcaataacttactataaggatttatataactccaaaaaacagctgtgctcacagttacagtttttatagcaaaaggacacaaataaaatcagcaaaaggaagagatg

SEQ ID NO: 14191 - DNA, 1020 bp, Homo sapiens
ctcaaagaaaagaaagtagcctagctagctgcaacttgaaaataaaagggactgtttatgttagattgatacctatactgttttattgttagtttaaaaaggaacacaggccaggcatggtggctcacacctgtaatcctagcactttgagaggtgatggcaggaggattgcttgagcccaggagttcaaaactagcctgggcaacatagtgagaccctgtatctacaaaaaatttaaaaattagcctgttgtgatggcatgtatctgtagttccagttactcagaagactgaggtgggaggattgcttgagtctgggaggtcaaagctgcagtaagtcaagattgcaacgctgcactccagcctgggtgacagagtgagaccctgtctcgaaaaagaaacatacataaggaatatattgtctcagatatctaaagaatccaggagtacacctggtgttggccactgggtgatgtggtgtggaaacaatctttctccatctcttaggtctactgttttctgtgtctcctccattttaagatagacttttgtaagtaaaagtttactgtttccagtggaaggaagttgcctctttccaaacagtaccaataaaagttccaaggctgactcatgggtccaactatagctgtgtgtcccaaactgaactgatttctgtgactctgataacccagcatgagtcatatacctacttctagaactggtgggaagccctgtcccacctaaacctcatagaatgagatgggaggaggaatgattccccccaaaataccaggttgttactagaaggggaacagatgttaggtgagcaaaaacaaaagctgtctcctgtagatgcacattgtaaagaactttgaatgtccattttagagatttgaacccaatgtgagctatgatggaaaaccattaatcattttgatcaaagataagaaatagaaatgttagcccaaatagattcaacaacttaaatatatttggttatagtagtcaaaagcacttctat

SEQ ID NO: 14192 - DNA, 1053 bp, Homo sapiens
tgaaaatggcccatataagattataatagctactaagaaggaaaagtgggtcactgcaatagaatgacaacactaacatcagaatttcattttcaaaatacttagatgttaaaagacagcaaaacaaagctttcagtattttgaggaaaattattttgaacccaagattctgtatctagccaaattcttaatcaaatgtgaaggtaaaatgttagtttctgaagtgtgaagatttagaaaaattatttttcataccctttcttggagatgtttgccagtacaatgaagatcaagatcaagaaagaagataggtagttcaagaaatggtgaaactaatctgtaaaccaatgtaaagaaaatctagaaagaaacagttaattgttgaactttaagaaaaatgtcttcaggtagacaagaatcctagacaattagataacatgagtaataaactggaaaagattatgtctgtgataaagaagacatatttgtatatctccccacaagaaaaaagaaggacaatggaattccaggaaaaaatagttctctgctggtggaatgtaagaaaggagaattcatctaacccagcaagagtctcctaggagtggcacagtggccataggaggaaactataactatgctgtactatgctaaaactataactgtacagaggaaatagagttttagtagcttttccgactcttcagtggttaatctttacattgtcataatgaaaactttttactgattttcaagttttagaatcaccatagcaaaatgcaacaattatgtctactgaactaaatgtaaatgttatcaatatttacaaatgctaaagtcaaggtttaatataagttgggaggtagaaggaaatcatagaaatagtagtgtccttataaacagattatacaagagaaactgttgggattgtgggaataaaaaaataagagatttaaatattatttaaagtgacaaaaaatactcaatagaagaaccgaagataaacacattactaccaaaatttccagacaaatagggaaagggaagggataacga

SEQ ID NO: 14193 - DNA, 1029 bp, Homo sapiens
ctgtttgttctggatccttgctatatcacatattctctcttgtggatctttaatctctatactagcttttttcattcagtccttaaagttattcaatttttttaaaagttgctcccttaactttctctcctctagagtcttttttttccctcttcttcattccttcttaactaaatttcttcaaagaatggtcagactctgtcttcatatctcattcactgtaccttccactgcagtttctctttaactttctctttgccactgaaattgtatttaccaaatcacaaagaaattgctactcactacattcagagaatactttttctttgatatttccactgcagcaagaatttgttttgaacatttacttcatgactgtattctctcctgtttctcctctttttattttctttgtctatctgcataacatggctcccagtgatcaccactgcctgggactcacactctgaaagttctcctggagtgagagctagacctagtgatttggctctcataaaacaaaatatggctaaagtgatggaatttcccttctgcaattaggttatgaaagactgtgacttttgtcttgctgacattctctctctgtggctcttctgtgtgcttctcttttgaagcatattggagatgcctttttgggaagtaactgcaagcagtctgcagacaactaccagcaaggaactgcggtcctcattcagacagcccttggggaactagaagaacctggaagtagatcctacccttgttgagccttgagagaactacagcacagctgacaccttgactgcagtctcaaaatagtaaaagccactagccttgatagcataacataataattctgtgcacaatattgaaggatgaggttaaaatacagcaaaactgaagttaagtctaaaagtgctattaagcagttgctttcaacttaatcctatttgtttttagttgagcttttaaaagtggtactagaatttcagcttgaatttcatttgtttcctaccatttctcttcata

SEQ ID NO: 14194 - DNA, 1044 bp, Homo sapiens
gtatgttaaatggcattagatactattttcagttttgaagtatcaagtagtataaattgccatgtagtatttattaataaaatatttacaaggctgtaggaagaaaatctcttactctccaaccaccctaataaaacttaatagcttattgtttttcctttcagcccttttttctaccatacatagatagccatttttggttttttagaatacatccttataatcctactatatataattttacatcatgatttttctgttaatataaatgtttttctgattgcagtctttgtagacacatacaaaataagtggatgatatctatatactaatatttttaatatgatagtcttatttcatacaaattgtttaagtaaaaaactgaatctggtgcttaggtttattaagaaatcaacaaatgcagtgtttttcacgtatctgtggcttgaattttcaaattatatatccctcaatcatcttcaaagttctaatgcactcttaatgttttgtttttcacttacttttgaattctgttcacctgcatattagattcaggttcatctatgtacagtgctattttacacatgtcaaaagctgccatttattgtaaaaagtattggtgaattttggtagtgagatatgtagagctctgtaaatggcattgctttttcactttaaaagttactttgggaggaaatacagcttttaaaaacagttctaaagcttttggctgtctttgaccatgtcaagcattttaagggataaagagggaaacaatggcacctgttttatctagtgccttaccttttagttatatactagggaaaagctatcctatgtcttgtcattttgatataattcatatagtgttattgacattaatgataacaaatactagatacagttatgttcaacttatttctcataaacataaaactatgttttgtcctgactttccttaaaattgataaaaatattaagatattaatcttacacctactgtgaaccaaacattcttctagattctgaaggcacagcagtaaa

SEQ ID NO: 14195 - DNA, 1013 bp, Homo sapiens
ttgtcgtttgtttttttcttgtaaatttaagttccttgtagactctggatattagaccttggtcagatggatagattggagaaattttttcccatttcatagattatgtgttctctctgatgatagtttcttttgctgtgcagaagctctttagtttaattattaatatatcccatttgccaatttttgcttttattgcaattgcttttggcatttttgtcatgaaatccttgcccatgtctacatcctgaatagtattgcctagattttcttctagagttttaatagtttcgggttttacatttaagtttttagtttatcttaagttaatatttgtataaggaaggggtccagtttcagttttctgcatatggctagccagcacttccagcactatttattaaatagggaaccctttccccattgctggcttttgtcaggtttgtcgaagatcagatggttgtaggtgtgtgatcttatttctgagttctctgttctgttccattggtctatgtgtctcttcttgtaccagtacaatgccatcttggttactgtagccttgtatattttgaagttgggtagcatgatacctccagctttgttcttttttcttaggattggcttgactattcgggctcttttttggttccatatgaattttaaaatcactttttctaaatatgtgaagaatgtcaatgttagtttaatgggaatagctttgaatctataaattacttagggcagtatggccattttcatgatgttcgttcttcctgtccatgagcatggaatgtttttccatttgtttgtgtcctctccgatttcctttgagcagtggtttgtaattctccttgaagagattctatacttcccttgttagctatattcctaggtattttattcattttgtagcaattgtgaatgggatggctctctgcctacttgttgttggtgtataggaatgctagagatttttgcacattgattttgtatcctgagactttgctaaagtt

SEQ ID NO: 14196 - DNA, 1521 bp, Homo sapiens
aaatggcctaagtgcctcacttaaaaggcacagagtggcaattggataaaaaacaagacccatctgtctgctgtctacaggagacgggctcaaagtaaagggtttgagaattatcatgcaaacaaaacaaaacaaaaccaggagttgctattcttagataaaacaaacttgaaaccaacaatagataattataaagtgttcaacaagaagacttaagtgtcccaaatatatatgcaccaacactggagcacccagattcgtaaaacaaatacttccacacctatgaaaaatcttaaggcagctgcgcaataatagtgggagacttcaactcacccactgttattgaactaacccagtcagacaaaaataaaaaagaatttaggccagaaatggtggttcatgcctgtaatcccaccactttggaaggtcaatccaagaggatcgcttgagctgaggagtttgagaccagcctgggcaacacagtgaaacctctccacaaaaaacttaaaacttagccaggcgtcatggtgggtgcctgtagtcccagctactcaaaaggctgaggaaggaggaagacagcagacagatgagtcttgttttttatccaacttgccactctgtgctttttaagtgaggcgtgtaggccatttatattcaaggttaatattggtacatgaggttttgagcctgtcatgaagttcttagctggctccttgccatttctatcgtgtgttagacactgacagtgttagacagattatcgaggcagaaaactaacaaattctggacttaaatggacactgatcagttagacctaatagacatctacagaacattccacccatcagccacagaatatttattcttttcagctgcacacagagcatactccaagatcaagcacatgcttggccataaagtaagtctcaataaattttttaaagtcagaatcataccagtcatactcatggaccacagtagaataaaaatagaaatcagaactcagaacatctctcaaaactacataattacatggaaattaaataacttgcttttgaaatcacttttgggtaaactgaaattaaggcagcaataataaaaattcaaataaatgaaaacaaacaacatacgaagatctctggcatgcagcaaaagcagttttcagagttatagtgctaaccacctatctcaaaaatttagaactatcaccaggcgcggtggctcacgcctgtaatcccagcactttgggaggccgaggtgggcagatcacgaggtcaggagatcgagaccatcctggctaacacagtgaaaccccatctctactaaaagtacaaaaaaaaattagctgggcctggtggctggtgcctgtagtcccagctactctgggggctgaggcaggagaatggcatgaacccgggaggcggagcttgcagtgagccgagatacagccactgcactccagcctaggtgacagagcaagacttcgtctcaaaacaaaaaacaaaaacaaaaaaatttaga

SEQ ID NO: 14197 - DNA, 1042 bp, Homo sapiens
aaaagaatccattgattgtgagatttgacacaggaggttagtaaagtaactggatatgagatcagtatactaatatcagttgcttttctctcttctaacaacaaatatttattaattattttcatcagttttattaaatgcctactacataccacaccctgttttaggtgcttggataaattaataacatatatagccaacaatccttatcctcatgagagtactttctgtaatgactcctacatttacaatgacaagagcaagcaaataaaagatacttaggaaacctgggggctggggggaaggtcagttttgtggagaaaatttggaattatagccatgaaagtttacctaaatgaatgaaaagctctaccatgtttatcaatagaaatatttcacttcataattatattgttttctgcaagtgatttctaaattcattgcatttccgaccaaagtggaattttggggatttttgtgaaatgtgatgttttattttaaaatttatatggaagaatgaagactcaaaatgggtgagactttgaaggataaagtgatgggacttgtcataccaggtaataagatgtataaagtttgtggtattggttcagggaaagacatatctatcaaaagaacgtgggggtcccaaaacttaagaatacagaagtgacattacagtaaatgggagtggacttacaacaactgtggttcaacagtggctataccaatgcaagtaaataagactttacaccttgtgtaaaaatcatttgagttagcttaaaaatgtaagtgtggaaaacaaaactttaaaacatttagaagttaggacctcaaggtaagggtttcctagataaaacttaaaaagctctaagtctgcaggaaaatactgataatttcagctaaattacaaatgaaaaccagtgcccattaaaatatgtcattaaaaaatagggaaaaatgttataagcaggagaagtatttacaatacatatggccaataaaatatttatattccatgagatgtaaacattttctacaattc

SEQ ID NO: 14198 - DNA, 1027 bp, Homo sapiens
caaaatatcacaagatctccataaatgtgtacaactattatgtacccgtgaaaattaaaaataaaatttttaagaaaaatttaaatttcagagtgtgtatcatttcaccttaggaacacccaaacatgtttataaaccattttaacattgtaaatctcaaccagtcttctgagatccaatcaattggaatttctttagcttcaggtaatagctcagctccattggttattaaagagacatattagaataaatgggttccctcttctttaaggaaaaatgagcttatatttcttcattaggatttgcatttatttctgctcaagcctaagagggctgctagtttcattgcactttaaatacaaaaatctaagttttttggactataaatatagtatgaaatccagctccaaacccatatgaaaataagctagaggccatgaattcatttgggagacttactcttcctccaccaagaaccaaggtgaggtagacaaatttctatgctgttactgcagagcattttgttttctaattcaccttttcaccataagtgtagcactttatgtgtgcataaggatatctggatgtgggtcctggatttaaatttcttgttcttctgagattggcccttaaaaacccaaatcctaggtcatctaggaagctctaaatttcctccaggcaaggtctttagtgtttatttacatctctatattcatattcctacttcctctctgtccttaggtgaatactttcttcaactcagagccgcatttaggggacatttttcatatttatttttttgagacagagtatcgctctatcatccaggatggagtgcagtggtgcgatctcagctcactgcaacctccacctcctgggatgaagcgattctcttgcctcagcctcccgagtactgggactacaggcatgcaccaccacacccagctaatttttctatttttgatagaaacagggtttcaccatgttggacaggctggtctcatactcctgacctcaagtgatccac

SEQ ID NO: 14199 - DNA, 1047 bp, Homo sapiens
tcatcccttagcatatgctgttccttttgcctaccgctgtcttcacttctttcatttcttctaaagacttcacatctttttcttttttttcctgagatggaatcattgctctgtcacccaggctggagtgcagtggtgtgatctcagctcactgcaacctctgcctcccggattgaagcaattctcttgcttcagcctcctgagtagctgggattacacgcgcctgccaccatacctggctaatttttgtatttttagtagagacgaggtttcaccatgttggccaggctggtattgaactgaccttgtgattcacccacctcagcctcccaaagtgttgggattacaggcgtgagccaccacacctggccagactaataaatatatcagtctgtgcctctgagatggctgcctatcttgctgctctgttagagaatgctcttctcttttctatatcccatatctttctgtgccttcttttagaaaagttcatggtctgtattttttgtgtctctgttgttcttggtgtctatcctgtcatagacacctcatagtaagcagtcaataaatgtttgcccaatgaatgaatgaacaaacaagaggaaaaggatgactagatcaaagtacccagggttgcttttacttatagtcctagagattcagagtctcagaaaagtaagaaagagtaagcgtaattgctgagctctgataaactctgatagagagccaccccacacactataagaggtcacagtctttatgatcctaaagcacccttcacatattacaccaaccagactgtatagtataattatttggtatgtaagggagaagggaaatgactataaaatattatatctttattctttgagaccatgagttttggtgtctttctaaatgttccttgattatctttaaaggtgttggaaatatgtaggaactcatatttaaacttagggtttggacctcctgcctcacttaaaagctaaacccagcatttgttacaggccttttggcttatttctgattatgaaatagaacttgact

SEQ ID NO: 14200 - DNA, 1081 bp, Homo sapiens
agaaaaacaaagatttttttttttaacctgttgatttggtagtttggtttgcaaatccaaacttactaaaactacaaaattacaattcaaattttatatcaacacacttccaaatgaggaaagtaaatatgaatttaggaacatttttattactgaggagctaataactttccagaactgataatggaaattggctatgtgaaattgcatttcttttatgaactataacaagatatacggccttatagtttcgattcacttagccaccaactgattggtcttttgactagatattcaaaatgtagttttaaattgagctgttatgaaattgaaaactctaaaaaattttcatctttgtcagattactgtaattagaaataacccagtttctacatgctatctttcatataatgtgggcctgagaaattagcaaattaaattttagtgtgggcagcaatgttaagtatttgtctgaatagctgaagctaacttttacatattcttacctggaaatagaacaggccaaagaacagtcactctggccatatacatatcaataaggcttggtagaaagtttagggaggaaagaagagaatacaaagaataacacactactaaagttctccttccctccaatctctaccttttcctctatcatgcaaaactgtccctgtgcaaacctgaattaagcaaagacacatggcttcttccagggagtttgctgagctctaggttaaagttgttttctaaccccttgagatgtgccaaatgataatggttgcagtacagccaacaagaatttcagtctggaagctggaacaactttaaaactattatgtgtgttcatccaggtttcttccttttgaataaaatatggtgacttctcttgtttgatgaggtaatctctaggagtacatttaatatttgccctttgtagaaagaataaaataaaggtactaaaattctgatcataaacatttcagaccactctgttttagtgaactgtagccccttattgcaagaacagatgttaatttgtggcatttggtatattttaatcattgagaaacaaagaaaactt

SEQ ID NO: 14201 - DNA, 1039 bp, Homo sapiens
aagtcacaaggccagccagattcaaaagaatggaaaaatagactcaatttcctggtgagaagtagcaaggtcacattgcaaaggagtctggacatgggaaggagttactcatttgtggcctttataataatcttccacaaatgcctgtaatttgggcactgtgcttagtactggtgatagaagataagtagcttatttcagtatcttaattttgttttatatatttgataattttatgatgcaggttcactgtgcactggtatcaatcccaggggaggactgtaaacaccttgccaatactgtgtaccagtatcaatccactggcatgagtctggtgagacagaacacacaataagtttagggaagcaactttattactcacagacaggcagcaagggacaatagacacctaaggattcatggcaagctcatcccccaaagcttaggatagctgtccaggatggatggagtctcacgtgcacgtcattcatgttgcaccgcagctaaggaactctgaaagcctgctctgccctgggttttatacctaggagcaacttgatgagctgtgctaaagcattgcaagacatcctgttctaggagctatgggaacagagcttggctttactggcaattccttcatatttcttgcatttccagcacatcattctacagttattctgagatttacaagtgagaaagcgaggaagagctgggttgccaagatcttttggggacttgccctacaataacatcatataaaatgtgttttttccctcagtgttcttcacattctcaattttaattgttcattgtataattttgagttagttattgctatttagtaaaagtggaaaatcttaaatattcttgagtgtgttggcatatagatatttgcataatctacataaagattatctgtaaagtgagatgtaaagagaaagtgtgggtgtgtgtacagtttgtaaatgattacatatttaagtcattaatttcataaatatttggatgcctctgtgccaggcattggttcatgtagcag

SEQ ID NO: 14202 - DNA, 1032 bp, Homo sapiens
cagtctcattctctaccccaacaccaattggagtgttcttttaaataataaagtgctgtcactcctagagatctttcttcgttagatctggcacattggttgggaatatatagcatatgattctgaggccctctgatatctgtccactgaagaaagagaaagatgagacattctagttctgagagaggaggtcataactaggtggctgtttaataaggatacaatgcttataaaattatttttccttgttttgaaacatacaataaattatttttttggttttattacatttttttctgttctttttttcatttattattattatactttggggggaggggggagggatagcattgggagatatacctaatgctagatgacgagttagtgggtgcagcgcaccagcatggcacatgtatacactaacctgcacatatgtaactaacctgcacattgtgcacatgtaccctaaaacaataaattattaaccatagtcactcgattgtgctgctgaacactagatgttattcttcctaactgtatttttatacccattaaccatcccctcttaatccccacatccccactagtttttccatcttctggtaactaccatcattctagtctctgtctccctgacttcaaaaattggaatgttcctaacacaaagaaataataaaatgtttgaggtgatagatatcccaaataccctgatttgatcattacattttgtatgtttgtatcaaattataacatataccccataaatatgtgcaacttttctgtatccataataattaaaaataaaaaattttaaaaacaaatatgttttttttttttttcctagagttgcttagataccatagctttgctgcttacctggggatagctttgctgcttacatggggaatccaaaatttaagtttcttagtgctgattgaagctatcttataacttctgaaagcagtaatatatgattgtagaggatgaaaatctcttaagttactactatttatgaggaaactaggtatt

SEQ ID NO: 14203 - DNA, 1098 bp, Homo sapiens
aatatgaattcttccatgaacatggaatatctttccattttttggtgttctcttcgattcctttcatcagtgttgtagttttctttgtattaatgtaggtctttcacttttttggttaaattaattcctaggtattttatattatttgtaactgttgtaacattttcagaatgttgtttgctatttgtgtatataaatagtactgaattttgtatattgattttatatcttgcaactttactgaattcatttattggttcaaacagttttttggtggagtctttaggtttttctaatataagatcatattgtttgcaaaccagggtaattttacttcttcctttccaatttggatgtcctttatttatttctcttgccttattactctggctaaggcttctagtattatgttgaataaaaatagtgaaagggggcattcttgtcttgttccagatctttgagggatggctttcaattattccctgtttccatatgatattagctgtggatctgtcatatatggccttaattattttgaggtatgttccctctatacctagtttgttgggggggagggacttgtcagaaagagatgttgaattttgtcaaatgccttttcagcacatatttaaattatcatatggtttttgtgttcttggttcttttaatatggtgtattacatttatcgatttgtgtatattgaactatcctgtatccctgggatgaatctcacttgatcatggtgcatgatctttttaagttgttgctgaattcattttgctaatatgttgttgaggatttttacatctgtgtttattagtgatattggcatatagttttctttttttgttgtgtccttgtcttgttttggtattgaggtaatgctggcctcctagaatgaatttggaggtgttctctcctcttcaagttacagagcagagttagaatttccaagactggggatggcagtcctgcctttcctctttgtctttgtcctgaggcatatttctccctttagacactcatgatgtttcccatgtgtggtactatcccacagctcctgagtgttctgctcagtttcttgctgttgtttgctt

SEQ ID NO: 14204 - DNA, 1048 bp, Homo sapiens
ccttcctagattttctttagttttcattttctttcagtttttccagattaggtttttatctttttttaaagaaatgactgataaattttttctgcttttttattctaataggttttgcatttatgtattttcttctgtctgtggttgagctaaacacttggttttttgtgttttttttgttttttttttcaattataacatatttaggtcatcaatgttgcctttctttactatgtgatattctcattgtcccaatttcgtaaaattcttcttaacagtagttttatttacatgttggaaagtagagtgaccactgggagaaagttatactcatttaggatggtaatgattgctgtcactttcccccagatatataactcatattttattttgttttatttatttatttttttgagacaaggtctcactctagtgcccaggctagagtgcagtggtgcagtcttggcttactgcaacttctgcttcccaggctcaagttgtacttctgcctcagcctcctgagtagatgggactacaggtacaaaccaccatgctcagctaatttttgtattttttgtagagacggggtcttgctatgttgcccaggctggactcgaattcctgagctcaagcaatctgcctgcctcagcctcccagagtgctgggattacagacatgagctaccactcctgatcttcattcacattttcgtattatgtctataaagttttggggcagttccagaccatagatttttgaaccagggaataggaaatagggagagatgaagaatcagtttactattctttttttactagcatgttcttgttctaagtggtagttgactgtcagttatgattctaagttgaacagcataggttttatagttagtagactttactcccaatttatgtatgatacaaagttatttttagtttgcaacttcattaagaatttttgtatctgagtctttgtaaatatttttggagatactgtaaaatttagtgtcagggactgctctccaaatgccacttcaaatcaatatgac

SEQ ID NO: 14205 - DNA, 1035 bp, Homo sapiens
aattatgaggacaaataattgaaatgaagtatcataaaattttaatagaattttttcaataactatgaagcatgtctttcctaggataaagttgattttattaaaatatttcttagattctacctacgtatagatgtttttttactttaattagagcaataacttaatagtagttgatgagttattttaatcaaagtaatgtgtgagggttttaaaatcatattgtaattatcaactgctgtagctaaatataatctttgaaatcttagattgcagctgatgagccaccaccagatggttgtaatgcatttgtggttattcataagaagcacacctgtaaaattaatgagattaaaaagctgctgaagaaagctgcttcaaggtaaattaataatagcctataatgaaagaagtggttatagagaggagagttcaatagcagaaacttcttataataaaaaaaatttaatattctaagacattgtatattcaagaatgtgatttgtattgaaaaccgtaatatatctgagaatgttttgtcttgattagcttttgattttagcatataaattgtgccaaaataacataaaatgtatgaaatgtttcatataagcataacttgttttttgaaataaacatgcaaaactgagtttatttggcctatagctctttaaatataaactgaatatatacctggggaataacaaagtaatcaaaacaatagatgaggttgcttcctatattcaaaactatttttttgcttttttgcaagtatttaatttaaaaaatggcaaatcagaagtaaattattaatttattagtgattttttagagtaatactaccagtatattttttttgcctgattatttatactttaaaaaataataaagtagtttttttaattttgaaagagctctattaaacagtaatatatatttatgcatattaatacttaactcacttgttaacaaaccatttctaacattttcttatacttgtattgaatttcatatacaaaagacttttatttttat

SEQ ID NO: 14206 - DNA, 1031 bp, Homo sapiens
atcctggctaacaaggtgaaaccccgtctctactaaaaatacaaaaaattagccgggcgcggtggagggcgcctgtagtcccagctactcgggaggctgaggcaggagaatggcgtgaacctgggaagcggagcttgcagtgagccgagattgcgccactgcagtccgcagtccgacctgggcgacagagcgagactccgtctcaaaaaaaaaaaaaaaaaaaaaaagaagagtgaaagaggcaatgcttattctcatatgtcaactgtttaaagcaactggattaggaaaatattgtttagaatgaagaaacttatttataatatttattaaatattaaagaaatttattgaatgtctattttgtatgccaggagtagaaatgtacagttgaaaaactatgatagaaaagatcctttccttcatggtttatagcttaataagaggcaccaaattaaacaattataccaatactttttaatgacttctttgtgaattgatgtagagatggtatagagctcacaatcagactttatgctgcaatttctccaattatttcttggttatataaagtttgctctctggttggtgcctcatgaataactcttggaaaaatagcccttgagttcttcacatacttaattgttcatgtgtgaattcgaaacttctgatttttaactttagagccccagagttgttttttgtttgtttgtttgttttttaaactagagaatgttgcaatgctgatcattctgtgtcttttttgttttaggtatgtaagttcattatttttaattctggaaagttttcttggattatagttttctttaattattctgttccattcccttgattttctgccttagggtctacaagtatacatatattaatctcctttgcctgacctctgtgtttgtcatttactctcaagtcatttttcccttctctcctttttatttgtttcatttttatcacttttcctctgcatattctgtttctcctactgttttccacagtgtctctttactcttg

SEQ ID NO: 14207 - DNA, 1138 bp, Homo sapiens
ttgaataaggagccgagctttgtaagtttcccagggatcacagcgtacctcttcatgtgcggcttgacttggttgagatacatcctgttgggattgctttaatcactcttttcagctgtcttcctggtattattcatttttctttttctaagtaagtatgattgacttctttggtttgcaaatacattttaatttttaagtattaaaaatctccttattttcttttagatttctgccatctcatacttcattgaatctgaagaatattctccttaatattaaatgtggaatcataaatgtttaatatttatagaagatcaggccataaactgttacactgtttttaataatggcaaaggttagctggaaacaaatggctaaatatgtctttaaagtaaatgttttcactttccaggtggcatgtgttaggaaacaaaagattagaaaatataaccaagccaccctctgtgcttcttcccctccccttcctgcctactttctctttttaggtttaatagactctggcagagccatacagcagtaacgactgtgtggctttgcctcattttctgtctgaattaggacatttctttgaaagtagtgtgtgtgtgttggtgttggaggtagcaccatatgtccttgttttgtttctgagttttccagcagagttagctgaaggctaagctgagccccccttttcttaactcttatgtaaaaatgggtggttacttttacaagagcaccatggtttcctaatatgccagttctggtaaaggaattaaatgggtaatgcaacattttctaagtacgtctaaggagatgcaggctgagaccaccacaccagtgtttgatgactacatcagcatcgggtggtggtggggcttgtcctgcatgccacgatgctctgcattttattacacgatgatgtttcttgcagccatcatgcaccagcaccagtggagatgtgtgcaggcatgtcttcccatacaaagcatgtgtcctgtatgggcttatgccccagcacacagagctccaccccacagctaccgaggagctggctgagaggcgagaatatgagcacctccggggtagttggggtttcacccttggatggacagggagggagaatacttgaggt

SEQ ID NO: 14208 - DNA, 1026 bp, Homo sapiens
tttccaaagttgggtatatcttacacattacactggatatggtagtctgtcattgattggtatttcttgcaattgatggggtctcagaggtgagcaggtctgatacagtgtatgtttaaagtcagtcatttgtaatatccttacagaggattttaagatgtgtggtatgtttaaaccaagtattttcacttggggcctttacttcatatgaggtcccactttcagatgcaactcaacattaggtttaaaaaagacacagggaagagaaagctgatggtatgacgcctacctcctgaagcataaactcttagattacagcccgtgtctccacaaggcattctgagcatatttgttttttttgtctgtggatcaaagggcagatatcaaatgatataaattttaccttggggtatcactatttattctattctctactctttgccagtctgtgaggaaaacctctttagcaataaaaattggatggaaatgaataatagattgtgtagatattgatcagtttgatattttgcaaaaatgtttgaactcaataaaaccatatgccatgagttaataggtatctaggagactaggtcttctacatttggagagttctttcagcaagaaaattccttgttatttggtatttatattttctcataagacttactgtgtttctggattcatgttatgggctagaggggaaaaaagtcaaaatacgaacaagaattttggttgcataaagagtgaaggtggctatcaacatggaagtgccccctataggaatacgtctctgacctactcttctatcccaaatgtcctctggtattcagaaaaggcatgtggcctcaggcttctgtcctgcccaccacattacctctgatgtcatggtggtggggagggaggaggttcgccgatgtgtcagcattattcatttgaactatgcaggtaacgtgagtttgtagaacagggttaggttaattcagtgtagacaaatttcatctgtggccccagagtatttgaaagatt

SEQ ID NO: 14209 - DNA, 1561 bp, Homo sapiens
ggggacaggctgaatttcaagtatagacacctacattttgactagtaattctaccacagttgagggacaagactgatttgggaagatcttattcctgagtgtagatttttcctaaagtatttccccttttcggattaattgactgtgttagttcaactcatttaggaagcagtcttgattgcttatgtgtgctgagtgtacaaaaatgatggggacgctgacacatgggacacgcaggtactgcctgaggacaggaaaggatagctcagcctagaatctccagtggaggttcagaaggaagcttgggctgaaacaaaacacattgtcaattcaatttttccttgtctaggcaagtttgtgatggggctagccttctggctaggattgacctattttactcatagctaccaatatcatattccacgtcaagtagctgtggaagaattgaagagctgatggattattctcaacatgttctgtttttgccaattataactgaagtggaagaacttgctcggttagaactttaacagcagctaggaccctgtcagctgcttaatgaagagcagtaatacaggcaaagtgcttgtcacaagaggagaaaataaacttgtcttcagtttcttttgtgacatgttgggataatgcagctgtaattttacccattgtaaattaatatttctctctctttttttttttttaccttatggccttaaaaccttaaagtttttcatgtctctgtcattacaagatttcctaactgtcttcaacatgtcttcatactttagtactatataaacttttatcagaccactttaatctccccaaacagtcccgaaggactaaacagtcttttctaatgagaaaaacctaccggctatgaaaaaaatcctttaattgatcatgtacttatttaacagtcatttgttgaatgtgtgcactgtgcaaagacagcagagttgaagatgatacgctttctggcccctgaaagcccccatcctgcttgtgtgtctgtgggtttgggggtggggacaggtgggatctcgggggctggctgagaggtaagtgaataatcagtgacaaggtatgtgaaaatggaataataatacctgttagctggaggcaggcagggaaagtagaggccagatcttgattatcttaggtgttctcatggctttttcttgtacatttatatcggttttatctgcctcgaggtgtcatgaaggcccggagcctgcttggctgccttctagtgccagaatactccttgggtccaagtctggtcacagcaccatggtttgggtaggctgttttccattttagttctaatatttttcttaatgatgcccggtgggttttgttgtctgttttgatcacaacagtaaactaggctgatgttttcaaggaacagtctgctctgattccttgatccatttcctgtgtcataactaagattgccctgctctattgtggctgcttttgagtgcagccaatgtgtgtgagcacgagagagggccagacctttccccagaactttgttaaaatatactgtcttatttat

SEQ ID NO: 14210 - DNA, 1020 bp, Homo sapiens
agagaatacctatataattggccagcctacccctttgaatattcagtatctagacctatcctcctaaacatattttaacttccacacaacaaaaactactttcttttcgtctaacagaatataaacattctcacacaaatgaagatgttctcaccagctccctaaaatgcagtgtcacaaagtctcattagtgtatccatctctgggaggtagtcacattacctgttgctgggctttgttaatttctccttaaatttaattaaagttctgcttgaatgttgtgttatccagagttaaattgtagaggtaagtttcaacaatgtttgtataaataatgcaagaagaaggagaagaaatttgttctcgttccctccctccctctccaaaagcaagaaggaaatatgcatatctgccacttttcagtagttgagatttgtatctttcttctcctgttacctgttccttgtttcttttgcactcagccaggacttcaactgattaggtttctgtacctgaaggtctgaattctcagtggtcctgcctttttttggattgctgtggttttccattaacttttgctgttggagatagaagtactaagagctgccctgatgaaggaagccgtggtccttcctgactctttgggaggcagcatcccagggtcctctcacccccactggcagtgtatcctcctcactggcctcttggctaagtggcttgaggagcctagaatgactcagtggcagtctcaccttccagttcactggaaacattgctgcctccctttaatagctcccttaaaatcaggacctctgtactagcagggatgaaaaccaaaaatttttagagtgggttattagggtaatagtgagaggggccactcctacttcttctattgatttctggaccaatgtcttcttactttggggagacaggtgagtcaaagcatgtgctgtgttgtgtgagacagaactccatctttcagaatgttgccttacaactgttgtcttcagtaggctg

SEQ ID NO: 14211 - DNA, 1598 bp, Homo sapiens
agagtttcccatgttaaccatattggtcccatggtaatcatactggtttcagtatttgtttcctagggttgccgtaacaaattatcacaaacctggtggctgaaaacagcagaaatttattctgtcacacttctgagagaccaaaagtctgaagcctggcagggccattctctctctggggacttaaggagagaatttttctttgcctcctccagattctggaggtggttcttggctggtggccatgtcaccccagtcgctgcatctgtcttcacgtggccttctctgcgtctgtgtcttctccgcttctgtctcttattagcatagttgtcatttgagttagggttcacctgggtaattcaggatgatcttatttcaagatccttcattatatctgcaaagattcttttttcaaataagtcacattcacaaattctggtggttaggatgtggacatacctttttggggaacaccatctaacctaccacagtctccatctgtatcctgatgagtaggaagtgtacttcaggaaccctgtggcctgcactagctgtccacctctggggattgatggttttagacaatgtagttcattcttagcttgtggtaaaactttttttttttttttgagacagtcttactttgtttcccaggctggaatgtcatagcctgatcatagctcactgcagcctcgacctccagggctcaagcaattctctgcctcaacttcctaagtagctgggaccacaggcacatgccatcacatatggctattttttctattttttgtagagaaagggtttctctatgttgcccaggctggtcttgaacacctgggctcaagcaatccacctgccttggcctcccaaagtactgggactacaggtgtgagccactgtgcttggccagtagaacattttaaaaatacaggagagtgtaaagaaatcaggggaaaaaaatacatctgcttgtcttatttctacccactgtcctgcttgaacttcttcatgcccccagtattcctttcataggtgctctggccacagatgtccagtggccccatacacagtagctccacactgttgactgatgactcttagacacctctggataaaaggttctgcagggcccaccttgggtattagtagaatgactgggaatcagaaaaccaactcttcaaatatttatgtaggctgccaaaccagttttcattttgtttgcttttagtggaataaagccatcttttgttacattgctgacttagggaatagtctcattaaccatgctttggggggtcctggatggagcaggagtcaggaaggggttggtcaaatacatcctattatgatttgtgtcctccctccctcctaatttctccaccctctgttgtcgtggactcctgtaggatgggacagatcttgtctctgtgtatcctctcccgtgtctggcgcacagtggaagtgcttcataaatgtttggtgaatgacattttgaattctgggggatccatgaatgatttatgctgtcactaaatctggtataatgtttggattgagttttaaagtagaatgctttatttatacaatcaccatgtaca

SEQ ID NO: 14212 - DNA, 1059 bp, Homo sapiens
gtggttgcttgaggctgatgcttcaagattagggccaggcgcagtagctcctgcctgtaatcccagcactttgggaggccgaggtgggtggatcgcctgaagtcaggagttcaagaccggcctggctaacatggtgaaaccccgtctctactaaaaattaaaaaaaaaattagctgggcatagtggtgtgcacctgtagtcccagctactcaggaggctgaggcaggagaatggcttgaaggtgggaggcagaggttacagagagccaggatggcaccactgcactccagcctaggcgactgggcgagactccgtctcaaaaaaaaaaaaaaaaaaaggattagaaccactgattctcagaaaaagtttgactttcattattttcagacaacacctaaggagtgaaaataaatgagactaagaagatgttcttaggccccagaatgtttaaaagtagaaagacaatttccttattctaacctggggaccctgatggtaacagacgtgcttatgtgctgcgatggcagctgatactcctcagcctgtggttctctgccccatccagagagagcctgaatctatacacagaaaaggctgtgtttctgaggaaataaaaaatatgtacttttaaaattttctaaataggccctacttctagggtcagctggcgtgtatttcaattagcacattatcttgggaaactttaccatgaggaaaagtttactcataggcttggccatttttatttatttgacccccatgaatagtccaacatagccaccaaaaattgcacagatgtcagtggctgtttggccgtgttttaaataaatattttgtcttttaatcatcagagataggagattaaacctggactcgtccaactttggctctcttcacgctcatccttatgggagaggaagtgtcaagatgggctttcctttggagcataacctaaacaggaaccttttaaaaacctatccaaagctacactttgtaccttaaacgcaggcatgaagtatgagacatttctggtgatgtcttcaggaggattaagaggtc

SEQ ID NO: 14213 - DNA, 1058 bp, Homo sapiens
aagaccagcctgggcaacatggtgaaaccctgtctctacaaaaaaattgtagaaaattagctgaacgctgtggcgcacacctgtggtcccagctatgtgggtgggaggcaggagaatcacttgagcctagaggttgaggctgcagcgagccatgattgtgcttttgcactccagcctgggtaacagagcaagaccctgtttaaaaaaaaaaatttcagctgttacatcagtagcctttaacacactccctcagtccagatttgtctttttcttttcttttcttttcctttttttgtagctgggactacaggcgtttgccaccatgcccagctagagttgtctttttctaagatgtccttactccatggccacaccatgcctcccgatgacaaggctgaccacactgcccctgtccaaggagcagccttcagcattgcctgctacctccttttggccagatattctgaggttggaaggtgaggggtgataaggtatgtggattcagaagtactgtaaacatactcagatgaacagtattaccatttaagaattttcatttcacagttgggtttcatctccaaaattcttgagtaatgagagaattgagtaagggtagtcattgatgattctgttgggtccagaaaacagagtgattgattgaagtctgtacaatgccaaaacatatttttaactattcattttctttccattcttagccatacagaaaataaccaaacaaaaaattaaacacgaactccacagtcagacttattcagctgtttattattattatattcattatttgtacttagctatgattattcagcttattaagctttgctgtttattagtagcagagcttaatgtcagggatttgaatttcgctttttggtgtgaagtctttacctaacaaagtgggaagtcccgagcagtggtcagtgatggaataataaaggtacaagtatattagtgcttacagttacaaagagaactgtagagaatgagaaatagtggcactgtgaggatgggagtgttgcatgtgagctgtccccatttgt

SEQ ID NO: 14214 - DNA, 1045 bp, Homo sapiens
tagcatcaatagagtggagagacagccaatggaatgggaggatatatttgcaaattgtacatctgataagggattaatatccaaaacatataaaaaactcaactcaaagtgagaaaacaactcagttaaaaaatgggcaaagagcctgggcaacatagtgagaccctggtctctacttaaaaaaaaaaaaaaagaaggctggtgtggtggcatgtgtctatagtcccagttacttaggagtctgacgtaggaggaccacttgagcccaggagttcgaggctgcagtgaaccatgattgcaccactgcgttgctctccagcctgggtgacacagtgagaccctgtgtctacccccacaaacctccccaaaaaaaagggcaatagccatttttcaaaagaagacatacaagtggccaacaggtatatggaaaaatgctcaacatcaataatcatcagggaaatgcaaattaaaaccacagtgagataccacctcacaccatggaacccttggatacggagtgtggtctgtactttgaaatcatttaggatagcagaatattttgtggaatctagggagatggggagctgaggtcagggagaagtaagctgtgtgctggcatttgtttaccaggagatccttccatcctactccatggccaggcagtgagtagtgggccaggggtgagggtctctgtggaagcacaggatgctgacattagacagggcacactcctacctttgctgcatatccactgccccttgcagggccttcatgtttccctaggggctgtggagctgtgcccatcatccccactagaagcccccagctctgatagtcaagcatttccatggggaaaattggtcgtgctgagagctaatgacttatggttattaaggatgttttgaatctttaaacaggaatggtacttggctgaatatcagtttggcttctgttgctcattgcatgtcttctttattttcaaaaagccaactgatttctctttcatatgtggtgtttcctgtggttctggtgtttttgtgaacaa

SEQ ID NO: 14215 - DNA, 1033 bp, Homo sapiens
taacccatttggtattgagaaagcaggaaagcaagttttcctgttacgagcagtgaacaaaaagcagaaaagcaggcagcggatggcgatatcctgttgtagaaggcttgcgggagcgaatgcagacaagtgcccctcattctttccgtgtctttaagaaaagccaggagatgagaaggaaattggttactttgcaggccacatccaaatggttttcctcttatttatggtgcttatcaaggaggtcataagtgtatgttttgtgatttaaaaacttgtcagaccagagatctataacacatgacaaattagaaaaacgaaatagattggtgggttttttggttggttggtttcccatgaggtcattcgaagtttgcttgggagggggcaatgaactgtaaaagtaaatgtaaactttatacaagttttatttatttttaagtttaaaatcacttaaagatggcacaattcctactgagttagatttataagaagttggcttgtcagatgctcttaggggacctttctttggtacattttacaatgaactagggatgggcatggtggctcatgcctgcaattccagcattttcagagaccaaggtgggaggaccacttgggctcaggagttcgagaccagcctaagcaacatagcgagagcccgtctctacaaaacataaaaaaattagccaggcatggtggcatgtgactgtgattccagctaattgggaggttgaggtgggaggatcacttgagcttaggagttagaggctgcggtgagctgtgatggcgccattgtacttcagtctgggcagcagagtgagaccgtgtctcaaaaaaaaaacaaaaccaaaaacaaaaaacaaaaagctttttcctctcttattacatgagcaatacatgtttattataggaaaattagaaaacatttacagacaaccaaacagtaccggaatgggatagaaaggcatggaggtggaaaatgagagtgatgtggtgagaaggaaaaggaaggtcgcctgggagcagtggg

SEQ ID NO: 14216 - DNA, 1065 bp, Homo sapiens
ctggcgtatattctaccagctacttaagtccccttggactgttgcttaatgtctctgaacttcaaggttcctgctctgttaaataagaggcatactcggtttttctagagtcccttattccaccaatgggcttctatttgaagctgtttttttttatttatttatttatttatttatttatttattattattatttttttgagatggagtcttgctcttttcacccaggctggagtgcagtggcatgatcttggctcactgcaacctccgcttcccgggttcaagtggttctcctgcctcagcctcctgagtagctgagattataggcgcccaccaccacacccggctaattttttgtatttttagtagagacggggttttgccaatttggccaggctggttttgaactcctcacctcaggtgatccgcccacctcggcctcccaaagtgctaggattacaggggtgagccactgcgcccggccttatttattattcttttagagaccatcttaatctgtcacccaggctggagtgtagtggcatgatcatggcttgctgcagcctttgaactcccgggtacaagcaatcctcttacctcagcctccagagtagctgggattacaggcatgcaccaccacgcctagctaatttttgtatttttttttagagatggggttttgccctgttgcctaggctggtcttgaactgggctcaagcaatcccaaactcctgggattacaggtgcgagccagcatacccagccctaagctgcttttataaaagtagtggaggtgctactaggaacatttttaactgtaggaaaagtaatttataatgtttggtaatgaaggaagaatcctcacaatttcagaattagctttccataatttagaatagtcaggaaggtagcatgttcaaaacgtacgcgaactcagaagaaaagctagaaagaattccctgagcagggttgagttatgattacttttagagctcctgaaaggattttacctcaggtctttcagatgtattaaagatggcatcataatgacctagatctaagagg

SEQ ID NO: 14217 - DNA, 1316 bp, Homo sapiens
caggttcagaatcccatggtctgtgcatctgtccttagatggaaataattactctgtgtctgataacttgggtcagcactaatacaatgcccacaacataaatgctcaataaatattcttatctagctaataaagcagttctgcagatggatttaaaaaaaattaaactatgtgtgggtttagtagctcttcccacacttcaagtattgatgagtggatggtcatgagatcagaaacaacaaaatgaaatagttcagtggatgataaaggctgccattaaaaacaagctttaaaatgtaaacataatgtgggcttatccatttttcattgttcaatagcttcatttttcatgtgttcaggttcatggactttcatgaatgattttgtattaatttgtttgaaaagcttgaaaataagcatacaaaaagtagagagaatagtataatgaaccttcatatttcatcatccagattgaataattattgagattttgccaaacctgcttcatatgtctcttcttcctattatttttcatgtgtgattgtgagtcccaggccttatatcatttcacctctatataactagtatatgttacttaaaaatagggtctattcttacataactgtgtcataataaaattaacaacttgttagtatgctcttcacatttcccagattatattaaaaaatatttgattgttagtttgttctaataaggacctaaaaaagctttgtaggccttgtcaaacatggttagctctttcatgagccttagaattctttttttttttttctgagatggagtcttgttctgtcacccaggctggagtgcagtggcgtgatctcggctcactgcaacctccgcctcccagattcaggtgattctctggcctcagcctccggagtagctgggattacaggtgtgttctaccatgcccagctgatttttgtgtttttagtagagatgaggtttcatcatgttggctaggctggtctcaaactcctgagctcaggtgatctgcctgcctcggcctcccaaagtgctgggattacaggcgtgaaccaccacacccagacagaattctttataatggagagaaccctccatggggtcaggacttctgggttttaatcttagaggtttagtagtttagagcatgggttgtaaacctggttttatgcctcaccagctgtacaatcttaggtatataacttaaccttgttggggctcagtttcttcatctgtagattggagataataattatgctttccttgtattgttgttggaaggattaattgagctatgtgggtgaagc

SEQ ID NO: 14218 - DNA, 1047 bp, Homo sapiens
caaagagtctatttgggattataaagtaagaatagatttcattatttcttgcagaatgtctgagaaatcctttgagagtgtgtggtagtaggataatgaagtagataaaccggctattctggttcctgtagcagtagccattcctaaccctataagtaggggtattagttgtatggctctgcgctgactgacttgagctttgaggggtactgataaggtctaatttcctggggcagtgttaatgttgggacttagactaaggtgcagatgcttgtccagttagtggggaggcagatataggtcgatgttccacataagaagaatatgccttgtctgggtagaaagaactttaccctggcttttaaaggaatgggatacactgttttttctttactacttccatctctctttctcgttgacttctttgtctcttcctctctttctgactctgactttctgtgtctgtccctctttctctctgactccttctctttgtctctctgtttctgtctctctgtctctctttctgactttctttctctctttcattcttgctggtctttccctacctctgccagccgcttatgctgctgttctcccctctccttcccattttgatggctttgtcagtgtaagactgccacctccttgggtttttccgctgcgtgcaataactctataatttcctcgtggtatttgatgggggttcccccagaggttaggaactccctctctttccgtattgcagcatgggcatgtaggattagatgagcatacttgctatctgtatacacatttattctttatccctttcccagttctaaggctcaggtaagtgccactagttccgctaactgggcactggtccctgggggaagaggcttgctttcaagtgtggttacttcactaactatggcgtgacctgcccttcgtatcccattctccacaaatgaacttccatcggtatataggttaaggtcaggattagttaaggggacttctcagtccccttttctgggagacttctaagtcttagaaggacttaga

SEQ ID NO: 14219 - DNA, 1042 bp, Homo sapiens
tccccgcagaccgcccctctgctgacctctcacacagccggagggggtggagaaggggagcgcaggagctccggcaaatcacgagccagaaacccgatgccccgccccctaacttgcggaaaggggagggtgagtggtcggccagatccgccggatccgggatccgggagtcgcgctaggacctggagggctagtcggcgggctgcgcgtccggccgctagctgagctggaggccaccggccagagccgaccccaggagtgagagagacaggggcgtgcgtgagttccggcggcctgcaccgggcaaaccccgtaccttcccagcatcggctcagcaacccacgtgcatccaggccggtcaatgtcattgagtcacctccgcgccttggccaccctggagtcccgagaatccgaagttccagacaaatgcccaaactacattcctgcatgttcgaaagcgtaaattgcaaagcacaaatccaggtaaggtttttaacgactgtaataacacataaaaagttctaggtctggaaatcagagatccgagctcaagtcctacctctggcacttaatatgtgtgtgtgaaagaaattagccacaactagagtcagtctttgttgctcgcaagcagaaacccttgttagtacaactactggccaggcgcagtggctcacgcctgtaatcccagcactctgggaggccgaggcgggaggataacctgaggtcaggagttggagaccagcctggacaacatgccgaaaccccgtctctactaaaaaatacaaaaattagctgggcgtggtggcgcactcctgtaatcccagttactcgggaggaggctgaggcaggagaattgcttgaaccctggaggtggaggttgcagtgagccggatcatgccactacactccagcctgggtgacagagcaaactccgtttcgaaaaataaaataaaaattagtacaactattaagggccgggccgtgtgctagagcctcagattccctcttacttgagagtttacaagaaccttaatggagtata

SEQ ID NO: 14220 - DNA, 1104 bp, Homo sapiens
aatcaatgaaaacagagtctacatcatcagaaaattctagaatctgagggataaaaggaagcccttaagagcctccagggaagagctcgagtcacacacacaggggacctggatcacagcacactgacttctctgcaagaactcggaaagttagaagacaatgaagaaatgtctttaaagttctgagggaaatgatttctagaatcctctacgcagccatgttattaaccaaaagtgggagagaatacacttcagcaaaatgtggccaacatcccagccagaggacgggacaggaatgagggtggcctggatggcagcgacacagagagcccagactagagctggcagggaggaccttccagcggatggtcaggacccgggttctggccatgctctcagaaactgcgaggctgaattacaatcctagaaactaagcgaaatgcaaaacaaacaaaaaaaacaaacttgaagcaatttttaatttcaaggaaaacataaagttgtccaagaaaggaaatgtaatcatagtatgctctgtgtcttagccaagagccgtgtttgcatggttctaatgccgaaatagatctgggtctgacccaaaactatgatgagtctgttgggaggatggcgggatgtggtaggagagccaagggtcaggcttctacagtgatgacagcagcggcacacgctacatgtcagcagatcacacaggaccacgtgtgttggtacccaccgcggtctctgaggcaggctgctactgtgacttcagtttacagttgaggaagctgaggcacagagaggttatatgatctgcctaaagtcacacagttaaagtctgtgctttagaaccactatgctcacccactttttgagtagaagggcaagatatgatttaagacatcaagaagtagcagcgtaagtaacaatatggagataaatgctgaacacaacagttaaaagccttaaaagtgttgcctccagggagtggaaaggggtaggaaacttcatttttcttacaaagcaatctattgacattttggacacatgccattttaaaaaactgcatcagggaaagccaggcaggcacctggcagtggagagctg

SEQ ID NO: 14221 - DNA, 1036 bp, Homo sapiens
gtgtgtgtgtgtgtgtgtgtgtgtgtgtgtagagtataatcggctcggatttaattcattcagcgcatccagtttccttagaagggccagtccctccagctcaatgcctttttctggaagttttggcctcagaattcaggctgtccggccagcacacagtggccggccgtgcgttcacgttcaggactcacaggaatgtggcagatggacccactctgtgcaggggctgtagaagctcgctcagggacacatgccgaattgccttccccgctcccttcttccttgtagttgagtcttaacttcgctctcagccattttaattgaatttaacttggggtaattatacaagcactgaaaggatttgaatgctttgggaacaagataatttatacaaaaaaacttaatcaggcttaattttgaattctatgcttttatctttaaaaatgtttatttttttcaaatgtgtgaaaatggcattgtgtgtatgtgctcatgtgtgttggggatgaggtctcatctccttgggtgcactgacgtaagcaatggacttttctagagttgctttcctttcttttatctgccacctctggctatatgatctccaggtagttagcatctttttggagggtttaaactggttttaataatattcttagcgaaaggtgatgctgaaggcaaacctgttattactaccaaaacgagtcctgccttacagagcccactggaggcggagtctggctgggccctgacccagctccctgccgctggcacaagagaccagctagctatgatacaacttgttgcccagttttcaatggccagttgggttccttttagctcctgatttcatgtttctgggcagtgggatatagggccctgcctggcagtgccaaccagcagcgagccctggattagaatggcgctgtgctggtttgaagtggacagacgagcaggtagggccacatgggtggctgttgatttatttatttattgagacggagtttcactcgttgcccaggctggagtgcaatggcac

SEQ ID NO: 14222 - DNA, 1048 bp, Homo sapiens
tgtctataaaattaatgttgggagagtagttttttcaaagctagcctggctttaaaatgtggttctgttattgcattaaaaagatagcaaagtgatagccacacttacaaatctcaattgcatgaccagaacagccccaaagtttgcccactctattaccttctcatgatgaaactcagattgtccttctttgtgttaagctgagaagggtgagattggatcaagagaatgaggctatggttgcgaagagttctcctagtaaattaatcgtaggtactttggaagcttgccattgaacttacctccttttccttccttcttacagagtagaccttccccttccagcctggtcttctgctttatatcctcttatgccttggctaaaatgcatttataatcatttattccctagaattcatttcttgcatttgtatgtctccatagttaagatgtttagagcatagcattgttgatgtttagaatgctcacagaaatgttttttcaccaaagctgttctctaccaactctgaagcttctcttcacaaaagccaaaaagcgtccacagatgctcttctgcccatatagaaagttaattttactaacaaaatcactgtcatgatcagaggctaatcatcctaatgattaggtttactgtaactatcattttagggtcagctcttgatatcagaggccttttttctaaatggacccaaacaagctattacttccccaaatggtgtaaggaaatatttaaaataaacagctgaacttctgcatagtcagggctctgggcagtgcctagcatccatcacccccacctcccatacccagccttgcttcctggaaatttcatggcagcactaagacattgcatgtactcttctttttgcttctttatgtaataatgttactataggcagatgtatcttatctagtgctatgaagagccctaggagtaactggcagtaaatggataatcatcagggagtgtgattacaataaatagagttttcagtacaaacaatattgtttcatacaattgactttt

SEQ ID NO: 14223 - DNA, 2094 bp, Homo sapiens
tgcagtcatagttcactgcagcctccgatgcctgggctcaagccatcctcccatcttagcctcccgagtagctaagattacagtcatgcgccaccactcccagctgacttttaaaatttttttgtagagacagagtctcactgtgttgcctggttgatctcacctggcctgaagcgatgctcccaccttggcctcccaaagtgctgggatagcaagcgcaagccaccatgcccagcacggattggtggcttaatggccacagaactgcttttctcagaaagctacagttttattatttaaattccattattcattttggtgagaatatcttgactcttccacttgtgtaaagcagaagacatataaagtgttaattcagaaaccatgttgaaaaatgttggtcagccaggaagaagaaaaacacgagccgtgttgtatgtggaggccccggtgtctgggtgtaattctcgttccttctgtgaggtgaggcagatgaagccatttcgtggttctgctgagcatggtcttggcagtgtttttgggagcatcacactgtgccccttttgttaacttgctagccctccctttttcttttcctggttaatgaaaggcactcctccgttcattggcactgtgcctacagtaatgtgaaacaggctgttactggattttagtgatgttagagactgttttccagatgcttccttgcagtgtggagttgccttttttgttccttgagatgatgatcttctttgagacagtggagttagggggaattttagacacaatacatcttttccataaatcattatgaggaagaattgacctttctttctgtagcacaccctgctgtggaggctccacttaatcaaatatttagaacctcgttggtgttcatttcctgttcaaagggaggaaaagatcctctgccgaagcccttcacagctgaccgggtacttctgtaagagtgtagaagaaggtaggcttccaggcttgtcactgagtcaacgaagggagcaggtgcctcacatgaccttcacagaatctctaacctgctcttggggagtggtcagtgtgctcctggcttctgaagccgatgcccatggaagcaaatgtcacccttaacagtggacatcagtgaccagctttgcatctgtcacctcttttcaagcctttccctttgagtcagcaagcacttaagtcgcaggtgctaagtcgcatggtggctgtggacctttgttgctctttggggccacccatcatttgacccatttctgtttggggcattcttaggtgctcagaagatgatttgattagggagctggtacagacgggctgtcccatcaggtgcgcccacctgttggaatcaggaactggtcacgcgaggtgggggcccagaggcagccaggcagtctctgccaggtgcccggcgcatgatttgtggttttgctcctgccacgtggccctgccctggctttccaggccacaggagggtctgtgagctgcaaactcccctttgaagaattccctttttgtttaaattaatcagagtttggttactgcgatgaagaatcttgatggacaacccggggaagtgatcagcatgttgtaatttctagtccctaaaacactcctgtttaattatgctctaaagagaaagttaatctgtcatttttcttacttactccaccacagtgccttgtttgcctctcttctcattagacacaatttaagccatctactttcatcttttgaatgtaaaacaatgcatttttaaacatctgtagtatagtaccaaattatctcagcagtaagagcggtacagtgttttttttaatatttagtgacttttgtctggaaaaattaaggttttttttctgatttcatagtctgcttagctcatgatcaaaaatggaaacttaaaaaaatatgtttatccatacttaactgggacattttggtaagttaccttatttaatagatgtgagaggttaatagtgatcttatttagctgtgtggtccacttatttgacacgtattaagcaccttctgtatacagccagcaaacccagatgtggcccagtcctcatggag

SEQ ID NO: 14224 - DNA, 1003 bp, Homo sapiens
gagtaaaaccatacccaacaaggaggtaaatgagtggatgatttttgaaacccaccccccaaatccctccaaaaaggcagcctgaattacatgtactctttgaaaggcatcagtgttaaaagatgcagtttgggaagccgggacagaagacagggcagacgtggggaagggtgttccactctgcagaaggtcctggagaaggggagaggtaaacagaagtaaagagggactccaagagacgtcggcactgggagagaaaaagagagcataggaaagtatagcatgaattctggaagccacagtccacctttgtagtatcttagttcagccttgttccagtttatgatgttaaacctgagcttccctgaaactcaatttgtagaaatataaatatacactcttaaataaatccatttgattgtcattcctcacaaagatatcatatggcatttaagttcgtcgtgtccaagcatgtttgcagccaaatggaaaactcgctgcatggaccaaatgtggtatttgtgttttgagcttttctgttttaatctgctaggcgacataaccaattttcctgccattgtctctctttacaaatgctactacttagtatgattctgtagttaattttttttaaatttttcatggtttttaaaaatttttaattctagcgttaggcatgtgtaaacaaattttattgtttaaatatgcaagtaatagtaaaccattaaaaatgtctgagatgaaaagagacttgtctttgggaataaaatgacataaagttttccttgaatttttttctggtttagtttttttgttgttaagttttgtttttgttttttctgttaactcaaaagttttagctcatagagcaatttatggcgggcaagagaggtatacttggtaggcctttgctgccatctactggcatttcatgtaattacttattgcttccattctaaaactaattttgtgtaacgtatataatagtattataggttccccc

SEQ ID NO: 14225 - DNA, 1068 bp, Homo sapiens
gctatgacctcaaactatgaaattactacaagaaaacactggggaaaatctccaggacattggactgggcaaagattttatgagcaatacccccataagcaccggcaaccaaagcaaaaatggacaaatgggattacatcaagttacaaagcttctgcacagcaaaagatacaattaacaaagtgaagagacaacacacagaattagagaaaatatttgcaaactacccctctgacaaaggattaataaccagaatatataaggacctgaaacaactctataggaaaaatctaataatctgatcaaaaaatgggcaaaagatttgaatagacatttctcaaaagaagacatacaaatgacacaaacaggcatatgaaaaggtgttcaacatcattgatcatcagagaaatgcaaatgaaaactacaatgagacatcatatcaccccagttaaaatggtttatattcaaaagtcaggcaataataaatgctggtgaggatgcgaagaaaagggaacccttctacactgttggtgggaaggtaaattagtacaatcactatggagaacagtttgaacattcctcaaaaaactaaaaattgagctgctgtaatttagcaatcccactgctgggcatatacccaaaagaaaggaaataagtatatctaagagaaatcttcactcccatgtttgctgcagcactgtttgcaataagatttggaagcaacctaagtgtccatcaacagacgaatagataaagaaaatacagtacatatgcgtaatggagcactattcaaccatagtaaagaacaagatccagtcatttgtaacaacatggatggaactggagatcattatgttaagcgaaataagccaggcacagaaagacaaacatcacatgttctcacttatttgtgggatcacaaaatcaagataatcaaactcatggacatagagagtagagattggttgccagaggctgagatgggtactggggggacggggggaggcagggatggttaatgggaacaaaaaaaatagaaagaatagataagacctactatttgctagc

SEQ ID NO: 14226 - DNA, 1046 bp, Homo sapiens
acaagaaatagctgggaatggtactgtgcacctgtgatcccagctacttgggaggctgaggcacaagaatcgttggagccgggaggtgagggaggttgcagtgagccgagatcatgccactgcattctagcctgggtcacagagtgaaactccatcgaaggaaggaaggaaggaaggagagagagagagagagagagagagagagagagagagagaggaagagaggaagagaggaagaaagagaaagaaagaaagaaaaaaagagagaaagaaagaaaaaagaaaggaaagaaaaagagaaagagaaagaaaagaaagaaagagaaagaaagaaagaaaaagaaagaaagagaaaaagaaaaactgagactgggtatcttatttcttttattacatttttgggtcctatatttgtatcatacagaatgagttctgtatatttttcagatggaaaagaaatattgacttaaaaggtacctctcaaatcttaatgtgtacaataaactggagatcgtgttaatgtagattattttttcagaagatctggaagaaagcctcagtttctgaatttttaacaagctcaccagtaatgtcaatgtttttggccaaagaagaatattttgtcaaaaattcagtaagtggaagagcctgtgtttctttttctagtttttctggcttgtaaacaaagatgagagttttcatttaccaaagacagatatatgcaaagaaaacctaagaaagaagggcagctgccagattaaatgtgatggtttatgcacatcagctgcataaagatacctaataattaagagaaaaataattaactctgtagtgcgacagtctgtcagagagctctttaaccaagtgaatcataaacattaactgcactaggacaaatttttatgatgtgctgatgcacacagaaggacgcagcatcactgctgtgatattgccccctcaaaagtacattatagtctaaatttaaccataaagagacatcagttttatgcgaagctcaagatacacgtatctttcatgttctgtaa

SEQ ID NO: 14227 - DNA, 1102 bp, Homo sapiens
gcctaaatgcggagtttttaatgctatctatttgtttgtagtggaaggagttgaatttggtgtagtccatcttgccacaaccaggactcacatccatagctatttttttttctatttttgtctaaggtccttgaggacacgtatgagaaaggtaaagaggatattgtgttatattcatctttttatccttactacctagtatcctaacacagaataaataattagtaactatttattgaaggcatggttgagaacatattctatttagacagataatattaacatgatgacaaattgataaagaagatgaaataaaaaagaaacagagaaaagtaagttgctaaaagcaggaaaggagaaatggctaaaaaatagaaaaacaaagtttaagcagaaagaagcagtgaattagttcatatacggagtaagaaaattgaagcaagtggtgagtaagggagttgactgtgtgggtgagggaagagacaaatgcatggaagaaaatctgtaggtagttggatttatttttttagtgtatgtaggctgtagaatatgcctagattgttctatgagtgaatatgaaaatggaaaaagatattgtgtgggttggagacaatcaatatggagatgaagaacagggaaatcttctggataagaaagcagctgtgtagtactgcagtgggtacagaggctggcttcaaattaccgttttattaaaaccaagtcagaatgtgagagttataaaacttgtaaatgcagctagaagatcaggcattatgctggcaaacgaaagctcatattggcacataaatgatcgcagaaattgagaacagatacacgaatgtcttctgaactcatgaccctagagttgcttcagtaagtattctttgctagttccacgctgtatttggtaccaagaaaagaatgatactgaaaaaatgcatgaaaacatgccttgtgatctaaatattagctccagctcattactttatcctaaaaatgaagttcaccatgaaaaatttcataaatgttgacagaatgcttagttacctgagacatagccattatggtgaaatggctgcatttttctctttcccatatgtgt

SEQ ID NO: 14228 - DNA, 1015 bp, Homo sapiens
ccaacaagtttctcatctccatctgacaccacctcagcctggacttcattgtccatatcacaatcagcattttggtcaaagccattccacaagtctctaggaagttccagactttcccatgtctttctgtcttctaagccctccaagtctctaggaagttccaaacttttccacattttcctgtcttcttctgagccctccaaactgttctagcctctgcctgttacccagttccaaagtcacttccacattctttgggtatctttacagcagcacctcactctctgcagtaccaatttactgtattagtccattctcacgctgctaataaaagacatacccacaactgggtaatttataagggaaagaggtttaattgactcacagttccacagggctgggaggcctcaggaaatttacaatcatggtggaaggggaagtgaatacatccttcttcacatgccagctggaagaagtgctgaacaaagggagaaaagccccttataaaaccatcagatcttgtgagaactcactcgctatcttgagaacagcagcatgggggtaactgcccccgtgattcaattacctcccactggatccatcccatgacacatggggattacgggaactacaattcaagattgttcccagaccaaactgagagtcaggctactatttctcgtggcccaataagaagatgcagatgaactggggaggaagagagtttttatttctgtaaccagctacagggagaaggcctggaaattatcaccagaccaactgaaaattacaaagttttccagagcctatataccttccaagctatatgtctatatttaagtatgcattcatctaaacacataagtgattaacttcttttaatctgtaactaaggtctgagtcttgaagacctttctctggagcctcagtaaatgtacttaatctaaatgagtccaggtgctggggtgattacccttatcttgtctcctactaaatcacgaaggtttagggattt

SEQ ID NO: 14229 - DNA, 1025 bp, Homo sapiens
catcaccccaacctctcctttctgtgcattcatgcaagagtttcttgtaagccatcagaagttacttttaggatgggggagaggggcgagaaggggaaaaatgggaaatagtctgattttaatgaaatcaaatgtatgtatcatcagttggctacgttttggttctatgctaaactgtgaaaaatcagatgaattgataaaagagttccctgcaaccaattgaaaagtgttctgtgcgtctgttttgtgtctggtgcagaatatgacaatctaccaactgtccctttgtttgaagttggtttagctttggaaagttactgtaaatgccttgcttgtatgatcgtccctggtcacccgactttggaatttgcaccatcatgtttcagtgaagatgctgtaaataggttcagattttactgtctatggatttggggtgttacagtagccttattcacctttttaataaaaatacacatgaaaacaagaaagaaatggcttttcttacccagattgtgtacatagagcaatgttggttttttataaagtctaagcaagatgttttgtataaaatctgaattttgcaatgtatttagctacagcttgtttaacggcagtgtcattcccctttgcactgtaatgaggaaaaaatggtataaaaggttgccaaattgctgcatatttgtgccgtaattatgtaccatgaatatttatttaaaatttcgttgtccaatttgtaagtaacacagtattatgcctgagttataaatatttttttctttctttgttttattttaatagcctgtcataggttttaaatctgctttagtttcacattgcagttagccccagaaaatgaaatccgtgaagtcacattccacatctgtttcaaactgaatttgttcttaaaaaaataaaatatttttttcctatggaaaaagtgccttcaaagtacttttcttcttttcttttcatttttctttcttttttgtttgttattttaatttgccttcctttactctatttcc

SEQ ID NO: 14230 - DNA, 1026 bp, Homo sapiens
tcgctgttatcaaatagcgatgtgcaggaagaaaagcccctcttcattccggggaacaaagacgggtattgttgggaaaggaacaggcttggagggaagggagaaagtaggccgctgatgatatattcgggcaggactgttgtggtactggcaataagatacacagctccgagctgtaggagagtcggtctgctttggatgattttttaagcagactcagctgctatacttatcacattttattaaacacagggaaagcatttaggagaatagcagagagccaaatctgacctaaaagttgaaaagccaaaggtcaaacaggctgtaattccatcatcatcgttgttattaaagaatccttatctataaaaggtaggtcagatccccctccccccaggttcctccttcccctcccgattgagccttacgacactttggtttatgcggtgctgtccgggtgccagggctgcagggtcggtactgatggaggctgcagcgcccggtgctctgtgtcaaggtgaagcacatacggcagacctcttagagtccttaagacggaagtaaattatgatgtccagggggagaaggaagataggacgtatttataataggtatatagaacacaagggatataaaatgaaagatttttactaatatatattttaaggttgcacacagtacacaccagaagatgtgaaattcatttgtggcaattaagtggtcccaatgctcagcgcttaaaaaaacaaattggacagctacttctgggaaaaacaacatcattccaaaaagaacaataatgagagcaaatgcaaaaataaccaagtcctccgaaggcatctcacggaaccgtagactaggaagtacgagccccacagagcaggaagccgatgtgactgcatcatatatttaacaatgacaagatgttccggcgtttatttctgcgttgggttttcccttgccttatgggctgaagtgttctctagaatccagcaggtcacactgggggcttcaggtgacgattta

SEQ ID NO: 14231 - DNA, 1073 bp, Homo sapiens
cctcttgtgcttccagtttgacaaagcagaagtcatcagcagtttctccctctgcagacgcagttctcaattctatttacaagtaactgctctactgtgcctgtttttctcttgctgatactcatttaattgtttttcttttggatctgaatctttgactgtcttttccccctcaagattaaaataaatacatctgtattcctcccctttctttctgtgcactgcccttcagatctcattttgtcatttttcagcttagtgttgaaacttttagcaacaaaaagtcagttacttactttgagtaagtaactcaaagtaagttaactttgagtttgagtgcacttttgcgtgtaggttcatttatgtgcttgtgaatttaaaaacattgggattccacctgaatgaagtaaaccaaacattttaaactatcagccagatagagacatcagcctttcacttctttctatatgcagacatatcctaattttttagaaaaatcaaataggaaaattctcaacaattaattgaagattatagctctgctctgaaatggtccagaaataggatctgctcatagaaactcatagtttgaagcctctgggaggaaaggatactttaaaatttagtcacatatttggaggagggaaaagggaaagagcagaatgaagaactgaaaaaaatcacacaccggggcctgtcgtgaggtgggggactgggggagggatagcattaggagatatacctaatgtaaatgacgagttaacaggcgcagcccaccaacatggcacacgtatacatatgtaacaaacctgcacgttgtgcacatgtaccctagaacttaaagtataataaaaaaaaattttaatagccccattaaataattaaaaagattttttttagattcacagaagtgtacaaaatttttaggtttttttttttttaagctgtctgctgaatagtttcttaatggtctacaatgtttgtatctacaaacagatactgtctgcttcttactacccttccaagacaagtattattatggcaattattgcccagtttcccgggaaaaattt

SEQ ID NO: 14232 - DNA, 1044 bp, Homo sapiens
taacacatatgtagagacagcagagtatacgtacacacatgttgcatacatagcaacagcagagaagctcatgaactataaaggatggactgtatgcttgtatcagacattttggtactgacgctttgtcatatattgtgtaacatataaccagcttgcaatcatctgcccccaaagttgaactaagaaaatcctacagggtactaggaaaggaaggccattgggaaaaggtggttatagtggcaatttgttagctcttatgaattttctttttctttttagacatactcttaattccattttttcaataaatctatactattttgtgtttttatgttagcaagtactttaagcccctcaatagaaagttgctacatcatatagtgattaaaaataaaaatctctcaaacatacaagtagaggtggtatgagacttcaaattcccttagccaagtacaagtgcagcagttttgttggctggctggctgcatagaaggactgatggattggcagaccctcaagctggagtgtaattgatctcattacagaggagccaggctgggtgacagttgtgctttgcaagtggttttttgcattggtgaagtagcccattttgttgttcctgatgttaaacaggggatgaaggtattcttttattggcacaaacgcgggaaattgctctggattcttagaggatagaacatgtcccctggacggaataaggttcatgtgtagggcaaatttagataggggcaccttattggggttactactggtctctagatggtcaaagcaaacaacatgtccatctaagctgtgatgtccatctaagctgtgtgtgtccatgagagtgacgcattttctcctctgcagtgttgttatattctaaactgtcagcagacattaattcggtcgctggtgaagtcccaccgcctagagatgaactctgcctccgatggatgttttccacttcagtgccactcgtctcgcaattactgggtcattaatatcattgcatgcaattagtgacagtagaaagagcta

SEQ ID NO: 14233 - DNA, 1005 bp, Homo sapiens
catttttcccaatttccatgttaccagccttgccaggactttttctcagttccctgttacacaatgaaaatagtgtctctttattgataattttagtagcatcctaatgtggtataaatcgtcttccagagaagaaaatgtgtcagggttgcgttatcactgaggctagctgggaaagtagatcagcccattagtctgataattcgaagcgttgtttctgttatttctgaacatcatgtgaactccttttctgggtgtattaaaggttttcccagtgtgtgtcagtgagactcctgattgaatttaatatgaataaagataaattctttacatttaaggattaaagtctcagcttctgcttaacttgagattgcactgagaaactcctggctctcgggtatagcggagtcacgacctggggatgtctgtcccatatggctctgtgtgtaagaagaaaaagctgctgtggacggagactctgttcacattaaatgacatcacctaagccatcatgacagcaagaattatttaggaattgctcagaataaaactgccttcattatttcataaaatgtatcttggtatctttagcaccttatttatggctttttaaaggttcactgggatttataaataattggacaatgctagagacctagtacaagaatgaaagaggacaggcttctttcttaataacctttaaacattcatcaggaagataaaactttaaagcaaaataaaacacatgaaaatagccaagatgcacagaccagacaagcaaatactactttaacttatttgtatagttcttaagagtcacatttgttcctgaagtttcaaaatctcgggctgagtgtttgatcacttagggaagtgttgtggccttcacatactcttgtctcactttgaagtctagaaacacaggtcttagagcaatttttatcactgtgagaaagctgaaacttagtgtgagtagcttagtacaattcagttggccatcaaatg

SEQ ID NO: 14234 - DNA, 1027 bp, Homo sapiens
ggcacatgctttagagtttggctatgtgagtccaatcccagtttagccatttattagctgggtagctttaggagcagtagccttagtgtctctcagttgtcccatctctataatagggacaataacataatagtgctgaataaaagagtaacaaaattttggtcaacatttaatgtatttaaagagctaagctccgtgattggcacaatgaaccaatcaatcaaacaccagttgttattaataaaagtcagttgaatatgtactgtgtgcctggccgtggttcaatttgcctttgcatacaaggaaaaaattaaaatactctgttaataaagactatagcataatactttcaccttaaacttcttgatgttaatttattttgtttacctgccaaacttctactcattccttatgactttctgctacatgaaacaccctttgtaattcttttgtcctattaaattaagttctctctcctctgctttcctgcttttggtgctttctaataacacttttaaccctggactttctcattcagctgtgcaactgtggactgagaggaggctctttgaattcattttgtatattctagtagagagtactgtgagcagttgggttgttgaatgaatacattaattcaacctggagggatgggcagtattgcattttttacattgatattacatgatatttagaaaactgcttaactggtggacgttgttttattaacagcattttgtgtatagcactcactatgtgccagctgctattctaactgcctgacaaatactcctgaaaccttcatggtaaccatatgagggaagcacttttaatatatccataataccaacggggagactgtggccaaattggttaattaacttagccaaagtcatattgaactaataagtggatttaaacccagctagtctggggccagggtccctcttttaatcttctgcctcctgcttatgctgttgcatggagtagtctttatcatataactaaattaagcatgcatttgctt

SEQ ID NO: 14235 - DNA, 1417 bp, Homo sapiens
tggtacaatgaagttagagataaaaataggtatagaacaaaatctgtcatctcaacatgtgatttgtggaaattaatttccacttccaaaatgtgtaaatgcttttccataatttgttcatttattttcattgaaaatgaaagacagaaaatgtagatgtaattaataaagggttctcttttaattttcttaattcttttttctctaccaaactatgtgaccttcgtcagattttatgacacatgccattgtgtgtaagttgtcacctcataactaaaatattttgaaggcatgtaattcataggaagtccttgtttttacccccttttttgcatttgcattaaaaatttttttgtagatacataatagataacacctgttgcaggggtacatatgataatttttaatacatttctataattaatttttacttttaactttcaggccgaagaacagttgagaattgttgaagaacaaagaaagattcatgaggaaaggatgaaactagaacaagaacgacaacgtcaacaaaaagaagaacaaaaaattatcctgggcaaggggaagtccaggccaaaactgtccttctcattaaaaacccaggattaaattgcaaactctgaactttttacaaagaaaaatggaaaaactttgtatggtagcttcatgttgaagtggttttttgtttttgtttttgtttttttaatttgtaaaatctggaaagttagcttgttctaataggggctatgctctgcaattccctttttttttttttttttccttccactaagtcaaatccttatcagatcattgttgtattctaaggagtgacgtatttttcacctgtttggattctatattagtggtctgaggaagagcagatcacattgtaaaactatggatggtctgataaggcttttactgaccccactgacttcagagttatactctgtttgctacatcataatgctggttttgctgactttttgtttttttatatatttataaaaaaagaaaaagttggtgattgcattgggaaattcccagggtattactggacctatgtggtgtattgttaaaccagtgtccttgtgatactgttgctcttgatgttcctgatacaggtaaggaaacagttggtcaactctgatacaaagtatatatacagttcagtattgtctctgttcattttgtttttatttcattgacaaaatcaaaccagcattccccattgtgtaaataaatgattttgctgaataaagtaaagtcttaaattcatatgttgaagcaattttttttaatgttatgttaagtcttaaagagggtggttcactttttgatggtcaaccatttagaagtcttagaactatatttcctcttgtttatacttttaacatagggtttatatgtacattaa

SEQ ID NO: 14236 - DNA, 1052 bp, Homo sapiens
gcatttctataagttgaaatggtacaatacttaggaaaaataaggcaccaaatgtaaatgtcaaatattttaatttgaaatgaagttttgggtaagtcaggtaaggattttcagagagcgagaggttttttcctgattgttaagataaaaagctggttgaagaccttatgttaatgtatttgggacagtaatttaaaaaataaatttctggacatgagtgagtgtattgacattgtgaaggatgggtttgtaggacacaaattggaaacacgaagccactgaaggccagtcaaaagatggggccttgaatcaccaaagtagcagttcttagaaactgtgagggagaactaataaacttggtgagtgaagaggtatgaaaaagccgggacgcaggggaaagtctgttgtaggaaccagaaaagacactcctgatgtaatcattcctaataaactcatgccaggtatccctaagcatttaaggaaaacttagtgcacaaaatagtgaatgaccaagacagaagaactgtaaaaagagagaatgtaggatacagaagattaaaagagccacatctagataatacctttatttgtgaaattttagaacagaaagtataaagaaaattccaaaggcatctgattttccttggcaaaattatacagcagtctctccagagtgctcaggcagtgctttttgtacataatattgcatacaaagctcaatctcagtcacttcctccttttgaaacagttgtcttcacttcaggtaacatggaatccatggagatattatctaaggttgaagtttcaaaaatgatttaagattatatataaatgtcacaagaggggaattaagaataaaagggggtaaagggagtaggtggtgataggaatttagatggtagctaatgatatcctgtaatgatggtttggcatattagaaaccctaaggaggtaactgtgagaataaatatgttgtcacagggatgaaggggatccttgcgttttacccttctgttatttaacattgtacatggaatacctcagaaaaattt

SEQ ID NO: 14237 - DNA, 3724 bp, Homo sapiens
cccatttctagaggagcttttaattgaaaattaacaaaaggaagaaaagacatagtaaggaactataaagctaaagaacttcagttcaaaacttaagttggtcatattttcagtaaaaactacgcactattagtccagcaatctgaatctcttcaatctgtatttattctctctttgcttagcgggaaatcaattcagccaatctgagttgcctgctacataatttctccttctctgtagctcagccccagacgaagtgattggcaaatgagcaaatccatatgttttaacaacttgtcctctgattataaagtcaataacagaataggttttctgtccggatttattgttcctaaattagaactaatgaattaggctctttgtatatacctgttctcctgtatttagaatatgataaaggaaaaaaagattttatactcatttgaatttctgtatcagttaacatcttggtatctgtcatttcctcaaatgtgacatggaaatgaattctgaaaaaatcactgaataatatcaggctcaatggcttgatagacttaaaactagttttgtttaaatttatagttttaaaagtaaatacctaacttgtttttttcactttgtttgctagtcgacagcaagaaatagaagaaaaactcatcgaggaagaaacagcacgaagagtagaagaattggtagcaaaaagggtggaggaagaactggagaaaaggaaggatgaaattgaacgagaagttctccgaagggtggaggaagccaaacgcatcatggaaaagcagttgctcgaagaactcgagcgacagagacaagctgagcttgccgcacaaaaagctagagaggtaacgctcggtcgtttggaaagtagagacagtccatggcaaaactttcagtgttgggttctgcctcctgctcagttcagaaagagatggaatacagactatctaattcctttctcgtctaaacttaacattgctgcgaaagttaattttttagcctattcagaagtgctgactgataacttaaaagttggaagcttttataaaacatattcaaggatactttttgatttaatggaactggctatttgagaagtgtttgaaacttttgccatggctgcaggacttacattcttttttgggaggacggtggggagacagggagtggtaaagggaaaaggttaaaaatccacctgtggttgtatattcttctattctgtcactctgttacctagactgtgagaggcttttgccttcagtcagattaaaaagagcagggcctaacattgagtgatagcacctgctttgataaataggttttctcactcttctttttttccttcttttatccctcactccctcccctaaaccctgcttcagcacaatggactaattctagcattctgatcataaggccctccattttcctaatgtgtttcaaggaatctttttaggaaaaatatccagattattcatccactttttttagtatctactaacaactcctttttttctctagagagttatgaaggaacaggttgtccttgtctggagtcaagctaaacacatgatttgttttatcagcagctggagcagaagttgaaaatgtctttctgtgagacagtaatttgctactgaagctttatggcttgtttgcactgattactccaggatccaaaaacttggtgaaagtcactgaaacactcaaggcaaattactttacagccctgagtgtctgtcaccatagtttgcataatgaatatgaatcccattggtgtgtgatgtaggaaatcctgtagttgtattttcttgaactgaaatatttgactcaaaataattaagactcattgtcatttttcatcttggcattattgtggacaagttgacatattaaatctctttgctttctggtaagcttagcttttaaaatgcattttcccttgtcctgtctttaactagatatacatgcttatatttatagtgggtttcacagactataaaattgaatgtatgaaatttttatttatatcagtgcttttaataatgaagatatttttggagtaatggtgctgtcttgtagcgagttattaatcatagtaagatttttttctcttcatttgctttttttgtttcatattaacaattttttttttacacggacacaaccctctgacagtctttccaaatattaaaatcatttgaatatgtatgctgtgatctgaacactgctcaagccatcaagcagtcttcatacagtttgcattataaaatctcattaaattctccaagaaaaaataagttgaagaattttatttcctgaccatgcatcccctggatttctgagtttcagttcagattgtagatgacaatataagctgccttccgaaattgtcaacatctgaatgttaagtccattttccccatggaagaagcccgtagttccatgaagtatggattaccatttgtatttttcactaacagtaaatgtatttttcttattaattgtttgccttaggaatgatgaattacattttttgttccttcttaccataaacatctgcattcctcagctcagccttccttgtatgttgtttctttataaatggttgagctgctgatgcaggtattgccaagctaacagtacaaatcattttaaagaggaagctggcgcgtatggcagccgaggagcacactctgcaggacactggacaagacagtaaatattcaacttttaatgctgattaaaggagtataggtaaagaatacgtaggtatacataattggtgagacaaatattcactttatttatattttatatattatttttttaatttggtaaatactatccagttttgtagttgtccttgttgatttgtgtgatattaaagtattagtaataattgccaggaaactatcattagggagggtttagttggttgctgtttggactgggagggatgatttaaatttagtgctagaaaccaattttagtgactgcacagtttatcatttgtcagacagaaggtagctataaagctaccctgtaagtcatatcaaaaaagttcagaggaagattagtaaatatttatcaataaaaataaacattttgtttttctaatatcttaacatatcctcccctttaggaggaagaacgtgcaaaacgtgaggagctagagcgaatactggaagagaataaccgaaaaattgcagaagcacaagccaaactggtaagtgtaaagcatacatgaaaagtgttttgtattttgctttatttccttttttcggattttgtggattgatttttgtgccctataatttgacttattttggggggattctcaggactaactttaaaggctttttgaggcaaggataggaacaattgagatttttccttccaatctggacagaactccaaaatttgcagtgattttaaaaaacaagttttctggggaaattattttgttctctatccccagttttttctttcctaacctcattcacattctcctatgcctaaaaaactaatagcaacaacaaaagcttgggggtatatttaaaccaactataatatgcagcattttactttgtattagttggcttgttaccaggagtagatagtatttatttgatagtaagtgcaccggagtaatttcctattcctagtttataatcttaagaaatacagagtcttcggtaattatataatatag

SEQ ID NO: 14238 - DNA, 1026 bp, Homo sapiens
actgatgtagaaattcagagtttgaggtactgcagataatttgtgcaaaaaaaaaaaaaaaaaagaagaaaagaaaagaaaaggaaagacctgaatgaatgaatagacgggtaaccagttaaggatagatgacattcattttctttgaagccaatcatcattacttctgaccttctttagtaacctcactgcaatatggaaaggataatttggtagagcaaaaggggaagtttggcagaatatttaaaatagataacaaattccaatgtattgtgaaaaatatttaaaatatttttaaaagctaatgatcttcttctagcatattctttaagcttttatgcttcatagctagttattttacatgtttgtagcttactaggatcaggcaaaaatgctatcatcagatttttaaaaaaacaaacaatgcttgtcccttaattagctggtaagcagtttcattttatgtaaacaagctactttattggacatctaaaattaatatattcagaagatatggcatttgtttttgctctaggctcctagattatgaaaaatatgatagattcattcattcactcatttattcatccatcacatgggtggtgctatgagggttaaggactataatacagtcagagaacaaaaggaggaaaaacaaaaccccatataatccttaattccagggagcttacagtctgatgccttacattatcttctttgcatatacactccataaacaaatagcaaataatatggacttgtcaagagtgattccaattttttaaaaagtctaatttggcagacgataaatgaaagagcatgagatcacatgtttaggaatggcaaaaattaacatttgatcaagacctattttgagtacgaatggggctagaaaagctataaaacaatccagccaatgatagactctaccttctgcgaaatatccttaaaaccacaaatgtgcctgagtggtgacctgatcatcaatgtggtctatgattaacaaggcaacggatacttcagatc

SEQ ID NO: 14239 - DNA, 1023 bp, Homo sapiens
tggtctcgatctcctgacctcgtgttccacccgccttggcctcccgagtgtgtgtgtatttcttgacacattacaataaaagcctgatctattaaatttgcccaaacttcaatgcaaaaatattgaaatggttttgaatacagtatgggagatatttgggtggacagcagatgggttttactgtaagatgtgctccctttgatggttcaggaactcttcacagaattaggtaacagtatttgacctgtgtgaatctatgaaaatatttataaatatgtcttctttctcattttactcctaaggtatgtacggttaacatccatgtggctataatctattcaacagtaattcatttagtctgctccatattgccttctgttaaataacttaagaagtcattattaaaatataaaaataagcctgattattaaggtagaaacttaagcagtaagtgggtttaacttcagtttgaattatatctatcgggctaggcctcctttcaaatgtgtgatcactctgacagtcattgtctttctccaaaaattctgagagcctttgattttgttttatttctttgttttaattacattttctgaagtgtagcctttgggaaactggctgtcttcatggttaaaataaaagataaagtttggccccctcctttcaatattctgaagtcagatatccttccctttaacttgtagaaatggaagtaactttagtcttatagctcattttagagagcaaaaaatgagactcagacataaattaattgtacaagatctcaatgattttactggtaaattgagaaaaatactgtttcttttcattatcaaattagtcactaaaacattctagcaaacattcattttgtgcttactacgtcctcaacactggaggtaaaaaacaatgaaaaagacactatccttttcccacagagcctaccatttagtgagagaaggagataatcaagttataatgaagcccagaagaatattgtaataaaaattgtggaggagaagc

SEQ ID NO: 14240 - DNA, 1570 bp, Homo sapiens
tttatccatgttgtagaacatgacaggacttccctttttaaaggcagaatatgttgcattgcatgcgtatacaccatattttcttcattcatctgtggatgtacatttaggtggcgtctgcctcttggatattgcgtataatgctgtagtgaacatgggtatgcacatatctcttcgagatcctgtttttaattcttttggatatatacccagaagtgggattgctggatcatatgggagttctatctttaattttgagggcctttcttgctgttttccataatagctatgccaatttacaatctgcccccccgcccccaacaaagtacgcaatgtttcccgtttctcctcatatgcaccaatgtgtgttattttctgttctgttttgtgttatgctgcccatcctagtgggtatggggtgatagctcattgtggttttgacttgcatttccatggtgattagtgatgttgagcgtcttttcctatgcatgttggccatctgtttgtattctctggagaaatgtctattcagattcttaatttatatgttccttgggttgattttcgttgttactatttgtgttgttgagttgcaagatctttttgtaagttctggatattaaccctccacccaataaagggttggaaatattttttctcaatccataggtgtaagttttaagattgatgtagtcctgttgtctatttttatattttgctgtctgtgctttcagagttacagttaataaatcattgtccattctaatatcatgaggctcttttactatgttttcttctaagagttttatagtttcaggtattacatgtaggcacttaatccattttgacttagttttgtatatggtgtaagataagggttcttgatcatccagttttcccagtacaattttttgaagagactcttctttccatattgtgtagactttgcatgcttgtcaaagatcacttggccatatatacaagagtttattcctgggctctcgattgtgttcttttggtctatgtctttgtctttatgccaataccatacccttttaattactcttaatttgcaatgtgtttcaaaatcagaaagtgtgaggcctccagcttttctcttctttgtcaagattgttttggccattcagggtccttccagattccatatgaattttagaatttttttctgtttctgtaaaaaatgcaattgagattttgatagaaattgcattgaatctatagattgctttgagtcgtataaacattttaatatataagtcttccaatgcaagaacaaaggatggtttttcatttactgatgtctttaacttctttcagcaatgtttttgaagttgtcagtgtacaagtcttgtgtgtgtgtatgtgtgtgtgtgtgtgtagctgctattataactgagattgttcttcatttttaggttgtttgttgttagcacatagaaacacaactgatttctgagagttcatttggtattcttcaactttaccgaatttgtttttattagttctaacaatttttttggtagaatctttagggatttttatgtgtaag

SEQ ID NO: 14241 - DNA, 1069 bp, Homo sapiens
tctctgcaagctccgcctcccaggttcatgccattctcctgcctcagcctcccgagtagctggtactacaggcgcccgccactacgcccggctaattttttgtatttttagtagagacggggtctcaccgtgttagccaggatggtctcgatctcctgacctcgtgatccgcccgcctcagcctcccaaagtgctgggattacagacgtgaaccaccgctcccggcccactaaaatgtatgtattcttaaatccccatcttttaacaaaatcttttatcttttccttcaaaatagaatatttttagttgttgtttatttctggaatataccttctcaagaaggaaaccaccccatgtcctttgcactgaaaaagagtgtgggggccggggagaatttcagggaaggagatcgctctgatgtctcaaaactgctttgacttagtactcgggtgactctgtgctacacaaatatagacacatgttttatatttccttggttaaagcgttcaagtcatacttctttctctgtccttatacaagagtttctcaagacaatttgtatataaagccttatgatttcttgttcttgtaatcactatcacataaataatcagatcttgaaaaatacgcaatataaaggaaacgttatttcaagtgtgcaaaaattaacatttctgaactaggaacattagaaatactagtgctttttaaaaattgttgttttagtagatatatttagttaaggattcagaaatgccacaaataatgaaataacaaattagtactaatgctagttgatactataactataaaagatgctattacttttcccgtatcatagaaaaaaaaaggagccatatcagcccattaaggaaaacttcttggcttgtgtagaactttcttttcttcgaactcaataacagttaataaattaccagttaagcctgtgcctctggaagagagcatttactcaactgtgtctcgacatgtctggcatctccatgtcatagtgatttaacagtgagacttttcaatctcagccttaagtgtaaatccatgtgatctgccc

SEQ ID NO: 14242 - DNA, 1050 bp, Homo sapiens
tagtatatgtaattcatgggcatgtcagcctaacttagcagtaccatgtgggtgcagtgagtttgaaaagcatttcaagatccttgtcaagattctttggcattttgtgcatgcagttttaccttaacatcaggaacacacagaacaaaggttgagtcctggagcatctctaagtaattatttttcctcctctcatcatttctcagacctggagagaagggaaatataatgggcaggaagaagggattcagctcccattgctgcagaggatgagcaagagaagtaggctcttatgcatggactctggaatggcaacttcaggaatagtccttgcagcttccctgctgggctggctggctcagtgctcagtgccagtcaactgagctgcatgccagagttccaaccagaccttggatccctagtcccaggtgttagaccttccaccaagggtagtgctctatcctccaaatatgcctccaggccatcttgcttcctttggcctctgccatgatcttaagtaattttgtactatttaaatgtatattacacatgcaaacatataaacacgtaaacacacacgtctagtctgattaatactaatcagccaagtattattgatacttttctactttgtaatcttcattcagaagtcacaaaaaaatccgcagagctcctgatgtgagagttgagcagtatagactgctgagaaccccatctctactgcagggtgagagaggactgtgcttattctcctgataagctataactcaacgagaatagcactacagccctacagttctttcagtaagtgctaataatgtgctttttcagaatattttccatgagtacttggccttgcctaaaaggcttgtttccatgacaagctgtagtctactcaggggcagaatgatcatttgctgtcatggctgtcctgataatcagtcagtagccactcagtcccccggagtgctttaaatatcagaatgggatgttgagatgctttcctgattgtaaagagctttcactgtatatgttcttggtagcacagct

SEQ ID NO: 14243 - DNA, 1044 bp, Homo sapiens
gggcttttctctttagaaacgcacttagtttatgatgaattactaacaggaagaacatatctaaattttcacccacaactgagttgtggttttgcatattgcttcaacccatagctccaaacttcacctttggcgagggaggattcttttctcaaaatttaatagcagcttagactttgttcaaatcaactttctttcgtaatgttgtaagtagaaaaattaggagcaaaatacgactttcatttgctagagaagacgtggtttgtctaacagcgacaatctaaaagcaaatacttctttctcactgaatgaggaagaatgaggagctttgtgactgacaagtgaaaggatgatatatttgatgtgttccatttatatgtaaatgctaaggaacatagacaagtataccaagtaaagttttatttatttacctagaataccaaagttgcatgtaaatgcactgttatgtacgaatcataagaggttgcaaggaaggagatggatagatggtttgaaaggaggtagatacatagaaccaacaatgctacatttatatgagtagtagatgataaatatcaagtatctctcccatgcttttggtttgaagttagccagtattctccaccagtaaatcagaatgtgttcattttacaagtgactgtcattgctctccttccttctgtttttcttctccttccctttcttgcttttgcttcataaatcttcatattttattctcaagtacatggttgtcatgatttgtagcagcagaggtaggtatgcagctggctattatgtttcaaaatagaaatgccagtatccctatcacctcccccatcacgtttacattgattataaggaatattgacaccaggggcggtggctcctgcctgttaatctcaaccctttagtaggctgagtggggcggattgcttgttctcaggagttcaagactagcctgggcaatgtggcaaaactccatctctagataaaatagacagattagccaggcatggtggtgtgcacctatagtcccagctactt

SEQ ID NO: 14244 - DNA, 1044 bp, Homo sapiens
ggggggtttcaccatgttagccaggctggtctcaaactcctgacctcaggtaatccacccacctcagcctcccaaagtgctgggattacaggcgtgagccaccgtgcccggctaatctcttttcttttaaagatgtgaataatccagactgcaagcatttcaaaaatatggttatattattaggacacaaaaataatctattcatattaagcacctaataacaagactgaagaattgacctttgactgtctaatgattcacttaagccattatatggaaggttcttcaaatagtgtaaaaggatggaggattgtaattagctgaaattttattaatttgaagcataacatacatagtttgttaaaagaccaagaagccaccatagacaattagcaatggaatatttatcacaaaacttcctcaaaagcagtgaagttagaggagctagaggtaaaggtgttttttggttttgttttgtttttgaaaatacttgcttagagatctgagaatccagaatttaacaatacaccactgtctctccatcctaacatttcctattgttctgttgcttggcaccttctctagggctgtttcctgattctgggaggccctgtcctcagaattttagggctggaggagaacctacaaataatacagtcacatacactgctcaaattatagatagaattgaaatccagagaacaactttttacagatatgttaatgaatccacatttcctgatttcccatacagaaggcagcatagatcgcctcaaagctcccaaatgctgggtctagattgcaagtcttccagtcctggttaagttgtttacagcagcagtgcaacctcgggcatgaggcttatcgtttctaaatctcagttttattatctctaaaatgggacaataatatccctgacctcacagagctgttgcagggcttaacttgggttaatagttatgaaaggcttgaaatagggccctgctcatgggaaacaccacttgctagccagaggcagctctgttttattaaaattgctctact

SEQ ID NO: 14245 - DNA, 1049 bp, Homo sapiens
ttttctgttccaatgtggatagcccttcattcttagctcttttctgataaagatctattattgaaacgatttggttacacatcagtttttaaaaactagattatgaacttcccaagggcaagaaactgagccttccttatcattatatcaagcaacaagcacagtttctgatttgatgtaaggcattaacaatggtatctgcttttttggaatgccttttcctcttgtttttccttgctaatataaatattctacatcttctgttctctactgaatactctttaatctgtggatgttgtctgctctccacaaacacctgtccttatttttgaacctctgtaacaaggcttttgtcatatatcataagtatcttatcctcaaatacttaatattataatacctgtacatcggtttcatctttcactctcatgcttctcagtttagaagcttattggaggcaaaaacaaagcaaaacaacagcaacaaaactttctcttactcaatatacctgtatctcctacatagtaaatttcaaaatttgatatgcatgctttttatttggtccagcaacatcctttccttcctctctattctgtaccctctcccagatattggcaatttacttaacaggttacatagaataatgccctctgggcccatagaattgtgtagaaacacaaaccttggagtctaacagacatagcttggaaccttaaatccatttctttaatctatgtgtgattcttattagattaactctaactgtaaacctaattgttagtaaaatagagttggataataattcctatgtcaaaaaacatttaggaatattaaataaaataatttatataaaatcacaaagcactgtatctggtattagtagatacgcagagatgaaagtactgttcttttcctcttcaagattcagaccatacatcttctgacctcttccctcaatccgtcggaactatctctgcttttatgtgtctgcccatcctatgcacatccatgtgtgtccgggttccccaagaccaccctcaggctccatg

SEQ ID NO: 14246 - DNA, 1034 bp, Homo sapiens
gtgccaaaatcggacagattttaatttgatatttatcatttctacttgtaatagaaatgtcatcaggattcagttacttctatgtcaacatggaattatgtaatctgctctcaaaattcaaaagactaccaacatgtattaaaatgtcgatcaagaattcatatatacatttcaagaatatgttgaattaacagatgaaaaaaactccttagaaaaagtggtcaaatatttcaagtgaagtttggtggggaagtaaaatctttaagaaattactatgcatcattgtcagttaagtgcaatataaaatggacatacataaatgaaaaagccagaataaataaagttgacagagaaatttaaaagaagcaagaagccgttttccacacccataccctggttgcacattgaccacacactccaaaatagggaggaaaaccgagacaacaccctgaaagaaaacaaaaccagaaacagcactttacaagaaattctccagaatcttataatacaaagacattttctacaactcagatctcctttccagattagcctaatttctttttatttcaagaaatgtgcttctgaattatcaaataaactctctcaatctctgcttctgcctgaagttgaatggatgaaacaactaaaaatctgaagattttataagatttccatatgctgtagaccacaaggacgaaggcagttgttgtcctacctggaagcaggcagtgccttgactcatttgctccagaccctgtctctgacatgcttggcagacattctccccagatgagtcactcctgagacctgcatttgagtggatcttccatgtcctgcaaccctgatttccacctcagccattcttacccttattaccttatccatgtcattattgaacttgctccctgctatagactttgcatgtgtgtggacctccaaaattcctattttgaaatctaatcactgatatgcaatagaattaagtggtgaggacttttgagaggtgactgggtcattgatatggtttggcagtg

SEQ ID NO: 14247 - DNA, 1032 bp, Homo sapiens
aattattaacgatcgtagttattaataatcttatattattattttgtgtgtatacataagtatacatgtatatgtgtattatattataataatatgactatataaaatcattatctgactccaaaacatttcaacagttcaaacagaattatgttaatattttttcatgtcttcatcgtatgtcatggactgcatgtaaaacaattcatttaagcattggccattaagggacactttggtttttccagctccctcagttttgcaaataatgttccaacaaacatttttgtacatgtatgtatgtgtatttgtgtgactatttctgaaggacagctttctagaagtgaaacgttgacctcagttaacctttgactttattggtagtggaccaaaagtgagcaatgcaaagaaaacttcgtgacttccctggatttacagtatatcatatgaacaaatgtgtctgactgtctgtagccaagtagacttttgctctactatctgcatgcatagatgagacttatgttctgcctgaaagataaaagaatgttcaaccatgaacttttgaggataggtgtcctaaagcattgaatgtttggatcctttctctgctacctcactaaagtgtcaaataaggaaggaagtaaatttaaaatgaatagtttaagaacaaccatatgcaaataagtaaagttagggaccattagacctttccagacaagattttattattctagcatttttaaatttttttgacaattactgtgagattcaattataaatattgatttattacctaagagggatgtcataaacttatcttgattaaaaagatacatagttggtcgggcgtggtggctcatgcctgtaatctcagcactttgggaggccgagtcgggcagatcatgaggtcaggagatcgagaccatcctggctaacacggtgaaaccccgtctctactaaaaatacaaaaaattagccgggcgtggtggcaggcacctgtagtcccacctactcgggaggctgaggcaggag

SEQ ID NO: 14248 - DNA, 1097 bp, Homo sapiens
ctgtatgaacacaaaatgctatacgcagaattgaagagtgctttccacatgtgttcaatgaatgatagccgagttcaaatataatgttcggatgacaaaccttccaatgatggggcctgtagtgttgtttccctttcacatttcagctcttctggcctcttctctcaaatgtgagtgcccttcttggttctctaatgagaacctcttgttctattttcctgggtggtagcaagtttagatattgtaccctgctggccacttgacacttagcagatgacgtgctctgatttgtgtttcaggaaaatgtgacagcctcattaaaagaaccagaaagctttcaaactggtatgaaattagggaccctgaaagaaggaaagcatatgaccaatatttgcctaataacttcttagagaatatgtcttatacttgtgagtatacaaaagaacccaggcacagacattatacacttcatttcaaaaatgtctaccttctgttaacaaaaaaaacttccatggtaggatctgtctctacccatatacgtacttggatagtgcctcccataactattaaatctcttgttcttgactgtgtactatgaaaaatctcaagcctgcagatacattgattgaataacacaataaacacctacatttaacattctgctacattttctctctctctctgtatgtatgtatgtgtatttttctctaacccattttaaagtatgttgaagacattattacatttctctctcaaataatctagcatatttttgttaagtattagttctagtaaaccatacgagtatcaatatgagaaagatcagaacttgacagcaatttgtgaacaaatgacatagaaatccagcttattccaacaacagtgtggggcaggagctaaaaactaacacaattcttaaaagtacagtttctggatgatagtatgaaatatagttctatcttgtgtttggaccacatcaaaagtattttgtttagtatttggctgtaacattccagtttatacccttgaaaagggaaatttagtccttgttccattgacaatgttagggatttgagttactataataacttatatgc

SEQ ID NO: 14249 - DNA, 1020 bp, Homo sapiens
tatattgaaatattgggcatattttttatttatttcaattaccatcctattgttaataagctatcataaatgatgactttctcattcttttttggccttctgtactgtgctatagtgatctggtggacaaagaacaagactttacatttagaaaatttacatttaatgctgacttttccatttacttgctgttaaacggtgaataaaacatttaatcttcaaaatcgtgaaaattatgataataataccaatagtaactattccttagaatttttatgtgaatcttacaaaattttatatatttgctttaaaatagtattctttatctctaaagcttttttaactattatatttatgtagcatttatatttaatgctattaatttaaaatttaatgttatattaatttatatttaatgcagattgctgacattttgaatactagttttaatgctatagtatagtaatgtcacaagtgtaagagattaaatctcagattccaacttgaagctctgattcctctctctgtaaatcttattcacatctaataagagtcagtggttcaaagctcttagaaccaaaattatacagtttaagaaattattcctattctaaaataatctgaagtctattttgtctagtgatctcttcctcaaaaggcctacagttttgtatgcaggttaaaaaataaaaaatactctttatagattgctgtaacatatagaaatcagatttattaaaatcataagtattatagatggaaatctgattatatgaaaaccaaacatacatttcattttaccaaatctaatgtgctgtcaattttgagactacaaaagagaagaacacaattaaaatgtgacaagccattgactttattatacttctagttttcagatataagacatgaggaataaagttgtctttgaatcacggaaatttgggacttttaatgagatttatatgcactttacctagcttagcttaaagcattcattttgctggtcatacaacattaatt

SEQ ID NO: 14250 - DNA, 1044 bp, Homo sapiens
ccttgatacaaagcacagtagttaacccataggtaaagcaaacagactgcaagactcatggttccaatgcacttgaatctcattgctcagttatgcagcaatgaatgatccatcagtttggaccacaaatcatggtcgtgaacatcagggcctggggacaaacagcacaggcaaccatggatagaccgttctatgccatatctactcgagatgaaaagcagtgttgatttcagctctcatcttttcatcgtccatttgggttttgcccttttattctgttgcttttttctgtttatcaacaaagtcagcaagtgcctggttccatccaagccatctctatttggagctattaatgtgaataattacacaactaacccttctgtctacctgccttttggtgttagctacccaaattattgaattaatttgtcctcttatgactatcaaaaagtgattcttttggtaattttcgcctaccggtttcagcatggcaagaagacaagtgttggtcctgtatgaatatttttattatatgtcacaatcttctgtttttatcagtagttctaacaattgagtctcaaatcatatcaattttcagaaccacatttatgaagtagaaataaattttagtgtactgaaatcaaatcattagacctatgtatagacaaccaaagtgttaaataatgaaaacaatgtcttctgcacagaccatcgttttctctaatggatatatgtgtgtgactgtgtgtgtgcatgtatatgtgtgtgtatatatataattttgagagatggagtcccactctttctcccagcctggagtccaatggtgcaattatagttcattacagcctcgaacacttggggctcaagccatcctctcacctcggcctcctgagtagctggaactgcaggtatgcaccaccacgcattgctattttttgtttgtttgtttttattttttttacagacatgatttcaccacgttgcccaggctggtcttgaactcctggactcaagtgatcctcctgccttactctccctggg

SEQ ID NO: 14251 - DNA, 1084 bp, Homo sapiens
aggtagtttacaattctaataaagaaattgagaaagaacagtttagcttgtttgcccatttctggtaatatatattaccagaattaaaatatacatatatttccattctaaaacagtgatgtttcaaaaatatatgtaattttatgagtttttttcataacctacacataacattgaacaaagatgtagacagttcatccctctcaagtctccttgcctcttcaaaggtcatcagacacttttggagaagcagcatgtaggtttctggtttttactctagtaattttctttattcttatcctcaatgaacatcagattagtgagggacacccttcttgtctcaaactctgaaagtatgatcttatggcagatcagtattttaacacattttctatggctgacaacaatgataaccatcttgtctacaaaggctatcttcttcctatgtgtgatttcaaaaaaatgatgctttatgttttgaggaaactgaacagtaaccacaactttaattatgaaaacctcaacaccactggaaatcaaatcacaccctgtgttagtagtattgtctacagggtatacaagacacttagaaggtttttccagggaggggtttggcgtatagaatgtatagtctgtatggaatttgtgaacattcatatgtgtactttctgccaagtatgcagataaactagcagagtctatttggcattggacaagatatcaaaaatcaactattttcattttatgcttttgtggtttcattaaaatcttcatagaaatcaagatgatgacttaaactccatttctaaatcaaagtacctaagagctaagaacatttttcacatttttgttgacattgttgttgctgtaatttggcgcatctctttatgtaccacaaaaagcacaattgtttgtagtatctgatgaaatcagctctacactatataggccaacacatctgttgtcaaaattttcccttttgttcaaactagaaatatcttacttgcaacttctgatgcaggaaatgtgacttaacttagtttcattgagcaatcaagagaatgatatgatgatgtatccattt

SEQ ID NO: 14252 - DNA, 1067 bp, Homo sapiens
gaaatgagagttgcagcaaagtaaagttaggcattgctatattctgaatgcatttgcctgggttggaaatatgatcccccacgctgtggtgttggaggtggggtcttttagggggtgtttgtgtcgtgagggtggagcctcaggaatagattaatgtcccgattaaaggcacatactggagtgagttctccttcttttgctgttctgccatgtgaggccatgacctttctcctcttccagaagacacagtgtccaaggcactgtctttttttttaaattttattattattatactttaagttttagggtacatgtgcacaatgtgcaggttagttacatatgtatacatgtgccatgctggtgtgctgcacccattacctcatcatttagcattaggtatatctcctaaagctatccctccccactccccccaccccacaacagtcctcagagtgtgatgttccccttcctgtgtccatgtgttttcattgttcagttcccacctatgagtgagaatatgcggtttggttttttgttcttgcaatagtttgctgagaatgatgatttccaatttcatccatgtccctacaaaggacatgaactcatcattttttatggctgcatagtattccatggtgtatatgtgccacattttcttaatccagtgtatcattgttggccatttgggttggttccaagtctttgctattgtgaatagtgccacaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttatttcctgactttttaatgattgccattctaactgatgtgagatggtgtctcattgtggttttgatttgcatttctctgatggcaaggcactatcttaaaagcagagaccaaactctaacctgccaacac

SEQ ID NO: 14253 - DNA, 1035 bp, Homo sapiens
ccttatgatatccagtaccatttcctggataattttcagaatgacctcattagttcttctccttaatcctctgacatccatctccctttgcaactgccaactggtttatccattcatatagtaacaattaccaaatggtagtttcagatgagaaaccaatgatagatccagttagacatactgagcttaggagttcacactcctaaatttcttcaacatgtcatttttgcagaacttcctttcaaagaatctggaggggccaggcacggtggctcacacctgtaatcccagaacttggggaggccgaggcaggtggatcacctgaggtcaggagttggagaccagcctgcaacatggagaaaccctgtctctactaaaaatacaaaaaagaaaaaaaagaaaaattagtcgagcatggtgtcacatacctgtaatctcagctactcgggacgcaaaggcaggagaatctcttgaactcaggaggcggaggttgcagtgagtcgagatcacaccactgcagtacagtctgggctacagaacaagactgtctcaaaaaaaaaaaaatctggatatttcaaatctcctagggaaatgaaaattatttaatatcattcaccagacaaatatgaactgaaggaaagtttatcttaaactgaatctagtaggtggcctgtagagaagaaaccacatatatacagataaattctggaaaagatagaagacaaatatttatcagtgaaactttagggatggatgaatttctttaaaggatgcacaaaaagattagacacctaaaactatattggagagaaacactgtaagaagtggtataagatgagccgtctatatggagagattgagaaagggtccaagaaattaaaggaaaaataagtatttgtgtttgtttcagtggcgtaggggagaggatacgaaatacgagaaaaatatccaatagcattaagagggaacataaggcccagctctgggaaatgaggtttttctttgtggtcaacagataaatccattattttctcc

SEQ ID NO: 14254 - DNA, 1020 bp, Homo sapiens
aaagacaaaactatgaagatgagaacagattattgaccatcaacttcaggattgaggagattgtgtgacagtaagtggattgtatgagggagtttttgggggtgacgggactcttcttaatcctgatggtggtagttacagaaatctccatgtgttaaaattcatagaactatacacactaagaaagtcaaatttactgtatgttaatttaaaatgcaataaaaaataggggttcatatagtttcttgaaatgtttgagatttgccggattttctacaggttaatcttgccaaaaccccatgttgaaaacaaggacagaactggtgggctaaacttggaagcttggaagctctctatgtctcctgggatatttttttttctctctctctctctgagaacaagttcctcagctgttatactgagatgtttaaattcacagcttttaagctgcagctgctgaactatggctctagaaatcatctgaaactgagaatgcgtaaatattatatatacagtaatttagctgagagtcaacatttcctttcttaacccaaggttttgagttcctgaaattgccaaggtcgagtaaacttttgagccatccatcttattcgttttccctaagttttcctattgagttactatctctgtaccaagggtacaaatgattaggctgcaaagtgctttgaggctttgggaggcaaaatgtttcaagtgctaattattattatgcagtattctaattctgctttaaaaatcatcccatctaccttgctttctgttatacttccccttatcctcttcctgctgcttggttgatcatcctgctctaacttttttctgtggatccgtttcgtaccatcctttaaatgttgacattgtattaacatagaaacctagaaatgtcatcttccttcacatacttttttatttgaaaaattacattaattttaatgacttctcgaataatcaaagaagtagctctcaaacctctacttctgctctggcctctttattgat

SEQ ID NO: 14255 - DNA, 1023 bp, Homo sapiens
tgtcatggagtagttcaggggtctcctgcttcagagtcactgttagtgttttgtctgaaatacagtcagcatcagcactgtacttgcttaacccagatccctgagagagatgcctgaggtctgcatgttttaacaaattcctcagctaaaatgtaggaaatactggcttatttgtatattataaaattaacattccaggcttaatacttaagtaatatgttgatctgttcagcaaaccactgtgtcacacatttacctatgtaataaacctgcacattctgcatatgtacacctgaacttaataaaagatggaagaaaacaaaaaataacattagtatttcatattaacttttgtccttattgctcctcttttccccatctctctccttttgttctttttttaactgaattacaaatagtttttcttagaggaaaatgttaatatgcatcaaaataaatataaacatattttagcaattttaaaattgtttttaattggaagatgaggcaaaaattctgaagtaaacatgtttgtggctctaaaaagatcatactttccagagtcatctgaagggcttgtgaaaatacatctctgggcaccacggcagagtttctgatttcataggtctggggagggcccagaacctacgtatctcacacacatttccaagtgatgctgatgccactgggccaatgaccacatttttatatcattaccctggatttccctctcacgttccatttctctctgctctcttcagtctccctctcccttttacaggtaattttcctctttgcaggatatttggtcccctggttctccccaagtcataatagatctttttgtctctccccctccccatttcccattaatgttaactctatattttcaaacagtttgtagaactgattttacctatgttcaatgacaaagacactcccttagaagtattgagcttttcctgagaccttaacggaagacatgatcctggatggtgtcatgttaggcatcacagaccctca

SEQ ID NO: 14256 - DNA, 1047 bp, Homo sapiens
gttttagagttgggtacatatgtgtatatatgtgggtatatatgtgtatatatacacatatacatgtataaatgtgtgtgtatatatacatgtataaatgtgtgtgtatatatacatgtatgtatgtgtgtgtgtatatatatacgtgtatatacgcgtatatatatacccacacatctatatgcagaccgttcccaatttatggttcaacttacactgtttcaactgtgtgatgagtttatgaaaggatcagatactttattgacagaatacttcttacttgtgatgggtttattgggatgcaactcagtcaaggagcatatgtgtatatatggcagatttttttctaggaagatatctaataagtgaatacctattatggctgaattgtaactgcctctttatataaaaagaacaggacagacgtggatccttttctctgtgagtgagcctgaatagtatcttaagttaattacaattgaattcatgacatgtggtttttttgttttgttttatggttgttgtaattttatataaagtgggctaaatgaaatcataacatattatgtagcattagttttaagtttccatgctaaacataccctaatttatattttttccttataccttaatttacatttaagtttagttttagtgatagcccttttaaatgtaaatatctttttcaaaagataatcatttggctcttaagttaatattcaggtagtctgttaagtagcttttgttcagaatgcaagtagagtgatttcaactaatatatctgtctgaatgaattaagggtctttagtaaacagatataagaaacatgacaatagtgtttgcgaaggtgatagaacagtgattattataaactgtgaggagaaaagttgtgacaaatggacaaaagaacatttatataattatcaagaaatataaactattttgatgccatggtttctaatgttttggaaacatgacttaaaatgataaatgatagtgtctttttagttgactaaacttacaatatgttaatagattttctaagaa

SEQ ID NO: 14257 - DNA, 1030 bp, Homo sapiens
tttatatgggattaggctccaccctaggaactgcatcttaacttgactgcatctatagagacctatttccaaataagatcacctttatatgtactaagggttaggacgtcggcatatcttttgagggggcaacttagcccataacgcagaacaaaactgtgtgtgttccttagagaattcagcacagtgtgtcactgtatgtttatttttgtgactgtgttgtcgcacagtcatgagcctgtcttctgcagaggacggtgatctccattctgttcacctgtagctccagctcctcacatggtgattgacacagaattgatgttccaaatattttatgaatgaatctcttttctacttctctagtcatgtgctgaatgctccccactttttttctccttcaaggcagggatgaaagtcctgtcacaaagcattagttggtgtcaataataggcttctccctggatctgaaaagaaacttaaaaagctgctacactgagatgattatagaaccaagggtcctgtgaagggtcatggctatcgagtgcccgtggtggcattttggccagttaaatcaggatatggactgtggggttctaaacttgtctaagtttagcagcaaaaatggtttagatggaactagaattctgacttcagaaattgctcatgcttctattttgtctctgagatataattttgtttattctagtgaaagagttgggcaaaattgcagtttttctttatttttaatagttaacacatctattttcaattatggcttgagtcatttgaaataaagtagtctctgaactgggaatatatggcatattaaaatatcacaaatgccaagctttcctaactcaatgatattgcaaagtcaaaatggtattttctttcggtatcctagagagtgtctgtgtttgaggccacttagctaaaagcatgcatcagcccacctctttatgtgagtgaaagagatagcttatttagaatgaatttcataatttagattgctctgcatatggcatgctat

SEQ ID NO: 14258 - DNA, 1048 bp, Homo sapiens
ttttcataacaaaactatgatacaggtattatctccacttgcaaatgagcagcctaagatggtaagagaagtcaggtgactccataatggtcacacagctaatagttgagttgggtttagaatactaggcttgccaatgtttatctgtaaattattctcccatatttcctccaataccataaaatggcatttattatattaggcactcaagtatactgagtgctgcaggaagtgctacttagatgtataatgcagtatacacacacagcttggtagtcgtatatcacaatatttgtattatttcctaaaaggtaattttactgatatactacatcagtggaatttgtttactttttaaatttaggcatagatggaaagctagccgggagagagacagagagagagggcgggagagagagagaaaccacaaaataattaagcttgccttatagagaaatattgatttgtattagcaatggttcaggttttagctcgagctcttttgccccctggaagtgcaaagaaaaaggccaatgtagaacttgaatctacaaatgaatgcagtatttaggagagctgatcctagtttaaaatgaaataactcagcccattatattctggacatatcacccatgaggtcaattaagaggaaacatgtgagaggatttctgggcaaacctgtgctgggaaagcctagcctggaaaaccttagcagggtgtgtttgtgcttcgtattgattcctcctgccttgaggacaaatgcagtaggtgtgtgttattataagagcactaagttcaagtggcagctttccctcttttcatgaggcctgtctgcagagcagcaggatggaataaatcgcaatgggctttgttggcacactggccccagggtgcaagaggccaagtgggtgttggcaggtttatcgggttgttggctataactgctgggaagaatgaaggcccagcggtttcaggtgatctgccgaggaccctggggaaagctgaaaaaatgttctccaatgcttgacccagagcccagaacactcca

SEQ ID NO: 14259 - DNA, 1075 bp, Homo sapiens
gcagccataaaaaagaatgagattatgccttttgtgggagcatggatagagctggaggccgtggtccttagcaaactaacacaggaagaaaaaaccaaataccacttgttctcacttataagtgggagctaaatgatgagaactcatgaacacaagggaacaacagaccctgggggctactcgaggatggagggtgggaggagggagagaagcagaaaaaataactattggatattgggtttcatacctgggtgatgaaataatctgtacaataaatgcctgtgacacgagttcacctatataacaaacctgcacgtgcactcctgaacctaaaatttaaaaaaaataggaaggggctttctagacaagcatgggccatctcctatttattttttcctaatagagtgttcactattccttaattacttgtgctactactgctggtcttgcagtcgcaacccttctctttaaattttttaaacactgttttgttctaccaataatctcatcagattatagactatatgaatacatttcaatttaagagaagtgggtaattaccactctgttaaatgccgtgttgtcctgggtgaagttgctctaatgtggccccaagtgcttaggatgatatagatgcaaggacagtgtgtgtgagccaggagcataggcctgtgttctaaactggcttcaccatgtgctgcatgtatcataacggcaaattgtgccttggtaacctcatctgtaaaatggggataatggtagttgccacctcataaaactgtagtgaggattaattaaactaatccatgaaaagtactttacagagtccttagccaatgagaaacattcaataattattaaccatgttattattcaacaattgtttaaaaatttggtaaccaacagatgatatttattatagactcttaagttccaaagtaattgaaatttaacattattctagtaaataatgtcaaattaaagaatctgggattttataacaaaattcaatttttctggatttcagtttcaatagaacagtttctttcaggaaaacacctgaacaactttttca

SEQ ID NO: 14260 - DNA, 1562 bp, Homo sapiens
tgaattctgcagagaccaaaaccttccctccatgggaggaagggcaatatttatcatgcttcagtggtggctggagaggtcgagaaacttgcacagacacaacataaaactgcgggtagcaaatgtgaatggtgagccactgtcagaagcaattacaaagggagattacattgcaaactctgacattaaaacctgtgtaaataatacatccaatctgatgggggccagggcctgctttggcaactccctgccagttcttgggtctgggcttccgttctctctcagcctctctgggcctctgataaggggaaggctccctgggtccccgggctgcacaggttcttgaggactggttgcactgcctggcctgggtctttccttggccagcggcaccctgtgttttgtgcagaactgactaactctgcattaaccttcttcaccctctttttgaagtagcagattctctgactcaggcctcacaaactctctcactaaaggagtattttccttctagctttttccccccggacttctggcctttgactgtggaacgggacagaaggaaagacatagttctatactctgaatttctctacagaaatctgaaaatggagcttcctgcaaagagaagcctggggctccatcagctgcatcttgtggcacagcctcgagttcggctccgggctcagctcagagtgcgtctgccatacatcaggaaccctacgtagtgtcaggagcttgctgtcatgtcacccacttacccatacagctgcatgagctcacaggattatctgcatttgcagatgtgggactaaggctctcagggctggatagctccatggcatgtagccatgaagtaagcggggacagtgagaatctgactgatgactctctggctgtgtcagtgcatggatatgctcttttaaagacgatgtggactttgccaggcacttacttaactaaagtagaattggggataggataagtactaacatgaaccctgagaggcaaagtagggatggaggaagcgcaattgctcctctgggctctgagatactcgcgtcttggattcttaaagttgaagcagagacagaagaggctctgtttggcataacttaagtgacttaactaattatttgctgtagtatatccataaggtatctataaattaatgaagcttaattaacttaatttaaatgccaaatgaatattttgattggtgagattttattgatatgacaattcaactaggacattaagagaagcaaattacattaatttgtaaatacactttagatcataaaaatctatagtaaatcataatgctaacttcagaagcaattgaaagggttttattcgaagataaaattacacatgtaaatactctcttataattcctggaacatattatatacagtataaacatttgcctaaaatgtagctatattcttagcacagtgcaattttaatgagtctaatacggaacgggtcaggtaacatgtatataagtctactaaactgtcatggggtgaattatggatagttgctcaagacataacaaa

SEQ ID NO: 14261 - DNA, 1029 bp, Homo sapiens
tagtcccatccagtctacattgcagaagacccatcctcattttcctccttttctggaatccactattgactttagcttcttcagcagattcctttgccaattccaaatgcacattcctggaaacctgtgaattcgattatctctgtttgaaaattctacgggcgtttcaaagtcaatgtttccaaaccagcttgtcttccctgactgtcttcttagccctaatcccaaaaaacttggtgatttccctggttaaatggcccttctcttgcttaatgatttctccttccttcctttctatggagggaagccttgggaagatctccgcctccttccttgggctacctgccttcctcggccggtggatccccctttagtccaagctggttccatctctgccatgtctctcctttatatctcaccaatagcgatatatttcacgttgttatctttttcctaggataaaaattctgtgttaattttagtttttaatttgagtttaccattaatgaacatcaaagaataatggacttttaaactcggactgggaatgagtgtgtgtgagtgtacattcaaatagcaaccctaaagcttttgctgttgttgcaaaggtttgatgctgatgctgaatagatagttcgttacatggccttgacagcgcttataaggacgcagaggagaaatgtctatcctgatgagtagttgttcctccccagaacacctaaggatgcacagggacaccgtatacaacctctgcagaccgcatgcctcctcagcctgagctggttcccttccttactttgagtctaggaagctcagatagaaacaaatgagatattattggttttttacttttctcttgatttaatcttatttctcttgcatttattccctttctcattatttcttcctttattctaacattgtagtctactctttttatttttgctagctgccttaacttgttttgttttgttgttgttattgtcatgaggcaaaatacataagcgagcaatgaaagattcactcctt

SEQ ID NO: 14262 - DNA, 1178 bp, Homo sapiens
tatagtccttaatcttttttacttttttttttttttttgagataaggtctcgctctgccacccagactggagtgcagtggcacgatggcagctcactggagccttgacttcctggtctcaagggacgctctggcatgagtctcccaaagtgatgggattacaagtgtgggccactgctcctggccatgccccttaattttaaaaatttcttatttggggtcatttttgtcttttctctcaggaacttttgaattcctatatcttttgttgtatgacactcttattttataatggttgtttatgtctgttttttttttttgtcttttacttatgctaggtttttttttttttttttttgcagatatcaccccttgtttcctacttctttgtgtttatacagcagctttgtttcctgctttcacctccttcctgcccatgtttcaagtggggaaatttttgtgctgagtggccgcacgtggtcccagtagtagaggcaaccttaattctttgcctttcaagctttgtgtcagcctcacctgtatgggggaatttgggctgaggtccctaatggctcttagaccggagggtgaagagactgtattgctgctagctgaactgtagattggaaaagtgacccaaagagaagccctgtcctattgccaccaacactcttccagcttgagagaagaataaactttcagctgatttagagccagtgggcctttcttggacagagggaggaaggtgtatggaggctttgaccatagcagtttgtagtgtttaagtggcatccatactttatatgtggagcgtttgtctgagttactcagaagaatatcagcgtccagcctccaagaataaaactccaagaactaggggcctggactctaggtttggtctttattacactggggatgagcaagaacaaccagggtgaactaggaaaggtgcacccacttaaaacgacctacgtgttgaaaggctgtggtttgatgtttgctttactccaggacaggtgggaagacagggagaccttggaagaatgactggcaactgctgctcttttgtccagtttcccaatatgagggaataagatttttggtaaatcaatctgtgtctctcactttcatgcacacatatacaaacaaaaaaataaagttagaatcattggattatat

SEQ ID NO: 14263 - DNA, 1021 bp, Homo sapiens
gcatagcatgggtgacgagggcaagttgtttatatggagccttcttggctttccatttcctaggcagtgtgctgccagccttagtattttgtggtaatttttgctcttcaggatgtatagaagaaccaggtcagggactctctgctaaaattgtagaaaggggctcatgggatggtgccctggagagacaagagcctttctggaatgggctctggttctagttcctctttgaccagattgactttgggcaactcactccatagctttgcacctaaatctttttaaatgcaaattgagtggatcctaccaaatggacttgaagtccctttgtctaagattctgttctgtttttttcccctgaactctaccagttttgataaggtgaaaaattcaccaaagttctaaggctctcttctattaccaaatgacccatttatctaagtctgtgttatcatcctaattttccagtgttagtggaaaatggaatttcacggtgggccttgtgcacttaggtcttgattatgcccttgctcctcgtacggtgaaaatagttagactcgcttcctaagcctcaggaaatatattatggcatgcatccaggagttttgttggctgaggatagtagtcataatgcgcaagatatttcaactgtaagaataattattggtcactttactatctctaagttgtcaaaaacttctcatgtgcctaccctagattgtatatactttcttttccaaatctctgttttacatggagtcaagtttccatttgtaatttaaagataacatctttgctaaggaaaggctgttcattgatatgcagattgagaaatcagcgtgtcctttagggatttcaagctgtggaatcaaccaaaagtctgcagaataataggacccttgagccttttatgattgtaagactttgatctgctaccaacaggtcactcaattttatctttgagcctcacttaatgtgaaaaagtgaagcctgatctccagtaagtgcttttaatgcagaa

SEQ ID NO: 14264 - DNA, 1436 bp, Homo sapiens
tatttattatttttatattaaagataactcattttaatatgtactatggaacacaggtaaaaataaataagattcatatcacaatgatacaacaatctagttgataggtaatatataagattttcatttatggaaagcatcaaggcaatatataatgagtatgaattaaatgccagaatgattgcctgggctgaggttgttgtggtagaggatataaaagaagttttgagacagaattcaaaacatttgttccattcaagtaagtataagagaggaaagcatcctaggccaatgaaaacatcacaagaaaggatgaaaaattactctattagaatgttgaatgaattgaaatttgacacacatcaaaaggactagtccaaaatgagtaaatttatttcaacacggcaagactaatgtcaaaccacttagaaaaattgtccatgagggagagaacagggtactgtgctagggtagaaacaaccagaaaaaaataaaagttgatggatttaggacttatttgtaaagaaaaggtggaagaacatgtcaacaaacggaatgacaacagcaaataagtggagactatcagagattcaaatgttaagttccagtgactggagattggatacacaatgagtaaaacgaggaggcaagaattgggaagaggagatagcaccaatcaattttagacctgtagaatttcaggtcttggtgaaaccccacaggagatacttttagatgaatggaatctcaaagggttttaagctggaaatttgcatctaaagggaaaaattagaactgctacttgatgatgaaaggatggaggctaccaatgaaagggtagcctaagaaggtgggcaaggataggagcccactcaagcgatgaaggaagaggaagaaccagaacgtacacagggaggtgaaaatggaacttgaagagatccgggatgaagcagcatttaagaagcttatgggcttgggtgggagagtttcaagaacggggtggtctttacaacatacaggtcacagaaaacttgagggagagaaaatgtaacaaaaaatagatcttccaaatcagctaataaggagatcttcccagtagaggcaagaacacttaggatcattctttaaatcacagagctaataaattcagtgagggttaatatgtagatcgcttttcaaaagaattatgaacacacctttcctggatcacagattacctagttttggggttttctactgacttgataatttgggggtattgcagatatctagctttctctcccaaacctatgttcctttcttcctggttttgcatgctagtctccaagaacatgtatcagccccttgttgctcctaggtgtggccacctgaccagtttccaaccaactttagaggaacaggcagatctgtgagatttgcatataccttgcttgaaa

SEQ ID NO: 14265 - DNA, 2055 bp, Homo sapiens
tcttaaaatcacaatagccattgtaatagtcttgttctgatggatcactcctgctacattatatcattggccacacatccaaaagacataaaaatatttaaaatatgaaagcagaggtcatgcctcttttaccaaatcatatttcataacttaaaagtgatctgaacaaaaatatcttagaataaaaatttaacttgtttgacaatgtaaaaatgttgataacattatttgaacatttatttagaccctgaagtggagaagcgtatcattaaactcattcttgcaaaaatacatatgcattgtaaatcttaaaatttataaattatatatttatataacattatgtttcataaatagcataatgttatatgtctatatgtcttatctatcaaattcagaatctttatttccttctgactctctaaaagagacagagaaaagagggaggaaattgtaatgaaatctttcaagaagtgttcctgtaaatgatgaaactagtcctactcctatatgcattgctgagatatttcaagccataaatgatgaaaggatgattccaaaagcttccagagaggggggaaaaggtgatataccaggaatcagaggtcagaatggctttggatttctcaacagcaaaacccaggtgagaaagcagtgtatggagcagtgtgtggatgtgcacgcgtagactcattttaggctacacattgattacacatgaaagtttcaaactgaattatacaggattttctttttatttaagggagtcataatgaacgtattattcttagaattctttgatcttaaatatgaactccacattttaagtatgcacatttgcttaaaagtacaagaaatatttcatgtatatattttcaaaattactttgaatctttccttacattaaattttaagaaaagaaacaatttgtaaccataggttgaagttgaaacaatcttctttaaattctgaccccatagccagtcatgcctcctgccccaaattcaactggcactgcaccgtgcttgatttttgacatttcctgattttctcttgctcctggatagtttgcaagggttatcttttggaactggaatgttctcagcctttgggactagatgcaagtgttatctgcctgtgaatcccttcctgcttctctgacaatgcagtggcacttctgtaacacgtgtatttctggcgtcactgtcatgtttgttaccctctgtggtatttgtgtgtttcttcacacagtagtgttatattatggacaaagcagggcccatgccttatccaggcttctgccctatgcctttcttaatgtctacttcggagtcattaaggactttgaaaaatgaatctattttaaaggatttatgtcatttatggtaatttaggcaccatgagtcaacaaaattatctttctcattatttttgaaattttatatatagtgtagataatgtgtttcatatccagagattttggctaagcaacctacagcactggagagttcaacaagaatgtagaatgaaacacagaattcctagaagcaagcctataattctggagtaaatgagtcacatgaaaagtaaatgtccaaaggcatcttttgtgggaatgatcaccataggctgaaattgcgaggaactagaacaattattattatggatttgtgtaagacgataggtgagaacagtcaccaaaaatgggagactattttaatgaactgtatgtgaattgatgagggtctgatatggtgtcagaatagaaaaatagatacaatttgcttatgaagaaaaatagatgcaatttgctagttgtaatagatgccatttgcttatgagctgtacagggctcaaggacctgcttgcaaggatatatccattatccagacatgtattggaatatacactcattttgttttattaaaacttagttccaaccagaactagattgatgtttccttcttcataatttggatccttctctctttacacaattttcttgtagtacacaaggttttatgtgtcagtttttaattaaattagcaagaccat

SEQ ID NO: 14266 - DNA, 1047 bp, Homo sapiens
gaatcattcacaaagttttctttcatactttgtttctttcagcatgaagcaattctaaaactccaagtgagtgaagaaaatttaaatggctttcttctttttatgaaagtagtgggaagggctgtacaatcaaacagacctaaatccagttacatttcactcagttggaggcaaagtcaaccccataataaaaattaaagaaaatgactctgaattactccttatgttgcatctggcatttaattgatgtgtataataaagtaagtaaaaatcttctaatcaaattttacatttgcatactgacattttatctaaaagataggtttggatgtactgaaatctttcagtcagtctctgaagaagtctcaatgctgaatgatggaagcctattatgtgcagaatacgtattaaacttggtcactcaaatgaagactgttactcatatgtcactgcatttactaaagctgcgggagggaagaggtctctggaatatttccatccatactcgatcttatactcatttccattttatgctcatttgactgtttctttttattacttggcatcacgaaactattgagttatcttaatgggaattctattgttactctcatctttattacttccattaggcatttggatcactggttggtctcttttctctttactgtttctcagttttacatttacatgttatttctatcagtaagttttataacagtctttataaactctgtgctagagtttctaatagaatgcttacaaacaatcctacctatcctatgacttctatgtttaatccatcaactacagctaatgtagggggatttcaggtgtctgtaagacaaaggcatatctcagaaggaagtgtggagggtgggggatgatgattgagcaggagagtcatcaaaactgtacatgagaaaggtgcttggcctcttctcagttaccactgcgacatgacacacaggctcaacgtcttcctcataaggcaatgtaaactgatacccacttactccaacagaagtcagcttagagaaattcaca

SEQ ID NO: 14267 - DNA, 1090 bp, Homo sapiens
tcactatttttatcgtttcctgttttcataaacactattgggtggagtatttgttttaggtttctttgaaggacagtaaatgtacaatgccttgataatatgccacactgattactttagcagaaaaaatacatacaggcatgcgaacctgcacacagggacacaggggattgggggaaagagacaaaagagagaagataagagggaaggagagacacagggagagattggtaatattgattgtgcaaactaattgactacatagttcactgttcaaattgatgtaaagcatttatttatgtgttattcataaatcaattcatctttgttgagtgcctaattttcacataataaggtaaaggagagagtgttaataggggaattgatgtagtaaaattttgcactattgctgtcatgctggaagctacggatgacaacgcagacttgggatttggagattatgtagactacagcccactttctgctcaatttccatgaattgaagagtggacagaagggcttgttagagtgtcagttttgagggatttggatttgaagaaaaggagatgaatgaatggatcgttatctagaaggttgacataatgtcatgcttttgataaaggaggttttatttagctgtaaatttgtcatgttatctgtgggcctaaagctcggtattctacagtttctacttcctgccatggactcccctaaatattgttaggaagattaaatatatttgaaaagaccttctatggcacctgatccaagacaatctctaaacaaatacaagtttccgtttctgtttttttttttttcctgttgaaaacattccagaagcagtcctgagttggtcattgatcataattgatatttttctagatatgcagtgatagcattaaacggttgttttattattactcgaggattcatggtatcatgagctgtgtgatgtcaagcaaatgatgtatgtgccccaaacacatcgtttgactcctaggatctcagtgttggaatttattgaatggtgtgaaagacaaaatttggggagatagacttaggtctctcagcagttttaaagtcctgtgtg

SEQ ID NO: 14268 - DNA, 1053 bp, Homo sapiens
ttatagtggaattatttataatcctttgggtatatacccagtaatgggattgctgggccaaatggtatttctgattctagatccttgaggaatcgccacactgtctttcacaatggctgaactagaaaattcccttttcttatgaggaggcacttgagtttctttagaggctgtagcttcctgagattgacagagaccttaatattgcaagattcccactactttgtatttgttgaggtgccttctcccacagatcattcctcctccactgaagataattttctctccattgccctcgaagactgataccttccccttccacatacacagctgggttttggcagtttccaccccacaacctttaatattactctttttttgttttggtatgtcagtgaccagtggctaaatataccaattggagccccagcaatatccaaaacctaggcagaaaagtcagagggtacactatgccagtaaggggcaaatttcagaaaatggtgttagagagatcacatgatcatctattgagcaggacgcttgaactctttctgttaaaataggctgcattacttgagccttgattttgcagttatttggaattgttctgagttttcacttttccatcactcatggtcacagatgatgcatgtgacagctatattaggcagggcatgtttataaaatctttgcatttatcttcttaaaaagcaattatctggaaaatatagcaattagaaagtatgcattagaaataagcccattcttgcttatataaaaatgaaatcagctatgcaactgcaattatttagtactagtttggcttgttatgaaatgaagcatgtgtagatggtgggccatgaaaagcataagcttccaggcaatattagaaaaatgttcctcagcattctataccactgtgtttctagtgccatcagtagaacatatgagatactctcttttaacaattttaatatactaaaatttatggacaagagaagagatgccctgaacccattcttattatttaaattgttttgtaaaagaattgtg

SEQ ID NO: 14269 - DNA, 1026 bp, Homo sapiens
atgtgggagatgaaatactacataggagaacctactgtagacattctttaaatcttgtacagaaagcataatttgaattatgtttcttaatttacctcctgtacctatgcaggagggtcatgtgtgtacgtgtgcgagtacacatttgtgtgtgtgtgtatgtgcattatttgtagaagccataaagcattaaggtaatacacctgctgctttatgctaatgtctttgataacatagacttcttcaaggattgactgaaaaatctgtttattcaccttatctacaaaagcactgctgatattttctgagggcatgtatgaaacgtaacaccctctatgcaaaatatcatttaaggtctgtctcaatttgaatatatcgaaatgtctcaagcaaatagaaaactgaagcaggggaaatagagttgcatacctagaagttccaatcatcattgtgtttttaagtgacttgaaatgacttcaaaaagttcagttccttaaaataacaggcatgatatctttctctaaataagtataacattgagcatactgccaacatgggaaaaaaatagaaatgaacacgaatgaaaattgtcttttctttttccatatattatactttaagttctgggatacatgtgcagaatgggcaggtttgttatatatgtatacatgttccatatggtgtgctgcacccatcaacccatcatctacattaggtatttctcataatgctatcctccccctagtcccccacccccctcaacagggccccggtgtgtgatgttcctctccctgtatccatgtgttctcgttgttcaactcccacttatgagtgagaacatgcagtgtttggttttctgttcctgtgttagtttgctgagagtgatggtttccaacttcatccacgtttctgcaaaggacatgaactcatacatttttgtggctacatagcattccatggtgtatatatgccacattttctttatccaatctatcattgatgagcatttgggttgtttccaattca

SEQ ID NO: 14270 - DNA, 1003 bp, Homo sapiens
gaattaaaccttttatagaatcaaactaagtgttaaatttttaagcactccttaattatttaaaggcaaactcaaatgcaattggaaatttgttgtgtaacatttaaggaaaataggaaaatattaataagccatgtcaccatgatataaatacctgcattattgattatcattgttttttatttgatctgcctgaagtatttgagacagagaaacaactttacgttatccctttaaaagatgggaaaactatcttagggaggttgagtgactgggccaaggaccccaaagtaggggtggcagagacactctggagagatctcagatgttattttagtcgagtgtgccttacattataacaggcaatgttttctctctaaatagcttattctcagccgctttctaaccacagtgcttacaaagacttccctcttatgatctgagtatatagatttttagattcaattttcctggtttcatagatggttagaactgaataatctgtagatcttcttggccaaacctgtcatttattacataagatcattaaagccgtaggagtttaaaactcactgaaaaacatagatcttctgattgaaaagctgaagttagaacataggtgtattggatgcagttcagagacctttctatacaattaaatcatgagctttatttttaggaaattgtccaagtcatattgaatttgaagaaaaaatgttcaaggaaacaatgggaaatttgtcgcattaaaacaaaaaaggatagggaagtgggagagagaaatagaaggaaaaggaaggaagggagggagcctcagtaatttctctccgattgggtaaaactgatattgggtttaagtaacagcattttttttttagctaagaatatgtctatatgaagaaacatactctatttccacctttttcctaccaatagtgatttttttttattgtgtgtgtgtgtgttttgttttgtattcatctctgaatccccaaaacactac

SEQ ID NO: 14271 - DNA, 1031 bp, Homo sapiens
ccggcccagcacaggtgtcccactcttgctgagtgcgtggaacccacggcagcatcgttagcttaacctcacctgccttccttccagcagagtcactctccatctctgcgggctgggtctgatcctgcttcaaaggatgccgttcacctcttccttcactggcgaagtagcctcatccttagccttggggatgaattctatttttttcggagtcaacacaatcatatgttttttctcttcaattttcaagttgcttaattatattcgacatatagtaagtgccctgcaaccgttgcttacacttctagaattagctgtatgtcaccaagtgtggcttcccccaaccacccaatcaggaagctactcgtatgtattttagggttttggacatggcaaaactcccctttaagtaacaaagtctgtgctggtaatatattgctgtgtaacaagccaccctagaacctaatggcttaaaaacaatatttattttatcataagtctgcatattgggcagatctctgtaggctcagttcatttctcctccaacttgcaatagggggcctggaattatctgtagattctttcattcatgtatttgatcattgacactggctgttggctggatctgtagtgagtgcttttggcttaacattatcatgtgccttctccacgtgtcctgggtttctcacaatattatgtctggatcccaacggcatgattcccacaagagagctgggagaagctgttttacctctaatgacctaatctcaggtgccacgtaacgttacttccaacacattctgttcatcaaaataagacattaaagttgtttcatacttagagggagagaaattacaccttaccttttaatgggagaaatgtcaagaattagtagaaatgttttaaaataatgagatggaaattaagaaaatggcagagtttcacatagaggtgcttgtagtccagcatttcagtgtagacagtgaagtccatgacagaacgctcatccttctgtagaggaagattagggg

SEQ ID NO: 14272 - DNA, 1026 bp, Homo sapiens
atggaagagaagtcccaaaatctgcagcaggcaagaaagtcaatgaatatttccagctggagtctcaaggcctaagaaccaggagggccagtgccagtccaaatgctggcagccttgaagtccatgaagtgccagtatacccgcctgtgtttaaaagtcaggaaggagcaatgtcctacctcattcagggaggaggagctctctctgactctgcctttctgttctattgagatcttcaactgatcgcacaaggcccacccacagcagggagggccagctgttctactcattctcccgataccagtgctagtctcatccagaaacactagcgtagacacacccagaacaatgtgggaccaagagtctgggcaatccatggcccaggcaagccgacgtataaaatgaagaatcacacccccaatcacatttaaatgtatattgcagtattggtaactatatgcacatagttatacaacagatctctagaacgtttttgtcttgcgtggctgaagcttcatacctactgaacagcaaccctgcttttttcctcttcccctcccctggcaaatttctgttttctctgagtttaataacttctgattgttcatataattggaatcatgcattattgttttctttccttccttccttcctctctccctcccaccctctcccctccccactcctcctcccctcccccctccccttcctccctccccctcccctctctcccccccactcccctctctcccccccactcccctctctccctccttctctgcctcctctttctttctctctctctttccctgtctctctcctctcctctcctcttctcttctcttctttcttcttcgtgccttccttccttttttgtctttcctttctttcttctgagacagagtctggctgtgtcatccaggctggagtgcagtggtgcaatcttagctcactgtaaccccgaactcctgggctcaggcaatcctccaaacccagcctcccaagtaactgagcttataggtgtat

SEQ ID NO: 14273 - DNA, 1069 bp, Homo sapiens
tgtatgtgtctttttatttatgtttaccatgcaaaattatgagggagttatagatctaggtgactgacaccattataataaagtttggatgagaactcatgacattcttaagagcatgtcgtgggaaacagtggtaacctctcacacaagttcttgacatactagagtactgtagatattgttggttaaagcaggtttgtttaatagctccacaattttatatggtgctgtaaatgtctgtcccagattgacatggtttcatataaatgtatttttctcactttgatagaaaactccgtagatgggatcaaataccttatttctactgctatgcctagttaccataatagttcctgagaactgttccttaaagggttcattgtctacagaaagcgaaataaataaatacataaataaataaaaaataaattaatctgagctggatctgaaatggaatggttttcattggttaagagcagtgtgttcattgacgaattattaaatttcccatctgagcagaatgatttgcaagcccctggggtgaaatcaacattgtggtactgtacagtatatttttctcttttcagtagcttacctctctgttaagcaggcaaaatttagcagagacagattatcaatggaacagagtaatgcttctttttttcttttcttttctctctgtttttttttttttgttgttgttgttgtttgtttgtttgtttttttgagacagttttgctgttgttgcccaggctggggtgcaacggtgcgatctcggctcactgcaacctctgcctcccaggttcaagcgattctcctcctgcctcagcctcttgagtagctgggattacagacatgcgccactatgcctggctaattttctaattttgtgtttttttagtagagacggggtttctccatgttgttcaggctggtcttgaactcctgaccttagatgatctgcccgccttggcctcccaaagtgctgggattacaggcatgagccaccgtacccagccatgattcttagaaaaactgttttgtgctttggaggctgagacaggagaat

SEQ ID NO: 14274 - DNA, 1027 bp, Homo sapiens
aactgtgtcttaagaggaattatcagacttgaagcctaatgcatcaaaagcatagtttagttggaattagaaaattgccaaaaatctcagtctcagttttcagatatatgattccatgccatagagaacaatatgatacattctttataggtatttaaaagtagatctcaaagattttgtttggtcatgtctgcctgaataagtatgtgtacagtgggtgagaacagaatgatgtattagtgattactgctatattagtattactcctacaaatagcatcttggacttaattgtcaaataaatgaagatgtgttttgactattagtataaatatgcatatttcatagtgtcaacttggccttcaattatatgtccagaaatttttcttctttagtgcacattagtcttatgaaatttaattcagctccaggcacaacactgtgtggttgtaagagtacaagacgtggataagaaagtaggaaatacaacttcttctaagtaaagttttatgtactggagaacagactgtaagtacactgttagttataataacatacaaaaaggcattccctaagagagatgaaatttaatgggggagcaggtaggtaagaaaaagattcacgaagaaagagcagattaacatcacttcttaattcctggttaaatatgtttgtcacagaactactctgatgtctagatgccatgattattaaaaattgcccaggtttttaaaataaattattttgaagtataaacatgaataaaatttgtaaaaagttatgccatttggcattctatgtgaaagttaaccagggttttgtttgtttgttttagattttttgtttttagtaagatttgggaattggcggcattgcttaagacaatggtttctttaacgtgaaacatatttcatgaaatgtaaaaacagtaaagtattgctcacgcttatctgtgacacgaaaggagaagtaatgggtacagtatcttgagtggaaacctactaactaataattttgccagtggcctc

SEQ ID NO: 14275 - DNA, 1047 bp, Homo sapiens
tgtactggaaaaaagtatagaggctaccaagtatattataaaattaagactgatttaaataatactataattttgtactttaaagtctatttccctttaccatacaaaattgtacaagaagagttaaaaagtaagaagcatctgttgcttcaaaaagcaatcagaaagctgaacaaatggactatgatatagaagaagctagaattagaaatagtgaaaagggtttatcttttagcattttttccttgaaaataaatggttaaatgttagtcttcttgatcagtgtctagatggggcacccacaaatcaatcttttaaaaccatacaatgaagaaatgttccatattgtgagttctatagtattggtaccagacaattccaaacgatttgtgtttgttttaaagctttcaatgaatggatgctcgagcaaactcagctatattttatttcagtttatatcttgtttggcggctttggttttgatcaagttattctgggtaatggattcaataattcggccgtgtgatgtagtgacagcttctgcttcttcgctgtgcaggagggatgtgattcacctgcttcatgcttcttttggtgcagattccaagtgcactgatgagggcaggctggtgcaaaagtaatcatggtttttgccattacttctagtggcaaaagccgcaattacttttgcaccaacctaataggtagcttcccctatttattttcccttccataaaatacttttctcacttctgtaaaatgcttttctttacagctcacttatgtgatttttcttactaaacatcccccaattttattgaggtttaggatttaataactgaataagctatagaagaccaaattatacttgcaaatttgggataggcttctattccctattcaagccaatcaattaactgtgcaactagtaggttgtgctttgataggaactattgctaataactgcaactaacgttaagtaacagtcatgtgcggcttatggggctaagtgtcgtccatgcatggctatgtttgatttttcaaaca

SEQ ID NO: 14276 - DNA, 1044 bp, Homo sapiens
atgaatcatactttccttacctaggttactcagtgggagttctccactcccataaacaaacaggtctagtaatatgttttgctaaacaaaaaaataatctactcctggaaataaatgataccactttcatggaaggtagaagcagtctgccaatgttcatcttaaataatatctcccaatgttcatcttaaattatatatatatatatatataaatctttatatagatagggatatatactccaagtgctttcatatataggttcattgctatgtttgatttccataaacactctagcaggaacagatgatgtcgtttttagatgtcacttatgaggaaagttgaactcaggaagatgacttacggtcattaaggcactgtatggtacagagttgttaaaaccaaatctgttgagttttcatctttgcactcaccatggtgacgtttctaaggctaatttgactctctaagtcaagaatcacaagctaaaatgccagtgaacattagacaagtaaggaaaatggatgaggtagacagagaatgggatggtcctttggatcccatgtaacatgtgtaggtttataagacttctagatcattactcagtttcttctcaaaaacttgcattttagcatcccacatgcgactctttattggattatttgtggctggttcagccctcccatttgcatacttttggttccaacatgggttggaagataaaatgatctgcagaaagaggggcttcagtcgaatgcacaggctgcactggacacactagcacgtggcagtcaggtacagtactttttggcaaaaaggataatgaatctgccacagcagtgttcgttgactgagagcttaattgttcactaaaggaagaaaataagattttaaagcctgtttacacagggatcttcaggtagcagcattttaggggggttagaatataacacagagaaggcttttctttttggaaggaagtaccttgaaatagtagtagatttatgttgtggtttggttatggtttgagttgtaagtatagga

SEQ ID NO: 14277 - DNA, 1077 bp, Homo sapiens
aaaatagttcacttaacataatcacctccagttgcatccatgttgctgtaaataagatgatttcatttatttataaccaagtagatatttcattgtgtgtcaataccatattttagttatccatttatccattgatggacataggttgatttcatattttggctattgggagtgcagacatctctgacatactgatttcctttattttgtgtgtataccaagcagtgagactgctggatgccgactttttaaagataagttgtatgccttgtaatcttttatatcttgccatagggcctcatactggtctcaagatctaagagaaacacaatgaatgttgctatcttctctctttggggtcttttattattattgttcctaggtctcacacagagtgatataacacaaataccaaatatatttcttggattattattattcttagaaaaaatactcatgcaaatgaaatcttgagataaaagtaatcttataaaattatttatgcaaatattgtcccctggctgatatatttccatggagtgatggatgaaagtcatctctgaagaacacttggtctatagattgtttcatatttattaatcccaaatcttatatagtaaaactgatgtgaaattaaaggttatgagaatgctgctgagaaagttggctaaaatagtttggatgccattttactgtatcttaaaaatgttatgttaaaataaaataaaaccaaataagcttataaatttaggaacgttttattttaaattctaaaattccctgccttgactttatagtgctaacaaatttgctctacagcataaacaggcatgttctcatcagtttagctgtacactgtgttatatagggcaggttataatttttattttgttcctctgactaatgccgtagtacttagtggttgagacatagaatttgtttataacctttaacactgtgtaaagttgttttcttcttttttttggcagaagtttcttttaattataattttaaatgatttccttttcactcaccaaagcaatgctgtaaaaacaagaaggcaagttaaataataaa

SEQ ID NO: 14278 - DNA, 1034 bp, Homo sapiens
tggcaactacttcctcctacctttcatagttgttggaagcagagcgtctcagcttttactgtgcataaaaattgcctggggattgtattaagatacagattctaatccagtgggtcggggagatgctgcctttccaacgtgctcccaggccagttgatgctgctggtctgaggaccttacctggtctcagcactgggtttgtcattcttcactgcacattgcagtcacctggaaagctatatatagaagctaccgatgccaaatctcatccctgagatatctggatttaatgggtgtggtatgagatttgggtttggggtttgctgaagttttccagggggttgtaatatacagaaacgcttgagaagtaccatgtggtgttgaaacctggttcataaatccccctagattcttgatctcgcttgctcctgctgagttggcccccagccacggttcaggttgtgaggcctgatacaagatctgccatccaggaacctgtcaaattgagacttagagactccgactattcaattcaaggccttacaatagtaatatcttgcctatggtggtaactaagccatcatttttgcccattgttgctattattgatgttactattatttttatctccaaatctctatttgttttttccaactaaaattatgactcatgtttatttttttaaatgaatgtataatagtggcacaagtgatattttgataaatgcatacaatgtgtaattattaaataatgatagtggacttatccatcacctcaattatctttttttgggttgggaacattcaaattcttaacctttagctattttgaaataagcaacaaattattgcaaactgttgtctctctactgtgctgttgaatactagaacttactccttgtatcgaatggtattttcatacccattaacgatttgtcttcatcctcctccatctgacccttcctagcctctgggagccaccactctatcctcttcctccatgagatctacttttttagcttccacatatgagtg

SEQ ID NO: 14279 - DNA, 1053 bp, Homo sapiens
actctcagtgctgactggtcagtgctagaagggctgttaccaagagcagggaagcccgtttttgtgaggcaagtttgctgcatcctgttttccccatagtgtgatttgctgattgctgatgcagggtaagaaaccaagaactcccagaactcaggttgagagtggctaccaagagtcagaacgagcatctgaacttactgcaacctcttggagtttgggagcaaaaacctggaattgaattttgctatgatactcgggaatgagaaattaaaatcccagagaggagaaaagcacaaggaaataaagtcaatacatggtgccggttttgccttcagttatttgctgattaagctgctcagggcagaagtctaagaaaccaggcacagaacagctggagagtaaaacagggatttttttttttttttttttttttttgtctcccagtatttgcatggtggtagagacagagaaatttgagttcataacttgcagaggagaatttgtagaaaactacccaggctctctgttgtcaaaacaggacaagaaaagagataaaaattgtattaagtggataggataaacaggttgtaaatactaatatagcatacctaaacccaaaacaattgggtgagttaaactgattaaaatcagtaaaacatataaatagtaacagcattccatttggcaattagtaccaaattggataaaatcttcacagattctggggatgaaaaggtgaacatctttgaaggtggggacattattctggctaccagggtcatcaaaaacatgcacactgaaaaacactttgatacttctatatccttcagattggttaaaatgaaaaggacaatactaagtgttggtgaggatgtggagcaactgtaactgcttgtggtgttgtcagcaatcactttgaagaacagtttggcagtgcctattaaagccaaatatatacatccttaagactcagcaacttgactcctaggtacattaatgaaaatgctcacatgtatttatagcagcattatttataatagtctaaaactggaa

SEQ ID NO: 14280 - DNA, 1072 bp, Homo sapiens
aaatctgtaaaatgtaactcattgattaaaaaacaatactacttgtttttatcatttgtagctttttgtaatacacataattttgaaacaaattactcttttctataatcttcaggtaaaaattagggtagctttttaaaatttgttaagctcagttttaaaaaataaatgcctaggtagatcagttttgaaataacatatattcccccatttcaaatatgtgaagaagctcaatggcttaaaatttggaaaatgtaatatttaactcagttgtttgcattatgtaatgtttactatacacccataatataaatattccttaattatatttaaagtaattcctttttacatttttctcctctatttatttatgacaaattgaactcagatattagtaacttgttcaggccatacaagttgtcaccggaggacattactaattctaaagtacataccttttttaatacaaaagtttattaattttaagcagcatcttatgttattaaggtttcatgggattgttatgtttgcaattctgcctttgtagaaacaatctatatgtccatcagtaggggaaggtttaagttttttttttttttcgataaaacatagtacaccatgcaagaatttaaaaggaatgaactggagctgcaagtgtcaacatgatgaggttcttttttgatttagtagaatatttttagtgaaaatgcatcttgtctgtatggtaaaaaaggacaaaattttgaaaactaactctttactgagggcatagagtgagggaagagacaggatttattcatgttcttgtatttttccagggaacatcctcatcttatgcttcctttgcatttaattccattttcgttttgttttctttaccaacattttggtgattgctcatattattatatataaattacctcaatctgcacagtgattcactgattacatataatatcatgtatttaaccagtctctttaggatatttccaaacttttgatttataaataaagctacaataagcattctagtatgtaagtctttacccaatgagtggtaatatctgtaaat

SEQ ID NO: 14281 - DNA, 1012 bp, Homo sapiens
aaaatacctctctgctaagaacagcagaggcttgattatatttattggtgttagatgactagggactaaaataaatgattcctcagtgtaaaagtaggcagataattctattacctaattttctctttcaacagtcaggaaactttcagtgaatttggtccctgtagggtaactcccaatttccttctccccctacgataaaacaaacagaatatgagagaattcgtttgttattggactaacatgaaaatacacaacttaatatacaaatttaatgtgtttaatctaatttaatgtggtaaaataaagcatagattgtttttccttcgaatgtcatgttcttacaaatacttaaaaatgttcatttttgttcatggtagtctaaaactaaaagcaacacataaagataccaggagtgttttaccatcttttctgccattgtttatgaatgaagtgtccttcaacccccgtgtatctttgttgaaacatttttggcagaagttatgaaaaataaataatagcaacttagaacatagaagagactgtggataaattcagattccagcaatttgaggcaccaaatggcacaatgcttctaatcattgatgtttccatattgtgaaaagagataatctaaaagtaattccaaggagaaaggcctttactgataacataaggatgattagtttgttggcacaggggcaggcagaataaaatggaagtaaaatctcactcctggaatgttgcagttgaaacagcccatgcctatatccgaacaatgcctaatgagttagatgatgaaatttgggagttctgagctgacgagtcttaggattttgagttcatgctgtaatggtttgagatttgggggatattaggatgggattggattcattttacatgtgggatgggcaccatcctttggggctagggaggctgacttctgtgtgcaaaataatgccactcaaagatgtccaatcatgaatttccaaaagttgtaaatatgttgaat

SEQ ID NO: 14282 - DNA, 1032 bp, Homo sapiens
tggcattttgtgacttctttctgtttcctaattttaaaaaaatctttaaagaacatcaagttttattcagttaataatgtgccaaagactgcattgatatggttaaattcccaggaccctctgttctttagatatggactaaatggctggcatcatcacttacaaaggtgtcttgaccttgatggagctcatgttgaaaaataaagtttatctttttcatttttatcttttaattttatttttcataaactttttgaagtcccctcatattattcggtgtccctttgtatatttttcttttatttccaatatttttgaaagcatttaagacaacttacaagacacaaacatgtcaagatgagataaaatatgaaaaataatataaaagaacaacatatttcatagtaaagcatccaattatagtttactcagaattgagagcagaaatggagagggggaaatatattttctgtagaattaccatgccatgaaatactatatatttattagacaggactgacaaatttgtctttaagcttcattgtagcaaaagctaatatggaaactggttaggtacaatacttacagtgcctgtattgtaaaaaacaaaaacaaaactattgcctaagagtaagaactatcatgatactgacaatgtaagtcttctgttgtctattgtctaatgcctttagagacattctcaacactcctgaaacaaacacaatgataaatctcattggctgcttgttaaagctccctttaaatattacatgtagagtatcagtgctaagtataaggaaaaaataaaccttgagtatagatgtggcttctacagaatatcagtgctaaatagaagaaaaaaattaatcttgagtacagacatttcttctacagtaagaaaattggaatgacctaactagtcaaatgtttcccttacaatgatattagggagttcaaagctaatttttttatcctcttatagtaaccattatatgtttgcttttaagtaccatattgtctgttggaaatttt

SEQ ID NO: 14283 - DNA, 1022 bp, Homo sapiens
ttgacttgtattttaaaattatatgaagtaaaactttttagtgggggtggtgttgataggatctcctcttataggaggatttggtgacttgaaggatataaatattttcaggacatatcagcatttaatttttagtgtgtttatgggtattggggttctcataaaatttatattgactctccaactttaaaatgtcgtttatggtaattacatacaaggttaaatacaattaaattgttgggtatctgtttattaattgagggtgcatttattgagcaattaaattaggtggaaggagaattgggatcaagatgaaactataaaaatctaaaaaatgcacgagtataattatttgaaatagtgtaattgtttctatgaggggtcttcaaaaagttcgtggaaaatgcatattatgtaaaaagctatgcatggttcaaaattgtttttcactaaaagaaactcatattaacttgctctaacatacctgaacaggatctagtctgaggcactgagaatgataagacatcagtttgaaaagaaccacatgaatctgctgaaattgaagcacgaactaataccaaatttatggcgaatcttggatcaaaacgtgaaattattgatactttacaaaaaaattatgggggcaatgcttcaaataaatcagcagtttaacaatggataactcattttaagaaggaatgagatgatgtggaagatgagcctgcagtggcaggccatccacatcaatttgtgaagataaaattaatctcgtttgtcctaattgaagaggaccacaattaacagtcaaaacaatagtcaaggccatagccatctcaataggttcagcttacacagttctggctgaaaaattaaagttgagcaaactttccaccccgtgggtgccaaaacggtggcacctatattagctgcagacaaaaagagaactttgaagggaaatgttaaacaagtgtaataaagatccccaaatatttctttgaagcattgtcacaggagatgaaaca

SEQ ID NO: 14284 - DNA, 1516 bp, Homo sapiens
agaaattacagtaaaaaacacctttgctatcaacaggaagctactcacattttaatatatattcttccaggcataggacagtcttctgaacaagaaatgttgcatcaacctaacctgtcctgcttcactactgtactgtgtgtgcacatttttcatgtaattatttgtcattggttgttttatttttgtgggttttctggtcttgtatattaccatatttaatttattctccaaaataaagtcttttgttcacctatatgtggcaaatatttactttttaacttttaaagtatgtttttatataaaagttttaactttatgtaacgttcatcagtcttttgtgtagttgtttctacctttgatattagattccaaaggcctttcccatgcagcttatataaaactatgtacattgattttcttccaatcatttttacattactaatttaatgcagtgtaagagactatgcttatgagctatagatctgactctttttcattcttaaatgattatccagttgtcccagccccaactttgaataatccatctttccttctgcttttaaatatatttttgttatatgaaaaactcccctgtgtaattctttctgtttttatcatctgtattctttatcatggatctttctgcccatttatttactggtgccaatattttaattatgagttcacaagatatattattatcttaagaaagtaccacttccatgttcctcaaattttcttcactattttaagtacttattattcattgttttaaataataattttataaaatgtgagtgaaaattttatttacttttgttctactccattaaaatttgagttgaacatacaacattttcgattgataaggaagttgcacatctgagagattcaatgactgattcaaagtgacagaattaaaaatcaacagagctgggaaatgatcctaggtgtattgtccataagagaactcgaaaggatggagaagaggctagacaatggaatctcaagacccaaaaatgtcttgactggctgtgtagttgaaaatctcacttccaaattttaactctaccagcactgggtattactcttaagcaagtataggagaccttgcttaacaataattttcagaaaacgtcttagggtttttaggctgtaatctcaatatgagcagcactgtgccataaatgctcctcagaccgtaacaaggaataccatcagtggttgtgaagaatattgaacagatctgggccctgtaatctagaagagctggtaagaaattatacgtggcccatgggatattacaatgatagtaaagagtctcaaaacaaaacaaccaggctatgtctggcctctgtggatgtaacaccttccatgtctcaggagagatgttggacatttacatactttagttcatttactattatagcctcgagaaaagatagtcttatcactgatttccataagaaagggggactgaactctagcccatctttctgagaggtctcactta

SEQ ID NO: 14285 - DNA, 1032 bp, Homo sapiens
tgccggccatacgctgagcacacagttcatccctcccgttcaccatgtcctcctgtctgtggagttcattggaaggaaaaagaaagcttgtaaagtgcaagctaaaagtaaatacttcaaagaaggtcactgacttcgcaaatagtctagccaggataatttttccttttgacacacaaaagggatagactttaagatttctgtacttgtttatggcctggttattaagaaatccaaaaataaataaattaactgaaaagattttgggccatggctttatatagaagttttttcaaaatataccatggcagaaatatgctatggacgtttaaaggtttcagaataagaagctgcctctctaaactcaagtatgtatattctagaaaattcaactcaagcttccttcaaccatctgaattacaggtctctactattttgttttgtttgcttgtgtttgctttcattatctcacaatctgcattttaattatttacagtataatcgcagactatagatacattgacagaataatatgattgaaaaaacaataggtggatgataaaaaattttaaagcaatattttgatcatactttatgttttttgtctttcatttctcacttgacagtttattatatctctacatgttctcataagaagtgattttaatgtatgtgatattccattatgtgaatttaccatgacatattttattctcctgtttctgaacattaaatttagttttgatttttaggtattataaataataatgtgctcagcataattgattatacattctatgcccaattctaattattcctgggacagaattttaggaggagagttacaaaactgtctaaccttattaaggctcctgatatttctgtttttctcaattgtgtttatacacatttacacatctgtggcttcagaagtactattggctgggcacggtggctcatgcctgtaatcccagcactttgggaggctgaggcagatcacttgaggtaaggagttcgggaccagcctggcca

SEQ ID NO: 14286 - DNA, 1020 bp, Homo sapiens
tgcttcgacatgaaccctggaatggcacagagatacactgtctttgacaccccctgtgggttttcccctgaaaaatctttcctatatagaaaaaaagaagtcttgttttattttattggaaaactgctttagaattttcattcctcaccctttttttctttttcctgttaagttctaaaaacaattgaaaagggctttgccatgcacatctgacacattttatactgttcaaaacatagttatatatttttctatagctggtatttctgtgattatttaaagctcatccaatttaacagaaatgtcatataatttgaatttagtaacgttaagcttgtcagtactcagagtaaaatcctaccatatgtccgtgtaaaaggtttttaaacttacagtaacatcaggtgggaaaaattgttgggaacacaaactctggggtctgcttcctaggtttgacacttggggccacatgtaatatctctctagccttggggaagttaatgaactattctgagcctccaccttcatagccataaagtgcacataataacagtgcctgtgtcattagatttaagtgaaaatgataagagaatgtggttaagacatttagcacacatttaccacatataaggcaatgcataattgttagtcactattataattaataatagtagtagtgtttagaatttttttagttaatattgttgtactttatttttaaaatgttaaagttctatgccagtattctgttgaggaatgttattgttttgaaaattaaatatatttttgcctaatttttggttttgggatttcaggcatttttcccagtgctgttccaaagacatctctgcactgatggagatgctctgtgtccatggcagccatgtgctacatgtggctactgagcacttgacatatggctagtgcaattgacaatctgaatttctaattttatttcactttttagtataaatgttgtgtgggtgatacttatacagagtatttcatctgagaaactga

SEQ ID NO: 14287 - DNA, 1034 bp, Homo sapiens
tgctgaaaactgcatcttatttatgcttttgataaaggtgtgcttaattgtgtcagccttgttacaagaatatgttagaggagcacagatatcataagcaaggatacgtgctataatagagagagttctcatctagaaccgaggagaatggtattatttgctcattctctctacctgtgttattttattctccaaaagccccaaataaaattcctgtgtttaaattaattaatcattttgggctttgaacaagcacaaaaattaaattaggtaggtgtctaagtaggaaggaataagcaaaatcatttgggtataaaaccatgaatctgcctttaaagggatgtattaacctgttgaaaaaaatacatgacaggggagtcactgaatgttttcttgtgtcacagtgactataaccttacggtcgacttatgtttgtttgttttaatgcatattggtttctacaaagctaaatttatgttataaaaattattctactttacacatctaaagtaatgatcactgtctgtcaactctctggagcactagtttttctctgactttgagacataggataggtgcttttctgattttaattccttctattttaaatatagttataggttctatatcatatctgagaaaactgaggcttagagggtaaggaacttcctcaacgttcaagttagttgaggagtagaacctataatcagaactgacatcaggccaggtgtggtggttcacgtccatcatcccagcgtgttgggaggccaaggtggatggatcatttgaagccaggagtttgagaccagcctggccaacatggtgaaaccccgtctctgctaaaaatactaaaattaaccaggcatgttggagcatgcctgtagtctcagctactcaggaggctgaggcaggagaattgcttgaacctgggaggcagaggttacagtgaacctagattgtgctacagcattctagcctgggcaacacagcaagactctgtctcaaaaaaaaaaaaagaactgacttcaaaataa

SEQ ID NO: 14288 - DNA, 1062 bp, Homo sapiens
aaggcataattgtttttgttttgtcctcagcagagataggtagctaattcaccctgttttttatgttataatcctggctttggaacaaatcatagggataattttattactttctcactgtgcttcttcctaagccagtattttgtttatgtctaataataatcttgtgatcaatgacaaatcggtattgttttctatttatgcatcactgtgtaagcatggtaaaacttggactattatatacatatatatatatatatgtataaaatctttagacttagcatatgaaccttttgcagctcattgcattagacgatataatttgccaatatatctaaaagcaagtgcatacatctgtgtgcacgctgtctcacaagtactttgctggttctaactgcagtaaatgattttcatttctttcaattcaagtttgtttttaaaactctcagtaatgactgcatcctgcactgagaattcattgtggcaaagcacatctgtactgcacatttgtgagggaggcgggacatgtagaagttaatagtatcaacttcttcgttggacaaagctacatttgggtcttgttcccaccaatttacagtgtcttgagattacatctgtctgtcttgggaagtacctctgtacttaagagtacctctgttttcttgtatatcaaagggagtaatatatgtactttttaatatgcctgatataaagttgaaatgagagaatgtatttaaagtctggcacatcgtgtggacaaggaggcctagaatttggaagaacatatttccataagttatataggccaggcatgacactaataatagaaagactgattgaaattctgtttgcataatagtgagacaaacaggtaatgaagtaaacagacagggagcattctttcccctttcccacactctctcccaatgtaacctgtgaaatagtgagctagagaaattgagacgcagggcatctcaattctaaggtaaagtttagaaatgaaaacatgatgaatatatcatattctacacactgaaaggtggggttccctgtcctcttatt

SEQ ID NO: 14289 - DNA, 1085 bp, Homo sapiens
ctgtgaattgcccccttttgaaataaaacagatacagaaaaattactgataaatatatagcacatatgtatgtgctggttactttcagctccattttatcattcttttgccttcatactacatggtttactaagtaaaacagagactgagttgccaaattgaggtaagagtataatagcacaatgttaagaacaccagtttgtaaaatccactcttaaatctattaatgtgacctcagatgatgatataatctctttatccctcagttacctcatctatggaatgtagataatgacagtgtccaccatacaatgctattgtgaggattgtaggaaatcattcatgtaaggcacttggcacagcacctggcatgtagtacacaagccagaaatatgagccatatcattacatgttgatatcattatattcagtaaaaaatatcagagcccttaaaacaggatagaggggaagtgtaatgaattcagaatggaacaatgcccaagtatatgattgtgttctgaaagactaaaaaccatttgtttgtgttcatttcctgcagaggataatccgtatgtgaaatgttctacttactgaagggagagggggcttagaagaacataattaaactaaaagatccatttaagagagctacttccgaagaaaatttgctgctgctttgccgtagcccctgatgtgtggacgtggttctgacctgtggatgtgggtcaggaaggcgttctctggagctgcaggcagggacacctcagctctgaatgtcctgttctggagccaaggagaagggctcgctccccagtgtcaggttaacatgctggacacagtccacctccagacaggtggaaaggaaacctggtggaccctcagactcagtgtctattttccttgtgggttagcgaagtcagcttctgtctttgataatacacaagagaaagtcttttgaatttagggaatcaaaccactgcagctgttatgaggcaacaatttgaaaagcttttgtagactgtctactgaaagacagctctgtaccttttcatacacgcctttcacactgcgtgacatttcactgc

SEQ ID NO: 14290 - DNA, 1050 bp, Homo sapiens
taaacactttcaattttgtttcttcccttgctacgaatagtaactcattgttaatatccacatttggaatagcactactgtttatggtataacctggttaatttttcaaataattcaaaatatgaaactcaggtgtggaaaacgtaggtggagcatgatgtcatggatacggcacctaattttttagaatttctgtgcaggaaaaacaatgacacaaacacatctgtatcaaactcataggaaataaactcttaagtgtcaaaacagagcacaaacaaaagaggaaatgctctgttcagattaaaaagtttcccaattttatctttctttttttttttttaataaagcctcactctgtcacccaggctagagtgcggtggtgcaatctcggctcactgcaacctcccaagtagctgggactacaggcatgcaccaccatacctggctagcgtttatatttttgtagagatagggttttaccatgttgcccaggctggtctcgaactcctgagctcaaagccatctgcccacctcgtcctcccaaagtactgggattataggcgtgagccactgcgcctggcctggtttcctaatgttttgagaaaggggtgccttagggggatttcatagtgtcaagtctcatggtgtgaagccaggaagcagaggccaacaagtgatctgaaggacagcagcgctgcagcttgtgaattctaagcattatacaaatgcacttatgtgtcatattcaaccataaatggaatctttgtcatgaaaaagattctttatatcaacatatgtcatcacaaaagagcttctttctttgataacatacaagtgaaagtttttgaattttgattttctattcattatatggtgaagtcaactgaaatcagagagttgaagtagcttgtggcaggcctcactggcagtgaaagctaaaagcaggactcacatccgaggcttctcatgagcccctttcttctcctctgttatttcttttccttcatctattttcattcttcttatttaatcgtttaataacacttctct

SEQ ID NO: 14291 - DNA, 1127 bp, Homo sapiens
taatttcaacttgttcaagcttgaatagctacaagtagctattggctgccatattagaaagcgcagggcctggttcagagtaggggtgaaataagtatttgttgagtaagtccattgaaacccagagttggatctacatcacactggcttcaaagactgtgttctttcaactacatggggcagctattcaccagtttcacacaactctttgtttggtgctcatttaaagctctaaatactcctctcaagaactgccttttcctcatctagtccacaaaatccacctattattttttctccttgctcaagccaagctgagatgattttctccccaggaaaaatatctgaggacacagttcgctaggataatcataggtgtggtagccactaggtaggtggggaggaagtgggatgagagtcttcttcctttaatgaggcaggttctgtgggaactggtttggtgcagttgctgactgtgatggtatgacgaggattctgacttttagggactactccccgtaagtccatgacaatcttatccggaactgcataaagcattataactgagcttctgagacagagcaatagggtcataacagagagaaagaacatcaaggtcagaaatctagagtgggaaagactctagaaggggtcaggcagggagacagtgccatcaaggacacatgtttacagcagcagggctctcgcctcgggatgagggatacgcattcgctgaagagacacctggtttccaatctggttccttgccagaatgtaggaaccaaaagccaaagccagttttatcagctggaacaacagcaggtggagggctgggtctaattgagagtgagtaagcttagtgagcagcactgtggaccagcgagttggggatctgaaaaaagaaagagctaaaaattacttggcgaagaaaaaagaaaagttgaagcagatctagatacattatatcccaatcatctctgtgccctgattgtggctgcttcagtaactaagatcaggaaaggataaacagaggctaagattggaaatttgggatggggagaaagagaaggaagccacggagggtgctgccttactttccccactcctggctttcagaaggtaaaaac

SEQ ID NO: 14292 - DNA, 1928 bp, Homo sapiens
ttgaagcagacaaactgaggagaaaaatcatttcgtaaatgaacgattatattctgggttttatcaagatattttacaacattaaaaagaaataagataaaaatcaggattatgtatttttcttctagaaggtgatttcttttttaatcatttttttttgtattaggtaaaactttagcaatatgagttaacattgtgaagcaggcatgaatttcaaagtaggaacaataaaagtgaagaattaaaaaagagcaaaatttgaaaccttgacaaaagcagatcttaaaagggaaaagcaactgatgcagaagtgtttggaaattgagggtaaaaaaatagtcttcagtttattcattaaaaaaatggaacaagcttcctattttcatctttaatcttctgtgtgttctttgtaagcagtattacgtctttgcaaattaattttcatctttctcctgtgaaaagatgaatcccttattttaacttaaattatttaggttaaaatttaacttggaacataactttatcaatgtagaaatcaaatatttgcatgaaaaaattaaagaatattgttaaatataacaatatataagaatatttgggctctttgtacagtttctcatgttaaaattagataaacaggatgaaatgatttatctaactagaaaaaattaggtaaaagttgtaagctagacaacagtttcactccgtgatttatccaaccttctttaacctgagttggaccttttattttcttccttctccacaagtctacttcgtttgcatgtgcgctgtaagaggtcgttaagaaagtttatcgggccctattgccctcagtcatatgttgaatcaaacacttcttgtttcagtatatagtatgcactggcctgcaatattctctcctgatgactttttcttatttttattgttttccttttagcccccaagttcagtatgataatcttttgtacttggtttaaaaccctctttaaatgtcacatgctctcattcattcagcaaataattattgaataaaaatgtgtgtgtataccgtatgtgtgtgtgtgtatgaattgggtgataagactatgaagttacataaaaaaatgatgggaacacaatttagacagggtagtcaatctttgagcttgccaggtcttaagtgtataatgcaagccaggtcaaacttctaaaaatagaactcagagtgtagaccacaccaacacatctagaaattggaatctcagggcaaaagatatctagaaaagtcaggaaccacaaaagcagcaagggattctggtactgggtcatcataaacatgtatcccaggaatcgcatgctcagtttatcatcttcttggggcccaatccgctgactgaatgtgatgaatgaaggcaataattaatcaggatgtatcccaaggaatttaagatttggatgtgaattctaacgagatggcttttaagatattttttcagttttgaaaaattctgataaatacgtggaaaattctacattttctaattctgaattgtgtaatagtcatgatagcttctgtttagggcctgcaccagcattgtgctcagagccgccatgtacagcaatgccttacgcttgggacccaggtgagagggaaggtgcgcgctgaaacccatccatgtggtgacaatctgagctgactgggctgagtgctttctctgcagcatctgtgattcttatggcaactctgaagtcacatttgattacttccattttacagatggaaatgaggggtggagaggtgccctgaccccccacgagtggagatagcccaggtttgatttaaggtctctctggatccaaagcctttctccctcactgtcctaggagagatgtaggcaaccgttttcagaaggagcgtggtagtgttgctaggggcccgctagggaggc

SEQ ID NO: 14293 - DNA, 1029 bp, Homo sapiens
tctttttcttttttatttatttatttatttatttattttactttaagttctgggatacatgcgcagaacgtgcaggtttgttacatatgtatacatgtgccatggtggtttgctgcacccaccaacctgtcatccaggttttaagccccgcatgcattaggtatttgtcctaatgctgtccctcccctttcccccaaccccctgacagaccccggtgtgtggtgttcccctccctgtgtccacatgttctcattgttcaactcccacgtatgagtgagaagatgtggtgtttggttttctgttcctgtgttagtttgctgagaatgatggtttccagcttcatccatgtccctgcaatgaacataaactcattcttttttatggctgcataatattccatggtgtatatgtgccacattttctttatccagtctatcattgatggacatttgggttggttccaagtatttgctattgtaaatagtgctgcagtaaacatacatgggcatgtgtctttatagaatgatttataatcctttgggtatatacccagtaatgggattgctgggtcaaatggtatttctggttttagatccttgaggaattgccacactgtattccacaatggttgaactaatttacactcccaccaacagtgtaaaagtgtttctatttctccacatcctctccagcatctgttgtttcctgactttttgatgatcaccgttctaactggcatgagatggtatctcattgtggttttgattcttatttctctaatgaccagtgatgatgagctttttgtcttttcatatgtttgctggccacataaatgtcttcttttgagaagtgtctgttcatatcctttgcccacttttggatacagttgtttgtttttttcttgtaaatttgtttaagttcctcatagattctggatattagccctttgtcagatgggtagattgcaaaaattttctcctattctgtaggttgcctgttcactctgatgatagtttcttttgctgtgca

SEQ ID NO: 14294 - DNA, 1160 bp, Homo sapiens
gtttctatacacaaatacttaccactgttttgccgttgcctaacatattcagtacagtagcatactgtacaggtttgcaacaggctataccacaccgcctaggtatgtagtaggctgtaccatctaggttcgtgtaagtaaattgtatgatgtttacacaatgagaaaatgttccatttcccagttcatatcctccttcttaagcaatgcatgagtatctcttctgttcttatgctttcctcttccaggaaatagatataagttgtgtcctagcaacaattttttgcttcacataatatctaaagatatctaaataaattaagattcactaatgactctagtggcttttaatgccatgagatattcctactagttctttctgtcattggtttattttcattatgtagattagaaatgaataaaaattacttccttattttacactaatactaataaatgcctctgatttttagagaactgtaatagatatatgatgtgttactctctttgactatttgtataattttgttttttaaagatacatctagattaaaaactactgttgtaagctgttgaaatcttccatatggccaaaattctgtcactgcctatagaaattccaaaagaagaaaaataactaagatttaagccattctgaatacacaggggccctcacaattgttacagtgtgaatttactctcttgataatggtggtcctggagtgtccagagaagaaataggtggggtctgtttaggacaagaaaaagaaagtgcttttgcaatgtgctgctgtcactgctggagcctctcacttctgcctaggttgctaggctcagactagacagtttaagtcggcataaggcataaatgctaaaatgttaataatggattagtgatactggcacttttttttatcctactagaataacttactaacctaaagaaatgtccgatatatttacaggatttgagtgaagattcttttaatccaagtgtcccttcttttccagggtgccgatttatttcatacattctttatattaatccatgaaattagcacaatatgtttacccacaatggtgccgtcaccccaaacctcttacctttttctgaacttccttaaaatcattaacttaaaaaagtcaagtttctttttacc

SEQ ID NO: 14295 - DNA, 1419 bp, Homo sapiens
tgtatgtatttgttactatattttcctgatgaatcagtgagggtcaatatcagtaggtgagacaatttgttcaatgtatagatcaaaaactccgcagccagattttatatacacatgtatataatatataatattatatattttatatgttatatatgaatttatacatatgtaatatgtaatattttatcttaattatatatttatatattatatatgaaaatatgaaaaatatatatatttttattttgctttaagttgtgggatgcatgtgcaggacgtgcgggtttgttacacaggtatacatgtgccatggtggtttgctgcacctatcaaccatcatctaggttttaagccccgcataccttagatatttgtctcgatgctctctctccccttacccctgaccgcctgacaggccctggtgtgtgatgtttccctccctgtgtccgtgtgttctcattgttcaactcccacttatgagtggaacatgcggtgtttggttttctgtccctgtattagtttgctgagaatgatggcttccagcaaacatgctctttgattataaaactgaatttcagttttctcattgaaaattatactgaactcagctgggcgaggtggctcacacctgtaatcccagcactttgggaggcagaggcaggcggatcacgaggtcgggagtttgagaccagcctggcaagcatggtgaaaccccatctctactaaaaatacaaaaatgagctggtcatgctggcaggcacctgtagtcccacctactcgggaggctgaggcagaatcacttgaccccaggaggcagaggttgcagtgagccgagatcacaccactgcattccagcctgggtgacagagctagactccatttcaaaaataaaataaagaaaattttactgaactcttttgaaaatgtattgatttcatttctaagtgtccttttattgacccattctaagaatgaagggggaaagtttttaataatctacttttattacacaaagtgatattgtagttatttctttgtttattctcagggtattaattatttgatccaaattgactgttagaagaatgagaaagtgtctggggacaagggaacggggagaaaatgggttattttgtgaagtccaggcttaagattggaatcttatgagactaacatagttgttcaattggaccaatggatttaagatcatgagtccacagaatgcgtaaatgccacttagaacaggaagtggtgacctcttatccagaagaaacttctcataggcatgaatcaatatcaattgggggaacattctagaaagtgttttcggtcacctccttttctggcaagacataaatgaactggatatcctattaataattttaatgggcattcccaaaaatgtcacagttattc

SEQ ID NO: 14296 - DNA, 1029 bp, Homo sapiens
actcactcaggattactagaacaacatgggagtaaccgcccccatgattcaattatcccctcctgggtccttcccaggacacatggggattatgggaactacaattcaagatgacatgtgagtggggacacagccaaaccataacaaacttgaacagagagatgttcactgtaggtaggttggttggtctacaggaaatgatgttttagatgagacctctagaataagaaagaggcagcacatgaatagccggggtggtagtgatccatcaaaggacaaggcgattgcaggagctggccatgtgacccacacattttccaaaggctaaggcactggatcccgctgaatgaggggagactgacttcccatccacttctcgtgctgtttcctgagaacatggtgcaccattacttaaagaaatcacattgtaaacatatgtaatggatattgatggtatcaacttaatttttaatgtatgattgttattgttattattagccacataagaccaaagttctgtagggatgagtttgagaactgttccttacctcaagcttgtggtcatagctatccacgtccatgtctttctggaaacttgctctgtttttccttgttcattgataaactagagaataacccattttcaggtcttgggttacttttggctttaagttctctccttcagaggtcctcatgagccaaattatctcagccagtttctcattcagtcactcttaattgtaccatctgggtcctggagctgactcctggacctggctcctgagttgtgtgttggtcctacacctgtcaattccaactagacagtataccaatttctaaatgcagtgtttcagaaatgaacttagaagtgctaaaagttcccttgtattattgcaagatatttctcttcccgtttatagtaccatcattttctcagtgttaaatacctgtcatcattcaagctttctcacctgattgctcctacatacgatagtgaatgggttaaggtaagtactcagtaggcatttc

SEQ ID NO: 14297 - DNA, 1045 bp, Homo sapiens
tgtgttggctaaggaataacagcagtttcaggcaacatactagaactgctaaagacatttgtaatcatttaatccaacaatcttaagaacattttttgaaactcagctagggggtgtctataatttgactaatatcacaaggctagtgcaggaaacacaagagaccagtcccccttcttggttcttaactcttgatccagtgcttttcttctgtaatagggtcaaccttcattcttcttctgtgtcactttctacaggtgcttcaaaagttatttaaaacaataaaaatatctgggttattttgtttctattttgtttaagttttagttgcagttaaaaatttgtttatgtaccctctaggtattagtgctacagaccttcctcaccgtggactggaatatctattcgatcatgtttgctaaggaccttttattcaaattgacaatagttctaactttcgtgttgatactggttgtgaatatcagtgcagtagaatgaaaaacctgtgtggtagagtcgtacgttcaggactctcaaagtccactgtgtgacagtcacggtgagatgaatgaaatatataaataaacagatatttttggttaattctttttaacctagagtttcatgttaaggctttcactcttagacacttgaatttgtcttactgttgagagtttaattatgttataccatgccaaaaaaacctgtataaatttaaagtaagaattttttatgtttcaataaaaatatcactttcatagaaagcacatttcttaagctggcatggccagcatcttgtgtccttgtagacagaccttcttgggaaatcaaattatataattcaaggttgttttgaggtcatgtcaaagaagaggaaggagcgtaaatcacatgatttctatagattcaggtgctggactccactatagggctgcacctatctgtcttttgtcctctttctataatggttaattccaggctgagaaactgcatacatcttccaattggtcaattctttattttaatatattaatacctttggcta

SEQ ID NO: 14298 - DNA, 2882 bp, Homo sapiens
ttctattcctttctgttttttatacgtataattatagattcactattagaaaagcacaaacaggtttacgtatgtcctggcctttgtcaattatctaatgtccaattatacaatgacttacttgagtttccttcttgtgctgagcatttacttaaaaggtgatgagtttactgtgaacaaattattaagagtctgtagtctctttggaagggcttagaaataaactagattgaccttcagaaggaactttttaagatttcatatataagtgaaataatgtagtatttgtctttctgtgcccaacttatttcacttataataccctgcagattcatcttaaatgacagcatttcctccctttttaatttgctgaatagtattccattattccattacacacacacccacaccatattttgttctatccatttatctgtcaatgaatatcatgggtggtgatgaatgtggtaatttgatcatgatatttattatacaatatatgtataacaaattttcttgtataccttgtgtatatacagtctttatttgttaattaaatagtttaaaatttcaaaaaggaattctgagtctcaataaagaacgttatcttattaaaccataatactcatgtgatagccaaaatctaaatgttggctaatacaatggtgaaagacagaaaattcaatgaattggcaatctattgtagaagaaaggaaaatactattgtgtagtttttgtaatggatatatcattcaacaggtaggcaaggcatctgacatgccaatatgttactacttttaaattatttaatattttctgtttcatgtgtaccaaataaaaatgatgcaatcattcccccatatattaatgtttttctaaaacattaatataaatattaatatgtttgaaatttgatagaatactaaaaatgaatatgctttgcaatatgtaaaatttatattttattaatataagcagaggtaaaattccaagcaccttgatgacatgaatttgttttgatattattttaaattttgaatacttataatatatgtgtgtgtgcacatgtatgttgctagtagtcaatagtaaaacattggctaggcttgggtttcttgtaagtctattttagggtaagcagtcggttacagaatgtaaactgtataaatttctgtgttacattcctcatcatgatttagcatttcagacattattttacagccattattttacagtagtatcttaataggccttcaatttgtacacgttcagtgtcattcagcaggtaatatatatttgtatatatgcagcagaaaagtccattaacattaattaggtctgttttaaggaataactaatttgtttagttcagtaaattgtgcatgtatgcagtgagttgacctaactttttaactgataaaagtttttgaagaaaaatagtcaagccagttagttatttgtgtttggtccgaacaccagctgtttgacatcatgtagctataactattttacctgaatgatattctctaacactttacaaggcacaaatattcttcaaggtcagttttccattatttttaacacagaaaggtttccataagtgcagaaatgtgacttctgtttacctctaccgtgggcaaagctatgtgaaatatcattggaacacatttggatgttttgttgtgagtcttacgataatttacccactccaaaaagggtaaggcaggtcactcaactgaaacctcctatgcctacaaaatagataattttctggaaaagcagcttttcctccttagtttgcactggaggaaatgaaattgttgctttaatatgcttaatagcacattgcattccattttgtagttgaaagagattaatcaatttctggcctgttttatcattcagtcaagaggcttccaaattaaggtttccacctgtccaactttcatttgtgtacaccagaatggagtctttaagtgaagctttctatgttgtgttttattttggccgggggctgtgggggcagggttggggagggcagttggaggttagtgtactttacagagcacatgaaacattcagttatttcaactttaacgtctattagtttcatagctaaaacatttctttcaagaagtttattttccaattttggtattttattttagagattttagtgtaaagacattttatagcatctgctactcttcactagaattttggattaagtgactgtagcgtactgttacctgttactatcacatcatgacttgtgggtttgtttcatttgttgctcttctttgttttctttttttttttcatgttaataaaatccaacatcaattataatttttctattttttctttttctttctcaatcttttaaaaaactaactgcatgcttttatatgattcactttcattccaaaacacatccagatataaaatttcaggaaaattgtaatatatgtggatttaaaaatggttatgcagctcagttgaatatgagttaaacattgtttacatagcttcctgtattttctgagaaatcatttcccatggttactgtaggcaacaccaagatagacactcgctttgacagcttgaagaccgtattccgtgttctggagtcagggacgatgccctgtgtggagctggctctccagaggtgcaggggacacactgagtctctaggtccgcacgtcccagtgtggcagccactgggcaagtggcgaccatgcactgactgtgaggttagtgaggccgaggcaatgctttaaatcattgcatctaattttaatcaatgaaaatttaaaaacactttgggaggctgaggcgggtggatcatgaggtcaggagatcaagaccagcctggccaagat

SEQ ID NO: 14299 - DNA, 1051 bp, Homo sapiens
ggtatgtgaaggcattgttcttgtcagtgttagtggatggaagtatttaagtgaatttagaagacaaatgtggaaagacactttttaaacttgttaaattacaaaattatgtgatcttacagtgaaaacatggagaatcattttctccaactttcatatgaaggaccgaaatgctctctacttccttgcaggttttcattcaggttttctttaaactcatgtgctgacagttttattcaactcctcaagacagattttggaaagttatttttaaagaaaaaaaaaaccatctagtgatctacatgtttgcccaccttgccccacagcaaaaacactttcattccttccattgagatcgattcgcagataattatcatgcttctctttggaattttgctaagctaaatgtgctcagattgttcagcggttccatatatggtgtgtgtgtgtgtgtgtgtgtgtgtgtgtgtgtgtgtgtgtgttcacaatgtacaaaaatacaattcctaggtaacctggtattccctttttggcttttgaatttaatggaccactaaaatcaaatcaaatgaaaggtttgtggatttgcattaaagacatcactaccatctaactaatctcacctttactgaataagtacaaaaataaactttacttaaaagtaggaagaaagtcatatcagaatgaaagagttcctatctgacgacttatttgtatcacacctagcaaacctaagcagaatatagtccttgtttttctcttttattccccatggattagagaaaatctctttattttcagctgcccaacatttggaagcattcttctatgtgacctctgttttgtcagtacctctttttagcacgtggatgggaattgagcacagcaccctccagtgcagtctctgccgtttgtccatgttatcactcttttctcatctgcaaccaaatggaaactcccagtcctgctgcatcacagatttatttgtaccattagctttttgaacctaaaagctacactttatatggatccttgttcaactccatctttt

SEQ ID NO: 14300 - DNA, 1034 bp, Homo sapiens
gtttattttatgttaaaatgtaaagtctctgccaagatttatgtatttatgttttacatgcatttgtgtatttatgctttatatatatatatatatatagccattaaacttatttaatatttagttgtgattgattcaaatgctagtctctaccctacatccttgctcttcaaggtggtgtttgggcatcagccacattggcatcaccaggggagcttgttaaaaatctagaattcaggtgtcactctgaactactgagtcaaggtctgaattttaaaaagacaccttcccctgtagatgtgaattaacatttggttttgaaacattgccgttatctttgggatgtgagagccctgtagaaataataatttagtatttttcttaaaagtttctctcttctagcttctcttccctgccagatggagattgcatgtaggagtcacacaaacaaaatataacaaagaaacattagacacaatgtctttagtaacctaggaagcaagacctcattagatactgtgaatataccaagctctgatatcagttgaagttggttctttctctttagtgacctctgtgtcattagttatcacatctgtctttcatgtagaaatctaaaggactgccataagattgtatgtaaataaaatatgagggcaaataagcttgctgaatctgcttttcttcactcctgaagtaacagggctcctggttctggtgttcaagattttctgttatgagacaaatgatgccatttgaaattctgggttgcctccaagtctgcggtagattgtagcttttcctctgcatgtatgtacatatgtgtgtgaagcatgtgcaatcaaacatatgtagaattaattctggacagctctgactgttttgtctatcaacatatgttcattataggagttgtggcagttgagaagataaatatataacagttcctgccttctgggcctctagaatctagtatgtaaaataaattaaacagaaataattttggcatgaaaatggaaccaaagagcttctga

SEQ ID NO: 14301 - DNA, 1058 bp, Homo sapiens
tagcagacatccatcgagactttccagggctcatcaggaggggtggtgctttccttctacagatgttcctccttgtgttgtctgtcctttctcttctctttcacaataagcatcatgttgatttttaaaatcttctccttctttgatccatggaagatgaattatttcttctccttaggcgtccagagttctctttgctgtatgcatgtatacatgtgaaaatcaaacatatccctctgaaaaaaaggagaaatctaccttgatgcaataactctgtacatatttcacaaaatgtcctgagcttggacagcaaaggctggcataacttgctaaggtttgcttgaattttatgttgattgcattcactttatattcctaccttatccatgaatggctgtatattggaatgaaaactaatttggtattttggtagaattacagattattactagatagatatttcacactgttgaatgttgaatgtgacaaaaaagttatcataacctgctctggtttcacgtaccctgaagaacaaggtgctgtcttgatgggctcttcattcccagcatgacacagctggaggatgggggggacaacatttggtaagaataacagattctctgggaagagatcagcaatttcaattaactaagtcccagaaaaaaaaaaagcaaagtaaatgccatttgaagatagctaattgaggctccaaacagagaggatggacagagacactgaacagtaaggtaagaacacagtaaggtaaggggagaacacagagtgatggctgatggattctgtgaatgttgaagactggaattagcaccaaacctgacaggtactaacaaaaccagtctgtctcttggactaggtggaatgtgggtctggacccgagagaaccagatgcatttgcaagaattcagagacacaagacagggtgcggtggcccacgcctgtaatcccagcactgtgggaaggcgaggtgggtggatcctgagatcaggagatggagaccatcctggctaacatggtgaaaccccgcctctactaaaaatact

SEQ ID NO: 14302 - DNA, 1118 bp, Homo sapiens
aaacatacgtgtgcatgtgtctttatagcagcatgatttatagtcctttgagtatatacccagtaatgggatggctgggtcaaatggtatttccagttctagatccctgaggaattgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtagttttgatttgcatttctctgatggccagtgatgatgagcattttttcatgtgttttttggctgcatagatgtcttcttttgagaagtgtctgttcatgtcctttgcccactttttgatggggttgtttgtttttttcttgtaaatttgtttgagttcattgtagattctggatattagccgtttgtcagatgagtaggttgcgaaaattttctcccattttgtaaaacctgtgttcatttctaaactctgaagaaattgctgtatctgccagtcaattgctgctgttcattattaatgttattggtagtattactttgtatgcccttacttgcgaaaaaggttttagtccattttcttccatttgcttatcagatgttaaagatgaagggaaagttattccgagaatgattccaattgttcatcctgttctttataaacgctttttggaaatctcacttagtagaaaaaaataagtctcaagatttagttcacattccaaattcttataaaagctactgtggattattaaccagtttattgtgtcccatcgtattagaatattttcaaatattatttctaatccttaaaatgagtctcacttctaggaaatatatttatttttattttgtgaaagaaaattgaaggattacagtattgaaataacttgccacaattatacagtatttagcatgtcagagccataatgttagaaacaaattactatccatttattgggtgcttattttgtgccagatactgctcaaagccttgtgcatgtattgtctcatttcattctcaaaataatcctaggaggcattggatcaatgaagtatcatggattccatttt

SEQ ID NO: 14303 - DNA, 1041 bp, Homo sapiens
ataaaattaaatttctgttcttaaaggcattgatggatgtattaggccgttcttgcattgctacaaagaaatacctgaggctgggtaaagaaaaagggtttaattggctcactgttttgcagggtgtagaggaagcatagctccagcattagcttgtggggaggcctcaggaagcttacaattaggcagaagctggagcaggcactttacatgacgaatgcaggagcaagagaaagagttgcggggaaggtgccacacgcttttaaacaagcagatcttgcgagaactcactcactatcataaagagagcagcaagccaggagagatctgcccccgtgatccaaacacctcccaccaggctggccctccagcattgcagattgcaattcaacgtgagatttgggtggggacaaatatccaaattacgtcaatgggtgtatctgcctttctttatacttagctatcggctgataaagctcaagaggcagacttctggctgtaccacctcctagttgtctgtttggggcaaatcttaaactttttctaaacataattttcttacctataaaataggtacaataataaaatcttcctcatgaggatgctgtgacagccgtgcaagatactttatgtgaagtttcgggaaaattgccagatatagaaatatcagtaaatgttaccagttttttgttcgttcgtttgtttgagacaggttcttgctccatcacccaggctggagtgcagtggcaggattacagctaactgaagcttcaacctcctgggcacaagcatcttccccccctcagtctcccaagcagctgggactatagacgtgagccaccatgcctggctaagtttttagattttttgtacagataggatcctcctacattgcccaggctggtcttaaattcctggtctcaagggatcctcctgcctgggcctcccaaagttttgggattgcaggcatgagccaacatgtccggccaattttcagtatttttattaagccaccactaaaactggtattagtttatattg

SEQ ID NO: 14304 - DNA, 1823 bp, Homo sapiens
cagtaaattatgtaggagattgccacgggccacaaacaaatgtttctgcaataacaacaacacaaccacaacaacaaaaccgcagtagcaattgtaaagtacattcagaaaaaaaaaaaaaaaaagtatgtcttggagatagagaacaaagtaataagagtacatttgtatgaagataaacattccatactaacttttaaaaatgcaattttgttttccaaatggcttaagaccaggaagcgtactttaacatttacagcagagactgtccaagttcagggttccaagcatgaaatgaaaaggggatattgagttgtttgtatctattcaataagtaaaaatatgtttcctgaggttttagaactgaggttttagaagaaggtggagacaagaggggtaaaagaagggattcaatgggaaacttcaaagtattaattaactcatccaactgtgtagagatctcagcttaatgtatgaaaattcagtgtcaaacttagtttaaaaggcagactacagaacgagtgcttggcaagccaggaatcaacgcacttttgtcagctagaatggtttggctccaagggagtgtgagcagtgaagagcatttcaagtggaggaataggaggagaatctccttcaccctactcactgtaagcattgtaaggcacatggaaatacaggaatgtttgaaagccactggatccgatttggaagcaatatcatcataagtgtgactcagataatgtataggatctgaactggatactccttaaaggacatatggaaagaaaatgacttaaagatgtgataatgcctttccacatgtagtcatgaaggtgatatcagaggtagccttttctggttctgagcaaactttggcaggattaaaatggcctgagaggaaaccacaaactaggatattagaattaattttataagaatgcaggtgtaaacacatccatcccttatttagatcaacataatgcatagcagaaaaatgaaaggtcagtgaaatttatgcatgagaaaagcataaagctgcaaaaatatttcatctctctacagtaattcagccaaaatattcaaaatatgaaataattagcttctcataaatctcgacctataaaagaaagaagcagcagaacttgactattgactgtagagaaggtaaggttaagaagagttaaatagttaaatagtaatacttttttaataaaaataattgatcctgggaaaaatctgatagtttatggttaatacatataggttttggaggtgatagttggatagtgagaactgatgttgagagccacaggctgttttcagggaatcatcaagtaacaacaggtgattgagggagcccttactgacctgatgaatgagtggggagggaagaaagagggttcagcatgaaaactgagtcatggggcctttgaatagggagagaccctaaggtttatggtctccatctcctgtccacactgaaaatttgtgcttaggcccttctaaacataggcagtttactcaaacaaacaaatacaaaaacaaacaaacaaaaaaacagaaaaaaaacaactcctgttttaatcctagcctgaaacctgctttcaacagactgccagccattgactttagttctgccatcaagagtcatatcttttccaattccagttccacatacaggtctttaaaatttgaattcagtgatcataccccctttaagaattcagttcaagttcaatattcccagttgctttaaccactcctcacacagtgtcacattagatgttccactcttctggatttcctcctctgggcacactcta

SEQ ID NO: 14305 - DNA, 2775 bp, Homo sapiens
tctgtgtttcatgtgcttcaaatgtaaggattcttggtaaactcattattatttgttcacaacattatatttttgtcaattctgagtacaattctttttatgacttactgcaaaaggaattttaaaaataaaatatccattagaagaaccaaaggatcatcatatagcctaaactaatgttttttgggtttctgcattaaaaatatatctaattacaaaagtatgacatgcccttgtggaaaacttgacaaaagcctaaagtctaaaacgataatcacccatgccccaggagtaatcactatagagtgaagacatagatgattgatagctagctagctagctagatatgatagacaggtacatagtttttgtctttttgaaaaatcaggattgtactgtagatgatacttttaattttgctgtttccattaacagcatagccattttaagctattacaaattttagggaatatttgataaatattgccaaacttttggcaaaaacatttttaccattttatattctcaccaatcatactgtagttgcaacaaacctgaatattagtaactttacattttttctatattaaataagcaaaataaataggaaaaggtggattttatttttccatttgccacctttacaacctttttaaaaagtatatgagactaataacatttttaggtttgtgggtagttttcaccatctccttccaggattatcttaggatcagatgctgtttttgctatactgtcttatgatttttcctaatggtgctgtaagctctttagagaataagaatcctgtatttttaatatgatgtaacactgttataagtctatgtttatagatttttatttagcctgtatattatataactaaaagacctctaaaataaggccctaacctgcacccattttctatgcattttttccccaaatccatttaatactgtacccatagatggctaaaaattaacactccttggttaactatgaacatggtgaaacagctgcttcttttattcgcataaatgtatgcagaattgctatgctattttaataactatgcaatagacacatcttgccatgactcatttcatgttgctgttagtgaattatgtgtatgtgatctgacatacagatttcagccctgttttattcaatttatcttcatcatcatcagtaaaacttcatcatataggagatgatgggtaaatgattacttacagaacagatttaaattaattagacaatgtatagtttattctataaatgctttcatctaagcttccaaaataaaattagtctttgtaatattttagtatccaccctttatgctttcttcaatttgttgcctatttaagagttaattttgacatattctttgtactgtattattccacttttttctgtaaatgttttttgtcatgttatgtttaatactttttattttattttagccaagttgtatatgtaaatacacgtgaaagactttgagtagtgcttggtataaagtacttaataaacattgatggttgccattctgtaaatgcttcaggaaaattcttaaatattatgtctgaaccactctagtttcctaaattagcctatggtctatgagtcttgatggttttgcattgtaagatagcagtaattttatggaggcagcactgtaaacctgcactattgaacattttcaaatattgtgtacagtgtacaagggagtgaatgagtcctgaatagcacaatttgccattttaattttcctaaacaaaagtttagtttcttttatccttatttgcctatatacgtaactcaagacataatagttggttgacaagtttctgtccagattattacagttcaccaggaatttaggtgaatataaccaactccctggcagcatattgccgtgcagagagcatgggcattcggctgggagacctgggtgccagttctgattttgccactttgtagctatatcaccctgaaaaagaatctgtctgagtctcagttttattatctctaacatggaaaaagaatgtttgcttccattttagtatgattttgatgcttaaaaaagaacaaaaaagtgatggtgtttggggtgtagccattgcttactatgtctctgttctttttcactcttgctctttctagcctgtatatctcatgatccagaatgacaaagaaatgatgagataaagatgaagtaagcatagtttcccaacaataaacgatctgtgtataaagattttatcctgtaaggtggaactttttatgattttaagacaggaattgcctgacgacattcatacccatttgtaactgaattaatgaagtactttttaaagcaaaagagattttcaaaaattgtgaaatcactctgtacttattgttgtaattaaactgtggagtagagatcacagtcttatcaaaatttaattttagtaaattcaagccaagccactaaaattttaattgtagtatcatgatctctcttgtcctttacttgtatacacacacaaaatttccttctgttatttcatcgtgtttcctaattcttatttcttctcttgatccagttcagataagcctgtgatccactccacggcaacccgagggagaggtcaagtcacacagagctctgtgtcaccccctgacagtttcctcaccacagtcagaatggcacttgtgacagacactggagtttctctgctatctaattaaggttccattaacttaactaggttaaccatatttgctttctat

SEQ ID NO: 14306 - DNA, 1034 bp, Homo sapiens
agcgagagtagtactttcagacttattaataactgttggaagaaatacaaatttcacagaaattttagatggagttgaaatcacaaaatataattaaatcttgaccagtgaaaagtgatattaaatacatctcaatcatttgttcacatcgaatgagagaaaataaaaatgctcagaaaataatgaaggcaaaaagattatcttaaaacaaaacattacacaaaagtattacatcaaggcctccaaaattcaattaatgaatgtagctgagcaatcccagaaaaataaaagataaatgttgacaaattggatgttatttgatgtgaacaaaaactattgtgaatttattaccgggctcaagaagttagaagacccaaactacataaaacacatgaaatgaaatcctataattatggctttaaatttgaagagggaaatatatttaagggggattattaatctatacatcaccacacacaaagattaccttatattagcattaaacctgttggattgttaaaaaatgccttaaccatcaatatttgatttctttaaaaaatcgtggcttaggactacaataagacactcaccaatatcaacactgagatcccttaagcctagtagtattcaatctgctgtgataggtgatttttctccatattcaaacagagaataagaaaataaagaaaaaatgtatgtttaacaaggcaagagaatggtgtttggggattattcctcactgctattggcataacacaatgctactgagatgaaactagagaagaataatttcttttatgttcaagggacagtatagttagtgaaataatggaaacgtatgttaaacttccattcatagctaacttgtgataactttgcttgcaaattgtaaaattcaaatgctatataaactatagtattattaaggataataacaatgataattattgtatacagcattgtgctaagataaatggaatacctggagatcctgcaagaacaaagccttctaccttctgaattttgagctgatt

SEQ ID NO: 14307 - DNA, 1034 bp, Homo sapiens
tgagccagcctcataaaaggagctgtaaacagggcacaatgagaggagtctgtggctaaaccaacataatattttaagattttgtaatgcatgctttcatatccctacagagctgttaaaatcactacaggaaatgtctgacgccacactcattttttcgaggcttcccttgatctactgtgtgtggattaggtactaagtagaagacagtggatatacagtgtttaagggcagaggctttggggaatgagcaagccgatgtggactactaagtctgcaatttccgggtcacaggacttgtattatatagggctctctaaggctcagtatttctctaaaatgagactaattataaggcacttgtgagcttaaaagagaaaacataatattcctgacatatataggtgctcaaaaggctacgatgtatgtgtttactgttatttctattttgaaaaagttgcgttttgttctacaatatttgggggcagtttgtttttccttattgccaggatttcatggactacagactgtattcaaagtaggacttagctagaaagacttagcctgcaaatgaagtattgtcttatctcatagtggcaaactctatttagaaatgcttaagacaaaactgtaaatacattccaaactgatagaatttttggtctgaattccttggggttgttttctaataaattaaattgtaatcacttgttaatctgcttcttaaatatatttcaaaattcagaagaaaaggtgaggaacacaaacacgagaactgaagtaaaggaaggatatataagatgatagggaaagaaagaagagattgataagggaaggaaagaagagattgataataattgtgctacctcaacataatattgtaacattttgcaattctagtttcagaaaattctgttaatatattagagaatttttgttattaattttataaatagcatctcaattctgaatggaaaatgtattaacctctagagagaagaagttagcatactaaactggcaacatatatttaa

SEQ ID NO: 14308 - DNA, 1032 bp, Homo sapiens
ttgacagctgccaaggctctaccaaaaccatctgtcttattattattgccttttactgaatttcgttgaaatttctcatatataagaacaccacccgagcattgcctctgactgtgttacaattatgccagcctcctttagtaattgctcaactattcaaaacctttcttataaatattttaaaacaaatcgacatcatcctagtacaccatttaatccactgtcctaaaatatctgggcgatgtcttattgctatgctttctatgcatgggtacctcagaagaaaaattagctatgagacagtgttctaatgatataattatattcactcatctagaacgtctagaattctgtgacagcaaatggcactcttatagttctcaatacttccctaacaaacatcttaatgctacgctatgtgatgtacctttgtgttttgtattgatctgtagaaaaatctgctaagtaaagcaaatgaaagcaagtgttatttaaggacatttaaatagtttaactgacagattgtgtaggacttgtagtgagataaattatacaaactaatttccttgaaatgcgattgaggaaattgaattagtataagatagttcattgatagaagaagttctgaatgtcatctgtcaaataaaaggctttgtctcaattatctatagcttattatttgagcaagagacatcatactataacttaaaccaagtaatgcttggtttaggggatgttatttcattagcaacttagaaattacctgtactatatttaaatataataaactatattatacactgtattatatattatatcatatattatataattataacatcttatatgtattatatgatacataatatattttattaccaataaaatacaatatgatgtattatatattatatatcttatatgtattatataattatataatatatatattatattacataatttattatatattgtatattatattaaatacagtaaactatacttattactatgagacttaaattagtt

SEQ ID NO: 14309 - DNA, 1061 bp, Homo sapiens
tcagtgcaagtacctgctgagcgccacccactgcatgctgggtcttggtgaggtgaggagtgccacaggatggagggatgttgtccctgtcttcagggagcttggggactagtccaggactttccactgcagggagctagagtgagggtatgaggaggataggacacatgtttatagtggcagagaccagagaaagttctcagagaaaaaaaaaaaatggcctctgagctccagcctcaaggaaagggaagtgggaaggaatgagaactggaccgtgtctgtctttttctctctgtctccccagcactagggaagcactggagcataactgatgctaaaggtatttttaaatgaatgactaaagagcataccagacagaagatgggcgtgaacaaggtcttgaagacaaattgcgcctttcaggaaggatacctgcttggatcaaggtggacaggcgagagaaaagcccagggtgtgggttaggcacttgtaggcaggattttagaaaggacgcttatgttcctgtttaggaaagataattccaggaaagtagaaaagaggacacaattgtgacactggggtgggggagtgggccggatgtggcaattgactgtgatgctgggtacagggaaggagaagtcaatggaactacattttctgtcttaggcaattcactgagattgggccgaaataatagaagcagctccatggtgcatggactgactctgggagccagtatttaaatcaggcactgtcattttacctgtgtgtccttgggcaaggcactgcctcctctgaaaccatcgtgttattagagttaaattaattaattcagatgcaattgcctggtttataatggtgctcattaacgtttattaaatttgttgtttagggactcattttatttgtacttagttttacaaatcaaaaccataaatgaagcaactccccatacttctggggtaacttttctaagggaactttttagctcaaagagttcagcctttgcctggggaaggtaatcgctctgcactggaaaacatgatacaattctgtacaaa

SEQ ID NO: 14310 - DNA, 1034 bp, Homo sapiens
ctttttaaaaaaataggtgtgtctgaatgttcattttttttctggggttcttttctgatgtaatttctttaatttgatctagaatgttttaacatttccgtcttttaatgttttcataaatactgcaagtatttcatcttcctcacaattgaaaaggtcaatatttaagccacatcagtagtgactacattaaattacctgaaggcacagaatattttaaaactgtaggcaacagaacccaggagcacagcagagtctttggtattggaatctaggtcagccctctaaaacgcatgtgccttcccaaccattgctttttctctctaggtcacttcgaggtttatatgcttccttcaaatgcttgcaatctgaaactgttacaaaagggatgaggtttctgaatctttcttcgtttctttctatataattctacaaaatcttatttagaactatgaatgacagtaagaaaatatttaaggcaacactttttttaaacctacagatgttgggattgaccttttaatttggtgcatcatattttttccgtgattttgtgattaacagcccacaggctttagggatctgggcggaagaagccacaggtgaaggccagcaccaacactagtgagaattgttaccagttcattaagaagacacttgcaaaatgtatattcaagacttccaagattgtagaaaataatttatttctgtgtacatttgctcctgtgatcgctaattgaaggtaaccgcacataggattaaataaagcatcccatttctcaatttaatatttatttactcatgtaagttagacattttgaaaccatgcttttttttctgatggaataaagcaagggtcataagaaggcagataaactctgcagtggattatattccctccatttctatccctctgtaagaacaaaagagctcctgggagagtggggaatgcatgtgtttattttccaattattaaggagtaaaattatcttggacatcctaaaatatcatctatgcttcttccgtaagcatag

SEQ ID NO: 14311 - DNA, 1470 bp, Homo sapiens
cagattttaataagccaaaagtaggacaaatcttgggaaaaatgtgcaaaaaactaagtgaaatttatattctctaggggaaaaagatagatattcctttcatatggaagaatcttttaaaagttgtcagaattagaatggagtcacttgtgtttcaagcctgacagatggagccgagaaaggttaagaagagaggattctcactcatgtatgcctgataacaaggctgccacaaaagactctgcaaaacctataacccacaaaggctactgcaaccttacaaaaatatatatacttctgtgagtgcatcggccccgcaactgcctgtccaaccttggactgatgccacccttgttatcgattcttgtagccaagtataattgtctcacaacaacttatgtaaccctcctcatttttctcttaaagattcttgcctccctttacctcctggaacacactcacatatattcccattgcaatgcctatttccaaataaatataattttcttttatagtcttcctctctgtctgttacttaggcttggcaatctaaataaatatcataaagatttcattgtaaacattgtttggtacagtcatttatatggtagtccgtgtgagctgttccccatggggtatatatctagactgcaaaaacatttgcgttttacaatacccctgcaaattagcagtcattatggtcccctttgataaataaactaaatgaagcctgaagagaaaaaagtaattttcctaaatcagacagcctgttaatgagagagacctagaactcaccagataacatttgcttctggcataaattattatttgtagaaggaaccacattgaaatattttgagttcatttatcattggtacattttccgtgttatcacaatagttaggtaatgcagtgtggaaagaataatataaaatctacaagtgcttcttggctggcagccatctactggctcaatgacttttcctgttgttgaaaactaatgctcatcagcattgaaaattttcacatattggtgtgtcattttagacatttgcaaatagttcccctatttgaagtgttaagccttttgtttttactgctttgattttattagttcttgcagagtcatccaggtgtagtaatattatacaaaaatgcatgacagtatatttttatgcatggtaatagttggtatttagttgtgcatattatatcttagatattgaaaataatattttgcaacaatacaaacttttacgaagctgaataaacacattttcatatcaatataatcatatttacatactgaatattttatagttgaatttaaaaaggataagtcattaagggattaataatgaaagaatgtgaatatactattatgtacttttagaagtgcatgtcagtatttggtattttaataagtgtctactggcgtgatatttagagtttcaaacacattggaattca

SEQ ID NO: 14312 - DNA, 1843 bp, Homo sapiens
caagattgcaaaaatttacatctatgttttcttctacgaactttaaattgttagcttttattttttaggtctatgatccatttggagttaatttttgagtatgatcagagaacatacttgtatgacttccaacattttatatttattggattctgttttatgccacaagacatgatgtatcctggagatttccatgtgcacttgagaagaattttcattctgctgtgttgggtgaagtgttcagtagatgtctgctaagtctaggtggtttataggtttgttcaggtcccccatttccctgttcatcttctgcttagttctatcaattattaaaaatagagtattgccatgtccaattattgtttttgaattatcttttccttttttcaattctttccgttttcgattcatgtatttgaaggctctgttaggtgagtatattttccacttgttatagcctcctgatgagatgacccttttatcattataaagtatccctctttatctctagtaacttcttctgttgttgttttcatgtctattttttctcatatcagtatagcaactccagctttcctgtagttgctgttcgcataatatacctttctccagccttttacttttaaactatttgtatttttccatctgaagtgtctcctgcagatactgcattaaaagtttggaaaatccaaaatgcgtattagtactccttctcttccaggacctggatggccagtaaaaggaagggtctacagcctccgtgtgcgactggttttgctggtggtgtagacagattgaggatgatggataggggtattgtctaaaaatacctcttcttacctttgactgagagttgacaatatcatggcaaggtgaattctatcagaaagtcctgtcttctagtggcttttaatataaacatcagaaaatccatccctgttccttaggtacaactcttgtccagccacaagatattcccctgaaataggaatcagtggtctgctgtatgagtttcccttttatgtttcttttccacagtttgcagggtaaaagataatactcctctagtttccttctttgtactccccctattatcttctcatgccataagctcaaaaacctatgtattttggatacctacattgattatatgtttatatctaaaatccaactagaatagttaaacaatgatagcaacaataacaacagcaatttaattaattatttaattaaactcatgatcttgaatctcagcaacacagacccacctgcatctccagtgtccattcagtgtctatcttattcatgtatatggaaggtctgatggatttatactgatttaatactttcttcttcttcttgtttgaacccacaagccccatcccgatgtcagaatataaattttttttttttttgctggtcttctttatgcactttgctagaattttcaacagaaagtttctattattaacagccagttgaattcagtaagtatctaccctgcatgaaatatataacacctagtacatgtgtaatataataataatttgtaataaatagtacctgttatatagccaaccttatgagaaaatgggaaaacacacaaataaacaaaacaagtttgagctttccaaaacttatttttgagctttacaacatgaaattaatgttacaggaggaattaaatactttggctttcctcaggctggttcatatgttccatgtgttgtttctttacgttttaagcttgtgtttataaaccagtcaccttcaagacctataatgctgttgcagaatataacagtcattttctatcaacttaattatagctttggtttcattg

SEQ ID NO: 14313 - DNA, 1033 bp, Homo sapiens
gtcctcacccaaatcttatcttgatttatactcccataattcccatgggttgtgtgagagacccagtgggagataattgaatcgtggggctgatttctcccttactgttcatgtggtagtgaataagtctcacgagatcttatggttttataaggggtttctgcttttgctttttcctcattctctctcattcctcatactccatgtaagaagtgccttttgccttccaccatgactgtgaggcctccccagccacgtggacctgtgagtccattaaacctatttttcttcgcagcctcgtatatgtctttatcagcagcgtgaaaatggactaatgcatctatcattcaattcactcttttaaaaagtaagttctaatgttccatggagaatggagaatgtctcctgcacttgagaagaattttcattctgctgtgttgggtgaggtgttctgtagatctttgctgagtttagttagtttacaggtttgctcaagtctcctctttccctgttaatgttttgttcagttctattcacagagttaggcaaccatcaccataaacgcttttggaacatttttctctgtccgtaagaaagcctgatatctattagcagccactccccatttccttttaatacccccaatcctaggcacctactaatctactttctgtttctagagacttgcctgtcttgaacaatttacataaattggatgatacagtatgtgtggtcctttgtgactgactccttgatgtttccaaggtccatcaatgttatagtatatatcagtgttgcagtcatttttattgccaaataatattgcatggtatgactatgccacatattttttatccattcaccagttgatggacattggggttgttcacctttttgggctactatggataatgcttctgtgaatatccaagaacaggtttttgtgtgaacatatgttttaatttctcttaggtgtatacctaggagtggaattgctgagtcaaatggaaactctgactatttcaggaactgc

SEQ ID NO: 14314 - DNA, 1104 bp, Homo sapiens
gaactgttacagtaaaactaaacaaatgcttttgacaacagcatttcccatggtcagccgtgtccaagcacatttacagagattctcattctcagcagacctcagcagtacccgattattttttatggctactggcaaacacattattgaaacccaactgaaggaagagcagactttctcagaaaaatgaattaatactcacaccccatgaatttttggtttaactatagcagcttaactgaccatttcaatctttgggttcatcttttaagctaaatttttccttgttctttttatatttaacgattttcctaaatcttcatatctttccagaatgctaattcaacttatccctttaactctagtgccaaaatttggaggattttcaatcacgttagtgctagaataaaaagaaacgtgaagtaggttataaaaagaaggatctcagcacttttacagtattcatgatttatcaactgcaatgctgagattttacatggctgactacttctgtgctgtaacacattaacctgcttatatgataaagcagtagttctcattttggggtgtgtagtggaatcctctgtaggctcattaggccatagattcctgtacctcactctccaggatttctgattcagtaagtcttacatttccatttctaaaaagttctcaggtgctgctgctgctgacagtgtagaggccaagctttgagaagcagtagtggaaaaggtggttttctcaagcctgggagacagggccagactctgtctcaaaaaaaaaaaaaatacttttgcatgacatcaggcaacagcttgggttggagggatggtgtagctccaccacacaagtgcattttcttaaaaaggaatggaagtcaaactgggctttattgtttttgctgcagaaggtcagtatgatgaccctatttcctatctactctgccacttttataacaagaggctttttattaagtaaaaagtgagctagctttctaaggatgcatgcttctcaatgatacacatatacattttctaagagagagacatagttgtgattaattttatgttcacaggagagcatagaaggtatgacaaaaggaaa

SEQ ID NO: 14315 - DNA, 1873 bp, Homo sapiens
gctagctataatatgaaatgcagagaagagggggcatgttcatgataggctatttttggagctcttctaagatagacaatggatacaggttttattgaactttgggtcagaaaaaataaaacagtgcacataatctaatagcttaaagagaaatgtccttgtccaggtaatgattcatgtataaccaaaatggtgaaattggtactgtccccccaagctgatctgaaaccatgtttttatttgtatagattgaggtattagttatcaagtgaaaatacaaatccacatctgttttttgtaggttttgagaaggtgaacaaattgttaagccattattgttttatttgcttctccaagcagaaatatatcttctctgaaaagagatactgcattggaatatagttaaaataaaaatcatgtttgttgctgtgggagatttgtgtgtgtgtgtgtgtgtgtgtgtgtgtgtgtgtgtgtgtatagatatagatatagatagatagatagatagatagatagaatttaatatgactctctacctattctgaatttcctcacagtgttcttctctttgaaagaaaaaaaaaaaaaaacaagtcagtggctcaactacaaaaagcactctattttctgagtgatttgatttaatcaaattaaatgagatgagttctagaagcacacactgatgtatgaatgcagttgcagctgccgtgcagggcctgacctgaagccttttctgtgcttctgtgacgtggtttatgcactttactgtagtcactgcagattagaaccacacgcagtaacgtggatatgggccagataacaataacaaaaatttggaatgtcagtgctactaaaagggaccttcactcaaattactcgtaaaattttttttcaaaaagaaagataagattgcatggcttaataaaagtgttaccggcactttaagctgaaaactgcccaaatgagaaataatgtgaaatcgaactcacaagtccctttggtttactctaactgtgagatccctgtcacctgtgagtatacattggcacagccagcttcagggtagaagtaggttctgactgagggacaaaacgcttcctaccgctgacggctgcagttttgtacaaataaaaatacaagagtataatattcccagaagagtttttcttctcatttttgtgctagaagacatgtttttaatcgccctttccaaaatttacccaacttaaattttcttaaaattgtaaccagtaattataataccactgtttttcaattcagtactacattgacaaagaaacatttgatgtatctcatttttaggtggaaaataaagcagagtgtttttaataaaatgttcgtggaataaaactagattattgatttgtggggcaaagattatatctatattaacaaacaaatataaaaacaaacaaaaatgaacagcgattatttaaaagcagacggaacgaaattgatctagaggtggctggtgcctgctgacccgggaaggtgggtttggttggctggattctaacactgcccgatggccagacccatgttgggatgtttgtgggaagcactggatttagctccaaggagagggtctgtttgtagcaatcctgcaacaagccgtctgactctgacagatgcttttcctgcgtacctggttggaatgacctgaaggaaagacataatgaattaacgaggaatccttcagatctttcaggtcagatgaaccataatctagttgaaaagaaaaagagaaaagaaacacgctaagtaaatctgcaagtttagttgagaagactacaaggagtatcagcttaagaaaatgccttaatgtttaacagacactccataaatgttt

SEQ ID NO: 14316 - DNA, 1092 bp, Homo sapiens
ggaagaggacaaaggcttctggctgccacaatggacaggactctatggatgttaatgaaaggaagaacgaggagttgcgaaggaccctgacccttccaatgtaggcaagtgagcagcaggtggtatcatttcgtaagacgggagaggcagacaaacaagtttttgaagggtgatggtgtggagttcagttttgtacatattagatttgaggtgcttgtgggatccaactggggttagcaaatcttcattatataccccaaatatgaatattttattgctatattatgtatatataaatacattagcactaatgtgcatgtatatatttatgcacattcagtatatatacaaaatatttacataagatgagataaagctgaagtaagcaatattttaaaacatttttgcctatgaatgatatataatatcttttttacttaaatagaatggattaaatataataaatattatattaatgataacatgttaattatcagcttgaaggtagaataataggattgaatatccatcattatttctaaaatcttagtttaatatttaggataaagtgcttggaaaatttacttgtaggttcagttcatgtcacagttttggtttcagtaccagatataatagtttaaaagataatcacaaaatgtgtagttctaaatggaaggacaatatggacttcatgaaatcattagactttattttaatgatgtccacaaattatgaaaaatttttttcctcaaacaattgaaatgcgatttttgaattcccatcttccttaaaattaactgtctttacaaactaaaagaatgttgaatttttgcattattatcaaatgaatttaaaccgaagctaaactctggaatattttgaaatatgttagaaagttctctgtctgggcagagatgagaggtggcatacattgttttcaacaacaaaatcccaggggctgcaaatacgcgcaaacatcttgttacaaaatactctttccaaagcttaaatgtcttccctgaaatcagttactgtcatttctacctcatcattatataatcacctttctcagaagtgccgttgagtatgttt

SEQ ID NO: 14317 - DNA, 2793 bp, Homo sapiens
aagattggagtctgaaagatggactggaagaaggataaagtgaagatgttaggacactgcttaaataacacctacgattttacatggtgtgactggaataggagcaggaagatggcttcatctgcatggcattcattagaattaaactaagcactaaactcggtaggccaactaaatgtcagccccttacccctagtcttgttacatagcaaatatatttttttctaggaagatagaaattattagtttaattcagggtggaggaggtcaccatgtatcctcactgtctgagagggcaagatatggactcaaacacaggcagaattttgcaaccaaagagaggcccctgcaggtgagggggaagcacctgctgtgctctctcttactgtgaagaagaactgttaatcctccacttgctagaacacaataattactcacaagtgaaatgtgatagaagaggatttgttgtcgtataatgactttcatactcaaaacatccccgaactctgcagatgagtgattgaagagctctgcgccatcctcccacctgctcagggagtaactggaacctccaacagcatgtattttttttaaaccaagtgagatcactggagggaaagactagggtggaggtgtgtttggcatgaatttaaatgatagcttgaataaaacagatctctaaagcacttttcaactcttgctatcaccattgtttctgctaagatctctttaatctctgatatagcctggatgcatgttcatacacgcatgcctcctgccagttacctgttacgtacgacacaatttgaaatgccttaaaatgtgatctccagtctcctttaagtaggtaaagcaaactgatttccaaatgcatggtgctttatatagtgtaagcgattacaggaaaaagaatactgcaactgaaaaggaaaaatcaaaacactcaatttgattttaatttattcttaaggaaaaggaatgcatagcggtgcatttcagatgttattgtttttgagcatccccttgggaccctgctgaactgtagactctgattcataggatggagttgggtctgagggtgcttttctgacaatcccccaggtgccgatgatgctggctttttgtttgtttgtttgtttctggctacattcagagggcctatggtataatgccaaaacttcttagtagatgtggaaagggtccatggcaggctctttagaagcccattccttcacaagtacttcttgtgccgagtttaccgtgcttccagcatttggaagttcagtctgaacagaagtcgtagtcgcttttactcacatttcgagcacctaattaagaaaaatataaaaccatagtgcatttctgaagccttatggttctatgatgagtttttttaccgtgtttttttttaatctgtatactgtattgatggaggatcccttgtaagtcagttatgattgctttctcacagggaaacctccatcaaatgatcttagagtatttcaggcttttttgcagaaagaactggtaaagtatcattttcattcatcatcctcgtcaaatgtcttttctcacacccgggtggctctgtgaagtgctgcaggggaggagagaaagcagatgtcacgctgactcctgggagtctgcgcagctggtggggcatccggggtcccaaaaccctccccagatgatttcaggttatttgtgtcactcaagctttgatatttccctgtgttctcagcatctcccctctcttttcaggaccattgtgcattatgtcctctgtacttacagaactcaccccaaatccatgtaacaggtagatgcgtaaggaaaattctagcagttcatctgatagtgggaggtggtatgaatgaaaaggaccactgatgtcaagaaatggaattgtctttttcactctgagacccaacgccatcccatgaatcagaatctatggttcaataggctctggaggggatgcccaagcataataacatctgagatgcactgctatgcattccttttccttaacaatacattaaaatgaaattgaatgtttttatttttccttttcaactacaatattttctttttcctgtaattggttacactgtatagagcatcctgcatttgtaaatcagtttgctcttcctgtttaaagggggctaggggacacatttctgagacatttcaaattttgttgcatgtaaccggtagctggtggaaagcatgcccgtatgaacatgcatccaagctctatcatggattaaagagatcgtagcagaaaaggactatgttcttttcattctaaagcaagaaaaggccctttactgtgattaagagttgtccttgcccagatatattttccattcagtaaatcagaacttgaactggggagaattcttcccgttagtgtcatcctatctgcctcccattgttcgtcacgtaaatgctaagttgagattgatgggcttataagggctgtgaataacatcacctaatgttagtgacattcataaagagcttcgccatttccaaagattttcacttaaattatctcagcaacaaattagagagactcacctgaggtcacttggctagtgaatattttaaaggatattttgaaatcaggcgaggactttcatagctagaaaaatactgttaagtacccttcatatacacaataatacttaactcagaatattattggattctgcttttcttccttgtgttacaaaatatttccattttcctaattaaattttatttttttataaaattaaaaaaatccca

SEQ ID NO: 14318 - DNA, 1814 bp, Homo sapiens
tgcatgatttaacaaattttaaaaaatatcttgtatatacaaaacatgggatggaggtggccataatagttgtgcaattcacttttgttgagtaaatgagtgaatacatggatgatgacccctgcccctcaagagcatataatataattagagaaatagagttgtttaaaatgatttattttccaagccaggatgctagggatcactaggaaaggtcaagttcagcaaggaaggattaggaaagatttcagttaggaagtagcttttaaatcaaataataaagatgagtagaatcttaacatatgaaggaaaaaagggcagtctgggtagacagaataccgagaacaaaaacccagagactagaaagaccagggtgtgttgtggaaggagcttactgtgtctgatgggtttgatgtactgaaaaccttttcaagttggttttggtccagttcttttgtctccatgtatgagagactgacaactgcttcccaatagacattctctcttcactgtcgaggaatagaacccgagtatccgaaactaatttgcagctgcatgtgtcagtgagaccaagtacactgaatgtctgtgtgcatttggtgtaatcctttagggggatcatcttaaatggaaggcacattccttttccttttatcactccattttgccacctgaaatgcaagtgtaatgttcaggagctccagcagacaccttgaaccttgaccaggaaggtcatgttataagattggtacaatttccaggggacctgatgaatatctgggtctcctaaaccaatatggaccacctactgccacttttaaaatgcaagaaataaactgtttgcttgcagccactatttttggggattttgttgttatatgtagctaacaataaccctgacctacatactcttcaaatagatcacaatccttctgcagtttccagtcccaaagactcaatcctctgtttctttcctattcgtatagttgcatgtatagagttaggtacacagccgactgcatttaactgactaaagaatgagtgattgaatgcgtgaagaaatgactggaaatacatatcgcagtggcattgctaaagggttttatcaactgtgttgacttcttttagtttcttttatatttagatcttagggtatgtataggatcaacttgtagatctccctttgtctacataagagcattgcaagtccatggtatatatgcatttgtagaatatttgtgtttgtgacttgtttttatatattaaagggaaggagatacaagtttaagtgcaaactgaatattgtagactatgctatttcaccagttgaaattattcacagagtagtctaagttccatacaagacataaaaagtggtatttcactattttaatttactttttccactttattccttgtctcccaaatgttttatgggtcaaaaatatctctttatttaaaaattaaataatacttaagagtttttttttcttatgcaggaccacattttccccactctaaacccaggattggggtcatactctgctgctttctcactgtgtgtcatcgggcaagtttcttgaactttctctcctttaatttcctcacaggtggggaataattgaacttatatcagacagtggattgcattaatgtatggaatgtgcttgtacaatgcctggcaacagcaaacaatatgaaataactagcatttcttataaaggagatcctctcatgataagctatagagcttagactttatctgtatataaaataataagtgatttaaattggaagcagaagcatactagatg

SEQ ID NO: 14319 - DNA, 1033 bp, Homo sapiens
ttcataaaagatttaattatgcagaaagtaaagactaagcattttttgatgcttcagtactgagtggaaataactcaatgaaacctacttttgcaacactgtatctttttggaagcaatagcatttgctattaggggcaacgtctatgttacacaatataattttttatcattagctaacatttcgtttctctccaaacatctttaaaatgctgttaagtttattctcaatttattttttggtctgattccattcgcagatggcttatgtttctactggctcttctttctttcactgatttttggtcattctggcctccataccagggaaggcagtaaagaggtcatccatgtgcacttcagaagttttagggtgtatctgctggaaaacaaagctgaaataagaaattggagtgattaggttcatctcccagtaaatttcatttacttttaccaggggaagcacttggggatcttgcgaaaatgctaagcctgattcttcaggtctggggtggggctgagcatctgcattgcagataagtttccaggtcatgatgtgttacaagtgatagcaggaagacttgaccattgacaaagggagattcgaggaggtccttttagcatttcctttctagagcagcagagaatgtggatgattctctaagtggagcgtgaactatatgcagtcagaatgtctagcctcaaacttcatccctgcaatttaaaagctgtgtgacttcacgctatttccttaacttttctgatactcagttgcttcattctgttatgacaataatagcatctacctcttggcattgttgtatagattaaataaattcagataaataaaacgcttagaatactatctggagcattttaagtatcatagaagtgtttgttagataaataaaatatgctttgcatgtaaaacacagcagcccaccatgagtcttcattaatggtctgctggccattgttatctaaatgttaaatgtatttctactgcctaggcaggtatcagtggcctggataat

SEQ ID NO: 14320 - DNA, 1030 bp, Homo sapiens
tacagtttgaggctgaacatgaagtgccacggagagacacagaggatgcttagggaatttaggatagatcactttttgcatttttcattgaattatactcatatgtgttactgtttgtccacatgtggcaagtaacaaggaaattagctgtccaaataattaaagcatcaaaatacagctgcttgcattttgaagggaaaagtaattttaaggctgcattatttgggaaagttacttgaaatcatgtttggttgctgttttcaaattaatgaaccatagtaaactattcctcttgaaattgaatcatttactctgcatttataacatcaaacattccatcttagagtttctgtcgttctttaggagaaaagttacattttcatgcgtatattaaaatcatcccctctttgatcatgtacctaccaaccatacttttgaacattgtaaagagtattagtgcaaatttgctcatttgatttgtttgaaatattttgggaacagttaaaggttaacagtttgtagaaaccaccaaaggaaacttcgttgtgttgtaatcagcaacaaaaggcatcatctaacagctgaaagtggcaaacaatgaattatcctgaaggaaagcatgaattagttttctgactgattgagtacacttttgattcaatagagtggttgccatttttcacagataatttcaaaagtggaataatattatatctgatttcttcttaaagtttagatcaaagtgaagcaggttcagtttatttttcttgctttgcaaaaaaagtagagaatttcattagttatctattgctgtgtaacaaattttcacacatatagagacttaaaacaagtcgtgtttattatctcacactttctgtgggtcagaaatgtggacgcagcttagctgtgtcctcagcaaagctacagtcaaggtgtcagccagggttggggtcttatttgaggctctgctagggaaagatcagcttccaagctcacgtggttgttgaatcctgctccctgcgagctgttg

SEQ ID NO: 14321 - DNA, 1683 bp, Homo sapiens
gcctcaccacaaatggctaattttttggatttgtaatagagatggggtttccaaatgttggccaggtcttgaactctccacctcgggtgatgctcccaccttggctttccaaagtgctgggattacaggcctgagccaccgcacccagccgagatgggtaatttaaatattagggtcacttcatcactgtaaatgttttctttttccttttgattagaaatatttacaaacatcccaaagaattaagacattattataataaacccacatgtaactgtcttatacattttacaattattacgaattttgccatatttactacttctatttagttttaatttatcattgaaaacatttttcgatgatatagcaagcaaagaagacagaaatgtgagagtcctgggcaactaggatggatggccaggtttatcatgtcaaaggcttaggtaacctgaatatgaatgaataatgtgaagatcagaagaacacgaaggtttctgatttcacgtttagagctgagtagagaaaggatgtgtgtatggttttggtgggatggaaataaactttggagattggcgataatttctatgaattcataatttcaatatggcagagtcttttagtctggtatatgaaaagaccttgcctagggcttgatgatgcccagtaaatgggagcaattcattaaaacccacgggaaacatcaataaaattaatatagtcctcacttgagatctcatataaattttctgtatagaagactgatttacaagacttttataaacagactttgcatattgtatggtaaaatcctctgatttattgcacctacatttattgtgcttctctagaaagatgattcaattattgaacaactgtagagtaaaatggaaaacataagttcagttggagtaaaatgtttcattcctaaggctggaatttttttctctattttaatttagagattaacatgtgctacattttagattgactggatcctgataggtgcgtaaccaaaggccttgaacactttggttcacagcctttttgagaggacaaggggagaaaccattgtagtgatcctccatctcctgtaaacctgtgggtagaaatggtcttgggaaacgttttgtgttatgtcgtctgtcaggcattggaaagccatgtgcctccagattccactgtagaagatgtgaactttgtcctgcaccctagattttcagctttgtattctgttatggttggttgtctctgttgttctctacttcactcggcatttatccagtcagccatagttagtatttttattgattgaggactgagatgaagtgggtaacagatatccttgatgtcgagctagagctaccagacaaggcaaacctggtagccatgacagagaagatggagcaggttgaagaaaagcctggaagctgtgctgcatgaatgaaaacaggattaccctgagatagagaagacacagggagacacagcaaggttctttaacttgacgaaaattgtcctgtggaaggaagtcttactatccaatgctttgtgttgctttaggggtgagagtgaggctctgtgtgcaggtgttttggcaagaagatctctgctctacataaggaagagtgttctatgaaaggagttgctctcctacaaaagcaagggctgtctcaggaactc

SEQ ID NO: 14322 - DNA, 1045 bp, Homo sapiens
ctttatccgctgtgttgctctcacaatgactaagcaccaaatattttgttgtttatattgatctacattgcaaatatatttttttcagttaacatatactctagattagtggcctttggggtcacagtggaacatcctggaaatctttgagggcgctaaggccagggcatcccaaccctaagagattctgattttatcgtcctgccggtgtcatgggtctgggctctgtcaaagtctccctggtgattctgatgtgcagccaaggttgggaaccaccattctggttcacagtgacaattgatatagaatgacctttcagctcctatatctcagtagtacatcataatcccatttgctcaactgatgaaagtataactcagatatttttaaaaagtggtaatggcagtaagacatatcccaagggcagggaacgaatttctattgatgagactgaggaagtgcatgagaagtgaactaactgggtctcagagttagggaatgtgctagaagggatcatggagagaaggagatggatgtgtggagggccagagttttgactgtttaaggttgtgtcaggcaactatggattttctatgttttagccaaggttgtaatatcagtcatcttttttattttttaagtttaattcatgagatactatataaagttaaatttaaattttatctaataagaaatcaagcatcattgtaagctacatagtggaatttcttcaatgtaatgctctaatttactctgattcttttttttttttttttttttgagttggagttttgctctgtcgtccaggctggagtgcagtggcgtgatctcagctcactgcaacctcctcctcctgagttcaagcgattctcctgcctcagtctcctgagtaggtgggattacagtagctgcgattatagcctaccaccatgcccagctagtttttgtatttttagtagagatggtgtttcaccatgttggccaggctggtctcgaactcctgacctcaaatgatccacccacctcggccttctaaattgctgag

SEQ ID NO: 14323 - DNA, 1075 bp, Homo sapiens
cagttaaattaaactcaaactgaccttgccttattctcattcttcaagaccagaaacacagctctctgaaaatagtaagtctgaatttacaacattaatttagagtgatacttcactagacaagtgtatcttaaacttttttatctatttttttaaccatatcactttaacttatgcctgggaataaaactttaatggtagaaattaataatgaataactactgcaataattgcagttatttattttgacaagatatgttgcattgaaattgtaaagaaaaggaaactctacgtcttctaattctactagtaataaaaggattgcagagggttcagtttagttgtgtttaagagtggtaccctgtaataattatatttgcctccttccctgcatgtaaaccctaatttctgataatttccatttgtataactcagtatttaaaagacagtctgtattgacaatagactgcagcgtattttcaaatgagcatgccaaatacatcttaatttaaatgttcaagtaaatatattaaaaagttttctttccccttaacctaaattacctctcaactgtatatttacatcatttacataatcatagcgataaagtatagtgtaagttaactcatttataacgttattgcctacttctggattatgtttttgtgtaaagtagaagttaattgtaggcacaaaaaagcacattatgaaaaccttaatttctttaaaaacttagtcttcgccttgataagtaaatgcagacacttgatttcttatcaccgcaatggagaattaattgcatgttatgtcgtgcagacgtttattggttgtggggtgtttttttgttgtggtttcttgtaaacttgaaatatttattccataatagctgttgtcaaaaattacagttgcaaatttgaagtgtggtgttcttggtttaagactcacaaatcaattggttatatgtagaaagggagtagaagcatagtttcttagtttaacatatattttctctttgattctgaaaaagccacaaacacattcacatataaactatgccacattacttaaaatgttt

SEQ ID NO: 14324 - DNA, 1060 bp, Homo sapiens
gctgggattacaggtgcccgccaccacgccccgctactttttgtttttgttttgttgctgttttgagacggagtttcgctcttgtttcccaggctggagtgcaatggcaagatctcggctcaccgcaacctcccgcctcccgggttcaagcgattctcctgcctcagcctccggagtagctgggattacaggcatgcgccaccacgcccagctaattttgtatttttcttcagtagagacgggatttcaccatgttggccaggctgctctcaaactccccacctctggtgatccacccacctcggcctcccaaagtgctgggattacaggcgtgagccaccaggcccggcctaatttttgtattttttagtagagacgggggttcaccatgttggccaggctggtgtcaaactcctgacctcaagtgatccgctcacctcagcctcttaaagtgctgggattacaggcattagccactggcccggcctgtggtgttgttgttattgaacatatgtgtcttgctaccagatggagagctccaggtcaaagctgggttcttgaatcatagcttcctaatcttgatcacggaataagtgccaagcatatataaagtagaccatttacataaataaattaataatcatggcaactctagaagatacttagtgaaaaaaacccttgattgtctttgaaccaatcaactaaaataacatgatgaaatggagactgggctttgaatcaatttggagtttgcctggtttcataattcatggttcttctcatgtaactaatacaaagtccagcttctgacattgtaggagctcagtagaggttgaacaagctacaaatgtacacggataggtaccctctcctaagatgggcaagtggaggctcctctaccttaacactattcatttttcctccaaaataaattgataactaaattgaagagcagatactcacaaaacaatatcatgagactttacaacatcacagatgattttagatattcaggcatattaggtcaattagacatacgaagtaaataactgaatgttct

SEQ ID NO: 14325 - DNA, 1169 bp, Homo sapiens
ggaagaacatggaaggacttgacttgctgaatcttttggccttcatctttcttctatgctggatgtgtccttctttttttttttcattttttttagacagaattttgctcttgttgcccaggctgaagtacaattacactgtctctgctcactgcaaccttcgcctccctggttcaagcaattctcctgcctcagcctcccgagtagctggggttacaggcatgcaccaccacgcccagctaacttttgtatttttagtagagacaggttttctccaggttggccagggtggtctcgaactcctgacctcaggtgatccacccaagtcggcctcccaaagtgctgggattacaggcatgagccactgcgcctggccctgcttccttctcttgaacattggattccaacttcttcagcttttggactcttggacttacatcagtggtttgccaggggctcttgggcctttggtcacggattaaagactgcactgttggcttccctgcttttgaggttttgggactcggactggcttctttgctcctcagcttgcagatggactattgtgggacttcactttgtgatggtgttgagtcaattctccctaacaaactcccctttatatattcatctatcgtgttagttctgtcgctctagagaatctatctaatacatacctaaatctaaccatatcaataattacattaatagaaatggtctcatgaaaggttgtcagattggataaaaataaataagactcatctgttatgttgcctacagaaatctcatgtcaaatatagaaagatgaatacattaaagtgaaggggtgaattttttgtggggaggaggcaaaaagttctaaaattacattgtagagatagttgcacaacattaagaagttacgaagaaacactgaattttcataacttaaaggcacgggttgtgtggtatgtgaattatatcttgataaagctatttttaaaaagtaaaggatgaaaaaatataccttgcagacaatgaacaaaataatggagtggctatattaatttcagacaaagtagacttaagacaaagaaatacaaataaaaaatgaaattgtataatgatgaatagatcttcaccaaaaaagatgcaataattttaaaagtctttgtatctcaaatatagct

SEQ ID NO: 14326 - DNA, 1045 bp, Homo sapiens
aagagcaaaggaagagagcacatgaagtgctgggaacagtccacatagactaacaataaattatgaatatttctgagggtgcaccagcgctggatggcatcaatgtcacccacacggttctgcacagatgggaggttatgcatcattttaagctttaggtgataaaggcctggacccagtgacgatggcgcagacagagaagaagaatggatggttttttaaaaaattagctttatgccctagtttcttcagtttcattccctcctaaaaatcaaccaaaatacaacattcattgctttgtcttttcactacgacttctgagcatcagccttgccctatttttgtaggtcctgagtccttccagtttcagctcagatgctatatgccttctctgtttcttctctgctacccttggaagtaaacatgccctcctgtgaggtccctcacattagtaagaatgttttatgttacttcttttgtgtcctcttatttcctatctcagttgataatgattcatgttccagttatctccttcatgactttacaaaaccgtgatctctggggccatctttcttcctccatctttgcacctgccccatcatagctggatgtggtactgctaggttagcacttgttcaaccaactggacatgggcacaagaaggagagagattatcagtgatgattattaggttttgatgcctcctttggaagcatcttctttgattcttcctttggaagactagaaggcagatgattgtcactggcaacagcagaagaatttggaataatggtttatggagggaaggtatacatttatttttggcttatggttgcatttgggaagactttgacactaagatgggaactggatttctgatactacattggaagactgcaggcaaggggacctgtgcctctgcagacagagcatctggtacagtcacacagctcacctgcacacccaggagaggccaggctaatccctcaacctctcccagtctgatctccctcactcttccaatggaggtgatgaggatgttaag

SEQ ID NO: 14327 - DNA, 1049 bp, Homo sapiens
cagatttctcctgttctttctctcaccttttcttcccttctcgccttctccctttttttcttcctcctgcaaagtctgtgagatacgggttgagattccagctccatcatttactagctgtgtttgactttgggcaaggtatttaaaatctctaagcttcattttcttcagctgtggaataaagacagtaatagttcctactccctgtgtatgttgttacaatttcatttatatgagttgtgtatataaatcacagtgcttggtgcatagtaaccactcaataaatgttagctattatttacattacctctttttcaacctattttcattttaatgaagtaaataaaagtattgaattgaatcctgtgtttctggtaaacaaaaaaagggaaacaatgtgttagagagtttgtatctgaaccattttgcaacagtcaacagagacctgagttgtaaaaaactccagttgatacaaaataaactacgaaagtggctttaacatatctgaacacacaatagctaagacccaaactgggattagataccccactatgcttagccctaaacctcaacagttaaatcaacaaaactgctcgccagaacactacgagccacagcttaaaactcaaaggacctggcggtgcttcatatccctctagaggagcctgttctgtaatcgataaaccccgatcaacctcaaattagagaccaatttggaggctagccagcaatagctgatctgctgtaacctttgcaaccacctccccactgaaaaatttataacagcactggagtatatcaggtaataaaatggaatgaattacgaacacatgccacaacatgtgtgaaccttgaacacattatgttgagcgaaagaagccagtcacaaaaggtcacatattgtatgatctcatttatgtgaaatgcctagaataggcaaatccacaggcagaaagtagattcttggttgccaagggatgagggagaggggatttgcagagtgaccggtaggggtacggattttattgatgtggtgatgaaaattagac

SEQ ID NO: 14328 - DNA, 1059 bp, Homo sapiens
tcttatgttaagaatttttaatccatttggagttgatttttctgccttgtgtaagaaaagaattccatttcattcttttgcacacaaatattcagttttctcaacaccatttattggacagactactctttcctcattgtgtccccatatgtcccttgtgaaaaattagttgatcctatatgtttggatttatttctaggcttttcattctgttccactggcctgttgtgtgtgtttttataccagtaccgaactattcgatgataatagttttgtaatataattttaagtgaggaaatgtgatgtctccaatttggtttttctttcttagaactgttttggctatttggggtcttctgtggttccatatgaattttaggataggtttttctatttctgtgaagaatgccattggggttttgatagggattgcattgactctccatattgctttgggtagtatagacattttaatcacattgattttttgaatttatttttccatgtatttgtgtcttcttcaatttctttcattcatgttatatcgttttcagtgtccagaccttttacctccttggttaaatttagtttttgatgctatcataaatgggatgtttaaaatttctttttcagttaggttacttcttgttggtaacttcattaacttccacaacttacacctgttttcagaggctcactagataatctcaatgtactgtccctcaacctagctgcctcccaccctatctccatctctcttaacacccatttattccttttatgaagaaaaagccacttatgttcaagaaagataaattactaaatatagaaaataagaaagaaaagcaccccacaattcccatgccagagctaatcacagttaaaactctggtaattattattccagagttttatgcattttgtttcttttataaaaaagcaatcataccttgcataatgtcttgtagccagattttcttctctccatttaacattatttgagaagcagctttccgtcatcaaataaatgtgtccaacactattttggtgacttagaag

SEQ ID NO: 14329 - DNA, 1004 bp, Homo sapiens
gggtttttctttcctgagagccgataactacagcacagagacttcctcgctttcttggttcaagtctctatcattgtttcagtaatttttttacagtggccctaggccagagcaacttcttaacagttctgtgtataagtagttagagccaaacgacataattatgcatgccctaacaacttagtaactgtttgaaaaaccaatacatatacctttaaagaaaaaacaaacaaaaacaaaacaaaacaaaaaacaacccatcttttcttttgctctgaaattcccatcacttagcagcgctgcacgcgcctgctggggacagcacagcctcacctaccttggcatgagattggagagccctgctgcgttttctgttccctgctggttttcatacggggcctgctttttatcagagcacctgctgaacatccagccagggcctcgtggaaagtaaagtagcgctcttgagccttggatcggtggctttgctagagcagacgtttcatggaggggctgatggatgtccaagaggttgtgtttctctcaaaaatgaagaaactccacagcgcccctgtgggtttgccggggcgaagatctgctgtgcttcttttaggccctgtaagttcaccgacaaattaattttctttaaaaactagtctttgggctttgtctttgggagaaacaatttctccgaccgtcatttttcgactctattttgggggattggtggtaggagctgtagtgagccgttccagctctcgccctaatgtttgactcatggcaaggtctttgcctccttgactttgctctcagagctttttctaggcttgcttgggaagaagctttcaacatttctattccatggctattttcatttttctcttttccagtaatgttatgttttcatttatatgtattatttttctcaaaagtaacttgaggaatagaaaaattggagccaagccagctcctccatcagccatttgaatttgcttgagcttcta

SEQ ID NO: 14330 - DNA, 1122 bp, Homo sapiens
tccgggtttggcagatttgatttttaaaaaacgtattatctttaataaaatgttattatgtcaaccagtgaggctgccctgaacaaaaaaaacaaaaagaaaaaaaaaaaaggaaagaaagaaactgataaaaagaggcattccagcccctatgttattgatggaaaaagaaaaagaagaaaagcaatctcgcagtacatgttacttgtcgaaaaaattccggacaagactacccttgttttatgttttcagtattctgaaaataccagtgtgtggcagttctcgcagatgttacctaaaactgctgaacttgaccggcagaatgttctgccgttttctgctccctcgacacttgattggagggctgtcgacctctcctcccgtgggggcttccccagtgcctatcttctctgatagtcatggagaggttacactaattcattggagatgtaagttgttggttttgttttgttttgtttttagaaaaatatatataaatatataatagatatctatcgctatagaataatgcattaataaaatgaggcttttttagaggaagaccaaaaaattcaatgtcttaaaaatatatttaatggcaatgcaaaagtcttcctgcttccgtgctgaactttagaacagaggattgtattgcaagacaaagttgaatgtaaagtgatctccctgaacatttttaaggttttacttttctgaaattatacatcacagcagtgcataggccatataatgttagctggaaggtcaatttcagtgtatgatatactttattaagatgtataaaaatcctgaagtttttatttagttttgggaataggcatcaatgggtggtatttgctttgtaactccccccaggtacgatagggactgaatatggaccctgctgaaagcagtgtattgacgcatatttaactcgccctctatccgtagagtagtcatgacactatacagatggttcgtgttcatactgcagcttaaaacaagcaaaatacacagatgataatatgctaaattttcctctatcctgtacatttcacaaaaaggcatatgcaatatttacatttttaatttagtttacagaatggaaccaaaatgtataaatgt

SEQ ID NO: 14331 - DNA, 1081 bp, Homo sapiens
aatagcaatgtaaaaatggttttttgaacctccaaatggaattacagactcagtagccatatcttccaaccccccagtataaatttctgtctttctgctatgtgtggtactttgcagctgcttttgcagaaatcacaattttcctgtggaataaagatggtccaaaaatagtcaaaaattaaatatatatatatattagtaatttatatagatgtcagcaattaggcagatcaaggtttagtttaacttccactgttaaaataaagcttacatagttttcttcctttgaaagactgtgctgtcctttaacataggtttttaaagactaggatattgaatgtgaaacatccgttttcattgttcacttctaaaccaaaaattatgtgttgccaaaaccaaacccaggttcatgaatatggtgtctattatagtgaaacatgtactttgagcttattgtttttattctgtattaaatattttcagggttttaaacactaatcacaaactgaatgacttgacttcaaaagcaacaaccttaaaggccgtcatttcattagtattcctcattctgcatcctggcttgaaaaacagctctgttgaatcacagtatcagtattttcacacgtaagcacattcgggccatttccgtggtttctcatgagctgtgttcacagacctcagcagggcatcgcatggaccgcaggagggcagattcggaccactaggcctgaaatgacatttcactaaaagtctccaaaacatttctaagactactaaggccttttatgtaatttctttaaatgtgtatttcttaagaattcaaatttgtaataaaactatttgtataaaaattaagcttttattaatttgttgctagtattgccacagacgcattaaaagaaacttactgcacaagctgctaataaatttgtaagctttgcataccttagattatttttattttgcacttcttccaaatgagagtcacagactgggggtgatttatagtgactacaacaaggaaaaaaagattggtgttctccatctcttcctctttcgtcgcctcctcactccctccttt

SEQ ID NO: 14332 - DNA, 1049 bp, Homo sapiens
taaaaaattctcagtatttctgcttctcacgttttgttttgggaaataagaattctggctgtaggagatggcggggggaggttagtcttcccagagtcgtgtcatcacagaacagtgttgctccttacagctgttatcccaagagaagaaaacgggagagagtgccggccacgttttgtggcttacacaagccagttgatggtgtcaaagatgttgttgagttctctggccaaaggatgttctgttttctgaaaaagtttagagctgcagaattgtttttatgctcgagtggctaaaaaaatgggacacatggttggggtgaggagaaaagccatattttactgatccaaaggaattggatcactcctgaagcaaacaaagtataatacggcgatctaagtagatagttgcatatattgaacacaaaggcagagcattagagtaagaaaccttcagccagatctcggatgtatttcataacatgtgttcgttgaaagaatataagaaaggctctaggtcttgaaaaaagaaagaaaattctccttcacatttatattcatgtattactagcaagattacaagttctcagaatagcaccaagatgaaagaggcttaccagaattattgaaaaggggatttttcgaggccacttataaaaccaacacaccaaatttggtgttgcagatgtaggcgtgggattgtcctctgtcttcagaggtgtaatacgtaaagcccatgccatgcggcgctgctaagccaaagcaaaccatgatttgtgagcaagaacttgaagattctatataattcattttttgaatactttctcttgtaatacaagcatagaattgttttcgttttcaatggcataatggtgactttgtgatgtattcatgagaattatgaagtttggaatgtgacttttattttaagattttgagggaactcctaaaggcatttcacttttgacctttatctgaaacttgtggctgactattgctgggtaataggcaccaagtgtgcatttttgttgtgtctgaaaatctggatgt

SEQ ID NO: 14333 - DNA, 1095 bp, Homo sapiens
gggaatcagggaagcccagggctgggtgggtgtcggcccagagcccaaccacggggtggggagggggcatccacaatccacagtctccgggggacgtaaccgcgccctgctggcttcagtacgtttcaggagacggcagcgaggctaccttgcatggtgtggtggacgagctggtgcggttccggcagaaggtccggcagtttgcgctggccatgcccgaggccacgggggacgcccggcggcagcagctcctagaaaggcagcccctgctggaagcatgcgacaccctgcgccggggcctgactgcccacggcatcaacatcaaggtgagtgccgcaccaaggtcagggacatcaccccaggagccgggtaggtcaacaggacgtggggccatcagaggcccagacatcccccgtgaccatgctttttttttgagacggagtttcactcttgtcacccaggctggagtgcaatggcgtgatctcggctcaccacaacctctgcctctgcctcccaggttcaagcgattctcctgcctcagcctcctgagtagctaggattacaggcatgcactcccatgctcggctgattttttatttttagtagagacaggttttctccacgtgggtcaggctggtctcaaactcccgacctcaggtgatcctcccacctcagcctcccaaagtgccaggattacaggcgtgagccactgcgccctgcccatgcttctgagtagagaaacccacccccataaaaaatgaggtgggagggccgtgagggaggggccaagttggctgcaggggacgctgagcacggggacgtgggtcctgctcagcccccgccacctcctgcaggtgccttgaagctcctggccttctgctggaggtagtggggccctttctaagcgcctggcaagctttttaggacaggccggtgagggaacaggcaccctgaacctgattacgcctgtcagccccctgtgccacatgacgtggtgtctgctcagagttggacctcactcttcttctccaggacagaagcagtacaacatccacgtgggaactgctggatcaaaggacaaaagaccaaaaatca

SEQ ID NO: 14334 - DNA, 1047 bp, Homo sapiens
tctagttactgtacgtctcaaagcaagctagggcctggcccagtagagaggctctggtgcctgcttctgcccaggggctccaggggtgtgtgcagcgctggcatcataggaagtccctcggcaactggcatgtgtacccagcgggctccctgtgagtgtgcaccctgttacctcgtgagctcactggggctcacatggcttgttaccatccccacctgaaggccaatccggtcctccggcctgggctctgggagattgcttacctcctggagagttccagcacgagcttacactgccgtcgccacattttgcctctcagggagccgtggcaggttgcacggtggaaccggagtagtatagaaacttgctgatatcagccggcacagagcaggaacacgctaaaaaattaatgtccgtgtgcacccacagtattcaagagttttcacatcattgtcagaatactgtgtaatgaagaagttataatatgtttctcctttagtccgtataaactcaatgctctagaaagattagattccagatttctattagaactactactatagctcgctgcagtagcgcccgcccccgcaagagcagggaagataagcctttaatgttgttggggtttcagagaactatgagatgcgtgaaaacacattgaggctaattctgcatgcgtttacattctgagaggaaaacccctttgagagaaagccaggtgaaatcgtttttggaatgaagtggggagcgtggaggctgcttgtggagtggtgtttccacaccgaaacccggagacctaaatagggcgcaacctgaactgaaaccggcaggacatggctgtgtgcgttaattggaaccacagcacctcgggtgagggagggtgtcaagtaagcctgcgagttgcgaattagaggacccaggagtaatattccttttttcacaatttgggaaggagcacccgggagatggacagacggaaatggaattccagtgtgattactgatgaactactgttggattggacaggggctcttcacacacacacac

SEQ ID NO: 14335 - DNA, 1049 bp, Homo sapiens
tgtaagatattcgcagttgtgaaacgaccactatctaagaacgtttttttttttttctttttgagacagagtctcactctgtcgcccaggctggagtgcagtggcacaatcttggctcactgcaagctccgccttccgggttcacgccattctcctgcctcagcctcctgagtagctgggactacaggcgcccaccaccacgcctggctaattttttgtatttttagtagagacggggtttcaccatgttagccaggatggtcttgatctcctgaccttgtgatccacctgcctcggcctcccaaagtgctgggcttacaggcgtgagccaccacgcccggcctctaagaacgtttttatcaccccaaaaagaaacgccacatccatgggccatcacttctcactcccacctcctcccagccccgacagccgctcatctactttctgtttctgtgattcacctattctggactgaaatttctttttctcgtggactgcaccccactaaagctctgtggtctgaacatacactcgcggcatgtaatgatctcctttcattaacacaagaggttcatttgttctgtttgtttccagtgtggtggtctctctcttccccttttcaatttactttttgttttgtcttttttgagagtcttgctctgtcacccaggctgtagtgcattagtgtgatctcaactcactgcaacctctgcctcccaggttcaagtgattctcatgcctcagcctcccaggtagctgggattacaggcctacaccaccacacccagctaatttttgtatttttagtggagatggggtttcaccatgttggccaggctggtcttgaactcctaacctcaggtccacctgcctcggcctcccaaagtgctgggattacaggcgtgagccactgcatccagtcccaatttacttttatttgtcatatctgtgaaacatttgcagggttcagcattaacactaaagagagcatggagaaggctggcctggagcccgcctgcacccattccttccccagcagccacagttgt

SEQ ID NO: 14336 - DNA, 1029 bp, Homo sapiens
cggatctgtggtactgagaatggccatggtcacagcccggatgagcattgcctccttcctagggagacacatggcctggaacacacagcggctgcagccgggcagccttggagcataggttggtagtgctttcttcttgacaaagctcccactctgagtgcctcctccccagctctgctttcttaggctttgtggtggaaggggcaagggcagcccaggcttgcaggaggctctggagaaggttctgacctcagactgcaaagcggaccttggcactcagcctcacagacacttcaatatgcagatgatttttttgtgtgttttttttggtagagatggggtctcactatgttgcccaggctggtctcgaactcttcagctcaaacaatcctcctgcctcggactcccaaagtgctgggattggaggcgtgagccactgcacccagccagatgatgttttcaatctgagtaaaaaggtagttttagaagatgactgggcaaagaaagagtgtctttgctagctggtgtgtaacataaagtaaagaaagagtgtctttgttagctgttgtgtaacacaaggcacaagatctaaatgaaggtcagtgataacacttttcttttttctgattaaataattgtctcagtagtttacagagaacttacatttgtgttttcactttcacgtctgtgtactcatgatatgtccaaatcatgcatttatcttatagtattgtttttaattctggttaacaaatatattaagccaggcatggtgtcactcctatagccccacctactgggaaggttgaggtgggaagactgcctgagccaaggagttcaaggctatcgtgagctgtgattgtaccactgcactccagcctgagcaacagcaagaccctgtctataaaaatataaatactatatatgtatatggggccaaatgctatgttctgtatttaaattctaattacttgttagatgttaaggttgtcaatatgctgatattcagactgagaagtgatgaattca

SEQ ID NO: 14337 - DNA, 1030 bp, Homo sapiens
gcctcccaaagtgctgggattacaggtgtgagccactgcgcccggccaccaaatatgaaaacattttaaaagctatagaaggtttttgttttctcatatatatgtatatatatgtgtgtgtatatatatatatgtatatatgtgtgtgtatatatatgtatgtgtgtatatatatatgtatatgtgtatatatatatatgtgtgtgtgtgtatatatatatatatatatatttttttttttttttttctgcacagctttatgtggtaggattgacctacaatagattgcatgtattattcaggaaggtgcagtttgccaaatgttgacctagggatgcccctgtggatgcatccgtcacccctgtgtctgtgcccctcgggactcctccctgcaccccctaaccctctggtgtccaagcatctgctgatctgttatctgtggctttaaagcctgcagaaattaaacacctgtacaaagcacgcataaacagatgatggaatacaccaaaaagtccagaaacagccctgataatcaatgggagtttgttttatgataaaagatggcatttcaaatcagtaggggtgggaggtagagtgttggcagctaggggtcatctggagaaaaacataagccagaggtagatagaggcgtcatagccgcattcaaggcaggtcagagatttaaatataaaagagaccccaaggcaaatttgatagcctcatactggggaggctttgtaagtttgtttccaaatccagaagccatttatgagaaaagattcagaaatatgaaagattgctaagtataaaaatgacagtttttacatttcatgaaacaaccataaagttgaaaaactgtggaaaaatggaaattatatcagcgataaaaggttaatttctttaatataaaaatacttccggcctggcacggtgactcacatctgtaatcccagcacttcaggaggccgaggaaggtggatcacctgaggtcaggagttcgagaccagcctggccaacaaggaaaaacccc

SEQ ID NO: 14338 - DNA, 1072 bp, Homo sapiens
ctaactgtagagagtagttaatttttgaaccagagaatttccatacttggtacacagcaagatcctaagatggtattgaatagtttctttcctcaaaataatgtctgacttcaatgtaataaaacatgtatctgaaacccatagttatgaaaacatctgttttttagtatttagtgaaaaggtaattctttaagaaatgcaaatcaaaaccacagtgagataacatctcatgccagttagaatggcgatcattaaaaagtcaggaaacaacagatgctggcgaggatgtggagaaataggaacgcttttacactgttggtgggagtgtaaattagttcaaccattgtggaagacagtgttgcgattcctcaaggatctagaaccagaaataccatttaacccagcaatcccattactgggtatatacccaaaggattataaatcattctactataaagacacatacacacgtatgtttattgcagcactgtccacaatagcaaagacttggaaccaacccagatgcccatcagtgatagactggatgaagaaaatgtggcacatggaatactgtgcagccatagaaaaggatgggttcatgtcttctgcagggacacgggtgaagctggaaaccatcattttcagcaaactaacacaggaacagaaaaccgaacaccgcatggttctcactcataagtgggagttgaacaatgagagcacatggacacagggaggggaacatcacacacccggcgcctgtcaggggttggggggctaggggagggatagtattaggagaaatacctaatgtagatgacgggttgatgggtgcagcaaaccaccatggcacgtgtatacctgtgtaacaaacctgcactttctgtacatgtgtcccagaacttaaagtataatttaaaaaaaaaaaaaggtaattctttttatccaatgtaaacttttttgaaggtaaaattaaaacttttatttttcttctttaccttttttataatataaaatttacgattttaaacatttttaaatgtgcaattcagtggcattaagtacatttacagca

SEQ ID NO: 14339 - DNA, 1102 bp, Homo sapiens
gcagagcattaacatttggaaaatttgcagcctgacaatatgatagaaaagaaaaacccattttctggggagaaattcaagctggctgcagaagtttgcataagtaacgaggagccaaaggttagtcaccaagacaatggggaaaatgtctccagggcatgtcagaggcttcgcagcagcccctcttagcacaggtctaggagggaaaaatggcttcatgggccaagtctagggccccactgctctgtgcagcctctggactggatgccttctgtcctagctgctgccactcaaactccagtcgtggctaaaaggggccacatacagctcaggctgctgcttcagcgggtgcaagccggaagcctgcacagaattcaagaattgaggtttgggaacttctgcctagatgtcagaggaagtatggaaacagctggctgtctaggcaaaagtttgctgcaagggtggaaccctcatggagaacgttagggcagtgaggaagggaaatatggggctgtagcccccataacagagtacccactgggtcactgcctagtggagctgtaagaagagggccaccatcctccagatcccagaatgtagtcccactgacagcttgcactgtggcctggaaaagctgcagacactcaatgccagcccacgaaagcagccaggaggggggctgtaccttacaaagccacaggagcagagctgcccaagaccatgggaacccacctctttcataagcgtgacctggatgtgagacatggagtcaaaggagatcatttgggagctttaagatttaatgattgcctcactggattttggacttacatggggcctatagcccctttgttttggccaatttctcccatttgaaatggaatcatttacctaatgcctgtacgcccattgtatcttggaagtaactaacttggttttgattttacaggctcataggtggaagggacttgccttgtctcagatgagactttggacttggacttttgagttaagactttgggggacagttggaagggcattattgtgttttgaaatgggaggacatgagattggggaggggccaggggcagaatgataatgg

SEQ ID NO: 14340 - DNA, 1045 bp, Homo sapiens
aaagttacaggtgccagggataatatcttggctgcgtaacttgtatcttaccaataaaacttagtgcgttctgttttcctagaatttaagagttacaaatattgatgcttttagtgtggaatttatatttacaaaagtaattacttccagaaagttttctggctaagtcacctcttaaggagatccctgtaaaattcaccctttaaaaaagaaaaagaaaaagccaaaacactttggaatcctgagtctgaatgttaaccattcttccccacaaaaagtagtgtctgcttttagtaaactactttcaagtattttaaattggaggaattttcttttggaagctgttgatgtaaaagatcttaagtgaagaagaaagacttggccttttgtattgcttgaatattaactgtcttggaaggaagttatgctacaagaagtcatactttcataaaattatttgcatctgtgtcaaatgcagtttagtcagaacgtaagacataataggtgtggacatgaactctggagtgtgaaataaaatccacagttacttaagcagtctgttttgatggaaagtatcttgggataatactttcctcagtgtgggattttgttcattttagatggtgcaaggaagtatcagtctttaatttttttgttgttgtttttatcaatcatttgctctgatggtatgatgcatgggcttcaggactccagctgcaccactgtataaaactcagttcaggtttgctagcgttcttggttaatcttcaggaataacccaatacaattatttttatatgtactccttggaaactgtggtcgtttttcaatgatcttggttagaaaagaatgccagtcccttccatgagtgaaaacttgattttgctgattgataattgttttggatggagctctagagtcgtggggaagaagcaggggaacacagtgagtttaaaaactgacccaataacttcaatttcacaattgggacatttgccccagaagtaggctgtggtgacagcagatctcaagtgtcaaactgact

SEQ ID NO: 14341 - DNA, 1024 bp, Homo sapiens
ctgaggcaggaggattacttgagctcaggagttcgagaccagcctgggcaacatagtgagaccttgtctctatttaaaaaaaaaaaaaaaaaaaagtcttaataagaaggtaaatgtgatagcttggcaggcatatttagtgaacttagggggagaggtgggagtgtgaagtaatgaagcagattatgagctcagatttgctgagtataagcacaaagttttgcccgttggtttaaaaaaatcaaccgtgcaagttacagcataaggaaaactgagtgactatcagttaatcacttaaaaatctagagattttggttaaatttcatgaaccaacatcatcttttctaccttatttaatgagtgtgtccaagtgaaacattttttccctataaagttgataaaatgtcagtattatgtacttcacaactatatcttgtcaccataaaaattcctgtgataagactttttatagtaatgtatgaacttaacagttttatcaaattcaagatttttatgagttaagcatttctggaaagatgctaaaatcataagcatgacatgaagatctgcataaaattcaaaatggtcttttttaatggtgatgtattcagcattgtcatttatttgtaccatgttttaatatattttttctaatgtagtttcaacgcctttttaagagcatccactttttaaaaaaatcctttgtcatttcctttaattaaagcctggttagtattgtagagtggcctcatgccctcatgcacgaattgtacatgtctgtccctgtatgtcactgtatagtctaaatgtccttgaaaaatgatttatgcttcattttctcttattgctgataaatcttaaattctgtttagtatttttaaaaagagatcacttaacatgctaattggactcaaaatgcacctagaagagttcgtaaaactagtctcagagtttctaaggtcagttgaattggccaataccacattgcttaattaccctgaaaagcatttctgaggattccttg

SEQ ID NO: 14342 - DNA, 2536 bp, Homo sapiens
ctgttcacattcttgacagaatagaccctcccaggtcatctgcacttctgatatcttttgaaagtgaaatataccattaaaaaaaagtccagctatatgatgaagctgtcacgtaatattagtatattttctatttcaataacaaggtgatctgattttgtacaaagtataattaatgtaatacaatctgcccaaactttggtgcttccttttcatttaattcatatatcaaaataaaaatattatgcaatactagaaaatactcatggccattcatagccatgcagtcttaataaggctaataaaaatagtgactttagtctgtaatagtcctgcacatagccgccttatatttttaagaattttgttggtttctgagattctcaattctcttttatctctgatcagataggatttgggtcttttttcaaaaggtgtaatgcatttatcttatgctttaaaaagtagagacgcttagctagtgtccatgcacacttctcatttccaaggtcagagctctatgatgtctgcaaataacgaatacaaggctattgtcagtccttataaataagaaaatattatttgtccctaattctgtagttttcactctcaaatgcggggttttttttttttttttttttttttgcattaacagtaaccccaagaaaggcatcagggttctggagtggttgtttgagtgacacagcacaaggccttgatttcatcatgcttttgctgtggatgtagtgtagcttgctgaacaggtatggaagctgtctttgctgttaagtacttctcccgtttgtttatcaacctgcagctaacaggatgtctgcttttttacaggtttatttcacagagcagtgtacattcttgtcttccaggggaacttcaacatggagttacttttgatccctcagttttaattcagtgtctaaaggtttacaagttcaacttactctattttattcagctctttcacttactctgccatcacttcctacttgaatctgagttttagctactgtagaggtctcagacctttcctttttagtactattagccaggtaaaactttggttcttgtgagtggtagggatgagtttttaggacagtattcaaagcctttttaaaggaaccaactactcaaatgctctacaatgccaaaaatacaatactcctgcaggttttcccaagcaaggccaaaacaatcaaaatctgacagaaaaacacagctgttcagctctggaatctgatgataggctactttttaatgtcaggacatccttctaaacttccacttacagtgtcacatgtaagcatgaaggctggctcgttggtgagccattgctttgtttttaggaagacagttatgaatgccatggacaatctcagtacatgttgtttgttatgattttattcacgctaaaggaatgggtattaaaattaagtgcatataatatagaattcagtttcaagtctgaagttagcgtaaatttagattcttcagactaacataaaacatgattttgagaagttaaataggaagatgccttttttagaagtttagcatatttagtttatctcccaaatcttgcttagaaatcaaatgtatataagagaagttagttacagagctagattgattaactacttctttaatgaagatttgctatgaatttgtttactctttcataccaccttcagatagctagtcagttcagcaggagcagagaccaggttagcacgcggatggggtgtaattcagtgtttttgtgttgtacagcctgagaaatgccagtggcctgacagcagcagacattgcacaaacccagggtttccaagagtgtgcccagtttctcttgaacctccagaattgtcatctgaaccatttctataacaatggcatcttaaatgggggtcatcagaatgtatttcctaatcatattagtgtgggaacaaatcgaaagagatgcttggaagactcagaagactttggagtaaagaaagctagaactgaaggtgagaccgctttgcgggtgggaagagcacacttatttttcctttctgtaatatgttttctttttatggctgagcgcaccttcgagatgagaccttcacttcaggtggtaatgcgcctggtggattgtgcggtgacggtggagatttctcctgtactgccactgcgaagatgggacttaacaaaagggaatgtgagggaaatactgatggcccaagtgtaaatgtctatgtggaactttttgagcacccatgtttacctgccatgaattagattttttaatttgttgtatctgtttgaaatatatctattaaagaaaatctgccactgtgcctgaatttttttttttttttaatttgcttcttgtaaatgttcctgggcttataaaaattgctgatggtctggcagtaaaacattttcacattcgggaaggtgaatgttttctgtactatttctgtactatgatttgacctcagtggtctctgtacctcacatgtgtgttgacttatcacagcaa

SEQ ID NO: 14343 - DNA, 1072 bp, Homo sapiens
gataaaatgtggtatatataccccgtggaatactatttggccattaaaaaaacaaaattctgttattctcagcaacatgtatgatcttagaagacattatgttaagtaagccaggcacagaaagataaatactccatgtactgtacttatgtggaaggtaaaaaagatctcatagaagtagagagtggctcatgcctctaatctcggtgctttaggagtctgaggtgggaggatcacttgaggcctggagtttgagaccagcctgagcaacatctctcaaaattaaaaaaaaaaaaaaaaaagtagccaggcatggtagcacatgcctgtatacctagctacttgggaggctgaggctaaggaggatcccttagcccaggagttccagggtgtggtgaactatgattgtgccactgcactccagctggggcaacagggagatactctgtctctttaaaaaacagtggttactagatggaaagataaattctagtgttaccttgcactgtagggtgactaacagtaattttttattttttttgtatggctaattcagtacaaatggaaagtgtttgaggtgatgcatatgcaattatgctggttttttttaatccctatacattgtattggaatttacaatgtaccccataataaaggatagaggaatatttacagtatcatctatttggttaaatgttattcagcagttctggcctgctgcctttttttgtataacctatggcccaagaatggtttctacattttttaatagttgagcaaaaatcaatagaataatattttctaatacataaaattagatgaaatttcagtttcagtgttcataaataaagctttatgagagccatgctcaattgccttgaggctgctttcagcctacaacaaaagaattgagtagttaggactgagaatgtatggtctccaaagtctaaaataattactacatagtcctttttagaaaagtgccttctggattagatgatccttaatgatcatttcaggccaatttctataatgtgcactacacagttgagtgaccacttgcaagattttt

SEQ ID NO: 14344 - DNA, 2189 bp, Homo sapiens
gggtcttcctgtgttgcctaggctggtctcaaacttctggcctcaagtgatcctcctgcttctgcctcccaaagcgccaggattatagggttgagccactgtgcttggcttagaggtaataaattttaatattctattcagaataagaaaatatagcatataagcatttgtatctttagtaaagttactgccagtttgattttttttttttgcaagttacttagcagaacatgtaattcacagtaaagatgattctgtgttgtaccacattttaatattcctgttttgaaagaatagtagagagaaaatgggtggcctgctcagtgattgcttttcgtagtcttggtgaatgttacaggagattgaatttatagataaaagcacagtcatcgtagtttccacagtacattgcagcacatttagcttgctagcctaaaaatctgatcatgctgagtttcttttaaagaaagttaattttagaacttcaaactagaaccagtttgaacctcaagttgaccgttgtctgagttttaaaaatctcttcccattttcaaagatttttcaaatggatgtaggagaggaccaaggaggtaggctatagctgtagaacaacacagtcctattttcagaaacgaacagacacacgttttaggtcaggcacagcccatgtatccaggtgcatcaaactggggatgctaagttcaaaagtgcgtctgttttgaagatttcatctgaaaataatgtgtacactttcattactaccagtttgcattcaaaatagtttttgagactctttaaactcttctggatactttaattttccctttggaatagtgtgtaaacacagtccggatgaactttactactgatacctcacttgaggttgacaggagtggccagcagttagtgcctatggtcatgtaatacactaagtcaatacctgtggagtgaaatccggtctctataaaaaatacaaaaaaaatggctggacgcagtggctctcgcctgtaatcccagcactttgggaggctgaggtgggtgggtcatctgaggtcaggagttcaagaccagcctggccaacatggtgaaaccccgtctctactaaaaatacaaaaaattagctgggtgtggtggtgggcgcttgtaataccagctactcgggaggctgaagcaggagaatctcttgaacctgggaggcagaggttgcggtgagccgagatcacgccattgcactccagcctaggcaacaagagtgaaactccgtctcaaaaaaaaaaaaaaaaaaaaaagaaaagaaaaactagttgggtatggtgttgtgtacctgtggtcccagctactcaggaggctgaagtgggaggagcacctgagcccaggaggtagacgaggctacagtgagctgtgattgcaccactgcactccagcctgggtgatgggagtgagaccctgtttaaaacaaacagacaaaaaaacctgtggattgaagggtaaaggatggagtatttaaaaagtactgtgacagaacaaagtactgtaagtactagagttgagtgtggatggaaacacagaacctgtaaatcaagtgtttcatttacgtgctcaactcctactgaattttagcaattaaaacatgaaaactgaaatattggttaacaaatgaaaatagaatttaaagacctgaacttcttttatgatctttaatgattatttgttctaatctttgacttggaaacccaaattattttcagtctaacgtacttgaaatttaactattaaaaaagttggaggaactcaaactttgaagttagggctccctttctccagataaagcacattgcctggtttattgtaaggcacttagaacatgtaaccaaaaacactcaatttaggaataggaatgattgttttacagctaagtgcgctctcagagtcttttgttttacacccctctcaagtttacctttagatatttttcttgttgtttaatattttgtgacagatttggcaacttttaaaaagttgtttgaattgaatagtgcataaaattaatagatgtttttcagaaaatccattattaagagtagaggaatgaggagaaatattcgttctaaagagaatcaaaaccacaatgagagattgtcttacccccgttagaatgacagttaccaaaagacagtaacaaatgctga

SEQ ID NO: 14345 - DNA, 1050 bp, Homo sapiens
ttcttcctattattaactgaagaatatatttaagaaagtcttcataattaaataagagtttggataccaaagggttaaaaatacacatgtatttcttttgctgaagatatcttagatgtttgctaatgttttatctttacaaatggacaatttagtaatgttttttatctttttttaatgattccatgtatttgcttatttccatctaggaatagttactaatgtatttgagatacagcataccaaattttaaagtaaccagaatcgtgagttgatggtttttagtccatactgttaaacttatgttgaaatattgacatatttaaattggcttcatgctaaaaaattaccaaaggtaatttaaaaggcagtgttttagagcagtagctcatggtcaaggtggtcacatgacaatggcttaagctcagtgtgcttctgcaccttatgttgtctatgtatttttaatccaaatgttgcctgcaaatatgtgatcccttattatttaagtttcctgtattatgaaccattgcccgttttaaatcacacagaagattctgaatctgtaaaaactacacatgtcaatgttttacagctacgtaattcgaattgacttgattttttcaagtaatcctagaaagggggagcattccatatagaaactgctgaaactgccacaggtgcttctccgaaaaccttacagttgtggcattgaatgttcagtatcgcttcctttctgcacacgaggcatactgttgaggtatttgttgcggtgattggttttaacgctaatctaggaattcagatagagatgctttagatttgcatgctttgcttacctaatttatgatatctacctttctatttgtaaactaacaatagctaagttgagatcagaattttaacagaaatattatttatataaaaattgttatcttttattgtcacatggcattaacaataagaaaacatcctgaaggtgatgtgacaactcggattctaaaaattatacttcaggtatttcctgatccgtggtttttcaaaattgaaaca

SEQ ID NO: 14346 - DNA, 1027 bp, Homo sapiens
acataataataagggcaagtacactaagtgtctgtggctagaatggtttgttatataacttacttgttaatgtaggttgcatctgtaagataacgcatttcagctgctgtgcatcgtattaaattttctagcaccacacgtgagtatgttaatggactttctttttcttttcttattttaaatcttgagttttggtgccaagttttctgtgtgtgaggctctgtttctggcttatatgttggtcattattatttgccattgtttacatctaaaaattaaaacgcacaggattaaatctaacttgtgaccaaactaaatgtttgtgtactttaaaggacctaaatctctgtgtatggagttttcagcaagcacgtgaagttgtcaccatccttaatcttgcttatatggtagttccatttttccactgcccccaatatttgagtgctgcttgcttggtactcaggtattgactggaagaagaggatatactattacaaaaagattgtcatctcatttttcttttgaacgatggaacaaataacagcataacattaagtcttaatgtgattttggaaaaagacttgaaaacttgctgtctgctgataattaagaagaccttttcactactagcattgtaaatagaattcgggccttggaatagctgtactttcagtaatttggtaccaattacttttggctgatttgtgtttattttcttgagagataagtggaggatgtttccatatcaaccagctagtaaaatagctttttgccactgagtagaaataaaaagatttagaatgaaaccagcatgacttgcatctcaggcagatttgtaggtccgttttaatactgcattatacggatgccagtgtttaatggcagagtctcagaacttttctacaggagaggatttcttgagaagccatttattctgtggtaaccagattttcagctgggctacatgtattttaacttaattatttttatcttaactgggatcatcagatagcttgagaagcatcga

SEQ ID NO: 14347 - DNA, 1024 bp, Homo sapiens
gtgtccaaacattcccttctgagaagaagccgttaggacagaaatcaggccaggactcagggctaccgcttgcgaagtccaggctttctccccagccctgctaacggctgccctcttacacaggtttcaggctcgtgttcttagaaatgtgctagtggtgcacaagatcccctaaccgttggtaagactcgtttgttgccagaggactaaacgagttgtttaaaatctctgttgtagcttttataccatattgaacagtatctttccagaattccaaatccaagtttctaaattgaacccaagggtaacaggtttaaagccagcgagccctgaatagctgatttttggtacgccaagtgattttcatccgttttatttttattggatttgcaacctgttcatcttatcgctaattaatactttcattttcacccagtgaattaataaaggcaataaatagacatcagcctttactcccaggtccaagttggttgaagagggtgttttgaatctgtgtactcttcatctcacaggagtgtttactgaaagcctgaaagtgctaagagaaatggaaaaagaaaccttgagttgagatggtagtgtcaggtgttttgtcttcaggtgaggtctctcctcttgaagagaattgcttgcagtcaggcatagcttgttccctaactgcattgtgattggagtgagggaaaatgagcagtccaggatcagagaacgtgggttgaacagttgcttggcacatggtaggcacttggtaaatttgttgaatgcgctaaattattttagccagaggctatcatggtattggtgcttggccacaaagtcttaacttgccatgttagtcacccactaggtgcattgctcagttatgctgtaggcttttttcccccatagggttttgaaaagagtaaaaaaatgtggagaatggggcctctattgattattcaatgagtattcagtgctggcttgtgtaaaagtgcacagttgtgcacactatagaaaatagtctttg

SEQ ID NO: 14348 - DNA, 1029 bp, Homo sapiens
cactggcatcatcatcctgtttcacaaaataaataaaaacagcagcattcatgagaattacaaatctcctgcccgttttcattactgagtgccacaatgccgatgtcacccgtcggaatctccacagctgcctccgctctgcatcactctgtgtttgaagcttgtggatcgtgcaccatgctgcattttgcaaacgtgtgcatctacaggtgctcctcaacttagagcagtcttatgtcccaatgagcacattctacactgaaagtgcatttaatataatatagatggagcatccctaatctgaaatacaaaatacgaaatgctcctaaacccgaaactttttcatcactgacatgacgtcacaagtgggaaattccacacctgactcctttgctttctgatggcttattgtacacaaactttgtttcctgcagaaaattataaaaaatatataaaattaccttcaggctactatgtatttaaggtgtgtatgaagcataaatgaatttcatgtgtagacttgcatcccctctccgagatacctcgttatgtatatgcaaatactgcaaaatctgaaattcaaaatacttctggtcccaagcatttcagataaaggatactcaacctgtaccccaataaacccatcgttaaagtagaaaaaatcttaagtcaaacgatcttaagttggagaccttatatgtatgtttatatacctgtaatgcaagtatatatgtatatataatatgtataggtatatatgcatgtgtatgtgtttgtgtgtgtgctttgcatatatgtgtgtttacaggtacatgcatgtgtgtgtgtgtgtacatgtatatgtacatgaaccaaatttctgtacttaacggttattttcagatttattaagcaagtttggctgtttatgggatttcttttatttactataatctgtttaatcttttactttttcaggatacagtcatgtaccacatgatgttttggtcaatgacagactgcatatatgacagtagtcccataaaatta

SEQ ID NO: 14349 - DNA, 1048 bp, Homo sapiens
ctttaccagctcacaggctggtccctgagcagctaccagagatccagaatagtgacccctgccgaaggctgtggggcagggagttccctgtctgagccaacactgacatgtagaattgtcggtttttattgggtgttgatatttgactatagtgggaagtgaatggtaggaatcctctgaattagctgagagggaagcaaaggggagattttcttttaaaggcagtgatggctgcgggcagggtacccttcttatgaatgtgctgccactggacgggaggcgggaggagggccgtgctgagagggctgcatgcacgcctggggctctgcgggtctcctttctccatggtttcacaccgtccttctcgccactgttgcggattcccttgctcacagttgctttaactggatgtgtacttgcctgcacttctccttccccctgtgttcttatgaataccaccaggtagatcggttcctggctgcccccttcacgaggcagcatctttcttgtagtggatttagaccaattcaaggccaaaccgatgctgtcattgtcacacgtcaaaataagcctctgtgaaggctgagctccattatcaacttgaaatatgggctggttgcgatatagttttctgatctgattatcagtttagcaacgtctgtatcaatttgctcttctcttattgtattgaatatcaataatgagttttgttttctagttggagataactaataaattttttgatcagttttctatgtatgggaaaatgcatattttattatttataaaatttatttatatcgctaggatcctgcttcacagagtttgactccagcttcttctgctgatccttccccctcgctattgaaactttttctgaaccatttttaatagcacgatattacctcatgtacatatgatttcatcatttctctttgcctggacatgtagttttttcctccaattttttgccgatataaataatgccatgcatgtttttataaatacaactttatatgcctctgaatatttcttgagaatagataga

SEQ ID NO: 14350 - DNA, 1060 bp, Homo sapiens
tttaagctgaatcaaaatcagttctttttttttcttttttttgagatggagtctcgctctgtctgtcacccaggcagtgtagtggcacgatcttggctcactgcaacctctgcttcctgggttcaagcgattctcctgcctcagcctccaaagtagctgggattacaggtgcccgccaccatgctgggctaatttttgtatttttagtagagataggatttcactatgttggccaggctggtctcaaactcctgacctcaggtgatcctcccaccttggcctcccaaagtgctgggattacaagcttgagcaaatgttcctggccaaaatcagtatttttcagattttaaagaaatgtaactccacaataattagtaagccctgtttgcagttaatgctctgaagcttttgttgccgcattattgtattggtcccatttgtcttttgagtttttataatttgaactcttacttttaatagtttatacgttttttaaagttcattaagaattgaagtaatattttctttaatttttaaaaaatttgttaagaccagaacttgtccgtccagctacgactttgtatcagcataacttgactggaattctagaaaccgctgtcagagccaccaacgcacagtttgacagtcctgagatcctgcgaaggctggacgtgcggctgctggaggtactgcggctctgcgtgttgggaacgccgccccggcaccgaggacccactgggccggggtgttctagcgagtgttttccatgttgtttcaggcacagctagccgttatctttctggaaactgggcagcctgagtaggaactccactctgtggcttgttactgcctggtcagcacatctgctccctctccaccatctgggtttccgtttgcccatcttgcagcggggagccttgcagggctgctaggcttaagctggagaaaacgcatgacacccttgccctgtgctgggcagcatatcacagatgcttagaaaatggtgctttcttctcatagtaaatccaacaggagcacaagacatggtgtacgatggtat

SEQ ID NO: 14351 - DNA, 2068 bp, Homo sapiens
tttgagaccagcctgggcaacatggtgaaaccctgtctctaccaaaaatgcaaaaaattagccaggcatggtggtgtgctcctgtggtcccagttacttgggaggctgaggtgggaggatggcttgagctggggaggcagacgttgcagtgagccaagatcatgccagtgtactccagcctgggccacagagtgagaccctgtctcaaaaagaaaaaaaaacagatctaggtaataaaaataactcaatagaaatactgaaagaacatgatggacaatattttcataatctaggaatgggaagatcttaggaagacaggaaactcagaaaccataaaggaagactgacatttatctacatataacaaaaaaatagatcagaactaaaatatggaccatactataaacaatggcaaatgattaacttggaaaaattaaatctctaatatttaatgattcacaaatggtcactattcctaatgtacaaagaatttttgtatattgatgagagaacaaaatgaatagcaagatgggtcaagggcatgaaaagaccattcacaggagaagaaaagcaaatggcaattagaactatgaaaatatgctcggcttcatttttggttaatgacagcaatataggataaccatgattccacctgactggcaaaatctaaaatgagccaggatgcaaaaacaggacatcttgcccgtgggagcgtcagtctacacagctgtgtggaaaggaaacctggcattgtctataaaaactaaaagctactttaattcagcagttgtgcttttataaaacaagtttatagaaataaaagtgcaattctattagggtgtatgattgaaaaatgagaatggctgcattgttgtagtggcaaataaactggaagcaacagcaattgaattttctccttactgctcagtttcctttctaacggcagtgatgtaggtgcccgtcagggtcagggcaggggagctgcatgccagtgaggaagaaagctcctgagcacagatggttcctgggggagccacacaggggtcacttctacagtgccacctggctggtgctggccccttgtacacatgggtacatgtacagcaaggtctgcccatagagcttgggacttgtctgtgaacagaggacgccggcctgggcacctctgtgttccaggctttggggctttgcaaaagagagactgcaagggcaggcagactgatgggaggagacacacagctgctgcctgtgagggaggggaaccccaaaagcctgcaccgttactgaggaagagctccgtgtggcccaggaagcctcagtattatgctgcagaggcactaatggacattctgaatctccaaggaagacataacttgtttttgttatactttagttttaaaagtttaggaaatacatagttcaatttagagagatttctgtgtttcatacaagttttattgtataaataggtaagactccctgtgtctggagaacttggctttctagaataacttactctttgatgttgctgttggttaatattttgccataaatatcactcttgaacatttccatgcccctttgctttcagttttttgtagcatcagatccaacagttaaaacagatcgactgtggcacgacaagtatactttgaggaaatcgatgattccttcgtttatgacgatggatcagtctaggaaggtaggattagaagagatttttgtgattttgatgttttatggctatgtatacttagattatgtgacaaaaccaattttcagttaaaatttcatgcgttttgagattgttaacgttctggagatgaagtaagtgcatgttaattgaatacatcagtatagtatgtgttcaatatatctttgagttactagaattcgctccatactgtagcagatgctcttgttagttttcaatcaatagccaatttgtagcttacgaatatttgtagatttgggcagtcgttttaaatttacataaaagtaatcatagaatgtttttctttttaggtccttttgataggaaaatcaataaatttcttgcaccaagttt

SEQ ID NO: 14352 - DNA, 1058 bp, Homo sapiens
ctcttggtagctgcctgcgtgattggcaagttgaagttggaattttttatggtctgtattaatggatctgattctcagaagttgcttgctaagaaaattaccctcttcatttctgtttttagtagggaggccttggcatttgtccagcaattaatgagaaatcatggtacaattatgttttattttttttcttaattctttctgcgtttgacataatggtgaaaattaaagaaccttgagtggaaaatgccttagtaaaataaaagcgtatcgcaattatattctgaccttggtttttttccctctataactctatatttttcacagaattaattatattctaaagcgtacccaagctgtgtgcttgctacgagatgtttgctgctggagtgattgcatgctcctttgcccttagatgaagcagtgctttcataacttctaaacatgcctgaattgcctgaggttttttatggcttacattttctttattgttcatactgataaaaatccggctgtactccaactattaggataaattagtgtgttgtctgtagaaacgagctcttctgtctaactgaataacagacatacaatttatatgcagttaatctaatctgtagcatggcaagctacagagcagtcccagcatgagcgcggtgacttcgtcactgccgagattactcaacgggggcttatttctgtcatggacaattgaagtctaggttaagtcgatgacgcctccgtgatagtactgctgtttacccctgaagggcaatatagatctcaaaaggctaaaatagatcagtgaatgcttcagtcatttacattgatacttaaagataagacattttagttgaaaataaacgtagcagcctcttccctatggtcataaaaatgttggcacttattcatgtgcctacttaccaggagattggctgtacataattgatagtgtctggcccttaaaaggatcaaatagaagattttgacatcattaaaattttgtttcctgaaatacttactcttggaagtagatttctgtgaaagaaaaaaattca

SEQ ID NO: 14353 - DNA, 1053 bp, Homo sapiens
aagaatccacacatactttataataaagattatatataggtagagaggtgtatgtatagctgtctaatgtataagttcaccacattggcaggatacaagctcaataacaaaaatcatttatatttccatatactttcaatgaataatccaaatatgaaattaagaaaataactccatttaaaatatcatctaaataagttaaatacatagtaaaaaatttaaccaaggaagtgcaagacttgtactctgaaaagaatagatcattgttgagaggaatgaaaaaggcctaaataaatggaaagacattctgtgcttatggatggaagatttgatattgctaagatggcagtgcttccccaacatgagacacactttcaatgtttgatattgttaagatggcagtactcccccaacacgagccacactttcaatgcaatgtctatcaaaattccaacagcctttgcagaaatggaaaagctgatcttcaaattcacagggaagtacaaggggccctgaggccaaacaatcttgtaaaagaacaaagttgaacaaattttctgattttaaaacatgctacaatgcaaggtaatcaaaacaatgtgatactggcataatgatagacctctgggtcaatggactagaagcgagagcccagaagtacatcttcatttttattgattttcaataaaggtgccaagattactcaatggagataaaaagcgtattcagcaaatgataacaggacaactggatgcatgtagaagaatgcattgggatctctgtcatacaccatatgtaaagattaactcaaaatggatcagacacctaaatttaagggccaaagttataaaacttagaagaagatatagtggtaaatctttgggaccatggatttggcagcagtttcttagatatgtcatcaaaagcaccagcagtgagaacaagtatatcaggctttatcaaaataaaaactatgtatattaaagggcacttttgagaaagtgaaaaaaacacagagtgggagaaaagtatttccaaatcacttacctgata

SEQ ID NO: 14354 - DNA, 1014 bp, Homo sapiens
ccaaggcccggggggcctcttctctctacatagagcggtgtttctcacactgtctgttgtagccagttaatgggttatgaaaccagttaatgggctggggctagcataccataccaaaaaaaaagtacaaggatggattcacaggacttctgcttttcatacatgtttgtgccctcctttgcaccatgaagcgtgaatcttagtatgtctcaagtagaaaaggcatgaaaagtcatgtgaactttagattgtgtagccggcaattttttgctactttttgtttctgaaaaattcctcagcagtcctaaagagaagagtgactcacacacttgtgtaaagccagggttggagtctggacctcctggtttctgaatcatgacatgttactgctgcttctaggtccaaagtggtattaactgtaagaaaacaaatgctctttatctcaattacttgggcgtctttggttggtgagaagtgactggtgtgtactatgagtgtaaatgtggatgtttttgtgtattttcctccatttctcccaggaaggaaaggaggtgagctggcctcagctgtccacgcctacacaaaaacaggagacccgtacatgcggtctctggtgcagcacatcctcagcctcgtgtctcatcctgttttgagcttcctgtaccgctggatatatgatggggagcttgaggacacttaccacgaagtaaggatcggtgttcggttctgagacttggatttaaaaagcatgggcacgcagttatgctgtttcatttttcccctcatgattaccatgttctcctaacaggaatgcaactgcacttccattgaataccatatacattttacacagtgcctcgacagctggttatctcactgaacagcagataagttcacgagttctttggttagtggagaattgtcccagtttattcctcagcaaggtggaatcactcgtccgagtttactagcacgtggatggcaaaacaggacgaggcctcctgagtcttgggg

SEQ ID NO: 14355 - DNA, 1863 bp, Homo sapiens
acagttagcagcatttgaaacatgagtgtcctgaaaacagaggattgggtttccctgttggctcgtaatctgctgattacgaaatggctctggatgttacctgtacctgtccttgcgtagaatgcaaaggtgaggagcatctgagagctggaggacatcctggcacagtattagcccccgcagtagtctccaccatctgccccactccgcctgtccctgtgtgtggctcccgcgtccagcctctgtccacagctgcagattcatgtcgtgtttgacagctgtgcgttcatggcacagcaggccaacctctagactgagactcgccttgtttctttctaatctcatactctttttcatcttgagcttatttattgagttagtaaatttcatcggggtggcaaatatctaatctgaagctaattgcaccataatatctattgtctgttaaaatattgtctagtaattactgtctttaaaaaatgattttgcaggtactatggaaattacagaagcagctctggtaagggacattttgtacgtctttcagggcatagatggcaaaaacatcaaaatgaacaacactgaaaattgttacaaagtagaaggaaaggtacagtaacataaaatctaagttaaaatattcagaaagaaaaaacatgtcatgaagtccagatagtggctgttgattgataaggtggtactggggttttgcgaatcggttgtgaggtgaaattgcactgtggaattctggtttctatttctgtccattgtggctcgttcagttttgttatggggaccctttgtgattaatgtgtgcctcctttcctcacgtctactgatggggctgccccatagctgatttctgcatcctgctgtgtgatggctgaggcacccaggggacagaggtcccttggcaccttcggcattgatgcaggattccaggtcaggggtcttcacccacttttgtttcctttttccataatctgcctttaccatgcccatttcttgtggtgtgggtcacactgtggctcttagccctttcacagcgtggctgagatcacagaccttctctgccacaccgcaggccaactgcagggtggtgtgaaatgagctcaccatgccctttgaggtgctttccatcatgctgtcacttaatgtgctttccttccctttagtgatgggatcttagttttaacttttatgtcttgaagcctaaggattatagtattaaaagtagaagtgcttgagaaaaatactaattaaagctctagtattgctttttaatgtttaacatttgatgtatttactttttaggcaaatctaagtaggtctttgagagacacagcagtcaggctttctgagttgggatggttgcataataaaatcagaagatacacggaccagaggagcctggaccgctcattcggactcgtcgggcaggtgcgttcatggttcctaggatgctgggatgctgcgcactttgggaaacgcttactctagttgaaatcttactgtgaaatagctccttctaaggctctttccaagtaaagcagctttgagagtcaactttcagggtccactcaagacagtagaaaccacagtaggtgctgatgaggacactgaatacagcaggttggctcaggaactgctggaggactgtaaaatacagagaaaatggtgagacagagctggccatggggagctggcattgcccgattccaaacgctcgaagggggccctgcccagctgctgctgcctcctccagaaggttgaggaggggccctgctgggacggggcctgccaacaggggacactcccagctgcgtgattccccaggcagcacggtgaggcaggatttgggaa

SEQ ID NO: 14356 - DNA, 1075 bp, Homo sapiens
agctcgcagagattttgttttccattttactgctaggaattcctagagccctgattgtatttaagtggataaaatgtctgcagagattgtggtgattttctttcctgtgattttatattatttatgtaagaaagagtatttggagtatctcagttgttgtatgtatacttttattaatttattaatttcagagatttatacccctctacatatttttgactccaaccgaaatatattatttgatgcaaaatgacttaggttccctcaaagacagcagaaaaatctcagcttgcattaactattagaaaatgcattttttggccgggcgcggtggctcacgcctgtaatcccagcattttgggaggctgaggtgggtggatcacgaggtcaggagatcgagaccacggtgaaaccccgtctctactaaaaatacaaaaaattagctgggcaacggtggtgggtgcctgtagtcccagctactcgggaggctgaggcaggagaatgacgtgaacccgggaggcggagcttgcagtgagctgagatcgcgccactgcactccagcttggcgacagagcaagactccatctcaaaaaagaaaaagaaaaaatgcattttttgtacatccaggagaatttgagattaccttgggcagtagcaaaggtacactttttagaggctagtttgcaaaagtcaaactggcagctggtgggatattgcagactctcagtgaatccttgttctttggtctcagccccacagggctcctcgtgggtcatggctttgtggtttggaagagacgctggccccacagcattcacgctcactgtgcaagactggatgttttttgtgccaatgtggccacatagtttaggagcagaggcagtgtgtggtctcagtgtgggttccctaggcctcgacccagaccccagggcctgctgcttctggtgacccattctgcataagggagggcctctgcagctctgagcatctctgttctcttatatttgggacttaatatcactgttcaggaagaacttacataaacaggaacatctcactttcctaattcttgacc

SEQ ID NO: 14357 - DNA, 1086 bp, Homo sapiens
cctgcagggctgcgccccctggaacggcttcccagagcctccacaagcacgggctcctgcagggctgcgccccctgaaacggcttcgcagagcctccactagcacaggctcctgcagggctgtgccccctggaacggcttcgcagagcctccactagcacaggctcctgcagggctgtgccccctggaacggcttcccactgcagggctgcgccccctggaacagcttcccagagcctccaccagcatgggctcctgcagggctgcgcccccggaacggctttgcagagcctcccagggtgaatgccatctatgctggctgctctctgttttggttttattatataaataattgttatgatataataggttttgtaatttgcattttaaggagacatgcttagtaatttgttttgccacctgtttttgttgtttttaaatattttaaatggattgttattcattatagatcaacaaactccatttatgtaaacccctaattagagcaattgacagctcaaacctgaaagacgattacagcactgcacagagagtaacatacaaatactacgttggacgcaaggctatgtttgacagcgattttaagcaaggtatgttgctaatctttttttcccagtattttaaataagacattgcattctgaacaactttgaataatatagtttcagagaacacaattactgtattttatttttaaatgtggaccaagttatatatacatatttgacactaaagctgattaaagggaaattatattgaagattcttaatccatactgggtctctgaagtgcatgctggagtctcacaggcattacagacatcgtttctgagttcactgagcatgactgttctcagaatagaatgtaaatcattgttttctttatttgctttttgaccctgtaatagatgctggttatgttgacataggaaatggagattaggacaacatttagttcagcgactgacttcatgacctacacatcccgcatggagatgacttagaagcaggggatatgcccttggacctggtgtcaaagctctcgtttaaacagcctcgtgcagtgt

SEQ ID NO: 14358 - DNA, 1031 bp, Homo sapiens
ccctttcagctgtctggatttgttccactgtgggttgcttcctgcctgttcggtgacttcatgtaaatggaccaccacagtgtgtactttttgtgtctgccttggtgggactcatcctctttgtgtgttttactggtttgttttgtcgtactgatgagaagtatttttccatttttcttttctttttttgtttttgttttttgagacggagtcacgctgtgtcacccaggctgaagtgcattggcccgggtttgagtgattctcctgcctcagcctcctgagtggctgggattacaggcacacaccaccatgccctatttttccatttttcaaaaacggtttataacaattaacttttacgcattgttgctgcaaatgaggcagtttttagctggtgccgcggaggaaggatgttactcaagtagttaattgggattttcctggtttgttttctcttttatttttacccatcaggtaagacatcttttttcataatgttattttgtttgatgaatatgacttgatatgaataagttgatatgaatatgacttgagctttgggacttacctcaagatattaatttgtttaggcagtttattttgtgatttataaataaaatttttatttcctatgtaacttaaaaaaaattatttccccatagccgtgctggtatagaggactctaagaagtggggcatgctgtttctggtgaaccagctgtttaaaatctacttcaaggtgtgcttctgtttgaatcctttctgtctttacaattttcgattgtcctgggcttcccacatatcatatatatatcagctagcctccctggcgttgcttgtgaaatgatcataaccgtattcctagtcctaatagcaaacatttgttgaatgcctactaggtgcaaggcactattctgaatgctttacaaatgtcttcctgttgacaatcagccctctgaggttagcgctcccagccccagaggaaacgaaggcccctgtgtgtgaagcagctgtcccagtgtggtggaattg

SEQ ID NO: 14359 - DNA, 1740 bp, Homo sapiens
gtcttcccgtcattgtcatggtgattgtcagccgctgtggcactggtgggagtgtcacggagcatgcaaatgaggttgtaatgaagttggaggccctgcaaaggccaggtggacttccacttagcatcctgctggtcttagctggtttaaccaagaggggagcctctgacctcaggcatcctattgctgaagataggcagagtttgagttgtgcaactgttcagccaagcctacaagatgtatagtgctgtgggggtaacatggcctccctacccagcctcgcttcagaactttcgtaccaaggctggactgtagaaaagtccttcctatgccatggcactttcccactgaggcctcccatgggtgccgtttcctttgctggaaggttctcctcgactcctggcagtctatactcatttaaaggtttccgccttctctaaagcctctcactgctggacttcacggtggatcagatttcccttttataaacattcatagcagactgtacatttctttcactgcgtttaccaaacgatttgatggcgaagtgcgtcagggcgtgggccttctccatcactagcgttccttgcaccccaggagctcaatccgtgtttcctaaatgaatacttgacatttcgcttgatcgtatatttttgcacagcagtgatcttcacgacctttgattaggcagtggcttctcagatacgacaacaaaagcataagcaaccaaaggaaaaaattaattggacttcatcaaaattaaaaactttagacttcaaaggacattctcaaaaaagtaaaaaacaaccataacctagcaaataatacatctgataagggcctaatatccagaatatataaagaattattacaattcaacagtaaaaagacaatccaattcaaattctttaaaatgtttaaagaatttgaaaaatcttccaaacaaaatacgcaagtgaccagtaagtgcatgaaaagatgctcaaggtcattaatcaccagtgacttagtcaccaatgactaatgcatcagtcacttgaaatgcacatcagaacctctgagagctgccaggccacacccagtgggatgactgtaatcagaaagacgggcggcgccagtgaggatgcagggagactggagcctcgtacacatcgccaggggaacaaaaacagtgcagctgctgtgcggaaatgggaaggcagttcctgaaagtgggacgtagagctaccatgtgacccagcatttccaccctgaggggacactcagaagacagggcagatccccagtgacatctctttcccgttggggtttgcttttgtcacagtctccaatagaggtcatcattcctggtgccagaccagctacgatattaccatgcgtgtagcgttttacgtgagttacggagtacttgtgtgttttgtttggtttttccatagctctttgaagtcatagaacagtattattatttgtctccgttttcagatgaggaaaacgagaccttgagagacttttgtttgaggtcatgcacgtagggaatgataaaagtcatagacctgcttagagcagctcacaggcagttataaaacagggtttgatattttaaaattgtatttttacattattttaagtgtttctatatggacacattttggtctttaagagtaattttatgttctgtggcttgtaaaccacctgcttgttttctgtactgggcacttttgtatttttgtgccttgactt

SEQ ID NO: 14360 - DNA, 1033 bp, Homo sapiens
ttggagtaatacagacttctcaatttttaaaaatattatagtacatgctagctgatttctccaggatctttcgggactttgagtcttaattgtacccattttttgcttcaagaaataaatgttttggctgggcacaatggctcatgcctgtaatcccaacacttccggaggccaggatgggaggattacttggagtcagaagttcaggaccagccagagcaacaaagtgagaccctgtctctacaaaaaaaaaagaaaaaaatattaaaataaattttaaaaaaacaaaacccaaaactagccaggcatggtagtacctggttccatggttccagctcctcaggaggctgagatgggaagatcagtggagcccaggaggttgaggctgcagtgaggtgtgattgtgccactgcagtccagcctggacgacacagcaagatcttgcttcggaaaaatgaaataaaagttcttatattttattaggcagatcaacagttggtaaagaaaggaaaaagcaaagttggggacatgttggaaaaagcagcagagttactgatgagctgtttccgggtctgtgccagcgacacgtgagtaaggacttgaggaccgaccaccagacgctgttggtggtgttttcattgcagcgttcaccctttctggcctgtgtttattgttgacacatatttcatttctacacatgctataatcccacaaccattgttatttttgctttaaaaagttgattgttttgtaaaggaaataagagctgagggaaaaaagagtcttcatttgcccacatttgaccatgcctggagctcctctctgcaggaaccagtttccgtctagtgccatttccctttcctgaggcactttcttccacatttgcgtttggtgagggtctgagggcagtgaatcttttaagctttcatttttctgaaactctcgttattttttttaagaaatgttctctctttaccagtgaagaagcagcactgatcaccttcatttttaaggctccatttgctacatggag

SEQ ID NO: 14361 - DNA, 1028 bp, Homo sapiens
ttgtttacgattgcgccactgcagtccgcagtccgacctgggcgacagagcgagactccgtctcaaaaaaaaaaaaaaaaaaaaagaaattattgtttacccactgcagagagtagtgaccatctgttacattttgattgttctgtcttctttcaaagtaggggaaaatgaattttcccctgtgtggcattcagtgtattgttgtaggttctattcgaacagaatattttattttctacttaggtttccctttcaaatgtttcaggtgtacgaagccatcgacagcagagatggagcatcttgtgcagagttggtgtcttttaaacatcctcatgttgcaaacccacgacttcaagtaggtgaaagagctgtgcacacaggtgtctgcagacaattacagggtaaccactttcctaagagaagcgtagagtttgagtaagaagaaaactaatattgtcactcttatttgaaaattttaaagtttctttatgatttatgtaatttcaatccatttgtggagcactgactatgtacgcacactgtggtgatgtggacctcctgcccttgtgtttgattcctagacagctctctgaggtttagagaagttagatggtggagaggcggtggagcttagattctgtctaggcctgtgcgtccccaaagccccatagacgtcatgtaccacaggtgtctcccatttaagttgttagtcagaaaggctggcaagccaaggcccagcctggggttgtacatggagtttccatgtcatctgtggcgtagatgatgttgaggcagtattttctatagaaaatcttgtggacatttggtaaagccctgtttcctcattgacaccctttatcatattggagtgtgttcctactggaagcagcatttttcttttggaagaaaaatgggcttatctattggtgattatgtttggcggtgtacagacttgcaactcagaccaggtaaatcagtctctgaagtagcagcaggcctgtttttgtttttctaataaagttacctag

SEQ ID NO: 14362 - DNA, 1048 bp, Homo sapiens
tgacatgattgggcccagcagttgcttggttaattgagaaaactggttaaaacaggaatcacgaagaaatggatgtatgtttttaacttaaaacatgaaagtatacattcacttgccaattttttttttacaccacttacctcaagttctatacttgccaatcttttgatgtaagcccagggccttttctttaggctgtgtctgttttggcctaatcttagcagacttaacattttccaatatcagtttatttaaagttaaacaaggatataggcatttaagaaccaatttgatacgattatctttagaattttcttaatcttttacaatttttcccccatacctaattatttttttaacaaactcaagtgagccttttaaaaacatacaacttagcttatagagaaacaactgtttccttttgcattcatatttcattgatgagcttaaaagtacataactaccataacaggttcgggtagcaaaaatagatttgagaacaaacacatctggatatgagaacacatacaacttagctggcaaaagcttgcgatgtattagagtgaagcctacttgctgaaagtcgtcatcataccttgggcatcagctcgtgtatttcagggagggattggagagagtcatttttccaattcaagtcagttaaagtgagactgataagcgagcttctactctatgtgtgtaaactgaagtttaaacagacagatttgggttaaagatacaaacctgagactccttcgtagtcacatgatgggaaagactgagaagggaaggggtgacccagggaacaagtagagagagtagacaggggctgggcccaggatggacttctatggagatgtgcatgcctacatctccgcaaagggcagtgtagccactggggtgagacagcaaaaagtccgcttcctcctaattctgatggataaaaatatttctggttgaactggcatgttacctaagttttatgtattaacagattcttgaatattttaagaaaataggtgcctcttcgatacagaatggcaaccgg

SEQ ID NO: 14363 - DNA, 1029 bp, Homo sapiens
tgagccaccacacctggcttaacattttgttttagagttgaggtctccctccgttgcccaggtttaagtgcagaggtgtggccatgaccgcaccctcaggctcctgggtttcagtgatcctcccacctcagcctcccagctaactgggactgtaggcacgcagactgtgcctggctaatttttaaactttttttggagggacggagttttactgtgttgcccgggctggtctcaaactgctggtctcacacagtcctctcacttcaggctcccaaagtgctgggattacaggcgtgagccatggtttcagctgaaggttgcacttttgatctgttctgttggtgtgtttcccagcatgcattcattttctaggggtgactactgtttgtagtatcttttttctcaggatagcattgtatgggatttgatctcagggctgttctgttgctcatttttatgtgaaattagttttcctagtctttcagaaggaggatggttcggggcagcttttcgacttcatggtgctccctcttggctgtgtgtgtgtgtgtgtgtgtgtgtgtgtgcaggcgtgtagtagacagaaatgtcggctttgctgtctgagattgtctggcactgctcctcccccctcctcagcttttctctcttttccatctccattgtccctttcccgcccagcctgttctgctcccaggcacttccctgttggtggcctctgccctcagccacagcctacttcaggctcgtccttacctggtcccggcgtgtaggcacctctgaggccctcctgttctcacatctgtcagaggccctgtgccccccacgtccccggcatgacggcaacacacgggtcctgttgctggcagtggctcatcccctagcttacaacttgggtttgtggtgatactttctcacctaaatttatggtaaatgttgcctctgggtgtttggctttgctttctaattgctgcatctgcttttatgcgcagattcagggaaggttacacactgtgctgcctccgcccc

SEQ ID NO: 14364 - DNA, 1958 bp, Homo sapiens
ccacctcccaggttcaagtgattctcctgcctcagcctcccaagtagctgggactataggcgcatgccaccacacccagctaatttttgtatttttagtagagatggggtttctccatgttggccaggatggtcttgaactcctgacctcaggtgatccgcctcagcctcccaaagtgctgggattacatcatcaagttactttagataagtggaaactcagccctcctatatctgaaagtgtcaagatgttactttgtttcattatatactatatatagtacagctatttggcagttttgttatttattgcctgcccagagcctctgtcctattttttcattttatttctgtctggtatacagaggcattcttgttattagtattattgtttccatttaatcataacaggtttttttgtgcctgcttgtgaaattttcataaattacttttaacgctattcttagttatttgtgtacattttcatcaatgtgattctgtgatttaaagtgggaaaaaaaatctccaaaccgcacagcctcttcccattcattaaagcctgaactttattgaaaccaaagaagactgcagctgtgacccccgctggtgccgtaaggtccttgccctgtgtcctcagaggctagatgtgcattacagagttactgagagttttagagaaaaatgatagtcacacttcatgcagagtgaactggatagagatcagaatgtattttgtataaaatgttaattctcataatttttgaagcttagactgcctgtttgttacagtatagatgctgttgtttccattttcagaagactgtgcagtctttgtaactgatgaagagcaaggctttgtctctaattctgcccagttaaagtgcaggcgttaggctaaagctgggacaaacctggagcggcttcattggctttcctacttcttttgcatcccaaagcataagcttaaatcgtctcagaaggacaaggtccgccagtttatggcgtgcactcaggctggcgagagaactgctatctactgcttaacgcagaatgagtggagactagacgaggccacggacagcttcttccaaaacccagactcgctccacagggagtccatgcggaacgctgtggacaagaagaagctggagcggctgtacggcaggtacaaaggtaagaggagactgcagcaaagccggacggatgtcggcctccgcgagcggcctgcgcgctgcacttccagggttctggtgccggggcaggtctccgggctgccgttgcttctcctccccacgctcagcgctcggcgctcagctgcagaatccacttgcttctgtgtaaatggggctgggactgtgattggtgggggtggggagggcgagaagagtggagtcagcgatggggcagggccaggcccgtgcccgcttgttctgtgcggtgagtctgacgctgcacagcctgtcagggaaaagctgctgctgggaggcttggtgtcttggcgtgactgtgtctgttaatacagtatttttttcaagcacttctatttaggctgaaatattgatgatgagaaggttaagaacaacagcaaatcatgaagatgatctgaagtgagggtaaaccttagtgttttccttgcccgggtagtggcgtgtcagccctgaaatagcttcagtgattagagaggctttgggaaaagctcgcagcaaagaaactttttgttgcagattgtgatttttattgacatcagtgcttggatcggagcttcttgtcaaaatgcttcttgtcaaaatgtgccttgaactgagactgccgtgatgagcatacgcagatccacgcccctctgcaggctttaaatttcatgtccaatgcagagggacaggcagcagtctaagagctgacttattttgctttttctttctagcagtttttaaggctaagttttctaaaactttaaaacaa

SEQ ID NO: 14365 - DNA, 1074 bp, Homo sapiens
tttttaagaatgattggaaccccagtcattcttaaatgagagttcttgtttgtgtgggtaatagtcatcaatattgaccatattagaaattaaaatagtattaaaatatttctatagttaattagcaataaaaacccattacatttttgcaaatatcttaatgtctggcttgataaaagataggctctcgaatctcgcgttcattcctgtgatatcacaggccttgcagcccacggaggcctctgctgtgcactctgtgagaatgagagtgagcaaggctggtggcggcttaggacgctcgggaaggtagttctgtgggactcctgaaaggcctcaggacccaggatcccagatgcacacgggagagtatgtatctggacagcgttatcttaatgcctctgcagaatcgtcctctggtattttggcatcagcatgctttttgattgcctgtctcaaaaaaaaaaaaacttctggaagctggctctgctgtacgtggttggcattttggtgaggaattggtatgtgtgaggggacattgaactttgtgaggagccgcagaagacgtttcctcaggttttaggccagaagggtctgtatctgtaccacttctgagctgctggtaaggttttagatcttatgaaaacggattttcctaactaatcgtgttttctttgctgtggcactggggaagcttggagcctgatttccagctcttacatgtgacaggcacgtccttgtactaatggcaccccttccttatccacaccttgttatccttctatatacttttgttaagttatgttataaatcattccatgtgtttttataagttgtctcatctttatttgaacaagattgagtataaatcgttttgagtaaaaaatttcctgcttatattattgtgtaaagcatttttgtaaaacgttagcatccagtggattctagggtctgtttggatttagagaagttagtgtatcactttcttttccagtgttgcttttatcaggttactttatttatttatttatttatttatttatttattgagatagagtctcgccctgtcgcccaggc

SEQ ID NO: 14366 - DNA, 1027 bp, Homo sapiens
tgcggcgtaggggtggccagcagctgtgaggaccagcttggacctaacagctcacgtaggggtggccggcaggccctgaccacacctcggtctcctgcagctggtggtcctggccgtggagcatacggccttggccctaatggagatcaaggtctgcgacggccaagagcacgtggtcaccgtctcgctgagggacggtgaggccaccctggaggtggacggcaccaggggccagagcgaggtgagcgccgcgcagctgcaggagaggctggccgtgctcgagaggcacctgcggagccccgtgctcacctttgctggcggcctgccaggtaggtgctccctgctccgctcaacccgggtgaagagctccagggaggcccagcttggtcaccccagatctaacctggacaggctggggtttctggtagtgaatgcggaagaggacttgtgttttaagaggaaggagaagtccaggtgggtcgttagtggctattatggtgtctcggtgctggtcaggtcattggctgagactgagaaacacgtacgggggccggcattggcctgagtcaggccccacgaacctgcatcttcagggagcattcgtccacacccatcagaccagccccgggggagagggctgggcagacctcgggccaggctgcagttgggacccgcggctgtcaccgcagctgttagcagcgaacagagtgaccgccagcccctcccatgtccagcagggcgtcctgccgtgtcccatgggctacacagcacagaggctgggaccggggatgtccttgccatgagctgggagggtcagcggaaaggcacgtgggagccggcaagtcctcggctgcccgcaggttttcacttgcggcaaacggcaggatttctctcttggctgccagacacagactccacttagttttaataaacagagctttgaagaggatgagagcgagccaggaggcctgcagcctgaatgactcactgggcacagaagaagatcacgtttaaccgatgggactgt

SEQ ID NO: 14367 - DNA, 1064 bp, Homo sapiens
gctggaagggacactcctcccacctccccagccctctctgctggagccgtgcccctcccccgacattcctccaggctgggccacccccacatgcctccttgctctccaccgcccagaccttctccttatcttgttttcctttttatattgttgttctccctccctggccttgcctctccctgctgggttccttgcccgagtttctaattcagagaagactgggtaactccccacagtgtctctgctaaagcttcccaggcccagtgactttttactaaatcctcgaaggccatcaggttccagggcctgctgaggtctccataatcaccccttgattccagaaatgatccgagactagagacttatcccagcccagccctactgcccaggtcctccggtgcctgcctgggagcctgtttgtgcactttgatccccggcctgcctgccggaaaatcatccaggctgtggttcctgatcccatcacctggctttatctgagatacaaagcacaatattcaccgagggctggtggccttccctgagggttggcctggattagcaacctgcacctgtacccgcacctgcacgacatgtggccaggcctgtgctccgaggccaggtttcccttcccccatctctttctttgtctccctctgtgtttctctctctgtcccagtctctctcttctccccactgctggtggtgaggaattctccgcatgggatgttggtgcatccgttttcaaacttgctggctcatcctgaactgcatgtgccctccaagcaccttttccctgaccttgtggattctttgggaacagctggggaaggggtaccctttatggaaatgaaaacccctctgagtccccacttgggaacagccacttggctgggacacaggcccagatgttgggatggcctaaagggaggtccctgttggaggggagggctgtacaatgtgggggcgcctggtggggaaggtgatggccaggctgagacctcccctgccctgccttgacagaggctgcagcacactcccacacacagacacatgcacacacattc

SEQ ID NO: 14368 - DNA, 1051 bp, Homo sapiens
ctgtgatggttatttttacacctggaggctggcatcctggacaaatccccaaaataggttccttgtgaggacttcgcctgagacttcagcagaggcaactgggtgggtcggatggaggctctgtgcccgcaagttcagggcaaatttgggctgggggactggatggcctggtgtcctctgggaacccttgtcccccggcaaccctcatcctcctggaaccctcatccctcgggaaccctcgtcctctgggaaccctcgtcctctgggaaccgtcttgccctggcaaccctcatcctctgcgcttcactgggtcaaggttgccatttgccaaggtcatgagctgtgcacacgcccatggccagcaaagggttcattcatgaagttgaccatgagcccagctgtgggggtggggtgaggcccttgacggaaattaaggagtggagccaagaagccctggggatggccctgccccaagggacctgtgctaattgtgcgtcacacttaattaactctgcttcctgggaaagcactggctggggaacccacacgtgctgtggaaagtgaaggacgctgtgattactgcagaactaatgactgtcctcgcatccccggagcacaagggccccagcgtgctgctcccacggaccttggcgtcccggcagaaaggcggggtttcccacgtgctgcccgggagacggggcttggtgactgggccgctcccgcctgcgtgtcggcgagttccccagctcttctattctgggatacccgccgtcgctggggtctccgtcacaacggcctctgagcagctggcagagtgcggcctcgtcgtttgcctcggattcaagtttggttttattggcaggtgtagcttttcctctttcttgccttttttttttttttactgatttaattttgaaatggttatagatctataggaaggcatcaaaacagtacacaggagtggcgaggggcgaattcccacctttccctgaaaacggaaggccgtgctcccttctcccggctcccccgaacggaaggccgtgctcccttc

SEQ ID NO: 14369 - DNA, 1096 bp, Homo sapiens
ggggatgggagtgagtgttgaatggggaccgagtctccgtttgggaagacgagagtgttccagagaggacggtggtgatggttgcacaactcggtgaacgtggttaatgccacagaactgtgcacgcgagcaggtcagagatggaaaattgtatgttaaaaattaaaataaagggactaatgcaggtaaacaagacacagcaatcctgagtcccaggctggcaggtccctgcttgcgggacttgcattagagggtggcgtgcatgtccctcgcctttcggcagtacacatggggtgcacatccacattttgacttgtggtggcaaaaaaaccaaggctttatagagagctagtgaatgcacacaagcaaaggctggaaacgtgtctgcgatgtagcagggaacaaacatttctacgctgctgatgatgtatgtcgcttttactttttaggtgaagccaaaaaccttccctcttacccggggccgagcaagatgagggattgctactgcacggtgaacctggaccaggaggaggttttcaggaccaaaattgtggaaaagtcactctggtaatgtcttctgttgctttacttggcactgatgtgttttctttggtgtagagaatgtcccaagggtgtacgtcaccttcccattttcccatgtgtggagaacgtcccgagcgtgtacgtcaccatcccgttttcccgcatgtagggaatttttctgtgcgtagacaatgtcccgagcgtgtacgtcaccgtcccgttttcctgcgtgtagggaatttttctgtgtgtagacagtgtcccaagcatgtacatcaccgtcccattttcccatgtgtagggaatttttctgtgcgtagacaatgtcccgagcgtgtacgtcaccgtcccattttcccgcgtgtagggaatttttctgtgtgtagacagtgtcccaagcatgtacatcaccgtcccattttcccatgtgtagggaatttttctgtgcgtagacaatgtcccgagcgtgtacatcaccgtcccgttttcccgcgtgtagggaatttttctgtgcgtagacaatgtcccgagcgtgtacgtcaccgtcccgttt

SEQ ID NO: 14370 - DNA, 1033 bp, Homo sapiens
tgcggctgtttctgacctctggaccggttagagagcgtttgtagggtaaaaacatacacaggaggctgtgtgttatgagaggagccaccaaatcggcaggcgacagcgagggggacacgaggcctgcagagggcgtggacatgaccagctgcttcgaggcctgcactctgcctccgacggctttatctctagggcatgagtctcttgcgacaggaagtgagtattaatgaatcagttaaccattttctaaactgggaagttgtcttgtgaccagtcttcacgcaggcaggcacctcccccgcgtgcccgacactaacccaagccttatgttttgtgggacacgtggcctcgcccgggccaagggtcggtgtgactgtccagcctctgtgtcaccaaggtggggtgttcatctattgaactcacatcctcaccagccgtcccagccaggagacactcgggaaaactgctaccgcacggcggcacagggaccgtaaacatgttaccgctggacataatggaagctgccgatgacaccacacacaaagccccccatgggttccaagtatttttacacggccagacctggccctgtgccttgttcagcggcctctctgtggagaagccttctcctgccgggacctgcagcatctcacagctgggggtggggctggggaacctgcagcatctcacagctgggggtggggctggggaacctgcagcatctcacagctgggggtggggctggggaacctgcagcatctcacagctgggggtggggctgggggtgctttcacccacggccaggggtcgtgcccgggaatttcccagcttaccagcttagcacccccgcgtcgtccctggagctgggagctatgggtctttccactgttggtcacgactctgccctgtccctgcacatgagggcgggtggttgaaaaatcaaagccaagtaagctttggagggagcgtgtttaacctgccctcgggtttacactgaaaccctgcccacatgttatcaagggttacccataaa

SEQ ID NO: 14371 - DNA, 1042 bp, Homo sapiens
cgaggttgggcagcaggtgccggtacctctggagggtgcgaggttgggcagcaggtgccggtacctctggagggtgcgaggttgggcagcaggtgccggtacctctggagggtgcgaggttgggcagcaggtgccggtacctctggagggtgcgaggttgggcagcaggtgccggtacctctggagggtgcgaggttggacagccgttgtggaactgtggtgggggtcggggaggcagctcactgagcgcgtctcgtcttacgcagccgcgggtcagagcaggggtctgtgttcacgcaggaaaggaggggcttgccgtgcaaccagagcttctagctttgaaccataggtgaaggcgatgaacagacgtgtctactgcagcagcacctgtggccagtggctgagtgagcaaatagcaaacagtagaagcaatgttgaggagttggggtctccccaccaatctcctgtcgaactgtcaccccgtcgttggaagtggggcctggtgggaagcgactggatcttgagggtggatttatatgaacagctcagcgctatccccttggtgctgttctcacgatagtgagtgagttctcgtgagatccggtggcacacctcccacctcgcgctcttgcccccgctctcgccgtgtgagacacctgctcccccttcaccttctgccatgactggaagcttcccgaggcctccccagaagcagatgcctccatacttcctgtacggcttgcagcaccgtgaccaataaacctcgtttattttgaattacccagtctcaggtgtttctttatagcaatgcaagaacagcccaatgagtaatcgccaactgaaacggtgattatgtcatgtgcatccacatgtgggctgctctgtggctttcaaggaacatattaagcccaggccaaaccacatgactcgcaggaagttccacggcataagattcaaaagaagcaaaatgagagcgcccaacaccaccccctagaagaatgataaacacagatcagatgagtgtgcgcagatcagggataag

SEQ ID NO: 14372 - DNA, 1106 bp, Homo sapiens
gagaaatgctgtcttatattttaacatacattttggccattacacagatgaagcaacttttcatttgttaatacatagcatacgttttcttctgtgtaattcctctttatattctttgctcattttcccactgggatttgcaagttctttattatttgataatctctatacattctgaatatccatttttttgttatgtataccatgtaaatattttcttctaatttgttatttgtctcaatggtatttatcaagtgtttgctaaaaatgagtttgtttagttagtaaaatttgtctgtcttttacttcatgatatttatatttcatgtcatgaggaaaaggcatgaatattttaaaaacttccttgtagtattaattttattttttatttcattctttaagttatttgaaatttattgtttatttcttcaaattccaaataataaccaactttctcaaagtaatacttctttctactgatttcaaatgttacatttgtcttctctgaagttcttgtctatttgatacctgacggtcacactactgctgtggatgtgcttcgtaccaccacagtactgcagggttataagattatctgatagccaatagaagcagacctctactcactgtcattcttttttcttttggagaagaaagttagctatttttatctgggttctcaatttttttttttttctttttgagatgaagccttgctctctcacccaggctagagtgcagtggcataatcttggctctctgcaacctctgcctccctggttcaattgattctcctgcctcaggctcctgagtagccaggattacaggcatccatcaccacgcctggctaatttttttatttttagtagagacagggtttcaccatcttggccaggctggtcttgaactcctgacctcgtgttgcacccacctctgattcccaaagtcctgggattacaggcgtgagccaccgcacctaaccgggttctcagtttcgtataaactttaaagtagattatcaaatcacataccaattgccatctgattgaaatttcaatgtttttatatgtaagtttcgagactaaagccatctctattctttcagc

SEQ ID NO: 14373 - DNA, 1033 bp, Homo sapiens
acgctccgcctctgggttcacgccattctcctgcctcagcctccggagtagctgggactacaggcgcccgccaccacgcccggctaatttttttttgtatttttagtagagacggggtttcaccatgttagccaggatggtctcgatctcctgacatcatgatccgcccgtcttggcctcccaaagtgctgggattacaagcgtgagccactgcggctggcaccagaagtttattgttatggaccaagagaggagtgataaaaaatcaaactgattaaacaattaacatttaaatttgttttcacttctggatatataccaccataaaaaatttaatttagataaactgaggtataccaggatgctgaaactgtccggaaacagtcacatatccaaaaaaatggagaagttttagtcttttttaagatgggaagatctgagacataatagctgtctttacacactgacgtcatgaggaaagccttttttttctagacttattctgagttgtaaaatgtgggaggcagaacttggatggtcaaccctctatatccatggattcaatgaactgagaatcaaaaatgtttgaaaaattgcttctgtactgaacctgtacagcctttttttccttgcttctcattattccctagacagtgcaatataaaaactttacaaagcatttacattgtataatattgggtgttataaggaatctagagatgatttcttagattgtcttgtgttttgtttgttttttgctataggatgaagaggaaacaaagaaagaggaatctcttaaatctcccttgaagccagagtcacagctagatcttcgggtacaggagttaataaagttgatctgtaatgttcaggccatggaagaaatgatgatggaaatgaagtataataccaagaaagccccacttggtaggacttcacattttcttctgcattctctccttataattcctagctcctttaatggatactttattatcattatgatttaaagcttgctcatagtactgaatga

SEQ ID NO: 14374 - DNA, 1067 bp, Homo sapiens
cacccccttttcctatttgagtaactaaaaccacacaaacaccatttctgtgaactcaagtgatattagatagacaaaataacattttacatttgttgattctgttttctggtttacatccgatttctatttcttttatagctttatagagccccgtgacctagaaataaccctgagtggtcaacaggtctacctgtgcttctagatagaactgtatccaactgttccctgttgatatcaatataacttatttttaaatgattttataaaaaataattttaactctagtctcaaaagtcaaaatccacatagttcatcttataccgagtatatatttaatattattttatatatttggaagttaagatctctttacagatctctttctctctcaaatggaaaacctgtttctcatacctgttttctaaaggacctatctgtcattttctatttttagtcatgcgccttttagccacatgtcagaaagctcattatgggttatatctctgttcttagactccgtactcctccactaatccggacacagaaggaactgtcagaaaaaatacaattactagaggtgagatatgtatgatttgagaagtattatatcccttataccagtgtcctcccacattgattctatatctcatcttctcaggctttgggagacattgaaattgctattaagctggtgaaaacagagctacaaagcccagaacacccattggaccaacactatagaaacctacattgtgccttgcgcccccttgaccatgaaagttatgagttcaaagtaagaaaaatgatcatttattttcatattcttgcacccttaaccacctcccccatcccactgttctctaactacttcttgtcaagagcaaattgtcaattagggcagactttttatgtactagggatttgggaaggccaagcttttcctagctgccttgtaagactgtttgggagcagaaaggtctgccaagttatatcagaatccccaaattcttcagttcagctcagtctcttgtagagtctacatcagcctttttgtcttatttttc

SEQ ID NO: 14375 - DNA, 1064 bp, Homo sapiens
gcccttttaccctccctaatttgattatttccttgcacttccccgtacactctggccccttcctctctaaacctttgtcataaggataagtatgcagcttgccagtgttcagtggatccaacactggagttgggcctgttagtagaaacaggctttattaacttttgccaggctctagaatggaggtagtttcatatcagacttgtagtgggcttgattcagaaagaagggtggctgagtagatggaagagcatagtatggcctttccctctgtgccagcttctccgtccctgctgcctcagtatacctgccagcctttttgcaccgaaggtcatttgtctgtgatgcccttggaatgggagcagaattcaccttgatattttttctcccccagatacacctatgaagattataagaacactgcagaatggcttctgtctcacactaagcaccgacctcaagttgcaataatctgtggttctggattaggaggtctgactgataaattaactcaggcccagatctttgactacggtgaaatccccaactttccccgaagtacaggtactggcaagggaaagtggggaatgggactgagggatgttcttggaattctgtggaacacaaccaaggaggccaatgtttctactccttgacctagcatttcactgaagacaaatgttgtaagagaggagaaaagcccaccatgagtcagagtgactttaggagatgcctctagcagacatcccataagagacaggacatgtgtgtgtcagtggactgaggctaagactcagaagagggccaggtgacaggggccaagtaaagggcaagggttgtttatttggtttacgtaatttctcaaataactaacttctgttggtttatttattaatttttaagatttctatcttcttttccctggagagttaagaatttttttttaagacctgtcagcaggaaaagacctttaatagctatttttttaaactctttaacacaagactggaagagcagagggagaaggtgagggaaatattaacagagggtgtgtgaagggcata

SEQ ID NO: 14376 - DNA, 1006 bp, Homo sapiens
acgccttaaatctaaacctataatacataggtaatcaactaaagctgaaagggaatggccaaagcacccacgtggagtgctgggtgctgtaggcgagaggtctgaggtagtggcttttagagctcaacatcttggtaatgttggttcgaccttttcccctgccagtcccgcggtgacctttatctttcggtgagtgaaatcggtcgttcgtgtttttcgtgggtcttccaaccacaggccgcctgagatggttctagtccctttgagtatacagacccttcctgtgcattgaccgacacagctcggcccggatcccgaaatgaacgtttctaccttcggaacgctgcgtctcggatccttctgaacccgcacgttgactttcctggagtctggagaaaatcactagattctaaaggaatcaaaactgttcaagtgttgtgctacaactaaaaaaataaatgaacactcttaaagaatagaatctctccagttctggctcgttggtctagtggtatgattctcgctttgggtgcgagaggtcccgggttcaaatcccggacgagcccctttactttcctttccgtttcatctttctctctttaaagtcagtagttaacaaatactgcaatcggcgctacggctaggtcacctagccctcttcaacctcgacctatgggggatgagattgttgagcaaattgcggctactttcgctgaaagaatcaaagacaacgaagacgctgcgaagggccaaggtcttcatcacagatcggggttccctgacgggctctgacaggatcttttgtcaggagcagagtgttcgggcagttcttacccagtattttgtgtggaacaaactagtgcacttttcactaggtcacttcgtatggaaaagattgctacctgaaggcgtgttagggtcacaatgtcccaatagaacccgctttctgagaccctgaccgcgcggtgatccagccgcgggatggagtctagcccctgccctggcc

SEQ ID NO: 14377 - DNA, 1050 bp, Homo sapiens
gcgcaggaagtgaggacatcagggagcccgggcctaagcctggaggcccgccctctccggcgttcacagttgcgcagtcagaattgtgtgcgtcccaccgcctcagcccccagttctccgacgcccaggtgccggtccccaccctacacacaaacacacgcatccacgctcgcgaggcccctgggtccgcgcccagtgaggccaacagccctcgggcgcccagaggatgagcagcctcggtatgcccgagtttcaggggcgcctgctctgcttgggagcccctcagtgaggcaggggaatccagatttagaaaggttgtcctcagaacctcggacgcaggactgtcttacaagctggctttgtgactctgcagtaattactttccgggtataaagagatttctttctttcccgtctctggttaaggatgtctcgagtagggatttttaggagagttgtttccgtgcttccttcgatagctcagctggtagagcggaggactgtagtacttaatgtgtggtcatccttaggtcgctggttcgattccggctcgaaggagacgctgctgttttggggtttacggttgctcttcgtttgtgcaaaaaatctctgtatcttgacgtgatcaaatctgtttctgtctctcacccttgtccgaaggaaacagcttagccgcgaggtgggctgcgttaatcgcgtcttgaaaagttggttacctttctgaaagatagtagacccgaatcgtcccaccgttgggggaaggcactgttgtcttaccgaagtgtgttatattttggcttctacgttaagtccaaaggccggcagatatatacgtatcgcgcgtctgtcctggggctcagtaccctacagccttgcaaccgagctcagctctggccctcgatctctatttcagccccctccaggttccctccaggccctagcgggcttaaatcgctccccgggctcagtgagacacaagcatgtgacctaaagtctaaaaagctgccttccttcaccccatcctgcatctggatcgaggagaataagccag

SEQ ID NO: 14378 - DNA, 1061 bp, Homo sapiens
gcaagagtaagaggtttgtcaagttattgttggaagcattggtcactgtgactcaaattaaagtagctggataaaaaagtggaccaatgaaggtcagtgaaacctttctttaggagtttttattgaatctgtatttaagcagattctctgtaattctctgtaaacagttattcccggaagaatgccatgaaatacttgggaaagagggaatgggaacaaagagtgagtgggcacaaagcccagagttggttgaaaagcaaatgtttaatttttgtctttgtttggaaatacaggcatgtcagcaggactttgtccccactgtccttcaatcagtagtgttgcctcttcctggagacgtggttcttcttgccacgtgtgcttttccttctttacctgttacttccgttattgaataagttcatgcttatagacctaaagtgttagaataataaagaaatatagaaattatttagtccattcttcccatcatctaattttataattagtcctaagacagaatgatacatatatactctgtatgaaggaggaaagtgctctaacactagggtccttggaaacaggacccgtgcatcccgtgtctgtgtgcagggacattattggcttgagggagagagagaaaaaaatctccaggaaaggggaatgactttcaagttaaagctgtctgaacatttaaaaaatatatgaggttttttgcaattggcgattccttcatttgtattaaaattactgacaaagatgtgatgttccttaatcatagaatataattccttgttgtattttaaacacaaatgactaagtgcttagatgcattctaatgaaatagtaatttttcccccaaaccctacttttcatttcaacaaaacttccttgtgccaagtttaaaagaaaaacataaaactgtctttttgcattgtgggcagattgtgtatcctccaaaggttgtccagtgaaggcccagaggcagagaagggacctaactatattcagaggctgctggttgccccacctcagcactactgcagaactctaaaatcagaggc

SEQ ID NO: 14379 - DNA, 1061 bp, Homo sapiens; identical to SEQ ID NO: 14378

SEQ ID NO: 14380 - DNA, 1049 bp, Homo sapiens
actctctgcagccccacggcgctccttccaatcagcagagagaacacacgtccttgcggaagtgacggcagttccgagtccagtgggggcggtgggagcgatgagggtctgagacggtgggagcggttgtgtgaagatggaggtaggaacctgatagctaagaaggctggcgagagaacgcggccgaccgggttgaagcagggacgggaagccgggcggagaggcgactgacgggagaggagagagagcggggtttggggagtgttgtcagaatgtcagggtcaaaagccatcgctccaagctgactccctgctccccctaacttatccccgcgactttcttttggtttccagtttcccggaggaaatgacaattacctgacgatcacagggccttcgcaccccttcctgtcaggggccgaggtgagccagagctgccgacgccgcgggggtagggcctgaggcagcggtggggtagggtagtggggaggagagcacggactccggggacgggggctgggaaccaagggccgcaattggtgtttagagaaaagtggcggttgcttctagagcctgtggggactatctggggaagtcttgggaagttgctgtcatcagaaagcaaggtattggaaagagataacctgtttaaagagaaaagggattctggattagaagacagagtggaattgtctcctttctctggggagaaatagctacagtaatcttaggggatcgcagtggaaagaaaatgtttcagcagctgaagaaattggggttgaggggaggagcttattggttttcttttgttttgagacagagtctcgctttatcgcccaggttgaagtgcagtggtgcgatctcggctcactgcaacctctgtctcctgggttcaagcgattctcctgcctcagcctcccgagtagctgggattacaggcgtgcgccaccacgctcggctaatttttgtatatttagtagagatggcagtttcaccatattggccaggctggtttcgaactcctgacctcaggtgatccacccacctcgg

SEQ ID NO: 14381 - DNA, 1039 bp, Homo sapiens
caggagatcaagaccatcctggctaacacagtgaaaccctgtccccactaaaaatacaaaaaattggccgggcatggtggtgggcacctgtagtcccagctactcgggaggctaaggcaggagaatggcgtgaacccatgaggtccgtctcaaaaaaaaaaatgtatctaggctgtaattctatttcagtttgtgtataattctgtttgtgtatgtctttttctctcttagggatgtattcttggcctgggtagcctctagaaattcaaacacagtggtgtttgtgaaatagtccttcctgttctccaagccagtgaagagttatctgctgggaaagtgtccaagagcctgtttttgaaacacaagctgggcttctggtagtgcctcatcacaacccatgatggctgttcatgtttcaccccttttcttccttcagcagaggccaggctatggagcagggccactgaatttgctgtaatctggagatgctttttactttcaaccataagcggtaatagcagaggaaagggtgaagggagtctgggcaagcaaagcatagagatggtggggtggtggtggggttgaagaaacttgttggtataattgtcataggacttgcctaaaatattattaaaattacgggagtgtactcagctttgagcctaggagaaaatgccactgtgtgcatccattttaaagggttccctcataaaaaaatgttattccccattatcacatcagtacactgctttgaaaacaaaacttttcaacatgggcatactgggctacatggaaaatgacatcacccaggagtgatttctctttatatatattatttctgcagttaccatccttatctgagttatcacagttcatgaatctaagaggcggaactctacatcattagtaagaggttccaccaaagtctaaagttgtattcacttgtgtttgatgaactatctttaaaagaccataggtctatcattatttcttagacataatctaaagaaaaacagactagagaagccacctggttgta

SEQ ID NO: 14382 - DNA, 1031 bp, Homo sapiens
actgcaggatgtttagcagaacacccactagatgtcagtagcattctccttcccctgcccccggccacccaccagttgtaataatcacaaacgtctccagatgtttccaaatgtctcctgagggtaaaatcaccccaggttgagaactactgccctagaacttctctaggtttggtcagctgccaggatggggactcccagctcagcaggatgttctttgggctcccagccacgccaagaagtgttcaggcagacctggttcaggccagtcccttcctggctaagagctcttggaatgactggaatctccaaacctctataactgagctgaaggtctagtgactctctgcatctctgaagcttgagaccacctcaggacagcttcacttgcttttccacccaaggtgccccttgtcacttactctgcacactagcttaatttgcaggcaatttccagagttaccctttggtgaccaatctgctcaatcccttaaagatcttctcatcaggattattagaacactaggaaggctgggcatggtggctcacgcctgtaatcccagtactttgggaggccgaggcgggtggataacctgagctcaggagttcgagaccagcctgaccaacatggcaaaacctggtctctactgaaaattcaaaaattagctgggggtggtggcacgtgcctgtaatcccagctactcaggaggctgaggcaggagaatcgcttgaacctgggaggtggaggttgcagtgagctgagatcatgccattgcactgcagcctgggtgacagagtgagactctgactcaaaaaaaaaaaaaaaaaaaaaaaagaacaccaggagatgtgatataaaggaagatatcacattatctggaaaagcctaaaagcttgatgtttagcaggggacttcctatccctagtgttacagaataacctctctccttatccctcccactctggtaggattcagtacagcattcattcaatatgggaggcctaaaatcaacccacccatcactcttcac

SEQ ID NO: 14383 - DNA, 1055 bp, Homo sapiens
gaacccaggaagcagtggttgagatcacgccattgcactacagcctgggtgacagagcaagactccgtctcaaaaaaaaaaaaaaaaaaaaaaaaaattgcaaggcaccaatagataccatactaaaaaaaaaaaaaaattttttttttgtcactccactctgggtccctccactctgacgcaggctggagtgcagtggcgcgatcagggctcactgcagcctcaacctcccgggctcaggtgatgctcctacctcagtctcctacgtagctaggactacaggtaggcacctctacgctcaactaatttttttattttttgtagggatgaggttttgccatgttgcccaggctggtctcgaacacctgggctcaagcgatcctcttgcctcggcctctcaaagtgctgagattactttggaagtgcaagaaccaccgcgtctggcccatactaaatattaaggacaattgtttaaagacatggattgtcataaaatagtataacacttgttagatctctaagccaacaaaccaactggactcttttttaagaacgtctcaaacacccgggcttctggttctttcatgcgttaccttattttgagcaaggtccttactctgctttttaacttttcctggtgctttacaggaaatgtaaggaggtaacggatgttatggagttgttggcatatttcagaggcttatatgcacattgaaggctctttcatcataaataatgttttttctttcttcccccactgttgatagctgcaaaacaattagcatcagccttgaccagctgcacgtactagattttaaaatgtgtgcattttcattttggagaagatgtaatggaccaacattaatcattgtttttttctttacccaacctggcacatagaagtaagaggaagagaatgaacaagaaatatattggttatttttaggttctttataagaaagatggaggaagacagtgggtggggaagaatgggtttgaaaaaggcaggcaaataggaaatgaagttatttttggtgatttttctaaggtagttg

SEQ ID NO: 14384 - DNA, 1041 bp, Homo sapiens
gctttggttcggctttatcaggggccaggcatatgggttctagagtacctaccatgacctagaagcatttatgatttatttgaagccacactgtttgcatgggtgttacttgtctgtacctcagagtctgaggatgttaactttggaactcgcagtcctctagaacagcttcagattatggctttttcttttgaggaagaaattattcactccagatgcatgccctgagccagacctcactgctgcactttccaaggtgctaagattgctgctctccaatgctaactttctgacacagtgctctagaaccctgcctgtggtcctgagcactgatcaccttagctagaccatggttgactcttcttggagattttcacttggtcctagaatgtggcaacgtagttgtgctcgccagaacgtgggaccaaattggcctcaggtgttgagtccagacttctgcttttgagagagggctgcactttttcatggtatttctaggggaggtggtaggctgcatgtgccacttggtcttgttgtgagtatgctgacaccagaaactcagagccagcttgtggcaagcagttggggtggggggtctctgacttgctcaggacaaactaggccagtggttttcaaactgcttggcagagccctgaagtttcctaggggttgcctcaggagtccttggggagatgaagggggtggggagctgagcaggctgggcaatttgccctcaaacagaacagctccccttgtagctgtcttacatattggggttcagggtaagattttatttgcattaaggggtttgctgctgaaaaaaagttggaaaaccactgactagaccatcggctccaaattggagtctgtgcttccttccccaggtatggagcacactcttcaccctaccctctaccacaggacacatatccctgttagcattccccgggacctttagccaagaggagctgcagggaccatggccaggttaccaaaatgccctgctctgaagccttgacacctgggtggaaagagaggctg

SEQ ID NO: 14385 - DNA, 1059 bp, Homo sapiens
aaacggcagaacagatttggttagtttagaagaaaagaaagctctataaatataaatctatattcctgtatttttatttaataatttataaataccaagttcatttgacttttatttttgtgtaatatgtaatgatcgtattaaaaacaataaataaagcccagaagtttaatgagaaggactgaacagggtttgtgacttctacactgtatagcctggggtcaggacatttccttgatccaatcatctcttcatgaccttgttaaaggcaagaattagaataacagggatttgagaaagtgttgggatcattaagaaaaaaagagtctttcccccatcctcaccccactcctataccagccaaatggtcaaagccaagaattccttctatttcaacctgagccttgggagggtgtgtgtatatggtactctgggactgccactaacaataaccaaatgagaaacaaagaaaacctaccaaaaatctttgtgtgatagtaatcaagcccccagttgtggttcaggctctaatcagaagtgtgtgataataatgaacatttctccatggtgccttcctgcctacctcagacttaaaaataggtctgggccaggtgcggtggctcacacctctaatcccagcactttgggaggccgaggcgggcagatcacttgaggtcaggagttcgagaccagcctggccaatatggggaaaccctgtctctactaaaaatacaaaaattagccgggcatggtggtgcgtgcctgtaatcccagctactcaggaggctgaggcatgaggatcacttgaacctagaaggtggagtttgcagtgagccaagatcgagccactgtactccagcctgggtgacagagggagactctatctcaaacaacaaacaaacaaaaaataaggcaaggcggagtctggcaaaaatgggagtccctgcttcctttgctggtcctgtgagacatttggtttcagccattttaatgcaaattgataaactggatggaatttctaagaatattcagctcatccttctctacctctaatcttgg

SEQ ID NO: 14386 - DNA, 1053 bp, Homo sapiens
acagtaaaacaattaagcgcgccgtggagataggcccacttgtcctgggaaatgaggggaagctggggtttgcagtggtttgattgaagggggactacatgttagaggcacagactgggtgcaggtacacccaaaggaacgagaagagtggaaggaaacaacatccacaaagtaaccacatgctggcgtatcgaaggccgtgatttacggttttgagactttacctcgccagcaaaggggggccagtctgttagcggtgcagattggaggggtgacattggaagctgtccaggaaaaagaaaatggaactggggagcagaaggcctacgcaagagggcgggacagacaggacttgtgactagtagctctggactgaggaatcctccctgctttctggtgcgggagagctagtggatgatggtgccaataacctggatggggaaagtaagctccctcctggaatgcttcattcacaacctccattttcagcaacatcccatctactggtgcttcctggtcgagatacaagtttcctgaaactgctgctctgttttgggcctcacccggccaacagctcactagctggcaagcagtagtatcaagatggcggccccctaggactggctagtcatgtgacctcgggtttcccaagtttgaagcccggcagtcctttcgggggcaaggttcacctgtcacgaaacgagtgtcaccccttcgactctcgcaagccaatcggcatctgagactgggccactgcggtgaggcgatcggaagattggtcctttccagtcgcctagctagggccaatcacggagcgtcccatacttcgcgggcccgcccgtaggccggggagaagcaggaatatcgtcacagcgtggcggtattattacctaaggactcgataggaggtgggacgcgtgttgattgacaggcagatttcccctaccgggatttgagaatttggcgcagtgccccgccttagaggtggggccttatttgattgccaagtaatattccccaatggagtactagctcatggtgacgggcaggcag

SEQ ID NO: 14387 - DNA, 1727 bp, Homo sapiens
agacaaagagtcagtgaggacttccttggccttagatgagtccctatttagaggaaggcaaatcaaggtaagcctatgtccattgctgttctagttgtgtataaactctccaggttgcctttaaggctatcatttgttcatctctgactcaggtgatcccaaaacgaaccaacagaccaggcatcagcacaacagaccggggttttccacgagcccgctaccgcgcccggaccaccaactacaacagctcccgctctcgattctacagtggttttaacagcaggccccggggtcgcgtctacaggtcaggatagatgggctgctcctctttcccccgcctcccgtgagccccgtatgcttcctcctctctggtctgaggaacctccctccccccacccctccccgtggtcttcaggaactttgtctcctgcctgtgcaggttgaggaaggtagttgcaggccaggccagaaggccagcctcatcatcttttctgcagtagaaattggtgataagggctgcatccctcccttggttcaaagaggcttccacccccagccttttttttcttgggagttggtggcatttgaaggtgtttgcggacaaaactgggaggaacagggcctccaggcagtgaaagcactgcttggacatttgttacttttttcggagttagggagggattgaagactgaacctcccttggaagaataccagaggctagctagttgatcctccccaacagccttgtgggaggattttgagatacttattctttatttgagccagtcttgcaaggttaacttctcactgggcctagtgtggtgcccaggtttttgccttgcttcacttctgtctctacatttaaatagacgggttaggcatataaaccttggcttttcataagctctacctgcctatccccaggagttagggaggatctatttgtgatggcctagggtttaagagctgtggaggactgaaaactggataaaaagggggtccttttccttgcccctgtctctcactcagatgcgcttctttttcgccactgtttggcagttttctgttaagcccccctccccctgccccagttctccaggtgcgttactatttctgggatcatggggtcagttttaggacacttgaacacttcttttccccccttcccttcacagtaactggggcaggggcctacggggaggggcttgtactgaactatctagtgatcacgttaacacctaactctccttctttcttccaggggccgggctagagcgacatcatggtattccccttactaaaaaaagtgtgtattaggaggagagagaggaaaaaaagaggaaagaaggaaaaaaaaaagaattaaaaaaaaaaaaaagaaaaacagaagatgaccttgatggaaaaaaaatattttttaaaaaaaagatatactgtggaaggggggagaatcccataactaactgctgaggagggacctgctttggggagtaggggaaggcccagggagtggggcagggggctgcttattcactctggggattcgccatggacacgtctcaactgcgcaagctgctgcccatgtttccctgccccacttcacccccttgggggctgctcaagggtaggtgggcgtgggtggtaggaggtttttttttttacccagggctctggaaggacaccaaactgttctgcttgttaccttccctccgtcttctcctcgcctt

SEQ ID NO: 14388 - DNA, 1050 bp, Homo sapiens
tgagacctgaagttccgctggccggtagtgtagcaggaaagggcaggtcctcccgggtcgtgagccagtagcctcctggggtggcaaggtgtagagaggggggcgttgaaaggacacccgctacccggcctgctttctaggggtctctttggattgaggacatcagcagcagtggaagggattttactggagacctgtcactgtcagagccttaaaatatcaccgacggggccttaatgtcaccgaggtagagagaaaagggcagtagccctagagactattgcgacacagtgtgcccctcataagtttttccagggaggggttctgtactgagttgacgccccaggagctgagcaccaggctttgcatccttgggaactcagcaaacgtttgttcagccaattgcaggtagcatggcccagggcttgattgaggtggagcgaaagttccttccagggcctggcacagaggagcggctgcaggagttggggggcaccctggagtaccgggtcaccttccgagacacctactatgacacccctgagctgagcctcatgcaggctgaccactggctgcgacgacgagaggatagtggatgggagctcaaatgtcctggagcagcaggtgtcttaggaccccacacggagtataaggaactcacagcggaacctacaattgtggcccaactctgtaaggtgctgcgggctgacggcctgggggctggagatgtggctgctgtgctgggcccactggggctgcaggaagtagctagttttgtgactaagcggagtgcctggaagctggtgctcttgggagctgatgaagaggagccacagctcagggtggacttggatacagccgactttggctacgctgtgggtgaggtagaggccctggtgcatgaggaggctgaagtaccaactgccctagagaagatccacaggctcagcagcatgcttggtgagggagacaggcccttttgtgcttttcctgctccccacttttctcttttggaggcacctgctggaccatgcagtgggggagggcctc

SEQ ID NO: 14389 - DNA, 1079 bp, Homo sapiens
cctcacgctcaaacactttgagatctgggatgggagctggagtagggagacagaagcagctcagtgtgcaggtttgagagaacatgtttgttcattcattcaacaaaaattgagtaaacacctactggccctgcactactcgaaaggctagtaacaaagtagacatgtagatgaggatggagcttactgtctaatgggggagagaaacaataaaaaaaggccgggcgtgagccagtaatcccagcactttgggaggctgaggtgggtggatcacctgaggcccggacttgggaggctgagacacaagaacagcttgaacccgggaggcagaggttgcagtgagccgagatcacgccactgcactccagcctgggtgacagagcaagacgctgtctcaaaaaaaaaaaaaaaaaaaaaaaaaaaaaggcaagataattacagaccataatagatgctatgaaggaagtaagtcatgccagaataactggggagaactgacttaaataggagtggtaggggaaggcatctgacattttagctgaagcctgaagagtgagaatgagctggtcatttgatgtgctggggaaagaacattccatgtaaaaaagaacatgaaatgccaagggtgggagggtgtgaggagctgagaagggggcagtgagtgggtagtgggaaagtggtataagaagggttggggaggaagcagggccctgtaggccagggaaagaagtctggaacaaagggaagacagatgaccatgattgacttcattcttttacctcctgagatggcgatgggatgggggacacacaggaagaagcagggtccatgagcctcagcccttggcttaggaggaggagcagtacatttccacctaccttctctaagacatcttccctttgcttaggcttacctgggggtggaggtacacagggaaggtcaagcaggtgtaccagggcacctcctggggaggggtccagatggggaggatgctggacatccccagaagccccatccaggagatctagcagatccaggagctgtgaggcctggcagaagggacagaaggggcagggctg

SEQ ID NO: 14390 - DNA, 1028 bp, Homo sapiens
caagaatgttgacagctagaacctatgagaggcagaagttggggtcagtcggaaaggagcaacctgctcagccattgaggactgggaacacattggcgcaagatgatggggctaggagggagaaaccagcaagcaggacctgtgtgggtgaggtggtgggcggggccgtagtgggagaggcataaggggtgatacccgtaggccagctgcagagcggatatccatgatggtgagtactgtctcaaacaggaccgcatttccggcatttcggctggtgtccgtgttagtggccacctgagtggatgagagaggagatgtatctgctcaaggccctcctcaggtctcctttttttgatacagggtctcactctgtcgcccaaagctcactgcagccttgacctcccaggctctgatgatcctcctgcctcagcctcctgagtggctgggactacaggcacatgccaacaagcccaggtaatcctcaggattcttgaaggactccaacatgttatctgtccatccttcaaccatccaacaaagttccctgaggctctactatgtgccagggccagcctgggcactggggcaatagcactaagacagactgtgtcccttcttcatggagttcactgtctagaggagatggagaggcaattacacggccactgcacagtgacgagtcatgtgaggggcacccagggctgatggggtctccaagcaacacagctaaccagtgccctcccaggccccacctgggccagcaagtcattcatggtctcactgctctcctcgtggttccggcccaggatccgaagcagacgaagtatctggacctgaggttgggttgaaaatggaaagttggaggggttcataggataaggagtcgtggggctgaggagaaaactccaacatgtgagggtctggctcgctccctagagccttcccccacctcctcacctccacaggtcccttggtcctaggaggggaacagaggtgtgtgaggccaggggagtttaggacaggcttaa

SEQ ID NO: 14391 - DNA, 1049 bp, Homo sapiens
caaaacaaatggaaagcaaaaaaaagcagggattgcaatcctggtctctgataaaacagacattaaaccaacaaagatgaaaggagacaaagaaggccatcacataatggtaaggggatcagttcaacaagaagagctaactatcctaaatatatatgcacccaatacaggagaacccagattcataaagcaagttcttagagacctacaaagaggcttagactcccatacaatagtaatgggagacagtaacaccccactgttaatattagacagaaaacatgacaaaattaataaggatgtccaggacttgaactcagctctagaccaagtaggcctaatacacatctacagaactctccaccccaagtcaacacaatatacattcttctcagcaccacatcacacttattctaaaattgaccacataattggaagtaaaacactcctcagcaaatgccaaagaacagcaatcacaacaaactgtctcccagaccacagtgcaatcaaattagaactcaggactgaaaaactcactcaaaactgcacaactacatggaaactgaacaacctgctcctgaatgactactaggtaaataacaaactgaaggcagaaataaacatggtctttgaaaccaatgagaacaaagacacagtgtagcagaatctctgggacacatttaaaacagtgtgtagagggatatttacagcactgaatacccacaagagaaagcaggaaagatctaaaatcaacaccctaacctcaaaattaaaagaactagagaagcaagagcaaacaaattcaaaagctagcagaagacaacaaataatgatgatcagagcagaactgaaggtgatagagacattaaaaaaaaaaccttcaaaggatcaatgaatccaggagctggatttttgaaaagatcaacaaaatggactgctagcaagactaataaggaagaaaagagagaagagtcaaatagacacaataaaaaatcataaaggggatatcaccagtgatcccacagaaatacacactaccatcagagaat

SEQ ID NO: 14392 - DNA, 1022 bp, Homo sapiens
ccctgctgggcacccatggcactcagctccatacccagtaagagtggttcttacctagggagggtcaccaagaggacctgctcatgtgtttgaggggctattcaagggagcctgtctctgtgactacacaaatatagtctattttccaagtaagcttgaaaaaaaaaaggggggggtcctagtgggaaaggagtgatgtaaggggtgaagagatgggaagggagtgttgaactttttagtaaggcagttgacacatgatatgaggccacttcgatttacttgaaaaacaagtttaatttgccctgactctaacctgttcttgaggaaagaatgccttgaagggagagaccacctggaattgactggaaaagggtgcagctggctttctttctttgcttatggctctttgaggagaagatgggtttgggggtcccttcagaatattgtattcttttttgtttgtgttttgtgttgtttttagtagacatagacagggctcactgtgttccccagtctggagaacgggctattcacaggtgtgatcaagtgcacaccacagcctgcaactcctgggctcaagcaatccttgcctcccaggtagctaagactacagttgcacacaccaccgcacccagcttagaatattgtcttctgtggtggacttctcaggcagaggctcagaaggaaatgctgtgaggatgtttagcttgttgggaggtcaacttagtaggtcatgtccacagcgtattggtcttgctcttgttctaaggaaatgatgttagaatgtttagctcgctgggaggtcaacttagtaggtcacgtccacagcatgttggtcttgctcttgctgtaagagtaaaactctctttcctactgtgttttataggagaccaaaaataacagccaaggtctagtcagcctcaaacctcaaaatgagtaccaagtggtctaagagctagatagccattgactctgaatttggttggtttgggggaagaagtcccctcctttataatgggggt

SEQ ID NO: 14393 - DNA, 1048 bp, Homo sapiens
ctagaaatggggcacagagccactggaggcctctgactgacctctactccctggccctgtaggctgtgttatatgacatcatcctgaagaacttcgagaagctcaagaagcccaggggagaaacaaagggaatgatctattgagagccctctctcccattctgtgatgagtacagcagagaccttcctgctttttactggggactccagattttccccaaacttgcttctgttgagatttttccctcaccttgcctctcaggcacaataaatatagttataccactgcccatcagcccaagtctctttattggaaccgggccccgctggccctggctcaggcatttccatttccattagtgggaccaacccactgggtgatttgagtgttgagccgctggttggtccagtcctgccggatgtcatcaaggtggcagtcaaagtccacaaggtgctggtgggcccgatcttccagtagagctcccaccatctgccgtgactcttcccagtccctccacatcactctgaaatagtaacccccatggaggtcaaacagcaagtagtgggtccagacacagacttaacagagattgggtctagagaaagacccttggggcagggccaaggacagaggagacccaggagccttgggcttctaagaagaggtagagggagtggggtactcacaagttcttatccttagggacccagcggagaccttggttctccaggacgatgaccgggggcacacgaggctgaggcaccagtttctgattatccaactgagtggacaaagatgggcaagtgagagtttcaagggtccccccaccctacttgcttttcacctccccacccagaaacccaagcctcaccataataagtactgcatcagggaagaattctgcaattcgcccagcaattttcaaggccaggggcccagggctgtgtagagggaagatcagaggagtgaggagccaactgtgggcaaaacccatccatttgagctgggcctcccaggtctcataggtgtgggcgcagctgtggccttt

SEQ ID NO: 14394 - DNA, 1049 bp, Homo sapiens
catctcaaaacaaaaacagacggggcgcggtggctcatgcctataatcccagcactttgggaggccaaggtgggcagatcacctgaggtcgggagttcaagacctgcctgaccaacatggagaaaccctgtctctactaaacatacaaaatagctaggcatggtggtgcatgtctgtaatcctagctactagggagggtgaggcaggagaatcgcttgaacccaggagttggaggttgtagtgagccaagatcgtgccattgcactccagcctgggcaacaagagcgaaactccatctcaaaaaaaaaaaaagagaaaaaaggtcctatgccaagttctcaaggaagatttggagtttgccacaaatacagaaaagcagttgtggatcattacgtgtgtgttaaaaaataaaattggggaggtaagcaggatcagacttaaagctgtgtgaaagaatttggatggacttgatcctaaagagaatggggagacactgaattgtttcaaatggaaataaaatcagatttatgctttggacttgggatggacagactggagtggagcagaaggctggcgggggccatctgttcgatgatggaggcgtgaactaagggattagcagtgggctcagaaaaccatgagaatattatcaaagagagaatcaggaggtataagagataggatttcgtgatagattgaatgtagggactgaggcaggagggtctgggatgacatatgagtgtctaaattaagggtgattagtgtacaactcacagaaaagtctgagagaagaaaataagttcaattattgatatggttaagtttgagatggatatggtaagttccatgcctggggcagacatggccacgtaatactggctgctctatctaaactccagatatatgggatggagatgaaattaggagcagtcagcataaatgtagtattgacaccatgggtatggacaagattaagggaggatgtgaaggtttgagaaaataaagcttgtgatgtaacacttgggatatgattaagggatggatagaga

SEQ ID NO: 14395 - DNA, 1022 bp, Homo sapiens
agttcaaaaggccatctgaattagtgagattcaaagctaagttctgctccgatatttctgatatatgaacagaattttcccttttgtcctgtttagcagtttgtacaccttgccaacttttcccaccacccaggtcaccccctcacagtcacatgcatcccttcagttatgcgattgtccacattaagcattcactgttttagtccagaaactacagtttaagcattcaaaaatcctaactagaagatcctaggagaagcagcttattaattttctttaataagaacaattcattaataaaagaatacttctgccattctttttttaatcttcctcttctttaagtcctaggttcctgggagtttctgggatgtgccccaaatgggatgtgtttttcttatatacaagttgttcactttgaaatggaagatgctgctcctgtcagtactattacctgcctctatacttgttgctgagaaggtagagagttatctgggcactttgagaacatatgcactctgctggttgatccatgtagccctggttgatgaattctgctattgtttgtggctccattagtcttaaggacttcatatcctttttctatttttgattgctgtgtctttgtggaatgtcttgtcatttctttaaggttgatagttatgcagttttatttttactttatttttattgccattcagtaactgcttaggaatctttctgttgcccactgtccatctgccctgaccagtagagttcagaattggtgactctgactgcagagttaacaggcgtgctgtaatacatgaacctttttggggactgtcttgatgctttatgtggagcctggctttcagtattgctgacgagaggtaaagaaatcaggttttagagataagagccaagtcttactgtaataaaaaggttggatgcaagcaaacatctttttctaagtttggtatgtaatctgatgtgctcatcatgccacactctgccagtatatctccaacatctgctgactt

SEQ ID NO: 14396 - DNA, 1125 bp, Homo sapiens
ctgaccatcgcagagcacagcgttatagcgagacagggcatgatggatccccagcagcccagagatactcagtgaagtcacatacccggaggtggggccagtgaagtcacatacctggaggtggggccaggtttggaaaccaggttttcaaatgactatcttagtgcttttgcacccatcagctctatcttaggatatgttgagcaacaaaatggtgaactgtgggggtgctggtgggatagtagatatggttgtaacggataggacatccatcaccaaataatatgaattaatgtgtctttgtcaacctggagggaggtccctagtgatggcactttttcagtgacgtgggatgagcacagatgccactctcataatcgaaggtcacttgcacataattgggaggaatactggatgatggcgtctggtgagattgttgggccagatttgtcatgtggtattgaatagggacagaattacactctggttctttggtcttcagataatcagctgcacaagagtgagatacgtgaggggtggaataacgatagtgtatgaagacaggaggactctggctgataagagattggaaagaattgactgtgatctgcttgccaaaagcactaacatgactttgggatgcactaagagagctttagtacccagaacaatggggctcataggccccagactctgtgagagtcaaaccctgtgaggagtgtgtggcccattttgagagggacagagacaaactgtagagtccagaggtagaaatcaggatggtgagaagagcccatgaccacagggaagacatgaagatactgaactgggagagaagattcaaggggcagatgataatggtctttcaactcctggaatagaaaccgaattgattctgcatatcttgagagcaaagaccaaagaccagagagtggatgtagatcctttatgaggaaggactttctaataattaaagctaattattctaccaaaggtagaatgggcctcaatgagaggtgggaggcattcaagcatatgttggtcaaccactttgtgagaacgtagtagtggacattcagagaccagagtctctccactctgaagttctgaaagatgctgatccct

SEQ ID NO: 14397 - DNA, 1033 bp, Homo sapiens
tgtcgccatggctgattcaagacaccacatgaaatcactgaatgaggacttagaagagatgtgcatcagaagctctcagaagctggtgagccactccacttaccactggaacagtaactggggacggtccccagaaagccacaggaagacttctgccaatcttgtgggcagcctggggaagcctcagctctcactctgaagattttgaataagtaaaatgatttatgtttctctgatttatggcagccatcccatcactttggatggttatctaggctgtccggtggaaggttccctcagaatagcccttggctcctcttaggaacacaccccattgccttgcctcaggctaggacagcctcttgcataggcaaggcagctctatagggctcatgcaattagttctgcagaaagcaattcaggtagaaccatcccgagaggaaggatgagagttgtcggtgtcacagctattcctctgtccctcacttggattcaggcagtaccttctccccaagttccaggaaatcatgaacaccaaggaatctgcctttgctggactgggcctcagccagagatcaggcccagctagaaggtagcaggcatccctgaagagatggtggaatgggggtggaaaaccagtgtgagactggatgtgcccacttctagctgtggagcgactctgctcctcagctggggcatgggaaacaggtcttgcagggcagagcaggaacagttctggaggaaaggggtcttgtcctggggcagaaccccttgagaagcttcacatttatacatctttgagtctttctcccaaattgttaacatgttgctgagcagagaatcagcagtcaaaaacacattgaaagagaaatgagacttttattagctccaagagcatttttcaatactaaggcaaaaagtaaaaagaaggacaaggaaaaccaaggcacaaagaagggacctaggcgcaccccagaactcaccacggacacacagcagagggcttctcttcatatcaagggtatgggtaaac

SEQ ID NO: 14398 - DNA, 1041 bp, Homo sapiens
agccggacaggtcgcgaagcacacatggggcagggtccgcgctctccacacaaggtggggcgccggttcccagctggtggcaaacgggggcgcggggccaaggggtcggggcgccccttaccaggccgtaagcggcaaccctggccgcctccggatgggcgctcggagccggctccagattcgcacccgcacctgagcccggaagctctgggatatttccgccgggcgctgtcagcattgaaagaggctcccgagactggggaagaacgaggtaggcagcaacttcggggtttagaccaagagcatcaaatccagggcaggcaaggaaactttctagggtcggcagggcgtggggacttagtttcatttcccatgtcctcttcctcggcctccgacccacgacccttggttaagcgagggtacataactgtattctctactaagtctcttcaaagtgtgtctttcttcccttttcagatctgatggtgcacaatataatgaaggaagtagagactcaggccctagctttgtccacgaacaggactggcagtgagatgctgcaggaactgttgggattcagtcccttgaaaccgctttgtcgcgtgtgggctgctctgcgctctaacttgcgcactgtggcctgtcaccgatgcggggtccatgtattacaaagtgctttgctacagctccctcgattgctggggagtgctgcagaggaggaggaggaggaggaggaggatggaaaggatggtcccacggagaccctggaggagctggtcctgggactagccgctgaggtgtgtgatgattttcttgtctactgtggagacacacatggcagcttcgtggtcagaactctgcttcaggtgttaggagggactattctggagtctgagagagccaggccccgtggttcccaatcatctggtaagtattacaagaggaaagtggacctagggggaagaagaatttagaaagttcagaatgagacagtaaacagaagagtaagtcttcatgggggagcttgaccgggaagaatta

SEQ ID NO: 14399 - DNA, 1012 bp, Homo sapiens
gcagctctccgtgttcttcagtttttgggggatcctagctagaggctgacctttttcctctttgctcctaccatgtcattggcatctccccttgctcccctccaagtcacttctggtttggaattggaaagcaagccaggttctcacgaagtccacccttctgtcttatctacaatgctgcacctcacttcccacaccctcaagagttctccagaagtgttttcagtaatagtgtttaacctttttgagtccttactctgtgccaggtatgaggactttacctacattatcctcttactcctttcaacaaccctaggaggtgatgtattattattgcctttttatagttgaagaaactgaggttttggtaggttgaacaacttcccaaggtttgacaggcaggaagtggcagaatcagaatttgaacttgatttgtcacacaaatcacctttccatactagcttctgaattctgtccctcgaactctccctatctcctgctaacccctgctcccatagaaaagctcactcggtggaaaatgaacaaattgaccagagctcattaggcccactccgctgcttttagccctcagagggaggggcagctgtgtgacttcagccctctgctccatcatcacaagttgccactgttgtggagccccttggctacccctgctataggaaccgaggaacttggcctacttactttggctagcagctcctggcgggtggcagctgtcaggcctttccggatggtccgcttgtgatcacagacacggaaaggtcgctggggtggtggagctgaggtccagaccctccgtccaaactccgagcttatattagatactgacctggtagttgagaagaaaagtcaagaaggggcgaggaggggcttggtgagtgtaaagggcatgatgagggtagagtggctagagggctagggagggagagatctaggtttatcgattagggatgagggagagaccatggagtgcaggtgggggcgggtggct

SEQ ID NO: 14400 - DNA, 1032 bp, Homo sapiens
agtcacacttaggtcatcttctctcacttttctccttttgccgattagtggacgtgacagagatgtgaatggggcagggatgtcctttgatggcatcaagactttagcttctggtgcgctgtgtcccagctctgatttcagttgcagccgtgatggacagttgcatggaagctgagactctcactgacagtgaaaccctcaaatgaacacaatccctgctttcctgccaaggatccttgtagggtcccccagcttccccactttttttctgtgtcctgacaaagaaacacagagtaacttgattgccctgtgacctggccagttgcatttcccctgcaggcttgagcccaagccagagccttgaaaaggtattcaggttgttgcccaaaacactgaaaaaaactggccctggccctgaaccaaataccttgaaccctcgtaaactccataccctgacccccttgttttggatatacccaggtagaacaactctctctcactgtctgttgtgaggatacgctgtagcccactcattaagtacattctcctaataaatgctttggactgatcaccctgccagtcttttgtcttgggcaatctatacttttctcagaggttcccaaggcctactgaagggacttaacatactcttaatggctttcctctctcttgttttaccttatgccctcacttcctgagttaacctcccaaatacaggatcacctgtacccaagcccttagctcaagaatacaggatcacctgtacccaagcccttagctcaagctctgctttggaagaacccaaactaagacagtgctcctggtgccctccccaagcaacctcaagttctggctgttacttgagcagaggcctttcttttcccttcccccagctctatccatctgccaggcccccctcaaatctcttcatttccaagttttgcttgacttttccaagaggagagggctgcttcttagtatgtccctactcatcctttcctttcttgtcttgtatcctggtgcagcctggta

SEQ ID NO: 14401 - DNA, 1028 bp, Homo sapiens
ctgggcctatgctagcccacttcttccttttcccagaagaggtagacatttttcctaggagctggcttcaggcctacccaccatctggaagaggacttttggggttgggggtaccccagagaggccatctctgggttagaaaatagcctcctaggcactcatcgaaagtcattcaaggctttggatggagggcgggaacttccctctttagggatgtatcaccattttggcttcagctaggagggcttgccatccatcctttgcctccagcattgactgcgcgggaatcctgaagcttcggaattcagacattgagcttcggaagggtgagacggacatcgggcgcaaaaacacacgtgtacggctggtgttccgggtacacgtgccccagggcggcgggaaggtcgtctcagtacaggcagcatcggtgcccatcgagtgctgtgagcaaagaggccctgggccatgtctctgtctcttgcaactcttttgtctgtgtgtgtgtgtctgtctgcccattccctctgcagcgtcctgtgccctgtctgtcctgggtagctctatagaggactcagcttctttctattctagtttgcccctgccacagactctgtctctggggtggcccagagtgacactggaccctatctattcctggggtgccctgtgcccttgtttgggaaactccctggtctaccctgtttaaccctctctctgctctgggagcggccccttacatggtgtatgtgactccatggatattactggtttatttgtgtgtctactgctgaggagggctccctcagagccctgtggcagttttcccaaagagggtggggacagaggaggccacccctccatgcccagcccagccagtcctcttccttgcactgctctgcagcccagcgctcagcccaggagctgccccaggtggaggcctacagccccagtgcctgctctgtgagaggaggcgaggaactggtactgactggctccaacttcctgccagactccaaggtggtgttcat

SEQ ID NO: 14402 - DNA, 1043 bp, Homo sapiens
tgggagcccacatggagggagttgggcaagatttgattcggagcaggtgtcaagacgtgttggggaaactgaggcccagtggaatagaagccagtagaggaggaatctagaggcctcctagattaagacctgcctggaatggattgggggtgggtctttggaaaaggaggggacccacctctagcccagtctctcaactgcccctcctttacagtgagtgagatcattggccgagacctgagtggcttccctgcacctcctggagaagagcctcctgcctgaaccacgtgaactgtcatcacctggcaaccccagccccagcctcagccctgccccctttccctccttcctggagtggtggctacagaagcttggggccaaccctggctcctctttccccagcttctgtctgtctcactgtcttccctcccctcccccagctgaggtgtggccctcaggcctggtgctgccttggagggctgggggaaggagtgtgtggaggagggaggagggtgaagactgaggctaggtgccagaatggactggagtgaaggcgtgtctagagtgtgggctggctgttgtgctggaaagctggggacaggttgatggtaataaactgctcaatgaccagtgcttcaggctccagagctctttggagagatgggttggggcagcttactccagccctggcccaaggaggcccagaagttggaaagagatggaatgtggctgggaacattgcatcccaaagagcttctcagtggaggaggctggggaaggcatgagggggctcagaggctccttgactgggaccaggattgggggccagggcttgagtaggcctctccactctcctccttgggggtccagattccttaggagctttgggatgaggcccaggaggctgcatttttccaggtccttagtcttgccaccacacagatgattctgattcatagccaagatgaggacacactgatgtagctgatctctcatttacagaggaggattctaaagttcagagagggaaaggggcttgcctg

SEQ ID NO: 14403 - DNA, 1088 bp, Homo sapiens
ggtgacgaaacttcagcacatctctgtccattttggaaaaaagaggatcccctcaagagcaaataggcggaaacaatgaccccgcgcccggagtttttctgagctcctaaatagggagagagacccgacaaaacaaacaagcgaaggcgacacagccaggttagcaccgagcagcagcgcaggagcgccagaagggcgggagcacacgggcccttccccacagccagcgcctccgcgggtcccacccctcgagggcggggccgaccgctctttccgggtttgcgagcggaagtggacgaatttgaatcctgtgggccgttgaatgtggctgctcgcggtcggcgtgccccgacgtacagcgggccgggaaaagtggcactgaggctctggaacttctgcccagctctccttggtgagtaaatggggaacgggaagacgcagaacgttccagagagagaagcaggaccgtggggtgggagagggtgtcaggaggccggacgtcgcagccggggcctcgcagtgcttttggggacgtctggtgctggggcccggcctggagactaagggaattcggggcactgggggcgtttgctggaccagcgctctcgacggttgcgcacgccagccagctctcagtgttgaggattcggaggccctgccggtcccccgcgagtaaaccttgtttatacgcatcctccgtggctttttttaaacccgtagtttattatttccaccaattcggctcgaatgctgaaattttaacagtagttaaatctcactgtgaaggcgttgccacgtttaaacaaatctcttttaatgaaagatggaaggttggggcgggtttagaatgaaaagatgctctacgtggctccgcgttcctcctgagagagatacccgggcaaccttgattaactctggactgcagggaagtgacagtctttgaaatgcctgagtgggatttaaactgaaattcgagtgtcctttgtatttaaaacccggatatttttctttcacggttgacatttttcatgtaccgcaaaaatccgagactcctatttaaaccggctgtggtaacagcggtggtgatt

SEQ ID NO: 14404 - DNA, 1063 bp, Homo sapiens
gtaggattattgtgaggattgaatgagttaatatatacaaagaccttaaaatagtgtgtgccacatagcaaatgatacataagtctccaattacattgagttactaaactgtaaaaaccgcatcacatacattctctcattaatctttacaatatcgctgaggtagttactatcttcaaataagaaaacaggctaagaggggctcggtaatttgttctcacacaactagtaacacgttggaactgaagtcggaaattagatttaactcaaaagtttatgcttttttaaaaaagtaatatttcttgcctctcttcagtctccctccagatgttgctccataagtatctctgatggcttctcattgtctaccatatataattcaaatttcttagctttgctttttatttacagagcccttcagagtctggtaccaacttctcttcccaaggaccatcttcataatattacaccagtctcttccaacctgctgatgttctatcaatactactagaattctccaaatctatctcttattacattttatgcatatttagccattggcctttttatttccccttaagattttactcaaatgggtttaaagacttctccaggctgtgctttttgcttataaatatatagtgcgagactgcccttgtccttttaatttttatgtctgcagtgcacagtgcagaacagtgagtgtcatgatactctgaaactgtgtatgttcagtgagtacttattattttaacaatttaacacattttgtcttgggttaatgactcaaaaagttgttgcttttttttttttaaggcttggcttttttctgagatgatagcatataattctgtgtagtttagtagagattttagtgatagcatatggtttataaactatggaaaaataagtattgaaattataggctcagaggacatttcaagtggcaaaaaatcaggagcaatgtttgttaatattcatgaatttaaaatgctttatacatattttctcacttaatcctcacaaccattttattatctctatattaagatgaagaaactga

SEQ ID NO: 14405 - DNA, 1029 bp, Homo sapiens
ttatttgagacaagatctctgtcacccaaagctggagctcagtggcacaatcatagttcactgcagcctccaactcttggactccagctgtcctcccacctcagcttcccaggcagctaggactacaggcatttgccaccaagactggctaattaaaaattttttttatagagacaggatatcaccatgttgtccaggctggttgcaaacacctagcctcaagcgatccttccacctcagcctcccaaagtgctggaattacaggtgtgagccaccatgcccagtcaaaaattagccattttaaagtagacatttcagtgacagtacattcacgatgttgtgcaaccatcacctctacctagttccaaaacatgtaaccttttatgtctgacttccctcatttaatataatgttttcaaggttatctatgttgtagcatgtttcagtactttattcctttttattgccacataatcattctatggatataccacattttgtatatccattcatcaattgatgtataattaggttgtttctttgtaatgtattgatttagtgatctcttttgtgaatagtgctgctgtgaacatatgtatgcaagtttttgtttgaactgaaatatttcaattgttttggttacatagctagtggaattgctgggtgatatggtagtcttgtttaatgtgttgtggaattgccaaactgttttccacccttgcatcattttactttcccactagcaatatgtaagggttctaatttctccatatcatcattaacacttactattttagtttgtaaaaattattattatagctattatagtggacatgaagtggtgtctcattgtggctttgatttacttatcactaatataatgagcattttttcatgtgctgttggccatttgaatattttctttggagaaatgtcttcagatattttgttcatttttaagttggattacttgtctttttgttgttgcattgtaagagtttctaatgtattctagatactagacccttt

SEQ ID NO: 14406 - DNA, 1049 bp, Homo sapiens
ttgcagtttaggcttagcttttccattcctgcaaaaaaaggccatcgggattttgacaggaattgtatcaaatccataaattgctttggggagtataaccatcttaatgaaatagtttttcaacctatggatgcaaaatgtcttttcatttatttacagttctttaatttctttcagcactgttttgtagttttcagtgcaaaaatcttgcaccaccatggttaaatttattactaagtaatttttatgctattgtaaatggaattgtttacttaatttcctttttggattgttcattgttatatagaaatacaactgatatttgtgtgttgatcttgcatcctgtaacttagctgaattcgtttagtagctctaacagttttttgtgaattctgtaggaaattctacatataagatcatgccttctttgaatagagttacttcttgctttcttgctttattattctgaatagaccttctggttcagtgttgactacaagtggtggaagtgtgtatctttgttttgttccagatcttaggtggaaagtgtgcagtctttcactgataattatgttaattacaggtttttccatagatgctgaggaagttcccttatattcctaaatgtttgagtgtttttatcatcaatgagttgtattttgtcaaatgctttttctgcatctattgagatgagcatgtgaccttttcctttttctctattagtatggtatattatattggttgatttccatatgctgaaccacctttgcatttctgggataaatcccacttggttatggtacaaaattttctttatcagaatcagtttgctggtagtttgttaaggatatttgcatctatgttcataagagataattggcttgtagttttattttctgtgatgtctttttctggctttggtatcggggtattggtggcttcataaaatgagttaggaagtgtcataatatcttttggaggggtttgagaaagattggtgccaatttttcttcaaaggtttaatagggttcaccagtgaacccatctgg

SEQ ID NO: 14407 - DNA, 1021 bp, Homo sapiens
tttaaatgtctggtcaaatcttttgtccattttgttcattttattgtgatgtctatttgagttgtaagcattctttatgcattgtggatataaatcctttgtcaggtatatgttttgccagtgtttattcccaatctgtgttttgcctttttctttgcttaactatgtttttttgattagaaagttcttaattttgatgtttaattcatcagtgttttttatgattcagtttcctaagaaatctttgccaaaccccaagatcatgaagattcttcactatgttttcttctagaagttttttttcttgtgatccaatttgaattaagttttaatatatgaggtcaatgttcttccccccaccctccgcccaaagcattcagttatttcaatactatttattgaatagactaccatttgaatacagtgaattaccttggtatctttgttgaaaagcaattgtctgggtctgtttctggcctttcccttgtgttctattgagctatatatctgacttttcccttatgatctattgagctacacatctgtcttgattaacatagctctataagaagtcatgaaatcacatagttggagaccactttttctttttaaaaatgtttttgctattacaagacttttgcatttttatataggttttagaatcagcatgccagtatcttaaaaaaaaaaaaaacctgctggggattttggttgggattgtgttaaattgacatcttaacaatattacgcccatgagcattgtctatctcttcatttatttaggtctttcatttctctcagcagtgttttgtagcttttcagagtgtagtctttttccacatcttttactaagtttttacctattgtgaatagaattgttctctaattttctgattaattcttgctgttatacagatttgccttgtttcattacaacttgttaaagtcacttattcttataaatatgttggtaggattttctatgtagatgatcatatgtgaaaacagttttacttcatcc

SEQ ID NO: 14408 - DNA, 1064 bp, Homo sapiens
tttttcctaagatggactgtttctttatttacatgaatgtatttaaggtagaaactttacttcattattgtaatagaaaccagtatcatttactacactagacaccaatcttaataataaatataatgaaatcaggacaattttaccaaattttaaacattaaaagcaggaaggtacaaatgaatataaaaataatctacttataaaaatgcatgcctgaaacctagtctgttctgcattcaaggccctccatactgggtagagggagacaaggggagagaggaacaaatggaaaaccacaggtccacagcatacagcagatgtacctccatccagggttcatggcaagagtttcccctcttctatagtttcagccagttcacaaggactcctcttttgtagactcagctaattctacataattctctttctcttgagctttatgcacacttgcgggtaaaagtgtaggtattggggatggagttaaggtggagcttactggtgtagaatgtccaatatgaacaaatggcaatttgctggagttaatgtgaacagttcccttgtatggaagggaaggaagaggagctgaaatcttttaaagggttaggagagatacttcgagttatgacttatccctttaaaccagagtgagggagggcagagtagttaggctatttcactatattaaatacgagctcatcttatttcttttcagttctagaatctatttggtgagcagcctattaacaaatataataccttttaacatgtgacatctattcttgattgcatgtattattcaaggtaaataatactagtttccataactggtaaaccctgacatcttactggtttaaaacaagagaagtttattgcttggtcaggttacagtccagtgtgcatggtttaaggaagatggagcagttagggagtttctgcggtatgcaatcatttagagatgcaagcacccttcatcttgtagggatctacttcttagggatcctgtcttttcagctagtgattttcaacttgtttcattagcatcttaataaaattttctgtat

SEQ ID NO: 14409 - DNA, 1032 bp, Homo sapiens
tttgagatatacagtttggtggcatttagtacatttacaatgttgtgaaaccatcaccactatctagttctaaaacattttaatcgccctcaaaggaaactctgtacctattaagtagtcacccctcattttccgtgtccccagcccctggtaaccactaatctgctttttgtgtgtccctgtggatttacttatgttggataaagtaatccataagtaaattgagtaatattgtgaccctttgtgtgtgtttgacttctttcacttaacataatatttctaggtttattcatgctgtagcatgtattactactttcatcctttttattgctgaataatattccatcatatgggcataccatattttgtttatccacttatccatcctttgatggacatttggcttgtttctgcttagctattgtgaacagtgctgctgtgaacattagtttacaagtatttgtgtgaacatctgttttcagttctttggtatgtatatccaggaatagaattactgtgtcatatggtaactctttgtttaaattttgaagaactgctggactatttcccaaagctctacatcattttatatttctaccagcagtgtgtgatggttttgattttttccagtcctttgtcaatacttgttattgtcagacattttgattacagctatccttgtgagtgtgaagtggtatctcactgttgttattatttacatttctctgttgactgctgaccagtgatattaagcatcttttaatgtgtttaatggctctttgtatatcttctttggagaaatgtctattcaaatctagtgcctatttttaaattggattgttggtgattttgttgttatcagagtttttttaatgcatcctggctactagacctttagatgtgtagagtgtctttcactctcttgatagtgtccttttttttttttttttttttgagacggagtcttgctctgtcgcccaggctggagtgcagtcacacaatcttggctcaccactgcaacctccacctccc

SEQ ID NO: 14410 - DNA, 1050 bp, Homo sapiens
ccaccccatgtcaagtctggaaattaaggaggatggaaaaataagcagctttattcaagaaggtctacaagggaagcacataagaaacatttattcttttagttgaggcaaagaagtggaggcaattatttttgaagatatcaagaaggtaggagagttaatggtaaaaacagaggttctagggcacaaggaagaaccgtgggagaaaggtgagcatgaatctaaggactacgtgagatgttaaacgtgagatattagtatcataattcctaaacttcctggtgatagtgagcttgtggtaaaaggtggtctctaaaggtccccttatggtttggaactacagattgaatatcccttatccaaaatgcttggaaccagaattttagatttgaaatttttttcagatttaggaatatttgcttaccagttgagcacctctaatctgaaaatccaaaacccaaaatgttccaatgagcatttcctttgagcatcatgttggcactcagaaagtttcctattttgaagcattttggattttagatttttggattaagggatattcaacctgtacttattttcttaaaacatccgaatcctctccaagtatattgtgaacccttgaaaagaagagtctcatttgtgaactcaaactagaattccttgttgtcagttcattgggagagtttcgggttggcaggtattctccagtgacctaggtggtgctcaaaggggtcagcagtaactctgtaatccctgaatcagtgaccattttaattgccgtcttaagggttccaaggtgttttaggtactgttctgtattttgctaatgattgattcatttaataatttttctatttatgtaccactgttacatttcagttagcggcactggtagtatattcatttcctagggctgccatagcaaattggctgcttaaaacaaatttattctctcaccattctggaggccagaattgtaaatcaaagtgtcaaaagggttccttctagaggcactaagggagaattgattccatgcttctcccctagctt

SEQ ID NO: 14411 - DNA, 1674 bp, Homo sapiens
tccccaagtgtaatcaagtctacttagtatattctgtgtatcctttttattgtaatcctactctcactgctttaatttcagacactctttttggtaggagaccactagttggtctttctctagggccttagtccctatcaatttattcttcatactactgtctttaacttacctacctagcctctacttagttcagtttggcaagaatgtaatccttaactatattattaattgtattttcctaattacacattctctctcttgccggggaaacttcatatatattattccccatccttggaatgtcttttgtcctattttcctggcaaacctctatttcttcttctaaacttagcttttgctttactaaccctctgacataattatcagtatagacttaggtactccttcttgtttctttcatgtgtatacttaaaatactcacatacttttacacagtattgtagttttatacctgtatacctactcactagaattccttgaagtcgaagctgtcatgttttttggtacataataccaaatgttgtttgtatttttggtacatagcatggtgtttggcatctataaagcaggagttaactatctgttaaataaatgcatgctactagtttttactggggactggctcttctttccagtaggcttacagtttcctgtttccttctgagtaccctctgtctggtgcttctgtatctgtatttgctatagcaatgaggataggttttatacttctcccgttttgggaagaaagctgtcttagagattgagttaaaaacagaaccagtgatgatttttatgtaacatttaaaccccatttctagatgaggtaactcaggagtttcatttttttctcacattttaaagggcaacacaacatttagtaacattacacagtaagtaaaatgacattgcacaataagattgaaaaaaatatatgggtgatgtaaagctaagtattaattagctttttttttaaccattggaaaaaagaattatagattttagcagtgggataacttagtttataaggacaaagtttgagaacccactagcatagaaaatgttttcataatatattgttaaaaatagcacatgttctgttacataatatatcacctgataacagatttaaatcattaacagtagactttttattttccactgtaggttcaagcaataaatgcgggagtgtttttctttaggtgtacaatatgcaataatagtgacatctttcagaaagagatgttgagaatgggaattcatattcctgaaaagtgagtaacatttagccttatgataaaaaaaagatattttaaatgtaggatttaatagcaatggaaatgatcacttatgtctgattcagtgagcatggacaggtagccatttcaaatggtgaaatgcaaaaccttctcctcccccacatggccagttcttggaaagcagggactgtgtcataaatgtctcattcattgatttataatctctttataagtagctcagctatgtccaattttaattgattgactttgtacacttataataggcttcaaaatgtataaattaagagaatcaagatgtgatttaaaatatgtaagaatttttttaatacttaaacatgaagaatccagaaataatgatagtgaacttaaaatt

SEQ ID NO: 14412 - DNA, 1067 bp, Homo sapiens
aacagtgggtaattctggcattctcttttaggggcttttatactacttttgctgtaataggaaatttgaaagaaaatgagaaggcatttcatttcatttgaatttcctactatattttctgtaaacatcctaaccattgcctaaagcatcatttttactctgtatagttcacacagtttaattataaactccctttaaaataaaatgtaaaaataaagaaaaaactttccaaatagtaatgttaactcaaggcagctttggtatggtggagagtacgtgaatttaaatcacagaatctgaattcaagtttgtacacatctagttctttacatccttaataactaactctctctggatctcagtttcttcatctgtaaaatgtgactatgaatatgtagcttgtaaggttattacacaggtattgttaatgtcacttattaataagttgctttcaacaatttaaaaattaaggaaaaatttacttgttttggcacatcaaagttgctaatacatttgaaatgacaattttaattcaagctctgacagtaaggtaagacagcatatactgttgggagtaaacttgtgcctttgggaaagattatttagtgatatagatcaagaaccttaaaaatgttcctatcctttgacctactaataccatctgtaggaatcctaatcaaataaatataaacaagaatatgtgagtatgttgactgtaacattatgtctcataaagttagaaatatcacttagccaggatagccagggggatggtttgcattatagtacatctctaagttagtctaaatgcatttattaactgtagatttgagtaattttgagtagtatgataaaaagtttacaatataataagtggataaagcataagtcaaactttttatatttatatacacaaagaggtacaagtacagtcatttgtcacttagtaacagggatatgttctgagaaatgtgtcagtaggcaatttcatcatgcaaagatcataaagtatacttacgcaaacctagttggtgtagcctactacacaccaaggctctatggtaaag

SEQ ID NO: 14413 - DNA, 1144 bp, Homo sapiens
catttattctagaagaatatttcttggtttacttttactgcacccatatgtactaagaaatttgagtataaattaacaagtatcatttgaaatgtgcatgtcactcaaaagtaaatgagtaaagtggctgtattttctccttcattacagataaatactgcaacaactgtagctgacttaaagtcaataataaatgaatgctataactaccttgagttaattggatgtctcagacttataacgacattaagtgataaatatatgttagtaaaagacatacttggctaccatgtaattcagagagtccacacaccctttgaaaggtaagttgtttctattaatatatggctctttcaaattacatgtttaaagtggttaattatcttgtaatgtgagatatatttggtaataagtgagatgtttttctcagaaaaaaatttaaatgctatttttaaataataacttaagcctttttaggatggttactgttctgatcatttaataagcattgtgtaggtcgggcatggtggctcactcacacctgtaatcccagcacttcgggaggctggggcaggcagatcatttgaggtcaggagtttgagaccagcctgaccaacatggtgaaaccccgtctgtactaaaatacaaaaattagccgggcgtggtggtgggttcctgtaatctcagctacttgggaggctgaggcaggagaattgcttgaacccaagaggcggaggttgcagtgagctaagatcatgccactgcactccagcctgggtgacagagcaagattccctctcaaaaaaatgaaaaaagaattgtgtaaatgtatgatgctttcatagaaataaccactgcttcagattataatttttttctaaaaaatattctttttaaaactcttaccacatgagccaactattctgtctctgtgcattcatttaataactatttattgagtaccttttatctgctgggtaatacatatattgaccgttctttgattaacaaggtatgtatgattcctgctgtcctttagtttagaacactggtctaagttagacaacttatgtatctccttacactcttacaatttttttaaacaatggaaatacacatatgaaagtctgtaatcaccatccag

SEQ ID NO: 14414 - DNA, 1051 bp, Homo sapiens
tataaagagtttcaagaaaatatggacttcaccataagaaacactctaagactagaaaaggaagaaagttctcattacattggacattaaaatgtttccttgaacaaagagaagcttctttaaaagctgctattgataactctcttttatttcactaaccttttcatcatcactttgaacaaactagttagcttcttgacctaataaaatttatgatatgaatataaaggaatattatagccacttaggctaaaaaaaggttttttttgttaaagcatactagtcaaaattggtgataatttctcattttcttgatatagatacttcataaacctcaatataaatactctcaaaatggttgtatggattttatttaggtatggtagcatggttaataaaagtaaaaactgttttactcacattttttgtaaattaggattacatatagaatgccacaatttctctaggtttattcaattttcaaattattcctcattttattttaaagcattaaatagaaaagctaattggttaaattttgttatataaatcagagtcatatattctgggatttgtgttactatgcatacttttctaggatgtcaccaaattagttgtttaaaatgtttttagattactgatttatattaagatgacccacactgcaattagattatgcctagtgggaagtattatataaaaagcagaattaagctgggcacatgtgcttgtaatctcagttataagggaggctgaggtgggagaatcgagatactcagccagcctggcaatgtagcaaagactccatctcaaaaaaaaaaacagaattgcacaaattttctggaatctatggacattccatgagcttaaacacttttgaggtggataacatttagttgaaaatacctaagaaagtgtgtcttctttaaagccttggctttaatcatgggaaattgttgttgttgttgttgttgtttgtatcctatgtttggtattctgtatgtctgatccataatcattttagatatttgaatgatctctgtggattggt

SEQ ID NO: 14415 - DNA, 1072 bp, Homo sapiens
ggcaataagggttcggcacaacagtatgtacacacacataagtatgcaaatgtatcactgaagtacaatctgttcagtaatagcagttttaacagcattatacctacctcagcaagcaagcatttaatagaagtttttcttgtgagtgaatgaatatgctgtaagttgatattcaggtgattttagtattacatagttctctcgtaggactttggagtataggttattctgtattacttaaagcctgatgcaaatgtttttaacaatcaaccaagtggattttaaggctgtcaattttataaaaattaaatcaagaaattacaactagtatactctcttgaatatttggccatctcagtttcacgaagaagtatattaagggattttcattttctgtaacactgttacagatgagtgataaataacacaaaatactgtaacagacccgtaactgtgatttttgatgttgtatatttgcttagctggaattatcagttatctactatatgggaaagtctgttttcccaagggacatagaattttaagcaacttttcggtgaatctgacaggataaattgtttgtaaaatatactcttacataactatagacagatctgtatgaaggttttgtatatgaaccaattgaatatgccatggataattttgtttttagaaagactgatccaggccgggcgtggtggctcacgcctgtaatcccagcactttgggaggccaaggcgggtggatcacctgaggtcgggagttctagaccagcctgaccaacacggagaaacctcatctctactagaaatacaaaattagccgggcatggcagcgcatgcctgtaatcccagctactcgggaggctgaagcagaactgcttgaacctgggaggcagaggttgtggtgagccgagatcacgccattgcactccagcctgggcaacaagagcgaaactctgtctcagaaaaaaaaaaaaaaaaaaaaaagaaagactgatctttctcactaggccactcacacttaaaaaaaaaaacagacagacagactgatccttctcactagaccactc

SEQ ID NO: 14416 - DNA, 1094 bp, Homo sapiens
tcctaagttgaaccattgtaagtcagggagtgtctatatttttttaaaaaaaaggaatatctaattaatcattaatatgaaaaatttaagtgactatgaagtaatgactgttaatcaccatagtgggctatctgtgttgtcttaactgttaagtttgtgtgattatattgcttctgatatgtttaataaaaataaaacaaatgcagtactttatgggcttgcctagtagaacatttggagaaggggccaggcacagtggctcatgccagtaatcctagcacttctggaggcccgggtgggcggatcacttgaggtcaggagttcgagaccagcctggccaacatggtgaaaccccgtctctactaaaagtacaaaaattagctgggcatggtggcgtacccacctgtaatcctagctacttgggaggctgaggaaggacaattgcttgaacccaggaggcagaggttgtagtgaaccgagatcgtgacactacactctggcctgggcagcagagcaagattctgttgaaaaaaaaaaaaaaaaaaaaaaaaagaacgtttggagaaggactgtgttcatggatagatactaatacttctgtatactaaaagagtccaattttatggtgttctaagctatttgcattttgttctatttatgatgttataaccaatttttatgatatcatatattgaattgaaatgtactcttactgggaatatagttttagattttcgataagtaacttgacagaatctggtttaatcagctcaaattcttcagttgtataatgagcatttgttaatagactgttatagtttgtcaattccaaatgtccttttttacatttctgaaattaggatctatcttatcactgatgatatgtcataactggcagcatttttatttctcagtagtatataaaatatattttaaaaattatgttttaaaattgttaccaccttgggtttcatgaaatacggtatttgatgagttttcctttcatttttatgtcagactgaaataagcaggtttgctttgataatgtgttaatttttatggactgaagtaaagtttaacttcatgctatcctt

SEQ ID NO: 14417 - DNA, 1072 bp, Homo sapiens
gagggacatggactgtgccagccctgactgttgattttgatcaggaatttaagcctttccagaaactcccagaagacctttatttatttctcactaggtagaatcagttacaagggtggctgcaaaagtcaatatttagatgagtcaccccaaagaaaatctagcaagattcttttagcaaggaaaaggagaaaagtagatattggataggtaagtaacagtgtcttccacaagtcacaacatctttgttattgactgttgaatcaaattgctatttaaattgttagtgacgtttgcaaattttgtgtcctgtgtagctttatgatgcccagctttctcttttaccctgcgtaaactcaagtatgctattcatgaaagaggtaccacttgcaatctcttcttctttcattatttaaataacacctttattgaaattataatttacataccatacaattcacacatttaaggagcacaagtgtatggttcattggtttttaatatagtcacagagttttgcaaccatcaccacagtcaattttagaacattgtcattacctcaaaaagaaacctggtaccatttatcacatcctcaaccctcccccatcctcttccatccctaagctaccttctgtttctgtatatttgcctactctgaccattacatatgaatgaaatcctataatatgtggtcttttgtatatggctgatttctcttagcataatgtttccaaggttcatccatattgtagcatgaattggtaccttattccttttcgtggctgaatatattccattgtatggatgtacgaaattttattcatccttttaccacttgatggacatttggattgtttctaccttttggctattaataatgttgccataaatattcatgtgcaggtttctctgtggacatgttttcaattctcttgtggccgtaaacacataggaataaaattgcatggtcaaatgataactctatgtttacctttttagtaatagactgttttgcgaagtgtggttgcaccattttatattcccaccagtagtgtgtgagggttctgatttc

SEQ ID NO: 14418 - DNA, 1421 bp, Homo sapiens
atggggaaccacatgggattctaatatacatttgaagactgtcactctagctgttatactgaaaatggactccttgggggcacaggaagagcaagatcggttaggaggctgttgcagttatcttagctgagatgatagcagcttatagcaggacagaaatggtaagggctgtgttttttatactgactgtagagtataggatttgctgataagttagatgtgggagttagatgtagagagagagagaactcaaagatgactccaaggttttagcctttgcaaatggcaagacgttgttgtttagtgggatggaaaaggcagtttccccagggaagatcagatgtttagttttgggtatgttaaatgtgagatgccggccaggcatggtggctcatacctgtaatctcagcacttggggaggccaaggcaggaggatcacgtgggcccaggagttcaagaccagcctggcaacataaggaagcaccatctttacaaaaaataaaaattagtgacttgtggtggcacacctactcaggaggcttaggtgggaggatcagttgatccccaacaggttgtggctactacagtgaactgtgatcacatcactgtcctccagcctgggtaacagagtaaagaccctgtctcaaaaaaaaaaaaatgaggtgcccattaagatatcaaaatgtaaatgttgagtaggtagttacatgagtctggagttcaggaaaaaagtctggtcctcagcctcccaaagtgctgagattacaagcatgagccactgcacccggacagaaaatatttttaaatgacggaaattacaacatgtttgtatactaatgggaatgatccaaacagcgaagttaatgatgcaggagataagagcgtcctgcaggtggcattagtgagcactgtggaccaggatttctcaaccttggcattattgacgttttggacctgatcattctttgttggggggcagggggagctgtcctgtgcattgtaggatgtttagcatcattcctggccttgactctctaggtgccagtggaactccctcagttgtgacaatcaaaacgtcttacacacgccaattataccccgggtggcagaaaggggcaaaattgcccaattgagaaccatggttacaggctgacaacatgagtttcaaagctagttttaggaaagagggcaagtaaagagtctgggagtagcaaggaagacacctaattccagtctcagatccagtggtatgagctgtgagaggttaaagaaaaaaaaaaatcaggttcccatttgagaaggctccaggggttagccagttggagttcaattagagcaagaaagaacagggaaagtttagagaggatgttcagaataggagattttgctgatgactgagtatgggttccagaagtgatgac

SEQ ID NO: 14419 - DNA, 1016 bp, Homo sapiens
aggcaggagaatcgcttgaacctgggtggcggaggttgcagtgagccgagatagcaccattgcactccagcccaggcgacagagactctgtctcaaaaaaaagaaggagggaggaaatgtgttttagaaatacagataacgcatgtttccattaatttgattttatttaaacctccaaaatttggaatcagaaagtaaagtgatagaaataatgatatttgggagccagattattttaaaataagcatttcacctgtattaataaatactgtaggtgttcaagtctagagattaaattagttgatagtttaattcgtcatcttgttactgtttcactgttctgagtttccacaggggaaacaccaggcatgagataaagtctatgtcattttagaaaatttattggttaatatttaattttttgatacttgcagttctttgccagaactccttgagaaaaaaagacttattgatctccatacaaatgttgccactgctgttttagaacatataaaggtaaatttaactttttcccccccacaatatgacttgcatttacatagggttttatactttgtaagatgctttagtattcattatcttattgagtccccactgtaacatgaagtataattatggaagacagcagtattatagttatttttttgcaaataaagtaacctaggaatccagaaagataagtgatttccaaggtcacatgtttagtaaatagaagtgggaatctatgatatttctattatattgcactgcctcaatatcactgctgtacatactactgtattaatagtagacttgtatctcagcatcagtaatagatttggaaatctcttttaccagagttctatctaaaatatccattaataacatcacttttatttatgtgactttgttctgaactttttaaatttagagaatctgttaacattgaagcttcttactgtgtatcattgaactgtgattttgaaacaagtatgttgggagttctatatattgtt

SEQ ID NO: 14420 - DNA, 1025 bp, Homo sapiens
ttctttttctcattaccgtgttcatgattgccccattgtcagcttacttaatcagtccttcagtattctgctattatttgttctccacacttggagctgaatttctgtggcagattgaccatatgctaaaacttggctaatattgacccctcctttccattttatatgatgcatttgaaactgtttaaaaagctgaatataattgctggctgtcagagaagttgataacacctgggatttattgagaaggtacttaaaggtattatttaaataattttaaaagccacaaaagcattagaaaggcactaacatagataatgggcagcatgcagtttaaacctgcataattactattacgccaacaacctaatttttttctttgtttcacatcttggtacttgatatttttcaggttcatacaggaatagaaacagaactgcagtctgtaggtgattctgctgatgttttcacttctatatgtagtgtctctgtgaaatggcaaaaggctgttcagatctgtttacctgaggtcattgtctcttgtggaggtgatacagatacagatatagatgtatagatatatcaccaggtgaaatacaacagagagctatattgagaatttccttcaggtcggagactagaacttatagtttgagaaaattttggttaatttacttattcaatcatgtttattgagtggctctatgtatattgtactaggccctgaagatactgtagtaaacaagacagacaagttctctgttctcttgaagcttatattgtagtgacagtaaacagagtaagcaaattagaaaacaagttaacttcaggcattttagtgacatgagaacaacaaaaacagcagggtgatgtgaggcaatgggatatgagaatggctgagaggcctactctggagtaagtctgcaagtgaaatcacctttgatgaggtgatgtttgagttgagacaggaatcacagaaaggagccaattagtgaagatctcagggccaaccatgccaggcagag

SEQ ID NO: 14421 - DNA, 1047 bp, Homo sapiens
acctcaggtcttcatatattgtggcagctgctccatggatggcccctacccatgtgaaaaggtggtctgattcagggaaggcagaaatgcccttgctgccacacattatgagtcatgagctcctgttgttttgcccatgggacccccagcggcaccccagcttggctctgctcctttgtgggaggctgcgatgctagtggtggctgggtcgcaattttgggaggccatccaggcggtgctggcagagacaggaactcgggagagctcatgactgcaactggggggtatactttcctatagatattacgtcgtaggtagatttctgtctcacaaaccctatctaattcataatctggaatattcctaacatagcattgcaacatagaaaggtttatcattccctgtacctcctgagaagtagggagaaaggaatattgagttcttactggtagaaaggaggtataactctttattcccttcttgtctttcttttcactgctgaatggttattggggatagaattggggctgaagaagagggaaagccaagaagtgtcactctagacttggtcatcaacccagtcattagactgaggtaagaaatgggaattatcgctagcagcaaatggagttccagaacagtagtgtctatagctagaatggggagagaaatagtaaaaagaaggaaaaatccctgcaattacttataggaaggaaaagggaatttcttttgtgtcctttcttggtcgtctggcaaatgtcccaggttatggattttcaaaaagcaaacgatgtgtacttacctgtacttctcagataagtcttttttagagacaagtctatgttacccaggctgctgttgaactcctgggctcaagtgatcctcatgcctcaacttcctgaatagctgggattacaggtgcatgccacagtgtccaactttagcgtcagataggttttaagattattcccttttggtgagagaagggacaaactagttttagaaagtgctccctttgttctttccaaaccctgtgggctatagcca

SEQ ID NO: 14422 - DNA, 1033 bp, Homo sapiens
cacaatctaatgttaaagcatttttgtcacctcaaaaagaaaccccctacctagtaccaatcacattaagttgtttttggaccctatttccattgttcattagaagctgatgttaataagtaagttactacatcaaaaagagcaaaatgaaccaaatgcctgtacttacataagtcagtgagccatgtttttttactgatttatatagttccagaaattagaatctgctatggcatttagcatactttatttatttatttatttatttatttatttatttatagacagggtctcactatgtttcccaggctagtctcaaactcccaaggctcaagcgatcctctcacctcagcctcccaagtacctgggactacaggaatgtgccactgcaccttagcatactgagttttacatatgcagtcacaaaatactagattctttacgttttccacttctagaagttcgttcatctatttttatgacttttaaaaatgattacttggtctgtatacaccccgttcttagtttcgaaattcagcaaatgcaagtgcttgttataagccaggtggtggtagactcctagggttaaacaattaattaaacatgctctaaggagtttacagttttagaaagacacataaacaaaggacagtaatatactgtgatctttgttattatgatgaggtgtataaagtgctgttgatacacagataagggagtaatgagttattttggccaaggaggagactgggagagggtcagaaaagggagagagtagggattgaaggaagagttgtagaaaagctacagagaaggtagacgttgaatgagtagaattcactgagtagatggtaaggaggaatatattctgcaaaagctgagagaataacttgagcctaagactagagaattaaaagcaaacacagtatttaatgacaagttaaagtttaatgaaataactatttgatgtgactagcggaaactgaatttagtgaatagtgataaaacagaaaaggttagctggatcagaggg

SEQ ID NO: 14423 - DNA, 1022 bp, Homo sapiens
tgcagaattactgctgaatttatccatcaaatatggtaaacaaaataatctgttggtttttttctatattaaatatatattcaaaagtaagacactttaaattcttttaagaaatgaaagccaggcacagttgctcacacctgtaatcccgcactttgggaggctgagacgggcagattgcttgagctcaggagtttaagaccagcctgcacaacatagcaaaaccccatctctataaaaaaaaaatacggaaaaattagccaggtgtggtgacacatacctgtggtctcagctactcgggagactgggttaggaatgagcctgggaagttgagattgcaccactgtacttcagcctggtacttctgaactgtacttttgacctgtctgaaagaacatatcttaaaattgatcatagaaaatagaaacttataaggtgagtagatcattatgtattttaatgacttaatatattctcatctaatgtttattttgaaacaggcaagaaaattggatgtatattttgaatatgaagaaaaaataatgagcaaaactactctggataaatctcttctagatataatatcagaccctgatggtatgtaccaaaaatttgaggttaatgtaagtttcatatctgacgaaagcagcattttcaattgagtaaactttgaatagaattgttgtttttctgacagtcaatgctaatatcaagataattaaatgagctattttctggtaaaattttataacttagcagttcctacagtggaaaaataatttgcatttcatttcattgaacttttatttgatagtatttaggcacattttatattcacttgtttaaggtgatatatgtaaagcttaatatctgctggttccaggaagatttgaaggtataacattcaaagcaagtgtctctaagtgattcgcttcctaattactttggtctaccctcaatttcctgaaaagatgtatctaaaactaaattctgttttacatgtttagggagtttacttttaa

SEQ ID NO: 14424 - DNA, 1025 bp, Homo sapiens
atcattatgaaagaatactgactggcataaaatgtctatggtgtgccactaaaatgtgttataaaacagtgtatacaatatgatgctaattttggtttttaaatcatatatgttaaataggcatatgtcctaagattagaagactatacaccaacatcttaacaggggttacctcaaagtggtaggattcttctgggagcattttatattttctggattctctacagtgaaaatactctcagaataaaaatattttttaaggcacatctaaatgccatctttctgcccatccttcatcaatcgtattgtttagttacagagattctggacatttagaaagagttgaaaataaacaactgtatgcaattaagtgtaaaatctgtggtatataatataactaaagggaaaaatcattgagtggtagagttagaagtgttaacaaagaaagtggttttgaacttagtcttaaaaggaaatgtacagtttctattgaagaaggtagtgaatttatactccctaaaggacagcatgagcaaaggcatgtacctggaaacaagggagcatagaatgtaggaaacaataaaaagactaaattattacatggttgttcttttaagccatcaagtctctacatcagttctttttatttaaatgatcagatagaaatgaagaaaaataggaagtttggaaaactaatgcatttgtgcttctttaagaatttcaggctgggcgcagtggctcacacctgtaatcccagcactttgggaggccaagttgggaggatcacttgagcctgggaggtcaaggctgcagtgagccatgatggcaccactgcattccagcctgggtgacagagtgagatcttgtctcaaaaaataataataataattcagtgttttagtactaattgtagtgtacttgtattcgttgaaaaattctcttttcagaaaatgtctgcatcatagaagttagagttagtcagtagatattttaataccgtgacacccagagttagttctaataat

SEQ ID NO: 14425 - DNA, 1027 bp, Homo sapiens
ctgccttcaagataagcgtcctcttacaggaggtccacatagggctttttcattctccagggctctgataatcaagacagtagcaattcttgtcccaatcccactgccagcttcgacatcagagtatcatctgaagcccagggctgcaagggaaaagttacaaatagtcaccatagatcagttgtcaatataggcaacaagtggctaattctaagagaactcaaaggaaaaaaaacacttccctattttggttatagaactatattatatttcttagttgtcttttttttaagtttttgtgcatattttattttgttttgtaatacaccatcagaaataaagttaccattgtttttacctaagcttttccggtgactaaaatcataaaacacgactaaagtcataaaatgagttaggatttttggaaatagatttctcactatatttttttcagataaagttcctagttcatgtatttgaaatttgaagaactttaatttaggatattcctgtgtataggactctgtctctcaaatctatatctataatggctttctaataaaaatttagttgctaactatacaataatgttttccattttatttctaaacaacaatttctaagaacaaaaaatatgcttgagaattcttacaacaatggagtttttcatttgataaaattttatttataccccttttactgaagcacacagactttttatgtttctaaagacacataagtaacactatttgttgagcaaagaatattgtatggttttgttctgatgttttccatgtgctaatatgttagctgctaaaatccggtttttttaaccagtaaaacttgattaacctggtatgtaaattattctaaatatataattgattttttttaatgattaagtcaattcaggcctttatctaggcaaagaatgaaggctagctagagcattagctggtgacagatctcaaaagttgtttcctgaagtactctttcctacgttttaaagacattatgtattttttaa

SEQ ID NO: 14426 - DNA, 1050 bp, Homo sapiens
cagatcacgatgcctttcctcttctttgtgttttctgtttatatccttaatagcacctaccacattgattagtaattgatagtttaatgttctgtctcttcaaacataatgcaagctctttcaggtaagaaaatgaatcattgttgttaaagccttaacacttgacccagtatatatttaataaaaatttttgaacaaacgaaaaacattggccaaatgaataaatgtttcctaataatgttggtaaatgttggtaagttctttcactatcaatcgtatcataaaatttttcttaataccaacttaaatgccattttgtgtatagaaaaatccctaaaagatcctagaggttatccactctgggcagaggtgcatttaaaaactaaagtttttccttctttcctttctgctgtaggccccagtggttactgtcaaaatgggcaagttcctgaaacctcggaaagtggtgtttgtcctggctggatgctactccagacacaaagctgtcatcgtgaagaacattgatgatggcacctcagatcgcccctacagccatgccctggtggctggaattgaccactatccctgcaaagtaagagctgccatgggcaagaagaagatcaccaagaggtcaaagatcaagtcttttgtgaaagtttataactaatcacctaatgcccacaaggtactctgtggatatcctcttggacaaaactgtcattaataaggatgtctgcagacaccctgctcttaaacccaaggctggacaagaagccaagatcaagtttgaaaagaggtacaagacgggcaagaacaagtggttcttccagaagctgcagttttagaggctttgttttggtcattaaaaattaaaaagaaaaaaaaaactacttttcttgggttttgttcattgtatttctttttaatcttcagagaagaaaatatataaccatccttgcagatgtatttcaatttcacaaacctttagaattagaaaaattcctcctcctagctacagagtctccatccaaatatgtacatgggcttgac

SEQ ID NO: 14427 - DNA, 1046 bp, Homo sapiens
ccttccttctcttccatggaatgtaaggtacctgtcaccacaaagggcacagaggagggtgcttgtcacaggcaaggtactcagttggacagtatggccagaaagtattcctctgccttggaaaaaaaaggtttttaaaattaatatatgttttaaaaaggtttggataactacaacttcccatgtttgaaaaatagcatttaataacattaatctcaatttagtatcgacagtaaattcacaaattaacatgttgtattatgttatcttgttacttgttgccaagagcttgtctcttcctagcatcatttatagtaaaaactgattctttgttaggttgacagtgtaaaacttgagaatattaacagtgctttctaaaaatgcatccgctgcttgataaatctcactggacagatctggagcagaaataatcaggttcaattaagataaaaatgctgtattctgaagggattcacttttctgttttctgtccttcgggagttgtagaatgttgtttgggcaaattaaccccacggctttaattttctcatctataaaatgaacaatcaagttagataactttctgtgaatctaagcatctttttgttggcttccttaatgtgtgagtttaaggatctgcatttgtaggctaactaggataaatggtcctatgaaggaaaggatggctttgatttgtgcacatgtctatgaaaatgttccacaaaggctcaatccagatttactatctttacctcaagcaactgtgtacatagcgtcatcaaagttgagatttaaaaatttttttttttcttctggagacaagatcttattctgtaacccaggatggagtgcagtgatgcaatcatagctcattgcaagcttgaactcccgggctcaagcaatcctcccacctcagcctctccagtggcggagagtacaggcatgcaccaccacgtgtggccatttaaaaaaaattttttttttttagaagagatgaggtcttgctatgttgtccagactggtcttgacctcctggactcaagcaa

SEQ ID NO: 14428 - DNA, 1083 bp, Homo sapiens
atttttttattttattttatttatttatgtatttttttgagacagggttttgctctgttgcccaggctggagtgcagtggcgcaatctcggctcactgcaagctccgcctccggggttcacaccattcccctgcctcagcctttcaagtagttggaactacaggcccccgccaccacgcccagctaattttttgtatttttagtagagacagggtttcaccatgttatccaggatggtctcgatctcctgaccttgtgatccacctgcctcggcctcccaaagtgctggaattacaggcatgagccaccacacccggcctggtttttatttattaaaacctcaattagttcataggaataaagactgatattatcagatgatatttactactactttatttactgtttatctataaaaacatttaatataattatttgagaaatttgatcttgcctttctggttttgtttgtttttgtcttcaaggttccagttacagccatcccttgtcataacttttgaactgtatttggaaaaatactggccaggaaagaaaaatgataaaatttttcctcatggtgaataaacaagggcagactcgactttctaagtactatgaacatgtggatattaataagcgtacacttctggaaacagaagtcataaagagctgtctctctcgatccaatgaacaagtaagtctctggttctctcttttatctctgcattcaactcagccttggcagatttgttattagtgagtctcaggggccatcattttctttgagctatattccttcaacagctactaaagaaaataagtgatgtgaaatgaaaaactgaaagaagcatagctctctttacatccctttaagaaaacaaaaacaaggaaaacctggaagaatcttggcttcttatttaagtcagcatatttgtctcaatgcaccttggaaacgacagtaaaatttccttctgctaatagacacacctcttcttttttcattcctatgaattcagcccttgaaactctcatgagtgcctgtatcaggtagctttctataagccaaaaaatgaagatcagatg

SEQ ID NO: 14429 - DNA, 1050 bp, Homo sapiens
gaacaaaactattataggatcctgaaggagagagcaattactatgaagtacagctgggaggctcatgaagggtttaaagagatgacatttaaaatgggctttgaaggacacataaggatggatgagtagaatatatgctattagatattgaaaaaactctggaccttttagcaggctcaaagcagagaaagaaattcattttgcctgagtacacggtatgagaataacaacattagaatttcagaattggaagggatattatgtatcgagtccaactaatagttttacaacagattcaaagatggctccagactttaagctaagtgactaagagaatgaaattagaaggtggagtttggaggggaagataatgagtttaattttaaacatttcacatttgaggtgacagtaaggcatccaaggggaaatgagggactacagcttagaagaggggtcagagctagagaagaggagtcagagctagagatgtagaatccgaatttttccacctggtgctaacaactgacagcactctgaaacaaacaccaatgttatcatcttaaccaaatggaaatgtgtcccactgttcaactaccattatagtttgattatactttgtttaattttaaatggagattttgagtcacaataaagaagctgtattataggtagcagaaagaacatagctttggaattggtgacttgcgttcaaattctaattacaccacttagtaggcatgacctagggaaaatcacttcatatctcagaagctcaatttcctcacttgtaaagtgagaatactatctccttccctgaggtgttctaaggatttgagatataatatataactagcatgttatatattacttacagaaggtgctcatcagatatttgatgaaggaatggagaatttgatatacttcctacttattttatactcaccactataaagcattatactgcattttctaggctttgtataacagaaaaattttcccaccaataaatgaaacatttttagaagtataacagttggtatttaatggtat

SEQ ID NO: 14430 - DNA, 1061 bp, Homo sapiens
tgataatattttatagaagtaggaaactaatacatataggaagtaaatttgcttatttctttaatttccaaaagtgtctttaatttatattcgttatttgatagcttaactagattctagttaactataaaattccaggttcaaaataatttcctctctgaactttgaaaacaacataccgtttttttctagcatgctaatgaaatgtctgatgatagtctgattcatgttcttttgtaataaccagtgttttccctctcaaagagtttaggttttctttatgtcttttacatttaaaagtgccacaaacatgcgtctagttattggcttaacctgcgtgggatttggccctgcagtatcaagctttgagtatttttcagcataggaaaaatttcttctgctcattgattatgttttgtgatgtgtttgttctgtctccagaaacctgttaggtagatactgacctttatgcttgttaatttttctgtcatattttgatctctttgtcttttgctctgtgttttgaaagatgtctttgactatttttcacattgctgtattggactttagttgttattaggttcttctgattttgtttttcatttggaaattatttttttttccaatttttccagaactatttcttattttccacttgctgttccaaaaaaaaggttgtaccattctcttgaatctctccgaggatgctaattgaaattaataaaaagtgtttttcttagtgacctctgcttacttaggatggttcttgtaatgtggctgttgaccagcagaatcagctttacctgggaacttgttagacatgtaaaatcttgagccccaccctaggcttactgaatcagaaaccctggggatagagatctgcaatctgtgttttaaccaaccctctaggcgattttgatgcatgccaaagttaagaaccatggatctagaattttccacttctaacctgctaatgtcaccctcttttgttttctagtgtggttatggttttatttagttttagactattttgtttccttgtcatttcaatggaatttgga

SEQ ID NO: 14431 - DNA, 1032 bp, Homo sapiens
gttaactgtagtcaccctactgatctattgaataccaggtcttatttctttttgtttttttgtttttctttttgtttttgagacagagtcccactctgtcaccaggctggagtgcagtgacacgatctcagctcactgcaacctctgcctcctgggttcaagtgattcttctgcctcagcctcccctgtagctgggactacaggtgtgcaccaccacgcccagctaatttttgtatttttagtggagacagggtttcaccatgttggccaggatggtcttgatctcttgaccttgtgatcctcctgcctcaccctccctaagtgttggaattacaggcatgagccaccgcgcctggccaatcttatttcttttatataactgtgtatttatttgtactgattaatgaacctctcttcatcactcccttacccccttttttcatcccttcttggcctctggtaaccaccagtctactactctttatcttcaacaaatccatattttttaacttccacatatgagtctgaacatgtgatatttgtctttctaggcctggcttatttcacttaatgtaatgacctccagcttcactcatgttattgaacatgacaggattccattcttttttatggctgattaatattccattgtgtatatatgcataatattttgtttatccatatgcctattgaggagtacttaggtttattccatattttaggtcttgtgaatgatgccctgataaacgtggaagtgcagtatctgtttgatatattgattttctttattttggatatatacccagcagtcaaattgctggatcaaatggtagttctatttttagttttttaaggaagctccacactagtttccatagtggctgtgctaatttacattcctaccaacactgtaggagggtttccctttatttacatcctcacctgcatctgttacctcatgtccttttgacaaaagccattttaactggccgttttatactgtgttattgtggttttgatttgcatttctct

SEQ ID NO: 14432 - DNA, 1720 bp, Homo sapiens
ctgtgggggattggttccaggaactctataggtaccaaaatccatgaaggctcaagtctcttacataaagtggtgaatgtggtattcgcatacaatctacactcagcctccctttaaataattgctgtattacttataataactaatacggtgtaaatagttattatactgaattgtttagagaataatgacaagataagtctgtacatattcagtacagatgtaaccatccaattttttttctgaatatttttgatctgcagttggttgaattcatgaatgtggaacccgtggatatggtgggccaactgtacttttactgcattgctggattgaatttgctagtgcagatattttgttagacttttgcaatagtgtttgtgaataatattggtttgtaatttatttttcttgtaatatttttttcaagtgttatatgagagttagcctggcctcaaaaagtaagttggaaagtactttcctcttctgttttgtgaaatatcttgtgtaaaaaatttattagctttggtttaaatgttggtatttgaaggaatttatcggtgaaacccaggcttggcgtgctttgttttgttttgggttggtagaacatttttgatgactaattctattcagattttaaattttatcttgttttaattatgttaaattgtgttttataggaatttgtttcttttactttaattgtataatgtacacatgaaatttgttcataatattttcttatgtttttaaatggatatgggatgtagcagtgttccctccttatttctaatgttagtaatttgtttatttttctcttttattcttgattgttcttgccagatgtttataaactttactggttttttttttcaaaaaaaccgacttttcacccttagacgtttttctgtcatatgtttgtttcttatttcattgtttctgcttttatcattattatttccttcctttcatttgtatcaggctaatatacccttctttttctagctcttaaggtaggcagttaaataattgatttaaatttttttttaaatacaagcagttaaggctataaatttatctcttaggcgttgcttaaactttcacaaattctgatacgttggtgttttcattgtcattcagttaaaagtagtttctaatttccttcttttgcctacaaatatttttggtatgttgtttaatatctgaacattggaagatcttcttaataacttaatggcattgatttctagtgtaattttgttttggctagagaatacactctgtaatatttcagtgttaaaatgttttgagattttctttttgtggaccagcaccagcatgcgatccatctttgtgaatatttcatacgcttttggaacgactgcatttttaaattattttggttaatgttctttaaatatgatttaggtcaggttggttgacagagttcacatttttttgtaactttattgatttgtctagttactgtataaattaatgagagaggagtgttaacatctccaggtatgattgtatatttgcccatttctctctctatttcaatttttacttaatatattttggagttctgttatactctcatatgttttgaattgttatgtattcgtggtgaatttgcccttttgttgttatgaaatactcctctatatctctggtaaattcttcatattgaagtctactttatctgatactaatatag

SEQ ID NO: 14433 - DNA, 1814 bp, Homo sapiens
gagggagaggtgtgggtgggaaccgaggttgcatgtggcccttgcaggccagcgcgagttccgggtgggcgcaggctcggcgggccctgcacttcgagcggccggccagtgccactggccccgggcagtgaggggcttagcacctgggccagcagctgtggagggtgcgctgggtcctccagcactgccggcctgcctgcactgcacttgaattcttgccgggcctcagccgcccctccacagggcagggctcaggacctgcagcctgccatgccccagccccctcccccccaccaccgtgggttccctcacggcctgagcctccccgacgggtgctgccccctgctccagggctcccggtcccatcgaccgcccaagggctgaggagtgcaggtgcgcggcgcgggactggcgggcagctccatctatggccccagcacaggatccactagacaaagccagctgggctcctgagccggctggggacttggagaacttttatgtctagctggaggattgtatgtgcaccagtcagcactctgtgtctagctcggggtttgtggatgcaccagtcagcactctgtatctagctaatctggtggggacttggagaacttttatgtctagctagaggattgtaaatgcaccagtcagcactctgtgtctagctgaaggtttgtaaatgcaccagtcagtgctctgtatctagctcatctagtggggacttggagaacttttatgtctagctagagaattgtaaatgcaccagtcagcactctgtgtctagctcagggatcgtaaacgcaccagtcagcaccctgtcaaaatggaccaatcagctgtctgtaaaatggaccaatcagcaggatgtgggtggggtcagataagggaataaaagcaggctgcccaagccagcagcggcaacccacttgggtccccttccgcatgtggaagctttgttctttcgctcttcgcaataaatcttgctgctgttcactctttgggtccgcgccgcctttatgagctgtaacactcactgcgaaggtctgcagcttcactcctgaagccagcgagaccacaaacccactggaaggaatgaacaactccaggtgtgccacctttaagagctgtaacactcactgtgaaggtctgtagcttcactcctgaagtcagcgagaccacgaacccaccagtaagaagaaactttggacacaccatctttaagaactttaacactcactgcgagggtccgcggcttcattcttgaagtcagtgagaccgagaacccaccaattccagacacaatagtttcacctaatgtcaagtattggattactttcaaatcatttttattccctgtgaacaaatagatttagagagaaccctttgcaatatgtgaatagtttaggtcaaataatggtgttaaagagcatagtccccatgagactgcccttacttttgacattgactgcaagtgtaggggttcccaagatcacccttaagttcaataatttgttagaaggactcaactcactgaaagatgttatactcacacttatagtttattacaggaaaagagtacatattaaaatcagccaagggaagaagtgcataaggtggagtctggggagttatcaaatgcagagcctctgttgtcttttcccctcagaatcagtctgttagtctcctggcattgatgtatgataatacgggtgtagcattgccaaccagggaagctcatgtgagccttgatgttcagagtttttattggggctccgtgataggggcatgattgattgtccatatggctgatc

SEQ ID NO: 14434 - DNA, 1036 bp, Homo sapiens
ttgaggaaaaatggatgaagatcagtcttctgtaactgctttctgctgacagaggggtggtgttggttctgtgagtattggcctcttgctagctctcagggcaggagggtgactctttgggtggtaaaagcagtatctatccaggtccaagggagacaggggcaggattttgccttcttcctgtcccactgatggacattctaggggtcccctttagaagcctgcctcttgggtattgagagaacagtatctctcactgaggatttttatacttatattctttctgatagtcatagttactgaaagtataattggccaggcatggtggcccacgcctgtaatcccagcacattgggaggccaaggtgggcagatcacctgaggtcgggagtttgagaccagcctgagcaacatggagagaccccgtctctactaaaaatacaaaattagccaggcatggtggtgcatgcctgtaatcccagctactcaggaggctgagacaggagaatcgcttgaacctgggaggcggaggttgctgtgagccaagatcatgccactgcactccagctctaggcaacaagagcaaaactccatcttaaaaaaaaaaaagtgtaatccttctctcattctcttctttgttcactttttttctcacttgttaaagatgttggcacttcctgttccctctagttctacccaccaccttggataacttcagagttcacatagacaataaactttaacatcccagtgtgtctggaattggtgggttcttggtctcgctgacttcaagaatgaagccgcggacccttgtgctgagtgttacagttcttaaagatggtatgtccggagtttgttccttcagatgttcagatgtgtccggagtttcttccttctggtgggtttgtggtctcgctgacttcaggagtgaaactgcagaccttcgcggtgagtgttacagctcttaaaggcagtgtgtctggagctgtttattccttccagtgggttcgtggtctcactggcctcaggagtgaagc

SEQ ID NO: 14435 - DNA, 1041 bp, Homo sapiens
tgacatgagctggcgcttgttccgggcaccctcagtcctgttgttggatcatctggttgggggcctctgacccagagaacctttgttctctggggcagtgcaccttccagtgattgccttggcatagcagacatggacgagggggcggcttgtttctcattggacaatcttttttaaagtgtcctagtaaaccacactgataagccctaccgggtgattggcctgctccattttctgtcctctctgaaccaccaaggtttgtttgtctgagggccatgactaaggctgcggtctttctctgatcttgcttttccttttgggcctgttcctcttggtccctgttatagaatactgaggttgccaggtttaataatgtctccaaattttgtttagggcccagggcttgcttttggaactttctcctgatatctgtggctgattgggtaataaacttatcttttagaatcaattgaccctcaagtgatttggttgacaggggagtatattttcttaaggcctcccatagccgctcgagggaggcagaaggattttcttcctttccctgagttatggtggacatcattgaataattcatgtactttttcctaattctccttagtccttctagaacacaggtcaacagatgtttgcaactgcagtccccatgatctgagtcaaggtcccagtggggatccatactggggacagcttgctgaccgttagggattttgcccctttcttcagctgtcattctgtcatttacttgactaagataccaagtatctccaaactcttgggctgcagctaaagctgcattcttttcattaaaggccagggtttgatctaacaatagcatgacatctctccaaatgagatagaagatttgtcctagaccctgtaggacatttatgtacctatcaggatcatctgaaaaattccccaggtctgccttgatctgctttaaatcagagagggagaaggggacatgtacccaggttgggccaaattcccctccccctacagcttgaaggggacataacc

SEQ ID NO: 14436 - DNA, 1031 bp, Homo sapiens
aaattgggggtttattatagcagggaagaaatgtaattatgtgtgggaaaacaggaactagggaggggtaaggaagaggaactggttaacgagaagcaggtgaccacttaggaacataggaattagggaggggtaagggagcaacctgatggatgaagggtctgccatctcattgtctggatgtggtgatctggtgagtttcagttctttgatactttttgagaaggctgaggatcatttcctgagaaaggaacttaaataagacaaacgttagttttaagctttaagaccagaagggtcaatttctatatttattttaaaaaactactgggttggtttcactagcctttttagtttcttccctttctcaacttgagtgcccttgaactccactctcatggcacaccaggaattttatccccttgaagtattcatcttaattaccttaccatagtttttcgtctttgagttcttttattaaggccattatatgtcagattccttgactgtttcactctttctgtacctttcatttttttcctaacatgtttatatatggcacattatgtcactggcttgctgataatttcagctccttcgtatctttccctttcagttgtgccacaaacccattggtacattccttttactctaaacccataaactccagtttagaatggattcagcattcgactttctctattcttacgcttgggctgctgggtgctgctagagatgtccttttaagtggcatgtggatggcactatgaattaatgatttctagccttgctcaacaacccgtaggaaatttttcttctattttttttctctcttgcttagaaacctgttattctaggcagccctctcttttattctccgtaggaactatttaaaatctgctttgttattctgaagacctctgtccttctacctctccctttacttttaatgcatgattccattttctgtttcacaaagaaaattaaatttatatggtgcaaactttctcaattaccagccagcctcctta

SEQ ID NO: 14437 - DNA, 1050 bp, Homo sapiens
actaagcattttgaataattgatattcagaatatcatttgtcatctatgaagatatttgatgaaatgaatttgcatttaaacattcgtgatgattctgagtaggaaaaatacacagaagaacaaagcacttaattatgtttctttaaaaataaacgccacaaaaagcatttaaaaataagataaaatatagtatgtagagaacaactatatctcagaatttagattattttgtaactgtatacaggataatagaatatgtattttaatgtatacattatattgaaagatttgtagaatcttttttttttttttttttttttgagatggagtctcactctgtcacccgggctggaatgcagtggcacaatctcggctcactgcaacctccgcctcctaggttcaggtaattctcctgcctcagcctcccaagttgctgggactacaggcatgcaccaccacgcccagctaatttttgtatttttagtagagacagggtttcaccatgttggtcaggctggtcttgaactcccgaccttgtgttccatccacctcagcctcccaaaatgctgggattacaggtgtaagccaccacgcctagccaagatcttgtagaatctttaaaaaaaatcttcagacacagcttaaatatcactcttttaaccctttgtaaatgaactcagtctcctttctttcaaagttccctttaggtctaggttatttctttttttttatttttatttttattattatactttaagttctagggtacatgtgcacaatgtgcaggtttgttacatatgtatacatgcgccatgttggtgtgctgcacccattaactcgtcatttgcattaggtatgtctcctaatgctatccctccccgctctccccaccccacgacaggccctggtgtgtgatgttccccttcctgtgtccaaatgttctcattgttcaattcccacctatgattgagaacatgtgatgtttggttttttgtccttgtgatagtttgctgagaatgatggtttccaccttcatccatgtccctaca

SEQ ID NO: 14438 - DNA, 1037 bp, Homo sapiens
tctcccaatttggattccctttatttattttatttatcttgcctaattgctctggctaggacttccagtactgtgtggaataagagtggcaagagtgggcatccttgtcttgttccagttcctagaggaaaagatttcaacttttcctcattcagtaagatgttagctgtggttttgtcatttattgcctttatcgtgtttagatacatactttctgtacctaatttattgagaatttttatcacgaatgactggcaaattttgttaaatgctttttctgtatttgttgagatgatcatatagtttatgttctttctgtcaatgtgatgtgtcacaatttgatacaaatggtaaaccatccttgcattcctgggatgaatcctacttgatcatggtgtatcatcttttgaatgcactattagatttggttttctaatattttgttgacaatttttacatctatgctcatcagggatattggcctgtagttttgcttttttgttgtgttcttgtttggttttggtatcagagtagtgctgataccagactcatagaatgagtttggaagcattcctccacttcagttttttgaaatactttgagaggaattggtgttagttcttctttaagagtttgaggccgagcatggtggctaacacctgtaatcctagcactttgggaagccaaggtgggtggattgtttgagctcagaagcttgagaccagcctgggcaatatggtgaaacactgtctctacaaaaaatataaaaattagccagatgtggtggcttgtgcctatagttccagctacttgaggggctgaggccagaggattgcctgagcttaggaggcaaagattgcagtgagctgagattgtgccactgtacttcagcctgggtgatacagagagagaacctgtctccaaaaaaaaaaaaaaaaaaaaagagtttgatagaattcagcagtaaagcgattcagtcctgggcttttctttttttttttctgagtcggagtctcgctgtgttgcccaggctggag

SEQ ID NO: 14439 - DNA, 1049 bp, Homo sapiens
tataaataatatgtatgtacatctatatatagatataactgtatctctgtgcatacagagagagacatacacagagttatgtatataactgttgtatgagctctgcacagaatgagataaccataaaagaagattatcacatttggctgatgtaatttcaattaaaagcacagaaacttggtagtttatctgtcttgtatatttttaaagtgttttatttatgttcagtttttaaaaatattcgtaataggccaggtgcagaggctgaggtgggaggattgcttgaagccgggagttaaagaccagccttggcaatacactaagaccttgtttctacaaaaaataaaaaattagctgagtgtgctggcatgcatctgtagtctcagctacttaggaggctgaggcaagaagatcgcctgagtccgggagttgcagtttgtttgaggcttcagtgagccgtgatcacactactgcattccagcctgagcagcagagtgagaccctgtttcaaaaaaaacaaaaattcattataaatcacagaacctgacaaaatatttttgtgcatctttagacccttaaaagattaggtaggagaactaccaaaatagcttctacagtcaggctttaattttctagagcagcactgtccagtggaaatataaaccatggaaatacgaaccacaaacgtagttttgaagtttttagtagccatattttaaatagaaagaaaagaagaagttaattttaataatatatgtaccacagtatattcaaaatattatcatttcaacatgaaaaccacataaaaattattgaggatcaaccaaaaaggaattgtatttgaaaaacactaggaattcttacaattcagtaaggggaagaagacatataatcaattgaaaaaataggcaagagacccgagcaggcactttatggaagaggatatacaaatgacaaaaaaatgtaaaacatatagtcaactttattaataattatggcaatgcaaattaaaaccatagtagaaaagatagctgggcacagactccaga

SEQ ID NO: 14440 - DNA, 1050 bp, Homo sapiens
ctcctttagttcttctactccattaatgtccctgcaagtactctgcttaaagcctagctttttgtaggcctttgtacttgtttgtagaattaaacccaggtgtcttggagtcatgtggattaaacatttggttatgtgctgcttgtgtttttctccagatgatttctatacctaagtcttgtcatacccactaggtggcagtcttcttgaccgcaggtctgtgtggtgggaaagcacagatttagaatcaacagcacaaagttcaaatcccagttctgacacttactaaattagtgttacttaactaaagttagcaagtgacataatctaagtcttagtccctcatctgcaaaatggtggacagtatctgttttcattaggttgtgctggtgaagtgaaatgatatcataacatagaacctggtacttaataggtgttaaatgacaagcttaccttttcctttctttattttctatctctgtaacatatcttttcataccaggaatgtgtaatattggcaacctgacttaccaaatagagtagctgtggaatccttttaggagagaaactgaaatatctttatacaatgtcccttctccccaggcacctagaacattgggtacaccaataacactttaaaatatatatataatgattggaactatttctaaagaggaaggtcatcttcagtgtatgtagacatgagctgccggatattctgtcagaacaatagctattcattgtgttagtttcaaagctggctccgacaagctagtatttcagtgttattcccacacaaacaaatcttgagcaaaatttccatgacccaatagattggtgtaaacaactcgctgcaagaactttttacatgtaaacccatgtcattcattcaaatgttcagtgctttcagggagttttgtaagtgcagcctaagaattaatgatttttaaaaaagcaaaaacaaaaaacaaatgctcatcaacccctaccctcaggattgtgttttgttgcagagtatatgcggtaaatagctcagttcctcccaccata

SEQ ID NO: 14441 - DNA, 1544 bp, Homo sapiens
cttggctaggcacttcacattttaaaaaatgatttatagatatagctctgttttatagatgaaggaactgtcttaagaggtgtagggctttactgttgtcatcaactagtaaatgataggagtcggattttgaaattagttgtatttacacgtggtttctacttccttgtattgccacttcaatatagtaatatttattacaaaagtgaacctaatatatattttgtttgactgtcagatggctgactgttaaagttaatatttagttgaggttgatggaataaacttctaaaatatgagaataaatctgaaattttatttttaaaaattattttatcagaaatgttagtcaagattttaaattatgagcacagtttatcttcaccattagttagtgtaacatatgttcggtgtaattgaaatagatgtttacttgcaacagaggtcagtggacaagcaggtatttgtgggagaggggaggaagtggtcttttcttacttttcttagattttttttgttctttattttgtctggattgaggatacttttcatatgtgctgatgtacgttgctagtgattttttcctatcttatgaaatttggaggtggtggaaatgatgcagttcttttaatttggcctcaaaagaatgtgaaaaatctctaaaaacttttttaaaagaccaatttattacctacatgaaaacaagtaatcaaaattaaattttatgcaattcttaaaagttatcttgtgttgctagtatatcaaataattctaaaagattgtctcagatatatcattttaaaattatttagcttggtgctactcaaaatgtggtctttgtgccctttgtaactattatgagaggaagtatatccagaaattaagagcgtttaggaacagtttggcagttttaagtttcttgaatctaataaaaaatcaaggcttcgatgtaaaaataaatttcgttatattttgcagttggtcttataggtttgaaataaaatttggtccttagtttaagaagcagtgatctatgtaaatgctatcattatttgtattaagtgttcacttatttctgttttctcttaagtatttaaatattcttaattttgggggggtataacatttggtagattttttaaaaaagacttgaaatttattgcaaaaaatttgtatattctaaaatcttatcaaattcttatgaaattctgttttaaggaataagttttaaggaaccctataatgtaaaaagcaggttgttttgtatttttaagttgtgagggagttgcaagtcaactagtacattttagttatcaccagcatcgcctccagtgacagaaggcaggaaaattaagggagtggaaaggactagctgtttcttcaaactcataggaaggggtaattagaggtaaaatgcacatttggtttaatagaggtttattttaaagtttgtgagacattatgttagattttgtattttgttaggtttgccttaaattttgaggtcatcttgtatttataacagtaaatcataaactgtttat

SEQ ID NO: 14442 - DNA, 1028 bp, Homo sapiens
tcggcctcccaaagttctgggattacaggcgtgagccaccacgcctggcctctttgatttttttaatttcaagaatcacatgtaagaaaatagagatccagttttcttgtttccacagctggttctttgagagcctagtaaactgcatttcactgctcaagttttgttcaatttttggttactggtgaagcatttgaggtgtttggttttttaaaaatgttactgtagtatttatttgaagatgttgctgaggtgaccctttgtgttgctggtattaagtaggaagagcagtttctggaaagggctgttttcttcttcctagtcatgtttacgtatacaaatgagagtttttaatatgttggacacttaaagagatgtaattgctgaatggaatgtttgttttactgtgatgtgcttttgcagataagaaattcacttaagtggctagaaaaaagacggcatttgcatttaagtagaagttcagatatgaatgaatgtagtaatgaatcaaaaattggattttcggtagggcgcggtggctcacgcctataatcccagcactttgggaggccaaggcgggcagattacgaggtcaggagatcgagaccatcctggctaacgtggtgaaaccctgtctctactaagaatacaaaaaaatagccgggcatggtggcagggcttgtagtcccagctactcaggaggctgaggcaggagagtgatgtgaacccggaaggcggagcttgcagtgagcagagatggcgccactgcactccagcctgggcaatagaacaagactccgcctcaaaaaaaaaaaaattggattttcatacttcagaatttgttttccactggcccaattattttattagaggtaccatttctaactaaaggtttatcaaaaactagatataaacaataaaataccatgctactaatttttctcttacatttcagaactttgatggcattttatagcaattgtaattatctagtcttagtttatgaaataggtttctagttacataaa

SEQ ID NO: 14443 - DNA, 1017 bp, Homo sapiens
atttctatttcttgaatatttcttagtagttgagtgattcggtttgaggaaaataaatgaattccaaatataggataaaatgcaggtctagtccaattcttaaaacaacttgaattagtttaggtcaactctcaggcgatttatatatttaagtgctttggtagaaagataacatagactgtagaatagaataaaagattaaactagttcttttgttgtcgttatagtatattgtttgattttattactgattttaaaactattaagcagttttagcagaaattcctaattgcctacgagattgtttgtgtcttttgagaaatttgttcatttcatctaaatttcatcaatttacagctctcaaaatgaactgtagcataaccttcttatatttaaggttcaacttgtaaatatattgcagatactcattacttaaagattgtgatattttgctgtttatagatccttagatgtagtgatataaatgatcagtaattgtgttgttataatcagtcctcttatttaaaagactaacctttcttgaacaaccatgaagaaaatattgacagttttaagaatcagctttattgatgtaatttacatacaataaaatttgctagtttgaatcgtacagtatgaatttttataatctatagtcatgtaactgccaccacaatcaagatttaagttattttcattcaccgctaaaagcatctggtgttttattattttattaagtataatgttagctgttggatttttgtagatgaactttatctggttgagaaagtactctaacattcctagtttgctgagtttttatacaaaataggtgttgattttgtcacgtggttttctgcatctgttgaggttatcttacgattgttttttgctgtggattgtgaattacattgatttttcacattaaactaaccttacatccctgggataaataccacttggtcatgttttatcctttttatgtattgctggattcattttctaaaatgttaagga

SEQ ID NO: 14444 - DNA, 1048 bp, Homo sapiens
aagatattttcttagattagaattctcttttatgtaatagctttattgaaatataattcactttatacaatacacccatttaaagtgtacagtttattcacagagttgtaccagcttcaccacaatcaattttagaacattttcatcatcccaagaagaaatactatactgattaagcaatcactttctattccccactctcacccccccatcaactttctgcctttacaggcttgcctgttcctggatatttcatataaattgaataatatataatgtggtcttttgtgattggcttctttcatttaacatagttttcaagttattcatgttgtatcacctatcagtacttaatttctttttattgctgaataattttacattgatggacacttggtttgtttctactttttaacttgtgaagagtgctgctgtgaacattactttcagagtttgtgtgtggacatatgttttcacctcttgggtatatacttaagagtggaattgttggatctgtgtttagccttttaaggaactaccagactctttcaaagaggtggcaccacttgacattcccatcagcagtgtgagttccaatttctccacattttgccaatgtttatttttctttttgattatagtcatataagtggtaatgtgaaatgtatctcatatgattttgatttgcatttccctgatgactaatgatgccgaacatctttttaagtgctttattggctttttgtgcacatctttgaagaaatatctattcagatcctttgccctctttttagttggattgtttgtcttactgttgagtttaagggctctttgtatattttggatacaaattgttttcaaatacgatttgctaaaatattctccattctgtgggtcattttttacaacttcttgaagatatgctttgaaggataaagttttcaattttgatgaagaacattttgtctgtttctaaaattttgtcactgtgtgcatggtgtcatgtctaagaaggtttttgcctaatccaaggtcacaaagatttatt

SEQ ID NO: 14445 - DNA, 1668 bp, Homo sapiens
gtggagccctaaaacactagggagaagaaaaattttactaagaagcatgattatcaacatttgaatgagaatgatttttttacattgctttttctgaggtgcaattcataaataacataaaactaaccattttgaaatgtacagttcagtggcaggtagtatattcacagtgttggataaccaccacctcatctagttccagaacattttcatttaccccgaagaaaaccctgtacacattaagcagttatttcttatttccccactactccagtccctggcagtaaccaatctgctttatggctctctgaatttactaattctggatatttcatatcagtagaatcacacaatgtatgaccttttcttctgcttcttagcattattgttttgaggctcatctgtgttgtaacatgtatcattatgtgtatatacatacatacatgcacacacattttgctttttcaatcgtttggtggacatttgggttatttccaccttttggctattgtgaacagtctgctgtgaacattcatgtgtacaactattcgttcaagtacctgttttcaattattttgggtacctaggagtagaatactggatcatatggtaattctgtgtttaacttcttgaggaactgtcaaattgtttccacagtggatgcaccattttacttcccaccaacaatgtgtaagggttcaaatttctccatgttgttgccaacacttgtatgtgttctgtatgtgtattaattttagctgtcttatcccttttgataaggtttccttttaatcactaagtaggttactttgtcagtattgtgattttagcaatattaagtcttcgaatccatgaatgtttgatgtcttttttatttgtctttaatttctttcagtaccgttttgtagttttcagtgttcaagtcttgccttggttaaatttattcctaggtattttattggaatgttattgtaaatggaatttaatttaattttcatgtttatggatgtttatggtggtgtgtagaactgatttttgtgtgttgatcttgtatcctgaaattttgccaaattattagctctattttttgtgtgtatttgggggtttttatatatgtttgtcttctgtgaatagggatacctttactttcaaatctgaatgctttctatttctttgtcttgcctaattgctgtggcttgaacttccagtgcaatgttgaatagcagttgtgaaaagagcacacgcttgtcttgttccttatctcaggggaagcttttattatttcatcatggagtatgatatcagctgtgggttttttttgtttgtttgtttttttgagatggagtctcacagttctgaacgctagaagtctgaaagcaaggtgtcagcagggccatgttccctctgagactctaggtaaaccttccttgcctctttcttgcttctggtggtggctgtcaatccctggtgttccatggttggcagctgtattactacaatctctgcctttggcattctccatgtgcgtgcgcaggtgtgttttctcttcttttcataaggacatcagtcatattgggttaaggacctcaccctactccaataatgaccacatcttaccttaactaactacatctgcaatgatctattcccaataaggtcaccttctaa

SEQ ID NO: 14446 - DNA, 1050 bp, Homo sapiens
ttagaagcactaagtaaaatagataccacagtaaaggtacaaaacagctagggaaagcctgttttctttacattagcaaggaagtcactgattacttttagagcctttgaattaaggggacttggtactagggatttataagaggaaatagatgataagaaacttctaaaatacaattgcaatagaagaaaagattgaaaacgaggcagttgagtcaagaaaatacaatattgtataaatttttaatgtaagtatgaagacagaagaggatttggtaaataagaaaggaggtactggaaaagcaggcattcagtattgaagcaaagtccatcaggcctggaaggaatggaaagcagtagaataaattttgtttttgaaataacaagaaactatctcttacactaagactgaagggaatactgtacaatattttgatatcagattagatattttatggagcatatactccgagtttcttcccaaatttcgtattcctaatacattaaactatctcacaaataaaagactgtgactgaacctgtataaatccatcaccagatttagaaaagcagtaatttgacttatgattgatcggcatcttagccattaggagtaaaaaaagccgaattttctactcatattcagtaaattctatatgcgattaaagatttaaacgtaaaaaatgaaaaccataagtactagggagaaaaatgagtgaatatttttatagtcttagagtaaagaaaagcctaaacttgatatgaaacctagaaagcatgaacccaagttgatagactggactatgtacatgctaaaattttacaaaaatgtaaaaattctgtatgacatgtggctaaaacagggtgtgacatacctagcttaagtaattcacatcagaagagagcaaccaataaatacatgaaaatatgcttagcctctattaatgataaaaattaaaggattatatttatttgttttatttgaatgaaaagaattgttagagcgtaagtaaacatgtatcttgtacgctgttggttgtaggtgcctttt

SEQ ID NO: 14447 - DNA, 1044 bp, Homo sapiens
atgtcaccggcgaaatatcggtgaaaacttccatgtttgggggaagacccctgcccgacctagtgacctagcgggccaaccgcctccccagctctcagagagacttcggggagacgccaagcgctccaggccggccctgtcctctgcgctccactgctgccgcacggactgccagactcccggcatgctctgcggactgaagtccgcggcacgagaaatcaaagccccggggcctgggtcccacgcggggtcccttacccagggtgccccgggcgctcatttgcatgtcccacccaacaggtaaacctgacagatcggtcgcggccagatacggcctggcggtcagagcaccaatcttacgagccttgtgatgagttccgttacatgaaattctcctaaaggctccaagatggacaggaaagcgctcgattaggttaccgtaaggaaaacaaatgagaaactcccgtgccttataagacctggggacggacttatttgcgtgctcgcttcggcagcacatatactaaaattggaacgatacagagaagattagcatggcccctgcgcaaggatgacacgcaaattcgtgaagcgttccatattttgcgcggttcaacgaaggtcgttgggcaagatacggtggtgttcctagaggttgttcaagatctctcggggcctgcattttcctgctcgcgagcttggcccagtagacacctacgatgctgtccgggcctcccaccagtcctgtcgcacagtgggcacacttcctcgacagcctccatcttcgaggcgcctagttacgttactattaagttacctaggtgatcctcgtatctgcgtccaaatacttgttttcattgattaaaatatgctttcaggctgggcaatgaacattcctcctaatcaaatttcccatcacagaatctgtccgatttatgtaaatcggccctttctaagtacttcttagaggatacatgaaaacagaagactcgtgaaaacagatccagatgggcttgctacttgtggccagtattcacatgggtc

SEQ ID NO: 14448 - DNA, 1045 bp, Homo sapiens
tttctgaaaacactagtaggaggaattaggaaccccacaagcaaaataacattaccttggaagaatgaatggtatattcagttttacctctacatctttttgttgctctgtgtgtgtgtgtgtgtgtgtgtgtgtgtgtgtgtattcacatgtgcttgtgtgtctgagagagagaggagagagaaaaagaaagagagcgagcgagcattatgggatttgggtagttttggaaactttcttttgagaatactgagaatgattgggggaaattaagtgagtggttgaagtactattgctaattgttgcttgttttaggaaaagatgatgtcagacacaatccttggtagaaattttgagagaatttttgatgtttcagagtctgacggttctagctctttataatataaatttcatttcaaaatttatggcttttttgggggggtggggtataagtgtaactgcctaagggattcaccttgcctgctgcctagacagagccgattcatcaggacaggggaactgtaatagaaaaagagtaattcacacagagccagctgtgcgggagaccagggttttattattactcaaatcagtctccctgagcatttggggagcagagtttttaaggataacttggtgggtgggggaagccagtgttccaggagagccgattggtcagagatgaaatcatagggagttagagctgtcttcttgtgctgaatcatttcctgggtgggggtccagaagatcagatgagccagtttattgatctgggtggtgccagctgatccatcaagtgcaggggctgcaaaatatctcaagcactgatcttaggtgcagtttagggagggtcggaatcttgtagcctccagctgcatgactcctaaaccataatttttaatcttctggctaatgtgagtcctacaaaggcaatctagtccccaggcaagaaggaggtctgctttgggaaagggctgttactgtctttgtttaaactgtaaactaagtttctcccgaagttagttcagcctatgcccaggaatca

SEQ ID NO: 14449 - DNA, 1057 bp, Homo sapiens
ggtgggggcaggagcactgtggaagataggaaggaaggagttataaactaaacctttcaaaaggcaacaaccgcaaacttggtcccttatccaaacagttgttttatgccccaagggttcactttgttgtcagggttttaaatgctcttaacactttaagtgtaaacattacacatgtaagttgatttggctttgtaatgagaaatgggaaatcagatgatttgtttaggagggggctgtttttcatacttgcttcaagtaagtgagtaattccacctttatttgcacattgtgcctagaacttgttggttaacaagtatttccttgtagcagttgaacacaaatatgtttataaaagatgactttctgtggatatgttttaaatggtatcctcctatttatttaaaaaaatgttttcaaaatcattgatttcacagaggcatttatggacagtttattctttactgcttttcaaatatattagtaatctgaaacttacagagaaaaatatatcttttgaattgtctcatttatttatgaaatgtctaacctgtgtatagtaatacagtaccaaagtcatttccttatagtaatgtttataatgtaaatttcagaaaaataagctcgttcttgataatgtctttggttactatttagtgctccttacatttctctgaattacatatacagaaagtgtctctttagagcctgaaagaacaagttgaaaaccttgtgtacataaacttgtttgattttctttaaacgccaatagactgcaaattatatagcactaccacaaagtttttctactatgtggatgtataaccaaaaaaattagacagagagaagtgtcaagcatgtgatatgcccatgctgatttgcaaagcgtatcccagtagcacaaggcttttggtttaaaaagtaaaggtggtggagactggtttttggaggtatttctatctacagtataagcttaaataggggtgataaatgattatatgcattgtctaacacttgcttatatatataaatagctccacaagattgcttaaatgat

SEQ ID NO: 14450 - DNA, 1033 bp, Homo sapiens
ttttaattaaagtcttcagtgctgtaagtacagatggttgccaaatttaaaatgacccatgctgaatccagcaggttgcccctgctcacccattgctctccctcttattaaaatctttgctttgtctgctgtggaacctactgtaggaggggggaaaagagaaacactttgtcacagagtagatccttcatatttctttgttgaacaaaatacattttgttagaagagtcatcaagaaccgggagttcaggaactggaaatggatagaagtgatagaaggattggaataggatagtttaccctcagattccattcatttcaggattactcacaaaaaagcaccctctctcacacacacaatggacaaccgctactgtacctgaaatactcagctcattttaatggttagcacatatgctgtttttacaaggtagatactgctggaaggcattcttgcagattagtttggtcacattgccttctttcttatatctgaggtaaagagagttttgcattgactgttagggtggggaaaatgattttggtggtggtggggctttgtcatctagagaatgggaatggtgattaagatttgaataaaggcactttcagcttagtatctaagaaagagaagactctacataaaagagacattctaagcacacattcatctgtttggagattttgccttgagctaacaccaagcccaaacaaggagtggggtagtatggggtttttgtctcttattaatttttttaaaatttccttttcactgacttagtctttattctgggaatacatggtccattattctgccatgttaaggttaaacaggcatctggggctgatcagacacctaactacaatctaaaaagtcatttgtttgaaaacagtgttccaagtttcatctaaaaatgtactttcagaattttgttagtaagtttggaattgcttgtaaatgcaattctgtttatagttctatgagtatattttgattttttttttttttttttttaagacagagttttgctct

SEQ ID NO: 14451 - DNA, 1049 bp, Homo sapiens
cgccactgcactccagcctgggcgacagcgagactcggtctcaaacaacaacaacaacaacaacaacaacaaaacaaaacaaaaaaaaccttgtattctatgcaatgaattttgaccattattttctacttcctatcacaatacctgtgaattgaattaagctgaaacaaatacaaagatcagcttgggagtgagctagttagatttgaatttcagaaagatgactctggtagtgatgtggaggagagaggaaggaggtgagattcacggaaggagatatcagtgtgaagctcttgcagttattccaggcaagacttggtgcccccattgaaagcagtgtgaataggggtggacttgataaattataggaggcaaatctacacaaactaattagtgaatggatatgaggggtgaggataaaggagggagtcacgataagcaaaggttgggttctactcagtacactgtgtttctattccctgaaacagggaatgtaggaaaaggagcaaatatgtgccagaagatcatgagtcctattttggatgctttgagaccaatgtcttccatgaaaacgtgaaatggcagaaacccagatatttgcagactaatccagaatatgaaaataatggaatgtatttgataagcaagtgcttattgaatgattgaatgtgtgtgattagccttcaattcattacattttaaatgactattattgacttgctatgattattttaaaatcatacagcacaacaggaagcattctaattattataaaagtgaaaagataagtggcacaaacaactctttttgtggctttaaattttccagataggttgatgtgactatacataactctatacttaaagttgattaatctagatgctaccattattcctccttccctcattgcccatttttttgaatgttttagtaataatggaaggctaccagtgggcaaatccagtaggtagaggaataactggaagagaaatgaccaatcaaaaacttgaaaactaggagtaagtacagattttaaaaagtcaggccag

SEQ ID NO: 14452 - DNA, 1118 bp, Homo sapiens
ctgagattacagatgtgcaccaccacgcccagctaatttttgtacttttagtagagatggggtttcaccaagttggacagtctggtctcaaactcctgatctcaggtgatccgcctgcctcggtctcctaaagtgctgggattacaggcgtgagccactgcgcctggccagattctgtgtttttaaaagtgtcaactttgcttttaaataacggtggcaaatagcaatattctttcttttaataatattctagactaatttatgggaaccacacttcctttggaaaaggacgtgatttaaaatttcatttagaaaacaacttcagttgttctagtattatcacagagcagtgtattagaaatcactgtattatattttgaaatttagatcaacctataatatgaacacgaaaaacataaacatgaaaatgtaatttaacaaaggtgaatttttctttacgatagaaatacactgaaagcttttgccagttaaagaacagcgtgggctactgtccttgcctctttccctagggaacccaggatctaatctggattagattccaaatgaacatgtgttaggtggtcccatcataaccctgaatggatattttgctacaccacaaaactagaacataatttgacataaatctttgtttagaagcgaaatagcaggggatgctgtgggtcagggtggaactggcagggctgcgtgggaacctgcccacatagcctggtgtctagcagagctggcacttttaggcctttggtttccttgaaattataggtaatgaatttaacatctagtctctctttctctgggacagtaaccttggtacatagtgttctttcatgtcgacttgtgacccatatttttggtatttcatttataagaaaaatatacatatatataatttttaaagttgcctaataattgccacaacttaaaaaaaatttttttactttattatgtttgtaccctaacagaaaatagaatgggttaggcaagcattatttaaatgatggtgatgccatcactgctgggttttaatattccattttaatcactgggcaaattggtcgtgttttatttggggaaaatggaatatgttgagggaggat

SEQ ID NO: 14453 - DNA, 1039 bp, Homo sapiens
gacacatgaaaaatgctcatcatcactggccatcagagaaatgcaaatcaaaaccacaatgagataccatctcacaccagttagaatggtgatcattaaaaagtcagggaacaacaggtgctggagacgatgtggagaaacgggaacacttttacattgttggtgggaatgtaaactagttcaaccattgtggaagacagtgcggcgattcctcagggatctagaactagaaataccatttgacccagccatgccattactgggtatatacccaaaggattataaatcatgctgctatgaagacacatgcacacgtatgtttattggggcactattcacaatagcaaagacttggaatcgacccaaatgtccatcagtgatagactggattaagaaaatgtagcacatatacaccatggaatactatgcagctacaaaaaaggatgagtttttgtcctttgtagggacaaggatgaagctagaaaccatcattctgagcaaagtatcacaaggagaacaaaccaaataccgtatgttctcactcacaggtgggaaatgaacaatgggaacacttggacatgggaaggggaacatcacacaccggggcctgttgtggggtgggggaagggggagggatagcattaggagatatacctaatgtaaatgacagtttaatgggtgcagcacaccaacatggcacatgtatatatatgtaacacacctgcacattgtgtacatgtaccctagaacttaaagtataaaaaaaaaaaattgcccaccaccttacaaagctagtcatcctcctttagaaacacacttttggggggaaaaccatctatttattttcatctattcagataatttacaactaaggttaaatattctctgttttcatataacccactatatggacaataaataatgattagaaaatgggaatttaaagatgcatttgggcttttagttattcaatttattatctttaaaaatatcttctgttttatttatggtaaaccaatattttaatatcgaataattt

SEQ ID NO: 14454 - DNA, 1102 bp, Homo sapiens
aaattgttaccagagttcaagaaaatgaagatcttttgcaagatagaggtgtgtgaatgaagaggcagctatggaattgagatagaatcattagcatgtggcccataattagaggtgaaaggctagagaatgacaggatttaatcatcaccacaagttttctagtttggctgctagctgtctgattctactacctgagagaagtcgagagggatggtctattaaatagccaagttgatatgaggtaggcacttggaaacctaagtcctgtttctgcagagcaattctcaggctaggtctggaattactgatcactggtgtatagatgaatgatagttcaaattaagaatgggttacagccctatggaaatgatgtggagcaaagagagggttaaggagagcccactgtggggtatgtcatcatttaagaggccagtaaacatgagaaaggaatggacagaaagaaaaagcaagccacaggatttgattttggtggaggaaggaatagtaataatgtcaaggtagctaaggataaatcctttagtagggcaaatcctgaagagatgtcataggttttgtggattgaaacagtcgctgtgcggagtaagtgtagaatacagacctaaagagtgataggaggtaaaggagaagaatctgagtgttcatggtaaagaaagggtgggaaatgagaagttatcatcaagagaaatttgtgtttttcatgtagtgagagtatgtttatatgtctgagatttatgggatcaagcattttgtgcatattggaaaagagatgaaaacctaactcttggccaattatatgctcttcagcaatctcctttaaaaatcagtatctcatggtcatgtctgtgctgagaaaggattggttttcattattattaatggctaaatgccattctatactatggatgtatcataatttatgtaaccattttcctgctattgagtattttgattacatctaaaaatgttcatatctaatgcatatatcaacgtgtctatgtgtgtgtgtaaacgcaaagagaagataaaatattgaaaagcatattttctaaaaagaaaagcctagtctggatggatttcag

SEQ ID NO: 14455 - DNA, 1064 bp, Homo sapiens
gcttttttttcccagaggtgagccagaacaagtactaatgccagtatattcagagtgtaaaatttgagtccttcgttcaataggttgtcaggaaatacctggtaaataaaaaaatgaacaaagaaatcttacctggcaaggtcacagttaacctcagagccagggccttgtctcagctccgtgttagaagcttagtttgtatccacatctccagacatgggagagtatatgacagattcattatgtgcgtggatttgggcatccagccaacatgagtttatatccccagttgttcatttattaactgtgtgcacctacaatggtctcttgccctctctaagccttagttttttcatctttaaaatggagaaaatagtagtgaaagttttcctggctggcagattgtgaggactgaacaaaatagtttagttgaaagtgcttgatacagaacttgacatgtagaacacatttgagaaacatctgctagtatttctgttcatgtgttaggtagtccagaataatgtgcgagtttttaagaaaaatcctgatgcttatcagaaactttattacttcaggaatataagaacattatcaataaaattctctcaggttcaaaacaagataaatattctttattgaacatgacataaattgcttacattgatgtatccatttgacagttcaggtttagttcagagtaaaaaattttatatttggtgataacaatgtatttttaccttgagaatgaaaattcttctcttaaaaaccaaagaagttgtcataatactctcattggcaacttagaagaaactgaaaaagagagagtttataaagggactccagaatcaaagtctcctttggactaaagtgtgacatgccattactctccttatcttattacgtgacctcctcaacttgctcagaaaaaaaatgaggataaacacccaatcagaaatccagaagagctagaaggtagaaccagccatcgaccattgctataaattatgctggtgaaacggtttaatgcacatatgcttctccttgtgcacattgcacgaaatcca

SEQ ID NO: 14456 - DNA, 1025 bp, Homo sapiens
gaacaaaatgtgtccccagattttcctcattcctactctttcagacttgtttttgtatcgtcttgtacacactgagttatttgcccatttctaaatgaacaattaacaaaggagaatgcagttatcaaacatggtttacatcaggggtaatgaacctgcagcatcagcacctcacgggaacttgttagaaatgcagattcctaggcttcatctcagtcatactgaatcagaaacttgggtgggacctagcagtgtgtttcaaacaagctttctaggcaagtgatacattgttcaaacttgagaaccattggtttagactcatcaggtcatcttctggtgctagagagaggacttatattcactgagcttactgctttcttatgcctgttgcagacacagaagagtgtttgccaccactgactgtatttcaacatcaagtaatcagccagtaaagggacagaatgaagataagacagggatgaactgagaaaggagatgagagtgcaagagattcatgaactcagattccacctccatgttaagaagaaagcatgaagaaaaatgtggatgcagaagcagataggctgctaggagcaagattgtaacttctcttgcattgggctcagatgaagcctcctggcagggagggaggtgtggtggaggtaagagctaagattgtggagaaggtttaaatctcttcagagaagcagggagcttgctaacctggaaacctctgaatgtagatgagatcatggacctccctgcgttggtaaacctgagttcggagtggactgagctgcctggctatgtcacatgcaacagaggacacaggcttgtagctgaagatagtttgattactttagggttgaggctttgccaagaagagtgtaacagaatatcatgagcgaggatacttaggatattgttaagggagagattgaagtgatgaaccaaggagttagtgctgaagaggagggagagtgcagatggggtacaggggagggttagtctatgagcccaaagtc

SEQ ID NO: 14457 - DNA, 1125 bp, Homo sapiens
aaagctaaaatttcttccctattgcagatgcccttggggactaaatcaagagtctgagggcagagtgaagctcaggattctctgcagataaatggctcatctggtcagctcaatagggatgtgaccccttcatcatttagatacaagggggtgttgttagtgtcatttatggagctgttggtctagaaaatcaaagcgtaatctggcttggtattttaaaaacctcaggaaaacgaggcttgatgaggattgtaaaataaaaggtgcttgttgttgctcttgcaagcacttagatcaacccagggtcaaaatccagtggtataggacaaagagcagacccagtttcctgcctctatttcttccccttcccctcccccattcttcttttcctccgccttcccttcagttcttctttccttcatttttctctaggaaagcaaagagtaaaatattttcctaggagtagagaataaactggtaggttatagttgtctttgacttgttaacgatcacactggctctccttgggtctttgggtcatttatcatgtggtcctcgtctaggatttgatcagattcttagagcatgggtggcctagcagagtacatgttatggctcgagttctaataggatttttccttctcccctctcccaactacactcccactcccggggtgtctgcactgtgacaagacaactgttcctcacccagcagtttgaaagcactgattttgctgacactttgatattattctagagacataagccaggcaacagaactggcatcagatctcctcagacactaacgtgagtgcccagggaaggttgtagatgcacatttgatttccacatctatcttctccctgcaaattaaattattaattttcccgcatgtcttcttgtttaatgagaggagtggtggcctttatctgtgcacgtgtgcaaacaaaacatcacagcaggggctcctgaactgcccagagaagctgaggggtttaagcagtcagatgcaactgtcttggtacagtcagtgtcatttgccaaagtctgtctggctgttggcatcataaacatggaagcatgcagactccagtgcatatcctcacatacatatccgaagatgaa

SEQ ID NO: 14458 - DNA, 1035 bp, Homo sapiens
cttattagttggttttgcttgcatttcataagaatatctggccttaatcactttatattttcataggacaagtattatgaaaatctcattcacttgtaaatacatgaaattacaatctctaggaaaatggtttgtaaaaccattggctggtttggaataaatctttgctaaacctcaatataatttattaaaagtaccatgttgactccactttgaacagtggcctcatttctcatgttctgtttcaaaggagccctctgctggacagctctgtgtgatatcacatgcacgcatatatttatatatgatttataggctatagttaatataacccaaaagccatttatgattgaaactctatcgttgcaaattgaatgcatcactgaaacctgttttgtcatcactttttcatatttaatgaacaagcagttgtctaaaaataaaatgttcatccttaaagtttactgtaaatcactgtacatcagcatattcccacacatgagataatcgtactaaatgaacattcattaccaataattttagtaatgaattattcagctgatatgcaattatcacacacatttctaaagcaattactttattacataggtattccatgtcattgattttacttgtctatattacatatgtaaatatagaaatctttgcttttaccatacgttcaaatgcaaagggatttttaatgtttatttgttcaatgtcatcaagttgtgaggatgtatggttagtattaactacattttaagaaacttgcaaatgtcagaaaattgctgtgataaaatgaggcaggaacaaataaacacaacccaaaaatcgtggaccatgaggttatagaaatggtatgtttttctgagtagcttgtcagtaggctcatattattatcaattatatttttaaagctgctgttattcaaggcaatgataaataacgacttgaaattatagtcccatgtacatttagcctgggaaacaagatggtatagggaaaccacacagcatcataaagcaaacgcag

SEQ ID NO: 14459 - DNA, 1050 bp, Homo sapiens
accttggcaatccactttagacctgacttcatatcccattttttatttgaaaggtaatcaaatctgagatacggacattgatctgagactataggtataattgactaaaatgataagcataaaagtgaaaaatatggtaaattaaccaattgttgttggtgtgtctgtgtgtgtgtgtgtgtgtgtttcacttctgtgatgactaacaactaatttaactagttgttttcccccctaccaaattggccgttatttttcattgaattgactggatgtctttgtgtcatgtagacgtagactcattttaatctcaccaggaaattggaacatgtgttgaagcctctgtttttgccaaaaaaaactggccagttcttagatcgctactgcttaatagcatcagatgtttagcctccagatattcttttaccctgctatggtgcccaaacctcctcaaatattttagtaagtacatgaaatctgaacctcatgttaaaaatcacaatcccctttagtgaggaagtaaaggatatgcgtagacagcaaatgacacatctattcagaaatagcactgggtactttgaaggacagaaaagaatccattctattctgaatatcaggaggtatcccagaccatagtggaaatctgtggaatctgaatctgtaaataatctaagtccataagctggactcctcaagaaaataatttccatccttactagtcattatggtatttgtgatataaggaaaagggagcactgagcatggaggtagaactggatttcataaatcttgattgagtggttgttagatgccagctagagaaagataaataaggcattgcctcactgttgagaaattcagtgattcagaaattctctagttgagagctgaataagccaaccagaggcatacaatgccataaatgctttaataattgtatgggagtgaagaagatttaatcctggctctgccactgactggccatctgatcttgtctggccacttagcctctctgtgcctcagtttcctcctctgtaaaatgaaggttta

SEQ ID NO: 14460 - DNA, 1055 bp, Homo sapiens
tttttaaatgttgttcatctttgctgtatccacttgctgcaagattacatctgttcagtttcatttcggcactgaactttccctgcctgcaaactaatcctcctcattctctcgttaaattattgtgattatttaaagaaaaaaaaaatgtgctttttctgtccgaattttcctctttataaaaaatgctaatggtattgaccacatttactagacaaacagttgctaacagttttcaggcatgaatgtttttgcggaggggtgttgcatgaatggcaccaaatacaaaaatgttgttggtgttctgaattcatcgtatgagagaccattggatagacttgaaggatgcttgctgctgcttttcatgagctgctgtctcctctatggactttggaaaagattttgtggctcatgggttattccctttttccttttcaacccaaatgtatttgtacattatcataggttcctgtcttaattcataaaggtaaccagatttttgttccccactcaaaaaaaaaaggacgtgaactgatgaaagcaaactaagggggctatattctcttctcggtgggcttggcaacattaacattaatgggagttataagtgcatcaagaagcaagttcatccctaagatgtaagagctccagccatttgaaattagcctttgtgggtctcctgtgttccgcagcaccaggggctaattcttattctttttcatctttcccctttcttcactgggcactgatgcctcattacacactgttcctcccattctgcagcgccgagtctctgactctgtctgactccaatcaggagttcgcaagcatcatcccccagatgtcctaatgccagctgtgggggacattgttcgaagctggggttttaaattgttcatttgtttatttaagtctttatctttttaaccaaatgtagtgttacctaaagagaaagttaacagagatctcagttcaataggagggttgttgtctaatcttttaagtcattttctgactatcactaacttagtgacagccacttgctttacatttcc

SEQ ID NO: 14461 - DNA, 1035 bp, Homo sapiens
gggtgtggtgatgtgtgcctgtagtcccagcttgggacccgaggtgggaggatgacttgagcctaggagatcgaggctgcagtaaaccaagagcacgccactgcaatccagcctggctgacagagtgagactgtctcaaaaaaaaaaaaaagaaaattttggtgattggatatcactggtatattctcaccacacacacacacacacacacagacacacacacacacaaaatgaccaaattttaattaacaaaacaaaaccttacataacatcaaatctaaaaattcacttggtattttcatctgcttcttacatatagagctttaaagcttactaaaagacttttaaaaagaaacatactttactcatttccatcccaatctttccaaacaacatactcacctttggtgtggaaatttcttgccttgctaacacttactggcctagtattttttgacattttcattctcagtggggcggaatggctaagtgtgtaggtggtggaatcagaatgcctgggttttaatcccagctctgctgcttaccagctgcgtcactggagcaagttgcttaacttctctttgtttcctcatctataacatgttggtagttacagtaatacttcagaattgttgtgaggaataagagttaatacaaagaaagcaaagtacctggcatattgtgctccataagtgaaaccactaccatgattttaataacttattcagcctgggcaacatggcaaaacctcatctctacaaaaaatataaaaattagccaggtgtgatggtacacgccagctactcaggaggctgaggtgggaggatcgtctgagtctgcagtgagccataattgtgccactgcactccagcctgggtgatacagtaaggccctgtctcaaaaaaaaaaaaaaaatttctttatgcttagactgaacctaaaatgcatttttatttttatcatctttttttcttgtgcattatttttgatgaaaatatattgtcctgtttgatggataacttaaaaaattctcta

SEQ ID NO: 14462 - DNA, 1028 bp, Homo sapiens
ccagaccctgtctgggggaaaaaaaaattccatagactactaaagtttaagaacttgtgaaatctttttactatcagaaatctcttttgttacatatgtattactggccaagacatctggaagttcagagatacaatgctgataatctgctttccagatttggtttacaaatggtgggttttatttggtctgccatagtcttgacactgtactccagcctgagcaatagagtgagaccatgtctcagaacaaaccaaaactgcttaaagatttatttctttactacaataaacctaccaaaagtttttcacgtgtaatgaaagaaaattaatctcacttgaaactcattttcttaaaatatcgttgatatagatgagtaacgaaagaggctttgaaaatgtagaactgggagtcataggaaaaaagaagaaagtcccaaggagagtcatccactttgttagtggtgaaacaatggaagaatatagcacagatgaagacgaagttgatggcctggagaagaaagatgttttgcctactgttgatccggtaggtttgatattgatgattctttcctcagtgggctttgttttgatttattttttttccctaaacattgagtggaagggaccttttgaggtttaaatcaactatattcttattataaaattatgtatggtgattttgatagaaaataatatttttacatgatatggacggaaatatttccagcatttcagtagcctgaaacagcttgtttttcagtgtcagagtactgtgttagtatggatagatttaagattgatcagccaggcgcggtggctcacacctgtaatcccagcactttgggaagctgaggtgggtggatcacctgaggtcaggagtttgagaacagcctggccaacatggcaaaacgccatctctactaaaaatacaaaaaattagctggacgtattggtggacacctgtaatcccagctacttgggaggctgaggcaggagaattgcttgaatctgggaggtggaggttgc

SEQ ID NO: 14463 - DNA, 1031 bp, Homo sapiens
ttgggttagaccatcatctgttgaagtcaatcctattatactggggcataataagtgcacttaaactaaaaagatgcttattctttctgtaagtgcttccagaaaactatgttcaagtagactgccatgaaaacattgtagtttctcacaacttttctagtcaagagagtttagagtaacttaagattatttacagattttcttagtatcacgttaactgatttgtgtatattgaaccatccttacgtctcagggataaatctcacttggtgatgatgaatgatctttttaatgtattgttgaatttggtatgctagtattttgttgaggatttttgcatcaatattcatcagagatattggcctgtagttttttgttttttttttgttgttttttgggttttttttttgctgtgtctttgtctggttttggtatcaaggtaacactagcctcatggaatgagtttggaagtcttccctcctctattttttggaatagtttgaataggattgctattattctttaaatgtttggtagaattgagcagtgaagccgtcaggtcctgggcttttctttgctgggagactttttattatggcttcgatctcgttacttgttattggtctcttcatgttttttatttcttcatggttcagtcttaatatattgaatctgtctaggaatttggccatttcctgtaggttttccaatttattggcatatggttgctcatagtagccactaatgatcctttgaatttctgcagtatttgttgtaatgtcttctttttcatctctgattttatttgggtcttctctccttttttcttagtctggctaaaggtttatcaattttgtttaacttttcaaaaaaccaactttttgtttcatgatcttttgtatggttttcttaattccaatttcatttatttctactctgatctttattatttagtctctccattttgggtttggttaactcttgcttttctagttctttaagacgcatatttggccgggcgcgatggctca

SEQ ID NO: 14464 - DNA, 1042 bp, Homo sapiens
ttgacagagattatcacaaaaaccacccaaatgtgtgataatgccaaaagaaactcttttttctctgtcttttgttttattctttcctctctcttcttttcttttttgctctttctttgttttggatgcggggagaatatagtaaggattgggagctctaaattccctaatcccgtcccgattgcgtagtaatagctaacatttattgagtattttcccatgtgctttgtgtctacatacattatctaaagtaaccctcataataacccaattattatttctactttaccaatgatgaaacaggctcagagaggaaatgtaacttccccaaggtcacacagttggtacatagtagaattagaatctgaacccaggcagcctgatgccaaagcttgtgctcttaattatgattattgaactattaagtaatagaagttggaaaggtctctattatgtgtctatccagttttatttatgtataagtccttccaccgcagagctgcatagattgcttaaaacatgaactggagatgtctaaggtgtctctccctccctcccttcctcccttcctttctcttactattttttctgcttccagtcatccattataaggtgtctttttatatagccaggtattttatatatttcgaacagacagtactttaccagaaaacagaatccataaccatagtgtacaactgtgtggggctttgtagcaagacaaaagctgtgtaaattagtgcagccatggccaggctacacaagttttcaagcttctgaactccccactcatcttactctttctcttctagtcatgaaatggagccctttgatcctgacagtattcatatactttcccagagtgagcaaattattccttatatatggactggacctagaaccctagggtgaatttttaataaaccttttgagagtggaaatttaatcaaattttgatatttccatatcaaaataagttagtttaatcttcctgaaattagttttcagtcttcagaatacctatcctttcttgccttacagg

SEQ ID NO: 14465 - DNA, 1097 bp, Homo sapiens
ggacctcagaatcacctgtaaatgctttgcaacacctgatgagtgacataaagggaatatatatctctgctgttgttctcacagcctgagctgtgtacagtgtgagccattgtcttgcatcgtgtgcctgtcctgaacattttgccaccgtgccttttatgtttagccactgtatttttctagtatacaaatgaatcccagagaaattgaggaagtgttggggaaaatggtagggaaggaaacaaagcaaataagatattactatggaaatgacatttctacatacaaaataactgttgataccattttgtttgagcaaggaagcaatttacttcctaacctaatggtttgttgttgggttcaaccatgaaactgctggtctttgactaatttttaacctgtaaaaatggcagtttcgtgtggttcaatctaatacttaggtattttactgtgtatttaagatttagaaaattgggggcttggagtcgagtttaatgcattataatttttcccatttaaaaactggaaaatggggccggacacagtggctcacacctgtaatcccagcactttgggaggccgaggcaggtggataacctaagtttaggtgttcaagaccagcctggcccacatggtgaaaccctatctgtactaaaaatacaaaaattagctgggtgtggtggcgtgcccctgtagacccagctactagggaggctgagacaggagaattgcttgagcccgggaggtggaggttgtagtgagctgagatcgcactgctgcactctagcctgggcaacaaagtgagactccatctcaaaaaaagaaaaaaaaaaggaaaaggaactatgacttattattttcttgcataatcttggacattcaagaatagtttactcagttttagagttctgtaagtttccaaaattttagcccaaaccaaagtctttgatcatgtagtgtttaagtactgttgccaacgtttgaatcctgactttaaaaaataaatatcattttaaaatgctgcccataaactattatttttatctttatttctttattattattattattattttggagacagagtttcactcggt

SEQ ID NO: 14466 - DNA, 1034 bp, Homo sapiens
tttatagtattctctgatggtagtttgtatttctgtgggatcagtggtgatatcccctttataattttttgttctatttgatccttctctcttttcttctttattagtctggctagtggtctatctaaaaccagctcctggattcattgattttttttgaagggtttttttgagtctctttctccttcagttctgctccaatctttgttatttcttgtcttctgctagttttttgaatttgtttgctcttgcttctctagttcttttaattgtgatgttagggtgtcgattttagctcttacccgttttctcctgtgggcattcagtgctataattttccctctaaacactgctttagctgtgtcccagagattctggtatgttgtgtctttgttctcactggtttcaaataacttatttatttctgccttaatttagtgatttacccagtagtcattcaggagccggttgtacagtttccatgtagttgtgcagttttgagtgagtttcttaatcctgagttctaatttagctgcactgtggtctgagagactattatgatttctgtttggcatttgctgaggagtgttttacttccaattatgtggtcaattttattttttatttatttttttaaattttatgttattttattttatttttttttgagatggagtcttgctctgtcccccaggcgcaatctcggctcactgcaagctctgcctcctgggttcacgccattctcctgcctcagcctcccgagtagctgggactacaggtgcctgccaccacgccagctaatcttttgtatttttagtagagatggggtttcactgtgttagccaggatggtctcgatctcctgacctcgtgatctgcccgccttggcctcccaaactgctgggattacaggcgtaagccaccgtgcctgggctatgtggtcaattttataataagtatgatgtagtgctgagaagaacatacatcctgttgatttggggtggagagttctgtagatgtctgttaggtctcctt

SEQ ID NO: 14467 - DNA, 1049 bp, Homo sapiens
agttgagaattagagattatttcaggtattgaaaacacctctaggagaaattgttatccctcatattctttatggtcttagacattaaaaatttgttagagcagctaatggttatactttactgtctttgttatggagttaatcggtaatattgtatatattaaatagataccaaaatatattttcagtctgaactcagacttctttcttcctctttttttttttttttaattaaggcaatggctacattggggccacacagagtgaaaacggaacgtaagtcatttagtctgagttgggaaatattctctttggagacttgttgaatcagggttgttatctacgtactaaagaactcttgaatcagtggttttatttcatcagtgaacaccgtgcctgaaattatgaggaattcttctggagtcattgcttcacgtaaaagtttcaaaatttctgaatgtggtataattatttcagtgttcagctacattcttattgctaataatggatcagtaactcaaaaaagtatttatgcagtgttttttatgggctctgtcattctataggggaggtatttggaatttgtggattggcttcagagattctgtgaatcctctgaaattatgtgcaaaattctgcatgtgcattttctgaggagagagatcagaatgctgatatgccttagtaaaattcatatcaagttacacttccttgattttttttttggaagtctaaaatcactgccaaaatgtgatggtgtttaggataagtttctctgtttctgccttctttcactataggtgagatttcctaatccttctaaggacaatgaagctagactaaaaagaaaaacatatttgaaatacttaggaaaggaatttctagtcacatttaaacagcttaagtaatcgataagagaccaatttctgtttaggctgggcatggtggctcatgcctagcatgatcccagcaatttgggacgctaaggcaggaggatcacttgagcccaggagtttgagatctgcctgggcaagatggcaagaccccat

SEQ ID NO: 14468 - DNA, 1044 bp, Homo sapiens
aagaacatcctatcccccacactcatacaaacttcaggttctatactattccttgttgtttctctacattttgcctataccttataaatagtccctatattgaaccctagtcaagttattcaatttgagtatgcttcctgtatcctgctgctactttggctactacctctatccagatttgttagtgtatacacaaacacacacacacacacacccctcacattcatttttttaacaaggtacctgcaaagtatgccagctattgtatagctgtatcaaaatataaacaaattaatatattagaaatttaaattgtttcctttttctattctaaataatgatgcaatgaatatctatatacatatatatgtaccttttccctcttgtttatattagtgccgtaaaatacattcttagcaggagtatttctgagacaaaggacctgtgcatatttaaggctttagatattgccaacagtcttccatacaggtcatgattatattcacttccccatgtagtatacaagaatgcccaaacgcccatccactcactaaccctctgtattagtccattctcacgctgctaataaagacatactcgagactaggtaatttataaaggaaagaggtttaattgactcagttccacagggtaggggacgcttcaggaaacttacaatcatggcggaagaggaagcaaacatgtccttcttcacatagcagcaggaagaagaagtgctgggcaaaagggggaaaagctccttataaaatcatcagatcttggctgggtgcagtggctaacacctgtaatcccagcactttgggaggccaaggtgagcagatcacctgaggtcaggagttcaaaaccagcctggctaacatggagaaaccctgtctctactaaaaaaaaaaaaaaaaaaaaaaaaaaaaaaaaaaaaattagccaggcgtggtgctgcatgcctgtagtcccaactactcaggaggctgagggaagagaatcacttgaacccaggaggtggaggtcacagtgaaccaagattgt

SEQ ID NO: 14469 - DNA, 1049 bp, Homo sapiens
gccgcagacttttccttggagaaggagaaggggccccgcggaatctgtacttagtgaatgctgaccccgcgtggccgggagtgatggggctctctcgaaggtcagtgtcgtggggtcctcaggtggcagacagctctttctgggtatggttttggtattgtctccagtttcctaatactggacctgagcagctgagcatttattcaagggtgtattttttttgtttttttccccttaagtcgcggttagtcagaaggttccagtcctcgctcaacctctgatcgactctgtgcccatgagagagtcgttttatatttcatttctcacacgtggaagtgtgggcgaagaatgaggggcttctttaagcgcgctaagccatgctgtaaaaagatactgttagaatttttttttttcttttttgattcacaatgtccctggacctggtgcaacgtttgggaagcattttaagctctatggatggagggaacaagacagccgcattattagacaaggatggtagaaaggaacaactttccacaaacacacgcgtttggaaaagctcctttgagcattttatgcaggttaaatcacagtggtagtagatagaaataagccaaaacaaagggccaaacaaaactacatttcaaggaggtgttcttttcttccccagataacttgaatatactatcacaaattattggcgtttcaaagtttttccttgtgatctggtatggagttcatctaaaatgacaattacataatcattctatgcaatcgtatgccaataaaattaattaaaacagtttaatttttaatgtgaggaataggaatcaagacatgtcattgatgggaggtaatgatggcaatcagcaaaatgaatgggagatgtatacaattttccttcaaaggagtagagtttatagagatatttttattgcgttaatatttaaagtataaagacatacagaaaagtgcatgaatcgtaagtgtacagctcggtgaattttcacaaagtgtaaatacccatgtatccagtatctagatcagga

SEQ ID NO: 14470 - DNA, 1034 bp, Homo sapiens
catttgggtaagtgaactgcagcttagaaagttcatgtacaaaaatgcactgtcacaatttccttttgattctttataagtaagaaactggttttaggatttcagcatcttaatttctattgtctttatttcatgcaggtaattaattttcatcttattttaaattaaaatctacctacatgtctctatttgtttatttgcttattaatagagagtctccctctgtcccccgggctggagtgcagtggcatgatcatagcttactgcagcctcgaactccttgtctgaagcaatcctcccacctcagcctcctcagtagctaggaatacaggtgtgcaccaccacgcccagctaattgttttaaaaaagttttttcatagagatggggtcttgctgtgttgcctaagccgtaccgacacatatttagatgcctatgctttgtttgttaatttttttttttttagaattaaaatctcatttgaaaatattttgtctcatgattactaacaggttggttctggaagctcaggttctacatgtaaatgtacctgccttagttcatcttgtgttgctataagagaatctcacggtttgggtaactgatcatgagcagaaacttatttgacttatggttctggagactggaaagtccaagagcatagtgctggcatctggcaagggcctttgtgcttgtcatctcatggcaacaggtggaaagatgagaacaagagcaggcccattgaacaaaactactcttgtgataatgttattaatccattcatgagggtggaaccctcatgacctaatcaccttttaacagtcccacctgttaatactgtcacgtggtgtgttagtccgttctcacattgctataaagaggtacctgagactggataatttatgaagaaaagaggtttaattgactcacagttccaaaggctgtacaggaagcatggctggggagacttcaggaaaccaacagttatggtagaaggtgaaggggaagcaggcacatcttcacattgtggagcaag

SEQ ID NO: 14471 - DNA, 1047 bp, Homo sapiens
tttagtcagcattgagggaagtaggctggcaatctctttaagttgtgtaccaggataggagagactatcttgcacttataacacccaaataatttttggtgtttcactcatacagagtttggcttagagattaaagctccttctatcttgtgatgccaccatcgcaaggttctcaaggttgttgtgggagaagagaaggctaaaggagctcatagaatgcctttaatggtaagtcctgaaattcgcttgtatcacatctgcccacactactttgtctacaattcaagtgaccaaaatataaataaggctaggaaatatgattttcctgcacatttaataggaactgctatggttataatccaactaggatggggatttggaaagggatagagtagaagaggaaatgatggttagatctcatctcttttcattactccagcaagatttttaccctgccttgacagtaccatttggcacttgctgcttgggctattgctgtggatttctgtattggtgggacagacaatgattgacctaaggcaacatcagggacttaagaaccatacacattacacatttttctctcacctattctttcagcatcaccagtgtctacctttcacctgaggtggcccccaaccctatttcaagacagttgacacagatttcttgaagtttttggttggttcctcaggtcaatgatttctttcttttctttttttttttttttttttttagtagttccaggtggattttggggaagagaactgacagccttttgcagttcattgtcttaaggggaactggacaccttcctgacttctgattaaaacatttttaggacaaaaactccaaccttaccttacctaaaaaaccgtttagtttcttgtcctcgtaaatagaacaaacagtttattgctagggtctagggatgatggtagtgacatgatggcaccatgacccagagaatagcagaaaactttgtattgggttacctatgaaatgtagttctttctttaggaagcaaattatctttctttcaaccac

SEQ ID NO: 14472 - DNA, 1049 bp, Homo sapiens
cacgttgccctgaaatacacttctattagcaggagttaagaatggacttttattaattgttttctttttttaagtttttgaggttttttttggttgttgttttgttttttaatagagatggggccttgctgtgttgcccaggctggtcttgaactcctaagctcaagcaatctgcccaccttgaccccccaaaatgctggaattacaggtcttaggcacggcacctggccaggagtgaatttttaaatgcaaaaaagagagatagggagtgggctgatacaaagtttgtcaggaactgtaattactttacaagaaataacattaattagtgattggctatacattgttaagctatagggtgtgggtcatagtgtctggtatggcattattaggttaatttatagctacttgtggcaatagcaagcagtttgaagagatgaatagaggccggacatggtagctcacacctgtaatctcaacactttgagagactgaggtaggaggattgcttgagtccaggagttcaagaccattgtgggcaacgtagtgggatcctgtttctacaaaaaaaattatttaaaagatgtagcctgacatggtgataaatgtctgtagtcccagctactttataggctgaggtgggaggatcgcttgagcctcagagatggaggctgcagtgaacctatgcactccagcatgggtgacagagcaagatcctgtctcaagaaaaaaaaaaagatgaatacatagctcagagggtggcaagtaggacatgattgcagtctcgttttcattctttctgggcctgataattaaaagggcttgcattcctcagataaaagttcttttctcatatgaaagaaagaaagaagcactttaaaactctgcttttttcattatgaatttcacattaaaaaatctgtaaaagttgtattcatttctatagccacgttagtttttatagccaaagtgtgccctgttgtttaatcttaactttaaaaggattgaataatcattgctggaagttttatcatagatggcatttttat

SEQ ID NO: 14473 - DNA, 1048 bp, Homo sapiens
cacgcagcttgagatctgagaacgggcagactgcctcctcaagtgggtccctgacccccgagtagcctaactgggaggcatcccccagtaggggcggactgacacctcacacggccgggaactcctctgagacaaaacttctagaggaacgatcaggcagcagcatttgcggttcaccaatatctgctgttctgcagccaccactgctgatacccaggcaaacagggtctggagtgggcctccagtaaactccaacagacctgcagctcagggtcctgactgttagaaggaaaactaacaaacagaaaggacatccacaccaaaaacccatctgtatgtcaccatcatcaaagaccaaaggtagataaaaccacaaagatggggaaaaaccagagcagaaaaaccggaaactctaaaaatcagagcgcctctcctcctccaaaggaacgcagctcctcaccagcaacagaacaaagctggatggagaatgacttgacgaattgagagaggaaggcttcagaagatcaaactagtccgagctaaaggaggaagtttgaaccaatggcaaagaagttaaaaactttgaaaaaaaattagacgaatggataactagaataatcaatgcagagaagtccttaaaggacctgatggagctgaaaacaatggcacgagaactacgtgatgaatgcacaagcctcagtaaccgatgcgatcaactggaagaaagggtatcagtgatggaagatgaaatgagtgaaatgaagtgtgaagagaagtttagagaaaaaagaaaagaaatgagcaaagcctccgagaaatatgggactatgtgaaaagaccaaatctacatctaattggtgtacctgaaagtgacggggagaatggaatcaagttggaaaacactctgcaggatatcatccaggagaacttccccaatctagcaaggcaggtcactattcaaattcaggaattacagagaacaccacaaagatactcctcaagaagagcaactccaagacacgtaattgtcagattcaccaaagttgaa

SEQ ID NO: 14474 - DNA, 1029 bp, Homo sapiens
cactagtaaaccttagtaccttccccaaagtcattttaaatagaaaattaaagccatgtatagctgtttcaaatcacctcttttctgaaaaggcaagttgtctaagttttgtgttgttttaagtgacacagtatgtgatatacttactgtagacctgaatttcattttctgaaaattatttttgttgattcctaatctttaactagatattgaatgatctagcttagaaaattatggcaaatattccaaattggcacttaacagtgcattaacatcaaagatctagtctcattttccaacactctgtatcaaggatttgcaaagtaagaacttatgttgaaattcagcctgctacctgttttgtaaataaagttttattgggatacaactacacttgatcacttattgtgtatggctgcttttgtactatggaggcagaatttagtagctatgataagagagcctatggtaaagcctaaaataattactatttggccatttgcagaaaaacttggctgatccctactctatataatctacttgagactaaattatgacataatctatctttaatatctgtgatatccgtgatatttcctgaaacttttaaaaaaatacaagtagagaaatacaagtatcaactttttctctttccagactcatgtttgtattgaaagttacttgcatctatgcagattttcaaatcttgaagtaatcatttttttattttaaccagttatatatttttttcctggccatttatcactataattatatcagttataaagaataataacaaaacaagattgagatccaaatgctaagtggctgacttagctcacttacgtcctgtgtgtcagacctagcacagcagccttaccaaaaacatacttgaaattcacttatcggcaaaatgacaagtcagtatatattatgtgcttttagcagcaatcacacaaattatttaaagtctgaatactaaattcatgtgccagggatctggaatagcccttgataagaacttttgat

SEQ ID NO: 14475 - DNA, 1024 bp, Homo sapiens
gacattacaggaattactgaacagaataaacaatgcagacacagggatagctattcagaagaatggagctataattgtggatagaatctacaagaccaaggaatgtaaaatgagaataactgcagaagaaatgagtgcactaatagaagaacgggatgctgccttgtctaaggtaactctgcatatatctgtaaaagcatatacttaccattttcctctctatttttttaaccattaaaaactgactttggcccagatattcttaattcacattaatttttagcacataattaataccacagtgattagctatattaaaataattatgtattttattatactactgttcaaaatatgaaacctcattttaaataaaatttaatgcagtctcatttcttaataaaattaaacttgttttattacagactaacttgttatagaaattgttatattttttcaactaatcacttttatatgggacttcttacttaaattacagttttctgaaggctgagactatgtctatattactgttttattcccagtgcctaattcagtaccttttagtaaaccttgattaatggatcaaaattattcatgtatttttttctgaatgctacttacaccttcctgctctacctgaaacctgattacctccctcaggccactgcttccagtgcagtcctttcaactagtggctgtgctctctctcataccagttataccactgggcttggaggcttgtttcttgttattttatttatttatttatttatttatttatttatttatttagtgtgtgtggagatttggtatcaccttgtttcccaggctgctcttgaactcttggcctcaagtgatcctcctccctcgacctcccaaagtgttggggattacaggcatgagccaccacacctggccttgttagtgttttcagatcaatgtctttttcactccctaaatacctccagctctgaaactcatgcatcagactgtaccacccagtgcacactattgttgtagt

SEQ ID NO: 14476 - DNA, 1036 bp, Homo sapiens
actccaattaaagacagatactgtgacatattaaaggtagtgaaaagtcaggactcaattatatatattgtctgtaagaagcatacttgagacaagacacagataagctgaaagtgaaacgtggaaatatataatatgtgagctataaatataagaaagttgctatggctatattaatatcagatgaagtaggcttaaaggcaaggagtattaccagagataaagagggacatatcaccagaaatacataacaattctaagtgaatatataaataatagcagatcatcaaagtacaagaagcaaaaactgagagaactaagggaagaaatacactatttggcaatcattattggaggtatcactgctgttctttctgtaattgacagacgatttgaacaaaattcattaccgttagagaaggcttgactttgcaatcacctgttgacaactatagaaatacagtcgtctcaagttcacatggaacaataaaaaagataagactatatgctggactttaaaataggtcacaataaatttgaagattgaatttataggcatatatgtctgtctacaagggagctgaatgagaaattaactagaaaagatatttagaataggaaattaagcaacaccttttaaataattcaaggatcaatgtaaagtagaaagggaaatttagaaaaaatataataactgaataatatacacagcttcatgctaatacatttagtaacccagtgtaaataaatttactaaaactatttagcttttccgtttcttgtgcaagttttgataaattgcattttcaaagaatttattcatctgggttaagatacatttgaaataaaaatattgataattgaatatttttaattttatggagatatgagacctcgactgttcagacaatcttaaaaaagaatgaaatggaagagttatgctatctgattttaagaccctaaaactataagggacagtcaagactgtagcttatccatacgcaaatcaatggaactgtatcgacagtagaaatag

SEQ ID NO: 14477 - DNA, 1027 bp, Homo sapiens
tttgatatatgatttacaaatattttctcccattccatgaattgtcttctcactctcttggttgtgtccttttatgcacaagttttttaattttgatatagtccaattttatctttagctgcttgcgcttttagtatcatattcaagaaatgattgacaaatccaatgtcatgaaattttttccctgtattttcttctaagagtttcagagttattaggtcttatgtttaggtctttgatccattttgagctaatatttgtatatggtataaggtaagggtccaaattcatggttttttttttttttttttgcatgtggatattcagttgtctttgaactacttgttgaaaagactatcctttcctcattaaacggttttggtacctttatcaaaaatgacttgtctatatatgcacaggtttacttttagaccccactattctgttttactggtctacatgtctgtctttatgccaatatcacactgttttaattactatagcttcgtaattttgaaatttggaagtgtgaaactttcatgttatcattctcttttattattatataattattattatattattattattatataatgccctctttgtctcttctaagttgcttttccagctatgtctattccactcataagcccaacaaaggcattctttatttctgttatagtgtttttgatctttggaatttctttttcgttctttcttaaaattcccgtctccctggttatattgcccatctgtcttccctgatgtctactttatctgttagagcccttagcatattaatcacaatcgttttaaatttctggtctgataattccagtatccctgccatttctgagtctggctctgatacttgctctgtatcttcagttgtgttttttgttttttccttttcatatgccttgcaattttatctttttaaaaatttttttatttttttattttgagacagagtttcactctgtcgcccaggctagagttcagtggcatgatcttagctcactgc

SEQ ID NO: 14478 - DNA, 1062 bp, Homo sapiens
ctagatgtgcagtaggctataccatctaggtttgtataagtacatgccatgtttgcacaacaacaaaatagcctaattatgcatttctcataatgtatctccattgttaagcaatgtattcctgtatcgtgagtattaaccaaaatgtgacacagacacacccaatgagcacatgctattggaaaaatggcatcaatggatttgcttgacacggggttgccacaaaccttcaatatgtagaaaacatatctgtaaaatgtaataaaatgaagctacagtatgcctatagctatttttttgttttatatttctaaaaagagcgttctgattttagcaagtatgctagccttagaatgtgaaattaaaaggtgagaaatatttgcttaggctgttttcattagtttaccatagacattgttaggaatgaaggaactgggttaaaaggtaataattctgtatatcagctagttccttttttatctttgttaagtatttccttgtgtcagacctaagtattacttaaaaaatatctgtatctctgtttgttcaaagttctaatattattttttaaattttttttataagtttagatggggtctcactgtgttgcccaagctggttttggatacctggcctcacgtgatccctcctgcctcaacctcccaaaatgctgggactataggcgtgagccaacatctctagcccaaagttctaattttaaaatatcattaactttttctgtagttctagctgtttgagttccttttgctattgtacatgtatacatacagtaaaaatttgttgacaactgatttatactgcttgaatttgaatcctgcttattagctacttgactttagaggagttatttattattctttccttttgatttttttctcttcaaaatggtataataatatctaactcataaggcacacatcaagattaaataatttaatacatatatttggaacagggcctggtgcacacttatttctcaccaagagttgattgactatcataaataatatgcatgttggctgggtggagtggctcatgcct

SEQ ID NO: 14479 - DNA, 1141 bp, Homo sapiens
tggttgctaagaccatgggaaaagcacagtatttgggccggaatgtcccatttttccaggtacagtctgttactgcttcccttggctaggaaagggaaatccccctgaccccttgcgcttcctgggtgaggtgacgccctgccctgctttggcttacccactgtgggctgcacccactgtctaaccaatcccaatgagatgaactgggtactttagttggaaatgcagaaatcaccagtcttctacgtggatcacacttggatctgcagactggagctgttcctatttggctgtcttggaacagaaaccaagaaatttttgcttagaccagcttagaccaatgtcctagagattttcccttatattttctgtagtagtttcataatctggagtcttagatttaagtctttcatccattttgatttgatttttgtatatggcaagggttagttgtctagttttattcttctgcatatggaaatccagttttcccagcaccatttattgaagagactgtcttttccccagtgtatgttcttggcacttttgttaaaaattagttcactgtaggtgtgtagatttgtttctgggttttctattctgttccattggtctatgtgtttttatgtcagaaccatactgttttgtttactctgtctctgtagtataatttaaagtgaagtaaagagattcctccagttttgttctttttgcttagggtaactttggttcttctgaatctcttctggttccatatacattttgggattgttttttctatttctgtgaagaatgtcattgttattttgatagagattgcattgaatctgtatattgctttgggtagcacctacatttttacaatattgactcttccaatccatgaacaaggactgtcttttcattttttggtgttctctttaatttctgtcatcagtgttttatagttttctttggttaaattaatctcttggtatttaatttcatctgtagctgtgataaatgggagtgttttctaaaatttctttttcagatttttcactgttgtcatatagaaatgctactgatttttgtatgttgattttgtatcctgcaaccttactgaatttatcaattctaacagtttttttgtgtgtatgtg

SEQ ID NO: 14480 - DNA, 1032 bp, Homo sapiens
tataatttgaagtcaagtaacataatatactgtaaaaagcctctagttttgttttgttttctgttttttggggttttttgcttaggattactttagttattcatactctcttttggtttcataaaaattttaggattgtttttcccaattctatgaaaaatgacgttggtgttttcatagggcctgctttgaatctgcagatttctttgggtagcatggtcattttaataatattaattcttctgatcaatgagcatgggatgtttttccatttgtttctgtcagctacagtatctttaatctgtgttttgtaattccccttgtagagatcttgaccacctaatatgctgggattgcaggtgtgagccaccatgccccaccactgtggatttttcatagatgaccttttgtaggttgaaaaagtttcattctctttctactttgttgtgtgtgtgtgtgtgtgtgtgtgtgtgtgtgtgtgtgtgtgtctattgtaaatggaattgcattctggaattggctgtcagctgaatgttattgttgtacagaaatgctactgattgttgtatattgattttgtatcctgacactttagcgaagttgtttattacttccaggagccttttcacagagtctttagggtattttaggtataaaatcatattgtcaacaaagagagatggtttgacttcttcttttcctattaaaatgtcttttgtttctttctcttgcctgattgctctgactaggacttccaggacaatgttgaataagaatgatgagtggacatccttgtgttgttccagttttcaaggggaatgattccaatttttgcccattcggtatgatgttggctggggtttgtcatagatggctcttattatcttgagttatgttcctttgatgcctagtttgttaaggttttttatcctgaagggatgttgaattttatcaagagcttattaaacctgcacatgtacccccgaatctaaaataaaagctgaaattataaaaataaataaataaataaaa

SEQ ID NO: 14481 - DNA, 1063 bp, Homo sapiens
ttttatacaagttgatgttaagatttgaaaaataggaaacaacattgctgaccatgctaaccatgtggtattctaaaattatggctcctatccttttgattgaatttgtcaaccgtgtgccaaatagaatgttctttggatcaagacaaaagaatctttaaaatacttaaccaagtacttaaaattgtaccatattttgggcttctttcttacttgagccatgactttcttgtaccgattttgtttatcctgccttaaatttctgattacatttatttatttatttatttatttatttacttaatttatttttttgagacagagtgtcactctgttgcccaggctggagtgcagtggtactgtctcagctcactgcaacctttgcctcctgggtttaagtgattctcctgcctcagcctttcgagtagctgagactacaggtgtgcaccaccacgcctggctaatttttgtatttttagtagagacagggtttcgccatactggccaggctggtctcgaactcctgacatcaactgatctgccagccttggtctcccaaagtgctgggattacaggcctgagccaccgtgcctggccacctttctttttttttggatcttgtgcatcattatttcagctcttcccatcctgtcactcttaatttctgttttatgaggtctccctttacgccagggcagtccatctccctgttgctgtctagacctgtgtgtggctctccagtttgctgcacagttttcatcctaggatttgtcttctcttctgcattggtttggctgtgtctcagattctgtatcttctatcttgctttatttcctcttcaagtaatttccaaacagaaattttctgaatatagaattcatattttaacattacatcctttcaaaacttttaagatgttattctttctcttttcttgcttctagtaactgatttcagaatgaatcaatctttgtagacgttttctcatggaagataatttttttaatctcaattttttttcatttttgtattctgaaatctcataaggaggtgtctaggaatg

SEQ ID NO: 14482 - DNA, 1038 bp, Homo sapiens
ggaaagaaattgaaagatgcaaaggagatttatgtgtaaaacagcataattagattgtgaggtgagagataaatattaaggatgatgtataggtttctgcatgaacaactgagtagatggtgatgcctaaggaaaggaggaagaagagaaagagccaatttgcagaggggtatgaaatgagatcatgagttcaattttagacattgaattaagatatttgaagaatggtcacgtggagatgtttatgaggtggttatgaggatctgttgcttaggatagaaatctgagctggagagaaatacctcagagtaaaaggtcattagttatatagatgatcaagtgaagccacctgatatggcttggatttgtgtccccgcccaaatctcatgttgaatcgtgatccccagtgttacgggaggggcctggcgggaggtgattggatcatggggacggatttcccccttgctgttctcgtaatagtgagttctcatgacacctgtttgttttaaagtatgtatcacctcctcttcctctctctctcctgctctgccatgtgaagatgtgcctgctttcccttcacctttcgtcatgcttgtaagttttctgaggcctccccagccatgcttcctgcacagcctgcagaactgtgagccaattaaaccccttttcttacaaattacccagtctcaggtagttctttatagtaacgtgataacagactaatacaccgtcagcgtgggttgcaatcaggagagagtaggtagaatgagaagacacaagttaaaggttgagtagaggacgagaagcccccaaagaagactgaagagcatcaaggaaagtaagcagaaaccagaagtgtattgtcatggaaatcagggaaaaaaggcatttctagaaagaattggtctcaggtcaaataagatacttgtaaagtgtcttttaatgcaaaagagagtaatagacactggcaactccaaaatgagggatgttgggaggtgggtgagggttgaaaatttacctattggttatagtgttcac

SEQ ID NO: 14483 - DNA, 1029 bp, Homo sapiens
tttattgagtttaagagaaatgttatcctcttaaaggaaaccaacttataagacttcgtaagatggtattcatagtctccttaaaaatctgaaatcattattattagcaaatgttttagaaagttctttgaaaatatgtcagtattccagggaatttaaaatttaaactaaaggaatttcttcacaatcaaatttttcttcacaacgaaatttcttaaataactgtccccttttcccttcacaatcaaatttcttgaataactgatctatattcaccatctctaatttttcaattcccatttactcctctgctactcagtacagtatggctagtttgtatactgaaattgttcttcttaagatcaccagtaattttctaactactaaattcaatggctcattttaaacgatatttttattgtacaatgaacatatgtttatggtgaaaataaataaagaccttcatgtatcttcagcaatatagcataatggtttaaaatctcaagctttgaattcagaatgtataggtatgtgaacctggatataaaacactatgctaatgtggacaataatgcttctatctcataacgttgccatgataatttgatgagctaatacatgtaatgcttttagaagaatatgtgttacgtaattcctccttctcttggcatttcactccacactgtactatctcattcctcagaaggtctctgccttttcaggactaaatgcctttgtgtatattggttcctctgctcacgtaatattattttaggattttttttaaggttagcaagcatccaatcacaaatgcagtcaacttttagaatatttatcctacttgaactctcatcatttagtactgttcatcattccttcctgaagccttttgttttcttagattctgtagcaccatttttttctacctttatgacttccctgactgttcctactccatttctttcggggattacatctcccagctatccgaacataatggttgcttaaagattttatttttcttgtacc

SEQ ID NO: 14484 - DNA, 1063 bp, Homo sapiens
ctcgctctctctagaattctctattactattggaactccattttaattattattaccaaattattttagactttgctctttgagaaataaagacaaactttccactttcatagttctgtcccatgactagcccaaacaattgttactttgactatttgatatcaggtgtaaaagaaaaaaatgtggcccaaaatcattttaagaaccataataattttctaagcttcatttcctgagtatccccttgtgtttgggatagtgggggttggtagtggaaacaatgtgtacataagtattgaattgggagtcatcatttttaggtcaaaaactagactgataatgcaatcaatgcttttgctgaaagttggcttttttgctgaaatgtatctaaacaaaacctaggtatctactctgcttaaacttacataaagctctaaatttagcaacattttagtactgatgaaaattctcaaatctcatgactatcacaagatattggagatacctgaacacggtggatgaagtaggtagtaagagggccttttaaaatgcattctttggtttctacttaatctcaaagatcttaatatgaagattaacaaagagaagaatgcttgattctaagtatgatatccatgtaaactttcaatgccaccttagctaggctaagatttttaacactatcctttgtcaaggaagacacttatatgtatgatataagtcatagttgatagttactttggctttctacatccctgctagtgtcaattttttttgcattttctgtagtataatgatagctgaaatctgactttattattgttgtaatgcccaattctaggtaaataaattatgcccacagccgaatcaatcacaacccattattaaatttgagttttctattaataagattacaaatgttttagtctcaaaattgtgtaaaacaagatcaatttttaagttcctatccatttaatagtgaatgtgttcaaaaaaatatgtatttttaataaggcaaaatgcatgataccaaacacagcattgttaggttggtagtattttg

SEQ ID NO: 14485 - DNA, 1039 bp, Homo sapiens
aacaggctaaactcaagacaagacacagaaaaaaaaacaagtaaaaaaatacctattaggaagattaaaaactggggagagaatctgtcagttccatgattctgaggagacaaaagttggagtgcaagtctcaccaaagaggagaaactcagcttttgattcacaacctggaaaatctacatcataagagtaaggacaaattataactagattagcctcaactataccaaggtgatcttctcaaactcttaaaaaaattaaaatctctgtagaaaacaacaatatcagccagaacccccactattttcatacacaatatttatcattcaactgaaagttatcaagcatggcagacaataaaactaaattaccaaaaaccaacacaaacaaaaaaacagaaaatagaaacaaatccacgtgtgattcagatattgcagttatcagacatggactttaaaatcattataatcattgtaatcaaatatgctcaaaagtggattttaaatggaaatttttaaaaaattaaacggaaatcttagaactgaaaaatataagaactaagttaataattcaatagatggttttagtggattagacctagcagaaaagtgaactcaagaactgaaaaggaaattcagaaactgaatttcctgaaaaggaattcaggaaccgaaagagaggccaatggaaaatatccaaattggagaagagaaagaaaaaaagatgaaaaatctataaaacattgtaaaagatacatagaacatagtaatagacttggtgtgtgtaattggggtcccaggacagaaggaaaatgggatagatagaatcaacatttgaagagatattgaccaagaattttctaaaactgatgaacaatatgctactgaaacatgagattctaaaaacctaaacacacacacacacacacacacacacacacacacacacacacacacccctaggcatatcatagtaaaacagctaaaaaaaaaacaaatacaaatagacaaaccttcaaaacaaccagagagacagctct

SEQ ID NO: 14486 - DNA, 1357 bp, Homo sapiens
ttagaaagatgattgtatttctgtaatttaaaaaaatcactcttttaaaaactagatcagcatctcatggaatacttccgggacagaagaaatatttgttcaaagttccattatatgaacgtcaaatacggtgtcccagtttacctttgtatttaaattttgaaaaattcgtccaagctaagggaggaattccagaaaatattgatcctcggacatgggctcttgataggctcattgagtacaaagatgcgagcatacctgtaaaagagaaagatgataaaatatcagttcctgaagacccacctgaaagagtgaaagaaccaccaaaactaaaattaaatgattatgtggagtctgatcttccacaagaggtcattaaatattatgaatctgaagtgaagattttgactgaagaaataaatgataagacaaaatatcctgcatttgcatattgtaggcgtggagctatttataggaaactgggaaagttgcagagtgccatgaatgatctgcagagagtaagttttctttaaccaaaatagtaatattcaccatttacacttgcttttaattgtatagtaatttttgctgaaattttgaacaatgaatgtttatagtatagcatgtggaattattataacagtataattatttgcattttcaagtaattaatattaaaaacatgatttttgtttgtcagattgggaggttttattttatgttacgtacatacaaagccactgggatcaaccgtgttttaaaaatttatttgataggatatcctcctttaacaaatcaactttaactgaatttttacatatattttctaggtaatactcttggaaccattgtttctcaatgcctattggcatcgacatttaatttatcttttccaagacaaaattaatgaagctttggatgacttgaattatatacataaatataataaaaataatacaggtgggttgtctgtagagacagttatattacctacattttgacctcagcctttgtcatttattggtactataaggatacataaatcagtagatatatgtcctgaaaatgactttcctcagttaaatttttttactcttgttattgtaaatccggggctcgtacaatcctatagtgtttttaaaataccatggtttgaaaggttattgtccttgatatatattgcagtaagttggttccttactgctcatctcacaacgaaagaatatgaatttaaaatagttagttatagaagtaatttacaaatcactctttgatttgtgtgatttgatcacatctctctgagttagagttattgtgcgcctaggattacttggttgtatgaaatctatatctttgc

SEQ ID NO: 14487 - DNA, 1034 bp, Homo sapiens
taggaagctcctggttaatcttcagcatttactctgccatatacatgttaaatttagcttgcccaaggtccattaaaaactctcttgagattttgaatcttgagattgttttagggagaattgacatctttatgatattgaattctttagtttatgatcagaatgatgtattgccccatttatttcactttttcttttgaatagattttacatatccattgctaaaagtttcctagttttccagttttttttcatagtttttgctactattataaagggtatctttaaaaaaatttgtttgctgatggtttatagaaatgaaactgattttggaatacttatctactggctgaccaccttgctgaacttgcttattatttcttaaaatgtttagttctgttcttttgggtttataactaggaaaatatgtcatctataaataataatagttttatttttttctttctttttatgtattctgtttcttattcttgtctaactgtgctggctagaaactccaagacaatactgactaaaactagtgacaaagacacccttattttcttccaaattttaaaggaagtttaccctactaagaatgaagtttgggattgatttttgtagataatttaaacaaaataaagattacataatctttctatttccattttgaattttatcaaataatttttcatcaggtattgaaattattatgtttttatcctttaatatgttaatgtagcagattatatgtcacatatgaaattaagtaatctatgacattatttagtgttagaccaaccatgcattcctgggttaaaccaacttgatcagaatatataatctttttgtagacattgctaaatttgagttgcttgtgaggatctttgtgtctatatttatgagtgagattggttttgtgggatttgagtattgatctcataggattatttggagagtatttcttcttttctatttagtgaatgagtttgtctaaagattgtaaggatgtcttctttgaaagattatttaat

SEQ ID NO: 14488 - DNA, 1054 bp, Homo sapiens
ggttcacgccattctcccgcctcagcctcctaagtagctgggactacaggcacccccaatcatgccctgctaattttttgtatttttagtagagacagggtttcaccatgttagccagaatggtctcaatctcctgacctcgtgatccgcctgcctcggcctcccaaagtgcagaatttttaaagcagtagcaatcactagcaatattgtggtttcaaaattttaatattagctagagcagtttgtgtaggcattcttttgtttggtcctcagaccacacatgtagcagggaggatggagtgatggttttcagctccagggaccagtgaccaggtttggcctatattttgaaggcctgtgggctgcagcaaacctttttttccatttgtcttgatccagcatctacctgtgcaaactcttgtttatattttgtaatcttacctactctcttctctcctgtcggtttggtcccttttcaatgaggattcctcactggggagcagctagtcttgcggtctttcagtgtagtgtcccatcctctttctctgttacttgtctcactctccttattcctgcccatgtccatagtaaatgacgcattcttttaaaaggctaggtcacattcccgctgttctgtgttcacacactctccattctgtgaaacgtggacagtgaaatctgtttaaaacatttagtaatttagaaatgtacaagctttagaagggaagttgagaaacattgtctctacctgagaggatgtaaaattcctggtaaccagattatcaggtttcctccagaaatgttgataaatgaatagctaatttttaacaaggggattgttaagatgctaggagctgattgaaagatcatttattagagtgacctacacaacaggggcctttgaggattccctccccaaccccattcctgccggaaaggtaaccctgaataggaaaacaatgggctgggcgaggagggaacacccattgtattgttatctcagatatgcgaaagagccagtgccctgttaattaagaaaatgcaaaactaccta

SEQ ID NO: 14489 - DNA, 1126 bp, Homo sapiens
aaaaaattagaaagatcatgttctgaggtgggaacagtgctaattattatatgattaatatataggtgctaattattccacattaatatatggagtttaaaattctattaaaaatcttaatgagttacattttttagaacttgacaacagaattcaaaagtctgcctagacgaataaattgatcagattgaaaaatgcttaaaagcttgaaaacactaaaaactaatgaggccgtggagtgatagaaaccctgcttataggaaggtaaatgtacaagcactttggagaacaactgggcaatacctactatgaagttgaagatgtatacatccgacagcccagcgagttactcaagagatctttccacatgtttatggagataggaacaagaatgttttacagcaaaagaaactacataaaaccttttatacaaggctatgggcaaataatttaaacaatacatttcattcatacaatggaatattataaagcagtgaaaatgaaggaactggagctacatatataaattgcacaaacattgaacagcaacaaaaaataggaaacaggatattttcatttacttataagaagttttttaaaaatgctaaacaagtgtatatattgtttagaaatatgtgtgtagtcagggtataaataaactcgagaaagataaatgtcaaggacagtgacaggatagtaagaagctcttttttactgggggaagtgatttgggaagtgtacacaaagacatcaactgtactgctaatgctgaggaatggaattctgattaacagaaaaaatagaaaatcttcagtctgattcatatcatctataaattttggcatgcaattaaatgtaggaaacagtaaaaagggatggaatttttgctaagtagtgttgggacaactggatagctatttgcaaaacacatagggaaaaaccattactttatcaccatataacaaaataaatttcaactggattaaagaaatttacatgccaaattcataagaacagtataaaaaactttgagaatatttatataatcttgagcacgctagattttaaaaacttgacaccaaatccagaaattaaaaaagataaaggtggattgatttgaccatgt

SEQ ID NO: 14490 - DNA, 1352 bp, Homo sapiens
cagaaaccctgtctctactaaaaatacaaaaattagccggacgtggtggtgcacgcatgtaatctcagctactcagggggctgaggcaggagaattgcttgaacccgggaggcggaggttgcagtgagccaagatcgcaccagtgcgctccagcctgggcaacagagtgagactctatctcaaaaaaaaaaaaaaaaaaaaaaaaaagcctcattggataagccgcctaatcaaactaattagagtcaaacaaattagctttctttgaaagtttaaagaatgaggccatttttaacatcagagttgctttctaaataaacttaatgaaactcatgttgaattcatgttttattattaatacaactcttctccaccccctctttttttttttaggcaacagtaactagtgtcttggaatatctgagtaattggtttggagaaagagactttactccagaattggtagtattgcatgtttttcttttcataatgtaggcaaaaattagacgttttgggtcaactgtgggccacatatacaatggtgctcctataggattataatactgtatttttactgcacattttctttttttcttttctttttttttttttttttttttttgagacaaggtctcgctctgttacccaggctggggtgcagtattacaatcatagctcactgcaaccttgatctccccagctcaagcaatcctcctgcctcaatctcctgagtagctgggactacaggcgcatgcagccacgcccagttttttttgttttttgttttttgttttttttattagagacaaggtctcactgtgttgtccaggctggtcttgaactgagtccaaatgatcctgcctcctcaccctcccaaaatgctgggaattacaggcatgagccaccatgtgtgcggccttttgtgttttttaaatagagacgaggtctcaccatgttccccaggctgatctcagactcctaggctcaagtgttcttcccaccttggcctcccaaactgtttggattacaagcatgagccactgagcccggctcctttccagtatttaaatatgtttagatctggccaggcacagtggctcatgcctgtaatcccaactactagggagggctgaggcaggaggatcacctaaggccagggaggttgaggctgcagtgagccatgattgtgccactgcactgcactctagcctgagtgacagagtgagaccctatcttaagaaataaatatatggtttttttggatgcacaaatgtttaccattatgttacagttgcctacagtattcagtatagtaatgtgctatataggtttgtagcctaggagcaattggc

SEQ ID NO: 14491 - DNA, 1035 bp, Homo sapiens
ttgaacattttaaatttcaggcgtggattctcagatagtggaggaggacccccagccaaacagagagaccttgaaggggcagtcagtaggtaggtttaaaaaaagattcctgaaggcttctttagtttctgaggtaccacacaaatataaatgtttattaacaataattctgtttcagcaatattaaaattgagtggtatgccactccctgccccccccaagttctgttggtatttgactgaacagttgactatcagttccctcaaaacgcagttctgcactcatgataacctaaattttatccaaataaaggtcatgtgaagagtaaaattggaaaaattgtcaattagtaccattttttctgacttgtacttgaaaaacttaaccagtttgaaatacttagaaaatacaggagagcaaaattggtttgggcgttagttcacacattgtagtatcctttctctgctggaggaaagaataaaatgggatggagacttgatagaacaaagcttctggaaacgagtcctagaagagagggcatttgcccttggtgtgcagttacataaatacctcagtggtcatttaaattaatttttggccaggcacagtggctcatccctgtaatcccagcactttgggaagccaagaccagcagatcacttgagcccaggagttggagaacagcctagatacatggtgaaatcccatccctacaaaaagtacaaaaaagttacccaggcatgctggctcacgcctgtagtcccagctgcttgggaggatgaggcaggaggatcacttgagcctgggaggtcgaggctgcagtgaaccgtggtggcaccactgcacttcagcctgggtggtatagtgaaaccctgtctcaaaaaaattaatattttctatgacaggctgggcggggagcgtcggaccagaagagaatcacgccaggaaagcgacccggaggatgatgatgttaaaaaggtattgagattgaaagaacttaaatgaatgtagtaccttcactttactacatttaaa

SEQ ID NO: 14492 - DNA, 2020 bp, Homo sapiens
agacactgctaagatgatgatttatctctttgggatcagaaaaattaatatatatgattttatgccaaaactggttctgttttacagaagttttatttttcatcagacataaagattgatctgttttcttcatcagttagaaaatgtgtagttctgtctgccacaatttctagtatgtagatttcccatggatctttgcttttataattttatgtcagtttgtggttacttaattgccataatcttttgtcataactttacaaaaacaaattcagatgaagcttaatgacaatttgtgaccagttataaaattatggctttgaattttcttaatcggtaaattttacacatgtaaatttttattctttagctttatttgaaggtagacgcatcgaatttgcagaacaaataaataaaatggaggctaggcctagaagacaatcaatgaaggaaaaagagcatcaggtggtgcgtaatgaagaacagaaggcggaacaagaagagggtaaggtggctcagcgagaggaagagttggaggagacaggtaatcagcacaatgatgtagaaatagaggaagcaggagaggaagaggaaaaggaaatagcgattgttcatagtgatgcagagaaagaacaggaggaggaagaacaaaaacaggaaatggaggttaagatggaggaggaaactgaggtaagggaaagtgagaagcagcaggatagtcagcctgaagaagttatggatgtgctagagatggttgagaatgtcaaacatgtaattgctgaccaggaggtaatggaaactaatcgagttgaaagtgtagaaccttcagaaaatgaagctagcaaagaattggaaccagaaatggaatttgaaattgagccagataaagaatgtaaaaccctttctcctgggaaagagaatgtcagtgctttagacatggaaaaggagtctgaggaaaaagaagaaaaagaatctgagccccaacctgagcctgtggctcaacctcagcctcagtctcagccccagcttcagcttcaatcccagtcccaaccagtactccagtcccagcctccctctcagcctgaggatttgtcattagctgttttacagccaacaccccaagttactcaggagcaagggcatttactacctgagaggaaggattttcctgtagagtctgtaaaactcactgaggtaccagtagagccagtcttgacagtacatccagagagcaagagcaaaaccaaaactaggagcagaagtagaggtcgagctagaaataaaacaagcaagagtagaagtcgaagcagtagcagtagcagttctagtagcagttcaaccagtagcagcagtggaagtagttccagcagtggaagtagtagcagtcgcagtagttccagtagcagctccagtacaagtggcagcagcagcagagatagtagcagtagcactagtagtagtagtgagagtagaagtcggagtaggggccggggacataatagagatagaaagcacagaaggagcgtggatcggaagagaagggatacttcaggactagaaagaagtcacaaatcttcaaaaggtggtagtagtagagatacaaaaggatcaaaggataagaattcccggtccgacagaaagaggtctatatcagagagtagtcgatcaggcaaaagatcttcaagaagtgaaagagaccgaaaatcagacaggaaagacaaaaggcgttaatggaagaagccaggctttcttagccattctttgcagcagaagatttcttgataaaaaaggattacctttccttgtaaagaggatgctgccttaagaattgcatgttgtaaaaaatctttttggaaaatacagactgtttgtttaccagacattcttgtactttttgcataattttgtaagagttatttatcaaaattatgtgaggttccaaaatatgtaaaaatgataataataaaaaaagattaacatcccttgtcatcttttttaaatatcctatactcttcagtaa

SEQ ID NO: 14493 - DNA, 1001 bp, Homo sapiens
tttttatacagacttttggccagtcctccttttttccagtcctgcttatacccctggtatttgtgccttcaaatcatgaggctttctagggtatatcaaatcagcctacttttgggtgttcctaccttcaggcttagatttaagttctctctagttggttgagtctttttatcacacttccatttctttccattttctacttctacaattattttttgtctcatctcctattttcttttttccttgtgggtttatgcctttgaaaaaaaaatctgttttctgccattttaatagatttgagtagaaagtggtggtaaaccctgtgttaaatttgccatgttatgatcaaaagtggccttttccaccttggaaaatatttcacctagatcagtcttactctttacaactgttttcatctaactcccttgtaataatccaaattcttgaaacaaactgtattcactgatgccatgttctaatgcactccttctctaatgttttaatactgtatactgtgtacttaagtctctttactaactcatgagagatgacctaatcaccaaatgtgaattttttcttggattctcatttgtttttacctgtatcatctgattctgttttatatatatatatatatatatatatatataaagattagtttttcatgtgttcggaatacgctaatgaagccttagttttgcggagaaatccaataattactgtttggtagaacagagttttttttttttttttttttttttgtgagcaacatggctgtttatttcacctgggtgcgcaggcgggctgagtccgaaaagagtcagccagaacagagttttaaagactaaataaatttagactttttcatatatatgagccatttcttttgtgaattgcctgctcagtcttcttttttctttgcctattttttcttattgacatctaagagctctttgcttgctaaggttattaaccttttgctacaaatattatgagaattc

SEQ ID NO: 14494 - DNA, 1049 bp, Homo sapiens
ctgacatgaacgctccatctctgctcagtgaggacctgggcagccacactttgaatcttggtcttcctttttatctaaaagggtgaagtagatccccagctttctcagttctcccaccaggtcctcattctggcacatctgcagaagaatgttacagcccctgacaaactctccattgaggtatgcttgtgggatggtgggccggttggaatagtcttaatgccctgtcggagcttgaggtcacccatcactttgtaggccagattgtcatggagactgcgcagttgtaggatatgcaccaccgtgttgctgaagccgcattggggctgctccggcatcctcttgaggaagtccagcaccttgtccttcaccagcgcctctctgctgcccgagtctgtcgcacgtgctgcatgcccagcacagcagagccaccacttcgctgctcatccccacacatttgctggagcccacaatggcccaggccctcgagcattattttgaactgaaatacagtagacttgaaaatttcaagaaagactacttctggattctatttggataacttttcccgttgctttgatcttacagtcttttaaatagaaaactaacacgtggtccttgaagaaaagttggaaaacggtcagatagaagaaaaatcaataatccaaggccatcaccaaagcagaattgcattttgcatttacatatttccttcaaacttttattcaagtatcttttgaattgttgtaattatgtgtgtctggaattttacttttttttcctgaaacttaatcctctaacgtaaatcatttttatgttacgtagtcatttgtaaacttcacttttagtgtttgtaaatggtccattttgtgaatatagtttacttgactattcttttcttggtgagcacttacgctgttttcattttttaaaaggatttttaaatatatatgatgatgtaatattaaatatctttatttattcacttttgttttctggatttaggataagtttaggaatgtattcccagaattggggccagaatttgg

SEQ ID NO: 14495 - DNA, 1025 bp, Homo sapiens
atgtgtcttatttaggaaagtgtctattcatgtcttgcccattgtttaatggggttatttgtttttcgcttgttcagtggtttaagctcttttagattctggatattagacctttgtttgtggtgtagtttgcaaatattttctcccattttgtaggttgtctatttactctgttgatagtttcttttgctgggcagaaggtctttagtttaactaggtcccactcgtcaaattttgtttttgttgcaattgcttttgataatttaggcataaattatttcccaaggctgatgtccagaatggtgtttcctaggttttcttctaggattcttgtagtttgaggtcttacattgaaatctttcatccatcttgagttaatctttttatatggtgaaaggtaggggtccagtttaattcttttgcatatggctagctagctaccccagcaccatttattgaataaggagccgtttctccattgcttatttttgtcaactttgtcaaggattagaaggctgtaggagtgtggctttgtttctgggttctctattctgttcattggtctatgctgtctgtttttatatcactactatgttgttttggttactatagccttatagtacagtttgaaatcaggtaatgtgatgcctctggctctgttctttttgcttaggattgctttcactattcagactctttttttggttccatatgaattttggaatagttttttccaattctgtgaaaaatgacattggtagtttgttaagaatagtgttgaatctgtacattgctttgggcaatatggccagtttaacaatattgatttttccagtccctgtgcattgaatgtttttccatttgtttgtgtcatttataattttttttcagcagtgttttgtagtcctttttgtagagatctttcacctccttagttatatatatccctaggtttgtgtgtgtgtgtgtggctattgtaaatgggatcatgttcttgatttggttctcagcttcaacattattgg

SEQ ID NO: 14496 - DNA, 1050 bp, Homo sapiens
cagcagttcttgggaccagttatagcagcttctgtcaaagtgctggcggacaacaagttggtgatcaaacaagaatacatgaaaatcttcctcaagctaatgaaggaagtaggacctcagcaggtgctttgtttactcctggaacatctcaaacataagcattccagagtgagagaggaggtggtgaacatttgcatctgctccctgctgacctatcctagtgaggattttgacttgcccaaactgtcctttgatcttgccccagctcttgtagatagcaaacgcagggtacgccaagcagctttagaagcttttgccgtattggcatcatcaatgggctcaggtaaaaccagcatcctttttaaagctgtggatacagttgaactgcaagataatggagatggagtgatgaatgctgtgcaggccagattggctaggaaaaccttaccaaggctcacagagcagggatttgtggaatatgcagtactgatgccatcttctgccgggggtaggtcaaaccatttggcacatggagcagatacggactggcttttggctggtaacagaactcagagtgcacactgtcactgtggtgaccacgtgagggatagcatgcacatttatggatcttacagcccaactatctgtacccgaagggtattaagtgcaggaaaaggaaaaaataaattaccatgggaaaatgagcaacctggaatcatgggagaaaaccagacctccacttccaaggatatagagcaggtatgcttctctaattttcttgagtcgaaagtgtgaagaatttaaatgaaaatatgcccgtgatgacttaagggtcagcctgcttgagggaaacatgttatgctttgttttaaattgattttaaatccatctgaatgttggtactcattataatggtacagatcacaaaggaccatttaataggcttcctgcttgatagatttaattaaatttgagacacatgtgatatagacaataccaagattcagttttagttactgtagcatgtcagtttatctcattcatacaaca

SEQ ID NO: 14497 - DNA, 1398 bp, Homo sapiens
gagtcagaaagtattctccctgcttctatattctgaaggtaattgcagagaattggtataattttttctttaaatgttcagtggaatccaccagtaaacccatctgactctggtgctttctgttttggaaggttattaattattcagtttctttacagatacaggcctagtcagattatccatatcttcttgtgtgtgtttttacacattgtgtctttcaaggaattgatccattttatctaggttacccaatttataagcatagagttgttaatagtattcctttattatccttttaatgtttatgtgatttgtagtgatagtctgtctttcatttctgatattagtaatttgtttctctgtttttcttagcctgaccagaagcttatcaattttattgatcttttccaagaacccgagtttgtttttgttgattttctgttgatttccttttttcagtttcactgatttctatgcaaattttttattttttatttttctcctgctcactttggatttaatttgctcttcctttgttagtttcctaggatgtgcacttagatgatcgattttagatctttcttcttttctaatatatgccttcagtgccataaatttcctctaggcaccgctttcactgcataccgcaaatcttgatacattgtattttcatttatttcaaaatatttaaaaatttcacttgagatttctttgacttgtatgtaacttagaagtgtatttagtctacaagtatgttggggttttccatctgtattctgttctcacattgctgtaaagaactgagacaaggtaatttataaagaaaagagacttcattgactcatagttcctcatggctgggtagacctcggaaatttacaattatggcagaaagtgaagaggaaggagtcacgtcttacatggccggagaaggaggaagagagggcaggaggagatgctacacacttttaaacaaccagatctcttgataactcactattatgagaacaggaaaggggatatccaaccccatgatccagtcatcccccagcaacccctctttcaacattgaggattacaatttgaaatgagatttgggacaggatacaaacccaaaccatatcaccatcttaatttggcctgagagcaaatattgtatgatttctattcttttaaatttgttaaagtgtgtgtgtgttttttttttgcgatagaacgtggtatttctttgttagtgttccatgtgaatttaagaagaatgtgcagtctgttgttggataaagtaatctatagatgtcaattacatctagttgattatgatgttgttgagttcaactgtgtctttactgatttttctgcctgctggatctgtccatttctgattgaggggtaattaag

SEQ ID NO: 14498 - DNA, 1021 bp, Homo sapiens
atgtaaccaaaactatctttttttttttctgagatggagtctcgctctgtcacccaggctggagtgcagtggcgcaatcttggctcactgcaacctctgcctcccaggttcaagtgattctcctgcctcagcctcctgagtagctggaattacaggggtggaccaccacgcctggctaatttttgtatttttagtagagacgaggtttcacaatgtgggtcaagttagtctcgaactcctgactttgtgaaccgcccgtctcggcctcccaaagtgctgggattaacaggcgtgagccattgtgcctggctttcagatcctttttaagcggcaaaaataagcatgtgtgttaacatcatcccaaagcatatatgtatcctttaactcagcagtccccaatccttttggaatcagggaccagtttcatggaagataatttttccatagactagggggtgggggatggtttcaggatgaacctgttccacctcaaatcatcagacgttagattcttagaaggagtgtgcaacctagattccttgcatatgcagttcacaatagggtttgtgctcctatgagaatctaataccaccgctgatctgacaggaggcagagctcaggcaataatcccagtgatggggagctactgtaaatacatttgaagctttgctcccttgcccgccgctcacctcctgctgtgtggctgggttcctaacaggccaggaccagtagcagtccatggcccaggagttgggaaactctgctttaacctattcattggttattctatgatgtataaatataagacacaagagtaaattataaaaacaagtttgatgatcagtgatttgcatttttatcttaattagaaattgttcaggatctaaagagttttcattaattcaattttagtccaaaatcttaaagttagctaagggtctgaaaattacaatagaagctgatatattaagcattataagatttatggcattataagaattgacctatttttataaaggta

SEQ ID NO: 14499 - DNA, 1067 bp, Homo sapiens
aactgttaatagtagttaaattcatgtgtatcttgtgttaagaatttttgtgaactaacctgtaagtctttagttttataacatcacttctcagaaaatagatttagtaattagtagtcaattagaaaaagatttgcactatgatctatttagggtgagaactgcatgtgattcttcattatgattagtaaaactacgttgaattgtgaataaactgtaacaaattggtatatgatgtttagtttcacatgatctaatgtaaaagtcctaacaactttaagctgctttatattataatcaccttcctaaaaaactgtatatgtatttgattatttgctaagattttaaatttcttgctcttaaatgtgtcttaatctcaacccctctttgtaatccccactaccatggctttagttcacacttttcctcatttattacctacttagccgcctaaattttctccctgcttcaatctcacttactttgaaactgttccccacagtgcaaatctgactatactggccagcctgaattcattctggacatgctttcatgatctggtcccagcctacctctccagcctcatttttcactgccctctttgtatcttgtactttccctgtttgtatccagttaaatcagaccaccatcagtaccatttcctatctctttgcaaatgcacatactgttttttctggatgaaatctagaatccataccacaccctatttagctgtgaaaagagctcagttgctttctctgggaagccttccttaattcacaaacaagattattacctcttttgttataccattacatcttgcactgacaccttttataatgatactacaattgctttacttttctttaactctcagattcttgatccccaaagattatttcccactgattacctatcaaggcttatcataatcgggaatgtgtgacttaaccaggtgtgtttagtatactgccttgcataaaactagtgttaacaaagagatagctgcacttctaggcatacaaagacagtatataagtgctttggagtccaaaagatgagctgac

SEQ ID NO: 14500 - DNA, 1045 bp, Homo sapiens
tgttgtcaccttaaaagaaatctcatacttattagcagtcatgccccatttctcaacaatcttcccttccccagccctaggcagtttgtcttctgtttctatggatttgtttattctggacatttcatataaaggaaatcatatgatatgtggtcttttgtgactggcttcttatacttacgtttatattaaggcttatccattttttttaatcaaaatatcaagggctcttccatgttatagcatttatcaatacttcattcctttttatgggcaaatactattccattcatccgtatatggatatagcacacattgtttatctattcatcagtttggttttgttgtggacatatgttttcagttctcttggatgtgtaggagtggaattgctggatcatatgataactctatgtttaatcttttgaagaaccagcagaaagtttttccaaagtgccaccattttacatctcaccagtagtgtaaaagggttcaattttttcacatcctcaccaatacttgtgattatttcagtggctataaactagtatctcatttgacaaagttttttttttttttttttttttggagacagagtctcgcactgtcgcccaaggtggagtacagtggcgtgatctcactgcaacctctgcctcccaggttcaagcagttctcctgcctcagcctcctgagtagctgggactataggcgcgtgccaccatgcccagctaatttttgtatttttagtagagacagggtttcacgatgttggccaggatggtctccatctcttgaccttgtgatccacccacctcggcctcccaaagtgctgggattacaggcgtgagccactggcttctcgcccgacaaagattcttctggaccaaactgtagacttgcttctctaagccctattttcaattcggccttgaccttgggccctgtccttgacctgcctaacccagtcttagcaaggtatcctgctagctcatctctccttcctttgatatgttatcacccttgatatctgatcaagttcctcacc

SEQ ID NO: 14501 - DNA, 1025 bp, Homo sapiens
gttgcctgggctggtctggaactcatgggtgatcggcctacttggcctcccaaagtgctgagattacagacaggagccactatgcctggcccgttttatttctttcttttgatagctattctgtaccctttcccattttatgttgctagttgaaaattattggttgttgttaagaataaactgataataattgacatataaataatatgttggagtaactcattaaaaaataactttagtgtattcttttgactctgtgatttgtgaagtaatcatcaaaatgatctctataagcataaggttgatgttcttaaatctttttacaacactgtgattgcagggtgtggagtaattgacaggctctgaagatgcaggggtgtggtaaatttgctgattccagaagaaacccttatgtctcacctaagtgtgaaattagaatagggtagctagttaatgactcagaatgtatcagcctacagtcttttttgtattttgtttttagactgagctctgaaatacaaaaccacaaactagtgactaatttgcatttggaaaattaatcttcaaacgtatctttttctttaaaggaagagggaaaaagaacaaaataaatttacaagttactttgccttttcctagggcctgaagtgattaaacttggaaaagttgatgacattaatcatacattgaactagaagggaacttattttttctggtagtctactactttggactctcttttattatgcattggctagatttgctttttctgtaattttttctcaaattcttttgtccataatatggctccatgctactttgcttttacccttctacttctcaataccaacctcttcattctggtcattctgtgtctctcttatcttttcagtcatcatttctaccttcttgtctgctgtcaaggagagttgtttaatgggttgttccacattctagaatagtttaccattctttttctattattccataatttttcaaagttaattatatttcatgttttcatc

SEQ ID NO: 14502 - DNA, 1030 bp, Homo sapiens
tgattatttccatagtataaaatatgtacagttgctatttggtacactcattattttgatttatgtctttattagtaaagatataggtcttttttatgtttattggtcatttgcatttcttcctttgcattattgtctttaaagttttagtcatctttttaattaactactattaatatattaagtagtagtatattctaagtatattttaagagtaaatcagttttatggtctgcttaattttgagaataattcctcattttaaaaaaaatgagacatgccctataatttaatgatttggtttccatttaagctgttagtggaagagatgaaggtaattatgaaaatataatgtggtattaccttaaaggggtaattgcttattaccttatagccttaaaaattagatgacataattttaagtatattatgtagttattatccagactgtaagcctttctcaaatatgttttttagaggtagggtcgtgctctgttgcccaggctggagtatcgtagcagggtcaatgcttacagcagccttgaacttctgggctcaggtgatcctcctgccacagcatctcctgagtagctgggactgcagctgtgtgccaccatgcctggccccttaaatgtgttttaagtaacatttattcactttaaaaattactgtttaattttttaaagccataatttatatcttatataataaagttgaaacctagctgtcaggatttataaatcgtaagtatatagatatatttaagcaatatgattttatcttttctaaaactttatcctgagccaagtgatgagcttccttttgaaatgtttatacccatgaccagaatttttgtcagttttacttttagcctccagaacagttgttaaagatatgccgttttccagtgattgatagcaaggtaacattcaggcaccgaatcagattcttacctaaataagaaacattgaattttaaatagtatttcttcattgggtagcaggcagtgtacttatttgttgtttgaatg

SEQ ID NO: 14503 - DNA, 1049 bp, Homo sapiens
ggatttttaacatcttccatcagattattattatttttttttttgagacagagtctccctctctcccccagggtggagtgcagtggctcgatctcggctcactgcaagctccacctcctgggttcacgccattcttctgcaccagcctcctgagtagctgggactacaggcacctgccaccacgcctgactaattttttgtatttttagtagagacagggtttcaccgtgttagccaggatgatctgcatctcctgacctcgtgatccgcccgtcttggcctcccaaagtgctgggattacaggcgtgagccaccacgcccggcccagattcttaatatccaagaatctttcttgttctctgagtgttcctttttttatactctccaattcttgtttcatggctgcatatctttttgttatttctttgatgatactaaggatagttgagattttcctctgttcccaggacggtttcctctcaaatttttctgtttacccattttcatctctgagatatgtgatctctggatttttgttcctattacagattagatattaacaagctatatgagccaggcacagtggatcacttgaggtcaggagttcgagaccagtctggccaacatggtgaaaccctgtctctacttaaaatacaaaaaaattagctgggcatgctggcaggagtctgtaatcccagcttctcaggaggctgaggtaggagaattgcttgaacctggaaggcagaagttgcagttagctgagatcgtgacattgcactccagcctgggtgacagagcgagaccctgtctcaaaaacaaacaaacaaacaaacaaacaaacaaaacaaaacacaagcatatggaagcactgtgtgttttgtatggggcattgtcagttggcctatggtgtttcacagtagtgtaatcatgtggccactctttttgctggtggattcccagtgatagtaaccttatatcttattcctgagccaagcagtttgtttagaaaaggataattttatttacttggggaatggacacctagcttc

SEQ ID NO: 14504 - DNA, 1033 bp, Homo sapiens
atgcttgcttttgacattttttcatatgccttatgaaatgtttagaaattttactgtttttagatagaagtttctccttattcattttaatggataaagagaaacaggaattctgtcttgtctaaggtagttcagagtaatgaaggaatgagaaaatagtacctaagttgagttatttatttatggcattaaattgacacagtgcctggcacatgatagatgcttattttttttgaaacttaatgatttgctaaatatacattattgtgattgctataacaccttatatccaaaacagtgaaggatgcattttatatagtaagtagtatctattttcaaacactcaggtatcattccattttaattttctaaaatgatttttctgttacaattggtatccttttattttaatgattactgttaaaacaactaattctgtgtcattatttttgtgttctgttttctgctttattcagagtatcccataaataaggatccagaaagtctttctgaacgagtatgaggactgtgtctttgcttttaaattggcatgttttctattttttgttataatttttatgagtagtattgtataaacttagtattttctattttttgttataatttttatgagtagtattgtataaacttaggtactttttaagtgagtgattttctaaattttttttttagtaccaaaagtagaagacttttatgaagcatttgtaaagtactaaggatcaatgtgctaaaggtagaagttatacagactcaggttagaaataggaagcatatagataggaatattctctctgctcttgatgaaatagaggaagcaggcaggtttctaaggtataacgacctaggaagacacttgctgaaagatgttaacacaagtaagaattggcatatggaaatgcttggtaaatagttaccaaacacataagtacaaaagtacttaaattacctgatgggccaaagagggtgtcttttcatagactagttcttctgtgatttaaagtataggaaaaat

SEQ ID NO: 14505 - DNA, 1023 bp, Homo sapiens
aaatgcatatatacttacaatagatattagtgggattatattacacatactgatctataatctgatatttttcacttaatgcatttagaaccactttccttatcagttatagtgaactcacaagtaatctttatgcagttcttatagtttatataagttaattcacatgactaactgctttgagaaccactgaatgttttgttttttttttccataacacatgcctctttcttaaagtcatttatttagcatttgctgtgtacctgttgataggctatttaagttgtaggaatgaaggcccaaagaagccatgtgtaaatagcgttgcctgtgagttggtcagaaggatagaggaggaggcgtgtgttaaaaaagatattctaagtggtatacagtaataatggaaatatttttattgtgcttgtgcattaggcttgtaccattggatgtaccctgcacattatctctgagataatgtctaatttaaatccttctttagcatgaggactttgtgatctggtctaacatccaggtccaatccctggtggttcctgagctctagacacacctaagtctgataacttcccaaagggcagtgttgttttatatctttatgactgtaataccttttcctctttccacttgtctagtggacttatattccctgagaccacacagttttgtgtcttctctgtgaaattttctctggttctcctatactgagatacctagtctgttatttgtgccatgactttacctacatttatttacatttatattagcaccagtaacactgctttgaatttatgtctcttatatcctcaacatgcctgtcagtttctgaggcttaattctttgtatctctaatatttaggaatagagctcaatatatattaggcagtcagccagtctttactgaataaatgttagctttataatacaaaaaactgctgaaaaaatactgcttaatattatgcacattttgtcactgttttaaagaagttgttacatgatgtagcaata

SEQ ID NO: 14506 - DNA, 1050 bp, Homo sapiens
agaatatggaatcatttcacagatatatgtatatacattgtagtcatcacagcaatcaagatacagaactcttttagcactccaaaggtccccttggcccctttccagccagagttcccctctccactcctagcactaggcagccattgatctgctttctgtcactatggttgttcaattttaaaatattcaacaaagtataaaatgttctgtacattaaaaagcatgtaattggcaaaatggcagaatagagagaaaatgtattatttcatttgtttgtaaagcttaaggaatttaagggttaattttaaaagttttttaaattatgaaatatgattaaaaattttaatcatcaattatatttaaaattatttgtattaacactgtacatgtgcatattttggtgatattggtttactttcattggcatgttacaatttcatttcagattaaaagaccttactttcatgtgaaacctttggaaaaggcacaactaaaaaactggaaagaatacttagaatttgaaattgaaaatgggactcatgaacgagttgtggttctctttgaaagatgtgtcatatcatgtgccctctatgaggagttttggattaaggtaagaaaatcatgtgctcttaaacttgaatatattataaacattgatctagtgactaaccttttttgtacttctgttgaatgttgttcatataactatatctgttgcattaggagatggtctgcttgcaaccagatttgactgctgcatatgccaacctcgttgcctctcttcgtccttccttacagaaactagtctagtggttcaataaaggtgctgaatgggtttaaaaatagaattttatcgttctgtcacaaatttaatggcttgttcaactgtaaattattcagtatttcctcttttctgtatgtagtatgccaagtacatggaaaaccatagcattgaaggagtgaggcatgtcttcagcagagcttgtactatacatctcccaaagaaacccatggtgcatatgctttgggcagcttttgaggaacagc

SEQ ID NO: 14507 - DNA, 1061 bp, Homo sapiens
tccagtggtggttcttggcttgcaacaattattgttgtggtatttgcctaatcattctttctctcttttatatgcattaatttgaattcttctgcaataaagattttttttccttctgtgggccacagtccaatactattttatcaattttattaagattgttccagctttgtctgttaggagctccttcaagctcctgtgtcctttagacatgcactttttttttttttttttaaacagggtctcactgagtcctccaggctggagggcagtgcacaataatactcactgcagctaaatttcccaggctcaggtggttctcccacgtcagcctcctgaggagctgggactacaggtgcctgccaccacacccagcaaatttttgtatcttttgtagagacagggtctcccattgttgcccaggctggtctagaactactggtctcaaactcctgggctcaagtgatccacctgtctcagcctctcaaagtgctgggattattggcatgagccaccataccttgccactctttcttttgatgcttctgtaactttctgacatcataagatacattatgctcctttagtattttttcggcccagccatggaatcaacagtatgtctgggaaattctggtttcctttattgaagaatggtaaaaatgcagattttgagacctgtcctataatattctgattttagtagctctgaacggtcttccatattgagtaaggatttttttttttttttttttttgagacagagtctcgctttgtcacccaggctggagtgcagtggcgcgatctcggctcactgcaacctctgcctcccgggttcaagccattctcctgcctcagcctcctaagcagctgggattacaggtgcccaccaccatgctcagctaatttttgtatttttagtggagacggggtttcaccatgttggtcaggctggtctcgaacccctgacctcgtgatctacccacctcagcctcccaaagtgctgggattacaggcgtgagccaccacgcccggcttgagtaaggattttattggataca

SEQ ID NO: 14508 - DNA, 1033 bp, Homo sapiens
aaaaaaattcaagacaacagaagctccattttctaagtatttaagtggatcggggtttaattttatgtttacaataaatccaaactaataattgcttgttatggataaattgttatttataaaagtaatataatctgacattttctatttgtttttacagatttataatcagagtcagtccaacaaaagaagtatatataaagctatttcaagtaacaggcaggtccttcatttttaccaaagaagtccacgaatggttcctgatggaatcaacccaaaattacacaaaatgttcatcacacatggtgtctatgaaccagagaagccttctcggaacttgcagcgaaagtcatctatcttttcctatagggatggtaaataaattttgcatttgacacatgcatttttcccctgttcttacttagcaggtcgtatcttgatataatatttcttgtttgaaaaactgaatatatgttctaattaatatattataggcattctctttggaaaggctgtacgagattattcatgtggcaaatggagagacactggtagtatagagtgacagaaactcagtgttggggaaaattaaacataccctaccaacccagagaatgttctccataaagtttagaaaagaaagaaaacagttttattttttaataagcattaaaccagattacaatgtgcgctgaagataatgtactaagataataccaagacagaaagaaattccctatatgtatccccaagcacttagaatcctttacatacatgttgtcaatattaatagtaacttgtcctcatgtaagagggcaccatttgctatacattccttcatagtttatcccatatttacctggtaattgaggtagccatttgtgttagctggttacctttctcaaatatcttgagatatttgcactatgaaagtgagaaaaaatgtttattttttggattttacttaatctctgaagtgggttttaaacaatcataaaaatcatataactaacatttggaaggaaccttggga

SEQ ID NO: 14509 - DNA, 1059 bp, Homo sapiens
atgcatattttacaaagattttctcctaccctgtgggttgtctgtttactctgctgtgcaaaagcatttagtttaatttagccccatctatctttgtttttgttgcatttgcttttgggttcttggtcatgaactctttgcctaagccaatgtctagaagagttttttcaatgtgacagaatttttatggtttcaggtcttagaggtagggcttcgatccatcttgagttgatttttgtataaggtgagggatgaggatccagtttcattcttctgcatgtggcttgccagttatcccagtatcatttggttgaatatggtgtcctttccccactttatgtttttgtttgctttgttgaagatcagttggctgtaaacataaattatgctttcataagcatccttgtaaaccaaaacaaaaaataaaatttttgttttgaaattatatttaaaactttaaatttgatgttattgtttattttgtttattattaacaaattctttgttaactttgtgaaagtcaagagaactgatcaaaggttgtagatgtgcctggagagctgggaaaacaacctcagaaaagatttcttttaaaatatttaactgtttgctcttaacatggaactatataaacaggaatattgtcaacttgtaagtcatataacagttacttaacaaatatattttaaagggcatctttctgctttatgaaattattttctttttttcttctgagattttagttgggagtatctaaatggatccaaattatgttaagctgattatatgtatattgagtgttttttaaaattagtttgtgaaatctcagtatgttttcatcatttttattactttttaaataattaaggctcaagaatcaaccactggaattcatcaactctctctctctgaatggagactgtggcaagatcatcctttgcctacacatcaagttgatcactcagatcgatgccgccattttataggccttatgcaaatgatagagggaatgagacacgaagaggtggggttttattgtaactttctcttgctggtatg

SEQ ID NO: 14510 - DNA, 1025 bp, Homo sapiens
gaagaatgtgctgaaattgttaaacaaactcatatcaaacctactaaaattgtttctttaaagaaaaaagtgtctaaagaaataaaaaaagatcagcttaaaaaagaaaataatcacggtattatagattctgtagataatgacagaaattccactgttgaaaatatttttcaagaagacctaccaaatgataaaaggacatcagatacagatgaaattgctgccacatgtactattaatgaaaatgttattaaagaaccgtgtgtgttattaacagagtgtcagtttacaaataaatccactagttcacttgctggaaatgttttagattctggttataacagtttcaatgatgaaaaatctgtttcatctaacttatttcttccattcgaagaagagctttatattgttagaacagatgaccaattttataattgtcactcattgacaaaagaggtactagctaatgtagagagatttttatcttattctcctccgcctctcagtggactctcagacttggaatatgaaattgctaagggtactgcacttgagaatttgcttttcttaccctgtgcagagcatttacgaagtgataaatgcacctgtttgctgtcacattcagctgtgaattctcaacagaatttagaattgaattcacttaaatgtataaattatccatctgaaaaaagttgcctttatgatatacctaatgataatatttctgatgagccaagtctctgtgactgtgatgtacataaacataatcaaaatgaaaatttagtacctaacaatcgtgttcaaatacacagaagccctgcacagaatttagttggagagaacaatcatgatgttgataacagtgacctcccagtattgtccactgatcaagatgaaagtttgctgttatttgaagatgttaatacagagttcgacgatgtgagtctttcacccttgaacagtaaaagcgaatctttacctgtgtcagacaaaactgctattagtgaaacgcctctggtctctca

SEQ ID NO: 14511 - DNA, 1083 bp, Homo sapiens
tcacaccttgctcttgttatattggcttctttttacaagcggcaagtagttggacccctattgctggttacaatttttggtggcccatacagggagccctgtgtattcacaggaggctccagacacacctatctgatcttctgttggatagggccatggagccacctgtgagtgccagctgctcatggctagctgaccctgtagtaagaacattaggggagcttccagcaatagccaaggtgcctttgtcttgcagaacctccttttctatttctgtcacagcatctgctgcttccaaagcttcactgatacaaagagaatgtgacattttgaagaagtcgacaaatgttggaaccaggtgagctgctgatgtgcacccagcctccctctgcctcttttagggtgttgctggggctctgctctgtttagacttagctgttggtgtcaccatttggccatttttttgcatttgtatttgtggcaccctcagggctttgctcacattggactgtcccctggggagggccgtttgaaactgaggcaaggagtttggaactctacccagccctcttaactggggatttgtttggaggcagtgcaccatttgtttgcagtgtaggtgtgtaaccttaatgtgtgtatgggccctaatctctctctctcttcctccatcttttctattcctcccagctccatcccactgactaaattggaaacaagccatctacagcctaaactcccctgggccataaacaccgttagcttcctccagctggaaatagctaaccttgactggtgacttgcagaagtgggaatgttacagcaggttaactagtcagggataagcaaggaatgagagggcctccccaccccccaccaggaatgttgttaggcgaccatcctgtgatggtcaggtggttgttaactgtgtctctaaaataatacttaatcgcagccagcaccagggaaaagcaatctctcaataaacagaaacacctaaaattggtgatcagcagcttcctcataagatctcagaaactgggcaagtgggctcaagcatgtgcattaagaggaaaaatggag

SEQ ID NO: 14512 - DNA, 1049 bp, Homo sapiens
tcatttctgaactctatcctattctattgatctatgtatttgtttttaagccagcaccataatgttttgattactatagatttgtaatatgatttgaaattaggaagtgcgatacctccaaatttgtttttcttaagattgttctggatacttggggtcttttatggttccatacaagttttaggatttttttctatttctgtgaaaaggttattgaaattttgatggggtatagggattgcattgaatctatagattgcttcaggtaatatgagcattttgacaaaattaattcttccaatctatacacatgagatagctttccatttatttgtttcttcttcaatttcttttattagtgtattatagttttcattacacagatctttcacttccttgcttaaacttatttcctaaattctttaatctttttgatgctattgtaattaggattgttttcttgattgctttctcgggtagaataatactggtgtaaagaaatgtaaaaatttttttggtgttaattttgtgtcctgctactctactgaattcatttattccaaaagttttgctgtgggtggcatctttgggcttttctatgtataggatcatatcacctgcaaatagggataagcttactcctttctgatttggatttatattatttctttttcttgtctaattgttcttgctagttcttccagtactatattgaatagaagtggcaagagggacattcttgccttgtactgggtcttagagtaaaagctttcagtttttcccattcattatgatattacatgtaagcttcttattaatgacctttattaggttgaagcacttttcttctatacctattttgttgagggtttctatcataaaggtttgttgaactttgtcaaatgctttttatgcatctattcagatgatcgtgtggtttttgtctttctttttgttaaagtggtatatcacattgattgatttgcatatgttaaaccaaccttgcatcccatggataagtctcatttgatcatgtatataatcttttt

SEQ ID NO: 14513 - DNA, 1038 bp, Homo sapiens
cataataataaaaaataaataaataaataaataagaaaaaaataatagaaaagtccttttctgtatttacgtctctactaaatgggaaaacaaaagatagacgaagaaggcagaattattcctgaaaaatggaagagaacatgtttcttatgaaagggaagagtattcctatgttttaatatgcacacaaagtatttctttatcaaatgaacacaaatgaagagaccgtctgtccacgggaacagaaaaccacatatggcatgttctcacttataagtgggagctgaatgatgagcacacacaaacacaaagaggggaacagacactagggcctactagagggtggagggtgggaggagggaaaggatcagaaaaaataactattgggtaaccaggcttaatacctgggtaacaaaataatctgtacaacaaaccctcatgacacaagcttacctatataacaaacctgtacaggtacccctaaacctaaaataaaaggtttttttttaaaaaaaaaaaaaaaaaaaaaaaaaaaaaaaaaaaaaaaaaggctgggcacagtggctcatgcctgtaatcccagcactttgggaggcttaggcaggaggattgtttgagcccaggagtttgagaccagcctgggcaacaaaccaagattccatctcctaaaaaagaaaaggagaccatttgtttttacccatcccttcactcaattatgttacttgcctggactctgctggtatttcagcttgagatcccagaccagagccatgcaggtagaaaacagaaaaatcacctaaatttcatgtaattgcccgcagtattctttattctttattacttatcgctataccctgccactggtgttaaacttctgtatgtttctgagcccaggagctatcttcgtcctctaagtaacttgtggcatctagagctcaaaggttttgtggcattgcgaggtggggccaggagcggtggctcaagcctgtaatcccagcactttgggagaccaaggcgggcagatcaaggtcaggagtt

SEQ ID NO: 14514 - DNA, 1062 bp, Homo sapiens
ggctccagtacagctgctggtgacccatcttgctctcagcagtgcaacgaggtaaaaggaagaagctggcccacgcatgcgctcttcaaatttttgagacagtttacccagaatgcagtgctcaaaggaaacgcgtgcgcagtgtggtcaggttgtttcgctgggtgagtaaaatgaaatcttagaggcgttgtgggctggcccagttgatgacgtcaccataccacagcttctagtgctattctgcgccggtatccgaccgccgggcgcggtggcgcgtgcctgtagtcccagctactcgggaggctgaggctggaggatcgcttgagtccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaatagccactgcactccagcctgggcaacatagcgagaccccgtctcttttgaacaataaatacgttaattttggactctcaagagatgaatattctcatagtcttttttattgattaaaccttttactttcttttaattaaaacgttacacttgggaaaggagtttttcctcgactcaccagtgacacctactggaataaatttacaaaacaacttaaaatcagctgtaatgatcacgagtcaacggtagggtttgcttttattttgttaaagagagtacgttttcaaatttatttttttgacacactcctccaagaaatacacctacaccattccaaaaaaaaatgagattctttggcatttagtgtatttgattcttaaatgtaattggctgaatgtaaagtaataaacaagtaatgtgcagtgtatgttgctttgaccagataatttggtgacaaaacaagtaatgaaaagcaaatgcaaaaatgcaaaaaaccaatgtcaataaacgaatttctgctgaaagatacctacattccatatggtcat

SEQ ID NO: 14515 - DNA, 1029 bp, Homo sapiens
taccgagaaacagcgcccgacacctggcccttcgcagctctcgcctttcgcagctctcgcctaacaggaaagggaagaaacaggcggaagtgggaactgcacctgagcgacagtactgcaaaccaataggcagccggccacggcggtcaggcgccttcggtcgcgtctggaaagcaccaaccaacggtctaaggggcgggccggaggggtgtgggccggagggccgcggtgtgccgcggggcagttgcgggttgtcataacggtccccgccggagtgaggcgaggccgcgtcgctcagttctggccgtctagggcccctgtaaggatgagagcgcagaggacgcagggccgctggaggcgcaggtaacgaagctagggtgcggttgggaccgcggctgagctttttccgggacccgtggtgctgaatggagaggacggagacgaagccgagccgcggctcctagcggcggcgccgatgctcgagctgtagctgccaggcgaggatgtgtggagcgcaggcggcgcggggtaaatgagaggtctcgggccccaggacccccggggcccgggatgagttagcgagggcagccgcgggggccagttccgaccgtgacaggccaaggcgacggccgccgcccgcccgccccttccgtgcagaagcagctgctcctttccgcgcccgcccgcctgcgctcccggccctggagaccatgaggttccgcatctacaaacggaaggtgctaatcctgacgctcgtggtggccgcctgcggcttcgtcctctggagcagcaatgggcgacaaaggaagaacgaggccctcgccccaccgttgctggacgccgaacccgcgcggggtgccggcggccgcggtggggaccacccctctgtggctgtgggcatccgcagggtctccaacgtgtcggcggcttccctggtcccggcggtcccccagcccgaggcggacaacctgacgctgcggtaccggtccctggtgtaccagctgaactttgatcagaccctgaggaatg

SEQ ID NO: 14516 - DNA, 1091 bp, Homo sapiens
ttcgccacgttggccaggctgctgtcaaactcctgacctcaggtgatccaccctcctcggcctcccaaagtgctgggattacaggaatgagccaccttgcctagcctaaaaaaaagaaaaaaaaaaaaaaaaaaaaaactttgccctcgtggatctcatctggggtgagactagtgactccaaaatggtatctccagttctacctgaccactgagctccaagagactcacatgccactgccccgcagttatccacctggatgtttgatgggcatctcacattaacaattctacgtagaaatcttgatttttatatctaacttgttctgtccccagttgcactaaataataccgcctacccagctacttaaacctaaaacataagctgattcctctttccctcaccctgctgccattcagttacatagtcctgttgtctcttcttgtacactccaaatatatccacttctatttctgctctgagccaccatcatctccatcgcagacttgtgcaatagcttccaatcggtctcttcagctcttcccttctgacaatctcttttccacacagttgctttagtgatctttaaaatcaaatcaacttacatcattacctgctgaaaacctagtaacttcatatccaagttccttatgtgtgtctacatttaatccctaacacacttcgtattcaccatctagttttcttccccaatcagtctaatgtcagaatactcttgactcctgtgcagcctgggcacaggccatcgaacctcaagaccttaaatgatgtcaccttagtgactccctgcaacatgcttctcccacctccaacacctcatataaaatggccagcatcgttttttgttgttcttgttttgagatggagtttcactctgtcacccaggctggagtgcagcagcgcgatggcggctcactgcaacctctgcctcccgggctcaagcaattctcttgccccagcctccaagcagctgggactaaaggcatgcatcaccatgaccagctaatttttgtgtgtgtgtgttagtagcgatggatttttctccatattggccaggccggtcttgaactcct

SEQ ID NO: 14517 - DNA, 1060 bp, Homo sapiens
acttctccaatcatattatctaccatttaatacacaaactttctcttccttccaactcagtctatttatcatttccccaaagcactatgcatattaccccaaagaagcactcccctttgttaatgctaattctccttggagtctccctccttcatttacttaactgctaacatatctttcaaggtatacttctgatgttatttccccaaacatctgaactcacagcaatctcttactcttgaactactttatcactttcagacactatttacatatttatgactacttcctgaatccaggactcaaaagcttcttgaaggcatgagctttatacttcacctctttgtatactcagtaagtatctagcacagggctatgtgctcagaattctctgtaattgttcaatgattatgtttctcaaatgaaaaggctttattgtccattctgttctagggcctcttcctggagtgctttagtttgcttagtctttcccaccctacagtagttgttcccttcccttccgcccttcccttgcttctacttgcttcctgagacctgctattaaaaaaaaaaaaaaaatcggccaggcgcggtggctcacacctgtaatccagcactttgggaggccaaggcgggtggatcgcgaggtcagaagatcgagacaatcctgcctaacacggtgaaaccccatctctactaaaaatacaaaaacaaaattagccgggcgtggtggtgggtgcctgtagtcccagctactcgggaggctaaggcaggagaatagcatgaatctgggaggcagagcttgcagtgagccgagatcgcagccactgcgctccagcctgggccacagagcgagactccgtctcaaaaaaaacaaaaaacaaaaaatcaactattctgccttacataaaactttcctaatttcaggtattcatatttattcctgacaatatcaccctagaactagtctatgtaatacactgaaatcattattgtacatgtttatgtaataaaaggtcttattagagctagtcctcaaataacatcatttcattcaaca

SEQ ID NO: 14518 - DNA, 1077 bp, Homo sapiens
aagggtactcttagacaaaagaataacctgtatcatgaataggttgaactaaatgatctccaagatcctttaccacaataaatttcttggacattgctaccctttcaacaatgaaaaccacaactctgccttagttgggtatttccaaaaaccaagacagcaaaattagttgcataacttttgctgcttttattataatttgcacataaaaacttaaatacgtattatataacgcccacatagcaggtgctcattcttctgcaaaaggaacactgtctaatagtagtaacagggtctactgcctcacctgtaaaatgagatgccaccactcatctgacaaggatggttgtgagaatagaaaataatgtaaataggccaggtgcagtggctcatgcctgtaatcctagcactctgggaggccgaggtgggtggatcacaaggtcaggagtacaagaccagcctggccaagatggtgaaaccccgtctctactaaaaatacaaaaattagccaggcgtggtggcaggcgcctgtaatcctagctactcgggaggctgaggcagaagaattgctagaacctgggcggcagaggttgcagtgagccgagattgtgccactgcactccagcctggcgacagactgagactccctctcggggggaaaaaaaaaaagaaaagaatgtaaataaggcactttatacagtcccagggaaatggtgagcctcaatcaacaaaatcttgcagcacaacagtaatagtaaatgaaacaatgcaatattacctgtaaagaggaatgaccttagcagagagaataactacaaaagtagtttagtgggaatattttccctagtttcctcaggtaggcagatgaatttattccagcaactataattgctctctacttgaaacaaatattttattaaatcaagccaaattttcatatgagaaactgcactttataaattcatctatcacttgtaattcctaaacccaaaactaaatgctaatgcacatttacccgagtctacctttgttaaacacatttatgcattacccattaaatactgaagtctcactata

SEQ ID NO: 14519 - DNA, 1139 bp, Homo sapiens
atgctgttaaggtgaatagttagaatttaattgactgtgaggggtggtgtctttttttagttctaaaaaagataattttaaaaaatgacctcactttcatctgtaatattttaaaacagctaaaatgatcaaccttaatacattaatgttgtattgaattttttatagagtatattttaaaaaattaaatctacattaagcacctagcatggtgcctgccacagtaagccctcagtaagcatcaacgattatgctttctctcctttttttttaaagcagtttctcctatggttttaatattttcaagacatttggtatatacctattagcattttactgtgtaattattttgcttgaggggagaaaaaccttgaaatattcacctttctgtctctagagcctagaacactgcctgacactgtaataatcatcaaaagcatgcatccactggttaggaaagctgttctacatcctcttgtgccaccaaccagacccacgccatggcctggagcaagtcacctaatcccaaatgcaaaaacagataatactagcaaggaatgtttaattctaaaatttgtaagattctgagtctcatcggcgtgatgaaaaaagaatagaagtttttttgtttgtttgtttttttgagacggagtcttgcttttgttgcccaggttggagtgcagtggcatgatcttggctcactacaacttccgcttcctgggttcaagcgattctcctgcctcagcctcctgagtagctgggattaaaggcgtgcaccaccacgcccggctaatgtttgtattttcagtagagatggggtttcgccatgttggccaagctggtctcgaactcctgaactcatgatccgcccgcctcggcctcccaaagtgctgggattacaggcgtgagccaccgtgcccggcctagaagtttgtttaatcaaatccctgtgttagagatctcaacattcaaattatgtatctaattaatgtagttctgctttaatatataatggatctgccagtaacctcagtatcacaggaagtttaagaaattttaaacattaggaccaaaagtactagattgttcatctcttacattacttgaagcttcaaagcttcatcttttagtagaaactc

SEQ ID NO: 14520 - DNA, 1032 bp, Homo sapiens
aaatataaaaatcaagaaatagagcaagcaggaaatgggattttaaacattttgatttcaagaaatagaactatcttaaatatgatgctgaaacaatctgagaggcaggagataggactcaggcaacagagatccgaggaaatatatatgggcattttgtggttcatttttcttgtgtggcatgtggtacaactgaagcataaatctttttgatatcatctagttttgccagaggtatgggacagttcatattctgtccataagttcggctacttacataaactgaaatacaagtgcaactccaaacaggttttttcttttctggacaccatcatcaagcatggaagactggatctggaatttcccttcatatcttgccagttggcctcccagtttcttgcttatgttttctcctggtgtgttttcaacattgtaattgttttcaatcaactgtataagttttattttcttcaaagcatctattgattccttttttaaaatcatgtctcctagctcctttaaatgtttggaaaacggtagttaagtttcttggtatcacagtagtacttcttattatccaaagctggaaggatgctgctgccagttagctggggtaggtactgcaactaaaaatgcaaaacacagaattaggttcaaaactgtgccatgcatttttttcattatttagaatatatcacaaaagaggtaattaagctttttagtatagaagtactttttttgcacacaatccaggacttgagagaggattaaatgtttcaatttcgtcttggcttttccttttaaatgtttatattaaaaaggaaaaacattcacattaaagaagatttagagaatatgaaaaggggaaaatctacatgttaacattattgggaagaaaacatagatttacaggagttgagagcttgctgagatcttagggatcatttaagccaatgccttgtcttatagcggagaaaactgataaacagagcacctaggcaatttgcctactcactctcttcccttagttaa

SEQ ID NO: 14521 - DNA, 1043 bp, Homo sapiens
tctctttcatttatttgtaatccttggttgtttgctcatttttaagagcacaggactaaaagactaactgcaaggtctagacataatgcgtgggatggtgggattgccaactatgattttcactgtagtgtcatctagctgggcagtttagccgggacatgtctgacatcaagatcttaatgaggccttttcacttgcattggtcagatttcacagagaagactcttcggtattccaccatgggatggtaaagatctggctgccaggattcagtaagaaaaggaggattctggctttcttatccatcatgtaaatgtcccctgttttgaggatggttcccctgtcatctactgtatcccgtattcttaacatagccaaaataaacagccacacacttactgaaatcatatcatatgtgcatttttaaagaataaataactttatattccatttgtataacattttattgtttgcgtattgcatagtgaaaagaacagagtcagaagactcatggtcaggctcaactactaacttgctgtgtaaattggatagatctcttaaccttgctaaacccttacttcctcatctgaaaaatagagataatacttattttacagaattgctaaatactgaatgagatacttatactgttttcctcttaagtaattagtcaaaataattatagagtttgctattgctaaccccttgttcatcatctcaatgctgttctcaataaatgcattaagacaacaggtaccaatgtaacactttaattttgaatattaacaatagcaaaagaaaaacaaactcaaaaatgaccctaccctttattatttttagaatactggcttttaaatacttattgatactatcccatcaggaattcaattcatttaaatattttttttcttcttcaacctactcaaaatgaatacctacatatgtgaaaaacccaagattacatgtgtaattactttatagtttcctctctggcatagtataagtaaaatacatatcatgggcaattaaatacttccccctgc

SEQ ID NO: 14522 - DNA, 1048 bp, Homo sapiens
tcacctcccagacggggtggcggtcgggcagagacactcctcagttcccagacggggtcgtggcggggcagaggcgctccccacatcccagacgatgggtggcggggcagaggcgctccccacatctcagacgatgggtggccgggcagagacgctcctcacttcccagacggggtggcggccgggcagaggctgcaatctcggcactttgggaggccaaggcaggcggctgggaggtgaaggttgtagcgagccgagatcacgccactgcactccagcctgggcaacattgagcactgagtgagcgagactcagtctgcaatcccggcacctcgggaggctgaggcgggcagatcactcgcggtcaggagctggagaccagcccggccaacaccgcgaaaccccgtctccaccaaaaaatacaaaaaccagtcaggcgtggcggcgcgcgcctgcaatcccaggcactcggcaggctgaggcaggagaatcaggcagggaggttgcagtgagcggagatggcggcagtacagtccagcctcggctcggcatcagagggagactgtggagagagagggagagggagagggagagggagaccgtggagagagagggagagggagaccgtggggagggagagggagagggagagggagagggagaggaagaggctaaaagaactttaataaatgatgtctttttatgtgtaagctctttgtaaaccctcttttttggagagggtaatatttttctatcagtaaaacatacttattaaaatgtgtggaaatcttaagtttgcgtcgcaatgaatttctccaaatggatgatgactcatgctccgtagccagactgagctacagaacattatgagcagctcagaagcccctcctgtgcctgcttcctgtcactgtctcctaagggtgattgctaccctgatttccaatatggcagattacttttgccagttttaaactttgtataaatggaattatacagtatgtctctatttgtctgacttcatttactcaacattgtaagtttcatttat

SEQ ID NO: 14523 - DNA, 1045 bp, Homo sapiens
cctacaatcattcaacttaaaattgactttacgatggtgcaaaatgaatatgcgttcagtagaaaccgtactttaaattttgaattttgacctattctgggctactggtatggagtacttttgtgatgctgggcagattaggttaggttaggtgtattaatgtatttcaacttatgtaaggataggttagttgtattaaatgcctttttgacttatgatattttcagcttatgatgatttatcagggtataaccccatcataagtcaaggagcatctgtattatgttttgtttttttatattctgtcttcaccctcacataaatcatatggccgtcagaaaatccgttgtgtgataagtgtgcaactagcattggatcccataaatgtaccaaagtacctactaagtcatgtgatgtgcaggctgttactgccactgttgccaggtcgtcctcctgtctcccaagagtttactttgggagtctgcatagattgatttctctgaggatgtaggtgttggagtctgagtcatcttaccacttagagcaaacttgagagtgtctgagacttgcccgaagaacttgttcaaacagattgctgattccccaccctgggttttggactcagaagttctgtattggggccaagaatttccatttcttaaaattcccaggtgaagttgatgttgctggtctgaggaccactatttgagaacccctgtcttagagaaagtggttaccaatgggaaaatctataggccccggggcctgaaataacttgtcttttggtgttgaccatacaaactttttaaaagaatactgactctgatagaatcctttctgtgcaatatcgtggaatacgtaactggtgtacacaaagaggtaagtgttctcaaacaagatgggtaagtcagtgaataggcacaattttagaaactttaaaagagttgaacctaaggaaatgacagagataatactctacctcttttaggaagttacaagggaattcatttcttggaaatgaaatttttaaaatgacttggctaat

SEQ ID NO: 14524 - DNA, 2439 bp, Homo sapiens
ttcacaacattaatgctgattcattaatttcagttcagtttataaataggtgggtaattagaatgactttgataactaaaatggctcaaacaatttttatttttataatattcatggttttttttatcttatcttgaataactttccttttggacatccaaacatgataaatttatgccaaagcagttttggggcatatgagacattgtatcttgattttactctaaagcaaatctaatacatcaacaaaaatacatttttggtctttgtctttaagaaaaattattatcagaatctgcacaacctttgaaaaaagtggaggaggaacaagaggcggatgaagaagatgtttcagaagaagaagctgaaagtaaagaaggaacaaacaaagactttccacagaatgccataagacaacgctctctgggtccatcattggccacagataaatcctagttaaattttatagttatcttaatattatgattttgataaaaacagaagattgatcattttgtttggtttgaagtgaactgtgacttttttgaatattgcagggttcagtctagattgtcattaaattgaagagtctacattcagaacataaaagcactaggtatacaagtttgaaatatgatttaagcacagtatgatggtttaaatagttctctaatttttgaaaaatcgtgccaagcaataagatttatgtatatttgtttaataataacctatttcaagtctgagttttgaaaatttacatttcccaagtattgcattattgaggtatttaagaagattattttagagaaaaatatttctcatttgatataatttttctctgtttcactgtgtgaaaaaaagaagatatttcccataaatgggaagtttgcccattgtctcaagaaatgtgtatttcagtgacaatttcgtggtctttttagaggtatattccaaaatttccttgtatttttaggttatgcaactaataaaaactaccttacattaattaattacagttttctacacatggtaatacaggatatgctactgatttaggaagtttttaagttcatggtattctcttgattccaacaaagtttgattttctcttgtatttttcttacttactatgggttacattttttatttttcaaattggatgataatttcttggaaacattttttatgttttagtaaacagtatttttttgttgtttcaaactgaagtttactgagagatccatcaaattgaacaatctgttgtaatttaaaattttggccacttttttcagattttacatcattcttgctgaacttcaacttgaaattgtttttttttttttttctttttggatgtgaaggtgaacattcctgatttttgtctgatgtgaaaaagccttggtattttacattttgaaaattcaaagaagcttaatataaaagtttgcattctactcaggaaaaagcatcttcttgtatatgtcttaaatgtatttttgtcctcatatacagaaagttcttaattgattttacagtctgtaatgcttgatgttttaaaataataacatttttatattttttaaaagacaaacttcatattatcctgtgttctttcctgactggtaatattgtgtgggatttcacaggtaaaagtcagtaggatggaacattttagtgtatttttactccttaaagagctagaatacatagttttcaccttaaaagaagggggaaaatcataaatacaatgaatcaactgaccattacgtagtagacaatttctgtaatgtccccttctttctaggctctgttgctgtgtgaatccattagatttacagtatcgtaatatacaagttttctttaaagccctctcctttagaatttaaaatattgtaccattgaagagtttggatgtgtaacttgtgatgccttagaaaaatatcctaagcacaaaataaacctttctaaccacttcattaaagctgaagaccagtatgatttctggttgctttttgaaggtatgctttattactttgtatttaacgatgttcagatgagtagttgtgtgttcctatatatgtacttgatatgtgtaatcaaaagactgccttctttttctattgagatgtttaaggacagtaatgctcattaatcaagcattttttttttttagtgttctagtatatgtgacatggccaatttttttattagaaaatatgtgaccagaaagattctatagagtaaaaaatcaaagcaaaacaaaaaccacaaaaagacccctgtactatagaaaatgtaaagttggctgaacagatagggtcttgaaatttcaggaaacatataatctcacggttcttaaagattgtcactgtagacatctgagtaattaattttcagttagtaacaggcttatagaaactttgggattatttacaaatg

SEQ ID NO: 14525 - DNA, 1041 bp, Homo sapiens
aaatatcctaagagatcagtatttcttaaagtacactttgggagaatgttagtgtagtaacttctcctatgctatgctaccctaatcttgcatgggacttttctgtatggcaccttgtactttaaacttcctactctattgtaaaatcctgtcttcctgaagtacaccaaaataatcctattgatcactacattgacagcatattggtaatgtcttagagggagagcaaaggcaggatattttgggttccttggggctctggcttatggtgggtcttttcatttgggggcttatgcttagacaaatttgtggataggatctgaaagtgaatcttggccaggcacggtagctcacgcctgtaatcccagtgctttggaaggccaagtaatcccggcgcttttcgagaccagcctggccaacatggtgaaatccgtctctactaaaattacaaaaattagctagatgtggtggcacatgcctgtagtcctaactacttgggaggctaaggctggagaatcgcttgaacccaagaggcagaagttggagtgagccgagattgcaccactgcactccagcctgggcaacaagagtgaaactccatctgaaaggtaaaataaaataaaaataaagtgaatcttgagaagtagacattcattgctgtattctgagaaaggagtatatactttgatgagggtaagttcagtagtttagtgttcagataaatgattatgatatgttcagtagttgagtgttcagataaatgattatgactatgtcttgaaatgaacaaataaaattatttgcagatttaccttcctgggtaaatttcctagaatattaatgctatgtgaatgaagacagttgttgatattgacggtaaactgtgtgggtgcagatggtttcagcttttagtgtatccccttgtaacataatatgaaatatatatttggtctttgccccccagttcctgacacagagttcctaaaactcttgcaatttccttagtggtggggtgataggagtatctttttaaatcttatt

SEQ ID NO: 14526 - DNA, 1050 bp, Homo sapiens
tagatagggaactttctgattaagtggaggggccttgcaaagctctttaataacaatcctagaaaaattgggacccctgccactagagagatgtttgaattccacaggttggcaatatgacatcagataatattttttctaccatagagccatagctccctagcaaggaaaggcttagtctatcctgagaataagcaaacagtggacaggacatattaaaaactcactgcaggatgtacttgtatgaatccatttggaggtgcacaaagaggacctttgtggttttggggtttcatgggtgctaggagcttagcaaaagatgcctgtcttccatagtgaccagccagaacaccttgtttagcatttgtgttatccctttttgggatgaatttcaaccttgataataactaccaccttaggaagtattagagcacttaaaagttgttttaatctgccaatcttaattggatttcctgctgatgtcaaaatcctgtattgtagccaaagcattctaaaatcatggactacctgcaaaagcatatccgctataagtgtatatattaagctcctttattgctaaataaccaacaagctaagcaataggatttcataggaggtaagcccacttgcgagaaatgtgtgtttccagaaagcaacaaaggttgtataacatgggacaccttcaagactaccatcagaactgtagacttggttttagggacaccgttaaacttgatgatgcctcatactatacaacttgcaggctttataagggcagaaggttttaccagtagtaaagagaaagattgtagtaagccattggcatctagaaattcatatgggcttgagtcagaacattaaaagcttgttcagatctttcttgtacaaataggcacaatgaataggcacaatgatttatgatgagaaaacccagaatatgatgttggtgaagagcacaacttggctgttttatcacagaaatagccatgacagtatgtaaatgaatgagtgttgctatattacagtaatactttatttacaaaacaggtg

SEQ ID NO: 14527 - DNA, 1048 bp, Homo sapiens
catctgtcattaaaaaggcttgtgacttttgggtttccttcttagagcagtgcatgaatttaggttcagcagtgttaaaggatgagaaatttttttttagaatttagagcattatgagactattgtagaaattttaactaccaggacctacaggatggagagtgggggaggggagaagaccagaagagaggcaggaaaacagatgcctttgctgatgtcctttgtagtataaaacttaacagcaccacagcacctaatcattttctcaggtgtggctttgagaaataaacgttttatgttaaaaatgaaaatacttcacaatatgagacagctggcatttgaatacttttcccagtatgtttgtaaacattttggattcatatttcatattaaaatggacatttagtaggattattagatgaaaagggtcccccaggggatatctaatatcaaattatctgcaggacatcttctccagaaagcagactgactgtaatatgaactaattttcccccctttgagttgcttgcaagaatctctgagatctgacactgatgggctacagtaatcagcagttcttgcagtactcaagacattttaaggggcaggaaatctttcctatttccagtatctcctttttgggggcaacaagggtaagctgctagttttaagtacataatttgaacttagagatttaagatgctcctggctgtacaggaaaacgcctgaaaacagcatgggcctggatgaagacgctgcttttgaaagcaaaatgccagtgtgctaggtagcggtttttagttacaaattcttaaaaaaaattgttactgaactaggttagctgaattggggggggggtctttttgtagtttttggattttgtttccacatttaactatacttataaagcttttggctttctgaacttatgatgtaatagactgcgtagccttttgtggcagatgcttggaatgaaagtttcaaacataattgtttttgactgagctgtcaggttcagagttgagtgtaaatgagtcctgtctcacaa

SEQ ID NO: 14528 - DNA, 1033 bp, Homo sapiens
acaggaggtattcagtttgtgtatccttatgggtaaagcatagaaattttggctctcatttttgcaatttcaactttcttcttttaaagtaaaaaaaaaaaaaaaagttttaagtgtgtttacaatcctcaatagaatcctactgtaacacagtttgtggattcaggtatagcaattggtccttgtttgatgatcccctacctcctccccacccccaacgaggaaaaacaaacacagtttattaaaaagtcagtatgtttttaaacgtgtactcccagtactagagttataaaggctgtttgttgcacacattaaaattatgtatttttagaaagtctttgtatgattatatcattacacattttgggagtgtgtttatgtcgtgattgtgtataaaacaatggagagttaggagaggggaatgggaaagatttagtgaaggagttttatgagtagtgaaatttcagttataatgtatgttccccaaaacccaaacaggaaaaatgttatcgttggtctctgtggttaaacttttatacagagggtagttgagagggctttctgaattgcacattatcctgaggaagaggctttgggggcctttaaaagtaagtagaaacaagttaaagggataatttgagaggaacgaggaagtggaatactggacattgaattgcaaggaaaaagttagaaggataagtatttaaaacaaggctgaagtagagagaacttactgtttagaagtgtagattaaagaataaggtatttttagctgagaaaaaaggatcagaatgattagaatcaaggtgccctataagatctgtatacaaacttgaaataggactgctaattgatagttatcctggaaattttgcctgtctttgtgttgaatcactagtttggtgttaaataatgtgcagggactggatgcttataactgtatcccgtacactccaaaagccacttcccatttcaaagactggaaacattttttgtttaagtgctaatgattctacaaatatttaattagtcc

SEQ ID NO: 14529 - DNA, 1034 bp, Homo sapiens
tttgtcatgaaatataatatttgataaaatcattttagaattgtatctctaaatggtatgcctaagaatattgttctataggaccttaatagatatgccttgggggaaaaaagtattgtgtgcccaagtaagtttgagatatactgcattaaatataagaagttgcctgcaacacttctcagagcctttaacactttctgatttctaagagaggacatatatagggtacagtactttgcaaacctatttatccctgtaccacctagtaacatttttcaggaaaatgttttgagcacacaaatttgacctgttttaggaattcatacctttgacaatgttgaggaccttttttttctattataaagatgatgtgatattcacctatattactttttcccaattctctatctttaagatatttttccaatgtattatattcaaccctctgctcagtcccttccttctgctaagtaaagtggtggtttccatctgttgctacacatcagaaatacctagctctgaccctggagattctgtatgaatagaaatgccagaatacctgctcaggattctgtgttcattacaaacacccaggtgattctgatgcagccaaccctggtcctccaactgatgctttggaattgttgaaggaaaagcatgcgtgttttttttttttcaagatggatgagtagcttggggcatagtttgtggtcctagaacacatgggttaaccatccatcctagtgagaacgatagcacaggcctccaatgaccccatgaggtgatgtactggctataacctaacatgagatgattattattaagaaaagcagaatacttctaaatgggcttttagccaccttcctaataatgaagtaccgtatatatgattaccatttgttttagtttcgagtaattcccttgtaaatgatgttttatttattctttaagaagaatactagattatattttctaaatgtgccaagtatctaagaatatattctttcccctcctgctgataagagttatacatt

SEQ ID NO: 14530 - DNA, 1075 bp, Homo sapiens
tgtcacccacacacatgaaatggtaatcatcgctattaggttggtgcaaaagtaattgtggctttcgccattgaaagtagtatcaaagactacaattacttttgcaccaacctagatagttttttttgttttttgtttttgctttttgagacagagtctcactctgtcacccaggctggagtgtagtggcatgatctcagctcactgcaacctctgcctcctgggttcaagcgattctcctgcctcagcctgccgagtagctgggattactggcacgcaccaccacgcccggctaattttttatattttagtagcgacggggtttcaccatattggccaggctggtctcgaactcctgacctcaggtgatccgcgtcagcctcccatagtgctgggattacaggcgtgagccaccgcgcccagccttagatagctttttaatatgcatcttgattttatcttaagagtagccaaaatctagccaatttccaggactaggtgcctataggctgaacatttgagcactaagctgttgcttatggtttgtgagtcatagtcagcttgcttagataacctgaacattgaggaatgtgatttttttttaactttaaaaaaattgagttataatttacatactgcaaagtatagaaaccttatgtgtgcagctcaatgaatgtttacaattgtatacatccatgtaaccatcactgtttgagatataaaacatttccagcaccctagaaaggtcctttgtgacccctcctagtcaatatccttcacctaaagggtaaaaactattctgatctcttgtcaccaaagttttgcttgtttcttaacttcatgaagctgaagttatgtgatatattctcttctggcttcttttactcaacatttgtcctgtgaaatttattcatgtgaatccatgtgacaataattctttcttttacattgttgtgtgatattccattgtacgaatacacccaatctattcatctactgttgatggatagatattgagttttgggctattgtaaaactgttatgaacatgttatgtgtatgcacatgtagaaata

SEQ ID NO: 14531 - DNA, 1015 bp, Homo sapiens
cattgattttctttaggattttgttaatagagatgtccgaaagaagaaaaaactcacttgacactctaaaagcatttcttactaggtctgtacatcttgggtacagcctttggggacagagaaaggtgggggctgtgaggagagcccagggctctgatagggtggagtatgcagacagaggagctgtatttacactttcacttgctgcaggtatgccacagtgggctttttcccttatgaaaaataaagactgaacaacagaagtgctgttctctgtagctatctgtgatttaaaaggagtacaggagaagctaagtccttagaactctagatgcagctgctccttggagatcttcttagtcgagaaagacttctgaatgttcctcagattatgccagtaacagaccctgttagtaaagaaggaaacactggatctcctgggacttgtgccagcaacagcagcatctttaaaccacggatgaagggggccacttggagtttgcacactagtgctccactgacatcagtgtttctcagactgtggtccatggaccacttgctccaggagtattaatacctggaatgcctctttacaaagcggatcctgagctacccacgaactcagaatccctggcagtgactcaagaacgtgcattctgttacatgctatagtctgaggaccactacagtatttatgacagctagcttttcatactgccaaaggaaaggcacaaacaactcataaatattctcgctcttcttcccacagcccccagaagtggctgcctaggcatgaacatgtaactgaagggtgagaatctagccagcaactagacatgctacactgaggaagacgcagctgggctgtgactctgctcctgttttgttgagcccctgtgggaggactgcctccagttctcattctttaataagctggtcacattgtagatggcacttagaatgacagagggaattggagctgggtcagctccaatccacaaattgcaaataattt

SEQ ID NO: 14532 - DNA, 1038 bp, Homo sapiens
acgtatttctgatgtgaaacacctggaatgacagtaagaataatttcaacatatcagaacctaaacagttattatccttcaagttgattttattataatcttatattacatataattaatgttacatataatactattatatgcaacatttatttgaatatacagcttctgacatttatttaaattacttggttacaccctacatgtatgttacatggctactcttttcagtggcatttccataatatgaaagttaaggtttagatagataatgatttattgtatatcctttttaaagttattctttttagttaattgctctatgtgtattgagactaggaatcagaaagcttagattctagtcccaggtgtaagttgtgtaacccttggcaagtgtcaatctctaggcctcagctttctcatctataaaatgaggaagttgtcgtattctattttttttcttaagatgatacacttaaatgttcccttctgttgggttatataattgcatcaaaagtgtagtaatgttattaaaaaattgttagagatccaaactaaggtctctttcaactctcccattcttttttctgtgactttatggtaataatgaaactggtggttttcttttcttccccctcacagtatctcagagatgttaactgtcctttcaagattcaagatcgacaagaagctattgactggcttcttggtttagctgttagacttgaatatggagataatggtacgttttgtggggaatgtgtattttaaagagagaggaaagatgggaaagggagtgtgaaaatgtagggaactttgcagtttgttttgtctagtactattttacctttggtttattcttatcacaagttaaaagcacttttattgtctttcattggtgtttatatatttctgttagaatttggaaatggtgccctctggagaaggctaattgactgtcttctcacagagtaacactactttgataatatggtctgcaccttagcctttcaaattaaattgtttttagtgtcccag

SEQ ID NO: 14533 - DNA, 1028 bp, Homo sapiens
tcatggttttatctgatttggattctgttttctgcctgcactatgctaaatcctttgcaaagatgttctcattcaatcctgccaacaatcctagagacagctgctaatatctttttaaaaatatatatcatatgaagaaactgagactcaatgaggataatgtctaagatgacacagaaaatgacagagccaggattttaagcactataaccctgtggtccattgtttttcccacattaccctacttctgtttagttagtctttttaatgattcatagtctgcatttgttaagatggtcgaaaatgccaaatgagtaatggtgaatttggtcaaaaatatataaccccaaaatctctttgagaaatgaatctttctgtccccgatgctagataggccactcagttcataactatacttcaggaatcccagtaatctgaaagaggtctcttgtttctgagagaaatcataaacttcagaagatttattcctagtaatcgtgaaagtacagtggtgtggatcaggggagtggtacttaagataccagacttggaaattttataagagattaaaagcttttaactagaccttgtgcatgtaaactactttgtgataaatatcactctacccagaagagattaagccataacttaccatgctttttagatttttattattaaatgtcagttttaacaagactgttgtattcctaagttattaaaattttctatactgaatctgaatgttaacttggattttctcaatccagattgcatgccaaaagacaaaaatgtttttagtgaaatttagctatttcaaaggcttgttctttattccgacaattatgtaaattgccttggaactgttctatagtgatcatgtcagctttaatcataaagtaagtgagaggagagtcagacaatgcatagcgtatttgggatgcttttgttagacttcaaaacccaaggggataaagtataaatcaactacaacaaaatgctataaaattctagtcctgctgcacatttgt

SEQ ID NO: 14534 - DNA, 1034 bp, Homo sapiens
agcaacactgaagccagaggtgtctgagctttggctaatgtcacttgatgtaggtcagccctactgtgagcgtcaaccctggtttctaaatgtgctgctggaggaatcccacttcacttccagtttaagtgtcagctgaggcctcgcctgatcatttgattcagagtagccctagttctcacaacactatctgaattttctacatatcacatcacagactaatattgtttataccagtcttgtttcctcctaataaaatataagtgccatgaaagaacagaccttgtcttttcctagaacaggtcctgacacctcttagatcctcagtaaatctttgttacatgaatgcatttgagctttcactctcttgttctgaccttccccacattgtatttaaaacccaagggcttcacatcaggatctacaggtaagagaagaattagggaagcccagctgaccctcggattggatccacagcgatggcacggggattcaccagatctgtgtagaagaggaccttgcgctcagagccatccagcagggcgctctctatcttatccaggacactgtccgtccagtacattgttctgcggatgtggtctatggcaagtccttcagggcttatcagacctggaaataaagcaaagtcaggactggagtgtttgcaggatatggagggcaaacctgaagccctccaacggtcgggtgggcaggggggtcagcaggggaaagcaaagcccaagtgtctccaagtccccaagaaccaggttaatagagaaacaagtacttttgttacatattccactacctctagcttctagaccagcagacctaccagtttgatgacaaccggcatccacagtgccagagccaggctgaataaacgaaggcgtcaccctgaattcttaccatgaattcttttaagaagtgcgcacagtaggaatcacctatttcattccgtatgtatgaaggtgtttgcttacagagggggctagtcttatacagctcaataaaatgacttgcctagaacttaa

SEQ ID NO: 14535 - DNA, 1049 bp, Homo sapiens
aggatcgcactacttgaagagtaactgtaaagctacagtaatcaagagagtgtaatgctggggaaaagatagacatatagatcagtggagcaggatagagaatccagaattagacccacatatatatagtcaactgatttttttccccaaaagtgccaaggtaatttagtggggaaaagttttgtcaactaataattccaaaataattgaatattcgtatgggaaaaatgaacattgattgttacctcacaccatagaatgtacttgacatagatcatagacctaactgtaaaagctaaaatttgtagaagacagaagatgttttcttggaggaggcaaaggttttgcagtaaacaaaaaggcatgaaccaaaattgacaaatgagactttatcaaaatttaaaacttttgttttttgcaagacaaataagaggcaagccacagactgggaggaaatatttgcagcacatgtatctggcaaagtacgtttatccaaaacataaagaacttataactcaataagaaaatccagtaaaaatgaacaaaggatttgaacagatacttcacaaaaaagatatatgcatagccaagaaacacaagaagagatgctcaaggttattagttattaggaaaacaaaaattacactcacgttgaactaccactagacattgattagcaggactaaaatttaaaagactaaccacaccaactattggccaaaatgtggattaattggaactcctacactgatgataggaatgtgaagttttacaaccactttggaaaacagtttagcagttgttaaacataagcctgtcataaaatctagctgttacagaagccaggcgtggtggcacaggcctatggtcccagctactcaggaaactgaggcaggaggatcacttgagcccagcagctcaagaccagcctgggcagcatagcaagaccctgtctcaaaacaaaacttatggagaaaaatctagccattatagatatttacccaagagaaatgaaagcatatgttcctataaaaacttgaacatggatg

SEQ ID NO: 14536 - DNA, 1028 bp, Homo sapiens
gcattctcctaatttttttgttaccttgatagcttctttgtaagctcatgtgcctgtcttgccatcagagaggttgagatttctaaacacttaaacctagatcccctcttctttccaagtgatcacatccactttcgtgacatcatgccacttaaaaacagatgactcacacttatctccgatccttactcacccatactactctgagctggctctgtagattctgcactgatttgacatcttcatggtatctgatgcactcagattcaacatgatctttcttcctcctctcccaccctacacctatatgcatcaaaacctggttcttgaaccaggcacagttctgcctgtaatcccagcaacttgggaggctgaggtggcagcatcacttgagcccaggagttcgaggctgcagtaagcaatgtttgcgccactgtactccagcctggattacagagcaagatcccaactcaaaaacacacacacacacaacttggttctcctcttttgttccccatttccgtgactagtatttatatccaattatctatataattcagaaacgtgagtccttctcaatattctttctccctcattacgcacattcactgcatcaccaaatcctgttacctcctaacatctcttaagtccattcacttcttcccttcaaaatgcctggtccaggctactagcatgtattgactagtccatggcagttagccttctaattggtgtgtctgtataccctggcccccacaggcccattctccacagtgttgccagagttttttggaacaaaaatctattataaaagccccacccaaccaggcacggtggctcacacccgtaatcccagcactttgggaggccaaggcaggcagatcacgaggtcagcagtttgagaccagcctggccaatatggtgaaaccccatctctactaaaaaatacaaaaattagctgggtgtggtggcacacacctctagtctcagctactcgggaggctgaggcaggagaattgcttgaacct

SEQ ID NO: 14537 - DNA, 1040 bp, Homo sapiens
acattcacacatagcaatattaaccttaaatgtaaacgggctaaattacccaattaaaagacacagactggcaatttggataaagagtcaagacccattgatgtcctatattcaggagacccgtctcacctgcaaagacacatataggctaaaaataaagggatggaggaatatttaccaagcaaatggaaagcaaaaaaaagcaggggttgcaatcctagtctctgataaagcagactttaaaccaacaaagatcaaaaaggacaagggcattacataacgctaaagggatcaattaaacaagaagagctaacctaaatatatatgcacccaatacaggaacacccagattcataaagcaagttcttagagacctacaaagagacttagactcccacacaataatagtgggagactttaacaccccactgtccatattagacagattaacgaaacagaaaattaacaaggatattcaggacttgaactcagttctgaaccaagcagacctaatagacagctacagaattctccaccccaaatcaacgaaatatacattcttctcagcaccgcatcacacttattctaaaattgaccacgtaattggaagtaaaacattcctcagcaaatgcaaaagaacggaaatcataaacagtcactcagaccgcagtgcaatcaaattagaactcaggattaagaaactcactcaaaactgcacaactacatgaaaactgaacaacctgctcctgaatgacaactgggtaaataacaaaatgaaggcagaagtgaataagttctttgaaaccaatgagaataaacacacatcataccagaatctctgggacatagctaaagcagtgtttagagggaaatttatagcactaaatgcccacaggagaaagcaggaaagatctaaaattgacaccctaatgtcacaactaaaaagaactagagagaggccgaggcgggtggatcatgaagtcaggagtttgagaccagcctggccaacatagtgaaaccccgtctctactaaaaatata

SEQ ID NO: 14538 - DNA, 1020 bp, Homo sapiens
atacttctcaaaacagtaagagctatttatgacaaacccacagccaatatcatactgattgggcaaaagctggaagcacttcctttgaaactggcacaagacaaggatgtcctttctctcccctcctattcaacatagtattggaagttctggccaggacaatcagccaagatagaaaaataaaggacattcaaataggaagagaggaagccaaattgtatatgtttgcagatgacatgattgtatacttagaaaaccccattgtctcagcccaaaatctccttaagctgacaagcaacttcagcaaagtctcaggatacaaaatcaatgtgcaaaaatcacaagcattcctatacaccaataatagagaactcccatgtataattgctacaaagagaataaaatacctaggaatacaacctacaagggatgtgaaggacctcttcaaggagaactacaaaccactgctcaaggaaataagagaggatgcaaacaaatggaaaaacattgcatgctcatggatagaagaatcaatgtcgtgaaaatggccatactgcccaaagcaatatctagattaagtgctatccccatcaagctaccattgactttcttcacagaattagaacaaactattttaaatttcatatggaaccaaaaaagagcccatatagccaagacaatcctaagcaaaaagaacacagctggaggcatcatgctacctgacttcaaactatactacaaggctacagtaaccaaaacagcatggtacttataccaaaacagatatatagaccaatggaacagaacagagacatcagaaataacgacacatgtctacaaccatctgatctttgacaaacctgatgaaagcaagcaatggggaaaggattccctatttaataaatggtgttgggaaaactggctagccatatgcagaacactgaaactggaccccttccttacaccttatacaaaaattaactcacgatggattgaagacttaaacgtaagacctaaaac

SEQ ID NO: 14539 - DNA, 1066 bp, Homo sapiens
tcaatatattccttaaacttaaaaaactaaattatcttcaatgaaatgtttatagtaaactaatgaacagttcatagtaattagttatattttacagagatttttagtaacaaaagctcacaaatttttcttctcacccataaatttaatacttcactcctgaaaattttagttatttatactttttaaaaatacttctacatggtagcatgcacctgtagtcccagctactcagggggctgaggttggaggatcgcttgagcccaggaggccgaggcttcagtgagctatgatcatgccactacattccagcttggatgacagaacaagaccttgtttcaataaaaatgaaaataaaatataaaaaatacttttagttaagtcgggcatgtaaagttacctaacaatctgaaaaacaacacaaagtggagatgttaaactgctcagttattacattttactgaacagatcctttgatttcttaatacattttcttgggcatgttaattctgcagatcttgaacaactaataactagttgctgtgacatataggtggaacattaataaagcagtatttgtcaccttagaagatttatgaattgggagaattaagctataccatctaaagatccaaatgtacaaatatatcaaagaaaaccaggatccctatgagccttgaattaggagtcaggacatctgggttgatcctattcaatttcccgtgtgtgttccaggacagtctactttaatctctaaagctcaactttgttatccataaaactaagttactgaactaaatttctaaggtttctcttagtccaggagacttcagggacaacctcccagttatcttctcctagtggagtcttacagatagagcttagtctctcactaagaagttcacatgagctgtgttgttcggggtttttactgggggttggtcatataggcatggagcatccacatggctgactttactcagtccccagcctctccagaagtcaaactgatactatgtggcccaaggctgcaccgtaactcacattgttagcataaactatttgg

SEQ ID NO: 14540 - DNA, 1044 bp, Homo sapiens
aacccggggggcggaggttgcaataagccaaattcgtgccactgcactccagcctgggcgacagagtaagactcctcaaaaaaaaaaaaaaaaaaaaaaaaaaaaaagatacctggaaattaaacatctgctcctgagtgatctatgggtaaacagtgaaatcaaggcagaatcaaaatatttgttgaaacgagtgaaaatagataccaaaacctctgggatacagcaaaagcaggctgaaagggaagtttatagtgttaaatgtctacataaaaaagtcatttcagattaacactaatgttacacctcaaggaactggaaaaacaagaacaaacaaaacccaaagctagcagaaaagagatcagaactgaatgaaattgagaccaaacatgcacgcgtgcgcgcgcgcgcacacacacacacacacacacacacgatcaatgaaatgaaaagttgattcttggcaaagacaaacaaaattggtaggcaaacaaaagaagagagaggattcaaataagaacaatcagaaactataaagatctgattttatctttaaaatcaggtaaatttaaacttaggggtgcagtggctcaagcatgtaatcccagcactttgggaggctgaggcaggcggatcgcttgaacccaggagtttgagaccagcctgggcaacatagcaaaacaccatctctacaaaaaaaaaaaaaaaaaattagctgggcgtggtggcatgcacctgtaagtcccagctactgaggctgaggtgggaggatcgcttgagcctgggaggcagaggttgcagtgaactgagatcgtgccactgcgttccagcctgggtaacagaatgagaccctgtctcaaaaaaaagcaataaaggtaatattacaactgataccacagaaatacaaagtttatcagagaccactatgaacatctctatacaattctgattttttattatgtatatgtgacttgttttttcctttctgaaaataataggttattctttgattccagtgttctgaaatttcatagtgatgtatct

SEQ ID NO: 14541 - DNA, 1035 bp, Homo sapiens
tcaatctgaaaactattctctgcaaggtaccagtgacataccagtcactcaattaaatggtcttttcttaatcatttctgacgttttgcagaattttaacaacggctctactttcttgcttttaactctaaactactctgctgttttctatgactagtctgattcttatgtttctctcctctgcccatctcccttttctttactcttgtgctttctaattgtgactattaaatgtgaacatatcacaggttgactctcattctacactttttcccttaagtgtattctactgagtttcagctgtcacctctataggtgactgtaatttccttcttgcattccaaaactcacctattatctttatttctgcctagatgtaatacattttaaatataacaatacatttcgtgacctggcttttaagttttttgtcagtggtgccctcattctatcaattgtttagattcaaaacctgagaatatagtttagtcagctcaagttcaacagtcttttaactggaattctttgccccaccgtaatgcattttctacactgtcacttaagaaatcattcaaacgtagaatcatattacagagtttatagccagcccaattcttcagcattttatacaaagcctccatgatttgatgactgcttgcctccagcttcaacttctgctgtttcccacactatcccacacaccaccaccacacgaaaacactttctttgaccttaattcactgctcatttattcaaacactgtctgaaaacctactgtgaactaggcattatggtaggtattgggctctatatctgagtaagttatggtctttcttaagagagaaataaatatgtaaataaatgatatagattatgattaataatgcaaggataaaaagagttttctctctccctgagacacttaacctaacaatataaagaatgacattctagtaatgtctggaaggatgagttggaatttgttatctggccataaaacatagtctaagcaaagtaaaaatatgtacaaaggca

SEQ ID NO: 14542 - DNA, 1045 bp, Homo sapiens
gaagcttgtgcatgcatcacgaagttctcatgctatggttttcagctccatcaggtcatttaaggtcttctctacactgtttattctagttagccattcgcctgaccttttttcaaggttttttgctttcttgcattgggttagaacatgctcctttagctcggagaagtttgattactgaccttttgaagcctacttctgtcaactcgtcaaactcgttctccatccagttttgttccattgctggcaaggatctgctatcctttggaggagaagaggcagtctggtttttggaattttcagcttttgtgttctggtttctccccatttttgtggttttatttacctttggtctttgatgttggtgacctacagatggggttttggtgtggatgtcctttttgttgatgttgatgctattcctttctgtttattagttttccttctaacagtcaggcctctcaactgtaggtctgttggagtttgctagaggtccacttcagaacctatttgcctgggtatcaccaggggaggctgcagaacagcaaatattgctgcttggtccttcctctggatgcttcgtcccagaggggcacccgcctgtatgaggtgtctgtcggcccctactgggaggtgtctcccagtcaggctacacgggtcagggacccacttgaggaggcagtctgtccgttctcagagctcaaactccgtgctgggagaatcactgctctcttccgagctgttagacagggacatttaagtctgcagaagttgtctgctgccttttgttcagctatgccctgcccacagaggtggcgtctagcgaggcggtaggccttgctgagctgcggtgggctctgcccagttcgagcttcctggctggtttgtttacctattcaagcctcaacaatggtggatgcccctccccctgctgggctgcagtgttgcaggtggatctcagactgctgcgctagcattgagcaaggctctgtgggcgtgggacccaccaagccaggcacaggagggaatctcctggtctgccagt

SEQ ID NO: 14543 - DNA, 1113 bp, Homo sapiens
gaagtgattttcctgtaggcaacatatagttagatcatgttttttaatccattttgccactctgtatcttttaattagacagtttaatccatttacactaaatgttactattgatatgtcaggatttactgccatttttgcttcttttctaactcctctcttcctttcttccttttttactgtcttcttttgtggttaagtgatttctctggcagtatgttttaatctattgctttttatttttagtgtatctgttatagatttttgctttgtggttaccatgaggcttacaaaaaatattctgtagttaacaacaagttacttaagattgataacaactttgatcacaaaaagaagagaaaacaaagaacactgtacacattagctccattctcttccccacattttgaacgtttgatggcacaatttgcatttttatattgcctgtctcttggtaaattgtagtcattatttttaatacttctgtcttttagtcttcttagtaaatatataagtggtttatgcatcatgattataatattagtgtaacaatcatgttaacagtctttttcctgtggtttaaaaaaattccctttagcatttattgtaggacagctctggtgataaattcccagtttttgtttgtgaaagtctctctttcacttctaaataatagctttgctagatagagtattcttagaaggctttttttttttccatcagcactctgaatatatcatcccattcactcctggcccgtaatgtttctgctgagaagtctgctgccaggtgtattggatctttcctaaatgttatttgcatctttactcttgctgctttcaggatcttctctttgtctttcacctttgggagtttgattatatgtcttagagtatctttacttggactgactctgattggtgacctttgactttcctgtacctggatatttgtatctttctccaggtttgggaagttttctgttattatttcttcaaataaactttctacccctgtctttctcagttccctacctaactccaacaccccaaatatttgcttttttatgttggcccacagattcataagctttcttcatttcttttttttctt

SEQ ID NO: 14544 - DNA, 1051 bp, Homo sapiens
ttctagaatttaaaaatatagtatttaaaataaatgtcactagttgtgcttaacagcagcatattggagatgaaggaagagtcagttcacttaaagataaatcaataaaaagtatccaatctaaagaacagaggaaagtggggaaagcctgtaataaaacagacagaagctcaggagtctaattatgtgtaattatcatccccaaagggaaagaggaagaacatgaagttggaaaaaatatttgaaaaaataatgacctaaactttccaattttggtgaaagacataaattataaatttatgtctttcaagcttagcaaacccaatcaggataaatatgaagaaaattttgtctagggtcattacagttaaagtgctgcaaactaaaaagaataagaaaatcttgaaaacagagaaaaataaattatagaattacataaagggacatcaatgtaaatgatgactcacttctcatcagaaataatgaaggccagaagacacggaaacggtattttttaaatgccaaaagaaaaaagctgtcaactctgaaatacaaatccagtgaagatattattaaagaacagtggagaaataaaaacatttccagaaaaaagaaaactaaggggattacttaccagcatacctaacactgtaagaaatgccaagaaaattctacagactgaaaagaaataaaaccagcttgaatttcagctcttcaagaaggaatgaagaacatgagaaatagtaaatatgtgggtaaatatgatttttaacttctttaaaatatgattatgcaaaacaaaaatcacgtaatattgtgaggtttacatatgtatacgtaatatataattctctgtgtattatatataacaaccatagcataaaggagaggttgtaaatggatctatacagttgcaaagttctaacatttatatcaaatgataggatattaactactatctagactgtgagaagttaaggatatattttataatccctagagcaatggttctcaaattttttggcctcaagaccccatcacactcctaaaa

SEQ ID NO: 14545 - DNA, 1029 bp, Homo sapiens
atcaataggggactaacaagcactctgtaatagaatctaaaagaatgaaagcaaatagcataggaactctatttctattctaattttgtatcagaaattaagtgtatcaaatgaactaatgcttctattttccattcttttctcattatgactaaactacctctttgattaacatcaattaaagttcagatcttttgccaacttgtttattcatatattacaaggcaaccttggcagaacaaaatctttctccagctgctatttggcaagttggcaaaaaaaaaaaaaaaacttacacatattaaacacaagcagttctaggaataggaattgaaaagcaagataatcaagagtttatttcaacaggtactcagtgctttgtaggagtgcattgcaagaggtgaccatattgtatgtacatgaatagcttgtcgtgacaaatgtgtagaatactaaagatgatgatttttatttgttttagggtatgtctctgtgccagactgtcgtcgtgggctctgtagtcattcttctgtactcttccagagcttgttataatttggtggtggtcaccatatctcaggatacattagaaagtccatttaattatggctgggataatctttcagataaggtaaatacctaccacgtattgccagtctaacaatgtgataattaacttaccctcatctagaagaacactgtagtgtttgacttacaaacacatttatggaatctctgtctactgtcagtaatcatacttaaagctttgtgtttaaaaatctttatgtacgtgtgacatttgaaatcattcttcacagagaacttctctcaaaggagtattttctctctcttttttggtaaataataatagtgccacaagcctctcggtcatatgctaattttacttatttttgttaatgatgatgtttaaatatttctagataaatgaattccctattattagccagtgaatatggtctttgttaggaggaaagtaactctcccctacccaagaactacatatactct

SEQ ID NO: 14546 - DNA, 1026 bp, Homo sapiens
acctgcttttcatctgtaagacagggataatagaacctatttcagaggtttgttgtgagaaatgaatgtatatgtgtgtctgcatacatacatacatacatacatagatgtcttagaatagagctgagtacataaggactacattgttgtcatctgacaatcaagttctaccagttctgagtggcatttattcattcttttgtaacatactgcgatatagaatccaggatattagataaaagtcattaaatttgtagaaaagcattttgttatttgacaaagaacatatttcaatgtatttgagtgctaactttattacaaaattcattgaaaatgctaaaaattcaaatgtgacttcttatatcctgatcatagtcctatggtctttttgccttttttttgttgcagtttaccaaattcgcaaagtttgggctggtatggcaccatgactgggtgtggcagcagcagttacacagtcactccccacctgaatggacctatgacagatactgctcctttgctctttacttgtagtaatttagatttgaacaatcatcatagcttatatgtgacaccacaaaactgacagcatcaccaagtcatgattcttgagttgtttttcataaatgtgtatattcaatgtgtttaaattccatctacataaacattccattatctgttgcaactgaaaacaaaatctggaagtgtggctgtgtttggtaaataacacagctattatttttgacctcttcatagtaaaatgaagtaaaatggaaagtttggagtaggagaaaagagagattagatcttaaggcacttgatggcctccaaaaatcctgactttggaacatcaaatgcatatgtgcacttttatctttgttctgagtcactgcagtccccaaagtcatatgccaatgttcacactgaaatactgtattgtacaccaaactggaaggcaattttcctatgaaaatcaaagccggtatattcattggtatgctctatacagatatcttaataaaaatt

SEQ ID NO: 14547 - DNA, 1044 bp, Homo sapiens
atttaaattggactttcagatcttcaatttctctagtctctacttttcttccttgaatcagtcttgagagcagaacatactgttctttaaaagctgccgtggcaaaatgccaacagataaaaattgtatataccttttctcttggtatgttgtcaaatccatcccccattttagaattattttgtgttgtattttcaaatgcaaactagtatagatcttttgagttgtgttttttgtttatatgttcatttgacttaactgatttttttgtggtataatttttcattgaggtataattacattaaaaaaatgtagattcttaagtgtacatttcaaatatgtttggacaagttatatatctgtgtaaccatcaccccaatcaagtgtgtggtttatttaaaaaacattatttgaaattttttagatttaagagatcttaaatctacctggagcaaaacctcttaatataaatggttttacctagcatggaagtctaggtctattaagaattatgatgtgtacacctaactaaggtgatatttgacttagagtatttgaaagtacattaaaaatcttgactaactttttaagaaagatttaacttcttttctaggtgatagaattacctcttacaaacccagagttatttcagcgtgtaggaataatacctccaaaaggctgtttgttatatggaccaccaggttggtattgaattatttctactccaccaataagataaatgaattaaggaattaaaaaaaaaaagacaatttttttatttttatttttttgagacacggtctcactctgttgcccaggctgtagtgcagtggcacaatctgggctaactgcaacctctgccttccgggctcaagtgattctcccacctcagtctcccacgtagctgggactgcaggcgtgcatcaccatgtctggttaatttttgtatgttttgtagagaagcaattttgccatattgctcaggctatctcaaactcctggactcaagcgatctgcccaccttagcctcccaaaatgttggga

SEQ ID NO: 14548 - DNA, 1032 bp, Homo sapiens
acagcctaaaaattgcccatcaatggatgaatggataaagaaaatgtggtagccgggtgcagtggctcatacctgtagtgccaacactttgggaggccgaggcgggcggatcacctgaggtcgggagttcgagaccagcctgaccaacatggagaaaccccgtctctgctgaaaatacaaaattagctgggtgtagtagttcatgcctgtaatcccagctactcgggaggcagaggcaggagaatcacttgaacctgggaggcagaggttgcagtgagctgagatcatgccattgcactccagcctgggcaacaagagtgaaactccatctcaaaaaaaaaagaaaaagaaatgtggtaaatacacacattggaatactattcagccttaaaaaaggaaactctgtcatttgtgacaatatggatgaatctagaggatgttatactaagtgaaataagccagacacagaaagacagttaccacataatctcattttcatgtggaatcttaaaaaattgaactcgtagaaaccaagagtagaatggtggttaccagaagttgtggtggtgtatggggataggggagatgttggtcaaaggatataaagttcacttagacaggaggaataagttctaggtgacatattgcatagcatggtgactataattaataatgtattagctatttcaaaattgctaaaagtagattttaaatgttctaaccacaaagtaatgctaagcatgtgaggtgatggatatgttgatttgcctgatttaatcattcttcaatatatacatgtatcataatttaacccataaatatacaatttatttgtcaatttaaaatagattttaaaaattataacattttgattaaaattttaatgttgacagcagaagtactttggaattttttttttttttttttttttgagacagagtcttgctctgtcacccaggctggagtgcagtggcgagattataagctcactgcaacccccacctcccggattcaagcgattctcctgcctca

SEQ ID NO: 14549 - DNA, 1199 bp, Homo sapiens
gtaagtgtaactcagttgtttctgcttcctgtggtggctcatttcctgtttttaaattagtttttgattgtgagcttgttgggactttatctgtgtgaattatttctgatctaggtttaaggtgtgtttttctagagaatatgcatttgcttcttccaggaatccagggatgcaatctacccaggaccacttacattaaattctcacttggcctcacaaaagtaactgaattctaaccccaaacttgagtggatgccagattgtggttaggaagaccccactccaccactaccaatacctacccagagccaaagctaggaaggacaagagtactcacttctgtgggatgagttgagtttttgtttttctttctttccctagtttatctttcactgaggatgttgcctttgggagttctagctttttggtcttgatctgagttcgactttgagcagatcatagactttgtcttatgtttacaagtacgtttccacttaaaataaggccgtagtgaagatgtagaacaactagaagtcccatacattgctggtgggagtgtacagtggttttacaaaacttttggcagtatctagtaaagccaaacataggcctaccctgtgtcaaaagacaaaattacaacaaatttagcttaaaaatctaactcacttttattagtggttcatgaatcaggcagtgtgtcatcaaaagatttagaaaaggcatttcagtgtgctgagcagaggaagttgaatttataggcaaaatctagctaaataaagcagaaatgaaacaaaaagtggattggtcatttcaaagttagtttctttatagtattaaaacacaggggacttccttatgctggctcaggataactggcctccttctgattgattgctatgaatcttttgattttttttttttttttgagatggagtttcactgatgttgcctaggctggagtgcaatgccacgatctcagctcactgcaacctccgcttccaggttcaagcgattctcctgcctcagcctcccaagtagctgggattacaggctcccgccaccatgcctggctaatttttgtatttttagtagagatggagtttcaccatgttggccaggctggtctcaaattcctaacctcaggtgatccacccgcctcagcctcccaaagtgctgggattacaggtgtgagccaccgc

SEQ ID NO: 14550 - DNA, 1048 bp, Homo sapiens
tttaaaaaatctttatagagatataatttacattccatgaggtttactcacttaaagtgtacaattcagtgtcttacaatatatttagagttgtatagccatcagcacaatctaatttagggcattttcatcactctgagaagaaatcttacgctcattagcagtccctccccattccctgcctaccctccaccccagtctgtttctttttatctgcttttatttactctgggttttaaatcatgttgtctttttgtacacttttaaaaataggagtgtcaaacattgcatatgaaaacccagtaaaggtaatttcagattccttacaatggcatcttactctagagaggatttctggtgtgcagctagctatggcactagcaatcaaagcagttcaccacactctaatcaggactgaatgattcgaatttggttttcagttcctttgaggactggtctagttatagttcagttaccctagaacgtagctctttggtatcattcacgtaaatctgttatacttgccagggtctttctgcctgtggaccatgaatccttctggcttatgagtttactgaagttgtggagggggaaaaattccctctaccttattacattaagtaattgggggcatgtgaattaaactgacaagacaggtttgcaaggaaaaaagttcatttatgtgtgcaatgtggatgcagacaggagtgctcaatgatgagtaactcagaggggagattagaatttgatgttgatatatctaacttaggaggggaaagggagtagggagaaaaggttcctatgggaagaacaaataggttcctttaagaaagacaaatgggtttttagaacaaatgagagataagaaaacttctgatgcttatttatgcagactggtctgtcttcttcagggccacgaaaatccctggagaagggatttatggtgggattacttttgatctctctcctaggaatagacaacttgaagagaaaatttatagcagttcttatttctcagaaaattctgcttttagtcagattataagag

SEQ ID NO: 14551 - DNA, 1010 bp, Homo sapiens
acttttacactgttggtgggactgtaaactagttcaaacattgggaagtcagtgtggcaattcctcagggatctagaactagaaataccatttgaccccgccatccctttactgggtatatacccaaaggattataaatcatgctgctataaagacgcatgcatacacacgtatgtttatagcggcactattcacaatagcaaagacttggatccaacccaaatgtccaacaacgatagactggattaagaaaacgtggcacatatacaccatggaatactatgcagccataaaaagtgatgagttcatgtcttttttagggacatgaggatgaagctggaaaccatcattctcagcaaactatcgcaaggacaaaaaaccaaacactgcatgttctcactcagaggtgggaattgaacaatgagaacccatggacacaggaaggggaacatcacacaccagggcctgttgtcgggtggggggagcggggagggatagctttaggagatacacctaatgtaaatgatgagttaatgggtgcagcacaccaacatgtcacatgtatacacatgtaacaaacctgcacgttgtgcacatgtactgtaaaacttaaagtatataaaaaaaaaaaactattgcacagttcacatgccagccatttaacattggtttactctctacttggggatgacatctagaatcttaaaagcgaagctaggcaattggaaagaatgagacttgggctgcctggttcaggggctcttgtttcttcctgccaaaacctcttctctccttttctgctaataaccctcccactctcctgtcttcctgcacggcctctccttggccatgtgtggattcctagccccaacccctctggaatctggagtctccctttaggtagagaatgaatggaacagtgatctgcctgaagtatctcagaggggcacccacacactgctgcaggtgcagccgaggctgttcatgttcttcctgaagcctgattgttc

SEQ ID NO: 14552 - DNA, 1017 bp, Homo sapiens
tatatgagaacaacaagaataggttgtaagtatttagtaggtttggattctttctgcaagccttataggaaagattggtggtatattgccaccgcgcagatgaggaatgaattaggggaacacttattcttcaaaacagaatgctttgcctccgaccagttacttatgaggctactagttacattgtttcttgctaagtattctgctaattgactacagcatatttttaactgtttaaaatttttttaatttgaaaactcatttaagaattaattgaggctagcatatgctttcatttgggatatttcaaggttaattatctgactcatggagaataaattgcaacattcttttttatacacccagtgtttgtactatattttattctgaagagctgaaaacacatctatatctgttaccccatttaaagcagagaggtaggcattccctttgagcagtctagaaatgctcgtattttagaaaactaggtttcaaaataacagggacacatttgagaaatggttaatgaaaatcaggaattaatactttgagatcacaatgcacaatcaggagcaaagcgtaggcttggccagagacagatacaaatgggattgcagctgtagtttttgtgtctttcatttatactaggatcacatttctacttctggtatcccttaaatccccttgctttatagacgtaattttgcagcaccatctcacctccatttctccaggcttaatgtgcctgtgggccctgttttgtagaagtcaccagttagcatctgcccctctagctatgtacaaatagtttttagaagatgttcttgacttccaaatacgattcaaatagcattcaatttgaaatggttgctgaataatataaacaattgaaagaaaaacctaaaatcgaacttgatggggagcaaaatgatgtgtaaaagtaggtctaatggcactttaaaaacaagtcaacaaaggtaagaagatgtcaactctttgttctgtgtccctctaccc

SEQ ID NO: 14553 - DNA, 1057 bp, Homo sapiens
agcctatactgttcattcagataaggtgtaaatatggggttaggacagcaggaagtgattaattttcttagatatttaacatggtcctttgaaggggatcagcttttgaatctttacgattatatttattgcaatggtgcttcccttctatgtttagacatgaaagtgaatgtcactgttgaacagtaaacacaggagaatgactatgtgacagaagtatgtaaagtattttgtaattcggtagagaatcaaagtcagcttcagttctttgcattctcagggattcagaaaggattagataacaatagttggaacctatgccagagagtaactgaaggatagcattccttgaacctcagaaacctgggtgaaaggaattgggcaattaaggtttttaggaagtctaatggggtcatttgtgaatgccatcttcatggaacttggcaaactgtcatctcagagatcaagggaggtcactgatgtgagggttggaggaatgaaagtggagtgactgtttcctgccaagtatgtttaaaggctcttgtctgaaggtagctacaggtttttttttgtttaatttggttttgttttcaacaatatcagggagctaaagatacatgtctttgtaaagtgagctctcctggttttccaccaaagttatattatatccaaagagcctatatttgttttcccctttatccaatgactaaacatttattaaatataaatgatgtgtcatgctgaagataaaagtacaatgtaaaaattttttttttacattagcttaaactttcaaatacattcaggctagtactgattcattaaaaatatgtatggggggatttcctgttactctgggtaggcatggaggaatttgattttttttttttttggagacggagtcttgctctgttgtcccggttgaagtgcgctggcacaatcttggctcactgcatctttgcctcctgggttcaagcaattctcctgactcagtctcccaagtagctgggattacaggcgcccaccatcacaccctgctaatttttgtattttagta

SEQ ID NO: 14554 - DNA, 1073 bp, Homo sapiens
ggctgtgtaaacacagatgttggttaagactaaaactaagtaactggggatggagagtgaaggcaggaaaacagagttaaattaatgctgtgattataaacagaacataatgttagtgaaaataaagatgctccacttaagcctatagtaaaccatcaattcaaaataaggtgtgcttgcaaaatcatttttggtttcttttttggaatatgggatatatttcctaaagataagaaattctaagatttctaagatgtggttaggtttataccaatctatttgagtaaaaaatgtagatagaaggcatattcattaacataaacaaatacaaggaagattactgttgtaaagacattaaataatatagaaaatatgtaatgccaacaagatatttaataatattaacttttattgtaggtccttgaatactagcaaatttaattacatggaaataaggacatgaatgaaaacttggagattataaagtgaatttctgggttcttttaaaagatataggactggatccttagcatatacaatgtagaagaagattaggagttttggttatgcaatgtatgtcaactgagtggcatggctgccaatatagttaatgtcttagactgtattagtagatatattatgcccactctggggaaagtggtaatcctactctattttgctctgatcaatctgtatgtggatacatggagtattgtagttagtattggacatgacacttagaagaggacaaagacaagctaaaggttgttcaaagttgataaattaagaatctgagattactggataaccagaaaatgtttagggtggatgtgaagggaataaaagatatgaaggtgtcttgtgcaggaagaattaaggatcctgtcctatacccctgaggtatgttccttctacactcagggttttgagggttttactgtgaagagatgctgaattttatcaaatgtgttttcagcatcaattgaaataatcatatgattttttgtccttcattctgttgatatgatgtatcacattgattgatttatacatgttgaaccatccttgcatct

SEQ ID NO: 14555 - DNA, 1051 bp, Homo sapiens
agcctgacaaacatggtgaaaccccgtctctactaaaaatacaaaattagctgggcgtggtgacacatgcttgtaatcccagctacttgagaggctgaggcaggagaatcacttgaacctgggaggcagaggttgcagtgagctgagatcgtgccattgcactccggcctggtgacagagcaagactccatctcaaaaaaaaaaaaaaaaaaaaagagggggggttattttaaagcagtattcattgcaaaaaaaaattttttgcaagaacagcaattgacttattttgaaattcagtaaaaggcattttgacttgtaatatgaggtttaattctagaccccttttgattcagacatatcaataggcacttcagatttatagattgtcatttggtattagtttggcttaagaaatttaatttcatattctccctcttgatggtatttaaatgtgtgatgttttctatgtgtgtgtgtctgtgtatcctggtctattggcagaagaactaaagagctgtggtatacaagacatatttgttttctgcaccagaggggaactgtcaaaatatagagtcccaaaccttctggatctctaccagcaatgtggaattatcacccatcatcatccaatcgcagatggagggactcctgacatagccagctgctgtgaaataatggaagagcttacaacctgccttaaaaattaccgaaaaaccttaatacagtacgttcttttctccatacactatgtgagaaatgtctcagtcaaaatgatttctggaattatggtagccctattcagttatcacctacttcatagtttgttgtaaggattaaaaggtaataatgcactaggaaagcactggcacaatgtctggtacagggtaagtagtcaaatacgtgctgttattacttttcaagagtagggacaataaatgagtagatttggaaattgttagaacaaggttacaagcttttcttttttatttctttcctttagtcttagacctttagttgcaattttgggaccctcctttcccctcatcaccat

SEQ ID NO: 14556 - DNA, 1061 bp, Homo sapiens
cctcccacctctgtggccataggctagaacctgctacaatgtcacatctggctcttgagcaggacccgcaatgaaaaacctaccagctgcaaggccttccttcctgcagtacagttccacaggtctgaaaatacactgaaaaactaagaagagctgatacattgtgagcaaaacacagggcacttgtgaggcagaaagtgtgaggaaatccatcaatctgcttttcaggcagaaatagtcacaaatagaaccagccttgcgaatgtttgaggcaaatgaaaagatagccagtaagtagccctcttagctatgcctgcacactagttgctaaccaacagtagtattactgaagtcatgaaaaattatttaaatgtgtggatgtacagcatgaatactgaaatattttaatttttaaaataccgatgcatatcatttattatctttctcctatggggaaatagaaggattttgataggagttatactcaacagagtaaaattcatttgtttaaactgtggaaaagtgggtatcattaaagatgtctatacagaacattaaaataatattgtaacaatatttgtgacatttaaaaaagttatttcatttgatgtgtagatagtttaaaaatctttttttcaccactgtacccaaactgcctgacatatagcagaagagggtgaataatctagagacctgatttaacttgaaaataaaccagaggctgcacgtggtggctcatgcttgtaatcccagtactctgggaggctgagacgggcggatccttgagtccaggagttcaagaccagcctggccaacatggcgaaacctcatctctactaaaaatacaaaaattagctgggcgtggtggcacatgcctgttagtgccggctactcaggaggcttaggctggaggattgcttaagtctgggaggttgaggctgcagtgagctgagatcatgccactgcactccagcctgggcaacagagtgagaccctgtctcaaaaaacaaaaacaaaaaaacacacatgctttttatttatatttaagatttttttttttt

SEQ ID NO: 14557 - DNA, 1096 bp, Homo sapiens
agaaaaatcattctgaaaggcaatccattgaaaatttgaggaggttaaattcttaagatcactaaatgttttacctttgatgtaatcggagtgcaattaagaaaaaacttaattctacttaaagtaattgtgtgttccctagtttatacaaaggagttggaatgagcttctttagatcttttcctgaaataacagcttttataaatatccatctgtttggtttctaatgtcccttattatagttacgtaaatacaggtcatagttttaaatataggttcttaaatcataaatacaagatataattcttgactgttctccgtgtattataaaatgatactcatctataggaggcagatatataaaattcggataataagattttttggataattaaatttattaaattgatagtcaagtgtgattagattagcagaatgtgatctccagggaagatctgtgagacctttaatgccttaccttagatttctgcctgcacagcaaatccatccagaactgaggtgggaggtggaggttatagagctagaaaaatcactaaaagaaacaaataactatttttttctagtgtatttttattccaaataaaccctgtattcttctgaatagtaaattactttattcatccattgttctgtctgtaagaattttgaaacttggtaggcagaaagaccccacccttttctctttccaagataactaaaagaaaaaggtaaatcagagctttccatgttttcagtgagaattatcataactcaccaagaaagcagatcatggcaaataaactgtgaccttcagggagatttttcaagcccctttttgtcctgtttgtattaagaataatgccttacctttgtatctgcatttttatataattccattccaaccaggtatagcactctgaagaagacattatctattctccattatataaaccaaatcaaactttcatctacattcactagctatgtaataaataccttctaggagccagatacttgttgagagtctgggctacaaagaatcaggcaagactcctgatgtcaggtatttgagcataaaaagagcattgatggctaa

SEQ ID NO: 14558 - DNA, 1031 bp, Homo sapiens
gaggtcatgtgatgatttggtttactttcggagtgtggggatcataaagagcatcaggagttgtcatagcatacctgagtctgtagtgtggctctctgcatatccggaaactagccaagaaccaggaagggggcaaaaagtccacttcgcaaccagagtagatagcatgaaagtccaagagaatatttcaggccctctctcagaatgtacttgctcttattctagacacaatcctaacatttaaaaaatttgacaaataatccgtagtgtattgggggtaacacatttagaatggggtgagggactgctgtaatcagtagtaaaaagtgacccctgacagcctgacaacttggaaagagacagaaaaactgtaactttagacaagaattggggcagaaactttgaaggcttgggaatattagggtgggaaccctcaattgaccttgtaggcaccactctataataacataaacaaataattgctatttactgttgttaacggtgaactatggaaataatacatttttagatacactctttaagaagagaaggaaatgttcaatatactttggaaatgtttacacccagaataattaacctctgagctgttttgatgtgtaaggctcttaccaattcagaaaactaggctgtgcagaatgactcattcattggattgctgagatttcctgtaccgaagtcatcttgtatcactttattttgtaatcatcaatttaaaaaaccctcacattttgtctagtgtttagagattttaaaacttggtaaatgggaaccaaattcatatatgggactcgatctcagtataataaaaaaaaattactagtaatagtatgaatatatctctcgttttatgcaggactgattttaaatagtgagatatcctgcgcattaaacatgatttatttgagatttgtgggatgtaatttggtgctttcattctcttaaatttattgagaatctagtgattcactggttcatcctttgcctcaggctcatggtcattggagattcca

SEQ ID NO: 14559 - DNA, 1019 bp, Homo sapiens
cccaactactcgggaggctgaggcaggagaattgcttgaaccgaggaggcggaggttgcagtaagccgagatcgcaccactgcactccagcctgggtgacagagcgagactccatcttaaaaaaataaaaaataaaaataaaagtcttcttgatttccagtgtattcctcctgcactttttggcctgtttggaccacagatttgtggctttttatgaaatacacctgtagattaattttcagtttttttatggtagtagacagtcaaaggctagatcactgtgatgagtagggcttccacatttaagaaaaagctgtaatgaagtgaattgaatcttgcttcttttgggtcacccaaaagcagtgataagtgctgagtgtgttaggcacttattaacaaaagtaactcagaattgctgtctaaacctccatatcttttttcttctctccgtgtagttctaaaaatgaccatatgatattccttgaatggtaagagcgtctattcttcttagcatgttctgtgtgtcacacactgtgcagacagcaacatacacacacaaacactatctcctgttattgaatggatgaatgatacaaagaagcagaacgagtggttgtgaaaattaaatgccgtatatttcaataattagataatgggctgacctctcagagtcaagcacactgtaagtgcttaatccctggtttctaagttatatgaatcccacaaagtagatactatctccattttccagatgaggaaacttaggtttagagtggttggaaatgtgcctaaggtcaccagcatctttctgatcccaaaacctatgttgaatccttgctattgcatgaatgctgaagatagattccagttcttaggtaaatgaaaatgttggcaattgaacaaaaaacatgtatttttaatggtagttttaataattcacagtaacattgtatatgtttcatcttggaaaaattcttttcagcttgtccatttaaatattcctcttacttatgacattt

SEQ ID NO: 14560 - DNA, 1665 bp, Homo sapiens
gcaattcaaatgtaactaggggtcctatagttgtatttgctgagtctggcaaccttgtcctgaattagcagtgccccgagaagcagcagggtggcctgtaggaggtgttcatctgttatgtggaatgaatggtgcctcttcagaattctgttgtgcagtcttctattagagaaaaccctttttatctgagcatggagttgggacattacctgtagttggatatgatctccttatccttctccctttgattgatctttttctttgagctgatttgagctttcttcttttctctgtagttggcggaatcagctcagttacattttttactaagttacccacattctgacactccttgacagttttaagatcttcttctaacacacttgaatagaatggatactggaatctattttgacagctgttgaaaatctattctgttgttacaggaggttaaggaggttatttgtaacactgggattatttaatgaaccttttgaaaaggtgtgcagactgttcaggcaaatagtattttttagaatttaaatgattttggttttcacagttaaattatcaaatgtaatgcttttaagaattatacacctagtaatatttttcattaattttctccaccagtgtagtaatagtacattacaatgttctcaattaccggtgccttctaaaatgcaggtgtagagtctttaaatacagctagtctattgccagctgtcccatagataaccttctctttaaaagtgacctttgagcaatttcataaagaataaatatttctagttttttgttgctgaactgctaaaagatggttctatacatgtaacaggtggctttagttgggttgctttcactgaaatttgattcaaataaagcattgcattattttacctttggaattataattatgtgccagactgacttcatttttggcacactgcatttcagtgttgaggtttgggttgaggatggagtgtcttgcatgtgcaggagtaggagagctttgcagataagacatagcagctgaggcataaaacatcagcgtcttttttatgcatcagaggaatttctatcagaggagttgctgttctactaggctttagatttagggacaactgttcagattaaccccttagacttgaattttctttgatctcaaatccaaagcattaaagaagactctgtcaagttaaccatcagtacagtgcttaacacacagtaggcacacaaaataaaatttgttcaatggaataaactagacaattatgtttgggttattatttaatattaaatgtgatttaattacttgaaatagacgatctttcagttcctgccctttaccgcattgcttggcaacacaattgttaacatgttttctgattaaaataaatgttcttacctaagtttatgctagattatagcataaagatttagaagcattaaatggatgaaatagaatttgacacgtaggctatttctgagaaatctattttattaagtatactttctcttgtgcctgaaaaaatttatcaaattgtccaaatcaggttctagcaaagcaggtagaagagtttttaaaaagacaatgttcttagaagaattatatttctattgtagaaagatttaaaaaagaaaaagttacataaataacaccta

SEQ ID NO: 14561 - DNA, 1065 bp, Homo sapiens
cagtactatgttgaatagaagtggtgaaagtgggtatcctcgtcatgttccagttctcaaggggaatgcttcagcttttctccattcagtataatgttggctgtggcttctatgccaattttgctgagggttttaatcataaagggatgctggattttgtcaaatgctgtttctgcatctattgagatgatcatgtgatttttgtttttaattctgcttatgtggtatatcacatttatggacttacatatgttaaatcatccctgcatccctgatatgaaacccgcttgattatggtagattatctttttgatatgctgttggatttggttcgctagtattttgttgaggatttttgcgtctatgttcatcagggatattggtctgtagttttctttttttgttatgcctttccctggttttagtattagggtgatactggcttcatagaatgattagggaggattccctctttctctatcttttggaatagtgtcaataggattggtaccaattctttgaatgcctgatagaattcagctgtgaacctgtctcgtcctggactttttttttgttggcaatttttaaaattaccatttcaatctcgctgcttgttattggtctgttcagagattctgtgtcttcctggtttaatctaggagggttgtatgtttccaggaatttatctgtctcctctaggttttctagtttaagcctgtaaaggtgttcataaccttgaatagtcttttattatttctgtggtatcagttgtattatctcctgtttcatttctaattgagcttatttggatcctctctcttcttggttaatctcgctaatggtctatcaattttatttatcttttcaaagaaccagctttttgtttcatttatcttttgtattttttttttgttgttgttttaattttatttagttctgctctgatatttgttatttctttttttctgctgggtttgggtttggattgttcttgtttctccagttccatgaggtgtgcccttagattgtccatttgtgctctttcagactttttgatgtaggcat

SEQ ID NO: 14562 - DNA, 1617 bp, Homo sapiens
catctctgtttcctggtagttgcctcccctttcttccatgtggattagctctttttttctttatttcaactatcctgctcttgtgattattttgagccattttaaatccattatggaagtaggtagagtccagattataaataaaatggtatcacttatattattgtcacagtcacattattggttcatctttggtgttagtctcctgcttccttctgaacttctcctttgtcctttttgattcattcatattgggtggggatgaaaaacaagaatgagtctcaacagaaacccagcgacattttaaagcctaaagttttgatgcctattgtacaaatatttttatcttcatgtaaatcaaagggccatcacctggcttaggaatggcaggattagagtaattagtggaatttgttgcggttaaacagtggactccatagccagggcctcccgtggaggctccaatgttggaatttataaagtgtgttttatttgaatcttgtgtctgtgtgtaaagaattgctgttttaggcagaaaccaaggctgatgacttggagagaatactctaacccctcagacactcttacatcactatcctaagaactaataatgggtattagagttgtaaaactacagtctggctagactgacttaaagactttggggtgagttgatggtgctaagtccttagagaaagaagaaaactccgaaggcatctggcaaccatgttggagagaaaattgagggaagcaatgtagaaacaaaggagaaagcaggacagaaacagcagggtcctgggatccgcctggtaccagagacttctttttttctctcacttgggctagacccagagacaggcttctggtttagaagaggaatgtgggactggctggccatggattagataactgtggaatcaatgcccttttacttgggacatctttccaagtctggattatttccttaggattaactgggaaatcactgtacaaagaagaagcatatcaatagactgcttccttattttcaacccagaataatgcatttttccattgctagaggactgctttaaaatacacacacacacacacacacacacacacacacacacacacacacacacacacgaaacaccaggatagcacagacagtggctttcagggatgaagatacttcctttcctgtctgttctagtctcttctggttgcgtggaacagaaactagtacaagctagcttaaggagatgaagctttattgcaagaatataaaatgttcttgtgggaatgacatgagtagccccatggacagaaaccttctcagccctgttggggctagaattgggaagctttggagacttaagacattcaccttcgggacatcacacaccggggcctgttgtggggtggggggagtggggagggatagcattaggagatatacctaatgtaaatgatgagttaatgggtgcagcacaccaacacggcacatgtatacatatgtaacaaacctgcacgttgtgcacatgtaccctagaacttaaagtataattaaaaaaaaaaaagacattcgccttcttacattctctctcagttcatgcctgtcaggctaaatgtctg

SEQ ID NO: 14563 - DNA, 1034 bp, Homo sapiens
gtggtgtttcaaggtgctggaatccaccaccaagaatggtggcttcccacaatgccttttaacaagaatgtgtctcttcaatgcacgttgtaactttctctttgaatttattgaagaaccacaaattaagtctgtgtctttattgaagcaattcaggtgatgggaagaggctcttgaatcaagaaagaaaggaagaaccaggagtggtgatattaggtaaggggagatttaggatcactcttccgcaatacaaaatgaacttcctgtgctaagaaaacttacagccctgaataaggagttgatggcatgtctatgcaacgtacaattttattcctgggacgtcgttggaaaaccattatattagatgatcttcaatcttttgtagttctgaaaatttatgaacgcttatacatgttgcttataaatcctaaatgaaaaaagggctccctgtcttaaatttatgttctatctaatatgcacttttaaagtttgagtttttattgcacttctgatctttttaaaattataaaacctatcatacatacaaaagagtatataacacttattaatatgtatagttaaagattaataagatgaatgcccctgtgcctaccacccagcctaaaaaacagaacattaccagtgtctttgaagctgtctctgttaatgtgcatttctagactgctttaacttattggatttgtgcattgcagtgttttatttgtgagcagttatatcagtgaataccaagtgagagtggctcagccatttttaccttatgctcaaactcctttcagatttccaatctgtctgatattggatttaagaacagttaaatcttactgcttggaaactgatctttaacaagctagttttcctgctttaaaataatagtgttgttcgtgatgttaatttccctgtttcacttgacaattacagcgggggtagcttccctgagcacaggatgaggatcagtcagcttgagtatctggtacagaaggcaagctccctgtgcaccaaaaatctactcaggc

SEQ ID NO: 14564 - DNA, 1048 bp, Homo sapiens
acttgagtaagatggcttctggtgcaactcagattaaaattggcatggagctatatggtattgctgatgtactttatttccagtggtgtgctggagccgcctcccaccagctcccgtgagctgatcatgcacagctttttccaactatgctttcaccttggtagtctgaaatcagccatgttaggagtatttacaccaaggaaattggcatatgctacaaatccatccctctgccccatgagaaccagttgttaaaatatttactactgcttaaaaaccaagagataataaatttacagttcttagatttttcagcagtatctactgagaagcaatcacaaaggaaatatcaggtaaggtctttgactttgagaaatcacaggtttagccaaaccatctccatctaagcatttatcaaatttctctttaaacttgaaaatcaactgaagaatttaagtcaagtttagaatagataaatatgtctttgagtatattttacaatgtctgtttgatttagtagatccttctggggacaggtctttctagagtttggagagttaccaagttactaaggtgtatttcctcagggctgcttcttgcttgttctcagagaagttggccaatcactgacaaaatgcatttcttttcccccttttcctgtcgtttgttttatttttaagctagcacttgtattttggaaaaattatttactcaaagatatcttgggcaggaaagaaaaatgttttacttcagttatttattggatctctataaagcaatatgatttctcctaaggctaactatatagtaggactagcatcataaaaaagtcatgtctttaaaaatgccaaaaatttgattttttgtatagaaagaaaaaaagagcccctttattaatcaaatatatgtccctttaaaaatgttttgagggtaaatttatagaatcatttccaatgtgtagacaactgccatcaaatgcattcttaacaatgatttaaaatagaatgaactgtaagtgggaaaattgctaaggatgataatctcctga

SEQ ID NO: 14565 - DNA, 1261 bp, Homo sapiens
tagatccaggagccgggcgcagtggctcacgcctgtaatcccagcactttgggaggctgaggcaggcggatcacctgaggtcgggagttcgagaccagcccgaccaacatggaaaaaccccgtctctactaaaaatacaaaaaaaaaaattagccgggcatggtggcgcatacctgtaatctcagctactcgggaggctgaggcaggagaatcccttgaatctgggaggtggaggttgtgatgagccaagatcatgccattgcactccagcctgggcaataagagcgaaattcagtctcaaaaaacaaaaacaaacaaacaaacaaaaagaatatagatcgggagtcagaatgcttgtgtacaaattcaagccttgcttcttactacttttgtggtattgggcaacttatttcaccaccattttatcatctgtaaatggggataataatatttgcctcataggtttgttttggtgaggaacaacttaagttttggtgaggaacaaacataggtttgttttggtgaggaaaggagttaatacatggaaagtgcttaaaatagtgtttggcatataataaatggcaataaatattaaatattaacatgtaatgttaaataatacttaatattattactaatattaccaaggaagctagttttgtggtggacgtggaaaaacgaacacaaatcagacaggcagaattggttagagtcttaccctttaactttccttactgtagaattcactctccactaacctatggtttccatttgttattcttcattgtttcagtggattttccaactgtgtcactctgtctagattgttctttaatgattacatttagagttgactattccttgttgacatatggagagacgctttgatctgaaaccatcaaaggcttctctctccatgtcacatctttggagaggcttctggtcatggtatgtggacccatgtcagcttctctttctaggtcaccaccttttttggcctttaccccttgagtttgaactttgacttatttagtagtggcaagagaagccccatggctcttgatataccaagtaccaacctgtctgccagatactgaaagatgccgagatacttacacagttgttctttaaaataataagctgcacaaataatagtaaagctgattctgaaactagtttttttgtttgtttgattgtatgttttttgagatggagtctcactgtgttgcccaggctggagggcagtggcgcgatctcggct

SEQ ID NO: 14566 - DNA, 1034 bp, Homo sapiens
acccagcctgacatacattattgatttactcattttttcattcacctagaaaatgtttattgagtgcctactgttgtgtcttccctgctcaaggcacttgagatgtatcagtggataagacaaagctgccttcccttggggcactggcagtctagtgtgtacaaattgtagtatataaataaagtatatgtgtggtagaagatgataggtgatgtggaaataagaacaagggtaggatcaggcctatgtaatgaggtgactagaccatgaaacagggtggtcagggtagacccctttgagaaagtggggtgtgagcagagagttgaaggagtggaagttagccaagtgggcatctggagcaaagagtattccaagcagagataaagctggagcaaagatcccaagacaaaacagtgcctgacttgctagggggaaaaacaggaaggcagacttgctaggggaaaaagcaagaaggctggtgtctgaaagggattgaacgaggtagacagtggtcggagaggctggagacagaatgggcattgtaggtcattgcaaggacttggacttttgctgtcaataaaccagaaagctattggaggatttccaacagaaaagtgacatgatccaactcacattttaaaaggttctctttggctgctgtcttaagaatagatagggcaaggacagaaacaggaaaaccagttaagagtctgttgcagtaatcaggcaagagaagatggctcaaaccaggatggctacagtagaagggtgagaagaagtcaggctctagatatattttgaaaatagaaccaacaggatttcctgacagaataaatgaagggtttgaaggagaggattgaaggaggactccagtgctttttgcctaggcaactgggtgttgctatcagttgagacagggaaagtctttatcaggtagagtaggatttggagtaagctcgggagttcagtgtcatatacgatgagtttggcatgtctgttggagatactgagtaggtagtgggatatatgagtgt

SEQ ID NO: 14567 - DNA, 1032 bp, Homo sapiens
aggaagatttttttagacttcagtgacagtgagggttattaaacactagatgagctacagaggaagacagttgtgttctcattccccaccagactttaaaaataggatggattctggctggaataaatggcttaagttggactagcctggaagaggggaggaggaaaggggagatgaacaggatggcttctgtaagaccctttttgagccctgtagtcttatgatttctgttatttcacaagatttagagtcatagactaactatagctgttctacaaacagacaggaaaacttttaaatttgcatttactgatttttttttcttttaagatttcccgagtaaactcaggctacactaaagaaagatgtctcatgactgtagcttacacatatctttgatatctttaatttcaaaaaattaaacctttgaatttcacggtcttaggtaccgaggtgagggtaaatgttagtgccatcaactattgtcaatctagggtatattttctaactgttaaacactaaatctcattccggccatctcccatccccaccccagctctcaacattctattaggtaaaatacattctcaggaaatctcaggtatcagtcagttaagagcagggtgtggagatgaggaagccaggtgagcagggggctccaaaatctggaaaatgctataaaggatttttgtgggttggaggaaggctaaaactcccaacatactccagggtagtcattccttgctaaaactttggaccatttccacagacaaattccatggctagagctagacagtgaagccaatgggagcacagggtttgctttagagatttgtttcacagccagcctttctgagatgcatccttttggaaaagcccagcaaaacccatatggagctaaaagatttataatggattactttatgctttagtcttctgctttgcacagtaagacattgctatataaagggaattaattataaggctgtgaatagtgtttgagagattcaagttggtacataaacaatgagg

SEQ ID NO: 14568 - DNA, 1009 bp, Homo sapiens
acacactagtaacaattttagatggtgaaacagtaaccactcatgctttggggactagcatgctgaagggaggctctgagaacatcctgtttgctggcattaatagtcctgaggtttgctgtttccgatcttccccttgtgaatgatcagtgttgacataggaagctctgtactgattcccctcccttcacggaagcctggcacagaaagcatgcccatgactgcccaaccactggttataagggagcaccggactgaaaaaatggagcttgtcaactctgggaatgaggctgacaagaagctgctcccctggcacattccttgaatcttcctcctgcttaggcctgtgtcctctccatcccacccccatttcattgatggttccagggctgagtgcccagagtgaggggatgtgtcttaatgctgatacaaatgggtctttaaaggtatataacaggcagcaaaagccatgtgtcacttgggtacgaaggggatgtatgtcctctttctacttcagagttttcaggggactgtatcacaattttggagcactagcaaaacccacttctgactttatgctacatggttatgtgtttaagcagctgagccccaggtgatgcgtagcaggtgaggctcaaccctgctgtaggtagactggcttggcatctgtcaatcggcatcaaaatagctgaaagaccaagggaggctgagacagccgttgcttttaactagcttctttccaggtgaagttcagtgtctgtttccaagaaagcctgtgttgcggttctagttggtaactgtggggaggaagcattggcctttgtgtttgaagggtaaggaggatcctatagaagggccattcaccaggagaaagatcttgtccaaagaagaatgctgattccactgtctggtttttggacacttattcttcttccttttactttgttttctttctttccttttctttttttttttttttttttgaggcccttatgcacactttcaacat

SEQ ID NO: 14569 - DNA, 1147 bp, Homo sapiens
ctgcctcctgctcacaagaggcgacattggaacctggggagatagaggggttccaggtggtagaggggagattgtggtgagaatgtgcacagcactgtcggtcagtgggagccgagcccctactgcctgcagagtgggtgtctcagcccttgattctagaggccctcgaggctgagtgtgttgacagttacctgcagttgctgtggcaggtggctgagccccggctctggagtcagagagggtcttgtcccagctttgtgttagttggctaactttgatgagtgacttcacctctctgaaccccacttgggcttgttgggcagattaaggagcccgcacacctaaagccccccacgtggtctcacactaagaggtgcgtgctgggccctggctttcctctcccactctagatgcatgccaggccctgctctaggcacagggggcagagccatgttctgctccaatgaggtgagcactcagcggggtcaggggagggggacagtagaaagtgaatacaaatatcaaatatgacagctgtgggcgaaggctatgaagaaaaataaagcaggggaaagggatagtgtgggggcatggctcatacaaggaacaaagtcctttccaaggagatgatagagccagaaatgtgaaggcagggagagccatggaaaccaccccagggaacagcggtgcaaaggccgtgaggtaggagggggcctggggcagagcagaggaaggagagagctgtatgagggtacagagataacaagggcctggatcatgcggggccttatgggccagggcaggaggttggctgttactttgatgggaggccgctggagggttctgagcagaggaggcacagactgtgacatgaccagctatttttagtctccgttttgttccaggttcccaagttcacagtggactgtgtttaacagaccttagaggttggttgagcctgagtggagccccttccatgccagcgctgacagtccccaagtcctcccagggaggtacaccagacctttctcctgaaggtggaaccaggtggcaccctgcttatctcctccttgtcaccaacataaccctttatcgcctgcagaattccagcttcccgtgaccgaacctgacatcaacaacaggctgg

SEQ ID NO: 14570 - DNA, 1043 bp, Homo sapiens
catatattgatggggcaaaagataacattttataaaagtaggacttcttgagcatgaacttaacagttctctagcaaaagaatagctacgcaaaatttatataaagctctaattctgagatagatacaaaacagtaactaatcagaaagttttcaggccagtcgcggtgactcatgcctgtaatcttagcactttgggaggccgaggcaggtggatcacgaggtcaggagttcaagaccagcctggccaagatggtgaaaccccgtctctactaaaaaaaactacaaaaattagccaggcgcggtggcaggtgcctgtaatcccagctacttgggaggctgaggcaggagaatcacttgcacccaggcagcagaggttgcgccactgcactccagcctgggcgacagagtgagacttcacctcaaaaaaaaaaaaagttttcattgcattaactctctctctgtttttttttttttttccttgacatggaatcttgctctgtcgcccaggctggagtgcaatggtgcaatcttggctcactgcaaccgccgcctcccaggttcaagccattcttctgcctcagcctcccaagtagctgggactacaggtgcacgccaccacacccggctaatttttgtgtttttagtagagaggagattttgccatgttggcgaggctggtctcaaactcctgacctcagatgatccacccacctcggcctcccaaagtactgggattacagacatgagccaccgtgcccggcctgcattagctctttaagtacaggtgaacgtgtggaaaactcaactagggcagtgatatttttcactttattttatggacatctacagcattagcacacgtaaaaacagttaccctaaaatccaaacacacttgattgactggtacctgtaacatacaagttgggagtcttgcaaaagaaaacctgttttgttagcgtgtaaacttgttctttgggggaagatgtcaaatttttctgtaacttcatggtctatgagtttcacctgtatctgacatgtgga

SEQ ID NO: 14571 - DNA, 1022 bp, Homo sapiens
tggagtgcagtgacacgatcatggctcactgcaacctctgcctcccaggctcatatgatcctcccaggctcctgtgtagccgagaccacaggcgtgcgccaccacacccagctaattttttgtatttttgttagagacagggttttgccatgttgcccaggctggtcccaaagtcagctcaggtgatccactcaccttggcctcccaaagtgctgagattacaggcatgagccactgcacctggccttagaaatggagttctttatatggcaagtctttattattagttcacacttttaaacacttgacagtcatattttctgatatagatacttgtttcaaatcccactactttgaaaatggattcaagtgtctgtagacatttacttgactgttgggatttttaaattttcctgtgacataatcagacaatcatatcagactgttgagtatgactgattttttttgttgcaaaatttatttttcatttgtaaaatatttgagattataggaccccttccccaagttcctggcgtaaatcttttttttttttcctccaagacagagtcttgctctgtcacccaggctggagcgcagaggtgcgatctcagcccactgcaacctctgcctcccgggttcaagcagttctcctcagcctccctagtagctgggattacaggcacccgtcactgtgcctggctaatttttgtatttttaatagagacagggtgtcaccatgttggccaggctggtctcgaactcctgacctcatgatccacccgcctcagcctcccaacgagctgggattacaggtgtgagccaccgtgcccagccaacccttaatcttttttttttttttttttttttttttgagctgaagtctcgctctgtcccccaggctggagtgccgtggcgcagtcttggttcaccacaacctccacctcctgggttcaagtgattctcctgcctcagcctcccgagtagctgggattacaggcgtgcgccgttgcacctggctaatt

SEQ ID NO: 14572 - DNA, 1284 bp, Homo sapiens
agaggaggcttggctttttcttatccacactgaaaattagctatgagaaaggaactcactcttcactctatggcactattaagttatcatgtatattatataatatatagcatgttatttaagtgggaacaaagtgtcttgggactcccttccaacatctctttttcatgtactaactgtgcttttccctcttgtgtctaatagaagcttaatatgtaaactagacaaggtagatgacaaatggttaatgacttttttttgttttctttagatacatccagaaagtgcccagaagaaacttcctgctggaaaaaatgaaaaagcagtatttataacattagaatctggataatttgttaacatggcagaaaataatgaaaatattagtaaaaatgtagatgtaaggcccaaaactagtcggagcagaagtgccgacagaaaagacggttatgtgtggagtggaaagaagttatcttggtcaaaaaagagtgagagttattcagatgctgagacagtgaatggtatagagaaaaccgaagtgtctttaaggaaccaagaaaggaagcacagctgttcatccattgagttggacttagatcattcctgtgggcatcgatttttaggccgatctcttaaacagaaactgcaagatgccgtggggcagtgttttccaataaagaattgtagtagtcggcactcttcagggcttccgtctaaaaggaaaattcatatcagtgaactcatgttagataagtgtcctttcccacctcgatcagatttagcctttaggtggcattttattaaacgacacactgctcctataaattccaaatcagatgaatgggtaagcacagacttgtctcagactgaattgagggatggtcagctaaaacgaagaaatatggaagaaaatataaactgtttctcacataccaatgttcagccctgtgtcataaccaccgacaatgctttgtgtagagaaggtcctatgactggctctgtgatgaacctggtttcaaataacagtatagaagatagtgatatggattccgatgatgaaattctaacactttgcacaagttccagaaaaagaaacaaacccaaatgggatttggatgatgaaatcctgcagttggaaacacctcctaaataccacacgcagattgattatgtccactgtcttgtaccagacctccttcagatcaataacaacccatgttactggggagtgatggataaatacgcagccgaagcactactggaaggaaaaccagagggtacctt

SEQ ID NO: 14573 - DNA, 1038 bp, Homo sapiens
gggaagccgtgaacatcggcagccactggcgtttcctccgagtcctcggaactccggaaactctgggagcttttagcccgcccaccaggggaaagcggcccggagccggcgccaggtggagcccatccccctaggcctggcgggccgcagtaccgccaggggcctgcgggaggcgcacgcggcgcggcctgaggggagggggagaacgggcggaggcggtgcgctcggcgcttcctgttccggcgccaggaggagccgcgcgctgctggtgctgttgccgccgctgctctagctgccgtcagtcaggctgcgcccgcgtcttcagggcccagtccctcggacccatcgccgcttctagaccctactgcggtctcggatattgccgggtgaggctgcttcggtactagtgggagtcgtgaaggggaatcggggagctggggttgcggagcccgcgggcgcggccaagcgggaagcgggcgcggtgaccgaggtgcatcgagtcacgtccagtgctcgggccgtggtcgcctgcctggcaccaggactaagcgtttctatcggtcgccttcctccacgctgcgggctgcctggggatcgccccccagggagaaggtgtcggaggccgctgacgtcgcgcccgacgggtttctgggcgcctgacgtcaggtctggctgcggggcggggcgggcgcgggccggcccctcccccaccccttcccggcgggcgcgacccgctaggaggccggttcgctccggttgatcccggactccctttgttcgtgcgtccctaaacggctgccggcctcgcgccccttggccccgatttcccctctacccccaccctattacactcattcattaatttttaataaaaagggaaaggcctgaaaagattcttacaagagtctcgggcgcttgttaatccgcagtgtgacaacgttctggttatgacttactagaggaattgctcacggatacattagatgaatacccagggcaaaccacgagaagggcagaattcagtgatctcctttttta

SEQ ID NO: 14574 - DNA, 1028 bp, Homo sapiens
gagactccatctcaaaaacaaaacaaaaaacttacgaattatttatttctggaatttttcatttaatatgttcggaccttaggtaattaaaaccacagataaggggggatcaccctaacatgaacgctgtttattctaggaatggagagctggtcactttactaagacagtgccgtagaacagaacttgttactaattcctatgcttagggctttgttttttaatcacaagattctagcacctcccctatcttccagacttggattttgaactttaaaattttgaagtagtgttgtgaatcagttgaatattattaacttgtagaataatttatgtaattccatgactaggtaactgtataattctgaaaacctgaacagtcaaggccatttggttcactttgattctcaactccagaattaatatgaactttgatacagaatcattttctatttcagaaaggctaaccctgtttaaaaagcatgttagccttacaacttaccgtatattttctacactgttagtcctaaaaattttattgtgtgatgtgattgacgttaaaccttaacatgggaatgggttgtatgtgggtttttttgtttttttgtttttgagacggagtttgcactgtcacccaggctggagtgcagtggcttgatctcagctcactgcaagctccgcctcctgggttcgcgccattctcttgcctcagcctcctgagtagctgggactacaggtgcccaccattatgcctggctaattttttgtatttttagtagagacggggtttcaccttgttagccaggatggtctcaatctcctgacttcgtgatccgccctcctcggcctcccaaagtgctgggattacaggcgtgagccaccgcgcccggccatgttttttgatattctgaataaaaaggatatagcagttgggataggcttgggttcttgtcctttatgttcttgtcctttcctcatgataatcaaatcataattagaaataagatgctaagaatacaaaggtggct

SEQ ID NO: 14575 - DNA, 1050 bp, Homo sapiens
gcgcaatctcggctcactgcaagctccgcctcccaggttcatgccattctcctgcctcagcctcccaagtagctgggactacaggcacccgccaccacactgggctaatcgtttttttgtatttttagtagagacggggtttcaccgtgttagccaggatggtctcgatctcttgacctcgtgatccgcctgcctcggcctcccaaagtgctgggattataggcgtgagccactgcacccggccaaaaaattttaatctcatatatgaaagctagtctgcttagtatcttacaaagcagtgagagaaaaagatgtgctactgagtaataaaatgatcaaaggcaaagagtacctacagtcttttatttatataaagtcaaagaacaagcaaaattaagtcaaaaattgactgccatgaggcaaggtagttgattggaaaagagcatgagtaaactttctggagtgagaaatgttctgtatcttggggtggttataggggcgtatacaattatcagagcttgttaatctgaacacttaagatctctgcattttgttgagtgctaattacacttcaatttaaaaattggtaaaagtactccaggacatcaataaatttaaatttgggagtacacacagtggctcatggctataatcccaatactttgggaggctgaggcaggagggtcctttgatcccaggagtttgagaccgggtctgggcaacatagtgagacacctgtctctgcaataaatttttaaaattttaagaaatttgctgggcatgatggcacacacctgtagtaccggctattagggagactgaggcaagaagatgacttgagcccaggaggtcaagattgcagtgagctgtgatctctctcgccactgcactccagcctgggtgacagaatgagaccctgtctccaaaaaaaagacgaggaaatgtaagttaaaataagacgctaatttttaatatctattgtcattataaacaataaatttaataatatccagtggtaaaaggagttagagaaatgagtgtaaattggca

SEQ ID NO: 14576 - DNA, 1054 bp, Homo sapiens
caagagtttcaggctgcagtgagccatgattgtgccattgcactcctgcctgggtgacagagtgagactctgtctataaataaataaaagagatgctttttgtgattcttggctttgggggtagtaaagagattttgataggtgatttgccttagtttactgagataatagcatgtttggaaatgtttcctgtatttatgaaaatatgtatttctttaaatgaaaatttaagatgttacttctgttgttctcttttaccctgatagtattaatagccaacatttattagaaattattatataccaggcactctgtgaaagtgtactacatgaaatatcatatttaagcctcaagttaaccctaaaacagttttgaaactgaagaggctctatctcagagtatgtagctcctttgaggttaagccaggattcaaatccatatcttgactgttagttctatcttcttaattactgtattttgttgtattaatacagcagagaaatgaagcacaatatgattagttgtatttagaaaacgagtttctctgaagaatttgcactgtaaagttgatacgcaaagtagcatctcaaggtttatgttaaatagagtattttttaaatgactagcttagcttttgaagatattcttgaggtttataatccctgcccctataggttactattctctgtgggtttataatggtgttcgatgtaacttttccctagataggaaagacgtatctgttttgtgttccagttggcagatgcactacctgaacactcccctgccaaaacctctgctgtgagcaatacaaaacctggccaacctcctcaaggctggccaggctccaacccttggaataatccgagtgctccatcttcagtgccatctggactcccaccaagtgcaacaccctccactgtgccttttggaccagcaccaacaggaatgtatccctccgtgcctcccaccggaccacctccaggacccccagcaccctttcctccttccggaccatcatgtcccccacctggtggtccttatccagccccaa

SEQ ID NO: 14577 - DNA, 1226 bp, Homo sapiens
gtcaaacatccaatccagctataaaggaaaagaaatctttaaagtacccctaaaacttcctccttgcattagtgtaatttctttcttgctatatatattatctaaaaatatttgttttgcaaagtgtatgccagagtaaatgatgtgacttgctgtttggatttattaagcaataaatttactttaagccacagtaaggagttaataaactccatttgcaaaatctagaagttgactttttcttttttctattgcagtcttaccattaagttaacaatggacgaagagatgacgctttgctttttgaagtacatgtatatgcacatgaatgcatatataaaaattgctggtttcactattagagggcattcatgaaagaacaactcttgcacctctcagagaagataactgcctcttgtacttggatgcgtagtacatcatatgtatacaatcagataaaagcatagaagtaaatcattcggatgtgatttttatttggttttcatggaaagttaaagtgataaagtatattgaatagttctttgacagaatttgtttaaactatgaaactacacacttaaaaatctaagatgtggattattgttagaatctgcaacttcattggcaaattatttcaagtatttttctataatcactttccccttctaaataaataaacttcgagaataacccatcataatccaaacaaatgatgcctcaacattttgagctgctctgtcggacaaataaacctggtcctcttgaggttatattttggatatacatttttaaactgtcagtaattattgtcagatgtggagttcaatagccagccagtgttcatttttatccttgagcttttagtaaaaacttcctggttttatttttagtcattgggtcatacagcactaaagtctgctatttatggaaactaacttttttgtttttaatccaggccaacatgtatgtaaattaaatttttagataattgattatctctttgtactacttgagatttgattatgagatgtgcatattgctttgggaagagctcgaggaaggaaataattctctcctttgttttgaacctcaaactagataaaccctaggaattgcttaactgcaacaagtaattttcattcccacaaaaacctgaggcagctcttttgcccagagcgttccctgtagccacccccaccccacttgcccttggttctttagaagga

SEQ ID NO: 14578 - DNA, 1033 bp, Homo sapiens
ttgatagctacctccttctaagaaagcaaaatggttacctttgagaggaacattcagtgtttaatcatcccttatgttaactagatgatagattcaagcttttagaaatgagaaagtagaaactaatttgttaagatattttcagactgcggaatgttgttagctttttctttcacttctcttcaaggacaggtgttagctgtctacaatactgttgaactctgttgtcaaagtagcccccttagtctacaaggcaggtagccttggcttgaattatcaatatcaaaatgtcagttaaccatggagggataaagtaatgtgaaaagtgagatggctgcaaagatagctctccttacagttattttggctgtcctacattgggataagctgacaaattagcagtatttagtttaacactggagcaaatataatttgagtaggaagaagagatagcaggtttgggaatctataattatgaagtccattgattttgggagaaaatctgttgctaaaggatttgaagggccatgaacacaatttgggattattactccctataagtataataattttgctagtgacccatactgtccagtgtgccctaaatcatactgctattgtactccctttgttttcaaggactttgcaactggtatttgggggagatttttttttttttttgagacggagtctcgctctgtcgcccatgctggagtgcagtggtgctatcttggttcactgcaagctccatctcccaggttcacaccattctcctgcctcagcctcccaagcagctgggactacaggtgcccgccaccatgcccggctaatttttttttttttttttttttagtagagatggggtttcactgtgttagccaggatggtctcgatctcctgacctcgtgatctgcccgccttggcttcccaaagtgctgggattacaggcgtgagccaccacgtccggccgatttttttttttttttttaatgtaagaatggagataaaagggataatataatttgcttttata

SEQ ID NO: 14579 - DNA, 1084 bp, Homo sapiens
acctggaaactttttttaaaaaatgtattttcatggtttcacagatttttcatgttattttattctttaggcccaattctgggcttctctgagcaagtccagagcctaattaactgtaaatttgttgtcaaaaaggaagaaaaaagggcctgagatacctctttgcatgtgacctgcattcactaaggatatctggaaaccacccttcctccgcaaaccctctcagcaacatggtgtccattgtggtgattttctcttcttttaaggctaggctactcttggtaaccagattatccgtatatatgataatatgaagtcagggaactttctctgtctgtccctactcccctcactcccccactttctgttatgaaagatagttctacttttatcattaactgctacgcatttagtgagggtcacattattaaacttggagtttaccattttcccacaggagatttcgctggcattccttggaactcccaatttcagtagggcaatgaatgaatgaatactttgcagtgctacttttggaaggaatttctgctttttgccttatgattggacaaaatgcagctgtaaaattttaaattgtttttgatatgttattcaatatcccatgaaagtattcacctaaagtggagttatgaaatggatggtgaaataataagaccattctggagcagggccagtttctttttttcctgttgtgagatgacattgctctgacaaacatgctatcgtgggttacctgacccaggcaagtccttttttatcaccgtattaatactcttagcaccaatccttttgcaactgatctccaaagcaaaatagaattctaaatcttagctcacttattttaaataaggcatgcaatagaattcgagtgccaggagaggatttgggtcatctcatagagcttattcctgtggcttttacttatttttgggacagtctcactctgtcgcccaggctggagtgcagtgatgcaatctctgctcactgcaacctccgcctcccgagttcaagcgattctcctgcctcagcctcccaagtggttggaattacaggtgcacaccac

SEQ ID NO: 14580 - DNA, 1755 bp, Homo sapiens
aagtccttaatccttcctcactgaccttgacttgtaatggtacggttttttttttttcctctctctcaatacttcctgctccccatttgccttttagaggtgattgataagatactgtctctctgggttttacatcaacatgcagatggaagttatgcccattttcaggcaggaaataaaagcaaaaatttacccgttaggtactattggatttgactggaagttcacaaaacaaggctttcctgtacatgttattttgatcctcaccacaaccttgggaatttgacagcattgtgtgcgctactgaaagttgttctggttttttcttccttcttttaagaaatgaggaattttatgctgacagtgttgagtgaagtctctaaagatacaattttgtatacaaattatttttcgtatgtacaaattttgtatacaaaattttgtatgaaagatacacatttgagcctttggatcaccagagactgagaggcacttgaattattatgcaactgctgatattgagagtgttagtcaacctttaagatgaaagaatcttggcaagatactatgtaatgcaattgaaggaggtccaaaatggacgcttgcatgtgtctttcccgagcggtagcgattctggggccggctacacggctgtatgtaagttaggtgtactagtttttttgtatgtttttttgaaacagagcctcgctctgtcacccaggctggagtgcagtggtgcgatctcggctcactgcaacctccgcctcccgggttcaagcgattctcctggctcagcccctcgaatagctgggactaccggtgcgtgccaccatgcccggctaatttttgtatttttagcaaagacggggtttcactgtgttggccaggctggtcatgaactcctgacctcgtgatccgcccacctcagcctcccaaagtgctgggactacaggtgtgagccaccgttctcggccaggtgtgctagtattaatgggaaaggatgaaagtcagactaaataagagttgaaagacctgcagctgataaggagatacctgctattcggcagtgcatttttcctctctattttgcttagcagttaggaagtttttatttttcctcatggaaaatgagttaataggtgaagaataaatgtcatagtgcatactgatgtgactgagggacaacgacagatatttaaaaagccagcttgtgagtgttgtgtaattatctaacaagccagaactcgtgtgaaacatttttacagtctgtttctatttttggcaggatctttttcacccatgctttccagttttgggtctgggaagcagcttttacttcatataaatggttttatggaaattaattttgagattggtttattattttaagtcattttattcacttatataatttgaaggcactaaattaaacagtcattcgttatccatctttctgatggataaaagcaaatgtcaagatgagagtgctgtattgtagaaattcctcaggatatgtttattggatcagttattttattaacatttagaatttaaattcttaaaaatttttactttattttttaaacttaatttatgttcagctagcttaatttgacagtttttatgttctagtaactttaatcttgttttaatatttgtttgggagaaaacatacttatctttagagacatcatttagtgttatcttccaaaatttgcagctgtttagaaccagatacttgagggaagctactat

SEQ ID NO: 14581 - DNA, 1051 bp, Homo sapiens
atatagtggaataataatgtgttcagggtaactaagcacaatagcatcaccagaatatgtgtatctgctgttaagcaacatcatcaacaaataaggttaggctttcagtccccacctatgatgttattttttgattaaaaggtttctagactttttgtttgtttgtttgttttattaaggccggaagaaacatcagaatcgattgagggaccaggaaatggggcctctagggaagagaaggcattctgctagatggcttttaaaaatatttccgccagagtcacttgtctcattaacaacagtttttgtcttagaagtctctctgtgattttataaactagcatgattttgttatgaatgcatgctgctctggttctctaataagcccaacatgcatttgcatcatgtcggcaataagcactttttttgctgtgttaacaatgtcatcttcattgttgtgtgcctgtgttttgactgtgacctgtcacatgaggttgggtgtggaattttccacttgtggcatcgtgttggagctcaaaaagttttggattttggaccatttcggatttcggatttttggattaggaattctcaacctgtgctatcagccaggaggtataaatgatgtctcctttgtgggtttaaatataatttattacttaagaagttgcttgtaattggtatggatcaataatttatgcttcatgacctctaccttatgatgtggttagtcatcttttggcattggtgtgagaaacaaggttttccaaaaggaaaatccaattttttttgggtatttctaaagtaaagaaatttttttaattttgtgcatttaaattataatcattacatagaaataagtacataaaaatggaatataaaattacatacactaatcatagctgggaaaaaatagtccaagacttgggctactgcaaaattaaatggtttaattaagagtagattttgagtaactcttgttgtgttgtttatgccatgaaaaaggcaagagtttatattcacatattttaaaatagtgttgaaaagaaaa

SEQ ID NO: 14582 - DNA, 1060 bp, Homo sapiens
gggtttcaccatgttggccatgctcgtcttgaactcctgaccttaagtgatcctcctgccttggcctcccaaagtgctatgattttaggcatgagccatcatgcctggcctcagatggtgttttgtgggatacatttttagaaggggaactactggatcaaagagtatttgcagttggacaatacacttgttttctcatatccttgctgacacagtttttgtatttgctaatttcataggtaaaaaaatgacagagggtagctctaatttgcctgataggacatgtaggtagagaaaatacttctatgcttacatactgatgatacctagaaagcatggattacacagttagctaatgtaatgctagttggggtgaagcatatgcagcatgttttcattttatttaggccaattgtagcagaagattgatggttaaaggtagatgagaaacccttctactcacaaacatgtcactgtgaactgacaggaaaacagggtaataatgtattctttaggagtttttaaattaaaaagtaggttagggctgggcatagtggcttatgcctcctcacttcaggaggtgaagtggggaggattgcttgaggccaagaattggagaccagcctggacaacatagcaagaccccacctctaataaaaaccccaacaaattagacaggtgtagtgacatgcacctgtaatcccagtgctttgggaggccaaggcaggagaattgcttgagcccagaagtttgagaccaccctaggcaacatagggagaccctgtctttagaaaaaaaatagctgggcatagtggagtgcacctgtagtcccagctatgtgggggtggctgagatgggaggatcgcttgagcccaggagttcaaggttacagtgggctgtcattgcaccaccgctctccagcctgcgtgacaaagtaagacctcatttctttaaaaaagaaaaaaaatcaattcatgtataaagttaatttagcattaattttctttggtcctgttttctatcacatacatttcttaacattcagaaacatatttttaac

SEQ ID NO: 14583 - DNA, 1043 bp, Homo sapiens
tatagaaacttaacagcagtggctgacatttttgcttatttgttaggtattggtggtggtgttaatcgggtacgcatatgctttccttaggatttgcatttgctgttccctgtgtctagaacgctattccttagataaatcttcattccttacctccttaaaatgttttctcatctatcaccttcttaagtctgtactgatcaccctacttaaaattataactgcccctctttgcttgcacttctaagcttccttaccctagtctgtttagcagttacctccttgaaacatgctctgtagaatttacttattatgactattgtctctcttactaccagaatgttagttccttgagggctttgtctatttgttcactgtattccaggtgcctaatagatgctcaaaaaattattattattttttttgagacaggatctggctctgtctcccaggctggagtgcagtggtgtgaacactgcagtcttgacctcccaagttcaagtgatcctctgacttcaacctcccaagtagctgggagtacatacgcacaccacagggttttgccacattgcccaggccggtcttgaactcctgggctcaagtgatccacctgccttggcctcccagagtgttgggattatagacatgagcctggcctcaaaaaacatttgctatatgtgtgaagagaagaaagggtataacgtaagaaagttagctataaaatagtttacattttaaatacttatatttgaaagtattatttccattatttaaaaagtaattttaaaattttgcttttggagactactgtgttccataattacaccggggcaaacacagctgtgctaagtttaagaactgtatattctgttggtggaaaaggactgaatattgctttgcccaatacatcacctgcctcagtcttctagtggttttgtggtgaagttgctttcagtggtggtttagttaatgctgtttgacttacgtcccgataaatcagttgaaaataaatgcatttaatatatttaacctaccaaatatca

SEQ ID NO: 14584 - DNA, 1065 bp, Homo sapiens
aactgaactttacattctatcttaaaggcctacttaaatatgtgtgcatgtatataatacatagtcctcctcttttcccagtcattaaaaacaatttgagtttatgctcagtttgagtttgtagtaagccatgaagttgagttatgtgaacactaaacttccaaaaagttgcttaattgctaaatgttttggacttcattatgattagggaaaatggagtcagggaaaccatatgagagagtaatttgtttcctaaggaataaaagcagtagaaacccacaacaaaccacacattagcctttatgttgttacttgttggcttcattcagtttgcacttctattgtttgtgaaacaagtggttttctttagagttgcaatgcttatatgtttttaaagttttccactaaagtcatttctacacagcgtcattttgaaaattacatgatgtcagatccagtatccagtgcatatattttaagttaacaaattatagaaggaaatagtacgtggtctttcaaacttttgtttaaaaacaggctggctgggtgtggtggctcacgcgtgtaatcccagcactttaggaggccgagggggcagatcacttgaggtcaggagatggagaccagcctggccaacatggcgaaaccctgtctctactaaaaatacaaaaactagccagacgtggtggcacacgcctgtaatcccagctgttcgggaggctgaggcaggagaattacttgaacctgggaggtggaggttgcagtgagcttagattgcatcacggcagttcagcctgggtgacaaagcgagactccatctcaaaacaaaacaaaacaaaacaaaaaacaggccatatttaggtcttactaaatggaaacctttctcaagtagtgcttttcaaataataaaaatttttattgtgtaaaggaggaagggaacttagcatctgcattggaatcattttttcctatatcctattagctaattccgagattgtttaatatggtatccacccatttcatttggctcaccctttgctctcatgaaagtaagactgattgttc

SEQ ID NO: 14585 - DNA, 1032 bp, Homo sapiens
cccaaagtgctgggattactagcgtgagccatgcccccagccattattcctccgatttttataaataaagagtggctcttatgctaataagtgactcctttttggaattagcattcctgtgcctttactgaagcagaaagaaacatgaactgtcgtatcttctaacttgttttgataagcaaggctgaagactagcaagttagaaaactggcatctgcctttgatattgtggcttcctattagcactaagagaaatatcgtcctttctccttttctgaccacgtattgtcattcgattcttcatcaggtttacccctctgtggacaagagttagtatgactctttaggtgttaggatttatccaagtacattttttaaaaaggaaagtttagttgtcttttatggcttcattttggggagtgtatactgtctttaggtgagagttttcttttctttacttttttaagctgaacttagagtctaaaaggaatactggaattattgaatgcaggatttgggcctttactggaataaagttgctcaaattatacctggttcactattctatctccccatagacctggaaaggatttaagctgacaggtatgttgagactgtccttcatagccaagcttagtgagagagtcgctgtagttggtgctcaccctctcaccttctagtcacccctccatcatgaacttttgacttcttgtccactgtacttcctcacagcagggtcaccaggggtctttatcaccaagtgggcacaattctttatttgaccttgctgctgactgtgccttccttttacagactttttttttttcctgattatgaaagtaatacatggtcattgtgaaaaattttggaaaaagagttgttatctctatccagaaaactttctcctcattgaaatgtttctgtgacaactgtcttcttcctttcctcctgtttctcttgaccagacctgagtcatttcgcctcctggatatctctgtcttgtaggcactcaagcccaatgttaatttttgt

SEQ ID NO: 14586 - DNA, 1029 bp, Homo sapiens
acaaaacgctgtccatgtgcagctgtctaatgttaggcattacaaagctaaattaaggttataaggatccccctcccccccataggaattagaagattaattcttaaaactagtgatttaaatttaaagacttgaagtttttcaagtggagaaaacagtaaaagctacttaaaccacatgctataaaatgttttagttatatggaaagcagtagatagaatgtcgtccttttgtttccaagaaacttttctgtttcatttcctgcatatgttcattataagttactcttgtgtgatcttatagacatttcttaatggttacctcgaaaacgccaactctgaccctacctaaaaatgcataccctccctattctttgtcacagccttatttttattcattgcattatcagtcacaacctgatgttataatacgcttatttctttcttggtatctgcctcacctacaagaatataaataatgtgaggcagggactgtcttgttcatcgctgtgaactatatgtctgacacctagctagtgctcaatttgaatgaatggatggtctgatgcttgaaaatgattgggactcattgagtcttttgctttacttgccatcctttattagcatggctaactgagtggtatttggtatgccatataaagtgaaactctaagaataagggttttaggtttactcttgggagagtggaatggaaaacaatttgaaacatgaatttcagcaaaatgggtgtgcttagtcccagttaatcttgttcatcagtaatgtaagtgttctgagtggaatctgtacataaataatttagtgaatgcttgtgtttagatctaattaccttttgaaataaatttggacaagctaagctgtgcactgaaaactccctagtgttctgaatgctatgttgcagaacgttgaagatgttgccttaaatctgtaatatccacacaggttgaattcacttacgtgccaccaacctgtacttgcctactttattgggaagtcatgttcatttgaa

SEQ ID NO: 14587 - DNA, 1029 bp, Homo sapiens
ttttagtctaaataattggatttagttttaacttgaagtatttctgagcttgaaaattctggagcacttttcaagtaaaaaatacagctgacctttggacaatgtgggaattaggggcactagcaccctgtacagtcagaaatgtttgtataacttttgactctccagaaacttaactactagtaccctacttttgactggaaaccttaccaattacataaatagtcaattaacatgtatattgtacgttatatgtattatatactgtattcttataataaagctaaagaaaagaaaatgctactaagaaaatcataagagactgtgtatttacaatactgtactgtttattgataccataagtttatatcatctgtaagatgaatcatctgtctgaaacagtgagcaactgtaactgcagacctcagtctaagtacatatcaagtaattcaacttttccttgtcatgacttttctctgcttctcgggagcacttccagcattactagtggcacttggcatgggtctcatggtgttattcagggtttacagtgttgtgctaaaaatgatgaaaaatatgcgagaactatgatcactttttactgtgatactgttactggaaggacagaatgctcatgtggagataattagagtcatggataggagtcagggatacttcagacacttgagctcacagtaataccaacaggaggtggccacaaaattattacagtggtacagtatgtactgcagttaattttatgcagttgtgatttggtactgtatcttgacctttgtttacatttccatctattgcaaatggcaccatgtacagtaaccatatagggtctggtttgtgtaagttttgataaattttaactttattatttgtgtatattttatggtagtaaattatgaaatagactgggatctacatatattttatgcattcatgacatttttcttaatttttttcaatatttctaggctgtggtttccctgtgagtttttttcatattgttgcagtctc

SEQ ID NO: 14588 - DNA, 1058 bp, Homo sapiens
attgaaattctaataattgccgccagatttttatatcacttaaaattttaggtttcacttctttgttatattaatataaattgggtcattgtgccttctgagaagtttgtaaaatttaactcagtgatgtgtctcaggttttgtatgaacaaatgtaagttataggagagcgagtaaatagaattttaaaactatttgattagtatttgtaatacgtactctgacgaaacacgacttacatattatgcgtgttaacttattataatttttttttagttcttttaagatagggcaggaatgaaaactctcaatatagagcaggattttaaacctggggcccgtgcatattcttcagggaatccagaaacctggagattatatgtaaaacttagtgagtgtggatactttttttctttgagaaagcgggtcagtatctttatcagtttcttgaaagatttatgtccgagtgaaagataaaagacaatggtgtggaatgtggttttaaaatagtttggacttgctttcctattgttccatggatatttctctcctggttctcttgacagagaaatcctatttgccaccactggctgtttattgcattcagattggaatctattatgacttatgtgtgatgaggttaaagaggtaactaatattagaaagggtaagccaggctaggtggtacatgcctgtagtgtagttccagccacttgggaggctgaagtgggaagacctctggagtttgatgctgcaatgcgctatcatagggattgtgaatagccaatgtggtccagcctgagcagtgtatatatagagaccccatttcttaaatgtgtaaaaatactacacattttttgtgaaaactcgggttgtgagttagcaaaaatcaccagtgttatttcttccatgtgtgaaagaacaacatgagcgtctacatgtctccatgtttttcaactcaacaaacatgtattgaattgtatactgtggacttagaaaattttaatgacctggttcttattacccagagctaaattaactttgtctcaacctcttta

SEQ ID NO: 14589 - DNA, 1093 bp, Homo sapiens
tgatttaaagaactaacctgtttagatttgtaggtcaggttagatttgaaatgccacttgaaagagcagcagttttgactttaatttttatgagactgacaggttctttttttttttttgtccccaccttcttccctatttaggttttataggatcacattgacaaaagtaccatggagttttatgagtcagcatattttattgttcttattccttcaatagttattacagtaattttcctcttcttctggcttttcatgaaagaaacattatatgatgaagttcttgcaaaacagaaaagagaacaaaagcttattcctaccaaaacagataaaaagaaagcagaaaagaaaaagaataaaaagaaagaaatccagaatggaaacctccatgaatccgactctgagagtgtacctcgagactttaaattatcagatgctttggcagtagaagatgatcaagttgcacctgttccattgaatgtcgttgaaacttcaagtagtgttagggaaagaaaaaagaaggaaaagaaacaaaagcctgtgcttgaagagcaggtcatcaaagaaagtgacgcatcaaagattcctggcaaaaaagtagaacctgtcccagttactaaacagcccacccctccctctgaagcagctgcctcgaagaagaaaccagggcagaagaagtctaaaaatggaagcggtattgtaatctatttaatctatttaattttattgtatgatttggagcttggaattgagatattctgttaggtacatacacagaatgtttaatattgaatttgaaaccatgattattcatttcattatgtgtttgcttcattaacattaattgctggtagaaattagtattgatcataaaatagcactttaaacttcagggcctgatgcagtggctcatgcctgtaatcctagcacattgggaggctgaagtgggaggaccccttgagcccaggtgtttgagaccagcctgggcaacaaagtgagacctcatctctacaagaaattaaaagaaaaaaaaaaaaccccatacatcttataaatatccaactttggctattttacttaaaaccacttag

SEQ ID NO: 14590 - DNA, 1050 bp, Homo sapiens
aagttctgggatacatgtgcagaacgtgcaggtttgttacataggtatacacatgccgtggtggtttgctgcacccatcaacctgtcatctacattaggtatttctcctaatgctatccctcccctattcccccacgccccgacaggcatgttgcccttcctgtgtccatgttccccttcctgtgtccatgtgttctcattgttcaactcccacttatgagtgagaacatgcagtgtttggttttctgttctggtgttcgtttgctgagaatgatggtttccagcttcatccacgtccctgcaaaggacatgaactcattcttttttatggctgcatagtattccatggtgtatatgtgccacatttcattttcataatttttattagcccatggtaactattactaattctgcattgctttctcaattgcagtcaagtaagggagaattgactacgcttatacatcagcttcaagaaaaggacaagttactcgctgctgtgaaggaagatgctgctgctacaaaggatcggtgtaagcagttaacccaggtgaagacattcttatgtacgagggatatacttcccaaatcagaagcaacaaaagattttagaaattgtccataatcagtagtttaattatttgtaatttatgtccaacaaaagtaactttcctttagagttttgggagggtagatagagctgtctctctcttttgtgatattatagcctatagttgaattatttaaaataagagtacttacagatatcctagcttcagaataacaaaagcactctgtacagaagcatgggaatttgttttaattggatctgacctagatctgttctcaatagaaacacagaatttggtgtgatcttgtttaagtctgattaatggaataagtgtgaaactcttaacataggtaatttatttatggagcttcttgtgataagtataattttttgtcaagttcttcacatctcagaaattttactttgagaggttaatagtaaaaaataccagaaaagccaatctttaaaacatcatgaaa

SEQ ID NO: 14591 - DNA, 1556 bp, Homo sapiens
atgtaggagactagttgcaataagcagttttatgatacaacagtaaaggtagaggatgctttttttccctctttttcaaagtagaaattctgtgtttgtgctaatttatcctttctcccttttaaaataccaaggttcaactacaagaagctgagagaaggtgggaagaagttcagagctacatcaggaagagaacagcggaacatgaggcagcacagcaaggtaaggggaagaagtattcatgtaaactttgtatataattttgggtaaaatttcctctctcttccatctgtgaagaaagtataatttggcattttggttatagctcaataaaaatagcttttatactttcagaatatctttctttctttgacatttgttagggttttaaaataagttacctactagctttgcctgaagcattaaagttgcaggcaaaattatagtacatgataggttaatgggatcctggctgtgtgtgtttcttttctgtagttattctctttggttctttggttaattcttttttttttttcccaagaaaatactcacttcttattttgaagagaaaaacagagcattaccatcccaggtagtttacttaaaactgcccatttaatacatgctaacgtttactcatttactcttaatttgatggatccatctgggagataatggagtacgtgttatgtgtattgtttatttctctactactccctttctcccatgaaacgcaagtatagcctgctacaggagcatgcaagaatggaagcaggagagattcaaagaaggttttctagaggagagaatgcctacacgaaagatgagtatgagtaactaggcaaagaaagagacctctgtaaaatgtaatgttttattacagatttacagagtaaatttgtggccaaagaaaatgaagtacagagtctgcatagtaagcttacagataccttggtatcaaaacaacagttggagcaaagactaatgcagttaatggaatcagagcagaaaagggtgaacaaagaagagtctctacaaatgcaggttcaggtattttttcttctttttttttttttaaaaaaatacaggtggtcacttattagatctgtgtgtctagaagagagactaaagtctaccttatcctaattctgaaatgatgatgaataattataactttgtcttttgagcacttgtcacaatatggtgtgtttgaaggtgtgctcacccacagtcttaggctctttgtgttagattaggaatagcacaaacatatctttaacttctgtcttataagctaactcagattgtctaatcattgtttaaaataatgccttttggaatctaagaatgccttaaaaaaaaaaaagaaaaagataaacaaatgtacctataatacattgtgttcatatacatggggttatttattagcatgctttttctctttttggttgctatttatgaaaggatattttggagcagaatgaggctttgaaagctcaaattcagcagttccattcccagatagcagcccaggtaatgatgctttcttattgctt

SEQ ID NO: 14592 - DNA, 1859 bp, Homo sapiens
cttgaacctgggaggcagaggttgcagtgagccgaaatcatgccattgcactccagcctgggcgacaagagtgaaactctgcctcaaaaaaaaaaaaaaaaaaaaaaaaaaagagccaggcatggtggctgatgctggtaatccccagcactttgggaggccaaggcgggtggatcatgaggtcaggagatcgagaccatcctggctaacatggtgaaaccccatctctactaaaaatacaaaaaattagccaggcgtggtggcgggcgcctgtagtcccagctactcgggagggtgaggcaggagaatggcatgaacccgggaggcggagcttgcagtgagctgagattgcaccactgcactccagcctgggcgacagagcgagtctctgtctcaaaaaaaaataataattataataataatatcattaactttgaaaaatagttaatacatgtgttacaaatttataatttcagcattcaagaaaaagatgagaagttaaagactgtggaagaattacttgaaactggacttattcaggtggcaactaaagaagaggagctgaatgtaaagcattttgtagttttgttttccttgtgattattcagtgacataaaaggatttctctgtaatttgtgtaaggtttttcccatagatcttaaacttaatagtacctctcacatttataaatttatataatgcttttttaattaaagtttttttagaagttaaaaatgcataacattgactgccttaatgaggtagatactattgttatagtttgtcagtttccccacttgcaccaaaattataaccaaatgataactagcagacttaattcatgaaatagtactggaggccagagaagagattgccattctattttatggttgtcattagctttacctaacttgattgggaaaaggttgcgggaagaagtaagttaaaagatgtatttgaatgtagggagaggagtagcttaactaacaagttgtatactgtatatttttgaggttgtccagacatgagtggaaatatatgtggatgtaattgaattaaaaatttgtttggatagctatagaagttacagaattatagacattacagaattatagacatggaaaaaagtgagagttttgggccttccagagtagaaaagaagcagctaaagaaatgagaaactaatgtattttgaagctagctatatttttcagagagtaaaatcatgttttgcttatgtgtctttgaaaaaggcaataagaacagaaaattcatctctgacaaaagaagttcaagacttaaaagctaagcaaaatgatcaggtaatgtaaatttttacaactgttctttgtctctgtgttttttgtttgtttgtttgttgtttttaaattaaaagaaacggggtcttgctcttttgcccaggctggagtgcagtggtacaatcataactcaccgtaacctcgaactcctgggctcaaccgataactcctccctcagtcttctaagtagctaagactgtaggctcatgccacaatgctcggcttttattttatttttttgtagagatagggtctcgacatgttgtccagactggtcacaaactcctggcctcaagtggtgctcccaccttagcttcctaaagtgttggaattataggcatgaggcactgtgcccagcccattctcttttaaacagtgggcaaactgttgcataaaaacaagtctgttgtttctcttcctccaggttggaatatgtcaattatagttttaatttatgaatgataatcagtaatagaggctgcaatttaatactgattgccaggtactgtgacaaatactccagatagggtgccattgcct

SEQ ID NO: 14593 - DNA, 1054 bp, Homo sapiens
tttaaactgtcaagatattgaggatatttattaggttattatctttctaaaagggagattactctgttcttggaagattactcatttgtacaattattgtttgtcttttggctatggtgtaactgtcgaggtgcttatctcttatttgcttggaaagcttagggcctcatttctggcctgtttatagtagagatatgtagaccattaaagtaggtaattttaggtatatttctgccttacattttttttttttttgccattttcttttttaaattaatagattttattttttgtggtggagaactttttatatttataggaaaaagagaaataccaattctccctattaacatcttgcattagcatggtacatttgttacaagtgatgagccaatagcagtacattgttatcgttgttattaactgaagttcatagtttccattaggaaactatgtgggttttaacatgtataatgacatgtatctatcattacagtatcatacaaaacagttttactgccttaaaaatctcctgtgttctacctgtgtatccctccctcccttcctccacatcccggcagcaccccccggcaaccaatgatcttactgtcttcagagttttaccttttccagaatatcgtagttgaaatcatacagtatatggcttttctggtttggctcttttcttttctttttttttgggacagagtctttctctgtggcccaggctggagtacatggagtgcagggctgtgatcatggctcactgcagccaggacatcctgggctcaagcgatcctcccacctcagcctttcgagtagctgggactacaggcacatgccaccatgcctggctaattttttagaaacagagtctccctgtgttgcccaggctggtcttgatctcctgggcttgagtgatcctcccaccttggcctcccaaaatgctgggattacaggcatgagccaccatgctcacccttggattgccttcttttacttagcaatatgcatttgagtttttccctttttatacatttatctcactcttcat

SEQ ID NO: 14594 - DNA, 1260 bp, Homo sapiens
atggagtaggtttggaccacaatttaaatcaagttcaatgtgactcatttttaaggtcttttaaaattcatctcttttaaatgagatgcatttcaaaaccttggaagtgtcttttaattgatcagaattctacaggatagaaactgctatatccttggtggttttacttggccatgtaattgtttcacatttcagatgcagtcatcatttacatcttcagaacaagagctagagcgattaagaagcgaaaataaggatattgaaaatgtatgttatttgattgttttacttgtaacctatggatttgtttttagcattaacggttgtctgaagatctatagtttaagattactttatagttatgctcttaatatcttgggtagtgtttgagttgatatagttttatattcataagtgtcataattttgtcttgtggggaaatattatgaaaggaaattttaagtgtgttaacttttcctttgttgcattgctagctgagaagagaacgagaacatttggaaatggaactagaaaaggcagagatggaacgatctacctatgttacagaagtcagagaggtacttacaacagaatcttttcaaacttgcttctcaattcagattaagtttataacagtgatatttcagtataagttgtttgtggcagagcttccgagtagcatacaaaacatgggctatcataaggagatcaatcttaaactctaaacttcattgcagctgaaagatctgttgactgaattgcagaaaaaacttgatgattcatattctgaagcagtaagacagaatgaagagctaaatttggtaagaagcttgtcctccactgggtatcaagtaggcactgaaaacactttattgacatgtggagaaaccatccaggcttttttttctttgctaacatctttagcttggcctttttgtaagtctaagataatcttcatattccgatgattcctaagattatctttcttttcttgactcctaaaatgatccttcttttcttagctcctaacaatggcatgtttggcttccaactctttttcaaaattttccatgttttataaatcctattttctcaaacagcagtcttttctgtgaataaagaaatgaaataaagattggctgagttacgaagattttcttctcagactatcatagttaatggggccttttattttctaacctgggagaagattatattgaaagtcaaagacacatattcttcattcaagggcagtaatct

SEQ ID NO: 14595 - DNA, 1095 bp, Homo sapiens
aaaacttcatatgacctaaaaaaaaaaaaaaaaatctatttctgctcttttaaattatttattcactggggtaaggttgtattcaaccccttttcagtgctactcactcactttagctttacattctcttgagtaggactaataaaaatggattaccagtgttgttgttttaaatgttttctaacagaatttggctcacatttaaaagtatctacctaaaagcttgtttcctttgaatcctgagatttttctcagtttgattaccattagtgtgaattgctttgagtctatttgaaagggccatgctagatcaaatggaatatgtacttttggtgtttgacaaatgtcttctgattgccttctgttgctttgttttaaagtgaaattcattctttctgatcttttacagagtgaagtaattgggaaactgttcatttgaggataaaaaaggcattgtattatattttgccaaattaaagccttatttatgttttcaccctttctactttgtcagaaacactgaacagagttttgtcttttctaatccttgttagactactgatttaaagaaggaaaaaaaaaagccaactctgtagacaccttcagagtttagttttataataaaaactgtttgaataattagacctttacattcctgaagataaacatgtaatcttttatcttattttgctcaataaaattgttcagaagatcaaagtggtaaagacaatgtaaaatttaacattttaatactgatgttgtacactgttttacttaacattttgggaagtaactgcctctgacttcaactcaagaaaacacttttttgttgctaatgtaatcggtttttgtaatggcgtcagcaaataaaaggatgcttattattcaaacttgacttgttctaatttttattgagctttaacagatttcattagtagtacagatcattgtaatttagaatacagctattaattggcaaccattcaacaagataggtttatgtagcctctgtaacctttctaactgatgctctgggtcctcttcagtttggtccaatgtaaagtgccccaggagtgctggggtttcagaaaggac

SEQ ID NO: 14596 - DNA, 1034 bp, Homo sapiens
ataaagaatagtcaggggcagacttcttgatcccccaaaagagaagagagagacgtggaagggaggagtggggatgcctgtgaagccggccatacccttgggtttggcgtaggaaaactaattcatttcctggaggtagtgatattgtgtaaagcatcgaggcttgagctgccttgcatgcgtttcactctagctgcaagaggctatgtggtgtatagctgtgggcaatagctgtgttgctcacagagttagagctagatttttcatgtgtcttgcatcccgggacagagactgcatatgggcacctgccacttgtggaatctgcccaggatgagatgtagggagaagcagttaccaccagaaggaggctgcagttataccctcgtttgttaagacacgtttgtcccttgacctcattcatttgggtccccagaaaaggaagggcaaaggaagaatgaaagaaaagacgattccttgttgacattattaaagccagggggcagatgggagatgggttattacactgggttggactggacttgtattaaccgaagttacagaacagcttttgggtctgcttaggatgtgcagaagagggagactccgcaaagcagagttgaagactatggttgggaaaggacactaacttgttaggctgttctgcaacctgggtggtagatttttttttcttgactacatttttgtcatttttattttcctagaaaatctggccatttcatatttgttggcagagttctacaaggcagccaacataccacttgtacaacctatcacatgccagatgttttttaagcagttacgttagttcatttaatcttccctagaatttaactggccagggggttgtgctttcatcatcttcattttatagataaggaaactgaggcacagggaggataattaaattaaggtctcacagctactaagtagaggaaccaggtttccaacctccaacctaagctgtctggcttgattgccttatttatactcataaaaaaaattttttttatata

SEQ ID NO: 14597 - DNA, 1035 bp, Homo sapiens
aggatttgagaggcagtttggtatagtgggaagaacatgcatttacaggtgggtgacctgaataagcccttctctcttgctgactggctctgtgactttggcttaattcctcctcctcctctctgtttctttatcaatttgcaaaatatgattggattaggtaggcttcaagagcccttcctggtctgtgctcagtaattctgttcattggcgcaaatgtagaaactatttagttacatattctaagttccctgacagttgttttaatagcagaaaagatcaatgctgtggttgttttttatgaagatgtgcgtaaaaacagaatgtttaaaaaagttgtaatgatatacatctgtttgactcattggtgttaggttacccatgggagcatttaaattgtgtaaaactttatgttccaagtttaagaaagacagtgatgttttgaaatttagctaaatagactgaaataaccagcataaagaggagatgatctcatgataaaaatttagaactgaatagcattaggggaaattcctaatgtagatgatgggttgatgggtgcagcaaaccactatggcacgtatgtacctatgtaacaaacctgcacattctgcacatgtattccagccttaaagtataataaaaaaaaattaggactggaagggggcctaatggtcatggtatatgtttagcccttatattttattcttgaggacacaggctcccagaacaagagaggttcaagttcatagttgatctgggctgagctgggtggctgtactcccctactctaccctttcctcactttaagacagattccagcagcgctgtcagttcctcaaagcatcctttctggattcaatttgaagcatgtggctctcttgctgactaatggcccatggtggtttttggaaaaatattgcttactctcttagttcctctcacctcacagttgaatggataatgcattttgcaagactttttttttttcttttgatgcttcacaaaatgtatttttattggctctctcaacca

SEQ ID NO: 14598 - DNA, 1050 bp, Homo sapiens
ctgtggcatacaagcctcttggatgacagacctaataaatatgcatcagggggcattttcagcagcaggtttaaggctattgcgagtcattctcgattgaggttttctttctagccatccgcataatgcttctcactctcaaacacttcactctgcttatccctgcttttctgctcatgcagaatctgtttttaggataagaaatcattgtttcaagctttgtacttccattcttattagtactggtttaacagaatttaaccagagcgagcagttgtgtgtttggcttctaggctattggtataaaacggctgatcgtgattaccaagtgcctcggaggacctcggtggcccccctcctttcccatcttgtgcttcctgctccatgattatagaacactaattataatcagaactggtgatgggtgagcaattaggcttttctggactgatgattgattgatggattgattgattgattgcgttggggaaaggcccttcctgcggaaggattgtagacacaaaggagtgtgctttcacaccagatcccagaaaattatgctgactagatccttgatgtagtacataagattacattatggtttgggtactttcatcacatgctgtggatagaattcaaaatgcaacctgacaagactgataggaaataaattcattaagtttttattgagttgttttttgtctcctcgggttgttgatcattctagtgagcacaatttcagcctttttgatgagttattccaaacattaagtactgtacggtttgaaaatcttagctaacaaaagcatttttggagtggctttataatttataagtcatctgcaagtctttttgcatttgttaatctccaatattatctgaaatttgttgagagcgtggcagttgaagaatagcctagcttactgagaaccatgcttctggcagactggaacataagcagctttcacccaggagagctaatgcatgacacagattttcaagcttttaaaggtcacctgacatgaaataacagaactaacagagattcga

SEQ ID NO: 14599 - DNA, 1046 bp, Homo sapiens
ttttctaaaaatatgattctgctatccagtgagactctactagcacagatgaaagaaaaactgggccagaagtcctcacagtaatcatgtcacacaccactcccaattcggcagtctttatagctggtaaaattcagctcctttctttggaaggggtgatgcaaaccagcttctttactaaaaaaaaaaggtgagattttagtatttgaagttcgtcatttgtagggcagctcattgctgttaaaatttctggcttttctggctttcatcagaaatgaatgattaatttattctgaaaatggacctttcctccttcccccttctctttttcctgccttgttaacgtcttagcacatgtctgaatgaaatggaagtatagctctgttgattatagctaaatcacccgtcatgcctcaaacatgtataatttagagctgggtgcttcaattgagtgctgttacatctgaaaggtttataattttacagaattgatgcacacttctcatgaatgtcgtcaggacttgtaaagaatagttaataacagcctcctcctcccaaaacacaagcaaattccttctaccccattgtacttattcatttaaaatgaattacaaccatatctatggtcactttaaatgaaagccatttgaatatattcttgttaggtgcaaattaatctaatttcttcaaaagtagtcaaagcaacagtagatacaacaataatgtctccttaagttctattttgccttcacagtgaggtctaaaaagaaaaggacattaaatttaagcaaacctttgaaaacaactcctgttttgaaaacaagtttttgaaagtttctaagtcaagactacctacattaaagagttatatgcagatgccatacaatcctcagtaggatcatatgcctctttaagaggatgtttgtcaacttctccttatggaataacggcagggaagaagaatattgaagacttaaaagtacttttagtttttaactttatcccaaggacttaatagtgttttcaatttgaaattttggtttaac

SEQ ID NO: 14600 - DNA, 1040 bp, Homo sapiens
tgctgtgcattgtagggtgtttagcagcttccctggccttcacccgctaagtgccagtagcacccccgcattcttgctccccacagttgttaatcactaaaaatgtctcaagacattgcagcccgtctcctggggagggctgggcaggtaaaatctgtcctattaggaagcactgctttagtataccaaagcagctagcatttattgatttggaatagatgtagttgaaatgtgatgttctttatcctaaagagtttttgttttaaatctgggtataaacctcatgatttattttccttctgttaattgagtgtagtaggtggttttacataatctgtatgtacatggaattgaatttgtgtggctcatagaaggatgaaaagtatacacgaccaagtgataaaagaggccgactatacatatttttttctcataattttgaagtgaataaaatgctaattaaaaaaaactggttatttgttttctgatctataagtcgaggaaaaaatctgagtttttattccaattgatatatgttacatagtcgatttattacagtgtttctttaattaaataaattccttaatatatagtcttattttctataaaatatatttacatgaagcatttcatacggggctactggctgtacctgttgatcatgagtttggaccacctggcatataaatgagagtcttgatttccatttttcctgaaaacccacttttggaagaaaaaggaatggcttcatggaagcatgtgtgatatttatatgcaatgtaaacatagatcacctttgttaatgtttttatttttaaaaagctcctatttctgaagcagtgccattgaaagaatttgttaggaggtgccaattgaagcgatcttgtattaatgagggatgagtagataagaaaatatcaaacaccacggaaacaagaaagattaatatttagtagataagccaaagctagaaaaagagaaataaactaaacatttttaggtggaaagaacattttatgaggaaaacaaaggaaatccaa

SEQ ID NO: 14601 - DNA, 1032 bp, Homo sapiens
tacggtttcataaaatgtgtaattcatattatttagagaacaaatggaatattttacaattttttatttatatggctatttttttattaaaaggctggttgttaaataatatcactcctgacatgaataactttaataagtatatctgtgattaggtgattatcctattatatgttttacatagagtgagttttagatcaagaattggctgttactaaccctctattacatttccattaattttgactaatcagtacttttctgtaaaatttgattaatcaatacttttatgtttttatgtagttcttttggtaattctgtcgttgcaaataatgtaagtatagtaatttgtgagctgttctttttccttcttatttttggtttagtttttcacttctgttactcacaaagcaaacattaggctctcttatttaaatacattttctttcaaaccacctaagtaaaatgttgagctttttgctgctgtatttaagccaggcagtgttactttcactgatttaagatctgaagcagcatacctacttatcatcatttcattatacagatttgtgtaagagtgtttaaagtaggttttaagatacagtatgtttaaaattaaaatttgaggtatgatttgcagtgtccactgaatacttcaagaaagtagaagagttgcttcattatatcacagttttgttagtttcagcaattaatctagtttgacattagcatttttgtttttctgtaatctttttttttctagcatatgtagtttcatcttttcaaggaccaacaactaattttgtgtgtatgtattgatacttaacataaattgctgctttgctgtgtggtctgggtagaattattcattgttttctagcaaaaagggacatttgtctcttttttcctgcatgtattatgtggttgggagaataatttctgtccccattctcccaagatgctcatacattaatcactggaatctgtgaatatattaccttacatggcaaaagggattttgcaggtggaatt

SEQ ID NO: 14602 - DNA, 1035 bp, Homo sapiens
gtaatcacatggaactcaatcctgccaggtccctgaatgtccctgaaaacagattattccctagaacctccatagatgctgccctgtcagccccttgattttggccttgtaagactcaggcagagaaatcagccaagcctgctgaacttctggcaaacagatctgtgacataatacattagtgttgtttttagctgctaagttttgtggtaatttgttataaccacaagagaaaacttatacatactattttatggaaaatcaaatgcaaaatacctcacattactgagcagctcttaatctcgtggtgggggaaatgaaaggttggggaagagatgaaagaattgagaggcagggaatgaggttttttgtttcttttaaaattcttttggatggagcattagagcaggaaagcttgactctagcactcagtaacttaattatctgtgtaattatctgcattactgatatacagtaattacaattttgacttgatgcatgtattcgttggaaaaataatttaatttgtgttgtccttaaagcataattttattagagttgcttttaacatgtcagtgcggaaagaatagttctatctgcatttataattatgcttctactcaaacttatttgaattatgaccctgattcaggcacttgcagcccatcttttcatggaggaaaagaatcttctgctgcaaattaaaaaaacaaacatggagcattaaagttcgaaggaactttattcaaactgactgctcattcaacaaatgaaggagttaaaaagttcaaggaagctcagtatgttgacctaagtcactaagccaggtgcgctacccaggacccaagaatgttggtctgttgctgcagatggcaggtagaaaatattctgaaggataagaccaaagctgggttctgctcctcatttttccacgtttctatactgtgaattgggaaatttattcatctccaaactagaatgctgcaaccctaaaataagtgaatatgatatttgccaataaaaatggaagttgcct

SEQ ID NO: 14603 - DNA, 1050 bp, Homo sapiens
ttttcgttttgtttttgttttgaggggtttttcggtgaaattgtgaaccctgaaactagtgtgtctggcatttatttctggagaaggcccttctaagtctgtgtttactaagcaatttgagccacagaaaacttttagtctctgataatttgatatctggtgatgagacagtaattacatcactatttctaggttggtaatctttgctttggaaaatgtgtaatcctctgcttcagacatactcagtgtggatccatcacagatgtggctgaaagaaaaaaatctgcaacctcttgcttttgtacattcttttctcttgccaaagctgtcttgccctctgcactgtgattgtattatactgcccatttgaaaaatggccgataggatcattttaaaatcataatctttaaaaaatatttttactttaggaacgtttgtcttaatttttgccgatatggtgtgttaagattagaatctgttaatttcctgacatttattaactacgtgatatttaaattccttgcctatttttgaattgtattgtttgacttctgttttttaatttgtagaatctgttatatgtgttgcatatattttgtttatcttttaactttgttcatggtgtctcatctcatacttgagttgggtataatcaaatctggaattttctcacttaagctttataagtttcttgttttgcataagaagtgcttatctatctcaaggtttatgtaacatattttttcagatactttaagtattttattctaggtgtttagatttttcttgcattagaattttttgtttatttaattaatattaattgagcatctgctgtgtgccaggccctgggctctgcatgggatgagttaagacaaacatggtccctgcacaaatggaggttgtagggtcagaggcaggcaataaataagaaatcaaacaaataaatatataatattcattggtgctcagcactgtcaaggaaacaaacagtggagaatactgtgagggccagggacacatatttaagttttgatgagttatgaaggc

SEQ ID NO: 14604 - DNA, 1034 bp, Homo sapiens
tcaggaagggagatctgagcagtaagcagggctgagctcctgggaggacctgccagcccaaatatcaggcaggcgttagagggcttgttcaacaggggccgattgatgggaacgaatatccatttttgaacagtcacattggtgattgctttgatgttatagagatgattaaagatctcaaagttggtgaatacttggagatcagttagaagctattgtccaggcaaggtgatgtgatttagactgagttgttttagaccgaattggtggcagcaaaactaaagagtaggtgacagcttagagcgatattcatatagtaggttaatgtggatgcttggatcagtccttaggttgtcttgatgtggcagctaagagagccggaaaaggctggggccactctgagcttctgacttgaagaaatggaaggataatgtgaatttggaggaggaccatggtctttttcttggagggagtagaacaggggagaagatgactgcggtttgcggtatgatgaatttgaggcatctgtaagacctgaagtgctggcattcagaaggcttaaaatgtatgggtgtggagctcggaagtggggtttgggtaagattagggagtttttcataaagatggtgtttggagaaagaggaaatgactcccctggaaaggacttttaaactgttaagaagagggcctggaaaagaggtgggagtctatgagttagggtctggagggtgggaagagaatctgaaagtgctttattaatcccagcactttgagacgccaaggtgggtggatcatgaggttagatcgagaccatcgtggctaacatggtgaaaccctgtctctactaaaaatacaaaaaagtagccaggcgtggtggcacgagcctgtagtcccagctacttgggaggctgaggcaggagaatcgattgacatgggaggcggagggtgcagtgagccgagaccatgccactgcaccgcagcctgggcgacagagcgagactccctgtcaaaaaaaaaaaaaaaaaagaaagaaa

SEQ ID NO: 14605 - DNA, 1043 bp, Homo sapiens
tacttgcaagctgaactcaccactttcatagaaaaccatttttacctaaaagaatgacatacaaatatggttattcagacttgggtatttggcaaccattttctatagggaaattacaggaaaattttgttaccagcgttaaaatttaagctttcaagcaaaaattaggattttggaaaacttgtatctgctaccaagacttgacagttccgaatacttaatatttttctgatgaagttggtggtgatattaataaatgtgatattttgataagtataatgaaatatgtcaacatttgtaagacctgcataactcagtgaattaatatttcccaaatgatcaatgcatgatgttacagagtagtacatagttaaaagattaattcaaagtataaattacaccaatggattttaacatcacagagtaagaaaagctcattgatgtagtttcagactccacattgcaactgacctttaagaagtgacccccacttgctgagtttggtgtagtaccacagcagcgtctgccattttctgaaaaggctattaaaaattacccctttttccaattatatatgtacgtaaaggaagattttcttcatatactttcaacccaatcgatgtgttgcaacagactcagtgcagaagcagatatgagaattgagtcagacattagagagatttgtaaaaatgtaaaacaacatcactcttccagtaaattgttttcattttggaaaataggtttttttaataaaatatttcgtttcgtggtagtatgtattgtggttactattgttttttgtaagcgaataaatgaataaaaatttttaattttaatttataatatggtaaatgcccacagatatatgaacaaaagcttttggggattttccagtcatttttagagagcgtaaagaagtcttgagactaacgcatttgagaaccaatgatttgaatatttgaaactgaaaagcatttaataagggaattagttgcttgccaagccatttgaagggctggaggaccaatacctgggaaggccct

SEQ ID NO: 14606 - DNA, 1036 bp, Homo sapiens
ctgatgttcaattaagcagactagtctagtgttcaacatataagccaagaattgcactttcttcttatttatgccttatggcactagagcaaagaagtagttccaggtggatcttctgataataaaaatgattagtgttgagaccaacattgttacttctttacttgttgccaatttttacacatttgagaactctgtagttgactgtgtagtcagttgcatacaagttaatgtcttgtgcgagattttaaggttaatttcttcctgcttactcttccacctcccagatgttttcctttattttccctaggagatggaaatggaaatgttattcttctttattgttgcgggtaatgccttaagaaaaatcagatccaagactgtgtgcatgcacgcacatgtgtgcgtgtgtgtgtgtgtgtgtgtgtgtttgagagagagagaggttggtggggaatgaagagagaggatttaattgccaagatgattacagattaagctacaaaaagcaagagagctattggtctgaaactgtgttgtgtctgtagagtgcactctgattcacagaaaattttgtcaacattaaatgcgatgggagttgagttttcagaggtggtaactatgaaggggttggtcatgtaatgctgtgcacatattagagcaacaggcagtgctctcgcactgcttttacctggatttataaaatgcccagtccttatactcttgagcatgaccagatccatttcctgtttttttcacatttctttttctaagaataaacagaaccctaggaagggaaggtagcttcaaatacaagccattttaagtatcctggtctcttaattccttttttatttttttttggatgacttgaggacaataaggtgtttgtttatttatttatttattttggttttaaggagcagagagtttaataggcaagaaggaaggaagaagacagaaggaagaagctcccccgtacagagacagatgggggctccaaaactgaaagaggagatccccctcttaattctta

SEQ ID NO: 14607 - DNA, 1033 bp, Homo sapiens
acatggcagctgaagtgtgtgtttgcatgttgtaggtggggtagagtgggcgaaggtgttgatggagaaagggcaaaggatgaacgaaggagaagggaacacgtacaggacaaaatgataccttggcaaatggtgaacaatcgaggacattatttgagaattgggaaggagaggaaggggtaaatggctgcagccgacccctgttcaaggcctgtaaggcagtttggtcctcccagtgacccctgatgctcgtgcctccgtccacctctacagcctgtggccaaaacccaaaggaataaagagggccctggaaaacccaagcaaattgcactattctcaccaccactgccgctgccaagggagtctttctttccttaaccgtaactccctctctggtcttaatttctaacttcagagcttaataatgcttcttcttaaggggcagaggaattcttaggctcccagtgctctctgggagaaggacttagagacactgggggatggtgtgaaatactttagagctttgacattctcccccttgactcatatgggggttccctgtcactgagtagtattcagcccataggtggtgagacccagcccttggtctctgaagaccatcctggtctctactcgcatgttgtcctgttcccctatggcttgcagatgtgcagaaaaaggccacaattgtggattgggtgcagtcataataataggaaagcaaaatatgaaagcagatgtagagagaggaaaatctaattgtaaaagagcctgtttataagttgcatacatgtcttgattatttttcttcttttcatactagaaaatatttgatcatttattattattaactccattgagggccaaatgcagatttcaatactgtgtttagtaactctctgaagttgcagaagggcaaaataagtcacagtaggtttttcgttcatttttctaatttaggcatcattcactctaatttcataagatttgaatgcagtttgctaaaattccagaaggagattaatttaccagt

SEQ ID NO: 14608 - DNA, 1019 bp, Homo sapiens
gcgtggtctaccagtattgattagagtgatttttttgtgttgtttctctgttaaaagcagtgtttacggacgtaggccaactgtgtaccaggaagtatgggcttgacatggttatgcattactttatttaacccatattactttgcaaatagttttgattatctgtagtacgctgggaaactaagactcaaaagttaagtaaattgttcaaggtaatttacctaggaagtagcagcgctgtgtctcctatcccatttaattattccatcatacattgacttatattgtgcaatttttctcatacttactatcttggccacgtttcctttttagaatttaagaaatattacattcttctgaaaaacctttaaactatacagaaatatataagaaaaaccttctccaccccagtaaccatgtggtagtgtgatacgagagtacctttttacgttgttggtctactgcttactttctgtacctaaataaaatacagagatacgaatgtgtacctgtgtctctgaaaagattgagttaataaatataatggacctgtagaattgtgtctggtacacagcaagtgctcaaatgttgctattatatgtacaaacacatacataatgtgtgtatgaaaatcaacatacacacacggaattctttcaaaaccaaaacaggaatgggaacagtctctgtatacaatgcttaaactacttttatcacccaagatttatcgtgtatattcttccgattattatttcagtcaactgtagtttttctttttgttgctacaaagtatactctatccccttaatttatttagctgtccccttacggatggatgtttaggttgtctgcatgctgttagaaatagtggtgcaggggactgcttgagcatagatctttattcatgagagttgattgtctgaacctacacatataaatgtacatttatcactttaaaaatgccttatcttgttacatttggcctgtttttataatgtagtcattgggtagattttgac

SEQ ID NO: 14609 - DNA, 1025 bp, Homo sapiens
gaaatacctaatgtagatgacaggttgatgggtgcagcaaaccaccatagcacatgtatgcctatgtaacaaacctgcatgttgtgcacatgtatcccagaacctaaagtataattttttaaaaagtggggttgggggaaggtggtggaccacagcagattgtataggcaggatggaggagatagtgtttgatgtacgtagggcccacagattggtgtgatcaggtgtgtcatttacataatgtgtggggaaggctggctgccccactctaatcttattatgcaaatgaattatccttggctggcaccatcttgtctgctccttactgtacatgtggctggcagagaagggaagatggagccaccaccttgaacatggctagtccctagttcctgctggcattcactcgtgcaagctcccagcttgcttgtctatgcagctcaactttacagggtgctctttgttagaaaatgatttggggctgcttttcattaaaaagaaaagccttactgaggactccagtaccctttcttactatctgtctaagtaatttcatcttaactcctgtgtcatcggtgctcatgatggagtcagtttaggttaggcaagacaaaaaataccatttacactcaggagcagtggctcatgcctgtaatcctagcactatgggaggctgaggcaggaggatcatttgagcccaagagttcgagaccagcctggacaacatagtgagacccatctctccaaaacacaaattaaaaaaaaatattagctgggcatggtggtgcacacttgtagtcccagctactctggaggctgaggtgggagaaggcagaggtgggagaatctcttgaacctaaaaagattgaggcagcagtgagttctgatggaaccactgcatgccagcctgggcaaagatcgagaccctgtctcaaaaaagaaaaaaaaaataccattaacttcaaagtaaaaattaactataaatgtaagaagccaggtgtgagtctgaagaaagcatatatccg

SEQ ID NO: 14610 - DNA, 1038 bp, Homo sapiens
cactccctgtggacacgtgtgctcggagaagtctgcaaaatactggtctcagatcccgttgcctcatggaactcatgcatttcacgctgcttgccctttctgtgctacacagctggttggggagcaaaactgcatcaaattaattttccaaggtccaattgactgacgcccttgacagccatctacgactttattaacaggttactgtgaagattttgccactaactctagattttacctttttgtaatgctgtttatcagaggagggtgacaggggctggaaataaagagaggggacatggtgatgaaacatggcaggagtgtaacagataccagtggtgtgttgcatgctcaaaacagcagcgtcgtcattgaagtctgcttgattaaaccataatatctttgtaataattggatttaaaatgctatgcttctatttttaaccttgggtttttaaccaagtttttttttttttgtaatcttggacaagactttaaatcatattttacagatgtagaagaaatttattcaaaagtgtgggctcatgaagttcacttcagtgcagtgtggtgtaggtgttacgcgaagggcgcacagtgtctagaaatacttgatcgtggctcaaacctgaccagacagcagaggggcggctctgtacagtgtgactggtggacagatggccttaggcacaggtggttttgaaatctggggctttttctgatttatttttctgacttgttgggggagagaatattcataacttgtgggctttttttttttttaacttcagtggaatttactttagatattcattcatcaaatacatgggacttcacaaacaattttccataactttttagcctgtcttttgttatttctgcctaatatgatttgccccgatactcatcttgcacggccagaactgtttggttgattaaaatacatcagctcttaaaaactcattaactgagggtaattacagtagtagacatggtctgggtactatactaccatgtttatttgctgactgaattaaga

SEQ ID NO: 14611 - DNA, 1031 bp, Homo sapiens
gctgttatctccccaaattgcttgtcttctcctttcaaggttttcactcagaaaggtacagaattaccacttgatgagttaccatggcaacccctatacattatcttttaaatatcccagacatgcagagtctaatttgactgcagggattttaattcatgacttctatgttttgtatagtaccatgtttttaaagttaatgaattataaacagaaaaacatagttaaattggctttgattaaaagatagcttatttagcaatgctgcttccatatatgttcctcaaacaacagaacattatttcaacctatttcaaatctataccactgagagactgctgcacacttctgcaataggctgtgatcctgggaacctgggatgggaacttcattattagtagaatctagtagagttggccttgctatgttggtgtctgaggctggctctttctggttgtctcaggatgccatcagtgattagtaaataataaattataccaagaaagaagctcgtttgaatgtttagtatgccttgcaagggaaattagggacaacgaatagacctcttctattctctttgcacttgatttgcaaaaatatttgtttattaaatgagttattacatggacagcagttagaacagtgcctggcactttgtaaccagtcagtgagtttcatcatcattgtttgcatttttacaatgattcccagtacaaaagccttcagcatcttgggctcctcaacacgctgggcttgcatgatcctcatcacactgtttatcttactcttgactactgctgtaagccctggattgaactgttccacatgccctctcaccattatgtttggatgattttaaagagatttctgtttcaaagaaatgtaggaagaagaatttcacagcctcttgggttgcaatcttatttggtggttaaggtgaatataacttagattgtgtatatcattattaggggaatcttcactaacctacagaagcagtaaagaagttgtatcacactgtcttgagcttc

SEQ ID NO: 14612 - DNA, 1104 bp, Homo sapiens
tttcagctttgtgtttcttttggttggtacagtcttgatttttaaaaatatttataacaggtaactcttcctttttaaatgccattttttattgaatactggcttatgtatcctgtggcagaatctcacaatctctatttgtctgagtccacacaatgtcatttaacatattcctctatcccccataagtttgtaaactaatatttgcatctgaagacttgattagattcagatttaagtttttaaaaggttacctcatggcagggctatgaaatttccattgaatccctttagaaggctcataatatctggctgtctttccattaatgcctttaaggtggattagtcaaatcaggttgtcaagttgatccatcctttataaaattccccatcacaattttacctaatgctttgagcagtcactgatcattgcctagaatagaccccttgttttaccgggtgttccaaagtgtgaattttctaattccactattctttatgcatttattagctagaattccataagaagaacttacccttgtcaactagttagacatcctaaaatacattcaatacagaaaagacaggataaatgtctatcccatgcttttaaccactgtgctatcctggaaagataatgctttctcacaagcatgatctgatagggtggggctggcatcaaaagggtctagctagtgaaggttctcatccttaggtctcaggagactatgcagattgaagcaggatttctgttgggagatggaaagaggagatcagggcaagctacagggagaggagtctggcaaagtttctgccccagcccatgaggctgccacagacacagaactggagtgtgatggggaaataggacagaggccctggaatatggaacaggcacactgggtgaggttaaaagcgggaggagttaagaacatcactggaaatgaaagggtctagggtctccacccaagcaagaggaagctgagccaaagtgtagctgggctccttaaagggggcggggaatgaatactagacaatgtgggactgagccctggagggagtgttctgaaaagtgttcgtgaagggctgggtttgtatgactga

SEQ ID NO: 14613 - DNA, 1029 bp, Homo sapiens
gaataaacagcatattcactggtgataagttatggagacagtaggagggaaatatgattgagagtgggggtaagtagtgggtccttccgaatgactattcaggaaagacctctgaagaggtggtgttttagttgaaacctgaatattgagaaggaactagccatgcagaatatttgcaggagaactcttaaaaaggtggaagccaggtgcggctgtttctatgaaaaagaaaagcatgactcattggcccttaaatcacactaattgttttgtatttgatgcaagaaacaagatccatgttttgtttttggattcaataatgccatatcatggccagtaattttgtcagaatagtgctgtaatttcaggtggtgaacctatggactgaagaagcagtttttgctgcatgactagtgatccccaaattgagcagcttaaacagcaaacgtttatcgtctcccgtttttgtaaatcaggagtctgggtgccgtttaagctagatgctcgtactcagaaaaaggttgctgtcatggtgtgcgatggggctgcggtcttctcaaggctcaatttggggagaaacgcaatctagttctttgctatgtgggtctccataagttaactgacttctgtcaagaaaaagatgaaggacacctctctgtctgacagctctgtcattttgtaacctaatactgtaagtgatataccacttctgcattttattcctggaacttcgtcagtaaacccaacccatattcaagggggaaggattacacaggtgagaatatcaggacttggggattagtggggatcatatttagggctgcctaccacgttgaagatctttgatgttacatcttcaaattgttacctttcttctttcaggtcctgttgcacaagtagggatagtgtttcattcgtgtagtagggagtttctgtacagtgttaccaagattggtatttcataatggaagtaactttatagttgtgagttttggtgctggagagcattattcagaggttaggtagttc

SEQ ID NO: 14614 - DNA, 1022 bp, Homo sapiens
ttgttcacgctggtggctaaactggcaattacactgtttccttttggttcaattgcctaccgcgtcaatcttctctgtggcttatttggagcagtagctgcatcattactttttttcaccgttttcaggtaaagtagttgattagttaaaattaattttgagcagttggagatgtagatttcttatggctcaagtacatacattaaaaaaatcttttgttgcttggtttccctaacacatgtgatttcactttcttaatttataatactttcatatgcatttgacccctcaaatgattacacagttggttttgtttcctacagtggagtgaaggtgtcaccagttcattatcacagttctctgattaggcagaactaatgaggtttgtcattttgtgaagatgcagatgggccagtttaattcaacaatatgaggttcatcttttggtaaatggtaaatatcatttaattattcacagtattgctgacgagcagctgcctatcaggtccagggctaatacctaattatattgtattctaaatatgaacatgttgtatactttctgaaataaggatattaactaaggaaatcaatttgggatgtggttttagtaaggtttcactctgctccgttatggctgtagtaaaggtaggcaaattagatcccaagtaattcattgatagaagactttcttaggttggaagtctaccctgcttttaaaacattggtcattagtttagaatgctggtaacccattgtctttgatgttctgtctccttcattcttaactcagtgcatcctatacctaagaggattatagtgaaaaatacaaattacactttctgcaaaaggaaaaaccaaattaaaacacttcttctaaaaacttttgcatgtcttactataaaacaaatgatttctgtaggtaaatataatttgaataggtacaatttcaaatgtcttttttggagaccaatatttttatttgtgtcaaagtcataatactgccctttagccaaattcta

SEQ ID NO: 14615 - DNA, 1100 bp, Homo sapiens
cttattaggaaattttgatgagcctgactaattggtggagagaataatgttgatcattagtgaatgagtgggatccagtttattggaagcctggattctaggctgactgatttagaacttatccctcaagcagcggagagtccttaagtttttgggctgggtagtcataaaggatatgttttaggaaacttgatgtgatgttatattgcagaatagattgaaaaacagaagacaaattagggaactcttaaaataattaagtgtaaggcagtaaaaatacaaataggaatgagtagacaggaaagtaatttggaaggaagaaataataatgtgttgaatcaggatcgctggaagaacgggaagctgaaagaaatgggaaactgctgattttttaagagaaagaaaacaaataaattgcaaacagaaaatcaaagtaaaaacaggtttactgatattgagatttttatttaatcatttaaaaataatgattgactaaagccatagaactaccctgtaactttttatacaaaaggatacagttgaaaatcaatggtttggagctatagaatatgataattgttggacgcagtaatgcttgctgaattttctaacactattagaaataggcatttcataatagctttcattttcatagttttagattaataaggaaatagaaagttgttttggtttgatatgcactagtaaattcatccacactaccagtctcaaaacaaatctctgaaccgagatccagattcctgattgttttaaatggtatgggttttgttggcatttgtgggtgagaaatttgtttctgagtgtagcatctgattcttctggtgttattgaaattcacattcccatcttcttctttagaaaaaaaattagttttaacttcaccgttgtctaaagaaaaaaaacccttgcaaagtaagaaatgcactgtataagatattgaaatcatcagatattgtgatcaagacattctttgccatatgctgagagatgaaaatagaaggtacctaggtccaaacattctacctgaagtgagaatgcatttttctgaataaatattttttcatttcattaatttttac

SEQ ID NO: 14616 - DNA, 1050 bp, Homo sapiens
aacgcttgtagaaataattgtcaacatataatcatagtaatatatatagttgaagtctactcctaatgatgatgacaaagtgaattggtcttagaattgtattttgggcatattcaaaatcagccaaacaacacataatcacttccaggcaggttatcttagctgtgcaatgctgcttgtcatgacatggttttaaatgtaagtgatgcaataaacatgatactcatgagcctttgctaatattatttgcttcactcagctttcacctgccatgcaaaggagttcaggctgatgcaattttctagtaatccgtagtaatcagaaggtttaacatagtattctgtggtgacttaatataaattgggagatcagctctgagtaaacatatttgatgttttccttgatatgttcttgaagttccgagatgaatctactaaaataaacattgttataccacccaatgtgctctgatgcaggaactctccctgggctctttgttgaagttgagcctgtacttctctgctggtttgctgccctatgtccaccttcccatctcatcttaccttaatcacgcccggtggacctggggagaccagacaacactgcaaggatttttgacacattttctcagggaagaatatggaaccttcagcctggtaaattcagatttaaagcccttctaaggaaacaagtggcaaaacttcagtgctctgcctgggccttgattaaaaaaacaatatttgtcaatgacagtagatcaaatgtttgttttggttatttatgtaacaaacttgccccttggaatatggcctttgatatatgtaagagaaaagtcagaatcacttaatttaacatcatgtagttgtatatcctgaatatactttttaggatagcagtcattaaagtcttccacctacagtcgaaacatttcagtcttgttagcagtgagtcactatgggtacttgatctgtgaataaaactatttggaaaagatcgaaggaaaaaaaatcctcaatttaaaaaattttccttgaccaaaccacttcttat

SEQ ID NO: 14617 - DNA, 1086 bp, Homo sapiens
tgggattaccagagtgagctaacacaaccggcctacaaaacattaaaaaaaaaaaaaaaaaaggcatggtggcatgcacctgtagttgcagctactcaggaggctgaggtgagaggatcgcttgagcccaggaggtcgaggctgcagtgagccaccttcatgccactccagcctaggcaacagagtgagactctgtctcaaaaaataaaaaaataaagataaagacagtcaaatgtcatatcaatgtctctgagctttcattttattctgctttgctccatgcagaaggactcactgcctgctcttttctatctaccttccagagattgttacagcattaaggataactggtatattttgtcttagcaaaccctacatgaactccaaagaactcttgagagtaatcctagaccatatgtctaacttttattagttgcacataaaagtcatctattgggacccttaaaggcctcctttacattaaaataatagcaggctgtatacccagaaaaaagacttgacaaaagtgatgaccactcacacccacacttctgtgttctgtgtggaccaagtcatcatgtagaatgaaggcataatcttagcactccctgaatgagaatgtctagtctttaatagtttcaggtgggcaggaacattgaaaaaggcaactcataattaacttatgagaaaatccttcaaaatgatagaagctaatcatctacccttttccagtcaagcaaattaaattttttccccatgcatatctctaaattgcaatcctgtacaaggaaattattgaatctaaccttaggcagtgaccatcttttagcgcttacacttaagcaatagatctccaagaataattttgagactgacttcattccttttgaagaatggtttgaaatgggcctcatgctggaatcaattttttcaagtgtatttgaaaatgagtaaggatatcttctcatagtagatgagtcttcattagtaaaatacacattgtatggtttctataattatggtatcacattttctccagtaaaattgccggtagggagaagaaagttctttgagatgatgtataga

SEQ ID NO: 14618 - DNA, 1021 bp, Homo sapiens
gagaacaacagacactggggcctacttgagagtggaggctgggaggagggagaggatcagaaaaaaataactattgtgtgccaggcttaatacctgggtgacgaaataatctgtgcaacaaaccctgtgacgtgaatttacctttataacaacaaacccacacgtgtaccctgaacataaaataaaagttaaaaaaacccacaacattgttctttataatactggggtagagctggtgttaggaaggccaccaggaggccttgagagaaggggctgcgtgtcctggacacaacatcatcgctagctcaagaaggtgcaccaagcccacagtgtgtttcccaaccttttcttatcccagtcatctcctggctcaggccattagggcagtccaggttcgacaccagacatatttgcacaggctaggtgtttttatcttgttttgattttttttatttgtcccaggggaatggaatacatagcacttttgctaggtggcaaaatgtgcctcatcactctgcaacatagggaatcaggtaggaaacagtaatttttacatcaattacaaaggcagggataatattctgttcctagaggtgttcatttgttttgtgataccccagatattctcagctccatcaaatgtaatggacttggtaataacagaaaggacattgcttgtctcattttttgatactaattactgttttgtcatctttttcttttttcatagaatgctgtcagaattcatgccagtttttctttgaagttagaaagttaacttcattcttgaaaagaatgaagttattggcaatagcaaataatgcctggagagaagtaaacaactcaggaaactcgtcctccccttgcttctcattggtctcattccctagcaatttcttgatctccaaaggcagagagggacacaggaggcctgtgattcaggggagaagtggaaaggatcaacctctgcatgcaagaaaatcatacaaatgccatacaaattcaagtcagaaatgggcag

SEQ ID NO: 14619 - DNA, 1035 bp, Homo sapiens
gtaaaagaacagaaattataacaaactgtctctcagaccacagtgcaatcaaactagaactcaggattaagaaactcactcaaaaccactcaactacatggaaactgaacaacctgctcctgaatgactactgggtacataacaaaatgaaggcagaaataaagatgttctttgaaaccaacgagaacaaagacacaacataccagaatctctgggacacatttaaagcagtgtgtggagggaaatttatagcactaaatacccacaagagaaagcaggaaagatctaaaattgacaccctaacatcacaattaaaagagctagagaagcaagagcaaacacattcaaaagctagcagaaggcaagaaataactaagatcagagcagaactgaaggaaatagagacacaaaaaacccttcaaaaaaatcaatgaatccaggagctggttttttgaaaagatcaacaaaattgatagaccactagcaagactaataaagaagaaaagacagaagaatcaaacagatgcaataaaaaatgacaaaggggatatcaccatcaatcccacagaaatacaaactaccatcagagactactataaacacgtctatgcaaataaactagaaactaatctagaagaaatggataaattcctggagacatacacgctcccaagactaaaccaggaagaagctgaatgtctgaacagaccaataacaggctctgaaattgaggcaataattaatagcttaccaaccaaaaaaagtccaggaccagatggattcatagccgaattctaccagaggtacaaggaggaactggtaccattccttctgaaacgattccaatcaatagaaaaagagggaatcctccctaactcattttatgaggccagcatcatcctgataccaaagcctggcagagacacaacaaaaagaattttagaccagtatccttgatgaacattgatgcaaaaatcctcaataaaatactggcaaaccgaatccagcaacacatcacaaagcttatccaccatg

SEQ ID NO: 14620 - DNA, 1047 bp, Homo sapiens
ccttgagcctgggaggtggaggttgaggtgagctgtgattgcaccactgcactccagccttggtgacagagtgtctcaaaaaaaaaaaaaaaaaaattattataaaaactcaagagcttttaaaaattactcttgcaaaagctacagaaactttaaagaggattgtttataaatggaaaatgattcatttatcaaaaaactagggttccttagtctgacaggtgaaagttttcaaaacagttcgttcttaaaagcataaaaaactgagttcaattatgcagagcttaaaacaagcaacttcactgatagagaatactcgtacttagtgtttgtttttacttagagtgtcataattttcccctaaaattatagcatattcattcaatatgtggcttgtatctacacagttaagtttctctttcagtgattagaattttagccattaacctatgcagtcgcctgtatccacctggaggcagttcctccagttgcaggattgtgcttatttaaactgattgtcaaactgtgggtcatgaagtcaattgagtgagaattgaccagctttttcataatgaaatagaattaaaaacaccaccatgggccgggcgcggtggctcatgcctgtaatcccagcactttgggaggccaaggcaggtggatcacctgagatgaggagttcaagaccagcctggccaacgtggcgaaaccccgtctctactaaaaaatacaaaatttagccaggcatggtggcgggctctggagcctgggcaacagagcaagactctgtttcaaaaaaaataaaaaataaaaaaataccacaatgcattcgaggtaacaaaggtaagtattgtttcatggaaccttcagtttcatttaaaatgtgtatgcacatatgcatgtgtgtataacatatatgtcatatatgtgtgtatgtaaagaaattgataaatgtgtgtagagtcaatataaaatatacttattgtaggtcatagtaaaaaaataaatttgaaagtcactggcttagaagaacttaacaccaggccaggc

SEQ ID NO: 14621 - DNA, 1048 bp, Homo sapiens
aattaaataaacctcatcttgtctagcttcctggtcagcattttgaaccccctacagatgggtctgaaggattaacagcaaatcctcctcgacctagctctggcagatgggcggcatgtgtctgataaatactcggactgggcttgcttcctcctgttcctaacagatagacagaacacccagcaaattaattttaaaatggtgcccctcgtaactcttagaatggcaaaggaggccaaacacaaatgatatgaatttcatatgtggaacacattatcacctcccaataactgagaaaaaggacctgttgggtaaacaggacctgcggggaggcttggtcagcaagcttgcgctcagcctggagagcgagcggtctacgcatatactcgcggaggcaccttcctgctccacgtccgtatttgcatgtggccctttcctgctgtgaaaatgtctttttgcttttgcgtttactttgtggtgatccaggagcctttggaatttgagggtagatatacccgaagatagaactcgtgtggctttcatgttaaaaaaaaaaaaaaaaaaaaaaaaaaaaaaaaaaaaaaaaaaaaagacagctgaagaggaaagagcaaaacgtcttccctaattgttagagatttttacatttaagaattgatggctatctcagtctattccaacttggaaagagaaaagcaatgctaaattctgggagaagggagtaatacatgtaacttcatttatgagatgccctgcactcgagaaagcattcttccagctgcgcctcactttgcaagctgcttggaatagctggccaagctcagctctgccagtcagaggtgtgtgctccctctcgttcactggctgtgtaaccccaggcctctatgacctcattttgtaaaatgcaaggaatactattaagagctgtgatttacacccccagtaactggacaagacaggtagaaatgttatttttctcattctacacaaatgagggaatgtattcttgttgagaacatacagtagttgctcagtaaatgctgaataa

SEQ ID NO: 14622 - DNA, 1033 bp, Homo sapiens
tcatatgtaatcttataaagtacttgaatgtttaccttgtggaatcttgtcttttttccctaggctttaatagtaagcataaaaaattcatgttctaaagaatattgagaaattttaacactggaacatttaaaggagttaggggatttagatttctgaaacttctgtgactgctgtcttgcaagagttcccattatcttcccccgtcgaaaatgcttaccaatggttggttgttgttttctctggataattgtgcagtacctgatggcaatgtattcttcataactgtttgtttatttttaaggccatggtaggggaggagtgtgtaggtgccatcgtttgcaagttggatatgcacaaaaagatgttccgcagaggttatatagccatgttagccgtggattccaaatacaggagaaatggcattggtaagaaaaatattattttatggaaagaatgcctaagctattttcatttttgttgtgttttgaaataaaagacttaaatgtaagtatgtagaaatgaaagaaactaagggaagaaaattaaggcgggttttaatttttaatttcaaaatggtatttttaaaaagttcttaaaatgaattttttctttattaatgttttgtttgacagtttttcgttttaacaagtagccgatcatcagctttcacctgcagatttttttaatcacattcaaaatgctttgcattatgctaagtaccacaagaaatactgcaatttataattacattatgatggtccttcatgccagccttcaagcacttgtctgtatttgggttaagtggacctcaatcaagccaaaattatggacaaattgttaccattacttggtgctagtcatcaactatatattgcaattcaggaaagatcaggagatgagaattgattgtttcttgtaattcccaaacttaattttttgttgggtctacttttcctgacatgtttagttaatcttaacactcatgatttataatgatcattagaatcatgtgggtggtttaaaaacatgt

SEQ ID NO: 14623 - DNA, 1040 bp, Homo sapiens
gattgtaggcaggccatttaactttttctggtctctctctttgtctatgcaacatgatgttaattctgatcttaaagatacgttgtgaagagcagtactgtttgttgttcattcaggaaatagcagtggaagggcttctaggtgccagacagtgtggtagtgctaaagttctagcagtgaacaagcctgctctccaggagcttccagcctacagtattaaaaaatactatcttaagcagtaatgttttgtaatggtttggcttatcctgataatgatctgttactgttgctaagaggatcggtggaatttcactgtaatttttttttctgttaggtagaattcaactctgtcaagtttctttaggaccaaaataacttcattttatggtgaatttctaatataaattcagatattcttttaatatgtttataagaatttaagaattaaaaattagttactttatcctggcatttttctgttgtgtcaaataattttctaaagaaagaatctctttgtttagaaaatatgagtgtgccaggagaatctttacattttgactagattagacattggtgtaacttttttctatgtaattgagcttcatttcattaatatattaggatgcaaacaaacttgaactcagttcttaaccacactttaagtgtgtatttgtgtagtggtggtagcctcagatgtgtttggaatattttagattgctaaatattgatggtggacttaaaatccatttcatcttgtcttaagtaggttagatttcccagtcactgctttgctttactttgggaaatgagggggaggtacagtagagtagttactattaagctttagttcataattggactctgttctgtccttgctctgttggtggccttgagttttattcatctgtaaaatggataaccacatcaatttcatagggttattgtgaaaataaaactacataatacatatagaatgctttacattgcacatagtacagctccaataaatattagctgtcatattttaaaattgtcacttt

SEQ ID NO: 14624 - DNA, 1061 bp, Homo sapiens
tgatattatttttagattgtggactttctcttgaggacaagagggaatcagtaaacggttttaagtagagaattaacaagagcatcaccctaactctagagagaatgggagacctcttgagttaggaggctcttgtaattatagtgagagttgatggcagcttggactgtggtatatcgagcatagaaagaagaggaccacttagagatttaagagggagaattgacaataatcagtgcttggatgcatataggtggttggagaggaatgaggttcaaagatgactcctgggtttcaggtttgaggcattggtgtggtggggggtgatcctgtttactgagatatggaattgaggaggaagagcagattatgagttcaattttggatataagttgaggtactgtctttattatttgcatcagttgtttgcattcttgtcagactttttgatagcttgagaaagaacaggaagagacttatgcttcacttgggcctttgtttaattatactttgccatttcccccccacccactccaaacacttgagggttatgacacccaatagtaactgtggctcactgtgttgatagttctcaatgaaataagttgagaaacaattgaaaaggcaaatagagctacgtgtgtaaaagttgggaagatggggtagagggtgttagagggaggtaaaaataaaatcgcagttttcaaaaataccagttattcattgtcagggccactggctcagtaatatttcaaaagacttaaatgaaagttaatactatgtgttcctctgttaagctttgctatatagaccagtggttctcaaaatgtggtcccttgaccgcagcaacatcatcatctagcaatttaaaaatattaaaaatgcagattcttgtgtcctactgcaaacgtactcataaactctgagggtggggctcagcaatctattttaacagacccttcaggtgattatgatacactgtaacattttgaatacctcttgtctggattcagcaaactttcttggtaaaaggcccactagtaattattttaggctttgtg

SEQ ID NO: 14625 - DNA, 1029 bp, Homo sapiens
tccaaaattgccaaattgactgaactggttgggtgtttgtaaagatgacgttaactgtgtgactaaaaagtcagatggttgccatattgtttggaatatgttgaatgtcagtgtatgccttatgtctttaattgggtatgcaaaaaaatttttacttaagtagattaaaattttaacctctagcatgaaaacccagcaccaacactgaaagactccattcaggttgaagtagcctcaaacagtaatttactttttgataataggctgttgtttttcttaaataagcttaaaacaattctatctgaaattggtagcatgggttcacttggctacaactgagcaaaatagatgcaactttcttttaatggggtgctgcctctttaggactgactgtactatccactgacactggtttggcagttggtactgctgaacatttttatacatgctaccatgaagctatatatgttagtattgaagaagctaacgggtatactatcatttttgatgtgtgggctgattataatttcctgtatttcctgtacattgggatgaaactactttagcaaagtccacagatcagaaaccagacggtagtttttgaagttgaaaccagcaaaataagaaaaaataaaaaatcgattttaatattttctgcctctttcccaaattacccttcccacttgctcgacaaatctatgtaaagcagtttgttttttcatgttttaactttaccttgccctgtgttatggtactggctgacatgtctaagactggatgtgtatatttattatggtgtctaaaaatcatgaagttcatcacttttcaggagtatagataaaatcaaattggtagtacatcagagttacttttcagtgcaccatgacatcactaaaatgagtgctgtaatgttacagggctttcaggtttgtaaaaacataaccataaattatattgacgtcagatatgagttgagtatctataaaatatcacgtgtatctcaaaatattggactgctgtttgactgga

SEQ ID NO: 14626 - DNA, 1045 bp, Homo sapiens
gggtctgtgaccttcgtatcaaagaccatggaccctcgtggaaaacaacatcccaggagagtagagagtatggtcagttaagaaatctggtctaaggaccagtggtggaggagggtcacctgatttcaacacagcattatcatgtggtccttctccaacttttccaaggattggtttatgatccacaaagaagaggaaatagaaggaatctacatcgagcatataatttcttctgtctcttacatttaacaaatagccattatctatgtgatttttgcattcttcttgatatgtcacaatcatttaccatttaaatggtttaactatttcattcttgccctcaaatctagtaaaatgtaggctccagaaggttttgccatctatacccatggtctctctctccccagcagcacaccatcttgaatccttggggaagcaaatgctccagtttgaagtgcacagacttagtgcatgctcttactcattgttctcagtgtagcccttatggacttgtgtccaagaaagagaaatgggactgattattcacataaaacagctgtttcaccaaagtatccattccttaaactgagggcacgagggcttggcaatgagtagccctgccgtattggtgctggtaaagcgttcttgttccatatcaccttgagaagttatagaccacaggatgcagaggcagcagaaagtggtgatggcaatgcagaacatctagaagcacaagcaaggcactctgggaaacccctcattcttacagggagtaacacagaagggatatggagctagagtttacattatgctgcagattgctagggtggaccagagacaacctgttttgtgagatattctggtgatcctttgtgcctgccctttccccaggatgttaagacttgagcacgtagcaccctcaagctcttggatgcttccaacttgtttcagtggaaactattcagaagtacctatttgacatattcacaaattcattttaggcgaaagcttgttgattagccaaaaatctcaatgtgaatgcctc

SEQ ID NO: 14627 - DNA, 1048 bp, Homo sapiens
gatttgggggaaagtcattattgcttcaaatattgcttagtttctttgtctctttcttctccttttggtattctcattacatatacttacaccctgtgtggctgttacacagtttttggatgctgtgttccatttttttttttcagtccattttctcttggcttttcagtttaggaaatttctattgtcatatcctcaaactcagaaaatctttccttagcttttcaatttgctaatgagcacatcagagtccttcatttctgtcacagtgattttcatctctggcattccttttttattctttcttagaattttcatatctctgctgacattatccgtctgactttgcctgttatttgctttttctattaaaagtctttgcatgttaattacaattcttaaaaattcctggtctaataattctaattttctgccatatatgactctggttctggatgcttgtttaatcttttcaaattttttaccttttagtatgcctttgtagtttttgtagaaagcggacatgatataatgggtgaaaggaactgcactaaataggcctttagtaatgtagtggtaagttgtcgggggatggaaagcattttttagtcctatcattaggtctccatcttttggtaagcctgtatctctggactgtcaacttcaccagcactttgcagtcccctccactccttatgtgggacaggatgtgtgtcccccttaggtgggacaggatggctataggaggctggagttaagtatttcttttccccaaggttgataaaaccccattagtttagcttctagtaaaatagtttctcctaagagcaggcgttaataagaataacggaatgctctggtgtattgaaatgtatcagaaatacattttgcaaatgattactttttccatcctccaactggaaatatgaggagatttttctctgatattccttgtgaggacctcatggagttttataggtaaaactcacaaaaatgtggatatatccttatgactgtgttccctctggaattcttatctctcagactt

SEQ ID NO: 14628 - DNA, 1031 bp, Homo sapiens
gaatatttaagaagtttccaaggcttccaaagcagagtagggggaggggagctgagaattgagagccatggggatttcttagcacagcatgaggcatggacagcctaccttagggactgtatagaagatatagttgattatttaaggatgagtcacaccctctagactgaggtggtgaccatctcagcaggagaaaaccactgggcttcttcctgagcaatcattacacaaggctagtgctgagagtatggtgggaagtgacaccagccagggaggttggggtagatgctcaggagagaaaggccgatgcccaagatcatcaagatgggtatcgttcagtcgaggccagtttggacaaaggatggcaccaatgagctattccccacatgcccccaggatagcaccataatcaaggcctgtgtgtcttcccccagccatggaccctggctggggaggaaaaagggagagtgggagagaatcctgagggtgcacttcaagccaggagtgacaaaagtaccctggattggtaagagcacagttttcaatagtaatggaaaggggagcttgagacttggagttacagagaaaggatattccaagatagtgtaccctgagacatctcccttgtgatcggtgaactcactatttacccttgagcatttgtctttgcacagtgttctgttggataaattccgagaaatggtttgcaaaagctgttgattttaaaatatagttcttttatccaacacccatttaattccattattaaatcaaaaaatgtttcagttgattcccttgggtagtccagccatataattacttcccctgctaattgtgatgcatttattttcatggttccgtagttgtgtacttctggcttttgttctgtcttgttgaactgattagacttctagaaccactctcacacacaaaatcttattttattcctaatttcaatggtaataacattgtttggtaactagtgtgtattgagcagttattatgtgtcaggcattgttctaagcacttta

SEQ ID NO: 14629 - DNA, 1058 bp, Homo sapiens
aaacaaggaaaacttaatggggctctaattggtggggcaatgtagcgtagaagttgtagacaagcctgtccattagaaagcatagagcgatctgagagcataaacaatttggcctggctgaaatgtgggggctgggtgcgagagtggcagaagatgaagctagaaaggctaggtaggcaatgactagatcctgaatggcttaggatcccatgttgagtttattttattttattgagacagaggccttgttatgttggccaggctaggttttgaaatcctggcctcaggttgtcctcccacctcagccttttgagtagctgggactacgggcatgagtcaccacacttagctccatgttaaggagtttagatgttgtttttaagctgacaagaatcctgcttgtttttctaagcaggagagtgacatggtcagatttgcattttatgagattactctgatgttagtgcagtgcttctagaacttcagtgtgcatgagaatcatctggcaatcttgataaaatgcaggttctcattcagtaggtctggggtatgacctccatttttgccttttgtaataaactcccaggtgatactgatgatgcttgtatgtggtaatactttaattaccgagtagagttaagaatcacttaaagttaagtgtttcttaaactttaagggaatcacaataacctggaggggtggttaaacccagagtactgggcataacccctgcagtttttgattcagttactctggctggggccctaacaggttcccaggtgatgctgatgctggtggtctggtgaccacatggagaaccactgaagtgaatcattgatggatggacagtaagacctaatgggaggggccaagtcaggaggctgtagctggagccctggtgtaacaggaccagggctatacctaaggcaatactactgggaatggaagagaaagggcagattttactgctaggtgatatcagcagggcttggtgaccgaccagctgtagggagatagggaagagtgacattggaggcctggttcactgagccagtaga

SEQ ID NO: 14630 - DNA, 1033 bp, Homo sapiens
gcaaggtcaggagtgagaagagaagagccaacaactgcagactccaggagttccagtggtgaggctggtgcccaggaataagctggccaaggagactgggaagtgatggctcaagaagtaggaggaaaaccatgaggacatcatgctgctgcaaagagtgtgagccctactcccaccttagtccaacgctgaaggcacatgctaatttactttaaaatggtttagttttagtgtgatttgttgcattattaagggggtagatttggaagttaacttggctttcaaggtgaccagaataaaaagagagagtggaaccacggaagatagatactggatattcagcacttgtaatggggagcatgacctgggttccccactacttccctgtacaaccacttctaggtccctggtcctggactggagagcacccagcagtcctttctgctggagcagcccaaagtagacctggtaaggaagagaagaagggcaaaggatgtggagacaaagaagagacaacaagggggaagagctcatctttgtgttagatatataccagatagtaatttgcatttgtggtgggaagtggttctctgttccattctcacctcagaggaggaagtgggtcttttaacataacttagcaaagatgtaatgagaggagatcaatcctagtaagaggagtttgtctgttccctgagtcttaactctgcaggacatgaagatgcaaagcaaatgggacctgctggcacaagaggcagcttctgatcaagtcagaaccctgcaagaaaaggggaaggagaagaaggggaggggaggccaagggagaggagcccctcaaggcacctatgggaggaagaatcaggaatgactgaagggggatttctggaagctggggagaacaaatatttgtgccatcctctggacatggagagtgttcaggatttggttctttctcattaggcctatatgccttcgcagccattactgcacgccatgcccagggttataaatatgtaatctcattcaatcttca

SEQ ID NO: 14631 - DNA, 1033 bp, Homo sapiens
gcaacatgtcaaaatgtaatgatgtgtaatggtcttccaggtccctctcctccagaacacttctgcattaggcaggtctctttctctctccctgttgttcatcccactcaaaaacatagaccgtttcatatagtttataatatcatgccatttttcccactcgattctacattatgtattggagatcttcccatattagtcattgaacactacctcattcttttgcatggctgtggattatttcagtatggatacacataattattcccctacggatggacattaacgttgttttcaattctttgattgcaaacaatgctgccatgaacatccttgcatacacttcttgtgcaaggtataagtattttcctatgataaataccaagatggactttcgccttttagctcagtctagctcaaatctaagactaaggtaccctcccagatagggatgctattatgagatcctacttcagtttatgacttatcaaaagcgaattttgctggtgcctggcctctgcccataggaattcacttgtctaagcttctgcttttgtttgtttcgttttctgcctctgatttatcctgattttctctgtgctaatgtctctgaatcttatacctgtacctctgagatatccaatatctacctgttggaatcttcaccaattactcctcttctctcttcccctatcacactgacctggatagactccatcagctcttggtctctgctctgaccttgacttgcaggcttctgatcccacctgtccttttcccttactctggtgtactggtgtcacagatcccattagagtccatattccccagctccacatgtgagatcagcaacctaaaatggcccattgtgggcttcctgctttattgtgaggttctgtctgggcttagccacttcttgatctggtggctgcccaagctcacacactattagggggttccatattgtcacacagtactgattatctttcatctctaaccatatatctgggtttttccctggtaaaaacacttt

SEQ ID NO: 14632 - DNA, 1043 bp, Homo sapiens
atttaaatcctagccctgccattgtatggcattgagtacatttttaaattcctttcttagcttctttatctgtccaacagtgataatagctatctcataggatttattttgagattaagtaccataatatccacaaaatcatggtgagcttcttttcagattattcttttcttctctttggtgcactggaatatccccaagtgcttccaataatcacagaaagagtaacttatgttccagatgatctttaatgatatggtatttgaaatttgtaatctgtgtatgatacatagggcatatctttattaaccagtgtgtttaattaactggaacattttgttttgcaaacaactggggtaataggaatattgcaatttattaaagccaattaaaactttctgaaaatgtaagatgtcattatttttctaagttttagccttggggttcacacagtgtctaagacatcattttattttctcataaaaaatacattctcaaatgagtaggaccctagacgaagctttcacatctcctctcttcctctgtttacccttcccccacccctaattgaatcctctgaattgtcatttttttaaggcagttttcccaaatttctggaggtttttattgttgttgttggttttactaccaacttattttggtggtgtattttgttgtttttgctgctgctgttactatttttgaggatgaaagagattttagtatgttgccagccaagctgaaggaacaaatggagagaaacaaatgggccagaagagatgtaggtagggctatcatggacacaggtagggggctaaaattggaaaggtagaaagacaatcataccacaagtcatcccacagtgatggtaactggtaaacaaaagcacagagacattctgaggtagaggaatgcatttgtaagcgtacaactgtttgctcttttcaggaacgtggaagtatgctcggtcatacaatgagaggaagtgaatttaaacaggggacttgagtccatttcctgaggaaggcaataagatgtccact

SEQ ID NO: 14633 - DNA, 1002 bp, Homo sapiens
ctaatttttgtatttttagtagagacaggagtttcaccatgttggccaggctggtctgcaactcctgacctcaaatgatctacccgcctccgcctcccaaagtgctgggattacagacgtgagccacggctcccggctgataattagatcttgatagaattttagagtaacattttttaaaattgtaactacatcccacaactaagttaccatttttttaaagctgggtttctgtattctttcttgctaaaaatatcaccaaggtgagtcagaaatttaaacataaatatatgacaccaagaatgtaccagaaataatgaataagtatttttatagccttgcattacagaagtgttttctaaatattacagttatttcagaagccatacaaagaataaccaattagttcatacagaattgaaattctagctgggtatggtggcatgagcttatagtctcagctactcgggaggctaaggtgggaggatctcttgagaccaggagttctgggctgcagtgcgctatgccattggggtgtccacactgagtgtggcatcactatggcgacctccaggagtggaggcccaccaagttgcctaaggaggggtgaaacaggttgaaaacagaggagatcaaaacacccatgctgatcagtagtgggattgcacccgtgaatagtcactacactccagcctgcagcaacacagcagaccccatctcatttaagaaaaacaaaataagattctgaagggtaaaagttactttaaatagagttgaaagaagaagcaggaaaaatatttgtaacaaacatgacacaaaagaggtgatttatttcataaataaagggctcttataaatcaaataaaagcagtcaaaaaatcaaagtgggacaaggggatgaggaggccatttccattacctgtcatccattctttgataagaacaacgaacaatagaccttttctcaatcttatgtaaactatggcacaatcacaattttaa

SEQ ID NO: 14634 - DNA, 1048 bp, Homo sapiens
tttatttattgatatgtaaccttagttgtgagagagaaaactcagaatcttattgattgtatttacacaaagttgaaaatactttcactccactctatctcacttgcttttaaatgcaataatacttgttatcatattcactattatctgctaaaggccatttcaattactttaacatggagttatggcttaccctgttattcaaaatgtaaaataaagaatggcttaactggaattactttgaagattgtggctatgcattgctgaattttaccagtccacttttgtcatatagtgaagtagatgtatgtgtacataaagttttctggtaaaagttttcatcttagctataaaaaatatttttgtcacacaggggctatttttggagcattacaagatatacttgggagccgttctgtttcaaaggaatattataatcagacgggccgtatacctgattggtgttctctcaataacccacctttggaaatgatgtttgatgtcgggaaaactcaaccacctctgatgaagagagcattttccactgagaaatagaagtttgattaaaaatcaaccttgcttcatatcaaatatttaaccaattataagcaaattgtacaaagtatgtaggatgttttgttatagaggactatagtggaagtgaaagcattctgtgtttactctttgcattaatatataattcttttgactttgtttctcttgtgtagtggtaaaatggtagctggtgcttattgagatttgctgtatttatatcaataaagtatagtaaagcagtttgattttggaagtttgttatgtggctttttttttttttttttttttgagacggagtctcgctctgtcacttaggctggagtgcagtggcacaatctctactcattgcaagctccgcctcccgggtttacgccattctgtctcagcctcctgagtagctgggactataggcatacgccaccccgcccggctaattttttgtatatttagtagagacggggtttcaccatgttagccaggatggtctcaattt

SEQ ID NO: 14635 - DNA, 1037 bp, Homo sapiens
gctctgtcgcccaggctggaatgcagtggcacgatctcaggtcactgcaacctctgcctcccgggttcaagctattctcctgcctcaacctcctgagtagcagggattacaagcacctgccaccacgcccggctaatttttttatttttagtacagtcagggtttcgccatgttggccaggctggtctcaaactcctgacctcaagtgatccacctcagcctcccaaagtgctgggattacaggcgtgagccaccgcactgggccagagagaacttttttagtaaacatctattgggcactgagttagtcataaatgtggagacacaggtgtgaagtcacattgataaaatattagtgatatgataaagggacaacaattagggaacggactctttctggacaggaggcaaggaagagtgtgagatgtagggagacttggtagttgcaagcacaggaactggtatgaaaatacgtgcgccagagagagttaagtatgcttggtgtgtagagtatgaggtttagagatgatactgatgtaggaaggggtccagtcatataaaagtctgtgctccatgctgattttcttcaaagaaatgttgaaaggctttaaaatagtgacaatgagctatatatcctgaaggataagtctcatatcggtagaaaatggaaggaaatgacggtagggatgggaattgaatagttaaaatattccgcatataagatgatgtgtaagatgctgctgatttcttttctactctaaggcaaatatagttgtcccttggtatttgtgggggattggttttaggacctcccatgaataccaaaatccaaggttgctgaagtccctgatataaaatggttaagtatttgcatataacctgtgcatatcctcctgtatgttgtcatctctagattacttgcaatacctaacacagtgtaaatagctgttacactgtattgtttagggaataatgacaagaaaatcacagttgttcagtacagaagcaatgttttttgaaagttttctatctgtggt

SEQ ID NO: 14636 - DNA, 1016 bp, Homo sapiens
tacggtttcccactttcatatgaagtaactggtggtcatcagtcactgttaatctttagatgtgatacagatgacagatgtttcagttttggataatttttcaaaaactgacccttctcaaaaaagacccttcaatacatgagtcaaggatgtttttgcttttttcctttattgtggtgaggggcggatttaaggatcaataaagtccctattctgtcactaaaaaaatttcttgatctctaaagattaaaataaaaataccaacatcagacagctttcatgttaaaaatcagaatttatgttaaagtgctctgtaaacagaactgttactaagtggaataaacagtactgtggccgataagaataacttgaagctgaaaagcagtactcacagcaggaacaatttgaactcaggccatgtatacacaccctctagtggactcatgccagtgtcactccattgaagtgttgtgctttcctaagaaggtaatctagccactgaatttgggtgcagggtatcgctggactttgagcatttgtgtagtttaaatagcaaatcattatacctgagtattaatagctaactactacacaaacaactcaaaaccagtaatgtcatgtcattaccatggcttcttttatgtaacattatctgctacattttaccactcaaaatatatttaaaatatgtattttaaaatatattagagcatatggctcaagcaatcctcccacctcagcctcccaagtagctgggaccacaggcaagcaccaccatgcttggctaacttttaaaaattttttgtagagaccgcatctcactatgttgcccaggctggtcttgaactcctggacttgagcaatctgttcacctcagcctcctaaaatgctgaaattacaggcatgagccaccgggcctggccacaactcatatatttaactgtgaatgacacaagtgttggtcttagaaaaatacaggaacaatactaaattggatccatttacagacaggtaaa

SEQ ID NO: 14637 - DNA, 1050 bp, Homo sapiens
caaccttcataattggaaaaaatatttgcaaactctgtatttaatacggggttcatatccagaatttataaggaacttaaacaactcgatagcaagaaaacaacccaatttttaaaatgggcaaaaggctgggcacggtggctcacgcctgtaatcccagcactttgggaggccgagacaggtggttcacttgaggtcagaagttcgagaccagcctggccaacatggtgaaaccccatctctactaaaaatacaaaaattagctgggtgtggtggtacatgcctgtaatcccagctacttgggaggctgaggcaggagaaatgcttgaaccctggaggcggaggctgcagtgagccaagatcatgccactgcactccagcctgggcgacagagcaagactccaatctaaaaaaaaataaatgaaaataataggcaaaggacctgaatagaaatttctcaaaagcagacgtacaaatggcccacaggtatgtaaagaactgttcaacatcagtaatcatcagggaaatgcaaattcaaactacaaagagattttacctcacacctgctagaatggctattatcaagaagataaaaggttacaagcactggcaaggatatggagaaaagggaatccttgcccgccattggtgggaaagtaaattagtatagccatcatggaaaatagcatagaagttcctcaaaaaattaaaaatagaactaccatatgatccagcaatcccactcctgggtatataaccaaagaattaaactagtatgtcagagatgtatctgtattcccatgtttattgcagcactattcacaatagccaagatatgggataaatttaagtctctatgagcagatgaatgtataaggaaaatgtgatatatatacataatggaatactattcaacttttaaaaagaaggaaatcctgacatttcttacaacatggttgaatccaggggacattatgccaagtgaaataagccaggcacaggaagacaaataccatatgatctcacttaaaaagtcaaactcttattaga

SEQ ID NO: 14638 - DNA, 1050 bp, Homo sapiens
tcaagttttgtttctttagcatactattacaaagtcctttcctaatcccagcctgcctttgtcagtttcatgcttacgctgtttgcccatttgctgtagctccagggctgtctactatttacattttgaagctgcctaatactaccactgccagttcatctcgaggaaaaccattcattccctcacttgctcctcctgtattctttgatgtattttacaacacttaccacatcgtgttatattggcttcttttacctttctacacctcctgccaaactcagagcagcaaaaatagaaggtaccatgtgttctcattttaatccacagtgcttttgaacaatctctgattcatggtaaccattagtagatgtttgagcttaatctgaagacatgtgcctaaagtcaaaaaattcacaatctagtagtgtagatagatatccaactacttataatactaagcagtatatactaatactaactaaaattggaaatttcttgaaattatcatcatgaatgtgactcttggatctctggcattttactgggtgcatagttattctttacatgtataaatgtaaatgactaaatgaagggaagaagtctcagatggtctagtggacctctacctcccattcttataaccctctcgcactccaaaacccttgaaagatgcaacagtgccaggccttcaccagcagagaaattgctatgaaaatgccatggacagagaaagcaaaccgtgatagcaattaagagccccatacaaaagtcacgaaggcacattcttctaattggaggcgttctctagcatatgcagttttactgcaaggtgactagcagcaaggctagttttcaaaaataattttgaggagtggcttattgtaagagataagcaattttaattttcacagaaacatcagataagtttaaaactttgtttatagcatcatgttttatttatttttggtggaaaagaaatttcccctcaaggcatttgtttgtaagtagaattctttattcatttatatcttgtttaactgtaccaaaact

SEQ ID NO: 14639 - DNA, 1051 bp, Homo sapiens
gagaaagtatataaaaaggtttaggttgacagatacttgtgattgaaagttatttcagcgcatctaatctgctttactccatttcttatgttgtcctgatttcctttccaaaatcaggatgcaggtagtgtctgcgattatgatacatattacagagctacatcttttggggtgaacagccttcatatcaaaacttatgatagttatgtttagctatcacaagctcagacgtctcaggacggcattttatgatcagtttttctgtttatgattctatctaaaacaccaagaaaatagtaacacagaaaagagtaacaaaaatttttttaaattactgggctttactttttaaaaatgtgtttaataacatgaattcaagttagatgcaaagactgtaagatttcttaaatgaaatattgtttgtttaggtatctctatggttttgaggagtactgccgttcggcaaatattcagttcagaactgttcatcaccatgaaccaaaagtaaaagaggaaaaaaaagacttagaagaatcaatggaagaggctctcaaattagatcaagaaatgcctttaacagaagtgaagagtgaacctgaggaaaatatcgattcaaacagtgaaagtgaaagagaagagatagaattaaaatctccgagggtgagttcttaatactagttttatctggtttaagtattatttaaaattttttattatagccattttcatatatacacaaaagtactacagtgaacctagtttattttccagtatttaatgctgcttagctagctacttttttcgaaatatattgtatattatttcctctacctgaaaacccttccttctgttttctgtttatattcgatcaagtcattcttgtctgggatgaatcccagatattccttttccagtcttctgctaaagtatcacctcattgaaggctgtcttggtcaccttatctgaaattgtaacctgcctcctctctttggaactctcagtccctctgatgttgttctttctgtaatttacttatttattctgtttattg

SEQ ID NO: 14640 - DNA, 1035 bp, Homo sapiens
aactaaaaaataatattatgacttcatatcttaaattatttagtaccaactaaagcaaaatcaggatgttaagcaagttgaacacaaaccatcacaaagttacctacgtgttagaaataaatctgatattgcaccttcacagcaacaaggtaagacttgtttttatgtaataatacaatagtttgatacttgtctgaatattgaacaaatatgagaattctttactttttatacatcccactgctctctaggtttttgttttcttttgttttctctcatttagtccatttacatgaagaatcggtattgtatttgactatgttagttctttttaccagtaaacactatttctagtggattttttaaactcttagctggtgtctttcctttacccttgccttttagttcttgttcaattgaataccaaggtctttttatctgtatataggtctgtttgacattacaatatgttaaagacagggattatggctgtatttaatatgctttgtaaagcacattatttagtgcgtggtggtgctgaccaagtataacttaaaagcaattgcctctcatattacatactgtgatatggatgaccatatcatagttctttatcaaactcgtgtggttacctttaattccacagtcagcgttcaagcattttgatgttgtctctatgtttctacaaggctgttggccttgtgttttgtttgccatcttgcttcttagtcatttacattttctataacctaaaatctgaaatttggcagtagaaattaagatctcttctgtttaaaaactttctgcccacaattctggaagaagtattagaaatattttgagaagtggaatttttcttttttgcttttataactgtgatttttatttaattttcaaataatatttaattgagcaaatgcatattattgaatgccggtataattgcgaatgtaactatgcatttggtgttttgggaaggacctaaatgaggaagtgctcaagatagtaagattatgccacttaaggtttaggttt

SEQ ID NO: 14641 - DNA, 1028 bp, Homo sapiens
gacaataactttaaatatgtgaacattaggaaattcaaagcttatatattcttagaagctaattttgaccacgtgcgcaaattatttttcttttttagtagaatggtgcattttttgcctttgtatttgaaatttagctaaattacaatagctatcagaactacaattgaccttagtaatttcaaaaccatagttataagggttttaagttgatttttaaaaatcttaagatatgatagggatttcaaaactatgtgtgtgtatctctgatagggaggggttggggcacagactaataagtgtgccaaaaatctgtgaatccaaatgtgtaacaagtgttgtctgaataaatgtccacaaatccatgctattattggttaacaaaaaataaattcactttgaaatgttgctgaatttgggagttttgtttctacctaggatgaggaaattggaaagagtgtcactttcaccctaactataataaaatgtcagataaactacaaaatcattaacatttcttgaacccatcagagagcttctgatgcagagcaactaagtagcctaaagtccaaggaaagacagactcctccaaaaagagatgagacacaagcactgtctcacttgtgacagagcatggttacaggaagagacaccaggcaccaatcaagcagataagaagtatttggttaaactttttaagtgggtttctaaaggccaagtatagaaccattggtagtcacagatacaagtggagttcacacccacttgtaggcatcttctgcacagacctctagagaaagattgtggggaaaggcagagagtctctctcactggtgcaggcctgaatgagaggagtggctgtcactgccagaaagacaggatgccccactttgacccttctcctttaagaacaaaagccttaagccactgaggaaggggcaacacatctgttatttccagggtataggtgaaaacctatttggctgggggaagggtaaagaaaaaaaaagaatccactcctggcggag

SEQ ID NO: 14642 - DNA, 1037 bp, Homo sapiens
tagcatccctttacataaagtaccatagaaagtgctgtggccctagagagatggataaaacaaagcatctgctctcccgggataaaaagaagaaaggccattttgtgaagagatgaagactgagcggttgtggccgccttgccgaccttgagcagcagttggcttctccacatagtacccgggaataggagtctcagaatcgaatctcttctgcctgctcacttctgtgagatttttttgatcttcagctacatttttggctttgtgagaagcctcatcatccaacacagtggccagcaacgttgccgacaagacggatcctcactccatgaactcccgtgtgttcattgggaatctcaacactcttgtgctccagaaatctgatgtggaggcagtcttttcaaagtattgcaaaattgtgggctgctctgttcataagggctttgcctttgtttagtatgttaatgagagaaatgcccgggccgctgtaggtggagatgtacagctcctcttttgacttggaccatgactttcaacgggattattatgataggatgtacagttacccagcacatgttcctcctcctcctattgctcgggctgtagtgccctcgaaatgtcagcatgtatcaggaaacatgaaggggaaaaagtggcttcaattctaagagaggacagcggggatcttccaagtctggaaagttgaaaggagatgaccttcaggccattaagaaggaattgacccagataaaacaaaaagtggattctctcttagaaaacctagaagaaaattgaaaaggaacaggggaaacaagcagtagagatgaaggatgataagtcggaagaggagcagagcagtagttccatgaagaaagatgagactaatgtgaaggtggagtcggagcggggtgcagatgactttgctgaggaggacctactagatgatgatgacaatgaagatgggggatgaccagctggagttgatcaaggatgatgaaaaagaggctgaagaaggagaggatgacagagacagcacc

SEQ ID NO: 14643 - DNA, 1048 bp, Homo sapiens
tctagcaaactccagcagacctgcagcagaggggcgtgaatggtagaaggaaaactaacagaaaggaatagcatcaacatcaacataaaaggacacccacgcagaaaccccatctgaaggtcactaacatcaaagaccaaaggtagataaatccacaaagatgaggaaaaaccagtgcaaaaagcctgaaaattcccaaaaccagaacacctcttcttcaaaggatcacaactcctcgccagcaagggaacaaaactggatggagaatgaatttgatgaattgacagaagtaggcttcaaaaggtgggtaataacaaactcctccgagctaaaggagcatgttctaaccctttctattccttcaaattagctctggaaaggactacagaaagctggactgtaatttccctttgcttactcaggtcatctaaacctaaatagtctgagtatattgccttaatcagaatcacattttcccctctttaattccttcccccataataaaggaagctaagaaccttgaaaaaaggttagacaaattactaactagaatcaccagtttagagaagaacataaatgacctgatggagctgaaaaacacagctccagaactttgtgaagcatactcaagtatcaatagccagattgatcaagcggaagaaaggatatcagagattgaagatcaacttaaagaaataaagcgtgaagacaagaatagagaaaaaagaatgaaaaggaatgaacagtgtctccaagaaatatggggctatgtgaaaagaccaaacctacatctgattggtgtacctgaaagtgacggggagaatggaaccaagttggaaaacactcttcagaatattatccagaagaacttccccaacctagcaagacaggccaacattgaaattcaggaaatatagagcataccacaaagatattccttgagaagagcaacctcaagacacataatcgtcagattcaacaaggttgaaatgaaggaaaaaatgttaagggcagccagagagaaaggttgggttacccacaaaaggaa

SEQ ID NO: 14644 - DNA, 1047 bp, Homo sapiens
cttgtcagctcagaatggtcaggaacctttttttgtgataagcctcacagaggctatggaaaacaggagcacttttttcttgggaatataattgcagtaatactgtaccacctaatggagtcagaaaaaacaatttatgtagaaatatagttctgagagccttgcgattattgccttttgtgtcattctacctacattacacaaagtaggacttaggaagtcctggaaatcatatgttggatattttctaattactgtgtcagcatgatcaatcattttctaaatttgccagtttcctgaaatagcttagcttatgttcatagcactttagaggaagcagcataaaattagtttctattggtgtcacaaaagaaatgaaatatttatctttggcaaaaagacctgtacaccaaacttcaattaatgagtacaagaattagaaatcaaaactttgtttagtctaaggaaaaacagttctttaaactgtaaccacatggctgtttcttgtttgcatcaactctgggtgactgttattgtcttctgtgaattctctggggcaggggcctgactttgttgaatgagccaattgttttcatttgtgttgcccatctagtaagttcccatctggtttgtatcagactgttttcacagccaacaactgctgccttctctatatcctgacacttcagggccccacgctatcaaagcactgctgcgatggccttgctggcagggcctatacagctgtgccttacagcttggaactattacccagagtaatggtaacgtagaacttggactggcccttattcccactggtgtcgtgtgtacagtgagcagaaacccaccctctccctctctcccccttgccccgaaacttgctattcaacagaaaatctttaaagctcttattttaggatgtggaatggtggtgtttttattttctagtggcttcctgtatttgaaagctcatttttcattctttcactctttcaaaagttaccaggtctggccttagggaagtgaactggtcactatgtcacattt

SEQ ID NO: 14645 - DNA, 1059 bp, Homo sapiens
tgccatacttacatctagaactcagtttcatctaggtgagtatctagaactattccagtaccctttgggtgctacttggttatatattttgatagcagcaagacactttatctctagaaatcctgtcccaatattgtaggtcttgagctctgtttctgagcctttgctgttaggttgtctgtattttctttcattttggaactgttttcttcttttaattatgtaaagctaaaactcagccaggtgcagtggctcacacctgtaatcccagcactttgggaggcttaggcagctggatcacctgaggtcaggagttcaagaccagcctgggttggcccggtgcagtggctcatgactataatcctagcactttgggaggccaaggtgggtggatcacttgaggtcaggagttcaagaccagcctggccaacatggtgaaaccccatctctactaaaaatacaaaaattagccgggcatggtggcacatgcctatagtcccagctactcgggaggctgagggagaattgcttgaacccaggaggtagaggtcatagtgagccgagattggaccactgtactccagcctgggcggcagagagaaaaaaaaaacaaaaaacaaaagaccagcctgggcaacatgatgaaaccctgtctctactaaaaacacaaaaatcggccgggtgtggcagcatgtgcctgtaatcccagctacttgagaggctgaggcaatagaatcacttgaaccccagaggcggaggttgcagtgagccgagattgtgccactgcactccagcctgggcaacagagtgaggctccatctcaatcaatcaatcagtctaacactcacattaagttaaatatgtccatcagcctggccaagaactggttggcacttcagggagcaatggccctttcatgttctccagaatgttctgcatgatggcagcttgttttttcttttaagtgggtgcccacatgccattattccttattttgggatatctttgcaatgacccccagaaggaatcatgctattgtactagaagagtttctgcatt

SEQ ID NO: 14646 - DNA, 1032 bp, Homo sapiens
attctcctgcctcagcctcccgagtagttaggactacaggcacccgccaccacttctggctaatttttttttttttttttttttttgtatttttagtagagatggggtttcaccatattagccagcatggtctcgatctcctgacctcatgatctgcccgccttggcctcccaaagtgctgggattacaggcgtgaatagctttcttttggagatgatgaagatgttctaaaagtagtggtaatagtgacatatttgtgaatctcctaaaacccaccaaattgtacagtgcatatggatgaattttatggtacacaaactgtatctcaaaataaagctattattaaaaaacatttaaaagaatcagactaagtagaatcttagatttttaggccttagggataatactactttcccatttgttatcttcatgtacatctcattttttcctctaaataaacagagtatgacatgcacaaaggatagatgtggtaattccttaatatttatggaccacttgagatatgagaatctttgttataaagaaatttttgttgtagtagaatctgatccatgtttttctcatacatcctaatcatgagctagggtattagaggataaaaagctttcttatactttatacctgctgtgatgacaagctaaggttttggtgatgcctttggcttggtcacaacgtgctttcagtgtgttcatttgattattttgcagcatgtttctgctgtagaagtcttcatattgtaaaaagcattcaagtatgaactcttgcctataaaactaactgtgttggataagaaatgttttatttaacagggattatgtagctcaaggtttctcaaatttggattcatgatcgtctgtgaaacactgtattaaaagttaaattgccaaatgtttaggtactcacttggtgttgatgggatcataaacccatgtgcaaaggtaggccttgagatactgtggtgttatttggttataaaatgcttatgaaggtgtattagttttattactgcat

SEQ ID NO: 14647 - DNA, 1043 bp, Homo sapiens
atagagaatgcttttcccattgcttgtttttgtccagtttgtcgaagatcagatggttgtagatgtgtggcattatttctgaggtctctgttctgttccattggtctatatgtctgttttggtaccagtactgtgctgttttggttactgtagccttgaaatatagtttgaggtcaggtagcatgatgcctccagctttgttcttcttgcttaggattgtcttggctgtgtgggcccttttttggttccatatgaaatttaaagtagtttttttctaattctgtgaagaatgtcaatggtagtttgatgggaatagcattgaatctataaattactttggacagtgtggccattttcatgttgattattcctatccatgagcatggaatgttttcccttttgtttgtgtcctctcatttccttgagcagagtggtttgtagttctccttgaagaagtccttcacgtcctttgtcagctgtattcctaggtattttattctctttgtagcaattgtgaatggcagtttattcaagatttggctctctgcttgtctattggtgtataggaatgcttgtgatttttgcacattgattttgtatcctgagactttgctgaagttgcttatcagcttaaggagtttttgggctgagatggtggggttttctaaatatacaatcatgtcatctgcaaacagagacaatttgacttcctctcttcctatttgaataccctttatttctttctcttgcctgattgccatggccagaactcccgatactgtgttaaacgggagtggtgagagagggcatccttgtcttgtgctggttttcaaagggaagcttctagcttttgcccattcagtatgatattggtatgggtttgtcataaatagctgttgttattttgagatgtcttccatcaatacctagtttatgagagtttttagctttattgagagtttttagcatgaatggatgttgaattttatcagaggccttttctgcatctattgagataatcatgtggtttttttccttggttc

SEQ ID NO: 14648 - DNA, 1073 bp, Homo sapiens
catcttttcaacagtcagatagtttgagttttttctcatatgaataactcattgtgttaatccactatatatatgcacctttgcaccttcagagagcagaatggctcaggtgttatatctgactttctcacacttaggatcctgggggcctagggcagtgcttggtccagagtaggtgctcaatgaatgtttgtggcttgagtgaatggatgtataactaattactgaagcattacacatgagatgcacaataagtatttgagtgaatgtatgcatgcatgcatgaattaataactgtggaatcctgcagcagttgggtttgtattttaatattctcatagtggtgataagtttgggctgattcttatactctgcctgcaccctatccacctgctgtcatcctgttttactctttcttctcattaaaatgttagttacaatggggacaccaaagtggttggcatgaaagttagcagattaaaaggataagggtgacaatgtttaagaaatattctttctctttaaaagtctctgtactgtatattacgtggtgaaataaatagctccaatgtgggaagacttattctgctagattgtcttttgacccaattaaagctttaaagtgtcagacaagcagccaaacaatcctcttgagggtgtgggaggggcctgggctggcaagagcagtgctggtgctatcgaaggaggtggccatgtgtggaacttggcttcatggttggttgcccacagggacttagggtacctttcttgtctgtcactttacagctggtgctgtatccccggagatgaagtacttccattcaattaggaaaacatgcttagaaattctctctttcaagaacaacaggcaatggggcctgtcagagggtgaagggtgggaggagggagaggatcagaaaaaataactgtgggtactaggtttaatagctgggtgatgaaatcatctgtacaacaaaccgtgtaatacaagtttacctatacaacaaacctgcacgtgtaccccgaacttaaaagttaaaaaaaaaatttatctagtaagacttgtcaactga

SEQ ID NO: 14649 - DNA, 1060 bp, Homo sapiens
cataatcgggtcccaaatctagagaaaaagacaagccagaggcatccttggtggggtgcctcatccagcttcacctggggcttctcttctttgctgcctttgagtgcgcgctttcagttgttcagccctcaccttcatctgcaagcccatgggtgagtgtgtgctttacacacctttgtgtcttgaggatttcagcatatcatctggttctcccaatgactgtaatcactgttaaaataaggacctcatcttctatttccttcttagtactcccaggcctcatgggtgtcatacacagagaggaaacactggtgaaatagtgggtatgacagtgctttggaaagtgatcataattaccatactaagcactgtttaatgggttcttagctgcatatgaccattaaggatacaaaggtactgctactttgtttttctagtataaaaaagtctgccttgcagaacgtacatatagtttactgtgttctttctatggccaggaactttgctaagcactttacgtgcattcatttgcttaatcctcatgtgcacacatacaaacacaatcccttttttttgggggggggggggtgcctggagggatgcagttatgtagttattactatccttgttttacagatgaggaaagtgaggctttataaaaaattttttgctctagtcacactgaccaggaagtatcggagacaggactggggcccagcctgtcttacaccaaagcccctacttcaaaagttgcatgtgacatgtgtacagcttgctctatatttgtgtgtttacatctttatctccagtcctaaatatgatgctttttcaagagcatagactaaaagaacaaatcaagtcatgttaatacgccacattagttataggttgtaaggaagtaagatttttaaaataagtctagaccaggcatggtgactcatgcctgtaatcccagcactttgggagggtaaggtgggaggattacttgaggccaggaattcaagaccaacctgggcagcatagtgagaccccatttccatcaaagaaaaggaaaagtctg

SEQ ID NO: 14650 - DNA, 1084 bp, Homo sapiens
tcaacctcaaacgtagatttatagcgcccgtcacaaagggcaggaccgctgcaaaaaaatggaatcttaaaactttagccatcgttcgctaaaggaaatgaaaggagaaattcaacagtcgcttggagcctgggttttgcttagtaagtgataggctgtttatttcagttcagtttatcatactggttttcaggccttggattttgagaaactttagattattgatattcacgtgtatttattaagcatctactagatgtaaagcccatacagaagtttccaattccttaccttctgcattcttgaaaaacctgaaatattcattttcatgtattaatttagaacattgtgattacaattggttacaaaaaaaataagcgcccattaaagaggccagtgggtttaaaaagctaagtccgaaatttgttaaaagcgaaaatattaaactggaggaatattattcaatgctgtttctctttttctctcagcagcataaggagaaggaagtaaaaagtctgcttgaatgtgaaaggagagaaggcactgtagaccaggcagtctagattgtgaattcgtgaataatttgggaaatgattgttcaagaatagtcaaaagatgcataatttttcaaattaattcacatgtagaccgcagtttgttttgagacggagtctccttctgtagcccaggctggagtgcagtggcgcgatctcggctcactgcaacctctgcctcctgggttcaagcgattctcctgcctcagcctccccagtagctgggactacaggcgcgcgccaccacgtcaggctaatttttgtatttttagtagagacggggtttcaccattttggccaggctggtctggaactcctgacctcatgatctgcccacctcgacctcccaaagtgctgggattacaggcgtgagccacctcaccgagcctgtttgtttgttttaatcaatgaatgaatgaagggaatcagatgtcactgatgaagaaaacttccataatttcttgtgaataaggtcaaagacaacgtattaggttcttagttgttggggtttttttaagtaaggaatagct

SEQ ID NO: 14651 - DNA, 1032 bp, Homo sapiens
tgtgtgcgcctgtagtcccagctactcgggaggctgagacaggagaattgcttgaacctaggaggtggaggttgcagtgagccaagattgcaccactgcattccagcgtgggcaacagagggagactctgtctcaaaaaaaaaataaaataaggaaatataaaagaatatggaggcattaatatagtcattgttcatgttggcattttgatgtctatattattttttaaaacatttaataattttataataatttctaatttatgatttggtaccgtgtcttgtacagtaagttgaacatcatgaatccagaacatttatctgcagttattcttatataatgttaataactaggtttttcattgaatgttagtcaactattttagtaacttagtaaaaggaatcttctaagagcattgtacaaatatagcacatacaatatagatttctttttattttacttatgccctcttttttatttctaaaagctgcacatgtaaacttaaatatttaaactgaaatgggatgtcttatagaatgatttgggggggtgttaatgttgtaaaataatatctgtacacaaaatattggttttatatattataggtatgcccaagaggacagagaacgaatgcacagaaatattgtcagccttgcacagaatctcctgaactttatgattggctctatcttggatttatggcaatgcttcctctggttttacattggttcttcattgaatggtactcggggaaaaagaggttagcacatttctatgaacatatctggctggactaatgttggaataattatcactcagaagaccttattaagtaattatgcttcttctgttttaaaagtggtaaacatgtttttctttatcttcagattattcttaactgtgacaagaaaacttaacaatagggcatgacttagtaatttttaagggaactgtccttagtctgttttactctcagtgatcttgaaggaatacttttacttctcaactataatccttattggttttctacac

SEQ ID NO: 14652 - DNA, 1067 bp, Homo sapiens
ttattgttcctgtaaagaaaacaataataaaaagcttacctacataaaatttcaatgttttgacacttaattgttgtttggcacaatagtatggaagtaattcaaactggtaaatagtttcctctcatatctcgggtatatatacataccatattttattgatccagagatacttatttcactttgtgacatctctgaattaggatgcatcttacaactgatggcttattagatttaatgaaatacagaagatacacagaataaaaagggttttcctgtggttggtttgtggtttgtgataggtgttctgtgatgtttatgctttgaaggccttaagactcatggttgcaaccatggaagcaaaatgaaatttttagctcttaacctaacaacctgaccatgtttatccatttttattgtttagaagtttatttactgatacttggtggaggttgtgtgaattagttaaattttaaatgtttaagacttctattaacagctgcaaaatatgaaagtaagtgcactcacttttcctgtagtagtctgtcttttgaattcacagcagttgtatccttgagttactttgttaatgtatttttctcagtacatttaaccactgggaaatgaacccttgtacgaatgtgtttcttcttctctgtaggaataaaaaataaatataaaaattttatttgtattgcacacatttggggggttattagtgttcattaaaattctgagttgcccaaagaatcctcaattgagtaattgtataatcggggtagagtagggaggggtgtcatgtgtctgattactaggactatatcttctggtccacttggggccatttttacaatcatttttttcatatgtcctgttctagcagaaaagtatatatgcaaaagaagaaattacaattacaaggcctcacgggcaaataatttccacaatacttaatatgtatctgcatttttaatttgctttggtaaaaataagactagaacaacttatagccactgtagttgctaattttactaaataatttgttaaaacgtggtcataagaaattt

SEQ ID NO: 14653 - DNA, 1032 bp, Homo sapiens
tagactgtttcccaaaggagctgtatcattttacataaccaccagatatgtttgagggttctgatttctccacagtctcatgaatacttattattgtctgccatttttattttagccagtcaaggaggtttgaaatggtacctcattatggtttcagtttgtgtttttctaatgagtaatgatgttgagtatcattttatattttctgtgcttattaaccatttgtatatcatctttggagaaatgtctgttcatatcctttgctcattttttaaagattggattatttgatttctcattattgaattgtaagagttctttatatagtctagctataagtcatatatatatatgatttgcacaaattttcttccattctataggttgttctcactttcatgatggtgagaaccttgttttttaaacagtttctcacttgtcttgtgaaagggtactggataccaaccccctcatgctggcttagccatcaaaagcgtcccatttttacactttgtagattcctcttggacccacttttctccaaagaaccctattcccccaagttatccttccagttctctagcatcaaaacaaaattcgctttcatttggcagttgttagtccaaactgcaccattttgtaagtcccccagcattttgcagaccttggtcaaagtgacacattccaggcgagtttgggctgtgagaaacatcctgcctaaccacctgaccacaacacacaagaacatccttatcataccctgctaagcaaaggcccaactgaaggaacgtccctatcataccctgcaactggaacaaagggccaaaccacctgatcataggaacatcttaatatcctgccgggcagcaaaccagacagcccagacccctcctgcccatacctataagtccccagcctgtgaacggcagtgggctctggcattaagctgcaccccccacctctgcaggtttttgcaatatacttgtgttgctgtagagcccccccccacccccatctttctttaactcccac

SEQ ID NO: 14654 - DNA, 1049 bp, Homo sapiens
actcatgcagctatcattcaggaccttttgggagtaattcactaaagcctctatatgccatataacatcttcagtacctatctgtggtacaaagattgaagctaagtggtcataccattagaataccaaatgtgtccaacaagattgtaaatgaaaaaggtttgctggttttggcaggtctgaattactcgtccttgtgcccaggcataacatagggaacattgtcctaaccactctggaggtaaccacggccataagttagtgccacatagccaatatgtcccatttggagctagccaataaataactgatcattggcacccaatgggtggcaagccattcagtgtcttgtaatatgatagtgtggtcacagcgttctccaggtatccaccccatatctctcgtactgtttggacataggtccttggtgtgatttctttgctcccaacacaaagcattttggctgagttggccaaatgaaggggtgagccagataaatcaataccaatttaaaaggcctgtgtaacaaataattattcttgctgtactgtatccaaataattaagccaagtatagtaaagcaaaccagtcctaccatgacttgtcttttaataagtgggaaactggagagagaaaattatgtttcaaaaactgtagcacacctgttgttaaattctagtcttgcctcatgttttccaatttttagtattttctacagtttaaattctgatttttctggctacaagtttctaaaataagttgtgcttccttaaagtcctatgaactgaaaactagatgttttatcaggcgctgcctctaaaccccccaaccatcacagaaggaaatctcttcactgctggcattgacaactaataactgagggtgcccggaatccttcaccccatgtctagtgagtctacggaaccagggtaattgagacaatatctgttacaggaatcaactcctggatacatcacacttgagtcaaagcctggaaagctgaggaagcaacccctgagagcccaaaggaacgtcctaaatataatgga

SEQ ID NO: 14655 - DNA, 1037 bp, Homo sapiens
ggatctggcacacaggtaaaaacctaccaaatactttgtaactaactttgtttttaagtatacagagtaagagagctttccttttagtgttacaaaaaaatgaatccatggattaaaaatcatcaaaccattgggtgacaggttattttgataattattcttttaggattaatctctgtaaaacatactaaagcaatagttaaaacttattaaagagtttttttaaaaaaccctttttgagataaggaacttttcaattttgtgtttcactttaaataaggagctttgagtttttaagatagcctggctaaaacctgtgtaaggagatggaactttcctgtggggggaaagaagaaattaaaatttatacatataaatattatatacagattgaatgaatttaagacaaatacaaaatttatttctaattttatgatagcaacaatagtagaagtaatattgattttttaaaaaccaacttgttacagaagaaaagtagaaaatagtttttttaacagacataattgttcacaaaattgtttgataaccccttttacttgccttttcaagtttgacttttctttctccgtctccgtagattgcagctttcttttcttaggttagtgtccaggtagaaatgttcagcatgttatggactgaatatttgtgtctctccagaattcatatattacagtcttaaaccccaatgtgatggtattttgagatgaggcctttgggaggtaattaggtcatgaaggtgggtccttggtatgatgggactagtccccttatgagaagaggtaccagagagcttgatttgtccctctctgtgccatctaaggacacagcaaaaatgtggccacctgcaagtcaaagaagagagctctcatcaaaacctgaccatactggcagcctgatcatggtctttcggccttcagaagtgtgagaaagtaaattgatgttgtttaagccactcagcttatggcatttttttatggcagcccatgctgattaagattttgctaccaagaagtggg

SEQ ID NO: 14656 - DNA, 1205 bp, Homo sapiens
taaatgctagttaagttcttaggttaagctgcagagatacagtcataacctgagttgcgcatttctgatattaaccgttctaatgttaaattctgggtcctgggagcgggacagtacaagacaaagaggaagagaagagctttccctctttcttagctgctaatgtatgaatgtgggtaaggctttgactttccaaagttacttgaaattttaaattataaaattttaaaactctgaagaatcattggtagaatttcagccaatgtagtagtttagacatttaggggagaaatgtttttgctctggcctcagttgttcagttttacaaattcctgtattcaattttcttactactcagtgatggcttttaattacttcctcctcctttgcacatttgaattaacatattctctaaatgctaagcttgtacacaattgtataggggtagttgctgatgtagaaggacacttgtcacaatttgtatgtattgatcatttgtaagttgggactaagacttttctgtggtgtgtgtgtgtggtttttttttggaagggagtgtgttgttattctgtgttgctttgctttttcttaaaagatcctcttctatatatttcgtgtgatttaaatgttctttttttttatataggtttgtggtaaatatgccagctctagaacacatgaatcagattttacacatcttgtttgtatttttaccctttctgtgggcacttgggactctgcccccacccgatgcacttctcttatgggcaatggagcaggttttagagttcggccttggaggctcatctatgtcaacccacttacggtatttatttttaaatattgatgttatatgtaatattcttaaagaacatttttcttttcaagtaaatatttttttcttttttttttctgtacaggttattagtaatgttcatcatgtctgctggaacagctatagcatcatatttcattccaagcactgttggtgtggttcttttcatgactggatttggtttcttgctgagtctgaacttaagtgatatgggtcacaaaattggaaccaaatctaaggatttacccagtggtccggaaaaacatttttcatggaaggaatgccttttctacatcattatattagtcttggctcttttagaaactagcttgcttcatcactttgctggcttctcacagatttctaaaag

SEQ ID NO: 14657 - DNA, 1050 bp, Homo sapiens
tctgtagtattcaatatgtatctgaaatgttttgtggtatgtaatattttgtagtattgaagccatctgagcctcagcttctctctgtgggtagtttttaaattattcaatctctttactttttgtaggttattcagattttttatttcttcttgagccagttttagtaatttgtgtctttctaggaacttgtcaatttctgcattatctaatttgtggcctacagtggttcagccttaaagcatagttagtacactgtcagctctctttagtgttactgttttttttttttaagaacaaactttaaaatatagtcttgtttattaattatgaggttggagaaaattaacaaaaaaatcaaagaataagatttatttcttcaaaaatactggggcaataataaaattactgtatagtctgtcttatatgatcttgaaaattcatgaaaaatcttctaaggataaataaaaataatttttacatttctacaggttggtatcatacgtgatcgtttgattcagttcatctctaaattgcagtttgccgtgactgtgcttttgacatcatggacagagaaaaaacaacgtcgaaaaacaactgccactttatgtatactcaacattgtcttttctccattcgtgttggtcatcatagttttttctacactactctcttctcccttactccctcttttcacccttcctgtgttcttggtggggtttccccgacctattcagagttggccaggagcagcaggcaccacagcctgtgtgtgtgcagatacagtgtactactaccaaatggtgcccaggttgactgctgtactgcagactgcaatggcagctggaagtttaggtaagtaaatgggttgtgctcaagaatttctcactaatgtatttaaagtacaaaaaaataacaaacaggaaaacaatctttttatccaaccataagatagcataacaaccataacaatttgatgtgtaggcagaaagactaaatatgaaattagaagtttatctcctgctccttgttttcatctaaattaagtta

SEQ ID NO: 14658 - DNA, 1103 bp, Homo sapiens
gaaaacatagagtaaccagctggcaatcagtggagcttaatagctgggtatgaacacttaacagacaagatagccgtgccaaaaccatcccaaggtagctgtgtgcattcacagtttggctgtactctatgagaggtcatatctgagacttcaaactgggcagggtatggtagggagcagacagatactgacttcactacaataagccagccaatcactaaacaaacaagtacataataataacaagccctggagttaggaatgaagaggaccagcacccagaatttctacagtgttacctggaatatccaattttcaacaaaaagttgagatatgcaaagaaatgggaaagtctaacccatatatcgggggaaaaaagcagacaaccaggcttgcctgtaagagggaacagatgtcagatttaataaaagatttcatagtagtcattataaatatgttcatagaaccaaaggaaatcatggttgaagaaataaaggacagtatggtgacaatcacatcaaatagagaatgtatgtagagatagaaattataaaaaagaaccaaatgaaaaattccactagaggggctcaacagtagatttaaactggcagaagaaagaattagtgaacttgaagattctagatcaatagagattatgcaatccaaagaagagaaaagaatgaataaaaaggaagagagcttcagagaaacgtggaacaccattaactgctccaacatacacttagtatcggaaggagaggagagagagagaagggagaaaaaaaattatttgttgaaataatggctgaaacttcttaaatttattgtaaaacattaatccacacatccgggaacttcagtgaactttagaataaatgcaaagagatccgcaggcaaatacatcatagtaaaaatgtggaaatccaaagaccaggagaaaaccttgaaagcaccaagtaaaaactacttgtacattttaaggaaagtcatataaaattctgatttgtcatcagaagcaatggaggccagaagcatggaatgacatattcaaagtgccccctaaagaaaaccccaaaacagaaaggttaaccaaggaccctata

SEQ ID NO: 14659 - DNA, 1035 bp, Homo sapiens
actttaaaacttaacctaattggcatatatgaaacagaatacccaacaactgcaaaatacacattattttcaaatgcagatagaatatttatcaaaactgaccatattccaagtcataggaatggaatatattctttggccatgtatcattcacttagaaatcaataataatttcaaaaatagaaaaattctattaagttcataaattaagaaatacacttttaaataactcatggatcagacaataaattacaatgaaaattagaatatatttgaactgagtagtgaaagtgctacatgtcaaaacttatggtagacgcctaaagccatgcttagaaggaaatttatagtcttaaacgcacattaaaaaaaaaagattgaaaatgaacctagtagttaaaatattctaagaatagcaaattaaacctgaagaaaataaaggaaataataaagaacaagaattaatggagtagaaaatgaagataaagtggatcaactaagccaaaagttgattctttgaaaagataattgataagtgtctggtagactgaaaaaggaagaaacacaaacaaccaatatcaggaatgaaaggatattacaaatcctagagtcatctgacaaaatatgtgcacaacttcatgccaattagttggaaattttagatgaagtgaataaattctttaaactatggaagagccaaaattgacaaatgaaaaaatagaaaattcgagtagttccctatctgctaaagaagtggaacctatagttactttatttgcttttccatagtgaaacaacaagcctagatggattgattcgtcaatggaaagacaatcttaaattcttacaaagagcagtagaaatgcaggaaccctccccaactcattttatgatgccagaaaacctagataccaaaacctggcaaaaactttatgagaaagggacctatttcattccccccaacatcaatgcaaaaatcccaaacaaaatactagcaaactaaactacacacatacacacacacacacacacccc

SEQ ID NO: 14660 - DNA, 1071 bp, Homo sapiens
ggaagtttacagcagtaccacattattgaaactataatgaacttcctgcacatggcagttgcctaagacattttaatttgatatcataaaacatttttagatcggtgaagtaattatattatgggaaaggtgtattaagactgataatgtttgaagttaactacctcaattatatttgagaaataatagtcatcaaattgctttttatttggcttgtatctttttatgtattttgtgtacatattgtatctttttacatgaggggctgaggtatatgacctgttgaagggaacagtgcagtaggagacaaggattgtttagtcatggctgtgctccaaaatatctgtgtccatggacaagtcctttaaccttttgagtttcagcttccaaatcagtaaagccagttgggcagattatattatcacatgtactgtccagttactacatttaaaaatttttttttatcaatattgtgtgtctagtcaacataccgttgccaaataaatgcctgttatgtgtcaggcacttagatgtttcagtgttctaaggctggatttctttctcggttctgttttatttaacaaattctaagttggtgatggttctttagaaaagctgttcttgtgttcttgtaagctattgatttttcttttgggattgggatgtgtagggaaactcttgagaggaaggaggatggagatttcatgggagacaaagggtggttgagactacaggtttgaacaagcacaggacccttggtagtctgatgtgaaggacattataaaaacacattatgaaggttttttctgtcacttcaagctgggtcttgttaaacctttgaaaattctctaatacctcatttgtttttgaaagaaatctatagcaacatcattttgtcatgtggtaaatattgctgagcagtcactaaatacctatagtcttttagtttgttcagattacatctaggccatttgtttactctaatagctaatagaatgtacagctgattttggtttaactgtgcgtgcatatttgtaatttttaaccaagaagtggcatatgtccacaagg

SEQ ID NO: 14661 - DNA, 1076 bp, Homo sapiens
ttaagttcattttctcattcccaaagtttcagaagttaacaaagctaaacattttatgtcttcaagtaccattgtttaggttaaggaatggaatccatgttaattctcaagtggttgatatccttaatgaaggatctagggaaatgtttctgaacagatgtaatcagtagagccacattgaagggccccgtggtggacatggtgataaaactaacctttgaaagaaaggacagtttgagtccctgttctcctatttcgtagccaggtgttcctgggtaagctacttgatttcttaaacctgtttttttttatgtcaagtggaaatacttttgtcgtaaggttatcttgaagatttaatgaaataattatataaagcatttgagatcttttctaccatgaagaaagtgccaaataaatggtagctgttattattgagtatatgaaatcttgagatacttaggggtatagagacttgcttagtatgagagggttgtctttcagtatagcttttgcagtgtgcctggaagccaaactagagattgagtagagaatttagaagacattgtaaactctgtgagtttagagagcttgcatttgaatagactaaaagttatagaagaaagagaaagttgagtatgagtagctttatttggctctgcaaagctggcaagatgtcaagggtttggagttaatgattaggtgggagtagatggttaaattgcggataaagagtaacagtaataaagcaaaggtgaatgttcaggctagaatgatcagtcagtaaggaaggacaagggttggtattttgaagaggagttacagtttatggttagaaatgagcaggaagatatcattgctacaggaaaggatgcaaaagagtaaggaaactaaatcattctgattaactcagttattaccattttttaaaaatggagtctttataaaaggcgttaaggctttatatgtgagttctaggttaagtctgaaaaattgtcttggaatagtgtgggtcttactactgcagacccaaaccaagatattagcattccaactggtctctttcctgctagcatctt

SEQ ID NO: 14662 - DNA, 1047 bp, Homo sapiens
tttgcaaaaataatacagtgaacttccatatttatttaaatggccaattgttaacatttttccacattagttttacagacttttttccctgtgtatgtgcatatatgtattcatattctcttggcatgcacacacacattttgttattttttagttttgctgaaccatttaagactcagtatggacatcatgaacctttactcttaaatatttaaatgtgtgtcccctaagaacaaggactatcactttctcttacataaccatagttcaattatcaaatttaggaaatttaacattcatacaatactattatctaatatacaatccatagtcagattttatcagttgtcccagtaatgtcctttataacaatcttcccctccccattccttcaccctttgccttcatccaagccagtccataatcacatattacagtttgttgtgacctccttggtctcctttaacctggagtggttctttagtctttttgcattttgtttttcatgagctctgaagttttttgagggatagttctttaataactttctcatattgttccaggtttctggtcttcactctagcactaattgaaaaaaaaaaaatttgttttccgagaactgttactttcctccatattttcaaatttattaacagagaattgtacagagtgatttattttacaacaataaaattctatttgtgaggtgagtatagcctgtttggcttctaattttaaataatttttttagttagactatttagtggcttacctattttatttttttcacatataacatgtactataattttacgtaatatattccttcagcttttattttattttgtatgtgtgtgtggttcatttttctttttaggttgaatatttagtatactgattttctttagtatactggtttttttaactaagtgtgaatttttttttttctattttcaacacactattgctggcttaaaggtgaggtttcttaataaggtttggtcacatctcagaatttgataggagatttttctcattattgtttct

SEQ ID NO: 14663 - DNA, 1071 bp, Homo sapiens
ttgatatgttaaagtgttattatacttgtaccattcaattggagattgtcataaattaaatatggtattttttactcagatttgatgagactgcaactagagaataaatattacattaaaattgctgctattttaaaacatagaatgtaactgtttgtattgtaaaagttgtgtgtcctcagtgaaaaatactgccttcagcttccaaagcaggcacctgaatgcctttttcttttctctctctcttctttctttaaatacatgccttcactagattgctgtgacctactaaacctcattttatttgcttggaacatttttggcttctctgtccacaccatagaaaaggacaaaggccttccagctctccttttctcttatttgttcccttctaaatacttgactctctgggggtgtgaaaagattcagctcataatttatactactattaattttgtggtccttctaagccaatttaaaattatacttttgtgtatatattttcaaaatctttgctactgactaccttagctttaaagttgctaatttggagatgactgatagaatccctgaaacttggtggaggggagtggaaaggagcagaatgtgtttgtgtatatgtatgtgaaacatggatcttctatatataaatattctttagaaaaagcgttcagtctttttacaattctaagtaaaacgtataggtcaacagaaattaaaggaatatttcttaaaattcatttatttttcttttttgaaagcagacagaagcaaggctagtatagtatgaatggtcaggtagtttaaatgcgttgtcccacgtggaacaggagatattaactgtttttaaagctttacattatttttttacaagaatttgttttcctgtaattttcttcacagttaaaatatcctaatttatattttaacaaaagagatgtaagatacatcaaatatagatgattcaaggtaatgttttttagacctgaaactattgattcaatttatcatcagtgtttatttctattgtatctagttatctatccaaataattgtattggcttagcggag

SEQ ID NO: 14664 - DNA, 1032 bp, Homo sapiens
tttggcaatcatttaaaaaatttaaaattatataagctattaataataaaagcaacgtaagttattaagtgaaaggtaaaaatttctgtggttcacttctccagaggtgacaacttttaggttgtttgtgtatattttcggatattttctatgcatatacaaacatgggtgtgtttgggtagaaaactttttcttcctttagcataaacaggaatatagcataaacatatatatatgtgtgtatatatatatatttccttgcttttttcattatgtatattggataatctctctagatcaatatgcatatgttttcctcttttaacaatttgatagtagtccattgttcaaatataatttatttaccccaatttttaaaattaatatttaattatccagtttttccttggagtaagcatccataaatatgcatatatatgtacatatatgtctttgagcatttaggccagtatatcataagatataacaggtaaaaatcacaaggtaatgtccagtagtagaattgttgggtcagagtttgtggcttttaaatttgataaatatggcccagttgttctcaaaaaagattatgtcaagacaggcatggttgttcctacctgtaatcctagctacttgggaggctgaggagggagggttcgagaccaacttggacaacatagggaaaccctatcctttttttttttttttgagaaggagtctcgctctgtcgcccaggctagagtgcagtggcgcaatctcggctcactgcaagctccgcctcccgggttcacgccattgtcctgcctcagcctcccgagtagctgggactacaggcgcccgctaccacgcccggctaatttttttgtatttttagtagagacggggtttcagcgtgttagccaggagggaaaccctatcttacaaaaaaaaaaaaaaaaagatcttgtcaattatgttaccaacaactgtatggagattcctattgccacacaactttgcctatattggctaatattattttttaaaatcttg

SEQ ID NO: 14665 - DNA, 1031 bp, Homo sapiens
tcctgggttcacggcattctcctgcctcagcctcccgagtagctgggactacaggcatctgccaccacgcccggccaatcttttttgtattttattagtagagatagggtttcaccatgttagccaggatcgtctcgatctcctgacctcgtgatccgcttgcctcggcctcccaaagtgctgggattacaggcgtgagccactgcgcccagcctttttttttttttttttttttttgaaacaaggaggaaaaggaaagtttatagttatagaaatattctttgtagttaagatgtgaaagtgggctttattgttaaataagctattttttaaaaaaattactatttgctaaagaaacataaatctgaaatcttgcagcctgattttagctgttctgctgatttaggaaaaggtcctttggggaagcaaatcattttggttggttgggtacaggttttgcaaagttagcatcaggggaacaaaaatgtctgggtgataccaaatatacaaatgttgtacgtggttccaaatatggaaatggttttgtctaaagcagccactgaagagaaattatctaaatattagcccctttaggaaagtggaatgtgttgtctgatttggctctcaggcttagtatgaaagtttgtgcaaaagtacagcttacaaaatgctatttgttttattaaaaggattgataggaagttgacatacttagttaatttaaatttggaaggagctcagcaaacatctttctagttgtattttatgtctccctccaccttcttttttttttttaatcaaatggggaaactgaagcctaagaaaggatatatggttgcatagcccacctggacagctccagtctctttttttgtgtgtaaatcccattcagaaattaaatttcaaaattaattttcaattacattttgattacctgttgactaaatacatttttttttactgtaatgcaactgggttgtaactcaaactcatgcataagatgaaaaaactacaatattaaaaatcatttt

SEQ ID NO: 14666 - DNA, 1049 bp, Homo sapiens
aaaatcttatacctctaggcaatctaagacatacagtactgtgttaaaaattttgagcttttatttgtcatatggttgtgactctagcagaggttggatatattctttattaaagtgtagaatcctcaaaatctgcctctataaatttaaaacctataatcttagaaatatataaaatcttgacttataaaattaaatgtataacttaaaaatgattaattcttttaaaatgaaaattttaactttctaatttctcttttaagtgatttttaagaagatgatttagataatgtaaaaggattgcatctgttaaataacaaactccactgggtgcagtggcttacacctgtaatctcagcactttggaggcctaggcgggtagatcacaaggtcaggagtttgagaccggcttggccaaggtggtgaaaccctgtctctactaaaaatacaaaaattagccaggcttggtggtgggcgcccataatcccagctacttgggaggcgtagacagagaattgcttgaacccgggaggcggaggttataatgagttgagataaagccactgcactccagcctgggtgacagagcgagactctgtcaaaaaaaaaaaaagaaaaaaaagaaatacaaattactcccccttactccttttttgggtattcgtcttgttttaaaaatctttttgtggcctggcgtggtggctcaggcctgtaatcccagcactttgggaggccaaggccggtggatcatgacgtcaggagatcgagaccatcctggccaacatggtgaaactccatttctattaaaaatacaaaaattagctgggtgtggtggcgcatgcctgtaatcccagctactcgggaggctgaggcacgagaattgcttgaacccgggaggcagaggttgcagtgagctgatcgcgccactgcactccagcctggcgacagagcaagactccgtctcaaaaaaaacaaaaatctttttgagaaacttttagatatgggacaattaatgaatatctaatactattcattgtatgactagattt

SEQ ID NO: 14667 - DNA, 1046 bp, Homo sapiens
aatatccactttttatggatgagggaattgaggcttagagattctaagtaacttgcctaaggaaacaaactagtaaatggctcagcctagattcagctaggcctcattgatgacaaacctttgcttctgaatcaccatgccataatacactttgtataaaccctttttgtttttctcctttatatcagaatgtggatgatggcaacgctatgtgcattttcaaaaagttaccctactcctaagattataatgttgagtttacatttttaagttatttttttgcatacaaaaagtgtatatataatatgtatagtttaatgaataatgaaaacaaatcaaatgcttgtgcactaaccccctgggttgagaaatagggtattactggtaagtttgaaccctctatcttttttctattatattttctcctcctcccatagaaatgactacttctttgaattttgtcattctttttcttttcttcatagattggccagatattgttggatctctaaacagtatactatttagttgtggattctatataagtgtatacattatatatttgtgttcttttttaagatatattttaaaaaatttgaaacaggatcttgctgttacccagggtagagtgcagtgggacaacataactcactgcaactttgttctcctgggctcaagtgatcttcctgcctcagcctcccatgtagctgggaccacaggcatatgccatcaggcctggccaatttttttattttattttattttttttcagatatggcggtctaactttgttgcacaggctgatcttgaactcctgggctcaagtgagccttctgctttgacctccctaagtgttgcgattataggtgtgagccactgcacctggctaagaattattttactgtggtaaaaaacacacaacatgaaatttaccattttaactgctttaaaaattaaaaaaaaaatttgttttttttagagacagggccttactccgttgcccgactggagtgcagtggcaccatcaaggctcactgcaaccttga

SEQ ID NO: 14668 - DNA, 1049 bp, Homo sapiens
aaaggattggttttaattctagatgctgtaatgtatgcttgtgtaaggatgaggttaggaccttgagaggggtgataaatagggaaaagtagtagtgtcagtggatgggagctccttgtgaggtcaaaggatagagtagtggtatttaatgcaagtcatctgaaaggagagggaaaggtgttcagagagtgagatgctagaaacagacaacccagcagagagatatatatatattgataatgacaagattgcaggctgaaggtatgagggtgagtgacttaagtgggatggggcaagagatcattggagtgaggcagtccaaggaattaaatgtctaggataatgcctggcttatttatgaggatgttcaagttgccaaaaatgatgataggtatagtggtgaacagggagaccagaccatataagccagatgctgaaaactgtcctggggggggaggagcagatacttttaggggaggccataactgaggataaagatggtgggattccagaactagtatcactgattgaagtgtctgcaatatgagtatgtattacgtattgagaatactttggatcatattcactataagtggttccagagggtgatggggaggacatgagaatacagtgattgtgatcatggcaggaaaaaggtgtacaacatttaaatttaaatggacttgtatagtgttgtggttttttttgttgttgtttgtttgttttggtttttgtttttttgagacagagtctcactctctttgcctaggctggagtgcagtggcatgatcattgcctgatgcagccttgacttcccgggctcaggtgtttctcctaccccagcctcctgagtagctgggattacaggtgcacaccaccactcccggctaatttttttgtatttttagtagagacaaggtttcgccatgttgcccaggttggtatggaactcctgggctcaagcaatccacctgcctcagcctcctaaagtcctgggattacaggcgtgagccaccatgcccagcctttgaatagtgttttaggaagtt

SEQ ID NO: 14669 - DNA, 1028 bp, Homo sapiens
tcggcttcccaaagtgctgggattacaggcatgagccaccgtgccaggcaacgaaaatactctttttacagttagtttctggaaagtgtaagaattctttggtcaagtggaaaggacttgataaatgtgtagctatagctaacacttttttttttttgagaacgagtctcaactctgttgcctaggctgcagtgcagtggtgtgatctcagctcactgcaacctctggctcccaggttcaagcaattcttgtgtctcagcctcctgagtagctgggactacaggtgtgtaccaccatgcccagctaatttttgtatttttagtagagatgggatttcactatgttggacaggctggtctcaaacccctgacctcaggaggcctcagcctcccaaaatgctgggattataggcatgagccaccacgcccagccagctagcactcagtgaacatttactatgtatcaggaattgatttaagttcttttacctataataactcatttaattaagttgattgttgggtggccatttgattttttaaaaggtttccatttccccctctttattagtgtaattcaaaaatagttgtcaatactaatcagaaaaataaaaaattacaaatataaaatataacttaggttttgaaacaatctggggaacgggtctcaaacttgtctgttattttattaattgattttccctagtgtttattagggatttaaatgattaattgaaaatgttagcaaatgttgagcaaacattgatatactttgctttcaagaaaacaaaaatgagaacattgtatttttagaactatttcaccttgagttaagcattgcttgtcataaaccaaatacagttcttgccttcatagccccacattctctgtatggatcttctggaattttctgttgttgaggtaggagatgatagtttattctcacacatctgctttatatagcttatataatttagtctataattatttgctagtatcaactgtttttaattgattcacaagaatgta

SEQ ID NO: 14670 - DNA, 1200 bp, Homo sapiens
gatgattggggtggtacctagacccatctaaaacagtatattaacagatcccaccaagtccccaggaatctggttatagagaggtttgcctctccagttcattgttttttcaactcaagtcttctaggaagttgtaagcccttcttaatgttgcactaccagaaaaggggatgcaggtatctgggaaacctggcttgcctgggaattcggtttgctttatttggggcaacgaactttaaccgaataaagcttttataagcagccactctttctgggatttctcatggcagaagttgtgttcattttctccctcacacatactggagcgctcaaagttctttatcctctggccagtgaggcctcattcagctagcacctctttcttgtaattgtcatttgctcagttgattactgaactttcaaaagacattcttacaaggaaaggaagaaaaaaacatctgttttagtgcttggggtatatagggctctctaaagagcaggcccctggcagaggcttctcttgcccaggtctatggatgatattgggactggggatggaggtgaccatacagtagccttttacatgctctttgacttctccctatcctgctcttcttcctagtctctcactcaatttgttttaatttataaatttgtttgatctgtaaaactaaactggtatcacttgggatacctatatctgaaaagtaagctccaaatgaaaaagaacattttccagaaagttttttggtaagattttaaatagaagtgactagttttcaagtctcactctccttatcccataggggcaaactattcagatgtgttgtagatttgaacattggcttaaatgttatgttttatttctgtccttacagctgtgaaagttgtgtagatttactgtttgtgagaggagctggaaactgccctgagtgtggtactccactcagaaagagcaacttcagggtacaactctttgaagatcccactgttgacaaggaggttgagatcaggaaaaaagtgctaaagatgtaagtattcctgctcgaatgattcagtcaacaaagaggactttaacaattatgtcagtaattgattattatttgctcataaatgtggacagattagcaagtaaataactataaattcatttaagttcttagagaactgagtaatattatttatctttgttaaagaaga

SEQ ID NO: 14671 - DNA, 1049 bp, Homo sapiens
atacttaagtaaagaacctatttaatattgtcttttaggaaaaatatgtttaatagagatagtaacacttcatagctggggaggaagactatatgggtacatgcatctgtgtgttgataacatattagagtagtttaaatgaatggaaaacatattctgatttttcaaaaatggggttcctattaaccatatttatagtgactaaagccatatgtttatcattatttgtgcttctgtggatatagtagtcttaaagtactttgaagcagttgactgttgaagtggcattctattaatcagtattattctggaatcagaggttggagtaatctttgtgccttttctttctgatgtgtttagtcaaaaggaagattttatcaagaaaaaatgatttcagttttcttaaataaaatttcagagatgttaaaaactttggaagttgttatatgttgatttaaaaaataatgctgctttttaaacttgcagtaattattactaagtgcgggtttggaaatgacacaaaggttatatactgtgaacattagaatgagactatgaggatcaaacagcaatcatttttattctttcaaacttaataggtaactgtactcaatatttactattaaaaataagattataataaaatggatcattctttagaagatttatatatgataaacttaacaattcagattcctgaggaataataaatattctaattcctttaatttctttactagaaaatccagaaaatctttttgtttcaactgttacctgaaacttttctcatatgtctaagttcatttgttatgccatagcaaaagcatgtggaaaacataatttagggtttctctgggatctttcagtgccataagagccactgcttttccattctgcatgtactcattgcactttgtatgttatcttagcaatcatgagtgactatggattttagctgaaaagatggtagaattgggagtgacaaggcaaagtggaaaagttagaatgtagactgagaagaaaaaccagaaagaaatctacaagaactg

SEQ ID NO: 14672 - DNA, 1029 bp, Homo sapiens
attgataggcaagagcaagtctggatattgggggtatacaacatgtaatgctttctttaccaaaatatagaagctgtggctcagaccatttaatttgaaagtgattctgctattatgtgtattcatgaaggactgtcttcagttgcagtatcgggaaactctcttaagcaacctccacttaattgtctcattgaagtaactgtcattccccagttcttccataaaaggtactcactgatacccacagcataatgaatgcattgtgaatgccatcaaccttcttatgccagttgtacttgttattgtagttatgtagttatgtaattaaatacatatttaatattatatgtaatttaaatatttaaagtgtgtaaggttggggaaaaaattgtaaaactctagaaggattctgtttctcaggtttttaagtcacttcttaaaaaatggaaattggccaggtgcagtgactcgcgcctgtaatcacagcactttgggaggccaaggcaagaggattgcttgagcccaggagtttgagatcagcctggacaacataatgagatctataccaaaattttaaaaagtagctgggtgtagtggcacacgtttgtagtcccagctacttgggaggctgaggtggatctctgaagtctaggagtccaaggctacagtgaaccatggttgcgccactgcactccaacctaggcaacagagcatgcccatgtctcaaaaaaccagaaaacagaaaaggaaactgaacaatatagatgacagttatggcctatataaggaagaagcaaaactctaaaatctagaatttgctctatgtcattaagttagagaatgactatatacttcctatatatgttttaagttaaagtatttgaagagagagacaggtgtatgtgtgtgtttctctcctttaacaaacttatttaaatgttcaactataaatcctcattgtgtttattaaagagtggttctactctatttaaagatattgatgatttttgggaagtaacctcttggatt

SEQ ID NO: 14673 - DNA, 1027 bp, Homo sapiens
gttgcttccaagttttggcaatgattaataaagctgctgttaccattcatgtgtgggtttttgtgtgaacatgtgttttcaattcatttggataaatacctaggtgcttgattgccagattatatgatagagtatgtttagttttgttagaaactaggaagctgtcttccaaagtggctataccatttcacattcccaccagcaaggaatgagagtccctgttgctccagatctgcaccagcattttatgttgtcattggagttttgccattctaataggagtgccttagaagtagtggaagtgataataaagatgaatcagacctagaaactgccctcaaggaacattctaataggtcagacaagatgtgcacattgaaaataattatacagggtaggaagtgggtaaatgccagcagagcgatattagacaatgtattgtaagcattcagggatggagagattgtaactgcaaagtgtctcataaggaggagctggtcattaaaatgggtatagaagggtgagtcatatgtggatattcactgttgttctgggttgaggttggtactgagatgagccctatgggtagggaacagtttaatcacaggtatggaaatgggaaagtgtaggggcatacaaatgcagaggactgctaggtagcagtggttttcaggcattgagagaaatgacacaactagttttgtaggcattgtagataaaagttcaggtttggaatcagatagcctaggttaatggctgggcatggtggctcacgccagtaatcccagcactttgggaggccaacgcgggtggatcacttgaggccaggagttcaagaccagcctggccaacatggtgaagccctgtctctactgaaatatacaaaaattagccaggcatggtggtgcatgtctgtaatccaagctacttgggaggctgaggttggatctggtagatgttgaggatggtgagagttgtgaaagatcattggatttggttgcttagaggatggcctattaaatacaag

SEQ ID NO: 14674 - DNA, 1292 bp, Homo sapiens
aagtgttcaatccatatttggtcagtctttatattctgttgatgatcactccttatcatttttaagcctcatccccactctaattagattattactttatttagggctcttatttctattctttcttttttttttttttttttttttgagatggaacctcgccctgttgcccaggctggagtgtaatggtgtgaacttggctcactgcaaccttcatttcctgggttcaagcgattctcctgcctcagcctcccgagtagctgggattacaggcatgtgccaccatgcctgactaattttttgtatctttagtagagacagggtttcaccatgttggccaagctggtctcgaactcctgaccttgtgatccacccgccgtggcctcccaaagtgctgggattacaggtgtgagccgctgcgtagggctcttatttcttatctgggttatttgaatatacttctaactagtcctcctattgtcagtcttgaacccaattgatctttatgtataccttactgcctctagtcatctttctaaactcatccctcaaattcccttaatatgttcccagtggccttagtatagcaaaattccactagtatggtataacagaatagttgttttatttaatagtaacgtgtctacatgaaataaagtaaattctattttcttcaatatggaattgctacattattaaataataagtgactagtgtgttttatgcttccaataaagaaagtattagagtgtggtatatgattgctcttggctcctaaatttattccacgccatatataaatttttgttttagactcgagaacaggaagaactggaagaagctttagaagtggaacgacaggaaaatgaacaaagaagattatttatacaaaaagaagaacaactgcagcagattctaaaaaggaagaataagcaggcttttttagatgagctggtatgtattaatgctaattgtgattgtaaaaaacattcttcaggatttacctttcctagtaggctggatgatggcatttaaagggcttttccacagtgtttgtaatctggttcacctttagttttgttggttatgtattgatatcagtgtatttattgctgaataagaggttgccctccatccacactgaacaatatgtttttatgctcacaattctgtgggttaggaatttaagtggttcttttgggcttttctgcttccctaatgtattctcaggacacctctccatgtggttttgatagcgacaggaggcagccaaatgcctaggcagataggga

SEQ ID NO: 14675 - DNA, 1050 bp, Homo sapiens
aacttggagaggaaccaaggaaggatgtataaatatgattaaggtttctggaaatagatcctttgagatgtgacagaaaagactgaatttatttgtttaataaacctagagaaagttgaagggttcaaaatgggcataaaataatgactaagaaatgaggattttattattatatattcacataggtagggttcagtcagtcagtgaacatattttgattaggaatattatgaaggttgtgccggatttattatttgaagtatattttctaggaattaaactgtcagggagtggagtaatgttaggcatagggtcttagagaaattaatgtaatttgtgacttcagaatttaagaaggttctacttatcactattttatgcatgaataggagaaatttttttttttttttttttttttttttgagatggagtctcactctgtcccccaggctggagtgcagtgatgtgatcttggctcactgccacctctgcctcctgggttcaagtgattcttctgcctcagcctcctgcttagctggaactacaggtgcatgccaccatgcccggctaatttttttttgtattttcagtagagacggggtttcaccatactgaccaggctggtcttgaattcctgacctcatgatccacctgcctcggcctcccaaagtgctgggattataggcatgagccaccgcacccggacagaaacttcattttatagattattgtgccctctgtgtggtgatagcttttgaactcttaaagtgagagctacaactttgtttcttggccaggtgttagttattttgatctatttggttcaaatcctgtcaatataattatgcagccttctatttctttatcattttacaaatacttctaattatttttacttagcttatggttatggttactattcttcattacatcattcttagttgaaccagtgaacagacctcaaagttttttttttccctgattcattactagataatttgtgtcaataaatatccatgcaagtaaatcttagtcttttgggaacaagcg

SEQ ID NO: 14676 - DNA, 1070 bp, Homo sapiens
gatgcacctgcctcagcctcccaaagtactggaattataggtgtgggccacctcacctggccttatttagtttctttaatgaagattattgatatgatatggctgtgtaaaatagtctttttatttctgtattattgattttcattttagaaattagatccacaaatgtaattacttctgatgcatggccttttatccttgaaatggtaaataacacatactttttcattgctgttacccattctagcaaagtttcactgttttatcaaaggtattcaagttattttccatgttctgcatagtagtaacatgtacttttccactaggagcatttgagttgagaatgagaactaatggggaataattgtagcctcctgttactatgtttcatggcacaaccaagagacttttttccttgcctttatacagaagataggcagaatagcagtgagataggtgttgggttttaatgtttgagagcttcaaattctggctctgtgagttatgcttttgggacttgggcaaataaccttattcatgcttggaataaccttacagtgtattgtttgtgagaataagataatataatgaaatgctcaatctttgagcagccttcttagatgttgtcaaatgcaaagatgagttcctccatggataacatggtagattaacttaaaaacaagcaaataaaaagaaaccaagaacagcaacaaagtaaaaagaaagagagtgattaggtgactggctccaaatataagataaacatttcttaaatctggatgtagaatctgccaaaatgttaagttgtcaaaaaacaaagggaaaatgatctgttttaagccataaataggctaatcagaaataatgacatggtctggtaagaaatattaatgacttttaaagtcattaaaggattacttaaaggataattgcattttccagataacagggaacctaaaactaactttattcttttttgggttcatactttatgggaatttctattaagcagattatcatctagtgaatacatgaaaagacaaacattggtctggtcatcaagtagaatt

SEQ ID NO: 14677 - DNA, 1074 bp, Homo sapiens
gatgaaaccccgactctactaaaaatacaaaataatagctgggtatggtggtatgcacctttaatcacagctacttgggaggctgaggcaggagaatcacttgaacctgggaggcagaggttgcagtgagccaagattgtgccactgcactctagcctgggtgacaaaaacaaaaacaaacaaaacaaaaccaaaaactggttcctattcattctaactatttttttttctacccattaaccatccccacatcctctcccacctcctcactacccttcacaacctctggtgaccttccttctactccctatcagttcaatttttagcttccacaaataagtgggaacatgctaagtttgtctttctgtgcctggcttatttcacttaacataatgaccaccagttccatgtatgttgtttcaaatgacaggatcgcataccttttttatggctgaataatactccactgtgtatatgtaccacattttctttattcagtcatctgttgatggacatgtagattgcttccaaatcttggctattgtgaacagtcctgtaacaaacatgggagtgcagatgtcattttgaaatactaattccctttcttttgggtatatacccagcagtgggattgctggatcatatagtagctctatttttgttttttgacaaacctcgaaactgttctccatactggttgtactaatttacatatccaccaacagtgtacaagattttcttttttccacatcctctccagtactcgttactgcttgtctttggataaaagccatttaaactgggatgagattctatctcattgtagttttgatttgcatttctctgatgattactggtgatgttgagcatttttacatatgactgtttgccatttgtatatcttcctttgagaaatgtatgttcaaatcttttgcccatttttaagttggattattacattttttcctgttgagttgtttgagttccttacatattctggttaataatgccttgtcagatgggtagtttgaaaatattttctcccattctataggttgtctctttgttcatcga

SEQ ID NO: 14678 - DNA, 1051 bp, Homo sapiens
actattaaccatcacacagagtatagaatgagttagggagtgtttcttcctcttcacttttttagaaacatttgagaaggattggtgatagttcttctttaaatgtttcatctaggttacccagtttgctcatagttctctcatataatcctataatccttttaatttctttagaattggtaataatggctccactttcatttctgattttagtaatttaagtcttctctcctttttccttagtctatttagcatttctgattttactaatttaagtcttctctcgttttttcttagtctgtttagctaaagatctggtaattttgttgatctttttgacagaatcacctcaatttatttatttttctcttttttctattctctattttgtttatttctgctttaatcttcattattttcttttttctgctagttttaggtttagtttgttcttctctttctagttccttaagtgtaatgttagattgttgatttaagacttttcttgttttgtttgttttttttttgagacaaagtcttgctgctctgttgcccacgccagagtgcagtggcatgattcagctaactgcaacctccgcctcccatattcaagtgcttctcctgcttcagcctcctgagtagctggaatttacaagcgtgcaccaccattcctggctaattttttgtagttttagtagagaccgggttttaccacgttggccaggctggtctcgaactcctgacttcaagtgatctgcccaccttggcctcccaaagtgctgggattacaggtgtgagacactgtgcttggtcagatttttcttgttttttaatgttagcactcatagctataaattttcctcttagtactcttttgctgtgtcccatacgttttggtatggcttgttcttgtttttattcatttccaactattttctaattttccttgcgattttttttgaaacattggttatttaatagtgtattgtacgatttctacaaatttgtgaattttctagtttttcttccattattggttgctaacctcatc

SEQ ID NO: 14679 - DNA, 1055 bp, Homo sapiens
gcttttagtgtgaggcctggagtgctggaaggagttttctaggttttcttgttctaccctctagttttcaacaggctctgtaagcctgagccacagagggcttctctcttggtgttgctcccctatagtagattgcccttgctttttacttagaataagtcttatggtgggaagaaggtttttcttgcttctccttttccaacgttagtcataggaggacctgtgtgcctgaggatcaggatggtgctttcttagtgttcctacttctttcccagaggccaacaatttgtatctgttacttcagggtacaggtggcttttctgtccctccccagactcgcaactgaagtttgtcttgttttgttgcaggtggggaatcttgggcacagggctgtttcctgcctctcccctagacttatgctttgcatcagtgtaggaccctaggtgtgagttggtttcctgcctttcctcagtggttggtttctctttcctgtttcaatgtaggactaggaatgcgggcagtaggttttctacccctcctccattggcacccaatctttgctcctccgtagcagtggaggcttggatgttttttttttttaaaataatttatttcctcttgcatttagtgcttcattattgctgattttattgggtctgtttcatggaatatcctcctcatctttcttttttagtcttctatggtggtggtacttcttagaacatgaagatttaaataagggttagaattccctgtaaagtaggtttagcctgattgtctattttttcccagtaagttattaaattaaataaacttgggcaacactttgtttggagccctttttgtgtttctttctgcctttacctctatgggttggagttttaaatgtaggatgtgtcctttagataaggtataaccttagtgttcttacttttcccaagtttttcatacttaacatctgatttgaagggagggaggagcactttttgtgtgtttgtgtgtgtgtctgttggtggtggtggtggtggtagggccttcatcaagcattgaatatt

SEQ ID NO: 14680 - DNA, 2092 bp, Homo sapiens
cacaactagattcatccatttcaagttattaatcaaatataactactgtcttcttttttctttttgaaatggagtctctattgcccaaactagagtgcagtggcgtgatctcggctcactgcaacctccgcttcctgggttcacgcaactctcctgcttcaaccttctgagtagctggaaaaacaggcgcacaccaccatgcctgtctaattttttgtatttttagtagagacggggtttcaccatgttggccaggctggtctcgaactctgaccccacgtgatccacacgcctcagcctcccaaagtgctgggattacaggcatgagccaccgcgcctggccataactactattttcactaagtatacaagtgatttatttaatgtgagctgttcatttgtgaatgattatggaaataaaaaaaaaagacttgttggcaaagtgttgaatagataactttattgttattattttatttctttcatgtactccagcagataaagataatgtaccttctgaacctactcttaaaattcccaagaaatcaattgacagattagttataagtaagaaatttaaaacttgattttaaacatttataatttatatccgcatgattttttgtaaattttggtttggattcttagaagttcatatcacattttaatgaatgtttatgagtaaatttctgtattactcaaatacttgaatagtgaaaaataattaaaaattacagagtatttaaggtagatataaatttgtcatatatatggtttcaggcaaactttgataccggccatgaaaatactacatgatgaaatatttaagtagtttcatataagagttacggttttattaaaagcactgctagtttatatttatgtaaatatatgcattatgtaaatacataatttatatatatctttaaatttctgtgtaaaataatcatatgtaaagctgagaagtaagaatgacttctctaatatgatatttcagaatgcctttctcagttttatgggaatatctattactttcattctatgacatgttgtgacatttttatgataaaatatctttatttaaggtgtgtattcttaaattttccttatgcatgatttaaatgaagctgtttgctaccaaaattctgcagaatgaaatttttttcttttactgatacataatattttacatatttatggggtacatgtgaatatttttacatgcatagaatgtgtaattatcaagtcaggatatttggggtatccgtcaccttgagtatttattatttctatgtgttggtaacctttcaagtcctctcttctggctacttagaaatatataacatattgttgctaactgtagtcaccctagtctcttattgaacattagaacttatttcttctatctaactgtaagtttatactcattcactaacctctctttatttttcctttccgccctcacacccttcccagcctctgctatattctagtgtctatctccatgagatcaagtttttatgtgagtgagaacatgcaaaagttgtctttctgtgtctgatttattttacttaacctgatgaactccaattccctccatgttgctgcaaatgacgtggtttaattcctttgaatggctaaatagtaatacattgtgtgtgtgtgtgtgtgtgtgtgtgtgtgtgtgtgtgtgtgtgtgcgcgcgccacatttttttaatccatttgtccatagatggatacttagattgattctacagtttttgctattgtgaatggtgttgtgatgaacatgtaagtgcaaggtgtccttgatatactgatttcttttcctttggttagatacccagtagtgggattgctggatcatatagttctattttaattttttgaggaatctccatactggtttctgtaatggttataccaatttgcattcccaccaatagaatcctcttttctctgtatccttaccagcatgtgtaattttttgtctttttaataatagccctgctaactggggtaagatgctatctcattgtggtttatatttgcatttccctgatgattagtgatgttgagcattttttcat

SEQ ID NO: 14681 - DNA, 1026 bp, Homo sapiens
aaactttattattgtcttattttaagaaattgctatgacctccccagtcttcagcaaccaccattgtgatcagtaaagcagatatcaacatccaggcaagagctttcatcagcaaaaagattaggactagccgatggcccagaggatcattatcatttttcattaatacataatctatttatttgggattttaactacatttgcaaaatcattttttatatataatataatcacagcaatgaagactgtcaaattgatggtcctatttatacccaaggactgagaattatgcaaggaatggatacaacggggtagaatattgagggccatgtctaaattctgcctactacaagcgagataggttttctcttgctacttatctttctcaaaatattctaagcatttttatacatttatactttgaagtaaactttgttggcaaaagcaacaaagcactccataattgtttcaaaatttgtgtacatttgaaaatttttataaaatactgtgaatcaagtaatgaaacatcaaaagccaccaacaacttagctaataagatacatccatccccctatatagtaatcaaacaccaatccttttgggattgtacctggaatttaaacttacaatctgatcagagaagaatgggcatttaaaatatacttagtttttatatatatcacacatttcttggaaattaattttcattatattctacttttgatgctgttgtgataaagttttcatcatgctttctaactggttcttgctgttatatatgaaaactattaaatgtaattttctacataatattttactgaattctaatagtttctatacctagttctattaggtgaatatctgggtttttatctaggagtcagtcagctgaaaaaaaattttttttcttttcaatgctatatttgtgactttaggtttatattttattgtattttggctagaacttgtagaacttttagaccaagtataattctaataactgtagtttctttctgtttttttttc

SEQ ID NO: 14682 - DNA, 1461 bp, Homo sapiens
aaaaaaaaaaaaaaaaaaaaagttgctagaatcaattttaatgaaacaaagattgcaacagtattgcactttctagaattaattgtgaaataaaattttttatattctgccaaactcatccttatcactaagatatttcctagttatctgaatatctgtttcttcagataagaaacttttgtaattaaaattaacaaaaagtattctccaggtgactatgagcagagataaattgatgaatctaactataacatctattgaacataactatgtaaaaacaaccaattttaatgcactcattgacaaatctgcagaagtcaaagctcaaaacaaattataatgtgatagtccattttgtgcttataaattgtgccatttttaaaaaattaatagatattttagtttgttacttatttctttcatgatataaagattattttacgtttaaatttttttattggaataattatgtgtacaaagtgctataaaaggaaagcctcactgtgtgctttttctggattgttatttttttctttattttttatttttattatactttaagttttacggtatatgtgtacaacgtgcaggtttgttacatatgtatacatgtgccatgttggtgtgctgcacccattaactcgtcatttaacattaggtatatcttctaatgctatccctcccccaaccccccgaccccacaacaggccccggtgtgtgatgttccccttcctgtgtccatgtgttctcattgttcaattcccacctatgagtgagaacatgcggtgtttggttttttgtccttgcgatagtttgctgagaatgatggtttccagcttcatccatgtccctataaaggacacgaactcatcactttttatggctgcatagtattccatggtgtatatgtgccacattttcttaatccagtctatcattgttggacatttggcttagttccaagtctttgctattgtgaatagtgccgcagtaaacatacatgagcatgtgtctttatagcagcatgatttataattctttgggtatatacccagtaatgggatggctgggtcaaatggtatttctagttctagatccctgaggaatcgccataccgacttccacaatggttgaactggtttacagtcccaccaacagtgtaaaagtgttcctatttctccatatcctctccagcacctgttgtttcctgactttttaatgattgccattctaactggtgtgagatggtatctcattgtggttttgatttgcatttctctgatggccagtgatgattagaattttttcatgtgtctgttggctgcataaatctcttcttttgagaagtgtgtgttcatatccttcacccactttttgatggggttttttgtttttttcttgtaaatttgtttgagttcattgtagattctggatattagccctttgtcagatgagtaggtt

SEQ ID NO: 14683 - DNA, 1511 bp, Homo sapiens
cagttcgagcttcctggctgctttgtttacctactcaagcctgagcaatggcaggtgcccctcccccagcctcgctgccgccttgcagtttgatctcagactgctgtgctagcaatgagctaggctctgtgggcgtaggaccctccgagcctggtgcaggatataatctcctggtgtgccgtttgttaagcctgttggaagagcgcagtattagggtgggagtgacccaattttccaggtgccgtctgtcacccctttctttgactaggaaagggaattccctgaccccttgcgcttcccgggtgaggcgatgccttgccctgcttcggctcaagcacggtgtactgcacccactgtcctgcacccactgtccggcacttccctgtgagatgaacccggtagctcagttggaaatgcagaaatcacctgtcttctgcattgctcacgctgggagctgtagactggagctgttcctattcggccatcttggctccccagctttgaatggtgtgtctggattgttatttttaatttcatggttattacagaaaataatttagttgtgtagaggcacagatatggtaaaaaaaaaaatctgttctggctgtctaatatgctatgtatgcagctgcctaatagagtccactctggggatggacttctgtgttgtaggtagcttctgtgttgaccaaattatcttaatttagtcataaaaaattctacatcctatttggttacattattttaagtaggctatagagccttagggagatttaaaaaagatatccacaaacttaagtagtggtcaagataggtcctatatagaaggttaaaagaagtgcgattattgaagctagaatcaaatggctatactttgggagagcagagtgaacatgggtagcaaatcaaattttagtttatgagggatttttgaagggaataatgtttttggaaggaaaattaccaataagatggcaaaatgtggactagatgaccagccagcgttggctgattattctgaaatatttcaaggtgagagaagatgctgattgattctatgtaggtttgttttttatttgaccgagagcaaggtgctatttcaggtaatttttaatgcagattgctgttcctggattctgcttgtctcagtgtaactttttttactctgcccagcttctaaatcttagctttttgttctactatttacctctgtatttctaaataacatcatcatactgcagttccttggtttccaattttatagctgtctcttgacttcctagtatgagaaatgaagatttagccatctaaaacctcttctctacccttatttcacttgccctattatctcttaatgcaattatattacgttttgaaaattgagtcatcttccctatattcatggtgaatatgaaaatcttattttcagctgagccacatattttaaacttattgtgtttcttagatttcccataatgattgccatgtttttggtgtctcttcacattttt

SEQ ID NO: 14684 - DNA, 1019 bp, Homo sapiens
ggcatttagtcctataaagttccctctacacactgctttgagtgtgtcccagagattctggtatgttgtctctctgttctcgttggtttcaaagaacatcttaatttctgccttgatttcgttatgtacccagtagtcattcaggagcaggttgttcagtttccatgtagttgagtggttttcagtgagtttcttaatcctgaattctagtttgattgcactgtggtctgagagacagtttgttatcatttctgctcttttacatttactgaggagtgctttacttccaactatgtggtcaattttggaataggtgtggtgtggtgctgaaaagaatgtatattctgttgatttgggttggagagttctgtagatgtctattaggtctgcttggtgcagagctgagttcagttcctggagagccttgttaactttctgtctcgttgatctgtctaacgttgagagtggggtgttaaagtctcccatttttattgtgtgggagtctaagtctctttgtaggtctctaaggacgtgctttatgaatctgggtgctcctgtattgggtgcatatatatttaggatagttagctcttcttgttgaattgatccctttaccattatgtaatggccttctttgtctctcttgatctttgttggtttaaagtctgttttatgagagactaggatcgcaacccctgcctttttttgttttccatttgtttggtagatcttcctccatccctttattttgagcttatgtgtgtctctgcacgtgagatgggtttcctgaatacagcacactgatgggtcttgactctttatccaatttgccagtctgtgtcttttaattggagcatttagcccatttacatttaaggttaatattgttatgtgtgaatttgatcctgtcagtatgatgttagctggttattttgctcattagttgatgcagtttcttcctagcctcgatggtctttacaatttggcatgtttttgcagtggctctggagacccctttt

SEQ ID NO: 14685 - DNA, 1046 bp, Homo sapiens
tgtgttgaaatatttcctttacaacatgaacatactcaaatttccatcttaaaaccacatagtcgcttcatcaaccctgaatcttcctctgactactgctctttcttccatattcaatgaaaaacctttgaaaaaagtcttatacttgctctctctacttccttatttctgattcatccaccaaacctagtggaatttggcttttacttagaatctgattttgctgattcacaatcgacttgctaattacaaaatttggtgggtaacttgcggtccttttcttattttacccttctatcgaaccattctcttattcttcaaactgtatctttcatttgctttatgacactacttcctttttgtttttgtttttgttttttttttcttcctctgatttcttctgaatccttttggccagttcttcttcctctgctaaagttattgtgtgaagtcattccttgaccttttgttctcattcactatcactaattgagtacctgtgtgtatggtaggctcttttttaggcacttcttgtatatcgttcctgataatttataacaaccctgaacaggccacatacctttcctgagaccagtactatgggggtaggatttaacatcaaatgtttgattctaaagctatatggtaatagtctatttgtctacttcaactgctataaccaaataccacacactcagtggcttaaacaatagaagtctatttctcataattctggaggctgggaagtcctggctgatttgattgctggcgagggctctcttcctggccttctatctgtgtcctcatgtggcagagagacagcaagtttgttctctggtatctgttcttgtaagggcattaatatagtcatgaaggctccaccctcgtgaattcatgtaaacctgaatgcctcacaaagaccccatttccaaatactatcacattgagagtaggggcttcaacagaagaattttaagggtagaggtaacacaattcagtacatagcaaatcgttttcagactttttaaaggaacacagctgttttt

SEQ ID NO: 14686 - DNA, 1053 bp, Homo sapiens
ctcccagcactttgggaggccgaggtgggcggatcacctgaggtcaggagatcaagaccagcctggccaacatggtgaaaccccgtctctactaaaaatacaaaaattagccaagtgtggtgacacacacctgtaatcccagctacttgggaggctgaggcaggagaatcacttcaacccaggtgatggaggttgcagtgagctgaaatcgtgccactgcactccagcctgggcgacagagcaagactccatctcaaaaaaaaaaaaaaaaaaaaaagaagaagaaatgaggcatcaagccatgaaaagtcatggaggaatcttaaatgtatactgtcaagtgaaagaaaccatgtgatccagcaattcctcttctgggtttatacccaaaggaaatgaaattggtaccttgtagagatatctatgctcccatgttcattgcagcattattaacgatagccaagttagagaaacaacctaagtgtcagtaagtgagtatataaaaaattgtgatatgtacgtacagtgcaatattgttcagacttaaggagatcctgccattttcaacaacatgcatagacatggagaacattatgctaaatgaaatgagccagacacagaaggaaaaatactgcatgatctcacattcatgtggaatctaaaaaagtcaaatacatatgaacagagtagaacagtggttatgtgggggatgggaagatgttcatcaaagggtataaagttgcagttatgtagaatgaataagtctacagagctaatgtacagcatgatgactatatgtaatattgtttactgaaaatttgccaagagagtagatttcaggtgcttttaccacaaggaaggaagaaagggaggaggaagggcaagagggaaggaagggagggaggaaagaaaagataactgtgagagggtagatacgttaatttgcttgactctagtaatcatttctctgtgtatatcaaaacatcatgttgtacaccttaaatgtatataataaaacaaaaaaatctgaaaaggctacatactgtatgattc

SEQ ID NO: 14687 - DNA, 1090 bp, Homo sapiens
tcacaagcacttcatttgacaacatttactggtagtgtatcttttttaaggttttgaaaatatttttcatagtaatttctattgaaaattataaaattttcagaacagtagatattttggtcattttttaatcaaatttaagatcctgaaaatgataagacaaagatatacatttttttctagggtcatgggggagcattttcccccatatattttgattttcatttatgcatgtgttctgtactatttgagtgcatatagaacttcagtggcatttagatattttgtgggaccaccagattaatgagacacattgaatagaataaaccagttagtatccatgactaaaaacatgtttgaaataaaattgaatctctctgagacagaaaggcaaacttattttttccccgtagcacatccgtttgtttagggctgagtaatcctttaagaattgctgaacttcccccaagtgctgaaaacctaattctgttttaaaaatagctgtaagtaattctgtcctcatacatatattttacatgtttaacaaaaaagattcttatcttcataaactgtaatgatgtcttaggcccaaactccaattagggttggtttgttttttttaagtttgtatgcttaataacgacaacttgggaagcattttcagagtgctgcgaaaaataactcataagaatacagtatttggaagcacagagactgatttttattttttggatttcagtggagtgttaatatttcaaatacgtgagaataggaaacttcctcttcagaactacaatcacagccgtaaatacagtagagtcatagcagtagatgcaatagaatctcatcatgaaactccatgaattttgaactaatcacatcaccaaaggagctccaatactgaaaaatgaaatacattgaaaatatatctcaagatgaaatgaaaattctaagtgttactaaagcttctgactaatgttctctgtgatattcatttcctttgaagtcaactgttaatctcagcattcaaaagtagtttgtttaaatactgatttaaaaaagaaaaataattctgaagagtggtacttct

SEQ ID NO: 14688 - DNA, 1027 bp, Homo sapiens
ataatatattcaacagcttcacatacatagaattttctctattttattttcttagattgccactacatttttattgctcttgctacatataatcattgtttttccaagagatagtactaattggcacgatcactagcaatgtatgaagtccagttgtgccacatccttgaatatttttgtttactaattttgctagattaattgaaacagtctcattatttctttaattagcaccagtgattggattttcttcatgtgtatttactagttgtatttctttcatgaattgtttctcctttgcatacaaatctattgaggtcttgggaattaactttaacttttaaaaatgtctacatatgtatctcacatattgctcatattgctatcacataaaaatatctactttttggtattttaagtatatccttctggctttatatgtgcatccagttttgtttttttcaatgaacaaatacaaaatcacgttaacctacctttttctcattctgtattctaatgcctttatatgaaaattttaatattttacaattggtgattaatgccctttcctgaaatttggaaaaatgtatatagaaaactataaagaagaaaaatgacctattattttaccacccagagataatggctatcaatatattttagttcctttccatttttaatgcatccatgtttttcctcaaaattatcatgctatatacacacaaatatatgatgtttactgaatattcagtatattgttatttcaaaattatcatggtcttggaggtttgttttcaatttttattattttaaatgttttcagtaaacatctttttataaaagtctttgttcttcaggaacagaaaaccaaacaccgcatgttctcactcgtaagtgagagttgagcaatgagagcacatgaacacagggaggggaacatcacagactggggcctgttggtgggtgggggcaaggggagggggagcattaggacaaatacctaatgcatgcagggcttaaaacctag

SEQ ID NO: 14689 - DNA, 1060 bp, Homo sapiens
aggacttctagtgtatagttattgatggagttgttcttgaatgaggaattctctcgaccagcttaggacatacttgtttctttacatataattcagatcacttattctacctttgtcatttttgtcttttagtccttcaaagaaaagaatgcagaatgttaccaatacagcaattgctttaagttttctcatttattttatatctgcactctttgggtacctcactttttatggtaagtacattttaaaattatagatgacaaaataatagttacatagatggcctcacgccaatctatagactttacctatgccttttattactaagttaatttgctcagatcaccaaattacaatgcagtactgtggtggctcttgaggcctaaacaattggattatctttcttttagaaaggtagttcaggtttaagattaatgacttcttatgaaaattttcttaaacacttaagtaaaacttcaggcttagggacatgattctttctataagaaaaaatgtgcaattttaatgattctgtttttcttaaattttgaattcaatatattagtctaattcagaagtgtgggggttgggtgagtcagtcatcttaattgcaaaagaacaagttgagaaaggaaagggttttacacagaactatatctgtatacttagatgtcagacatctctgccttcagatctaattatcacaggattcagcagatgtgcattctatgatgcaccatgaccttcctccttaattatttttacaggttcttttaaatttatgcaacaaaaataaaattgtgttttatttcttttgcaaaaactgtctgctttgtatgttgactttttttcctcttctgataagaacctcaagaaaaagtaaagttctgtgtacaccatcaggaaaagcattatttccaatgtgagcatggtgccctgctagagacgctacaaagaaagttaaaacagattgtcaagcttttctgatcatcattaataaaacaaaattacttaaatatataaactttatttttggatgttgggtttgttagtttttata

SEQ ID NO: 14690 - DNA, 1027 bp, Homo sapiens
tgagaaaaagggaacaaaggctttgggtataaatgcatctgcatggatgtcttgaatctctaatgctgagttttgtaagagctggggcttcaagcctcctccctgtgtgggctgcagtgccaagattacagcagggactggataaattttttggcatgtgaccgcctgctgtgctcttagcaatgggaagtgtagtgaactattttttcatatttacaggctgtgaaacatataaaataaaatagtaagtggtatttctttcccatggcatgatttctttttctattataaattgtctgtttttttaatctgttgcatttaatgaaaatcattctttgagacttttttcatatttttattgttggtaattttaaaaattatgcaacctaaaaaaattgcatgtgaaaactttttctagcattaaagctaagtatttttatgaagcttacacagaaagggttagtatataaacagtttatgtgtataaatactttataataatagtttatgctgtatttttgaaatctaaatgatgtaggaggcaaaaatatcatggttgttgtatatgtttctctcagcaaatatctggactttgacatttcctcttcgctatatgtttatttttctgtaatacaggccagaaaagctgtaacaatgatgtttttctccaattttccattctcatggattcgccattttttgatcactctagcactcaatattatcatcgttttacttgcaatatatgttcctgacattagaaatgtatttggtgtagttggtaagttttctgtttcaaaaagttcacataataaaattgataaaattgctacccagcctcacatctgaatccagcaatatcctctcttttttttccctccactttaaaggtgccagtacatcaacatgtttgatttttatattcccaggactattttatcttaaacttagcagagaggattttctgtcatggaaaaagcttggggtaggttgtttttgtttctttctttcaagacttctattttaa

SEQ ID NO: 14691 - DNA, 1031 bp, Homo sapiens
tcatggtacagtgcagtatacttggtgagtgttgatggtttaagagtgtgccctgaacaacgaaggatttctttgaggctgaaatcctgtgggatccatggaatgggagtttcacctgtctttggcttctgctcctttccccagcatgtgtagagcttctagaacagtccccagcaagagaggatcacttggtacacctctttcttatcctcactgtctccagtctctgctgtaggcctgctagtgatgatcaggatacaggttttaacatggccaagctgttaataacctgagattgggcaccatgaacaataagcattaaaaggcaataacaacaacaacaacataacctgttaattttatgcaggcttaattttttaaagaactatttcttcctaacttgcttttactcttcttcatctactttctcatacctatgactgacaatgataaggacacccacccactatacacacctaattccatccctccaaatttgatttcgtgttctctagagctggcgtgttatgtgacctattgtggggagaggctcagctgagggactctgtgatgccaaatggacaaaggcacacttttttctccaggtcccagcctggtgaaagtcatagcacctgagaatttggagctgactctctcctttggaaattgtgccttccaaaaatatatcttacactgcctgtacctgcatgcaataggttttggttcttaccaactgcagcttcagtctgaacttgagttctaccctcatggatgcaaatcaaaacagctcagaatcaagtctgggaagcaagtcgaagtggtttgatttgcatggggagcttttgtctctgcatgaaggcagccaaattccctaggctccccagccctccggaaatatgctttacaggacccgggggcccaggcccagtcgggtgggtgtgatttgaatgttctctgctacagctgctgcaccgggccctggtcactgctgttggtttcgctccattttactgcctcagaatccccctgtg

SEQ ID NO: 14692 - DNA, 1038 bp, Homo sapiens
atagctaatcaagcatggaccctgcccttattctctttttaaaaattttcttggctattctcacatatctgttctcttaaatatactttagaatcatttgctcaagtacctcaaacccaaacacctccaaaagaattccttttggattgacatggtatcaaaatatgtaaactgacttcagtcccagatgttgtcgaaacttcattcccaagatctgaatagagcagtcagagcggattgtgattgaaagaccacctccaaggccagcctgcctctaaatcccacctgttttgttttggtgtcttgaaattccagcattagagtgcagaaaaatagttctaggaccttagaggatgaaaatgtatgcagtttgtgttggaaggaccagcataataactaatgtgcaaccatcactgcacttacaaattaaggtcacagatctagacaaagtattgtgtgaattaagtgagtcagtgagtgagtgagtatggagagggactctgttaagaacaggggagctagaggggaaatgactggatctggaactgagagcacccgagtagctgagaatgcggactctaaatcttctggggacaagaggagaggagcaaaagccccacagccacctctgtggttgtcacacttcaatctggcagctagagaaaagcccgaaccaggccaggtaaggctcccctcaaggactatgtagattgtgtgctacaggcaaaaaaggggaaaaccctccaagaggatccagcagtgatcacagctattgatttgtactcccacggcccttgcggccatgcatctcttaaaatcaaatgaaacaaccatcaacaattgtggtaagaattttccagtaggagaaatagagaaaggaaaaaaaattctgagaaaacaaaacaaaacccttcttgatgttttccacagactgctttagaaagagaaagactgatgcaatccaatcaaggacagtgatcctcggttgacccaggatatttcacagacccagaatgcagaaggcacagacgcccacaa

SEQ ID NO: 14693 - DNA, 1045 bp, Homo sapiens
agtttattccgtatttttcagtttctgaaaagtgtatttgttttctatggactcataaatattaatggaaagtttcaataatttagatggacaggataattgcattgtagtggtataactgatagggccccaacttgtttttatttgttacaaaactatacatttatggctgagaattaataaacatactaacagtaatcataaaggaaataaaacctcagccattgtaaaaaataaaaataaaaaaaaccacaacccccccatctgccaaaactagatataattgattcttgcttaattctgaaagctcatttactttttggattataattttgtgaactaactctggataattttgcctattttgaatagttttagataatgcctattttggcatctccctgaatatttctgaccatcccttcaacatttatttggtctgtttaaagaagacacattaacatttgcctaagtcacatgaattaggatgcagaatctataattatggactaatgatacacaaatacaggctttgaggagtatttattggacaactaccataattatcagtgcatcatagtgtgatggttgggtgtcagccagattggggttcagctattcattctgcctctcattagcagggataatttaacccctgcaagcctgttctctcatccacaacacagtacctgcctcacagggttacttcagaacacagtgaggacttatgtaaaccatctacacagggcatgacatatactaccgcagaaaaatgattgttgatgtcactttcattaccaccactctaccctcagcacttcaatatgaagtgatgggcccagcccttttctgaagttaactttgaaagcagtaagatatttatttacatagaattcaagagaagggatttttgagtacaacttcctcactggttttgcttttaatgtaggattctggaatgtaaatcagtaggagatttctagttactggtggaagagaagatggcttccttatcccggaatcacagggattgggggtaaattct

SEQ ID NO: 14694 - DNA, 1100 bp, Homo sapiens
cccgcccgcctgcccgccctgggctcctgggccggcctcggcgttaatgggattggggggggcagcctttttgtttctgctgctgctcccctcccctctcttcccccaacctcgccggccgggctcccccgctgtccacgtcgccatcttgtcgtggggggtgggagacgcctcgaaagtgctttcaggggccggggtctgagccctgcttgccctccccgccggccgtgggggcctcgcgccgcccacctacccgcctcaaaaacccagcctgctctgtggccccatccggaggggactttacccagcctgaaaaccccgggaagagaaatgagctgcagctcggtagccgcggtttgcacccggagcttccgctccttcccgcccccatcctctccagttccattgaaaactcggccctggggcggaccctgcacgctggtcctggctttccagtggacttggggccttgagttcccgactgagggactcgcgtggtcggatgcgatcttgtcctgtagttgtccagccgtcgcgggtgtctttgcctttgtgcattagggatttgccgcgatggccttaagatgcgaactttttagtttgcacgtgcaggttttgtttcgttttaatcgccttgaaaaacttgcctagactgagagtcagagtaatgggaatttagggaaatggcaacattttaaagagaacttcagaattggatacttgagttcatatcacctgtcacgagaacgcagatattataaatgaatatatgcctcattcattcttcaaataatgaaaatgtaggggctggttaaatttaggcagttttaatgatactgaaaaaagtatatgatgagtgaatgaaatgcggcactaaaatgttgcaaaaattttcgaactctgtctcattttcctgaaattgaagtatattaaaggaaaaccgtcaacatatatctaaagtaagtaatcactcggttagaacttaatgcaagttttataaatcaccttgaagtttgagtctaaggggtacattagagattaagaattgtgagttggaccagtggtgttaagagcggactcccccatcccccaacacacac

SEQ ID NO: 14695 - DNA, 1020 bp, Homo sapiens
attctattttgattgtccttttgtttgaggaagcagcatatggtggttaagagcataggatctagaggcagatacctctgagttaagggtcccagcccttcacttgtgagcttgagcaagttactgaatgcctctgagcctctttcctccttttgaaatgatgataagaatagcagccatctgagcagttattgtaaaggttaaatgagataatgcttgtgaagcacttagcccattgcaggagtcttgatgacactgtgtacttgaaaatagatgttacctgttaaaattcttgtttaaacttccacaactcttaaaactcttttttgctagtccttccagctgtttcctttagtttcttttctgtgtcttcatgcatcttttctatctcctgaaagtgaaaagactaacattggatccagagcttgaaaagcgtttttttcctgttacaatgggcaaaagagtacatccttgggttatattggcacctagtatcagttatttttcttgagcatctgatctgctctctactctagtggaggcctcctgcttcacaattgctcacccctgtgttttctccccaaatagaatactgagtttactctggactctagagtcaaacatacacagtattctagtcttactgttcatttaagcaagatatgtgcaagacactgcattcttagtactggcagtaagttaaaacatttttcgtcttgatgccaaagtttagacaattttataaaaattaacctttgtaaaagataatgagttgataaaatattctcagtaaagcagctacgtggtagaaaaactgtcctttgcttatgagtttctccagagttaagaccattgggttccatctgaaggcaagacttcaagcttgtcttactggtctgttttgtggctcaatttgtatgaagtctatgcactcttccacacgtgtgtatttactgaactatcgagttattttagactgagaaagtattggagttcattcctacggtccactgcagagca

SEQ ID NO: 14696 - DNA, 1050 bp, Homo sapiens
ttgtattttagagtgtcattttcttgaactttatcatcattaaagttttaaatttggaacactggcaatttgataagtatattaggattcttcttattgcaagtagcaaaatacaactcaatctagtttaagaggggaaaatgtagtcattggctaacacaatctaattttggtttaagagacaaatctagagtctcaaatgatctcagagtgtaataatccctgacttttgtcttgatattacttggcttgtatacctttgctctatttgcatgctggccttactctgccactgacaggctgtctgtatggtgtggaagaggacggctagcatccccatacctgcatccatacagtttgtaatataaaaaaaaaaaaagtaaaaaaaactccctctctcttctagtgtctatatatcagtttcctagaagaaaacgttttgccctacttggccatgtgaatggagttccctgattacatgagtcaaatatgtcttattgtagcatatttgatggtcttcttgtagaatattatcttactatacacagaactcttgaccagtaattaatgggccatgagtttttgttgcaagtcatttgaattcatattctatagttttctaccaagtgtagtcattctgcaagctgttcttgtcatgacttttgggaagttgagtatttcttctatgggttagggttttcatctcaagaaaaagatgatccttttctctactaaatatgtgttaagatcacacatttttctagatcgtttagctctactgtgtgatcttacacaaattgctttattgggatgataagaataattgccttataggattgttatgagaatgaaatgatacatcaactcatatgaaacactcagaacagctcttggcacaaagtaagggcttaattaagtagaaactatccatatattcataatattatagtattggttaagttgttttcaacattgtttagaatcgctcaagccttctttgtgataatctgacgaaggctattcaccaccagtgagtaaataatagtggca

SEQ ID NO: 14697 - DNA, 1041 bp, Homo sapiens
tcttttgctgtgcagaagctctttagtttaattagatcctatttgtcaattttggcttctgttgccatggcttttggtgttttaaacatgaagtccttgcccatgcctatgtcctgaatggtattgcctaggttttattctacggtttttatggttttaggtctaacatttaagtctttaatccatcttgaattaattttagcataaggtgtaaggaagggatccagtttcagctttctgcatatggctagccagttttcccagcaccatttattaaatagggaatcctttccccatttcttgtttttgtcaggtttgtcaaagatcagatggttgtagataagcggcattatttctgagggctctgttctgttccattggtctatatctctgttttggtaccagtaccatgctgttttggttactgcatccttgtagtatagtttgaagtcaggtagtgtgatgcctccagctttgttcttttggcttaggattgacttggcaagcattctgtgttttgagaattcttccaggggactgtgatgaaaactgacgtttgagaaccttcatcttagagtaaaaactttacatacacatttttgttgttttatttatctagcacaatacttcttttttttgaaatggagttttgctcttgttgcccaggctggagtgcaatggtgtaatctcagctcaccacaacctccatctcccaggttcagttgattctcctgcctcagcctcccgagtagctggggttacaggcacgtggcaacatgcctagctaattttgtatttttagtagagacggggtttctccatgttggtcaggctggtctcgaactcccgacctcaggtgatccgcccacctcagcctcccaaagtgctgggattacaggcgtgagccactgcacctggcacaataccttatatataatcagggctcaaagatttgttgagaggctcaacaccaattctggaccaggaaagattttatttatatcactagtcaggaataatctaaaaacaaaaagcacattc

SEQ ID NO: 14698 - DNA, 1032 bp, Homo sapiens
tatgttcttaatctgaagaacaatagacattctctataaaacaactcttgcttattcatgaactttgtacacaagaagcttaataagacgggctcaaaattatttttctaaatatatttcctatacaaaataatttcaagatataattgttacttttgtgtctaatactgtatgttaaataataaaatggtaagcatgtaaaaactacaataccacaaagattgagctattttgccagtagtatactccaactttagttctagaacagttgtagaaatgggtaaacaaactgttttaactgtactcttaactgaaatatagtaccttatgcagtagcagaacatatcagcagaagaacttcacttgacctgtacttaaaaacaaaacagatgcaatttataaaatttagagaaatatagtgaccttatttgcatgtggaaaatgtacttctttctgatctacatatcttctgttgtgcaatgtaagcagtaaaacaaatagtacaggattcatctctgtgggacctagaccccctggtctaacaaataattcttggtcagtactgtaattctgtggtataaaactgataaaattagccttcctgtgactagacaagaagccgggcagtttaaatgctgaaactcacaagaacttcagaagctttagctttaagctttaagcttacttagaaatgttataagacctccagtagtcacatatgaagaatatcatgaagatttttccattaaatctttattatagatcccttgattggtttctgtctagactcattgtgtgataaaggacataataatttttatcaccttcatctaatataggtttgtcaactctatattagttgttttcttgaaggctggttttcttccaaaattcagtcttattttcagtctacactagcttttaaatatactgtcctttagatgctttatctaacctcaaatttctaatggatttgtcttagacacttattgccactccttagatagtcattgctatctttgaagttctgga

SEQ ID NO: 14699 - DNA, 1052 bp, Homo sapiens
atgtacaaaagcaacccaatcaccttcagcacatgtcttcaggacctcctgaggctgtgtcaccagtgtgtccttaaccttggcaaaataaactttctaaattgattgagatttgttctagataccttttggtttacagtttgaaagccacttccacatctttgtagcaatgcctcaatcctggtaccaattttctgtgttagtccactcgtgtgttgctataaagaaggacctgaggcttggtaatttataaagaaaagaggtttaattggctcatggttctgcagcctgtataggaagcatggcaccagcatctgcttggcttctagtgaggcctcaggagcttccaattatggcagaaggtgaagggggagccagcacatctcatggtgagagagggagcaagagagagaaagaggacgtcccagactcttttaaacaaccagatcttgtgtgaactaactgaacaagaactcacttagcaccaaaaggatggtgctaaaccattcgtgagggatccacctccatgatccaatcacctcccaccaggccctacctccaacattgggaatcacattttatcatgagatttggaggggacaaacatccaaaccatattgtgtatctccctggagggacaagctgccagcatttctacccgctctcatgttctgttgcaaaggctaaattccagatgagtgtggcctggagaatggaaagactggggactcctttcctcctttcagactgcattcacagagcagtggctctatcccaggtgtagcagactgagagtagtggagccccagttgcccttattgcagctcacatatagggtgcgagttccaagcaaggacaggcaagctgagaagaatgaatggaagctacttcccccttgcagagccttgcttataaagcaggagagtcagccaggcgtggtggctcacgcctgtaatctcagcactttgggaggccgaggtgggcggatcacttgaagtcaggagttcaagaccagcctggccaacatggtgaaaccccgtctctactaaaaa

SEQ ID NO: 14700 - DNA, 1050 bp, Homo sapiens
acatattaagcgaactgttttgagaacaaattagatttggcatctgcatttgctcatgtctcaaacatcagaggaggttactgaaagacgtacaaaattgttaaaaattctttggtgaaaagttgaaacttctaatagcatttgtttttttttaatctagtggtaattgagacactaggttgaagagcactagttctggttctgccattagctggcaaattatgtaatttctgtcttatctgaatttgtaggcatgtggcatggcatgtgagaggatacttcacaagtctaacagtctttggaacgtggatatttaacagatgtacccttacagctggttttgttttatctgtgtttacttatagacaatttttagtgctggcttatatttcaatacttttaacaatactgtttaaaagatactcatttaaaaagacacgtattatcacatagctgtcatataggatgaagaaaaaaattcaccgagctgaagttacagaagaatttaaggacccaagtgatcgtgtgatgaaacttatcacttctgatgtattagaggtaaattttcttttatgctcttgaaaatttttaaaaattgttttattgccaactacatattgaggttataccttcatctactggatactgatttttctaatgattttaaccactctaggatgctatttctctagagtatcagacataaaatagcctaaatatatcaaggcttacaaatcttgaaatagcgtgagaaaaaaagatgtagaagactggacctggactgaagatgtgtggattctgttactaaaactattgtttgtatttgactttagttaggtcataaaacaagagtttaaagtgactttacttacttttttaaaaaaacaatatacatgaccaggcatggtggctcacacctgtaatctcagcactttgggaggccgaggtgggtggatcacgaagtcaggagtttgagactagcctggccaatatggtgaaatcccgtctctactaaaaatacaaaagttagctgggcatggtggcgcacgt

SEQ ID NO: 14701 - DNA, 1004 bp, Homo sapiens
taagcctaaatgtctccctcattactattaggattataatattttatttcattcggttgttctgcaaattgaaatgaggtgatgcctaaatagtgctgagtgtggtatattacacacagtatatacccttaataaatgttaattccctttttctccagccctactcagtcttttcttgtattacaattgaaagacagggatcagatcttagatttactcaaatgtttgtttagatgcccccatgttctttttttttttttttttcttgtccctgacacaggatcttcctctgtcacccaggctggaatgtagtggcacgatcttggcttgcagcaacctctgcctcctagtttcaagtgattcttgtgtctcaacccactgagtagctgggattacagttgtgcaccaccatgcccaactaattttttctatttttaatagaggtgaggtttcactgtgttgaccaggttggtcttgaactcctggcctcaagcgatctgcctgcattggcctcctaaagtggtgagtttacaggtgtgagccactgtgcccggtcgcccccacgttgcaataacatcagcctgtcaggttgtttgtaattcaggtagcaaattgatttttgggagcactctgggtctgttctgtaaagtaactttatttttgagcaaggatccttaatctctggcctggagatggtccatgtccctctcccccaccacattgtatgaaaaattgatgtcatacatatggatcctttttttttgagatagattctctcactctgtagcccaagttggagtgcagtggcgcaattttggctcactgcaacctgcaacctctgcctccagggctcaagtgatactcatgcctcagcctctcgagtagctgggactacaggtacgcaccaccacactcggctaattttttgtattttagtagagatggggtttcaccatgttgcccagggtggtctcaaactcctgagctcaggcgatccgcccgcc

SEQ ID NO: 14702 - DNA, 1030 bp, Homo sapiens
gatttctttgtcttggagctagttatttagagagcaatctttcactcccttgtctaggggaggagggtgggaaataagcccagctgccaatgttttgggagcctacagagagaatcagccacgaggctcaccattccttatgcaggtttcactcagcccctctattttcaataagaggcctcatctccttcctcacctacaccagtttcctttgagcccacatcctttctcgtttagcctcttcagagagcaggccttctgttttgtacaggagatcagttgcctagctctgaggttgaggaatgagacactattctctatagattttcaatgcacctgcctgttttttcagtcccacctcagccttccaaagtgctaggattacagatgtgagccactgtgcccagccctttgcccgttttttaacggggtggttttttgtttgttgaattaattttcttatagattatgaatattagacctttatcgaatgcaaagtttgtgactattttctctcattctgtagggttgtctgtttactctgttgtttcttttgttgtacagaagctctgtagtttaattaggtctcacttttcaatttttgttgtcaactttgtcaaccatcaggtggtcgtaggtgtgtggctttatttctgagttctctgtcctgttccattggtctatgtgtctgtttttgtaccagtaccattctgttttggttactgtagtgtgtctgtggtttctgcatccatggattgaaccaattgtggattgaaaatatttgaaaaaaaaaatgcatctgtaccaaatatgtgtggacttttttccttgccattattccttgaataatatgacaatcatttacatagtattaggtattataagtaatctagagatgattgaaagtatatgggaggaagtgcataggttatatgcaaatactacacaattttatatcaggaatttgagcttctctggattttggtatacgaaggaagtcctggaactaatcctccatggatactgagag

SEQ ID NO: 14703 - DNA, 1036 bp, Homo sapiens
gcatttgtcttaggtgagcctcagagggatcactttgaatagaatgggaggctggtttgccctaagcagttccagcttgacttttccctttagcttagtgattttggggtccgaagatttattttcctctcacactgctaaagaaattaaattcccaggcttctctggaaattttagcaaacatttaagaaaggagtgatctagattctttcagaaaatgcaagagggaacactttgcagcttactgacattgcaagaaagaactaaagaccaatatcccttatcttatccaaaaaaaaattcaaaatggattatggacctaaatttgaaacctaaattataaaacttgtgaaaaaatatgtaggagaaaaatgtttgtgttcttgggttgggcaagatttttaaatacatgacacaataacacgagcaaatcatgaaacaaaaaaaaactgataaattggcattctcaaagttacaatttttgtcttcaaaagacactgttaagaagatgagaagataagccacagactgggagaaaatttttgcaaactactacgctgataaaggtcttgtatccaaaatagtaatatttaaagaagtctaactcaataaatatacagcccacccaatgaagaaatggctaaaacatttcaccaaagaaaagatatggatggcaaataatcatatgaaaagatgctctgcatctttagttactagagaaatgtaaattaaaaccacagtgacactccactaaaccctgaatggcaacaacaaaaagaccccacaaagcaaaacaaaaattgtgatgaaaaaagctgttgaggatttggaacaagtggaacctgcatacttttctggtgtgaatccagaatgatgtggttactttagaaaacctgtagtttttaaaaggtaaacgtgtacttaccatccgacccagaaatactattccttggtatttactcaagagaaatgaacacttaatgttcacacagaaatgtgtatgcaaaagtttatgtggctttattcataattgcaa

SEQ ID NO: 14704 - DNA, 1010 bp, Homo sapiens
ccccaaaaaggatatgtttgctgagccctttaattgttgaaaatgaaccttgaaaaaaagaaaaattaatgataggactaggaatgtacaccatccaggaggtagaattaagaaagtttaaatgcaatatgtgaaaactatacgcaggctgggcgcagtggctcacgcctgtaatcataacacttagggaggccgaggctgatggatcacttgagctcaggagtttgagaccagcccgagcaacatagtgaaaccccatctctacaaaaaaaatacaaaaattagcagggcatggtggcttatgcctttactcccagctacttgggggatgaggcaggaggattgcttgagcccaggaggcggaggttgcagtgagcccagatctctccactgcactccagtctgggcgacagagtcagatcctgtctcaaaacaaaaaagaagaaaattataggcaaagaaatgtagatttcttttatttaatatttaaaagagagttgttgtgaagttgatatgaatttatgtgaaataagactaccaaggctgggcgcttggctcatgcctgtaatcccagcactttgggaggccaaggtgggaggatcacctgtggtcaggggttcgagactagcctggccaacatggcgaaaccttgtctctactaaaaatacaaaaattaactgggtgtggtagcgcacctgtaatgccagctactcaggaggctgaggcagaagaatcgcttgaaactgggcagtggaggttgcagtgaactgagattgcaccactgcactccagcctgggcaacagagcaaaactccatctcaaaaaaaaaaaaaaaaaaaaaagactaccagactgatgtggtatttttaggatttttttttcttttttttttttttttgagatggcccgacctcttcttttttatcatatgatctctaactgatgtatgtgacacaataatacaaaactatttgagctataaaagaaatatgaaaggcttctgttttctt

SEQ ID NO: 14705 - DNA, 1032 bp, Homo sapiens
attaagaaataatattaaatacaatagcctattctctgagtcttcactgtatgttcccctcctttttttctttttaaagacaaaatgcttgctttcacatgtacaaaggatctgtgtcataatgccccctttcctactttcatcaaataaaagattatgtctggagtagtgtaaattcacttattttatttttttgagacaaggtctcgttctatcacccaggctggagtacagtggtgcgatcatggctcactgtagcctctacctcctgggcccaagtgattctcccaccccggcctcccaagtaactgactacaggtgcacactaccatgcctggccaactgtgaatttttttgtagagaagaggtctcaccatgttgcctaggctggtctccaactcctggcctcaagtgatcctcccacctcagcctcccaaagtgctggattacaggcatgagtctgcccttggcctcgtgtttacatttgagaagtttttgacttatgtatagacctgtggaactgtctccctgtagctccttgctataccctgaatccctcttcctcatccagccaatgatagctttctgtctctgtggattagtttgcgttttttagaatgttatgtaaatggaatcatgtagtaagttctcttctttgcctggcttttgcttagcataattattttgagactcatccacattgtatcaatagctgatttctttttattgttaagtaatactccattgtactgatagacgccagttcatgtatcttttcacccattgatagacatttaggttgtttctggttttgggctattaaaaataaagctgccatgaacattatacacagtctttgtatgcatatctttcatttcccctgggtagatgtctaggagtagaatgactagatcctatggtaggcatatgtttaatttttcaaagaactactatacttttccaaagtggttatataatataaccaaaatagtctatgagggttccagttgccccagatccttgccaacagtt

SEQ ID NO: 14706 - DNA, 1056 bp, Homo sapiens
tcgaactcccaacctcagatgatccgcctgcctcagcctcccaaagtgctgggattacaggcatgagccaccgtgcctggcgagatttgaattttttaaaaaaattccactagaacaagtatttccttaacattctagtatgaaaaccattatctaaagtggttttaaaagagatgtcattttttttttttttaatctttcagagacagggtctcactgtgagaaccccagctaacttttatgttttttgtagagatggggtttcgccatgttgcccaggctggtctcaaactcctgagcttaagctgcctgcctgcctcagcctcccaaagtgttaggattacaggtgtgagccactgcacctggccaacttaaattatatctatatatagatattgtttaaaaattacataatatttaggacctatgaaaaggtataaatgattatacagtaagtatatacctgctttagcatcctagttcagaaataaaatattgctaatttggttgtgacctcttcctcctccccagaggaagctgctgtactgaatttggtatttatcatgcttatgtgttgcttaacaattttgttgcatatgaatgttaaggttgattttcaaagtatttgacagctggtagtgtgtgggcccggccgtgtcaagttgtaccagcctaatattagtcctatcatggatccctgggagatactttaagattctatccagcttggtgcggtggctcatgcccgtaatccaagcactttgggaggctgaggcggatggatcttgaggtcaggagttcgagaccatcttggctaacatggtgaaaccctgtctctactaaaaataaaaaaaattagccaggcatggtggcacacgcctgtaatccgagccacttgggaggctgaggcaggagaatcacttgaacctgggaggtggaggttgcagtgagccaagatggtttgtcactgcactccacaccctggtgacaaagcgagacaccatctcaaaaaaaaaaaagacaagaaaaatccaacaagagtctaattggctgggc

SEQ ID NO: 14707 - DNA, 1051 bp, Homo sapiens
aatcagttttgattgttggtctctaaggatgaaaggatgagggatacattaatttgctgggcaattgattttcccttgggataagagagaaacaagaccaaaattgtcagtcatcaaaaatggcacagccactttcgttaataaattatgtttgggtttggaaaacttccagccctataaatagattatgggaagccttcagggagagacaaaaaggtgcaccatgactgctttcatataaaaaaaatagcaggcccattgaacttggagaaaaaaatgagaggcctataacctagaactttggtcaaaataggaactatgattcatagctaaaactttactttctaagtttgttaccactcacttccaagtttaggaggaataggtcaaaagtttggcaggaggatttttgggaacaatttgtaccaacaggagatttctgagcagttccatttttcctgctgagaggtggttaatttggttacttacattctcatattttgccgtagtagagattaagaaaaccactggagtggaaatgagaaccatctctacattttaatactgtgattgaaatagaattatggaatgcttctgaagatctacactgttgtaaagtgacaccattctgattttctgggcttctcataggaatgttgaaagtcagcaagtggagcttgatatttaacagtggagttggggatcaaagcggcgttatctttcatgagtagatgtgttccctatgtgtgtgttctttgctttcttaatctctgtgtctgtgtcttttttcctgtgtttccctgacagttctactttatgactgtctataaggtgtggcgttctgtattttatagccaaggtcatttgcattagctacacttttttttttttaagttaaaacttttttttgagacagggtctcattctgttgcccaggctggagtgcagtagtatcatcatggctcattgcagccttgacctcctgggctcaagtgatcctcccaccttagcctcccttgagtagctgggactacaggtgtgtgccaccaca

SEQ ID NO: 14708 - DNA, 1028 bp, Homo sapiens
catatatttttatatatacttatatatttatggaaaattttatgtttatataaatatataattataattatatatatatttctaaagaattagaaaaaaaacccaaattaatttctcccttagttaattaatctgccacatcaggaatctgttgcttcatttcatgcggatgtcagtggataagatgttgcttattcaacaccactcgaagaaacacaagctttgcatagccttagtactatggcattgcagaaaccgttagaacaatggcactattactgatgtttgttattggaacctgtaacatatttctgattgaccagccagatagactattgaattatggagactgttagccttatgggaattttattactctttagaatagtgtttgaaaggaagagtttaaaatccaagcatttcactgaggagagataataaggcctacaaccctgctgcagtttccagtttattggtcgtgctttgtgtgaattatttgagccttctagcaagctctgtgatgcaggtggagccgtagatccttgtgtaatagcagaggaagtggaaagtggaagctcagccgcctgcttgtggtcatggtatgggaacacggaaagggggatgagaagcagtcagctctttccatcctgacaaatgtcaacttgaataatgtcatcattaggatgaattggtgagcagctaaaattccatttatggttttaattagagatgagtatagtaattgatattaataatggtgttaagtcgccaaagaaaacttaaaacatattccatatgttgtatttatcaggtcaaggaatttctatcactcttgattaaaaacaagtagtaatgttactgaatgagtaacatgtggaggccgggtgagcggtggctcacaccagtaatcccagcactttgagaggccaaggtgaaaggatcacttcagtccaggagttcgagaccagcatggataacatagggagaactcatctctacacaaagtaaaaaaaaaaaaaaaattagct

SEQ ID NO: 14709 - DNA, 1032 bp, Homo sapiens
caccaggctaattatttctattttttgtagagagagggtctccctatgttgcctgggctggtgtgaaacccctgggctcaagtgatcctcccaccttggcctcctaaaatgctgggattacggatgtgagccactgtgcccggcccgtactgcagtatttagtcacagttttacatgacatgagagtcttcagaatgaaggcccaaagactcagggtgaagtatccatttttatgctgtggtttgatgcatggacaaccgtgtattaatatgatcagacaaaaaggatagaatctagaagagatagactgagggggaaattcattcaaattcttcttggcctctctgtgtagtattccttccatccaggtatggggcagggcccctttctggagtggttgggtcttgtctttctttctttctttttttttttttttttttttgagatagggtctcgctctgtcacctcggctgtatggagtccagtggtgtgatcttggcttactgcagcttcgtcctgctgtgctctggggtgatcctcccacctcaggctcccaagtagctgggactacaggcgtgggccaccatgcctggctaatttttatatttttagtagagacagggtttcaccatgttggccaggctgatctcgaactcctgagctcaagtgatccacctgcctcagcctcccaaagtgctgggattacaggtgtgagctactgcgctcggctattaaggggttttaggactcacaatcaaacaaagtaggccagagaatgtctttatggccagttcttacacagaaaagcaaggggaagtttgttgtaatgtttttaggttttatttctggctttagggaaatggggttctgatttctatgacccaccttgatgaagagggattccagtttccatggcttgcctctggagagaatgaggggagggagacaggagggcaggtggtcagagagaaactttgcttctgaggccttcacttgggagtacagttttttgagccccaacagtagattaga

SEQ ID NO: 14710 - DNA, 1049 bp, Homo sapiens
aaaagttattattgtcaaagaactacatcttatgtcattaaaatatgtttaattagcactcttcaggaaagaaagtggtgtaacttttttatcttttatttttgaagacagggtcttgctttgttgcccaggctggaatgcagtggcatgatcatagctcactgtagccccaaactcctgggtttaggcaattcgcttgcctcagcctcctgagtagctagaactacaggcatgcaccattatgcccagctaactttaaaattttttgtagagatgaggtcccgctttgttgcccagactggtcacaaactcctagcctcaagcaatcctcctgccctggcctcctaaagagctgggattacaggtgtaactttttgaaaaggaaaattattttgttatgtacatgctgacattttctcagtggtacttttgaatgttgtaggctggagagaaacatgaaaaagaaaatgaagaattcacagggcaactaaaagtggctaaagatgttgaaaaactcattggacaagtggaaatctgggaggcagaagccaaatctgttttggatcaagatgatgtggacacctcaatggaagaatctttgaaggtatgtgtgtaaaagtattaagagggtactttcatggttgtgcatttatgttttaagttaaataagaagttttaaagtaagtagtaataagcctacagttttaattttctttgttgggagttttaaaaatgaatggattttatccctggatcatttgctgttattttgcttgaaagcagaggatagattaggagaccactgataatacctatgaatgttaagctcttggacttattttcttagctataacatgggggttaaaatattttcttgcaccagaggacaatgaggagacgagtgagttcagtctcattatagctcagtgcagagtacacgtaagagataatataatcaggctgggcgcggtggctcacacctgcaatcccagcactttgggcggttgaagtgggtggatcacaaggtcaagagatagagaccatcctgg

SEQ ID NO: 14711 - DNA, 1031 bp, Homo sapiens
aggagaatgcaactaaccaaagctacagtgagcataacctaatcttcttctgagtatacaaatagttctttcaagcagagacccttttgaaccattatgaatactgattatctgtgtatattgttattgagggtagaagaggttgagcttgatctgtacagatgtttccatttcattgagatgaacaagttcatttatcatttgccttttcttctgctgcattataatgtatttcattttctgtgggaattgaattttctaaattcctgaagtctagataatttggtatttactgtgtgttacagtccagactgtcaatcagatcatgtggaggaaggaatgagatgaggtggatttgtttttagaggtctgctcctgcatggtaggcttctgtctacttttgactatgggtatggagtctcaggcagaaatagcattttggggctgggagtcttcctttaccatgctgccataccagttagaaggtgagactctcctctgtcctacggaaagacttttctctgagctgagacatctcaaagaaattgtattatctcctggtttgaggtataaagaatcaatgatacatttttgaacataagcatttatcttttccagataaaaagtatgtttaagatatttcgtttactattttgcatattcccttaggcaatggaacccactatgaagtttagcctggcatcagtgttaaggcctctgcaagaagaaagcattatggaaaaggattacagtgcatctataaatagtttactagagaggtaaactctttttaaaaacaactggaaaatccaccagaagtctttcatcgatgcaaacatgttagactttttaaaagttttattttcatttagtcgtcattttgcatatgatccagtaacttagaaattctatggtattttctcacacgcagttgacagtaattttaaaatatttctttgtgttattttatttttcttatttttttgtttgttttttgtttatctttgtgttattttatttttaatatttta

SEQ ID NO: 14712 - DNA, 1028 bp, Homo sapiens
gttacacccatttgatctacacgcaatgcagaatattatactgaaatacaaaacacaatttgaaggaatgaaccacagggtgcagaggagtgaagatactctcaaagctctggaagactttttggcgtctctcagaacagctaaactctctgctgagcccgttacagacctttcagcctcagatacacaggtggcacaagaaaatacgttgacagtaaaaaataaagagggagaaattcatctgatgaaagacaaggccaaacatttggataaatgtttgaagatgctcgatatgagctttaaagatgctgaacggggtgatgacacctcctgtgaaaacctgcttgatgctttttcaataaagttatctgagacacatggctatggggtacaggaggaattcactgaggaaaacaaattactagaggcttgtattttcaaaaataatgaactccttaaaaatattcaagatgtgcagagtcaaatcagtaaaattggtcttaaggatcctactgttccagctgtgaaacatcggtaagtattgtccatccatttccatccaaggtgactgacatctttctgtattttcacttctgttaggtgaaagaaattcttcctatgtctttctgcttctattccatcccactctattcagtgttcagcattcttttctgtagacttttcaagcaaacttcctttttgttggtattgtacctgtacaaaacgttgcataatttttttcctctttaaagtgtatcttatggatgaaggagtggtgaagtcagatgtacataaagtactgtacatgagttacttccgattcccttgtccttctgtgtgtttactgtggagttctcctcaggacagatgactggcagactccacgctgtgatattaatgaaaccagtggtggaagatgcatatgccacatcttgtccctgcttcttccttagttatttggtcccctcctcctcccagcaggattagggtaggaactgagtggaagggcaggagactgaatttaagag

SEQ ID NO: 14713 - DNA, 1085 bp, Homo sapiens
tgccatgcactcagtggcagcactgctgagctaagggaggatctcgaccaagccaagacccagatcgggatgactgaatccctcttaaaagccctgtctccttctgacagcttggagatcttcactaaactagaggtgctaccgagctgcttgtcttctgtggttcagatttattttcacactatttgcagttgtcttgagctcttagagttaataaaaatagaaaaaaaaagtcgaagaagaaaactcagaaaaaccgcttttgtatatttagcattttcatctttgaattgctttgtgcatgataattatttgatattaacttgcattgtatcatacatttactagcaaagagaaagtgaatccactcaacagagagtcattgagatttttacaaaacaattgagatctaatatgctttgtgtaatttgagcctgttttaagatttaatggttgttgtttgtttatgcatttaggagatacaacagcagattctacagcaaaaacacagtatgatattacttgagaatcaaataggttgtctgactcctgaactctctgaattgaaaaagcaatatgaaagtgtcagtgatttatttaataccaaaaaaagtgttttgcaagatcacttttctaagttattgaatggtgagtgcaacatttctcttattttgtttctgggactcttgaagtatgaatgtagtactgtgaacacaaaagctaatctaagcctgacttagagatggtttgcacagactacattcaaggaaataataatcagataaatcttttgggagcaaagactgatttatgcttgacataaataacacctagttcttgcaagctccaaacctttatttctttcttgaaggtaagtcactaaggtcctagtgtttgacctgctcattgtggttggtgagtctggggaaatactggtgcacaagcggtccaggcagtgtctttgagtgtcctgtatgcttggacgtttggtatagaaaatacactacaattatttgatgaattgtagtaaaaatactggaggcatagaactgtatctaaataaatagggaggccgggcgcggtag

SEQ ID NO: 14714 - DNA, 1030 bp, Homo sapiens
tctatataggttaagtgaagcagcagattaggatatggtaaaaagtgaagactgtctaatctcttaggattttatgtgcccataaagagaaacgataaagaggaaaaacagggaaactcatacattttctaatttattattttttttctaaaaaatcataatacaacattacagcttatctagtatggaatgatctttcttgccccatccttccgaaatagcagcctacatgacataattgctttttaaaaactgaaaacctttggtctgtaattacttctttgatttccttatcattgacgtaattgttagcatttctgaattgattttgttcttttcagaagtttctgagcatttctaatttgatgtttaagaaggcatttgtagataaatcttggaaggtacaggcaaaatgtgcaaagctctagctgtgggtgagtgacccggaacaaagcctggagtcagaatttgaatgagaaggaaactacttactggagagttttcaatcctggggtaaattatgtctatttctggtgttgtttatcctgttaactcagtagaaaaaaaaaagttataacagagcacatagttgggccatgtgtcaactacagtgtcctacttgccctttctggccagtatgcaaatcttgcatcttactgtagaggtattttcacaatccaaaatttatgccttaatgggataaccaacttacatggtacattttttttttttttttttttgccatctataaacaacgtgcatttgagaacatgctccaaagttgtaaaatctcaggctgaaaaagaccttagaaattgtctaacgtaacccttttatttcaggtgagggaattgaagtccagcagagctgggactagaacttaggcatcctttatttattttttatgaattttagagacagggtctggctctgtcactcaggctggagtgtagtcatagtgcagtcatagctcactgcagccttgagttcctaaccctaagccatcctcctgccttagcctcctgagtag

SEQ ID NO: 14715 - DNA, 1109 bp, Homo sapiens
gaagcagaaaatcagattaagaagtgtgacataaggaacaagatgaaagagactatcttatgggccaagaatttgttgggtgaacttaatccctccattccccttctcccagatgacattctttcacagatcagaaagtgcaaagtgacacatgatggcattctagctaggcagcagtctgtggaatcgttggctgaagaggtcaaagataaggttcctagccttacaacctatgagggcagtgatttaaataataccctagaggacttacggaatcaataccaaatgctggttttaaaatcaactcaaagatcacagcaattagaatttaagttggaagaaagaagcaatttttttgctataataaggaagtttcaacttatggttcaagaaagtgaaacactgataattcccagggtggagacagctgccacggaagctgaactaaaacatcaccatgttactttggaggcatctcagaaggaattgcaagaaattgacagtggaatctcaacacatcttcaggagctaacaaacatctatgaggagctgaatgtgtttgaaagattatttctggaagatcagttgaaaaatcttaagattaggaccaacagaatacaaagattcattcagaatacatgtaatgaagtggaacacaagataaagttttgcagacaattccatgaaaaaacatcagcgcttcaggaggaggctgacagtatacagcgcaatgaactattacttaatcaagaagtaaataaaggtgttaaagaggagatctataatcttaaagacagactcaccgctattaagtgttgcatcttacaggtattgaaacttaaaaaagtgtttgactatattggactaaactgggatttttcacaacttgaccaattacaaacccaagtatttgaaaaagaaaaggaacttgaagaaaaaattaagcagttggacacatttgaggaagaacatggcaaatatcaggcattattaagtaaaatgagagctattgatttgcaaattaagaaaatgactgaagtagtactaaaagctcctgatagctctccggaaagcagacggctcaatgcccaaattttaagtcagagaat

SEQ ID NO: 14716 - DNA, 1034 bp, Homo sapiens
atagatgttaccctttactacaggaggaatttgtccacttctgattattcagggacacctttactggctccaagttccatacctcttggtgactgtcttcctgccttttagtgatttctgtctcattggcacagcacatcactaatgagaaggaaagtggggactttgcagaaaccaggcagccaatgtcatcagccttctatcagcctcaacaaaccttttgtttcagaggttaagtgtattgaccaaatgataattgcataatttttagtaaaattctgagtcattcttgacccgtattacaaccaaggataaatatttagtatggaaaaatgtgaaaatgtgaaatcaagctaggcatgacctcagagtaaaccaccaccatgccattctaggggcatgcttttcatttattcatgtgcagttaggtactgtactttaggtatgcagttttacatttcataagcagtgggggagatatgcaggtataagcagtgggggagatatgcaggtatttgtagaattgactgaaatattaaggagaaaatgtaaaggtttgctattttggcatgaaatgtagcaatagccagaaaatcaacttgcattttaactgcagttttttttactgattactgattacttcactgattacttagatcagtgttgtgttgatgcagaagtgaagcaatgtgattcaccaactgaaaagttaacttggatactaaaaggttggtgaaattatatcaagaatgtggacttgtagattccaaagtgtagtgaaagcaggaattgcttttgattctgtttactagttgtgtgaccatacagtgcctgctcatggtaagagcccaataaaggctagctattattaatttacagttatgctttagagaagacatatttatttaataagaaatacttatagtaatactttttacacccccccccccccgccaaagtgtacaattataaaacatccatttaaataagttttgcttttagaatttggggctatcatatagagaaggtatttt

SEQ ID NO: 14717 - DNA, 1036 bp, Homo sapiens
atgttcaccaagaaagtggctcagaagacagcatgctaaggcatctttttctatttaaattaatatcagcaggctggacatgttggctcatgcctgtaatcccagcactttgggaggctgaggcaggtggatcacctgaggtcacgagttcaagaatagcctagctaacatggcaaagccccgtcgctactaaaaatacaaaaattagccgggcatggtggcaggcacctgttatcccagctactcgggaggctgaggtaggagaatctcttgaacatgggagacagaggtttcagtgagaggagatcatgccactgcactccagcctgggcgacagagcaagactccatctcgaaaataaaaaaataaattaattaacatcagcagggtctaaaactgtcagtaatagggttttcctttgtcaaataggtttccacaaatatgggtattctacccagcgtgactatgtataactttagatacccaacaactgaagaactgaaaacctataccacccaacttgaagacctgcgccaagaagcaagtaaccttcagacacaggtagaagctgcacacaatgtgttttcctcattgtaataacataaacaaaggagatatcatcattgtgacttggtcataattgtcgtcactgaacaagtcatggaacacataatggaatgggtcctaggattgcaaattgaattgatcttgcttgccaactctaatatattttgtagtggttccctagggactgtgtgcaaaggattctgagtccaggatcagcaggaaagaggatcatgattgatgagtgccgtctgcagtggtgatctgggattggaagggtgaagaggagagtagggagggagtataggcatggttttcaaccctgagcagacttaatactgaggtaattaatgctaggttatgtgaggtgtctatcagagaagatagtaggagacagggcccaagttggagtgatgactagctatggcatgctcctaaactacttataactgttcaagaattcagggtaact

SEQ ID NO: 14718 - DNA, 1050 bp, Homo sapiens
tcctgtttttaagacactgtacctcctctttgtaatcaaccccttcaagcttctcttttgtgacttcttttccttctcccagctatacttgatttcattaaccgctttctcctacattagaatgtggagggtgggaaacagtggtaaaggagacagtgtaatttatctgggaccacactttcacctggatcgccctgctaagggatccttcatctcatgatttaccttttagttccatgcagtactcaaataactacctaacgttgagcttcttaaactcatttttctccaagtttaacatcgtaagtttatttatttgttctgctacctagttcacaaagcgtttgaagcaacttattacaaaagaagcataacataaatcataaactataatggaaactaggcaaaatataggtctaggaaggcaaaggtatcttaattttctttttcttttttcctcttgattcaggaaaatatgacagaagaagcatatatcaatttggataaaaaattgtttgaactattcctgaccctcagtcagtgcctcagcagtgtggaggagatgctggagatgcccagactttacagggaggatggttctggccagcaggtgcactacgaggtagggcacttctcacgagcccatgtgttggccattacagcagccccgtgagttaagcccacgtggaagcctcttgaggtcagagctcattcattgtcttccttcctctccactccagacgctggctcttgagttgaagaaactttatttagcgctaagtgacaagaagggtgatcttttgaaagccatgacttggcctggcgagaacaccaacttgctccttgaatgttttgacaaccttcaagtctgcctggagcacactcaggctgcagctgtctgtagaagcaagtccctgaaagctggcctcgattacaaccgcagttaccaggtatgattccgagcacacagcctattttggcactgttttaagttacagcatgaacccctaatgcctattcctattcctggtgacatttgttaataagaat

SEQ ID NO: 14719 - DNA, 1045 bp, Homo sapiens
gatgttttgaacaacacatagaatttggaatatacaggagaacctataaggtgaataaagaattgggaggtgataaaagtaagatacttttatcttattatttaaatttattatttaaattaaatttattatttaaattattatttaaatttaataatttaaattattaagtttggcatcttctttacctcattgtttactggaaaccacaagtgaacctgagtcaatcaacagaggcactgagctaaatgctatgagaattacaggcaggaagtaagttgagtcagttacattagtgggagtaggtatctgagcatctgtaaaaccaagtggtttgagagctcagatcccatcttcctgggattaggaagagccttacagaggggctgcgttcccagatggtcctgaatgagggattgcggttactggtggcagagagagagacacatacattgagagcaaacaggtacagaatagagcagcatcgaagccgttcaggaagtgatgagaagccccactggccccaagcataggagatgagctagaaagatgggctggggctaaatcttagaagactttaaatctctgctaaatacttggccttctgaaaaaatatctgagtcatgcctggttccttagcagtggagggtttgctgaagacaaatattagggggatttggctggcaacatagactggcccaaattcaacttctctccacagccagttgggggaaaaaaaacaaacctacagaaatgcatgatggaaacctaagtaaggattaagagcacaagttttgaaccattcttgactttcccacttattcactgtggaaacttgagtatgtgatttaacctttctaggcctcagttgctaaatctgtaaaatgggtctaattggcttacatcagaggccgctggtgctgtctgctgtgaggatatgtgtcatgcctttggtatggggccagcacatatgagccagcatttatggagtggttgttttcattacttttccatgagaagactcttaggtcgtgtgtttattgag

SEQ ID NO: 14720 - DNA, 1043 bp, Homo sapiens
aaagtagataccattgtcccattttacataccaagaaggaaactgaggactgaagctaagcagcttacccacagttacatagccagcatgtgacgtaaccaggatttcaacttaggcagtgtcacttccctgacagcccagaccctctcatttgaaacactgaaatgagcagtacgtgctgagtgctaatcccttcagcactaaggaatttgggagggaatcatttttcttattttaaagcaagggccaggctgagacagacagctagaatctaagaagctcttagctgagtttattgttcaggtgaatctgtgggttgaggcagcaaacttggacctgtcataatcagccttacatagaatcagccttacatagaatccctgatgctgacttcaccctgggccttgtacaaaggaagggaagggttggaagcacaggctgcaaactttacatttgaacagtggcgacaagaacctgctctgcgggatgccctgatggcttcatttgcccacaggatccaggacaccatgtagcctcttccatccttcccacagtattctgctttggccctgtgggcagggaacagcagctcttgttaaaaataagatcggccaggcatagcggctcatgcctgtaatcccagcactttgggaggctgaagccagtggatcacctgcagtcgggagtttgagaccagcctggcttacatggcgaaaccccatctctaccaaaaatacaaaaactacctgggcgtggtggtgcgcacctgtagtcccagctactcaggaggctgaggcaggagaatgacttgaacctgggaggtggaggttgcaatgagccttgatcacaccactgctctccaacctgggtgacagagcgaactccgtctcaaaaaaaaaaaagattggaaggtgatcctacataggtacccggccttgttactgcaagatcttaactataaaactaacttcaaggttaagaatggttttcagaagtccaaggcctcaataaatcagttttaattcactggaggaaaaaatggg

SEQ ID NO: 14721 - DNA, 1034 bp, Homo sapiens
tgaggtacaccaatgggccaccccccacatagagggcatagctggccacagtgctacaccacctgcctgattgccaagggtgcccagcacgtggccccagaccaatctgagtgacttagtgttggcaaggtcccgggacctgtgcagacttcttctgggcttacccagcacgggctccctggagcccagggcagctttcagattgtgttcctccccaggagcagggaacctgtgtggcaggtgccccgggtattttggcagaactagttgattagtttagggatctctggaaatgtcagtttcctgaagagccaagcactttgtgaattctggtttgtttgtaaaacagcattattataatgtaggtatggtcaatgagcagtggtgtccatcacatatattatagaagcaagcgaggacattccaccctagaaatggttcagaaactcataggcacccttagctgatggaaacaatcaatcatatttaatacgcttagaatcagttttactccaatcagctggcaattttgagctgccggttatacaccaaaatgttctgttcagtacctagctctgctcttttatattgctttaaatttttaaagaaattgtattgcatggatgtggttatttgtgcatattttttaacaatgcccaatctgtatgaataatgtaaacttcgatttttttttaaaaaaattagattttagctggagcttttgactaatgtaaagtaaatgccaaactaccgacttgatagggatgtttttgtaagttaattttctaagactttttcacatccaaagtgatgctttgctttgggttttaactgtttggccacggcgggggtgggggcggggggttggtacagaaacttgaagctgtttgtgatatgtacaactcagatgtttctcattaaaaaacaaaattagccagacttctgttgtactgaattctgtaacaaagcagttcagtggtatgcttaatcttccaaaaaacaaaaattattatttttaaaatatttggagaggg

SEQ ID NO: 14722 - DNA, 1051 bp, Homo sapiens
accttttctacctaaggttttgttcagtctttttgaaaagcaggaaggccaggtccttgtgaggcttttctcattacaagctcttggcaggttcttccctccaagtggagaacccttaccttccccattctttctaccttcccctctgatgatccagagggctgcaagggacctagagctgttcattggagccctagtcagctctagcggccagatctatggttaggtaatcctccaatagtgagactaattctcagtgttagaattaggggtctgcctgttctcaccagcagacccactggcatcaactctcctttgttgacatatagttaagcaccgcttcttacagatcctcatactcagagccaaccttgtcttgtctcataactcttgctactggcagaaggtgataaaattgtggcctagaggccaaatgttttttgtttggcttacagaattagattacttctcaacacatttattactttacaacattagattacttcttaacacacttatgcctgtagttacacataaaaatctggatgcttgactttttgaaagatgtgaacagtttagcaatactgtactgtctatcttcatgccatcaatttgttggatctgagtagatgctgcctaccccctcatccttgagtgggtgggggtgggggaggtgggacctcattgttcaggaatcctaccacacttggttgcctgtaccaggactccgaaggttctttcctctttgagacctttttctgaatgaacttatggtccacttttaaaatcctaaattttataaagccttaaccagtccaacctagtccgtttattgcattagatcagaggttgtcaaatggggcagttttttcctccctctacctcagggcattgggcatgcctggagtcttttgggttgtcatatggggaaggggtatgctattggcatctagcagtagaggccaggactggtgccgagcatcctgcagtgcacaggatagtccccataacaaaggatgatctggtccaaatgtcagtggtgctgagatcg

SEQ ID NO: 14723 - DNA, 1029 bp, Homo sapiens
gggacagcagaaaaatattttcagttatacagacttagaaacatgtccacctacctttcctggaaaactgacttataagttacatttcacttacttgaaacatgaatgaagataaattctagaacagagaagttgtggcttccttactggcagcaagtgataaaacaatttaatctcagagttaagactaaataactagtggtaggtataaatatgaatgaaattgtaaaaaaataatacttttgtatttagaaccacctcctttcctactttgatctaaaaattccggaatgtatcaaatctggtaactgaaccagtgagggttgggtggtggggcaaagaacatacatagaaagtgaccaaagaggaaacatgagaggcacgaaaagtctagggaagcccctacgagaagcatctaatgtacttagatacaaataacccattaaaaaaaaaggtagaattcccctcaaaggactcttctggctcttgcaattcaaattagcaccacaaaactgagaactgtctgtataagggacaactgaagctaagattcaggccatgtcctgagatctgaggagagcgtccagtaatagcaccaatatgacaagctcagaaaatcctgtgttacaaaagccggcttctttctctgccatggtcctgttaaaaggagctgtgcttcagttgtctttgatatgaagggaccaccacctttccctctgtgataccctctgcaattctgggagaaacacaacttatggtagcatgtatcaaccttgagaaggagaaataccaaccactggagcatgaaacaatattagtacaataaaattttacaaataaatggttataatgataaactataaatatgttcatggtcaaagaaacagagggaacatagtgagacactgcatggtggttcaaaggatttagcctctgcactacaagtttctccctgtctctctcttttttttttaagagacaaggtctctctctgttgcccaggctgcccaggcatagtaccatgactca

SEQ ID NO: 14724 - DNA, 1032 bp, Homo sapiens
caaattaacattttaaaatgggtgctcattatatactgggtagttggttttaagaataaaaaacagttggtattttatttgccacctgagagactacaaaaggattctccaggttctgtaaaaccacttatgcatcttgtgaatttttgcaggtaaaataattttctccctaagaaatagcaaacatctgtcattccatagcttttaagttaagtaggcactggagcctgatgggactaacacaccctacaattctgctgagtttttgtcgtaactgatcaccaggactgtgattctgagacttagttttgatttctcccccacttgaccagatgataaaaaaccaaatgggagaaaagttgtgggtgatgtggcatacgacgaggccaaagagagggcgagcttcatcactcctgttcctggcggcgtagggcccatgacagttgcaatgctcatgcaggtaattgtgaataaaagtttctataagagttctgaaaagctgatcgagttttggctgcttttctccccaagtagaaatgtcaaaaacctactcagaagtaaagatgtgaatttattgagaaaaagggaagggaagaatagagaaataagatcaggcacattaatagaggaaagtagggatggcataattccagtctgttttggaatataataactttgaaagaagaaaagtgcgatcacactggcttggccaggtctgttttggtttgccttccctttctttttttttttttttttttgagacggagttttgctcttgctgcccaggctggagtgcaatggtgtgatcttggcttaccgcaacctccatctccctgattcaagtgattctcctgcctcagcctcctgagtagctgggattacaggtgtgcaccaccacgcccggcgaattttgtatttttagtagagacaggtttctccacgttggttaggctggtctggaactcccgacctcaggtgatccgcccaccttggccttccaaagtgctgggattagaggtgtgagccaccgtg

SEQ ID NO: 14725 - DNA, 1085 bp, Homo sapiens
catgttaggtgcctcttgactcttagctaggattgaagcatggtaataagtgggtctgaagcagttcattttgtgattgaactggagtgacctggagcttgaaactgaggtgaggattaaaataaccacctcttctaagtttcatttatttcattttgcttagagcacagtagagagtgccaagcgtttcctggagaaatttaagccaggaaagtggatgattcagtataacaaccttaacctcaagacacctgttccaaggtaaaaataaagttttactgatttaaaactttgtgaattgttggtttttagttgacagatactgtgggttcacatatgctccctctgaaggtgccttcagtggttggggttgggttgggggcttgttactactgtgggattaattaaactcagtggataaacattaatacctattttctatgtttccaaagtgacattgatatatcacgatcttgtaaaccgaagcccattggtaagctggctcgagaaattggtctgctgtctgaagaggtagaattatatggtgaaacaaaggccaaagttctgctgtcagcactagaacgcctgaagcaccggcctgatgggaaatacgtggtggtgactgggtatgctttttattcatgttgccatccaaatcttagtatcagtcctgatactaaggcgttgcatttgcacttggcacatgtatgtagaggtgcctttaatttgattttagcattttcacccgtatttgatctcatttgatccttacagcaatcctgagaggtaggtaagaatagattataatcatagatgagaaaattggtcaaggttatccatctagtaagtggaagagtttggtcttaaaacccggtcttaagatagaatcaccttttgctgttgttgttgttgttgttgttttgagacagagtctcgctctgttgcccaggctggagtgcagtggcacgatctcggctcaccacaacctctgtctcccaagttcaagcggttctcctgcctcagcctcccgagtagctgggactacaggtgcaaggcaccacacccagctaatttttgtattttta

SEQ ID NO: 14726 - DNA, 1046 bp, Homo sapiens
atgggggtttgctctgttgcccaggctggagtacagtggtgcagtcatagcttactgtagcctggaactcctgggctcaagtgatcctcttgcctcagcctcctatatagctgggactacaggcatacactgctatgcctgactttgtctttcttaatctttagattacgagtcattctctaggatctgctaggtatgacttagtgattcagatacacttaattctttaaacctttttctcttttgctttcgtcttgaagaataactccaacacccctgggagaagggaaaagcacaactacaatcgggctagtgcaagcccttggtgcccatctctaccagaatgtctttgcgtgtgtgcgacagccttctcagggccccacctttggaataaaaggtactagtgagactggaccatgggtggtgacaggggacctgcttctccttcagtcctcccaggcccacgcaacctatgatacttatggggtcttcaactcatttcaacaccaggaatgtcattctcacaaacctctgtagtcatgcttttgatgaaggctgtcattggatctccccagctcctgctgtcactgttggccactgcacagggattctctgggatgggtgatatgtagctggaggtgcttttatttgaccctcatagtccactgctacagtaaccataaaggtaatcatagctactgatcatcttacagacactctagagacaatgacaaaccccacagatgtttcaccttgttgggaataagaaaagcctacctttattgaatatatgctttgtgccagatattgtgctgagcagtttttgcatattattctatcatccagtacgagatagtattgtcaccattttaaaatagcagcaactgggacttcagaggtggcttggtcaaaggcacctgtattaagtaccagagtgattcttccatgtctatttcaagctctaaattactaccatactcgcactttaccttcagatttttattgctgcggtactaagaacatgtgtttttttttttttttttttt

SEQ ID NO: 14727 - DNA, 1029 bp, Homo sapiens
cgcgctcagccttacttttttcttttaacaattaaaaaaaaaaaaaaatagaagaggccaggtgcagtggctcacacccacaatcccagcactttggaagcccgaggcaggaggatcgcttgaactcaggagttcaagaccagcctggacaacatagcaagaccttgtctttactaaaatattaaaaaaaaaaaaacaaaaaaaaactgaatgtggtggcatgtgcctacagtcccagctactctggatgctgtggcgggaggattgcttgagcatgggagattgaggctgcagttagctatgatcatgccactgcactccagcctaggtaacagagcgagaccctgcctcaaaaaaaaaaaaaggaagaaaactttacactctaaggataaataaaataccttctcaaataaacccactgcttctttataccctgaaatgcatgttgagcaacatgagacacattctaactctatagaattattgcttctttgataattcaagaaaagacaaaggcactgatcaaacttgtttggtgccatttctatataatctaataaggttgttgttgttgttgttgttgttgttgttttgaaacggagtctcgctctgtcgcccaggctggagtgcagtggtgcgatctcggctcactgcaagctccgcctcccaggttcatgccagtctcccgcctcagcctcctgagtagctgggaatacaggcgcccaccaccacgcctggctaattttttttgtatttttagtagagacaaggtttcactgtgttagccaggatggtttcgatctcctgacctcgtgatccgcccgcctcggcctcccaaagtgctgggattacaggtgtgagccaccacacccagccctaataaggtttttttaaatttttatttttgggatagagtctcactctgtcacacaagctagagtacagtggcgtgatcatggctcaccacaacctcaaaatcctgggctcaagccatcctcctgcatcagtctcccgagtagttgggactgc

SEQ ID NO: 14728 - DNA, 1028 bp, Homo sapiens
atctcaattctctttcattgatctatatgtctgcccttacaccggtaccatatagtcttgataactatagctttgtagtaagttttgaaatcaggttgtatcagccccccaacttggttctttttcaaggttgttttgggtattctgggtcccttgcttttccatatgaattttaggatcagcttgtcaatatctgcaaaaaaaaaatcagctatattttgatagagattgtattgcatctttagattggtttgttgagtattgccatattaacaatgttaaatgttccattccatgaacaaggaatgtcttttaggtcttctttaatttctttcaacagtgttttgtggttttcagcatacaagtcttacacttctttcgttaaatatattcctaagtattttattctttttgctgctattataaatgggagtcttaattccattttatgattgctcattgctagtgtacaggaataaaatagatttttgtgtgttgatcttgtattctggtacattgctgaacacttttattggttctaatagttttgtggtagattacttaggattttccatatacaagttcatgttatctatgaatagagattgttttatttcttccttttcaacccagatctcttctatttctttttcttgtctaattgccctggctggaactccagtatcgaatatagtggcaagactggatatccttgtcttcttactaatcttagtgaaaaagcattgtctttctccattgattatgatgtacctgtgggtttttcatggatgttctgtgtaaggttggggatattctcttctcttcctagattgttgagcgtttttatcatagaagagtgttggattttgtcaaaatttttttctgggtgtattgaagtgatcaggtgatttttacactttatcctattatcaacctgaattattttaattaatttttagatgttaacctaatcttgcatctctgggataaatcccacttggtcataatgtatggttgtggttgctaga

SEQ ID NO: 14729 - DNA, 1022 bp, Homo sapiens
ttcctaggcttggctggggtagggaaggttattcatgggccagggatgtcttagggagatggagacatggaggttgttccttccacactcaattgtcacttgggcttatgaaacataaggcacccgggtactggtgggggaggtggggcaggaggatgtgagggcgggctttttctttctgctgcctagactcccatgggcttctctgtctagcagcagcctgctgtcctgtctagggtagggggtcccgcatgccagccttttgctcttttccccaagggccagagttggaccaagaaaaagggaggtggtgaggtggatagactgtttttctcataagcagatgctcccagtatctggtgccttttgcgtttctctccggtccccaggaaacatcctagaagacaaggattttttttttttttttttttgagacagagtcttattctgtcacccaggctggagtgcaatggcgtgatcttggcttactgcaacctccgcctcccaggttcaagcaattctcgttgtctcagcctcccaggtcgctgggactacaggcatgagccaccacacccagctaattttttgtatttttagtagagacggggtttcgccgtgttgaccaggctggtctcgaacttctgacctcaggtgatccacccacctcggcctcccaaagtgctgggattacaggggtgagccactgcatgcggctgaaggtaaggattctaaactcggagactagaaatgtcctaaaggtgtctgcaacattggatgaggagtacaagtgcatttttctgggatgattcctccctttttatcacattctcagaagtatctttgattcagaagagttaggaatgcctccctatttcagttgggttttctgccctttctccacagaggtccagactcattttgcttaattttttttctagctggggcctgggaggtagaggcttcagggcctgggtggtagagctgcctgacaagtgttcagcagggctgctgggtcagggccc

SEQ ID NO: 14730 - DNA, 1024 bp, Homo sapiens
tggaggacaggacccagctggccccagggccagccccagattgcatggtctgtgcccaacagggttgcattcctctgcagccgccgcctcctcatttcctccctgagcttgtttgtccaagccaccaagccatgtggtcccgctggcttcatcctcctctggattcctgcccccctcccatgaagggaggaagaggattcagggtcagcctaggggaccctggctccctccgataggcaggaaggaggagggatgcggaggagaggctgagccttccacgggcctcctgttaggggtgttggtggaggccaggttggggagggaagcctaaggaccctccacacctcccacagccagagtcagttgaggctgggacaaaggggaaggagagagggaaggaggaccgcctgaccttgcccagaaggagcttcctctaaactgccctgggaaggaagcctggtatgctggtgtggactggagctgtgtcaacctcgtttgggaatactgtcaaaagactgtagagtagaataaggagagaaaaaaaaaaaaagaccttgctagggcactgggagagcttagccctggtgtggcacacacagggtctcccaaagctggatgcctgcattttcagtctagttggtcgaatgtcttggagcctgggtgacaggagggatgtgtggggagctggcaacagaatggtcacatgcagctggctgccctggaccaggccaggggacctggggtggtgagatgctagctcttccactagagcccttcctttctcgggtctgtggagttgcttgctggaaatgcctcacttcaggtgctgatttggcacacgtggaagggggagggtgggcccttgtccctaggctccctaaagactggcccagggaaacagttgagggagatgtttgccaccatctgcccttcagcaaggaacctgctctctgccccagaggaggacatgcctgcaagtgcaccaaaggcctactttattgctaggtgagtgcagtcacctcac

SEQ ID NO: 14731 - DNA, 1024 bp, Homo sapiens
cagtctcagctcactgcaacctccgcctcccaggttcaagcgattttcttgcctcagcctcccgagtagctgggactacaggcgcaagccaccacacccagctaatttttgtatttttagtagggacagggtttcaccacgttggccaggctggtctcaaactcctgacctcaggcgatccacccacctcagcctcccaaggtgctgggattacagtcctgagccaccacgcccggcccctatcctcaaatatttcttaaaataattttgaatagctatgtggaagactttcacaatccctttattgatgaaccttataatactggaaaatgtgcccataatttaaatagcaatgtgatgaacattcttacacataaatctgtgcctataattctgatcttaccttgaagtacacttatagaactattacgtcttaagaccaacagtaaaaaattaactttttacaatatttctacatccatcagtgtatttgattctcactaaagaactgtgaaggaatgaacagggttttgtttcagtgattgttttctgttttgatgagatgtgccaagtatactaaactttttaaaggaacaaattttacaaatagggctcatgtcggccgggcgtggtggctcacacctgtaatcccagcactttgggaggctgaggcaggcggatcatgcggtcaggagttcgagaccagcctgaccaacaaggtgaaaccccatttctactaaaaatgcaaaaaaaaaaaaaaaaattagccaggcgtggtggcacgtgcctgtaatcccagctactcaggaggctgaggcaggagaatcacttgaatctgggaggcggaggttgcagtgagccaaaattgagccagttcactccagccggggtgacagagtgagactctgtctaaacaaaacaaaacaaaacaaaacacaaaaaaagacaaatagggctcatgtcaactggcatgtttggtgagggaatcaaactgataacaggtgggctagcccgagccgcttca

SEQ ID NO: 14732 - DNA, 1040 bp, Homo sapiens
gtaatttcaaaaattatttggtatatgacctagaagtaaatgctggccattttttagttttgttttgcctttagacattttaagtctgttaatcatcttcactaaagattttgaaatgtaaagaaattaaattcctgtttctgatattttagggtaatacctgcctggagaatggatctttcttactgaactttacaggctgtgcagtgtgcagtaagcgggattttatgctgatcacaaacaaatccttgaaagaagaagatggagaagaaatagttacctatgatcgtaagtagactttattttttaacctgagtgtgttagcaggtgtcagcttttggaagtcgatatgttacacaaaatattctgaggcctatttcaatattgtattgcgcacataattactagttaggtctttaagaggaaaatgtcattaacacctcatttatctgggatatcaaatagtctatgtaaatgacttttgcagataactaaagcttacgattcaggaactgaattttttttgtttatcaaattatttttcacggacatatttttaaaagctttatgctgccttaacaagatatactttttattattgttattattgtgaccttagggtcatccatgtgagttttcacttttctgctacagtataataccatgatatcctccaacagctattaaagtgtttagggctgcttgtccctatactaaatgacttcaggaatgcagtgtttttttcagtcttgtttctgctcagaatgtctagctttttttttcttctccaatctcactgtcagtctgttgttccttacttttgctgctaaataataagctgccttcctatccttcttctcgtcctcaatactgggaaaccaaataaactatgtataaaaaaatcaattctgaggttagcactaaggatttctgtaagttaagtatatgtatacttcagtgcccaatattgtgagaagtatttaactgttcacattccctttttgcttgtctcctggttcttgggtaccttctaaacacat

SEQ ID NO: 14733 - DNA, 1044 bp, Homo sapiens
gcactagggaaggtagagaagggaagacaatgtttgccgcttccgtggtcactctactgctgttgcctttgcttctggagctgcttctaccagcactgcctctctccctcccacatcactgccagggtctgagtgagacctacccccaaggactcatccaggcagccacaccggtggtttgaaataatctttattttgtaaacatctgtgtttaaaatagatgaaccctgctcacaattcatatatggacccgagacacagtacacgaagttcacccgtcacagggagatagtggaggctcaggagcaggtggcgtgcctggggctggatggagtctcaagacagcaggtgcagaggtggtgacgagtaaacaggccagcagagcctggttaacagtctgggcctcaagacatgccccaggccaccaaaagtttagggtgagcgtagctgcaccctaaaatcccaattctccttctgctcccataccttttcccagtcatggcccttgtggatagggcctatcagtctatagaatcctgattccatgttttcccttccagaacccctagggtacagtacaaatatagtccttctttcctgagggggctaggagagaaagacaatgaatggcaccctgcctgatcttcagggaaagctgaaatactggtccacagattggagccactgcccaatataacttctcaagtccctggctgaagacagacttgagggctggcatcacctacttccctagccccagtgtgatgtggcataggtcttgatacccaaggagtcccatcttcaaggaagcaactccagcctagtcacagcttcatcctagagttagctgtctccttttctcattagccagtgatttacaacttcctgctctcctttgctttccaccatctaagctataccctgtccctaagtcctgagccaccctctcctgctgttttcctggtttggtaagtcaggaggaaaggtttgatggttctttccccacttctttttggaggagtaaggaagtgaggttcttatcct

SEQ ID NO: 14734 - DNA, 1022 bp, Homo sapiens
gagcgggtctggggtgtggggagaatcgctttaacccaggaggcagaggctgcagtgagctgagatcatgccactgcactccagtctgggcgacagggtgagacttcatctcaaaaaaaaaaaaaaagaaaagaaaggaaaagaaaacgaaatgcaaatatgcaaattcttgggccttacctcagacctatagaatcaggccctctaggtatggggtcccgcaatcagtttcaataagctctcacagtgattctcacacatgcgtaagtttgagaacgacattaggacaaaagttttgcacctgaagtgtcaagagagcgagagcacaagagttctctgtttctcaaggtgtgctttgcagagcttcggctttagaatcacctggggtgacttaaaacaaagacaaaaacaatgaccttgacgtgcctagacctactgaatcataatttgagggtgaggcccagaaatctgtatttttaacagcactgtgggtgatattagatagaagtagtttcaagagctatatatgtcatggaagaaacatccattggcctggagtcagaaagacctggtccaagtcctggttctggcacttactgtgtaacttcaggcaagtctcaacttctcctagcttcaatttttttttttttttgggatggagtctcactctgttgccagggatggagtgtagtggagcaatcatagctcactgcagcctcgatcctccaggactcaagcaatcctcccagctcagcctctgggtaggtagctgggactgcaagtgtgcaccaccatgcccagctaattttttttttttttgtagagatgaggtctccctgtattgcctagactagtcttgaactcctgggctccagcgatcctcccgcctcagcttcccacagtgctgggattataggcatgagcctccgcaccaggccgattttcttaagtgtagaaggagaatactgcttccctcctaagggctgtgctgggataaattaaacgatgtatgtgaagcactg

SEQ ID NO: 14735 - DNA, 1179 bp, Homo sapiens
gtgtagaagatagtaagaaactaggttatgtagctaaccgaggtgtcatacaaaatcgaggggaaatacaaaagattttgagctttggtctgaaaagaggtacacttctgaatgccttttatgttaaaagatagacaaagttaaagaattttatattcacaaagcaagttatatgagcgctaacttattgtaagttgaactatgaagcaaattaaaccactgagtgttactgagtttgggtataatttgcaaaatgaaaacccattttttgttgacatttggaaagtgcttacagaataagtcagtgtacaaaataagtgaatttgcatgttatgactggctacataaagaaaagttaaaggtatttaaaaaattatataataatgctaactgaagcttgagtagggctgaatttcatatatttttattttgtttcaggttgctgcttttgctcagaggacatccatgaccctaatggtctttttgttcaagataaagtgattttttgcctttgttgattaactggacaaattcaggttagtgtattttgtggacagcacttccctgttctaattatatgttaatattttgagaaatagataattttgtggttaaagctacatgttatgtaccagtaaagcagaaaggccaagtcagtctaaactctgttgaattgtgtattagttaagaaacattttcttactgcctactatatacaatattcactgcataaattgaaaaaaatttacttccttttaaatagttttgtactttaaattatggggctggataaaacaagttgtggttgaatgcggtacactgaacttttggcatcgttgtgtggcatatttggtgctaaaaataagcaactcatcttaaacatttctgacatttttagtagctggcttttaaaggtattcttgtccagatttcagtcctacattaacatttttatttatttttagtgttcattctattaattttgacaaatatatatcaccacaattaaaacattctctaaaccttccaaatttgctcgtgttgcctatttgtagttaacctctccttatacctcaatccctagcaatcactgatctgctttctatccctgtaatttgccttttccaatgttatttaattggaatcatctaagatgtagtttttaaatcctggctttca

SEQ ID NO: 14736 - DNA, 1020 bp, Homo sapiens
tttagtaattaccaaagaaataataaaccaatattaaagttcagttacaaaattaaagtcaggactcacaaacaaatcatgttaaatgagttatgaattaaattagtgttattgttgagtttaactgtgtgtcaaatcaatataatttctttgacataatcacagaatagaaatcaatgtatgtgtggtacattgtattgaagggttacaaagtgatgaactagtgagtatgtatttttaaggatgttatagacctatgaatttcaattatatttgtttaaatgtgaatcacttttataagcagcagcaaaatatcattgcctttgtattttgtagcaggtgatttagcttttgtgtatattcagataaatataaattttaatttattttattttgactaaagtttaagagataatttagcatattgtttgctaatcacttttaagtaatctcagtttagctggttgtggtaatgtgtgcctgtagtcccaactactctggaggctgaggtgggaggatcccttgagcctaggaatttgaggatgttgtgtgctattgttgtgcttgtgaataaccacagcatggtactctagcctaggcaacatagcaagaccttgtctcttataaaaagaaaaggaaaaaaaaaagaaatttcagttaataattttatttgacatgttacagctccttatttgaccctgaaaatgttgcagtgagaatagcctttgcatgcatagtccttaaccctgaagaaaaggataaaagaaaataaaatcaaaacttagttgaaaatcaggaagtgcggacaagcttctgtcgagaaaatggaggtgaatttatgtgtaaatgttaaagacatatggatatgttgattatagccatctttaagtgtttgtgttataggcagacggtttgcagagttagagtaaatggattaaagatattgctaaaattaaaataactttatttttcaagtttttttggtattatgtttgttttttcaggaaaccagatacttaa

SEQ ID NO: 14737 - DNA, 1030 bp, Homo sapiens
ggcatattccagaaactggcagaaggctgatctacttggtttctaagcaagggaaagataataactaatatttatagattgttttactgtgtacaaatcacttttatgcatattatcataatcttcacaattatgtgagtttctacgattatgactcctactttatagcagggtaaactgtccatatgtgattgatttgaaatggttgctctttctaatattaacacatcatggtgccaatcaagtatatattatttatgtgcacacacacacacaattggagaaaatggtgatatatatacacatttcatttgaatttactagtattaccatttttcagcagtattaatttatttagggctgaaggtacagatggcaagtccagatttctagacccatttgagtagttaattgtatcagtaaacacagcctggtgtgttattgtgtgtaattgttaaggtgagtgagatattcttgataagaaccttataaatgtgattatgtgtttgtactttataactaggaagattaatttctaagatattggctgatttcagtgaattagtattttgtattcatgtatttatgatgctggcattttaaattcatatgtatatactatgacactactgataagaaatatgaagtatgatagatgagtataagtaatgaatgaaaatcaaattttataatcttggtaggatttatatgaaaattttcttttctctgtcctgctctgccctcttttcctccctgtcttaccctcttcttctctcttttcatcctctcctcttccttcccctcctctcctctttcttcccctccctttcccccacctctctttttcgttgtcttcatttcagtttagttggttttaccaaatgcttttacataaagtaaaagtttatttcagctagcattaaaggacccttttaatttataatactatttttacttgttcctttctacttctttcttacattaataaacacattatttgtaaattacccttttcccgtatagggagcaa

SEQ ID NO: 14738 - DNA, 1021 bp, Homo sapiens
ttagaattatagaaaattagcaaagagagtacagtcactgtatactctttgcccatgttcccctaatgttaacatcttacgtagccatggtacattcatctaaactaataaattaacagtagtgaaatactctaaactacagactacatttggatttcagcagtttttccatggtgtccctgccctgttccaagattcaattcaggataccacagtatatttagtcattatgtctccttagacttctctaatctatggcaatttctcagttgtttgtttttatgactttaatagttcaatacttttgaagagtactggttaggtattttgttgaatgtccccagatgaggatttgtctgatattttcttttattattagactggattcatggttttagaggatgagtactacagaattgatgggtccttttttagtatcatttagaatagtttcatcatataagttactcttgaagggactttataatcatcccctccttgtactttcaactcttgggaaccactgaactatttttcaacctatagtttttccctttctgtaatgtcatgtaaatgaagcacacaatatgtagtctttggttttgtcttccttcacttagcaacatacatttaagattcattttgttgagtaaatcaatggcttatttctttttattactaactagtattcctttgttttctatgtatcatgtttgttaatctgttcacctgttgaaggccatcttgattttttttttgcagttttttgtctgttatgaataaagctgctgcaaacatttgagattaattttttgtggaaaaatatgctttcatttttcttgggtggattaactttgaaacctcaaactaaaacttcttaaagaacccataggagaaaatatatgggactttgggtttagcattgaatttatagacatagtaccaaaaccacagtctataaaagaaaagaagtcagtatattgtattatatttaaaaaatttaaaaattttgctgtgtgca

SEQ ID NO: 14739 - DNA, 1019 bp, Homo sapiens
caatttgcctgtcacctgcagagttaagtggtataatggcagctgaacaatgagggaggagagtggagttgagaactggtagaaatgaaatcactcatacagggaacatgttttttcttgagataatgaacatatagcccaaaatatgtggttgagtacattttgtttttgattgattgttcaaagatataatttttaagtcttcatatataagttaatgtataattatgcaagaaggaaaagaaagtgatgatggcactttgaggactttcaggcttagagctaattagtctgttatctggtagagcactaatgtacatggctgatttaatatacagattaacagatttaaagcttttaccctttacttgttattaggcagttaggttatcttccaacttgttggccagtcaacaccaatgtgtttcctccaagaatctcagtatatgctattttatataccttaaataatttaaatacatttcttactctttccacagcatgtagagcgcatgaagtacaggacaataaagcttcctacacatatcaccaggaggatctctttgaaagattcactgcaggactaccagagagaataatttgtctgaagcatcatgtgttgaaacaacagaagtctattcacctgtgcactaactagaaacagagttacaatgttttcaattctttgagctccaggactccagggaagtgagttgaaaatctgaaaatgcggccatggactggttcctggcgttggattatgctcattctttttgcctgggggaccttgctgttttatataggtggtcacttggtacgagataatgaccatcctgatcactctagccgagaactgtccaagattctggcaaagcttgaacgcttaaaacaacagaatgaagacttgaggcgaatggccgaatctctccggtaggtcctaaaatactgaatgaagaatgatgaaatattgtactttgtttttaggtgtagggcttcattccgctaggaaaaatagttaa

SEQ ID NO: 14740 - DNA, 1035 bp, Homo sapiens
ttcagccccatccccagctgtcctaagtatttttagtaagtgttggtggttctttaaaattcaacctaagcgtgtcttcttctgagaatcctttcttgacctcattcatctgaattaggtgccctttctatatgttcacccagcagccatggcctgctcctgtcattgtactctccacagtttgataacttttagtgcatttgtcttttagctgaatcttaagtgagtattttgatggaatggattatatcttattcatccttgtatcatagtgtttagaatctggcgtctttaataaagtgaattaaatgctcattgaatgaatgaatgaatgaatgagcccagttgatttggggaacattgtacctgattaaaaaatcattctttgtattctcaggagataacggtcatcttagacatgctgatctatgcctgttatatctttgatcccacttattacttagtccagtacctctggcatagtgaatgctgcatgaatggattggaattaagggctgtattttatataaatcataaacattttcttctgtagatttaattattttataattaaaacttaacatctttagatgccatctttttttagaaaaagattttattgatctgccttttaccactttgatcaaagtacaccttttgggtttcatggttttatttctttttcttttgtttttttctttttagacaagatctcactctgttacccaggctgagtgcagtggtgtaatcactagcatgctcactgcagcctcaaccacctgggctcaagtgatcctcttggttcagcctcccaagccagctgagaccacaggcacatgccatcaggcctggcaaatttttgggtttcattacatttgactttttgttgttgttgtccagccatagaattcttgtcaatattatatagtagtttcctctgaaattttgcattttcatgtcattgtgaaaggtattagagataatattttttgtaggtcaggccacaatcacagttatcactgtgataaaataaaa

SEQ ID NO: 14741 - DNA, 1019 bp, Homo sapiens
tgtttaatatctcagctgaaaattagttgttgcctttctcttaaagtattgtggcatgtaaaccaagagaaatgtgcactattgaagcattgaagcaggctttttttttttttttggtgtatgtcatatataatctagtaacagcatactttacttatgtgattaacaccacaggcaagtcacatactgtaacaatttgcatgagttggttgtaactaaaaaacatgtaaactctattgcaagatacttaaaaaaaactgggaataaacaaaaggacattgcttctagatctcacctagttcttcagaaagtttcttattaactgagggattaattatgaagatttttctgcgactttgcatatgcagctgtatatacaattgtttttttgtcagcttcatttttaaaacaggcactaaatccctttggatatatatgagagctttcactttggttttgtgttataattgttcctctggtgtaaagtagttcatgaaaaaatggttgagtgcgacttgaaataaagtatatttaaattctagacaaaagaatgactagatttgagtggtgggggagaactgacctattatctattttttttccttcattcaagcataagtggcttcctatagaggaattaattgtgttctctcagagaatacctaagtggtgaggtctgcttgctagctagctagctacctacgtacctacctaccttcctatctatctgtattagatagatagatatattaaaggagctgttcaaacttcagcctttggtggaaggcaaaagaagactctaccagaggacctgatactaagcttacatttaagggattttattcttttgagtaaatagcctagttctgtctaatgatactaaaagatatttcattctgagtaggacagtttatcttctagaacatccttagaagttttcatgcatattcaatctccttttcccctttaaataatccctattgatctgcagtctgttgagttattgaaactttatttga

SEQ ID NO: 14742 - DNA, 1060 bp, Homo sapiens
ttggagtttcatttgctctttttttcttagtttcttagggtagacgctacaatatataatctgcagtaaatctcattctttatatttttcatttcagacattatagttttcatctgtagtagttcaacttgggtatctattaaaattttttctttctttctttcttttttctgagatggagtctcactctgccaccccggctggagttcaaaggcgtgatctcgactcactgcaacctctgcctcttgggttcaagcagttctcctgcctcagcctcctgagtagctgggattacagacgtctgccaccatgcctggctaatttttgtatttttcatagagacagtatttcaccatgttggccaggctggtcttgaactcctgacctcaggtgatctgcctgcctcagcctcccaaagtgctgggattacaggcgtgagccaccgcacctggcctattaaaattttaacatcttttttatatcttccctgtctctaacttttgaacatatgaaatacagtcataataactgttatttctatggtgattctaacatctgtgtcagttttgagttggttttgatagattgatttcactcttctttatgggttgtcttttcttgtttttttgcaagcctggtaacttttgtggattccagacatgaattttaccttgtttgttactagaaggtcttgtataatttacaaatattcttaaattttgttctgggatgtagttatgttattttaaaataatttgatcctattttgtcttttaataattgttaagtgggacctaagcaatgtttggtctggggcacattttcctgctattgaggccaaatccttctgagcattttacccagcatcccatgaattacggttttctagtctggctgataggatcaggaactgtttctacctaatctgtatgaatgccaggtactacttcctctaatccttttagagagttctttccccagcctgagtagttccttatgtgtgtgtgctgatgagtactctgctaattccaaaatggtacctttgcagatttctggaatt

SEQ ID NO: 14743 - DNA, 1031 bp, Homo sapiens
aatgttgacacatgaaacaaatgtctaaagtgcttcacaaatggaactgttgttccaaagcatcgttcaaagttgttccactattaatttaggatgaatagtctaaatggtggctaagatttttaatttttaattgaattaatagtttcactttattcaaaaggggctattatcacgtattctctgttaatcatgtgtacttctaatggctttctgtgatagtaaataagactttcctgtgggctgccattgcatttttgctaaataatttagcatctagttaagaatcaggaataaaagagtactaagactgtgtcacaagcaaatcacagttgttgagggcatatttcaccatctcttaagtgattccttctcattgatcaatcccccttcttcagggtgttatatggaactcaatattggatcatttttataattgattatcaataccacgtgttactgttacccacatctaatggctccttcctcttggtagtagaattattagtaggtactcttcagacacagtgtaaaagctcagaaacaactctctgaggacctctagcattaaaaaaaaaaaatagcggctaccacatgtattactattttgtgtgtattttttaaagagctttagagaaggtcttttgatactttgtctcagagatgtcaaaataattttcctaggacacaaaattagtaggagatagaaccaaaattgagaaattggtatgtctggctcccaaagctctctcctctgattcagactttctgatttttggatatttacattgaggagaggacacattattgtgctctggacctcctactttgatatttgttagtgtagtaattagaagcctggactttaaaattcattgcttgggtttgatttcctactctgacatttctgaggtttgtgactttgagcaaattatttaacctctcagtgcctgccatttcttacctagtttgtaagattattgtgagattaaatgaaataatgtaaagcacttagaataggtgtacctatt

SEQ ID NO: 14744 - DNA, 1038 bp, Homo sapiens
aaatacatgtttaggtagatgaccgtttggtatatccacttatctaaactgaacagttaccttctctccatgcctcatttccaaaaggttttagtcaaagagttttatttgacatccttaaggtttatgtggaggcaaccttgaaataaaagtaattcaattaaagtatttgctatttgctagatacctatgctgtactacatgaagacagacacagtctctttcgtgtaaagggcagtcaagggggaaagatagacaactgaataagcaattaaaatatgttgtgctaatgtggtggtatggttaagactaccctgaagcaaatatctaatgcatatttggggttcttttggaagaaatgatttttaagctgagacctaaattatgagtaggagtcaaccaggtagggacatggtggaagaattttctgtcagtgggcacaacatgtaaaaagacaggcaagagaacatggagtcactgggggaactagtagtaattcattgtaaagcttgaatactgagagactagctaatgtttccttttaaaaacaagcatcacttacaggatttccattttgatggttgtgtattcttgttcttcactaaaactgacaggttttaattcgagagtcaaagctgtttttttgattttggtttagagagtagacagagttataagaaattgatttcagatgacttttttgttatctcataactattaaactgtttattcaaatatctcactcaggtcagaaggaaaatctttagcaagtagaacacaaatgaaattatactttcagtctttcctttgatactaatattttaacctttacaaaactactaagatgtctgttggaatcatctaaatattctaaccaagttgtatccttaataaggattgacgtcaggtagactaatttataaactgatattaagcaataatgtgattaagaatatatagatataatatacatattaggctatagatatgcatatgttaagtctttttacagtagtattttcagtctttgataattgt

SEQ ID NO: 14745 - DNA, 1046 bp, Homo sapiens
gtctatttttgcttttgctgcctgtgcttttagagttctttccaagaaattgttgcccacaccactgtcatgaagcttttcccgttttcttcctatagttgtatagtttcagatcttaaagtcttataaccattttgagttgatttttatatatagtataaaagttcagtttcattcctctgcatatccagttttcccaatactgtttattgaagagatgagcctttttgcattgtgtgttggcacctttgtcaaaactcaattgaccataaatacttgggtttatttctgggctttcagttctgttccattggtcgatatgtctgtttttatgccagtaccatcctgttttgattacagtagctttatattttcaaatcaagtgggtctggtgcctccagctttgttctttttgctcaagattgccttgactatttgggttttttagtgaattcatacatatgttaggattgttttttctatttctgtgaaaaatgacattggaattttgatagggattgtattgaatctgtagattgctttggatagtgatacggttatgctttacatccccacccaaatctcatcttgaattgtaattcccataatccccacatgtcaagagacctggtggatgtaattgaatcatgggggtggtttcccccatgctgttctaatgatagtgagttatcacaagacctgatggttttatcaggggctcttccctcttcacttggcacttctccttcctgctaccttgtgtagaaggtgccttactttcccttcgccttcttccaggattataggtttcctgacgcctccccagccatgctgaactgtgagtcaattaaaccttttttctttataaattaccgaatctcaggcagttctttatagcagtatgaaaatggactaatacagataatgtggacattttaataatattagttcttccaatccatgaacatggtacatctttttttacttatttgtctttttaatatcttttgtcaatattttataagttttcagtgtatggattttca

SEQ ID NO: 14746 - DNA, 1028 bp, Homo sapiens
tttacccaagactgtctttggtcttatgctatatctttctggtgttacaatatgaacatggagaataagatttacaagagaaaatatatatagcagtttcaagcatatgcagactgcctgggttccaacctgaatttaccacttattagtataaccttgagcaatgccttaacttccctttgacatttgtaaaacaaacataatgatagaattttatggggatgctgaaaggaatctaattacattagataatgtctaaaaacaatgtctgacagttagcaaaagctcagtaaatattagcctctgtcattgttattgtagtttgctattattggagctgctttaattatttagtttcttcttttcctgagtcccacttaattttgcttgccttctatgagcctttggctgaatttgaaattcaaaagttccaaatctttttgatccctattttattatagtctcggtattctaccaatgatctcaattgtaaaatgacattgccaatataatcgttgttgaactaataaatctgaaagcaaggtttctattattttggttctatatctagttgaaattctatcactaaaatttgcataaatcacttaatctccttgtgttttagttgcctatctgcaaaattaaaaatattggggcaaatgtagtttcatttgcaaattatatatagcatttgagaattgcccctcaagttttctgaaattcagattctctaagttgaggtgatgattaacctagtcagattttatttgataagagttaagaataggcatctccatttgtattagtctgttttcgcattgctaaaaagaaatacctgagactgggcaatttataaagaaaagaggtttaactggctcatggttctgcaggctatacaggaagcatgatgctggggaggtctcaggcaacttacaatcatggcagaaggcaaacggggagccagcacttcacatgactggagcaggaggaagagaattgggaggtgccacatatttttaaacaatcag

SEQ ID NO: 14747 - DNA, 1011 bp, Homo sapiens
cctggagatatcattggtgtggctggaaatcattgggatggctattctaaaggtgtcaacaggaaattgggaaggacgggcctatatccctcctacaaagttcgagagaagatagaaacggtcaagtaccccacatatcctgaggctgagaaataaagctcagatggaagagataaacgaccaaactcagttcgaccaaactcagttcaaaccatttcagccaaactgtagatgaagagggctctgatctaacaaaataaggttatatgagtagatactctcagcaccaagagcagctgggaactgacataggcttcaattggtggaattcctctttaacaagggctgcaatgccctcatacccatgcacagtacaataatgtactcacatataacatgcaaacaggttgttttctactttgcccctttcagtatgtccccataagacaaacactgccatattgtgtaatttaagtgacacagacattttgtgtgagacttaaaacatggtgcctatatctgagagacctgtgtgaactattgagaagatcggaacagctccttactctgaggaagttgattcttatttgatggtggtattgtgaccactgaattcactccagtcaacagattcagaatgagaatggacgtttggtttttttttgtttttgtttttgttttttcctttataaggttgtctgtttttttttttttaaataattgcatcagttcattgacctcatcattaataagtgaagaatacatcagaaaataaaatattcactctccattagaaaattttgtaaaacaatgccatgaacaaattctttagtactcaatgtttctggacattctctttgataacaaaaaataaattttaaaaaggaattttgtaaagtttctagaattttatatcattggatgatatgttgatcagccttatgtggaagaactgtgataaaaagaggagctttttagtttttcagcttatttactttgttttttttcctg

SEQ ID NO: 14748 - DNA, 1026 bp, Homo sapiens
atcagtaagagatactggaacaaatataagactaggtactagagattagttaaaagactaattgtaaatgagaacatcaaaatattacagtaacaggtagggagtatttcagttattcataaatgaagtcattcaaagtattaaaaaaacaagcttgagccaagcagatgctactgtcataactctgcaattgtttaagcatttacttttttacattcttgaaacctgttctggtatattatgtgtcaatattattttctgaaaagcccatttattgataaggatatatacatattatatctgttttgagaatagatgtcattaagtaggcaaattactattaaatcctactaagtggaactgtatgttctgcctaacttagctgtttttttaatatgtgtttttaatattgatctatatgacttgaaaggaatcctatttcttgaaatagattgttattttgtgaattttttgttgaaagcaatgtattagagaattaaatgtttaggcaaagtaggaaaatgttaaattaatttctaatgaatatacttagtactattatcattggtcaaagacttgaaaaagtattagttgctatacaataagaattttaactatattaaaaacacatgtgacaatttgacttcaaagtgaatatacttaatactatcatcactggccaaggacttgaaaaagtattagttgctatacaataagagttttaaatacattaaaaacacatacaactatttgacttcaagcaggcatatagtggaaagtcaatagtatgtttttagggaggaagtgacgaataagagtctatttttaatcttgctagtgatagattcctggctaagttgaacagggtgtttttaaaaacaatcagtaaaatagataaaatctattactctgtttctgtaaataggattgaagaataatgaagcatatttggaatttgaaaggtattaaaaaaagatcctgaaaaagaaagtagtgaaaccacaaaggatttcttccttcacatct

SEQ ID NO: 14749 - DNA, 1045 bp, Homo sapiens
agtgtgcactggcttctccttttcatttcccaggcaaataatgatggtgatcaccttttaatattaatttttgacatattttaaagttattctgtctttgtcttatggatttataggaattccttatgtattctgaatatgagacctttgcatggcaaatttcttctcccagtctgaggctagtcatttcactctcttaatagtgtattataataaataaaagttttcaattctaatgaaccttaacttatcaagtttgctttttatggtttagttggtttgttaatgttttgtttaagaaatctttgcctattacaggatcatgaaaatattctccaaagttttctttttgaaattgtattactttcttttttactcaaagctctatgatgcatttcaaattatcttataatgaatgatgtgaggtaaaaaccaggaatttttaaaataaaacataggatattcaattgatttggccccattttttgaaaaaaaaattgcccttaaaccattggattatagaacacttttgatataaatcaggtgagtcttactagagtgtatatgctcttccactggtctatttatgtacaaatactaccctgtcttaattactgtagctctatactaaatcttggtatctggtggtataagttccttcaattttatttcttcttcaacatttttttttgtggtgggtatactctatcctttgtgtttccatatacatttagaatcatatttcagtgaaaacaaaactgttaatattatgattgggattgcattgaggctatagatcaatgtggggagaattggcatcttaacaatatagagtcttctagtccatgaacatggattatctatccatttacttgggtctttaagttctttcagcagtattttttggtttacaatgtagaggtttcgcatatcatttgttagcgttatggctagctattttaatgttttgaaagtgctattgtaaatggtattcgttatttaaatttcattttgaattgtttaatacatagaattacagttgtat

SEQ ID NO: 14750 - DNA, 1056 bp, Homo sapiens
gtcaaattttttgcttttgttgagataaatcatatggttgtatccttaattctgtgatgtggtgaattacattgattgatttttaaatgttaaaccaactttatactcctaggataaacgttactttgtcataatgtattgtcccttttatgtaccattagattcaatttgttaatattctctttagaatttttacatctattcatgaaagatattggcctgtaatagtcctttattataatatttttgtcagattttgttatcaatgtttgttagccttgtaaaaagaattgggaagtctctctctgttttatttcaaagtgtttgtgatagattgatacgtttcatgtgtacttgaattgggaagtctctctcttttttattctctgaaagcatttgtgattgatagattcatacacttcatgtgtacttgaatgttgattctgcagtctttggtgttaatgttctttgtcagtaaggtcatattggttaatcaagttgttcaaatcttcaaatgactgatttcttttttcctgttctctcagttttgagagtagtgtcttaaaattataaactatgactgtagttttgttgacttttagttctttcagttttcccctcatgtagttggaagctcttactaggtgaattaaaacttggcattgttattttacggttgaaatgacctttttgtcattatgaaatgaccttctttatctctggtaatatttcttgccttcaagtctacttttaccttctattaatatagtcactctttcttttcatcaatacttccatggtatgattttttcttctttttagttcagccaatctatattcttgtatttacagtatatctcttggaaatgtcatatagtcaggtcatgtttgttttatctagtttgacaatctttgtgctttagttgtaataggtattctatttacatttaatgtggttactagtatagttgggcataaatcttttatcttactgtttcttttctatttgtcccatccatactttgggtgtttaaatttctttcctgcctgtattat

SEQ ID NO: 14751 - DNA, 1086 bp, Homo sapiens
gtgagccatcaagcctggctaatttttgtaattttaatagatacagggtttctccatgttggtcaggctggtcttgaattcctggcttcaagcgatccacccaccttggcctcccaaagtcctgggattgcaggtgtgagccgctgcacccagcctgaaatatctttaacacaagtttgggtctgatccatggcatgttagtgtcatcactttttcattctctgagagaaagataagaaaaatggaattctaagattttgtaaaggatatgtgtttttaagggagaaggtactagaaataataaaagtcaagaaccaaaagttcttaggtcaattattttgacctaaatatatttcacaatagaggttcaagtgggttaactagactccctgttagaacaaaaatacctatgaagaaggttaagtttatatagtcatttatttgtataaatatttttctattcagagcaattcttagtggttcagatttttatgaaggagatcgatctgcagagaaatgtgaaagtgattttgtacaaatggtgggatatggcaagattcagtatcatttggaagtttggacactgacaggctctgagcattggacactgagggagagggaggtacacgaggcctggtaaaatagtttaacttttagttttgcattaggttcatccttttggaggttagtatgccgatgaaaaacaaattcacagagcagcttggtgctgtcagtaccatggacagaatgatgtgaatgagacacatctggatttagattctgttccatttgtgtcattcatatgctttgtgatttgggcaacttaattaagtcttgtttatgacacagatgataattaacgtattgatcttagcatcttttaagtgttcctttgttccttgagtcatcactttctcttctgtccaacttaaattttatagtattttgttatctatgatttgcattctcaacttccttgcatataccctcagctttcttgtctcactctcacttaagtccagcttaaatccagccatttttaaactttaagttagtatctgttagtgtctaaattagcagctatat

SEQ ID NO: 14752 - DNA, 1028 bp, Homo sapiens
gctgtacaggaagcatagctggtgaggcttcaggaaaatttcagtcatggcggaagatgaaggggaagcaggcatgtcttacatggccagagcaggaggaagagaaagaaggaggaggtgctacacagttttaaacaaccagatctcgtgagaactcactaagtatcactagaacagcaagggggaatccatctccatgattcaatcacctcccaccaggccactcttccaacattggggattacaattctgcatgaaatttgggcagggatacaaatcaaaaccgtatcagcaccccttcatgccccaaagagaaaccaacctttatctttgaaaccttgtcactgaagctcccagcctggttaagagggacttctgattctataatctaaaaatcatgaagtcatcttagacacctccctttcatttttccccacatctacttactcattaatgtctggctccctagtatgcctggaaatctgtttactttcctggtttttattctgtataatcactatcatgagcaaaataagaacagtcccatctcatcagaaagttatttcatacctgacactttctacttcactgttcccatctcattttctaactcatcctgcttccagcttctaatttccaatgtaagaccttacaactaaataactgcatttactcactcccctagtgtgatttttaaatcacattttaaacttttatatacgttataagccctactttacagtgttttattttgctttaaacagttatttgatttttaagtgaattatgagaaaggaaacagtttttgtgtttaccaatttatttaccatttctgaagctcttttttcctttctgtaagtctacatatccatttgatagaatttgtctttggtctgaagaacactcttcagcatttcttacaatgtagattgactggcaagcattctctcagcttttgtttagctaaaaatgtctttattccaccctcatttctgaaggatatttattattgatgaatataaaattct

SEQ ID NO: 14753 - DNA, 1171 bp, Homo sapiens
gatttaattgactcacagttgcacatggctagggaggcctcaggaaacttataatcgtggcggaaggcaaaggggtagcaaggaccttcttcacatggtggcaggagagagtggaatgagagcacaggaaaaactatcatttataaaaccatcagatctcataagaattcattcgctatcacaagtacagcatggaggaaccaccctcataatccaatcacttcccaacagtttcctcccttaatacccggggattacaattcaagatgagacttggatacaaagctaaaccatatcagctgtcaattatatagtcagggaatcatagacttttagtacttgtacaaactttagaaatgatcctctaacaagctcattttcatactgataaaatgtgtgtgctaggatttcatacatgctgggttgaatgggtaggtgataggtacctccaatgtggactgttaggccaagaatgttacattatgaagggcattttaaattaggatgtgaagcaaatgcttgaagtagaagccttcatatattctagtacccaaagatactatgacagttgccatgaaggaaccttataaagctctcagccaatatatggcagataatattaatgtatagcttcagaatattggaactaaagtagattcataatttgcaggataaacaggtcaccagtttaaaaacagaaaaaaatccccacaaaaaaaacaaaagaagcgtaagtacttaacgtttattgtgtcacagaaatctgtagcagattctgaacatatggtaggttacatagatggtatattatgcatatggtatatatataacatacatatttacttatggacacatatttgcctaaattgcattaagttctataatattactgagtaataattttcctccttttctgtattgatacagcatctgtaaatgcttatcaataggcaaatgaagtgaatattttgcagatgtctacagtttatcactgtctccctcacatctatcacaatgtgtggcgtatggtaggtgcttaataaatatttgttgaatgagttaatgaatgtgtcctatgattgcccccccgcaacccacgctgccttttgaaagactcattgctttgaaagaatatgtagaaagatggatttcatttttatactgatggtac

SEQ ID NO: 14754 - DNA, 1585 bp, Homo sapiens
ggtcttaaatgtacttaccacagaaaataagtttgtgaggtgatggatacattaattagcttgatttaatcatttttacaatatatacatatatcaaaacatcacattgtgcattataagtatatccaatttttatttgtcaattgtaccttaacaaaatttggggtgggggaaacagataagagaaaatgaaacaaatttattaacatgtggattgcttatacacaggagagtactcaatgattagtaactcaaagcgtttgttggaatttgggcttacgtatccttttaaccaaagaataattttgtagagggaagacaggacgaaggaaagggactttgagctactaagaacagcaaattgtaggataataaatatacgcgggaaatcaatggaagataagggatagtatggtttgctcagtagattcttctagtgctgtcttttggctgataaggttctggaattgtctttggtgataaagtatcaactaagaatcgaatagtcctgccctttctagtagagaggaggagggcagaggattttgtgtctgtgtgtgtgtgtgtttgtgtgtgtgtgtgcgcaaacttgccttttcttaattgacgttagctcaaaataatccttatgcgaaagtggcgtattttggggtggcatactctgaattccttgatgtgtaagatatattcacaggttctagagattaggacatcgacagctttcgtggggagatattctgcctacaaactatgcatttaaaattcattttctcctttaagggattttattggtataaatatataatctatgaagaacttatgaaataagttttaatgctctagacctctcaaataataacttttaattattagactaataaacgtagtttcttgaatgctagaaatatgattttcaaaaataatatggggtgtaacatctaatgtgactaacttttcacaatgtattaagatgtaatttaagcttcgtatcacatgtgtaggggttgctacatggtgggtttactatatatgtacctgattcttttttgataggtctactggtccaaaggcaagaatgaagagttctttctgtattatttttgaatactagatttcatcttaatgacttcactccttttccttttagctctctaaatttttcttgtggggctggttttatgctcatttgagcattcacatgttcattcagccagagcttaatttaggaccaatcctttctctaaaggaaatgtaagcaatcctaagctagtaactaagctggttgttatagtctcattttacattccaattctaatgtctttctttatttcttatgaccaaacctttttctagtagttcattttcagtatcccgtctgatttactaccatatctttgtgtagaaaaaactgctgctaaaacttaggcctcatggctggttttttatttttattttttttcttggccaacttaatcttgctaattctgattgcttgcatttccattcactggatgcttatcattctcttaagtgatggtaatttctagtctggcttttcttgcttactgacaaaaccttggttctg

SEQ ID NO: 14755 - DNA, 1639 bp, Homo sapiens
tgtctatgtgcctgtttttgtgccagtaccatgctgttttgattactgtaggcttgttggagattttcaaatcaggcaatatgatgcatctagctttgtgctttttgctcaagattgttttcctatttaaggtctttggtcgttccatgtgaattttaggatttttctaaatctgtgaaaaatgccattggaattttgacagtggttacgttgaatctgtagatcactttggatagtatggacattttaccagaatttttacaattcatgattactgggtatctctcaatttttctgtgtcttaaatttttttgtgtgcgtgtttcgtacttttcagtgtgcagatttttcaattccttggttaaatttattcctctgtgtgtgtgtgtgtgtgtgtgtgtatacgtctgtttttgtagctatggtaaatggtattgttttttgatttttttcagatattttgttgttagtgtatagaaatgctactgatatttgtacgtggttttggatcttaaaactttactgaatctttggttagttttaacttttttttttgtagagtttagggttttctatacataagatgctgtcagcaaccaaagacaatataacttcttcctttccaattttgatgttttcatttccttttttgcctaatttctctaacaaagacttccattaactacgttgaatagaagtcgtgagagtgggtatgcttgtctagttcctgatcagagaagaaaagctttcaactttctactgttgtgtatgatgttagctgcacacttttcatatatggtctttattgtgttgtggtgcatccttttataacgcattgttttattttccctttgccttcttctttgacacactggttattgaataacctgttgcttaatttccacatagttgtggtttcctaccacatttcatatcattgtggttggaaataataaatgataccatttggatcttcttaaatgtattgaaacttattttgtgggctaacatattacctattatggaatgtttggtgtgcacttgaaaagaatgtggattctgctgcttttggaaggaatattctgtgtatatctgtgaggtccaatttggtccatagtgctgtttgattctgttgtttcattattgattttctcactggatgttctctttattgctgaagctgggatatagatattttctactgttattgttttgctgtctatttctccatcagtcctggtagtatttgtttacatatttaggtggtctgatgttgggtgcatataaacttacaattgttatattttcttgatgaactgaccactttctaattatataataaccttttttttttttttttttctgagacggagtctcgctctgttgcccaggctggagcacagtggtgcgatcttggctcattgcaacctctgcctcttgggttcaagtgattctcctgcctcagccttctgagtagctgggactacaggcaggcgcctgccaccacgcacggctaatttttgtatttttggtagagacggggtttcaccatgttggccaggatggtctcgatatcttgaccttgtgatccacctgcattaccctcccaaagtgctgggattacaggcgtgagccacca

SEQ ID NO: 14756 - DNA, 1764 bp, Homo sapiens
tagcccatttacatttaaggttagtattgttatgtgtgaatttgatcctgtcattatgatgttagctggttattttgctcgttagttgatgcagtttcttcctagccttgatggtctttacagtttggcatgtgtttgcagtgggtggtaccagttgttcctttccatatttagtgcttccttcaggagctcttgtagggcaggcttggtggtgacaacatatctcagcatttgcttatctgtaaaggattttatttctccttcacttatgaagcttagtttggctggatatgaaattctgggttgaaaattcttttctttaagaatattgaatattggcccccactctcttctggcttgtagagtttctgcaacgaaagcatttctaagagaagtttatagcaataaacacacagatcaaaaataagaaagatcccactaaaacagtctaatgctgaacctcaaaggactagaaaaaacaacaatataaatccctagtttatagtagcaaagaaaaaaacaaaggtcagaacagaaataagtgaaatagagactgtaaaacaataggaaagatgaacaaaacagaattgattttttcagaagataaacagttgacaaacttttaactaagaaaaatgacagaagactgaaatatataaaataaaaaatgaaagagtaggcaatacaggagataccacagaaatacagatgacaagagactactgtgaacagttatacacaaacaaattacataacctaaaacacatggatgagatcctggaaatgtacaactaccaagaatgaatcatgaagaaatagaaaagctttacataataacaagtaaggagattaagtcaataataaaaaatagctcttatgtgaaaaagttcaggacttgatggtttcacatctgaactttacaaacatttaaagaagaagtaataccaatgcttctgaaattcttccaaaaaattgaggagtagataaatctttcaaactattttaagaggcctgtatgaccctgataccatagacaaacaagtatattataagaaaaaattaccagccaatattcctgataaacagatgcagatattctcaataaaatactagcaaattaaattcagtaacacattataaggatctgttgtcatgatcaagttggatttatttctgggatgcaagtttggttcaacttatgcaaatcagtggaggtcatacactacattaacaaaaagaaggacaaaaatatggctatctgaatagatgcagaagaggcatttgacaaaatctaaaatattaagtaaagaagattatattagtccattctgacattactataaagaactgtaggagagcagccccagtgcttatagataaaactcccatctccctaggacagagcacctgggggaatgggcggctctgggtgcagcttcggcagacttaaatgttcctgcctgccagctctgaagagagcagcagatcccccagcacagcattcgagctctgctaagggatggactgcctcctcaagtgggtccctgaccctcatgcctcctgactgggagacacctcccagcaagggttgacagacacctcatacaggagagctccgggtggcatctgccaggtgcccctctgggacgaagcttccagaggaaggaacaggtagcaatctttgctgttctgcagcctccgctggtgatacctaggcaaacagggtctggagtggacctccagcaaactagagcagaccttcag

SEQ ID NO: 14757 - DNA, 1035 bp, Homo sapiens
gaacttgaaagtaagaaaacaatctgatataaaaacatgcaaaggacctatataaacatttttgaaaataagacatataattggccaacaggtttatgaaaaagtgatgaacattactgatcatcaggaaaatgcaaattataactctaatgagatactgtcttatagctgttagagtggctactttaaaaaagaccgaaggtaagtattagcaaggttatggagaaaagagaacccttgaagactgttggttgggttgtaaattagtattacagccataattgtaaacagtatggaggtatctcaaaaataagaagtagaactatcatgtcatccaacaattttactatttagtgtatgtccaaaggaaatcatatcagtatctcaaagagatgcctgtatttctgtcacggcatccttggagtgttacttttctagctgggaacctctgtggctggtattgcctttgtctgaattttgcttgggcctgcttggcttgttctgcctactctgcctggcaggatacactctgctcgcactaacagcctgccaagggtgagccaggtacggagtggtgaggggtgtgtgagttagcgtgtgatctggccactgcacacagccaggcacactagttgtggtgtggtggacagctccaggtgccggcaccctgcaaggctgtggctcaatgaggcttactgcaagcagcttccatggctgccactggggtaggcagtggtgcctggaagcttggagacttcaggaactgcagagccccattgagggtgtcacagctctggcttggggagctcttaagtctgggctccctgaagtgctacagctcttctctccttcttgtcacctgcaacgtggcaagcaaggggcgtgtttcagccctgtttgtgttactgctctttcagtcgtgccgttccgcaggtcctgagttcttgtcctgtgtccaggaagaatgagttatgtggacaagtggagggtgaacaaggtgaagagatcctttattgagtgacagaacagcttaaa

SEQ ID NO: 14758 - DNA, 1072 bp, Homo sapiens
taactgataccaagacatgttgtttacccttaggagctatttctatctaaaagcgttaaaggtgttttgctcaaataactaaatttaaggtagtttgaaataagtagcataagtgtagtgctaccaagatgtagtggatattcagagggaagattattttggagaccacggaaaggctttaggtgatggtttctaaatggaggcttttagaatcaataagatttcatcaagttggcttatgaggatgtaggagatgaactatttcagaaggtactcattttttacatcaaatacgttcaatgattctagtcttttgggaataggaaagtgatggtgaaggggcaacctctttagttttcagttttcgggattcatatactcactctatgaccattttttccagtactatttaaaaatttattctgcctttgtaatactgggaactaaagcatagcaccattaattggaagtcttaaagatgaacaaggcaatgttttaatgtaaatgtatgattttcttattatggaagaagaaaaaccaataatagattgacatttgtgcaataggactgcaaatagtgggtgttttgtgggagaaaaaattgtttcccaattttttgggaaaaattcaagtaaatattaaaaattgctgaaatacaaagattttcccccatatacaatacttttgtaatatactcatcatgtttttcaatgcatctcattagccatacctcttaactgcattgtaaaaaccaaaaaattaagagggaatattttaaaccaaatattctaacttcaataggcatcatagtgattatcatttcagatttggtgtccttgtaactgggctgatttatcataggtggtggatgtgtaaacttacctgtgtatgatcttgttgagggcaagaattgtggcttttcattttttgcgtttctgataaccagcaaagttcctatcacatagaaagccctcaggaaatgttactgcctacctaaatgaatactccaaaaccctttatgactaataatttctatgtaaatattgtagattgtgttgatcagtgttcttcc

SEQ ID NO: 14759 - DNA, 1059 bp, Homo sapiens
atagatatttgtatgcatatgtatgtgtacgcattcgggtatgaatagaaatccacaaacctaactgaatagttgctttgcagacacttggttatgaaacactatccactgaccgaaatattttttctggctataattttggagtataattaaaatataaacttgtaagttcctctttttaaaaagatactttagaaaaacagattttactcttttcattagaaaaatattccaatatgtaacagtatatatactcagaaatgcatatgtctgatttaaaatgatttattctttagttttaagcctatgtatatattttaaaaataatttcttattttaggttcgggggtacatgtacagatttgttacatgggtatattgcatgatgctgaggtttgggatatagatgatcctgtcacccaggtactgagcataatatctgataggtagtttttcagcccatttccccctccctcccccctccctcctttagacaactctaaatgtctattgttctcatctttctgtccatatgtattccgttatttaggtcacgcttacaagtgagaacatacagtatttggttttctgttcctgtgttaattaggataatggcctccagccacatccatgttgctgcaaaggacacatttcagtctttttatggctgcgtagtattccatggtgtatatgtgccacatttgctttatcgactctaccatcgatgggcacctaggttgattccatatctttgcgatcgtgaatagtgatgcagtgaacatatcggtgcatatgtctttttttaggataatttatttgcctttgggtatatacccagtaatgggatggctgggtcaaacagtagtcctgttgtaagtttttgagacatctctcaactgctttccacagtggctgaactaacttgcattcccaccaagagtgtatatgtgttcccttttctccccaggcttgtcagcatttattattttttgactttttaataatcaccattctgactggtgtaagatggtatattgttgtagttttgatttgcatttc

SEQ ID NO: 14760 - DNA, 1104 bp, Homo sapiens
ggctaaactcacctagaaggatttttttctgaagacaggccaagataatcagacatctcctggggatggtggggaatgaagaatgcaattagatatccagggtgatcagttatcaatgtttttgctgtactgacttagcagagttttttgctaaaactgaattttacaagaaagtgcacagatgggcctaggagaaggcttggtcaagcaaataatcttcatcagttataaagcccttcacataataaaagcggctttaataattgtgaatttaaccttgcatagaaatttttcaaataagaaactaatatacttcaagaatatgcaggggattttttactagtaatttagttacatgtttccctctttttgttcgttagaagttacatgagggcagttatgacttctgttcactaaggttaattccattgaatacatacaaagcattattttcaaggccaaggccattggtagtggtggtaggggctggaacaaagaaatttattagataagatacccttaacactgatatacgtccattttgttttaagagcatttctgtagagacaaaaaagcatagaaaatatactcattgctatttggagtactttgtggtaaatctggaatccttgcttttgcttttatagtagttccataacaaggttatttttaaaacatcatccaaaactgaaatttcaacattaattggattggcacttctagttgtaaatcagcacttccagtcataaatcttgaggaaattggtatcagacctcatgatattctgttttcagtaggttagttttctcagcattattttgtgctaaggagaagaatctctgtgttttaaaccttttcaaagctatgtaacttgatatttgctcttttaaaatcttagccatcaaataccagctctactgcctgtgtccgtggctttccattctccctatcattgccctgttagggcatcattatcagttagagagacttgtattgcttccatactattcttcactgctagatgaaagtttctaaagtttagctcttatcctgtcattacaaacttgaatatgtagaataattccccattgactaatgtgtttt

SEQ ID NO: 14761 - DNA, 1031 bp, Homo sapiens
cagtgcctggccagggctgtcaaatcttttttttttttttgagacagagtctccctctgtcgcccaggctagagtgcaatggcacgatctcagctcactgccagctccaccccctgggttcacaccattctcctgcctcagtctcctgagtagctgggactacaggcacccgccaccatgcccagctaattttttgtattttagtagagacggggtttcaccatgttagccaggatggtctcgatctcctgaccttgtgatccaccgcctcggcctcccaaaatgctgggattacaggcgtgagccaccgcacccagccggctgtgaaatcttaaagctccaaaatgatctcctttgactccatatctcatgtccgggtcatgctgatgcaagaggtgggttctcatggtctgggcagctccacccctgtgtctctgcaggatacagcctccatcccagctgctttcattggctagtagtgactgtctgtggcttttccaggcacacagtgctgtcggtggatctgccattatggggtctggaggatggtggccctttctcacagttccactaggttggagccccagtaggaactccatgtgggtgattcaaccccacatttcttttctgcactgccctagcagaggttcttcatgagcgccccacccctgcagcaaacttctgcctggacatccaggtatttacgtacatcctgtgaaatccaggtggaggctcccaaacctcagttcttgacttctatgcacttgcaggctcaacaccacatgaaagctgccaaggcctggggcttgaaccctctgaacgcatggcctgagcttatactggcccctttcagtcatggctggagcagctgggatgcagggcaccacctttctggactgcacacaccatggggacccttggcccggcccacaaaaccatgttttcctcctaggcctttgagcctgtgatgggaggggctgccatgaagacctgtgacatgtcctggagacattttccccattgtctagggg

SEQ ID NO: 14762 - DNA, 1024 bp, Homo sapiens
gtggtaaaaatagcaagagaaatagaattagaaggagagccggaagatgtgactgaatttctgcaatctcatgataaaattttcacagatgaggagctttttcttatggataatcaaagaaaggtgttccttgaggtggaatctactcctggtgaagatgctgtgaatattattggaatgacaaaaaaggatttagaatatgacataaacttacttgataaaacagtggcaggatctgtgaggattgactcttccaattttgaaaaaaattctgtgaataaaatgctattaaatagcattacatggtacagagaagtattttgtcaaaggaagagtcaacctgtggggcaacttcattgttatctttctgttgcaaccaccaccatgatgagttagcagccatcagcatcaaagtaggaccctccactaacaaaaactttacatctcattgaagggttagatggtcattagcattttttgcaataagatcttttaaaatcaaggtatgtacattttgaaaacgtaatcctattgtacatttaataaactgtagtatagcataaacataactttatatatgcactggaaaaccaaaaagttgtgagacttattttgtcataatattcattgtattgtggtggcctagtactgaacatgcagtacctccaaggtgtgcttgtaatttgtttcttttctgtttttctctttgtcagtcttagaggcagctttttttttttaagatccagctttttgtttcattgttttattattttgctgtttttaatgttattggtttgtgctctttattatttccttctttctgcttgatttagttttattatgcttgtcaatttctagattttatgcttatattattgatttgagacttttactgttttcaaaaaaatgcacttattgctatattgtccgtatagcactacttttcctctattccaaaatttttgatatatcttattttcatattttttttcagtttacagagtgtgtgtgtgtgtttgtgtgc

SEQ ID NO: 14763 - DNA, 1028 bp, Homo sapiens
gcttttattggatgaagtcatcaatagatgagagtatatcaaattgattattagtgctgttgaattcagctatatccttattgatttttttcttgtgagatttgttcatttatgatagaggattgttagtctccaactgtaacaggggtttcatctattactccttgcacttctatcagtttttgcctcatgtattttaatgttccgttgttaggtgtatatatgctaaggactgttatgtattcttggaaaattcatccctttatcataatatattgcccctctttattcctgaaaacttttcttgctttgaaatctgctctgtctgaaattaatacgctaccttcactttcttttgatcagtgttagcatggcatttctttctccatcctttcacttttatctgtaagtatttttaaatttgaagtggattttttggtagaaaatgtataattggaccttatttttttaatctaccctgacaatctctgttttttaattggtgcattcggaccattgacattcaacatcgttattgatgtaggtgaattaatatctaccatattttaaacttttttatttgttgcctttgacctttgttcttgttttgtctcccactcttctaccttttgtgtttctaattgaacattttatgtaatttgaatttctcttttgtcatagcattatcagttaggcctctgtttttaatttttatttttattatttttttgagacagagtctggctctgtctcccgggctggagtacagtggcgcgatctctgctcactgcaacctccgcctcctgggttcaagcgattctcctgcctcagcctccctagtagctgggactaccagtgcgtgccaccacgcccgggtaattttttgtatttttagtagagatggggtttcaccgtgttaaccaggatggtcttgatctcctgacctcatgatccgcccacctcggcctcccaaagtgccggaaatacaggtgtgagccaccacgccctgcctgtttttattttttaat

SEQ ID NO: 14764 - DNA, 1021 bp, Homo sapiens
caaaatagacaaatagatcaaggaaaaagaatagagagcccagaaatagacccatataaatatagttgctgtggtctgaatgtatatatctgcccagaattcatatgttgaagcttaacccccgatgtgagggcgtttgaaggatgaggcctttgggaggtgatttagtcatgagggcagagacctcatgaattggattagtgtccctaataaaagaggcctgagacaggcccctttcccctaccaccatatgcgattatagccagaagacagacatctatcaatcaggaagtaggccttcacctgaatttcttggcaccttgatcttggacttccagacctgcagaacagtgagaaataaacttcttttgtttatcagccacccagtccatggtattttttaaatagcagctcaaatagacttaagacaatgttcaactggtctttgaaaaaggaataaacaaaatacaatggagcaaagatagtttttttaacaaatggtgctggaacacctggacatctgcatgctttaaaaaattgaatctggacgtagaccttacacccttaaaaaagttaattcaaagtggatcataggactacatataaaacacaaaactataaaactgccagacaataatataggagaaagcctaggtaaccttgggtatggcagtgattttcagctctaaaggtaccatccacaaaagaaaatattggtaagctgggcttcattaaaaactctgctctacaaacacaatgccatgaaatgaaaagagaagccacagactgggagaaatattttcaaaagacgcatctgataatgtactattacttaaaaatatacaagaactcctaaaactcagcaataagaaaatgaacaaccctaggccgagcgcagtggctcacgcctgtaatcccaacactttgggaggccaaggcaggtggatcacttaaggtcaggagttcatgaccaagcctggccaacttggtgaaaccccatctctaccaaaaatacaaaaat

SEQ ID NO: 14765 - DNA, 2039 bp, Homo sapiens
aatgaaccctaatgtaaactgtggactttgggtgataatgatgtgtcagtggaggtttatcagtggtaataaatgtgccacttcgttggggtatgttgataatgggagaagctatgcatattgcagtacaagggatatatgggaaattatatggaaaaatttctcacttcctaaagatgctatgaatttctttttcctttaaagaagtttatgcagatttgtggttatctcataaacaaaattaaccataaaagagtaatcctcattagaaaaatatttaagtcacgtttttaaagtctgctcaattttgctgtaaacctgaaactaatctaaaaatgtaaagttttgttttactatccattagccttgagtcttccaattctggaaagatggagtaaatgtactttggtctattcctcatgctaagtacaactgaaagtcctaagaaataatgtggtggtgtgttcttgtttttgtgtgtgtgcctcatatattttatacttggagctgaagcagctgacaacctagaaatatcgaaagacactgacaaatagcttcaacaaaagctttctctgtttagccaaagggcgtagaaaccataccaagtcagaaagcttatactataaccaccctactcctgccaaacactacagaaaaactgtggtcctacaccaacccatgccagcaaaagttgagtggggagcctggattctcaccctcactagactgtgatgaagtaccccaatttgtggtcccctgaaagggtctcagaacctctggtattcaagatcacagctttgagactttaagctttactactaaatgagttaaatttctcacttcctaaagatgctatgaatttattttgtttttccttttaagaaatgtatgtagatttgtggtttatcacgtaaaattaaccataaaagagtagtcctcattagaaaaatatttaagtcactttttaaaaaagtctgaatagttgaagtttatttttcaccaagtgataatttatttttgtcaattttgtgggaaagtaatgacttattatctgtttataaacaaaatttctacacactaatattttacatttgaatacatgtgtaaatttctttactcctatatttgtccctcacaggaatccacatcttcacctcatcttttaataagtattagtatgttttgttgactactgaggcattttatagttaatctacttaaatattagttggatttataccaaaaagttatctaaaataatattgtcaatgatgaattgtattaaacaaatgtgtttgactactctgtaattcagcatttataatttgccttagttatgtagtacgttgtgtgacttcacagtatcaggttttgtgaacttctgtaagcatcctttctgagaaagccaatgggaaaagtataattttttactacttgtaattttggataattgttgtatataagaatgtttactattaaaggcacaagatgaaatgtagactcaacagtattgaatgatgttaagaacaaattagattggagatactggtgtagtgtttttctctggcttctgtcatgtgaactttcattcttatattggatagatggtggatatttaaaagtatggtctaatctaggggttggcaaactatgatccacaggtcaaatctggcctgctacttgccttttttttttttcttttttcttttttcttttcttttttttttgagatgaggtctacctctttcactcaggctggagtgcagtggtgcaatcatggcttactgctgcttctgcctcccaggttccagtgatcatctcacttcagcttcccaagtagctgggactacaggcatgtgccaccacagctggctactttttacaattattatttattgtagagagaggatctctccatgttgcccaggctggtctcaaactcctgggcataagagatcctcctgcctcagcctcccaaagtgctgggaatgagccactgtgcccagcctgctgcctggttttataaataatattttcat

SEQ ID NO: 14766 - DNA, 1050 bp, Homo sapiens
agagcagtaatttactgagtctgagagattgccagatttgcttggatttgccagatcctgttttagaagtatgccaaagtgtgaatattttatatttttaaatataaaataagtatttctagttacatagttttcacatgacatgctggactgtagattatatggttgcatgtttttcttccactaaacttgcatttagcagcaagtacggagctcaaaagtccctatcatcaatattttatattgtaaaactaattttagtagaatattaagcttttaaattattaaacatgtgaagaactcttaatagtctattatacataagtattaaaacataagagttcagaccagtctgggtatttagaaaaatgagtaatttaaaaaatggatccaaagatattaaaaagaagataatacagtattataatgtgtcaggagatattcaggttaaaataatcatatcttagataatttgccaatgagattaatataatgcctctttctgatgaccacgtttttgttagggcctttatttgaacagtgttcctacagctttcaataactaaaagattagcagccttttctaaacaaccattcttttaaacataaaatagcactattaaacaggattagaactctgtattagattgaaagcaccctgaaatgaagagccccatctatcacattaagcctgtactgtagtccccttttatccacaggggataaattccaaaactgccagtgaatggctgaaaccacagatactactgaacccaagtactgcgataccacaatagctgatctgataacccagatggctggtaagtgaataacaagtgggtagcctatacaatgtgaattcactggacaaagggatgattcatgtcccagtgggatggagtgggaaggtgtaaaatttcatcatactcctcagactggcacataatttaaaacctaagtattatttatgtctggaagtctttatttaatatttcagatcacagttgaccttggaaagcaaaactgaagataaggaaagactactctatt

SEQ ID NO: 14767 - DNA, 1036 bp, Homo sapiens
actttgctgaattcttttatcagttctaggagctttctggaggagtctttagggtttttgaggtaaacgatcatatcatcagcaaacagtgacattttgacttcctcttcaactatttggattccgttttttactttctcttgtctgattaatgtggctaggacttcgtggtgagagtgggtatccttgtcttgttccagttcttagagggaatgctttcaacttttccccattcagtgttatgtcggctgtgggtttgtcatagatggcttttattacattgaggtgtgtcccttgtatgcccattttgctgagagttttaatcataaaagttgctggattttgtcaaatgctttttttgcatctattgagatgataatgtgatttttgtttttaattctttttatgtgaggtatcacatttattgacttgtgtatgttaaaccatccctgcatccctggtatgaaacccacttgatcatggtggattatgtttttgataatgttgttggatttggttagctagtatttcgttagggattttagcatcgatgttcttcagggatattggtctgtagttttcttttatggttatgtcctttcctggttttggtattagggtgatgttggcttcatagaatgaattagggttggttcccggtttctctatcttgtggaatagtatcaataggataggtataaattcttctttgaatgtctggtagaattcagctgtgaatctgtctggtcctggacttttttctgttgttaatttttaaattactgtttcagtcttgctgcttgttattggtctgttcagggtatgtattttttcctgatttaaggtaggagggttgtatctttccagggaattatccatctcttctaggtgttctagtttatgcacattaaggtgtccgtagtagccttgaatgatcttttatatttctgtggtgtcagttgtagtatctcccgtttcatttcttattaagcttatttggattttttgtctccttttcttggttaatcttgctaat

SEQ ID NO: 14768 - DNA, 1063 bp, Homo sapiens
gaaataatctattaagtctcatgcacagaagagacatagttcaggaggtattttggatgaaaattgccaaagatattgtagctgaatcccaaacctgagaaatattcttggttttttagtatttttccttcatcaccaccgccattgccaccatccctcttcagtctagtccattaccaaatcccattagctccttctccaaaataacatcaaatccaactatattatctattctaccatcaccctggtttaagccaacatcatctctaacttgaacttgcagtatttctaaatatctgtttccattcctgtcatcctttaatccattctctatatagcagccagagaaaccttttattaaccgtaaatcagaccatgacatttttcttcttaaaaccttggtggctctctataacattcagaatgaagtccagtttattcaggataggctactagaccctggttcctgaccttctctccaatctcatctcatcaccattttattatttatttatttttctcctcactctcttcctacaagctatgctggctgccttttcattgcaagaataaaccaagctccatactattttggtgcctttcagtttttgctgtcctgtacctagaatgtttttctccagttttttacttatttggctcatcgatgttaaaatcagatcacctcttcagataggccttctccaataaccttgtctaaagtgacctcaagttattgtattaacttattttctccctcatttaattttatctccttaagttctgtgaaagctatgaattcattccatttatctttgttgtagctatctttgttggcacttaggtgctcagtaaaaatactttttatgtggatatttccccagtcttcttagtaaagtctgaactataatgaaggatcataatcatagcaaacatttatgtagtctccatataaattaataattgacagttgatgatttctgaaaaccataatccgtattcactcagtaagtgagtattttatattatagctgaaaatagcttacttttaaaggtataaagtaaa

SEQ ID NO: 14769 - DNA, 1040 bp, Homo sapiens
aagatgttattagagacaaatacaaaaaaattctggctctctggattggactctgtgtagattgattccatctgtaaaaggtgcctcatctttgacagtagatattttagtcactgttacttgttagagattcaatatagcaatgcaatttttttttatttacttataaggatttatgataccaagttgtatttgacatttggattaaatcctgaggggtaaggaagattcgtccctgtggtagaagtttctaaagtcttaagtcaaatgaattctacttacactttagttagaaggccatttaagacaaacgtgccttaaaagatcaagtttttcagtgttaaaattctacatctcaatataggttatgaatactacattaagttcatttggttatgaattcattattttcaccttttgctgctattgttatacttcaactctcttatttttacaactttttattttgaaaactttcaaactttaaaaaaatgttgggacaacagtataatgaacagctgcactctgcacacctagattctcatgattgagaatacatgctgtatctatttatatctctgtcttgccttctctctatatataacttaaaaactgtttcagacatagtgacactttacccctgaatacttcagcatgtttccctaaaattaaggacattgttcaccgtactcttatcatatgctggaaatgttaacattgagacaataatatcataaaatataacatacaaacctatttttagatttctccaattatctcaaaatattatttatagattttttgattcagtattctgtgagggattataaatgataatttgatagtgatatgtcttcaccattttgttatatattgtcagaaatttgatgtagaataattcatatgttagcaactgtggaaagtgttgccaattatgaaaaaaatgtaaatttagataatttagaaatagtccactaagacttttattatatagttgattatattaattaaagtaacttgaattccttgacagtttactt

SEQ ID NO: 14770 - DNA, 1082 bp, Homo sapiens
ccctttttcaccctagatgtaaccactattctgacttctttctttttttttttttttgatacggagtctctgtcgcccgggcttgagtgcagtggcacgatctcagcacactgcaacctctacctccccggttcaagcaattctcctgcctcagcttcctgagtagctgggactacaggcatgcgccaccacacccagctaatttttgtatttttagtagagacagggttttgctatgtgggccaggctggtctcgaacctcctgacctgaagtgatccacctgcctcggcctcccaaagtgctgggattacagacgtgagccaccgcgcccagcctactattatgatttttatcattatcaattccttgcttttgttccgttttaccaactatatacacatccctaaacattacaattcatgtttgctctctttgaacttcatatgaattaaatcatattgtatgcagtttttttgtgtcttgcttttttatcaaccgtttttgtaggattcattcatgttattgactgtaactaaggtctttgtttaattgtaaaatacaccactgtaccacagatcactgagacatcctactgttgaatatttagcttgtttccatttgggacgattatgaaaagtgatgctataaacattattataagagcatcctggtactcatgtataagtttctctgaagtgtatactgaagagtggaattcctgggtattaagaaacatgtattttcaactttcctgactgaaatctcacttttctaaagtagttatgccagtttacactaccatcttgaatgcatttattttaaatagatatatttaaatattctttgtctgcaatgtatattactatagattttatttatatgtgaggtgactaaattgatacaatatttttaaaatgtgtctttgtttttccagcccatgggaaaaatcctgagggataattcttaatgaaaaagtccatttttgccccactggtttgaattttgcctcatgtatctcatactaaattttccaatttaggacatatgcatacttaagtctgtcttttcctgaacttctgtt

SEQ ID NO: 14771 - DNA, 1896 bp, Homo sapiens
ctagtaagtgagagcaatgtttttctttctgtgcctcgcttatttcacttaacataatgacatccagttccactgatgttgttgcaaatgactgaatctcattcttttttatggctgaattatactccactgtatataagaaccacattatctattaatctattgatggacacaggttgcttccaaatcttagctattgtgaacacagctgcaacaaacatgggagtgcaaatatctattcaatatattgtttccttttttttttcagtatatacccaccagtatgctaatgctacaactaatgctgcagtaggatttctggaacatatgccagcttaattttttgtttttaaagaaacctccaaactattcttcatagagtttgtaataatttacattcccaccagtagtgtacaagggttcccttttcttcacattctcaccagcatttcttattgcctgtccttttgataaaagccattttacttggggtgagatcatattatagttttgattttcatttctctgatggttaattatgttgagcaccttttcatatgcctatttgccatttatatcaaatattttgcctatttttaaattgaatagatttttttcctgtacagttgttgagctccttatatattctggtcattaatcccttgtccgatgggtagcttgcaaatattttctccattctgtgggttgtctcttcactctattgattgacctttgctgtgcaaaagacatttaatgtgatatactcctatttgtccatttttgctttggttacctatgcttgtggagtgttactcaagaaatctttgcccagatcaatgtcctggagagtttcccctatgttttcttgtagtttcatagtttgaggtcttacatttaattatttaatgcatttttatttgatttttgtatatggtgagacataggtatctagttcctttttttttttttttttttttgcataatggatattcagttttcccagcaccattcattgaagaaagagtttttttccagtgtgtgttcttggcatctttgttgaaaataagttcactgtaggtatgtggatttgtttctgggttctctattctgttccattaacctaggtgtctgtttttatgtcagtatcatgatgtttgggttattatagctttgtaatataatttggagtcaggtaatatgatttcttccagttttgttctttttccttaggatagctgtggctattctgggttttctgtggttccatataaattttaggatagttttttccatttctgtatagagtaacattagtattttgatagggattgtattaaatctgtagattgctttgggtactatgaacattttaacaatagttactcttctaatccatgaacatggaatatgtttatattttttatctctttattttattagtgtatcatagttttcattaatctttcattaagatcttttgctctttggttaaattaattcctaagtatttacttttgtgtgtggctattgtaaatggggttatttttatttatttttcagattgttcactgttggcagataaaaatgctactgatttttgtatgttgattttgtatcctgtaacttcactgaatttatcagttctaatagttttcttgtgtagtctttaggtttttccacatataatgtcatatcatctgcaaacaaggaaaattttacttcttccctttcagtttggattttctttatatatttctcttgtctgactggtctatctagaacagccattactatgttgagtaacactgatgacaatgggcatactggtcttctaccagatcttagaggaagggctttcagtttttccccattcattatgatactagctgtgggtct

SEQ ID NO: 14772 - DNA, 1029 bp, Homo sapiens
agtccctagactgcacatagcacaaggaccctggtcccggcccataaaaccactttttcctcttagtcctccagacctgtgatgggaggggctgctgcaaaggtctctgacagtccttggagacattttccccattttcttggggattaacattcggctccttgttactcatgcagatttctgcagccagcttgaatttctcctcagaaattcttttctatttcttttctattgcattttcttttctattgcattgtcaggctgcaaattttccaaacttttacactctgcttcccttataaaactgaatgcctttaacagcacccaagtcacccattgaatgctttgttgcttagaaatttcttccaccagctatcctaaatcatctctctcaagttcaaagttattgaactctctagggcagagtcaaaatgctgccagtctctttgcaaaaacataacaagagtcacctttgctccagttcccaagaagttcctcatctccatctgagactgcctcatcctggactttattgtccatattgctatcagcattttgggcaaagccattccacaagtctttaggaagttccaaactttcccacatttttctgtcttctttttagccctccaaattgttccaacccctacctgttacccagttccaaagttcctttcacatttttgggtatctacagcagtgccccactctactggtaccaatttactgaattagtctgttttcacactattgataaagacatacccgagactcggcaatttacaaaaacattaaaaaaagagagacgtttattggacttacagtttcacatggctgggaggcctcacaatcatggtggaaggcaaggaagagcaagtcacatcttacgtagatggcagcaggcaaagagagagtttgtgcagggaagattccctttttacatcagatctcgtgagacttattcactatcacaagaacagcacaggaaaatcctgcccccatgattcaattacctcccaccaggtccct

SEQ ID NO: 14773 - DNA, 1123 bp, Homo sapiens
ctttctgtctttataaatttgcctgttctagatacctcatataagtggaatcataccagttttgtctttcagtgtctagcttatttcacttagcaaaatgttttcagggttcatttatattatatcatgtattagaatttcatccctttttaactctgaccattattccactgtatgtatataccacaacttttttatcagttcacctgttggtggacactgggttgttttcagcttttagcttttacaaataatgctcctacaaacattggcatgcaagtatctgtttttcttttggttatataactagaaatggattcaatagcatttaatactttagtccaagaagaaattaaattaatagcaaagagatcagggaaaccacataattaatatgaaagattaataagtccaagatatgatattaggagcagaagaaattataaacttttagaaaggctacagaaggccaaatgataaaatttagaagactattctatgaataaaagggagaatgaagttaaaatgacacagatcttggatgattgtaagaaaacaaaaatgattctgaagaaagttaaattttaaaaaaataaccaacttaaggacagtatgatggcacatctttgaaatggaataatgtgggcttttatagaggagagaggtaggcatttgaaaggcaaggtttaaatgaagatgactaagatgagggaaccaggtcatgtttagaggaaccagcaatgggaacaggaattcatttcaatccagagatccttcatcctgtatactcagccttctaccactcatagacatttttctaaaaagattgctaggctcgaaccccagagattctgattcagtaggtttggaattcggtttaggtaatgtgcacatacatgcctctgtgtgtgtgtgtgtgtgtgtgtgtgtgtgtgtgtgtgtgtctgtgtgcgtgcgcacacgtgaacgtgtgtctgtgtgtgtgttttaatccactgatgaaacacaatatgagttaaattgaactctgtaccgtagtggcctagaccttataagaatttaaaaagttaaagagaattgacccttgtcttcaagcagtttaaaactgcagtagttaaaaaat

SEQ ID NO: 14774 - DNA, 1040 bp, Homo sapiens
tagtgttctttttttaaaccattacttatattacctacaccaatgaggtcaggggatcccgtttttcctatggaattaagtagtagttttcaaacataaaagaactctttcttgtatacaagcaataacatcaggaaagaattaaacttcattctcttgctaattcttttgtaataaaattttaattcggtaaacataataatatgcttatttgccaagtcccatattaagcattagggatcctaaggttagaaagaaaaataagaaatggtcctctccttaaggatcccacagtttaaatggagaaattatttcttgcaactgttaagataattcttcaaattgaatgtagctttcttgatccagtatagaaatatcactttttgttatatcaaaaggttttcctgaattaatttttttctcccttttgtatcctcataattacctagcactggactgctgagtgaatggaaaattaattagcaggagctgattctaattactttggaatgagttgttcatctttatcctgaaggctttgaaaattaatacatataagcagcatgggagcaccttctggcttttctgtctgtgcattgctgatttaaccaagaatatatttataaactttggaacagacatagtagtttacattagttacagaaaaggggatatttccctgaatgttcattttttgtgcttctcaaagcctttttaaaaattattatttttataatagccatcattagattggttcttcctttctacagcctttctattttgtatgcacttctggctttgtacatgcttctgctatggaacatgtcatagtatattgtaattaattatttgcttgtctgtattacctagttagtagaaacttcttaaagacaggagctttatcttattcttttttacatcctcagcccctaaaacaaattctgacacatagtaagtactcaaaaaatgtatattgttgcagttactatggataaatcagtgttttaccatagttctatagcatgtttttttcaggtaaa

SEQ ID NO: 14775 - DNA, 1049 bp, Homo sapiens
acccagcccccctttcctaaactctggcaaccactaatctattttctagttcaatattttgccatttcaagaatgaatataattagaaccatacagtatgtagccttttgggattggtttcttccattaagcataatttcctggagattcgactaaattgttacatggatcaataattccttacattttattgttgagtagtattccatactatatatgcactacagtttgttcaaccattttctgttgaaggacatctgggttgtttacagtttgtaattatgatgaacattacaccaaacgatgcggtatctaggttccatggcagttgcaggttttctgtttaaatgaactgtcaaattattatccagagcaactgtatcattttacaatcacaccaacaatatatgagtgtgtctccacaccttgccagtatttggagttgtcactatttttattttagccattttgatagttttgtaaatagttttaatttgcatttccctaatgactagtaattttgagcatctgttcaggtgttttgcctattgtctgactgtgttttttagtttttttatccctgatttttgagagtttttatgtgttctagaaacctgtccttcgtcagatatgtggattgcaattgttttctcccagtcaatacattgtcttttttcctcttcacagtgtcattcacagagcaaaactacttaatttccatgaggtccaatttatcatctttttcttttagcagttgtgtttttttgatgtaaagtctaagcacccttcacctaggcaaaggtccaaagactttctcctgtgtttttttctaaaacttttataattttacattttacctttaaatccatttgagttgatttttttctaaggtgtgagtttaggttgaggtgttttttcgtttggttggttggttggtttttgtgtatgaacgaccacttgctccagtgctacttgtttaaaaaaaaaaaaaaaaaaaaaaaaagctacctttcctctgttgaatggcttttgcacctttgttgaaaatt

SEQ ID NO: 14776 - DNA, 1035 bp, Homo sapiens
ctatcttcatctgattttggtatcaagttaatactggcttcataaaatgagttgtgatattccctccacttttactctctggaagagtttatgtaaaatgtatattaatttttctttaaacatttcagagaattcactagtggaaccatctgtcctagagctttatttttctagagtttttttactataaattgaattttcttaaaagttacagggctatttatctattttatatatggttaatgtagtattttatgctttttgagaaatttgtccatctcatctaagttgtctaatttatgtatatagatttgctcctagtattctcttattgttattttctcgtcttgagagtctgtattaatacgcctgtttcattcctgatattggtaatttccatctttttttcagtcttgcttaagatatttccattttatttatcttttcaaagaacaagctttttgtttcattgactatctctgtttttctgttttaaatttcactgttatctgctctttattatttcattccttctccttgtttggggttcattttgctctttatctagttcttgagctggaagcttgttattgatttgagacttttctaatgtaaactttaggagcactgatttaggtgcattccatgaatttgatatgttatatttgcatttttattcatcttaatgtatctttttattttttgagatttttttcttttttttttaatctatctaacactaggtcttatttcttctatcaaacttcatatgtgcccatcaatcaacttctcatctttccctcctccccactacccttcctggcccctggtaacaaccaatctactacctatcctcatgagattcacttttttagcccccacattatgagggagaacttgcgacattcttccttctgtgcttgccttgtttcatttaacataatgacttttagttccatccatgttcctgcaaatgataggatttcattttttaatcagtgaataatgttccattgtatatagatactgcatttt

SEQ ID NO: 14777 - DNA, 1044 bp, Homo sapiens
tttatggattatccagttattttggctacgagcattgtgaggttttttttttaataatatatagattagaatcatcgagaaatccttttgaagtgtccattcagtgatccagtgagtgcttactaaaggctagtaagtatttaagttttgtgtgattttttttttatgaaaccaattggtgaaacaggcatttttaaatcattatatgttccttttcctttactctgaattaaaagagtaagaagtgccataaatttcaatcttaggagagaagcttatggcatttaaaatctaagctgattctgtcattctacatttggaaaatgttagcatttcatttttccatttgtttttaccttttttcctttttagtcattttgcttgtatagtttcatgttttcctgtcactatattcatagttgttatgtgttgtgcattagaagcatccattctacaccagtcctgctgttgtcatggcacacggtgaacagcccatccctggtctcatcaattattcccatcattcaacagatgaacgggtaagacaagaggcttttgcattaatggttttccaaatatgtattctacttcctctccttggagataggctgtaacatatggaagatgtgttgttttattctgatggattttcagccttgctttcttgtgaaagtgtgagtgccattgagtatatccatcaaggaatttaatagagtttctcctgtgactaaagtactctgctatcattaagattctgtcatttgtgacaatgaacttttatcaaatgacttgcaagaaagtcattgctcagaagttatttttgtcttaccaatttcatcagatatctttaaataaattgcctggcttaaaattacctcttaagagaatcactttgagtcttaaaatctagacagattggtcaagcaaatagttgatttgtattaaccttcctgttttgtcttatgattttgcatctcatttttttttcattcattgagctctcattacaaccattgcagagttgaattttgatataaattctgt

SEQ ID NO: 14778 - DNA, 1045 bp, Homo sapiens
aagacattcttattaggattgcaaataactatactgtcaagaaaagttaggaaattactaagagtttctgaatttggaggaagtcagaatcaaatattattttgaaatgtttcatattagtttaagaaatcagggtctactaaattgtgtgggttacatatagcttaaaaagaagaaaaagagcttcctcatgtatccagaaaatagaacatttaaaacaaccagtgtcaatactactccaaacaaataggaaaagaaatttccttctgtattcctttttcattctgtgttgattcagtcctgtgataattaattattattcaaataagccttggcttagcagtctgctttcatgaaactttctgcttctggcctgagagagttttagaaattctaactcagtccactgtttaggtccaaaagttgtccaagcagaagtctactcatgagtctattctttcaagtattagtactttgaagtatttggtacaattctttccatgaagcttttgaaactatctctgttgaacacacaaactctggcctatagcttaataagcataatcttcaggtaaacatcaaaatttgttcatagatgacagactattgttaattgtaaccaataatatcaaaatgcaagaggttaaaattctttccactgggggataactatttcaaaagagttttgatcagtatccccttaaactaaaaactcttgcaaatatggtcaaatgatttttgaccagggaaccaagaccattcagtggggaagacagtcttttcaaaaaatggtcctgggaaaactggatattcacatgcaaaagaattaatttgaacttttatctaacaccatatacaaaaattaattcaaaatggatcagagacctaaagctaagacccacaatacaactcttggagtcaaaactttatgacattggatttggcagtgattttcttggacatgacaccaaaggcactggcaacaacagcaaaaagtacacaaattagactgcatgggaattttaaatctttgcacatccaaaga

SEQ ID NO: 14779 - DNA, 1025 bp, Homo sapiens
cttggctcactgcaacctccacctcccaagttcaagtgattctcccgcctcagcctcccaagtacctgagattacaggtgcctgccaccacacccagctaatttttgtatttttagtagagacagtgtttcagcaggttggccaggctggtctcaaactccatacctcaggtgatccacacacctcagcttcccaaagtgctgggattacaggcgtgagccaccacgcctggccccatttagttaacttttgtgttgcttaatattgatgaacattttatttctttatgagtcctgtacgtttttcctttattccaatgtcactatctccaaagttattagaaacctgcatttgagagcacctgttagagtcctataggtgattataaaccatcttttgaaaaggatcaaaacaaaacaaaaattgtctgaataacaaaatgtccagggtagttacagttagaatcaccattgacagagaagtttggttatctttgtggtttataataacttgacataacaaccttaattatgattgatagcatatactttagacattagaatttttgaaatttcctacaattttgggacatatattagtattattccccaaaatatatcctaaagtagattaaacaccgtttggcaatcccatgtaactaaatatgccaaataatcctgtttacttcttttctagatgccccaggggacctctgtagcactcaaaaagccaggtatcaggaaaaacaattttgaaactgaagtttgattttgggaagcctattaaatatattagaggtttaaaacaactattgttatgaaatagaattccagattaccatgaattatttattttgccaaaatgatgactcagatactttaaaaaagcaaaaacttattatgaccctttacaaattttgcaaaagagcagattagtgccttaagagtatcttgtgctttcatttcaatgctcagttcactgaaaaaccatataatacctttttgaatttagtcaatatgtttaca

SEQ ID NO: 14780 - DNA, 1043 bp, Homo sapiens
atttttttcaagatttttacagtccttctaccacttgtttgaactttgagctttattttatctaattcaaaacaaccctttaacactaggcaagaatttacatttttatgccttttttataatcttttactaaaaacacatcttattagtcttacatgcctcacatgtaaatttatttccagtagtttgagttatatgttataatggtaactccttgaaattttttactttaatgtaaaacctgataagttgttttcattatgtgctaggtgctgccaaggcttaactccttccagcttaattaaagatgcggttagtactacatgtccctagccttaccatttatggagcaggcaagtcaaatagttctttaaacccaaaaagcagtttataaacttaaaacatttagcaaacctagcacctgacctgcatagtttagtccacctgtttatattttaatgacatctgctttttaccaatattctttaagggttgtttttatttctcaaagattaaagtcacatgaactgaaaggcaccacaacttttatcatccctttaaaaatttttttgatccaagcactatcttcctttaagccagttaattagagctctttttataggcatcacacacacaacacatatataactaaacagacaggcaaaagaaaacccagtcaccataagatcttttgcttaccaatctcctaattggattattggatatagccctttaagagacagggctaggaaaacatgcagcttctaaaacctaataaacaggcatagatggggcaaaaacagattttcagagggatctatccacttttaattcttggggttccatgaagaaaatagaggtctttccccttcatgtgtgcattgagggtggcaagacaaacggagaaaaataattcagtcaactgagaaaaaaaccctttttccagaaaaacaagatccaagaaaagaaaaacataaaggccatttaaatatacctataatttgaatatccacttttaattaagccgagcactctttttaaga

SEQ ID NO: 14781 - DNA, 1034 bp, Homo sapiens
aggaagtgagcacttgctgttggaaaattggtgacgatagattcgcttaacacagggtagccacagacaaaccttgaacttgtaaaaaatgcaattatccatgaagcacggtaaaacgaggtatgcctgtataccacagcatttttacatccaggctaagccagtctcttcttaatcctgctggatagaaaattttatcatatttcagtgaaagttcaaagataaacttttttttggtctcatgtgcaaataataaaaaaaattaagaacatataatgtgctgcctaaaggttatttattttaacccacataataactcttttattaaagatgggttttataatttctttttagacagataagaaatttggaaaaaataatttcagtttaattattctctagttagtgaacaggaaataatttatataaaggtctaattttatatagattagatttaaaggtctaattttgtatagattatactgtcttggaattaaaactatatagaactttaagatcaaaattataaatgtgtaataaaatataaataaataaatgcaaatgttaatatatcattagacatcagaacctttaaaaaagatgatttcctggctgggtgcagtggcttacacctgtaatctcagcactttgggaggccaaggcaggagtatcacctgaggtcgggagtttgagaccagcctgaccaacatggagaaaccttgtctctattaaaaacacaaaattagctgggtgtgtggtgcatgcctgtaatcccagctactcgggaggctgaggcaggagaatcacttgaacccgggaggcagaggttgcggtgagccgagattgcgccattacattccagcctgggcaacaagagtgaaactccgtctcaaaagaaaaagatttcctaaggataaaaatatggcagaggggtttagaggatctgtaacttgccaccatgattctaacttttgacttctcacttcttactctttgcaactttccttgaccttttttatccttttattagttta

SEQ ID NO: 14782 - DNA, 1054 bp, Homo sapiens
gagtcctgctgtaactggttagtgtgtcaaaataacgttgacgtaggaatggttataatggagtttgtgaaatttcttcattttaaagcttgagaaaagaagcctgctcatttttctgaggatggtttcagattattctacaaggaagcatatgtttggaaaggttgatctcctcaaattgtctacctttacatttttattttcttcttttttattgtcttctctagctattctctctctctcttcacatagatttccccctctacacacacacatacacacaaagtcttcaaatatggaactctaatgtggatagaatatagattataaatttctcttttattggaggctcatttctgggttttcagagtacaaagataaatctcattattgctgtcttaaatgttatataaaatatgttattagagtattttcatttaacacattgcatttttctatttattacttcattacgtcttaacaaagatatttcccctgaagaccatgatgaacttttgatttttgctaaatgccctgtttggcctcacctaaaatcatataccttctatgggaaattttatacaactggaaaagatacactgacatgatcaagtaatatatcataccttaaaaatctaaatggtatttgaatcgaatcagctaactttgagtggggaagaacagatgaaacattagtccctagataagtaaatatttaatagtccttaggtgagcaaacagtttgtaaactctacttactttaagcaaatttgagtgtctcttgattcttttatgtagaacattgtttgagccttccttgtttggcattttggcatttacttatattaataatattcatttatttactatttcatttataataattatgtaacatctgagtatcttggtagatgatgtcttataaatatgaccagactacaataatgatgaagataacagtaagtcaattttaggattatgtctttggactaattttgagtaattttgctacttttcactttattattattctcttaatgtagttagtccaatt

SEQ ID NO: 14783 - DNA, 1034 bp, Homo sapiens
ataaaaaaaattgatgcaaaaatcctcaacaaaatactaggaaaccaaattggattatacacttcagccatgtgggatttatccctggaatgcaaggatcattcaatgcatgaaaatcaataaatgtaatgtatcacattaacagaacatggaatgaaaatcacatgatcatctcaaaaggtgcagaaaatgcattttagaaaattcagcaacctttcgtgatataacaatcagcaaactagaaacagaaggaaattacctcaatataataaaggtcatttatgaaaagctcataacataacatactaaatggtgaaaaactggaagctttttttttttaagatcaagaacaaagcaaagatgctcatttttgccacttctttttagtataatactggaagttctaatcaaagcagctaggcaatgaaaagaaagaaaatgcatcccaaatggaaagaaagaagtaaaattatctctgtttccagatgacatgatcttatgtagaaaactctgaaaattccacttatatacatacatgcacacacacacacacacacacacacacacacacacacacagagaaacactaactgttaaagctaatacaagaagccagtaaaattgcaggggtacaaagtcaacaataaaaaatcaattgcatttttatacactaacagtgaatgattaacaatctgaaaaagaaattaagaaaatcccatttacaatagcatcagaaagaataaaatacttaggaataaacttaatggagaaaatgaaagacttgtgcagtgaaaaccacaaatcattgctgaataaagttaaagacacagtaaatggaaagatacctggattcatggatggaaagacacaatattgttaaaatatccatactacccaaaggaatctacaaattcaaggcaatccctatcaaaataccactgacattttttatagaaatagaaagtaccaccctaaaattcatatagaatttcagaggtcctgggacaaccaaaataatcttgaaaaagaagaac

SEQ ID NO: 14784 - DNA, 1050 bp, Homo sapiens
aggttgcctgttcactctttttagtttctaaattttttagtttcttttgctgtgcagaagctctttagtttaattagatcccatttgtcaattttggcttttgttgccatttcttttggtgttttagacatgaagtctttgcccatgtctatgtcctgaatggtattgcccaggttttcttctaggatttttatggtcctaggtcttatgtttaagtctttgatccatcttgagttgatttttgtataaggtgtaaggaaggtgtccagtttcagttttttgcatagggctaaccagttttctcaacagtatttattaaatagagaatattttccccattacttgtgtgtgtcaggtttgtcaaacatcacatggttgtagatgtgtggtgttatttctcaggccttcattctgtcccattggtctgtatatctgttttggtaccagtatcatgctgttttggttactctagccttgtaatatagtttgaagtcaggtagcgtgatgtctccagctttgttcttcttgcccaggattgtcattggctatgtgggctcttttttggttccatatgaagtttaaagtagttttttccaattctgtgaagaaagtcaatggtagcttgatggggatagcattgaatctataaattactttgggcagtatggccattttcatgatattggttcttcctatccatgagcaaggaatgttttttccatatgtttgtgtcctcttttatttgcttgagcagttgtttgtagttctccttgaagaggtctttcacatcccttgtaagtcgtattcctaggtattttattctctttgtagcagttgtgaatgggagttcactcatgatttggctctctgtttgtctgttattagggtatagaatgcttgtgatttttgcacatttattttgtatcctgagactttgctgaagttgcttatcagcttaaggagattttgggctgagacagtggggttttctaaatatacaatcatgtcatctgcaaacagagacaatttgacttcttctcttcctatttg

SEQ ID NO: 14785 - DNA, 1019 bp, Homo sapiens
gccagcaggtcaaagttgcagtgagccgtgatcacgcaactgcactccagcctgagcaacaaagccagaccctgtctcaaaaccaagatgaaacattgtatattaagaactgactggtttaagaggatgcattttaactgagaaaaataatttcattggtataaatagctccatttcaagatgaccacaccacaaaaaaaggttactgatagataacaaagatccatattgttactctgctcagtagaaaggaatccatttgtactttctgtgaccctttggaggctttctacatcatagatagtgtcattagtatttaaccatgtctttgatgatgacaatcctgagtgaacccctattcattttgcgctgagttcttacatagtcttttcagtgattataactgtaccatggaggataggaaatctcactaacatttttattacttcctctgcaaaaattctgaactaaaatatagtcaacctcatctctggactaaactggaaaatgtaagagacaagttaagttgtacttatggaactgtaggctcattagagaaacctgtagcatcaatttgtgcccactttagaatagctttaatcctacaaatctacttaagaaaagtaaacccattgcaggggaatgctgtcagtttagatgttataataattcagtctgtcactcttagctccttagctcagttcagacagctatagtggggaagatgtctagactccctcccctacctctgccccaactctcaaataaaaatcctatatcctaaagaaccttgtagtttatttttaccaaacaagctagtctacctgcaaattaacagtaacagtgatatcaccaggtaattttaatattgtaaattaaagtgagtattctcttgaatgctatgatcttctcagtgggacatgtattttcacatgttttgtaatacatatgagtttaataaagctaatgccctcgcagattctctttgtgaccattagtaatcatttgtaaggtagcta

SEQ ID NO: 14786 - DNA, 1087 bp, Homo sapiens
taccaagcaaatagcagagaaaaccaggggttgcaatcctagtgttaaagtcttacaaaacagacattaaaccaaaaaaaaaaaaagatcaaaaaagacaagggcattacataacggtaaagggctcaattcaacaagaagtgctaactatcctaaatatacaggaggacctagattcataaaacaagttcttagagacctacaaagagacttagactcccacacaataatagtgggaggctttaatactgcactgtcaatattagatcactgagacaaaaaattaacaaagatattcaggacccaaactcaactctggatcaagtggacctgacagatatctacagaactctccacccaaaaacaacagaatatatattcttctttgtgccatatggcacttactcctaaaaagattgcataattggaagtaaaacactcctaacaaatgccaaacaactgaaatcagaagaaacagtctctcagaccacagtgcaataaaattagaactcaaggttaagaaactcactcaaaaccacacaactacatggaaattaagcaacctgcccctgaatgactcctggataaataacgaaatcaaggcagaaatcaagaagttctttgaaaccaatgagaataaagagacatcatgccagaacctctgggacgcagccaaagcagcgttaagagggcaagttatagcactaaatgcccacatcagaaagttaaaagatctcaaattgacgtcctaatatcaaaattaaaagaactagagaaccaagagcaaaaaagaaaaaaaaaaggccaaagctagcagaagacaagaaataaccaagatcagagcagaactgaaggagatagagacacgaaaaaccttaaaaaaaatcaatgaatctaggagctggtttgttttttttttttttggaaaaaaaaattaataaaatagactactagctagactaataaggaaagagagaagaatcaaatagacacaataaaaaatgataaaggggatatcaccactgaccccacagaaatatgaacaaccatcagagaatactataaacacctctatgcaaataaacta

SEQ ID NO: 14787 - DNA, 1030 bp, Homo sapiens
caaaaagaaaagtacatggttcaaaattataggacagtgactgagaaattaccattaaagaagaatttaaattattcagactacagagtgaacattttctttctttctttgcacaaaatcctgaccaacaaattcacccattggacgtaagtgctacccatttatcagtgatatcctactcatttgaccagggtgtggcaaggttttcatcattaagtactgaaaaaagtaggcatttgctctcaattgaagcattttctgtgacctcaaggacattttagatatttttaaaaattattcttcctaaaaacgtacccctttcatgttaattaagttaaatgctttttatatttacacagttattttaaaagtttaatgttttatacatagaaatgaatatatgtaacacagatggaagttgtagtgataaaataaacatgaaacaccaacccaacttaataactaattcattaccaattctgttgcatctttttgtaccactaaatcatggcttaatcatttctggtaatcataacatttgtatttattccaaactctataaccttacataaagcttattttattttatgacataagaactgtaattgccagataatgagcatctttagatggaaaaaagtgcacaacacaatagcactttgagaaagctatgtattttataagcataggaattttattattccattaacacaacttctggagtaactagattaatgaatgtactggttttcaacaaaggagatcttaaccctaaatgattcaatctttttcactctacgaatatataaagcctgtaatacataagcaagacctgcagtacaccaaagttttgtctagttggtctttcaaataaagaggtgaggaataaattatactggaatagacttgagggcatccaccatgttaaatgtttattttagtatctcataaatagccgtgaaactttccttatgaatgttatacatgcatacctcactttattgactttgcagatattcctttttttttt

SEQ ID NO: 14788 - DNA, 1037 bp, Homo sapiens
tcctttcttgcaaattgctttgtgtgttcaatgctaggtctgatagcgatagcttttagtagacagcggtaggtgcctgcagaacttgtgtttttctcatctttaaaatacaactacttatgctcttaaatcaaggctgtctgcttatttatactagcgtaggcaacacttggatttcccttcttagtatgcttcataactgctttacagagagcttttgcttgttctttctcatgtatctcgtgtttatgtgcacagtgccaaaagaagactgactgggtggaggctctgccttgcctcaagaaccatcccctgcagagcatccagggaggtttctcgccccaatagcctcacggcacagtactcttgggcagtaactggacaccttttatttgaagaaacaaactgaagaaaaaatgcttccttaagtgctgacagcctttttaaccaatacatttaaaattgtacagaacaaaaaaataaaatcaaagactgatcttgtacagatattagtgttaccagcattcatgtggaaatcaagagcaaagacaaaataatgttaaacaattctgtaccataacattttctgtaatgatactgaaacttaatgaataaaaaaattccttgatcattatttaaaaatgtaatgtgttggcctcgttatttaaagagagaagattgtcatgccattctgatagggttctgcctgaataaaagaaatggttaagatggcctaccaagaatatttaaaatatggtatattgtaactctgtatcttactacaatatgtggggaaaaatgtgatcatagcattatgatctgtagtgtgtgaaaatacagatgagaaggaaggagaacctgcagttggtctcgtctttccagtcatagctggagaatagcaagcaaatttagaggaagggtactaatgacttagaaaaaaaataattcttattttagacgccataaaatccaatttcaaacatctacagttctttgaaatggagaaaaaaataagcaatgaaacaaaaaattacaga

SEQ ID NO: 14789 - DNA, 1099 bp, Homo sapiens
acaggtttgtctgacatagttcccagcttgacttttccttggcttagtggttttggggtcctgatacttactttgctttcacaggatgtattagtgatttaaataaaaagtgagacacaacttgtggagagagggaatgtactatgagagacagctaaatattcatcttcataataaatgctcaacagataactaaaaaaaaaagaaatggcatgtatgtatacatagaacatacacacgtattttatatatgtatatatgtatgtatatataacatacagcctatttttatacatgtcactagaaatatgaaggtaagtttaagaagaaactgagagttaaaagtgttctctatgcagaactcaggtagaggaggtgagacactgaattgttcttcatagtaggtttaatggaactgtttgctttttttaaaaaatacacacataattttgtgttacacaactatacgtacaacacatatgcaacacaaaagttgtatattaggggccccttatatggagtgtgtaaaaacattgctgtcaccaaggtagtgaatatttgcatcatttaactacttcattcgattgtcattgaataatttgggaaaaatctctctcctcttgagttattaaatgtttggcaataggtaggtgtggtttttctcttcctgtcttatctagtatttaaatattcaaatttaatgcagcacgtattgagtttctaatatgagcatacatagatagcagtgtgcagggttctcagagccactaccagtagatgggaagtctatagaatatttgcagtctagttgagaagataaggtactcatccataaaaatttgataataggccaggcaccgtggctcactcctgtaattctagcactttgggatcccaaggcaggtggatcgcatgagctcaggagttcgagactagtctgggcaatgtggcgaaaccccgtctctaccacaaatacaaaaacttagccggctgtagtggtgggtgcctgtagtcccagctacttgggggattgaggcaggaggattgcaactgttgtccaggctggagggtcgtggtgtgatcacagcttactgcagcc

SEQ ID NO: 14790 - DNA, 1048 bp, Homo sapiens
taattggagcatcaacatgatttttgagaaggaaagatgcataactttataaggagtcaggaaaagtaacatcatagaatttattgtaccaaacgtgatcttagggcagaaacaggatgctccaaattttttattgatgaaactatccctaacttagactaaactaaaactttagcttacattatagattaagattattaaggggacatgtttctgagagttaagatgatacaaaatagaacaaagtacagtcatgcatcacttaacgacagggataagttctgagaaatgtgccattaggtgatttcattgttgtgcaaacatcactgagtgtatttacacaaacctagatgatatagcctgctgtacagctaggctatgtggtatagcctattcctccaaccaccatcatatatatggttggttgttgactgaaatgttgttatgcagtgcatgactgtatgtagatataattattttctacaaatggctcttacagttcccaggatggcagtagaataaagaaaggagagcagaactaagggaagtttaataagctatcggagaaggcaaaggaatacatacaggatgataaaaatagggatatagagtaaagggataataattcatccatttatttgttaataaatgctgttatgtctgcaccatgtaaagcactttgcctggtgctgagataaacttcgcttacatactttacttgaaagcatatccattaacacttatgtatatttttttcttctgtgtcccctactttataatattttcatgatattgtctctgttataattctttctactgtatatgctcagtttataaacttcttgatgtcagaggccaagtcttatttgttttaaatccagataatatatgttaaattaatgaataaaagatgattttaaaagttctcagaaaacaaacaaaaattaaaaaaaaaaaaaatagttctgccagaactgctgtttctgaattagacctttcaatgctttgctgtaatgtttttctggccttatcttttatctacaacctt

SEQ ID NO: 14791 - DNA, 1148 bp, Homo sapiens
acatttaagctaataggattttcgtactgtctctatagctgtagctttaaaattcaacgtatataattggcatggaaacttaatttgcagtcttttcaagcctttaggatagtgtgatgtgtaacaaacaacctcaaatgtgaatgccttgattttatttttatggtgactttagctacagcatttcctatacccagagctaaacactggaataatactgacatcatttaatttaacataagcaattatgtttaaggagtaatttgtgtcatgtacatatttgattgattttttttcttctacataattttatttgaacaaatgtagacagtttatatgtcgcctttttctgttcaaatttgcatggcctattaagttggctggagagtgttttatgtggaaatattttcaagataatgttccttaggaagaaaataacattcttgggttgagggaaggaatgccatacactactgtctcttcagatctgaaatactccagtttagagccaggaaatttcacaggtcacaccgatttttagcattaaaaactaaggaatatacttagcacttacttaatcttttcagttttccagtttacgtctcaggaatgaagtgtagtctatggttgacaatggagttttgtgatcctgcttattgtaactgacaactgttttcaactccaagagctaaactattggcagttcatgttaagttagagtgagggtgtaggtagtgtcagtgagtggctcttgtgcctgctgtagacattaggcctgcactagggccatgtgctgtcaagattcaggaacatggctttaacaagcagatcttgtatcaaggcagaggtgatgccatgccatacttttaggaagtctgagatgataaatatttcaaggtcagtgaagtctatcaatcattctccccttcctcatcagcaatggtagatagaaatgtcctaaacttttctaaatcctagtgatgaggatgtgctgatattcaacatagtccttaaagtgaaaactgagttgttgctgacctccacaaaagaatatggaaaaaagccttgctgtacacctagttgtacagccactctggccaattccatttcctgtccctctgtggttctgactggagaccccagtgtgg

SEQ ID NO: 14792 - DNA, 1028 bp, Homo sapiens
tcactatgtcacccagtccacagggttcaagcaattctcctgcctcagccttcggagtggctgggattacaggtgtgcgccaccatgcccggctaatttttgtatttttagtagagacggggtttcaccatgttggccaggctggtctcgaactcctgacctcaggtgatctgcccactttggcctcccaaagtgctgggattacaggcatgagccatcgcccagcccagaagctaattttttaatattgtatatggtcttatttatacttgaagttttgtgaacgtcgctaaacaggataggactaaaatttccaattctcctacactctgtcagaagcctagaactcactaaactgggctgcctttcccaaatgggaaaggtgctgacagagttggagaaaaaagaatagactcatttttccccattattggtatgtaggcattggtacagccccttctggggcagtctttgcaggataacatgctatacctgctaagattcaagctgttttcctcacactggactttaggccaaacccagtaccacgcaatgtgcaagcaagggcaggaggtaggtccaatctgacccctccctgtctcattttaatgactggacagcgctcggtgaaggctgtgttcactgtagtgggccatcatttgtttccttcttcttgtaaaagaccaagcaaatgcactctgctttttgctgctgtaagaccaccaaaaatgagtcagaaacacagaagactatttcaggcatgtgggcctggatatgctccttgagacttctggcaaacttctgctgggaattagtttgagggtgagggtacatatgtgacatttgccctagcctaagagtagcaggtaaaaaaaagtttctttcatcttttgccttactgataataccataatccccctcaattcagaccttctgattgagtgcagaggagactagacagtctcctctagacaggttgtagacacaccctcccctaacaaaaacaaaacgaaagagttcatactctg

SEQ ID NO: 14793 - DNA, 1089 bp, Homo sapiens
ccttgtgatccgcctgccttggcctcccaaagtgccgggattacaggtgtgagccactgcgcctggcctaaattggtctttttataaatgtatcccagtagtaaatgaataaggaatgatagaatatcaccaaattacaaactctgacaatctaatggatctaggcatttaacatcacaaaaagatgacgagtcactggggtactttctgatggaagaacaatcaaatttgaatgtgatcaaggcttcagatccagccaccaatttacaacctagctagagaagagaggaacacatcaaactgctctagaaaatgcaattagcagaatccaaactgtgggaaataacagaacaaacaacttggtttctgtaacaaataaattgtaagattaaaaaatagttggaaggggaacctttggattaaaacagatttaaaagccttattgatcaattgctgtgtgattaacttatttggatcttgacttaaataaatggttaaaaaaaagaacagaagaataaacattgagactactggaaatttgaacatgaaaatatatttgagattaaagctggtaaagactggttcactcaaattgtccaagtactctttaaaatgccaatgactagccttcgactaacaagccaagtaggtattaaatagccagttatgtcataaatagctaatgttcaaatagctcttacaaaggtcctggggaatttgggtaaagaattcaaagattaagattatttttataacagcagttcagttcactgtaatggatttctgctttctttgcaccacatacaaaacagagtttaggatgtcttcttaaggaggaaactgttgcatgttattttattaccagtattacagttcagagcagtgtaaaaaccttatcaatgaattgggtgatatcagcatacatacagaagactagcaggtgacttgtctgcattttccaaatgaatttgtggagagtcttatgttttttgtctttgcatagagccttaattatttactttttgaatcccccatatttacttatttctccttcatatctttttctgccaatgtgcatgttggtattta

SEQ ID NO: 14794 - DNA, 1050 bp, Homo sapiens
attcagtgtttagaaaatcatgttttgtttactaagaaagtattggaacattaatttatttgggccataatttaaaggaattattgcatagcattaatttgcatgaattgtttcaattgagaaagtgtatttttctggaatgagacatgaagacttactgatatctattataatacaatataccatatttgttcaaatatacttatttcattcaagaaaatgaaagcattcttatttagtaaacatatcttatagctgctactctaaatatcacttacaaaaaacatatttaatcccagaaagataaatctcaagagacattgttgtttgctcaagattagatgagatccaacagcccttgctggttgcatgctctgactgctaacctctgttagtgcttacaaaagagagcttaattctaaatctgtatattaagccattttgcttatacctgctctattgataaggcttaggagtttctcaagtaaaattaattagagattcagcaatgtggctttaagtagaattgactgttttcgtttgtgctatttttttcacccacagactggttgaaatagcagaatcccgttttcccagatattttaacactgaagaaaagttacttttgacaagtagtaaagttcatctttatcgggaactcacctgtgatgaagttctacaaaggtatgctgctttagattttgattttttagtaatgcgttgaaggtttatgttttatcttttatgtttcagcttctaagtgaaaaaagtctttataggttagaattatgtggagtaactttttcagtgttcttctttgttatagccttttggttgaagtctttcttgaaaaacaaaaaaaattaaatgaataaaatgttctgtatttaattaattaagtggtgtattatttatctattgtttcattaacaaattgtctcacagtttagtagcttaaaacagcaaatacatattatttcacatagtttctgagggttaagtgtctgggagtagcttagctgggtgtttctggctcaatgtcgctcaaga

SEQ ID NO: 14795 - DNA, 1080 bp, Homo sapiens
tgggcaagtgaaagagtacccaagatggaagctgtagtcttttataacccacactcagaaataaggtaccatgatcttgtcatatgcttgtggtcatacagatcaagtctggcacactgtgggagggacctatacaaggatgcaaaataccaagaggagggagtaagtgtgggccattttgcagactggctaccacaagtagttttaccccagaattggagcgttaacattatcttaggagaatcaaggaattctgaaactacacagaaacagtttgctctgtttccagaaaagtatgatatgtctacaagttaggtttactgaattcttgcaaatcattactgtaacttaggaaagaatagtttattgtttttaagttgcttagcctttgcaatacctttatttatttattttatcttaaatttattgactattttataaattcttcttttataggattgaatctttggaagaagaaattatctcaaaaggaattaaacttgtgattcttgactctgttgcttctgtggtcagaaaggagtttgatgcacaacttcaaggcaatctcaaagaaagaaacaagttcttggcaagagaggcatcctccttgaagtatttggctgaggagttttcaatcccagtaagtttttctttttttctcttttttcttttcctttcttttgtttcttttatattacattcactgacttatggtatcaaataataaaattagaggaaaatgtaaaacagatgactttttaaaggtagtacagtctaattgctatagcaaacatcgccatcatcttaaattagctcatctgctgagattattttattattttaataatttgagtctggagtagatttaaacgatgtttttaaaagttcctatagtccctccttttcttccttctcattgtttactctttgtgtgtgctttgtatcacatttctcacactgcagtaaatataaagtagtaaaacttcatgaaattgcctagatctatttctatataattaaaaaaaatactgcagttgttgttagttttgttttaagtattttaggtttagatactgtgtt

SEQ ID NO: 14796 - DNA, 1029 bp, Homo sapiens
tcactgaaatgaaaacataaaattaaaaaattttcacagagaattttatagacctttgagtatgttcagactgcagttttgagaaacagttgtagaagtctggtagaatcttttctcctgaagtttatggaggaggtgtaagtgatactctgccattgggatggaagatgcggaacctttgtctttttaaagtgttcacactagtattgaaaaaacagtaggctctgaagctgtttagagatactggataaaagtaaccgaaaaaaatttaaatactgctttataaaataaattgtggttatggctatttatgttgactttatcattgacttctaattaccacgtacagaatagttattatacgtattgtaaattatgtatcagattaaaataataggatgtttttgccagaaaggaccttaaagaaaatttagtttggccccttcattttacagatgacaatgaatccgaaaagtgacctgatttgctccaggacactcaacataggaaaggacaaacagtgggtagaatgagagatcttttagctgccagtttggggatttttttttttccacagcagaattttctttttttctgagacatacagaattacggtggactgtaaacttctttttatttatttattattattattatactttaagttttagggtacatgtgcacaatgtgcaggttagttacatatgtatacatgtgccatgctggtgcgctgcacccactaactcgtcatctagcattaggtatatctcccagtgctatccctcccccctccccccaccccacaacagtccccagagtgtaaacttcttaatgacaggattatattttctgtttctctgatttccaggacctagcactgtggataactaatatttaggaggtaacagctaatgaaagtacaattaaggtttatgaaaatagtcttaccatatgtatgtcatatttacattcattggaatatttttctttatcttttaaaacataatttgaatttttttatgcttgctg

SEQ ID NO: 14797 - DNA, 1068 bp, Homo sapiens
tttatttatttatttattttacaccatgagctgttccattatgccaagtgggtttaatttatgcaggattataccttgtcttagatactaataaatattcaaaatagaaaaataagaaactaggccacttcatttaaaataattaaggttttattaattataaattgggaatattgtgtttataactggtgagataagaggaaaaagaatgtatgtacccaaattcgacatttatttttatcttaaacataaatattcagaactgtcacttttgtgaaagcctgatgaagtcactctgattgtaaagtaggaatcctagacccttgatgtagacatagatatgccattaaaactgcagtcctgttttgctgtgtgtaacattgttgtatcacttttctagaaatgtaatttttggtttactcttattactttcatatttttactgaaaacaagcaccacaggacttctgaggtaagaaaagtcctttacaggatttttcttttccataaatgcttactgttggctcactcacatttgaaatcagattgttcttaaacctatcctatgttcattcaggtccctgaaactcacagtctagactaaacctttatcagttagtgaaaataattctagaaaaagtgtatctttcttttatgtagctctttatgacttctgaaactttgtttttattgtttctagcaaaaacctagaaacaacttaaaagttagtaagtaggtgattggctaaattaatgttgacatatccatacaatattatattgtgccactgttacaatgaatggtttagcccagaaatggattcataggttatgcaggcaagggttaattcagctagcatgggttactcatatccagccattcccaaaaaaggcctcttttcaggactgcccttgcctggctcctgggagatgagtgctgggccctgggaatactctgcctagtaagggtgttatatgcctgaggacttgagccacaggtactggtttgatcagattgtttatgcaaacagtgtgatttatggtgaagcctatttttctctggggatctg

SEQ ID NO: 14798 - DNA, 1047 bp, Homo sapiens
attgtagagaaattagatcatctcttgaatagaatctgataactgctcactgtttaattaaattcaaataaacagtttgaaatagaatattggctgtatgagagtttggtcaaaggatattttcttgagtttttcaaagacaaaatttgtttttttggttgatatttttacatatcctttgcgtttcttgaatgtagttcacttagttaatacagtacagttaatacagttaccttccaagtaaagctggagggaaaatactttctgataagaaaatatatttcaaataataaaacagtatgatactagcataaaacagatatatagaccaatggaacagaatagagagcccagaaataaacctgcgcatgtgtggtcaattgatctttgacacaggtatcaagaatacacaagggggaaaggacagcctcttcaataaacggtgtcaggaaaactcgatattcacatgcacaagaatgagattgggcccttattttataccatacacaaaaaataaattcaaatggactaaagacttaaacataagacctaaaaactaaaaactcttagaagagaacatagaggaaaagctttgtgacagcagccttggcaatgatttattggatatgacaacaaatgcacaggtaacaaaagcaaaaatagacaaatggaactatgccaaacttaaaagcttctgcatagcaaaggaaataagaaaaggaacaaacaactcacgaaataggagaaaatatttggaaaccacaaatctgatgataaagggttaatatccaaaatatataaataactccaaaactcaatagtaaaacaagaacaagcaagcaaacaagagacaatacaattaaaaaatgggcaaaagaactgaatagaaatttctcaaaagaagacatacatatggttcacaggtataagattcacaaagttactaatcataagggaaatggaaatcaaaaccacaataagataacactcacatcgcttaatacggttattatttaaaaacccacaaaagatagtaggagtgggcag

SEQ ID NO: 14799 - DNA, 1065 bp, Homo sapiens
ctgagggttttgtgtatttctgtggggttgctggtaatgtcccctttgtgtgttgtgattgtgtttatttgaatattctctcttctttcccttccttccttccttctttctttctttttttcttttttgacgaaatttcagtcttgttgcccaggctggagtgcaatggcaccatctcagctcaccacaacctctgcctcctgggttcaagcgattctcctgcctcagcctcctgagtagctgggattacaggcatgtgctaccatacccggctaattttgtatttttagtaaagacagggtttctccatgttggtcaggctggtcttgaagtcccgacctgaggtgatctgcccatcttggcctcccaaagttctgggattacaggtgtgagccactgtgcctggccctggatcttctctcttttacttattagtctacctagtggtctatcaatcttattcatttttttcaaagggccagcttttggttttgttgatcttttgtatggtttttcgtgactcaatttcattcaattcagctctgatttcagttatttcttgtcttctgctagcttcggagttggtatgctcttgtttttttggtttctctaggtgtgatgttaggttgttaatttgagatttttctatgctttagttctctactgctgcttaatattttgttataaaatatagtaccttaaaacaacaattataatttattatatctcatggtttgtgtgggtgagtaattcagataaggacttgtttctgctccatgatgtctgaggcctcagctagaagactcaaagactgaggctggagtcatatgaaagcttgttcatgccattttttagttaatgcttgtacctgctgggggtccagctggaacattcacatgtggttttaatattatcactgggtttttttatgaccctgcctccggagttatttagcatcacttctgctgtactctattagacaagactgttaaaaatctcctcctagacttacagggagagaatatgtccccttctgtcagttggaggagcatgtatcatgttgta

SEQ ID NO: 14800 - DNA, 1067 bp, Homo sapiens
ttttgcacccataaaccatccccacttctctgccccactctccactactcttcccaacctctggtaaccatcattttactctttatctccatgagttcaatttttttttttttgagatggggcctcgctctttcacccaggctgaagtgcagtggcatgatctcggctcactgcaacctccgcctcccattttcaagcgattctcttgcctcagcctccagagtagctgggatattaggtgcataccaccacgcttggctaatttttgtatttttagtaaagacgaggtttcaccatattagccaggctggtcttgaactcctgacctcaagtgatccacccaccttgccctcccaaagtgttaggattataggtctgagcccctgtgcccggccaagtgttttaatttttagctcccataaataagtgagaacatgtgaagtttgtctttctgtgtccgacttattttacacaacacagtgaccttcagttccatccatgttgttgaaaatgacaagttctcattgtttccttatggatgaatagtattccattgagtatatgtaccacatttctttatccattcatctgctgatggatacttaggttgtttcttttctcttgttgcttttaagatctttttgtacttttttgccatgcataaatttttatgtagtaaaatatatttatattttcttttattatgtctaaattttagtcatagttggagagactttcattgcactgaggttagagaggaagacactcatgttttctgcaattatgcatatacagttgatcctcatttttttgtagacttggtgtttgtatgtttacctccttgtcagagtttatttgtaacacccaaattaatgatcttgttggtttcatggtcatttgcagacatgtgcagagcagtaaaatatggagtcaccaatgtgcatgttcccatctgaagctgaataaggtgatatctaccttcttgtttcagctgtcatattgtaaacaagtgttctttttgtcggggatgccacctcttccaaaacacatggtctgagagtgtggag

SEQ ID NO: 14801 - DNA, 1228 bp, Homo sapiens
cttacactgtaataaggggtacatgcaagtaggcaggcaattatagtattctgtgaaggttcgtaaagtttagtactgtaggaaaccagaatatgcctccccaaaatgtgaaggattctcgagctgaagacagttaagatgcagtagagctctctgcctaaaagcaggacacagatttacagagaaaaatgtcttgctgtcctccctcctccctttctcccctaaagacaggatgtaaattctttactggaaaaaaaccctttatcatctcagagacggcgccagaggaatctgcaagctgactttactccattagtgccttccatatatttacctttccacggtttcccacctctggaagtctgggactgctttcctttgccttgtcacttctctaaaatttattgttctttgttggatatactatataaaccagactcatgaaccactgccttgagttacttttcactgagggcttttcctgtgtgatatgcaccgtacacgttaataaacctatctgtttttctcttgttaatctgccttctgttatagaagtctgtgctaactacatacttaagaaggttgaggaaaaaatactttttctccccttcagttctctgctgctagatcacccatagttggaatggaggctcagaaacctagtatttagctcctttgagcatctgtaattgaactggcaaagcaagagcttggggctgactgttggattagctgaagaatagtttccgtcatattctagaaaagaaagctttttttttctttttctttttctccagggaatgagtggggttatccatttattgtagtttaaaggatttaaaatccatctatatattgataagcattcatcagtttttattttagtatgtatggtgctatcatgtttataagaatattttgtttttaaaatgactagagcggtacaaaggaaaaaactttagttgttaattttagatgaaaagcaactgaatttcttaggtaataattattttaccctcccaagatacgttttctgtactccattgacttatgccaataaagtaatgttcttccaatttaataatggattttttttcttgttgaatttttttcaactctaacgttattttgttgttggagattgattaaaaaatacaaattttactgtttaaagaatgttgcctaattagttataaatctatttcatctttgcatttttttcttttat

SEQ ID NO: 14802 - DNA, 1075 bp, Homo sapiens
gtggcaaagtagttagttatattagcaggctggaggaggcggtgtctgatttgcatacagcccagggattggttttaccagatgtgtcattcatgtggcccgtgaaaaacctggccctcccaccttcgtcctttaatatgaaaatgcgggtcaccatgatgtcctgaacacgtgtgagttatctggaggcggccatgacacttggtacttgtggtgacaaggagaagagggcagcaatcgccatgttggccatgttgggtggacctagtttctaatcgccagaatttgcatatcaaagcttgccgtctttaagccgccttttctgttagaaaagaaatggtttgggggttgcttcttacaggaaaatttccaccgagaacctttaccctttctacctgcctaaaaattatttcttaataactcctatattaatgtgtttccaggaatttctccattttctctaggtttttcactttgctagcatataattcataatagtctctgatgatcttttgtacttctggtgtcagctgcaatgtctcctttttcatttctgagtttgtttatttgggacgtctcttcttttttcggttagtcaaggtagcggtttatcaattttgtttatcttttccaatgatcaacgttttgtattgtatttttagtctctatttcatttagttctgctctgatctttattatttcttttcttctgctaatttttggttttctttgttcttgctttttagttttttgaggtgcatggttagattgttcatttgaaatctttctgtttttctgatttaggtgtttattgctataaactcccctcttaacatacttttgctatgtcccacaggttttggtatgttgtgtttccattttctttgtttcaagaaattaaaaaaattttttatcttgattctttcattgacccagtggtcactcaggagcatgttgtttaatttccatgtatttgtatagttttcagagttcctcttggcattgatttctagttttattccattgtgatctaagatacttgatatgattttagctttggaaagattagttttat

SEQ ID NO: 14803 - DNA, 1020 bp, Homo sapiens
ctgcctgggttatttcttttttttttttcttttttttgagacggagtctcgctctgttgcccaggttggagtgcagtggtgcgatctcagctcactgcaagctccgccgcctgcattcatgccattctcctgcctcagcctcccaagtagctgggactacaggagcctgccaccacgcctggctaatttttttgtatttttattagagacagggtttcaccgtgttagccaggatggtctcaatcgcctgacctcgtgatccgcctgccttggcctcccaaagtgctgggattacaggcgtgagccaccgcgtcctgcctggctgggttatttcaaaaggcccatcttcaggttctgagactctttcttttgcttggtttagtctattgttgatgcttttgagtgtactttgtattttttcaaggacttcttcagttccaaaattttggtttgtttcttttttattctatcactgtggtaaactgctcctttatttcctgaattgtttttctgatttctttgtattgttttttgaaattctcttgtatctcattgggcttctttagtatcataattttgaattctttttctgggatttctttttttttttttttttttgagacagagttttgctcttgttgcccaggctggagggcaatggcacaacctcagctcactgcaacctctgcctcccgggttcaagcaattctcctgcctcagcctcctgagtagctgggattacaggtgcccaccaccacgcctggctaattttttgtatttttagtagagatgggtttcaccatgttggccaggctggtctcgacctcttgacctcaggtgatccatctgccttggcctcccaaagtgctgggattataggcgtgaatcacagtgcccggcccagcatttcttgaatttctttttattgggatgtgttgctggagaattattatgttcctttggaggtgtcatagttctttgctttttcatgttttctatatccttgtgttgacatctgca

SEQ ID NO: 14804 - DNA, 1032 bp, Homo sapiens
cacttgcttccttctccttctttgcctcaggtgtttcctgtgactagatcctgttggacactagtgttctcttctagatgttctattataggtgtgattattttggttatatattagtaattttggttctttctggagagggtgagtgtccaatctctctagttagccaccttgaatacatctctgctgaggagttcaggaagagcagaagctacctctatgctcctgctgagtcaggcaatgcctatacctttaattctaccagaattgaagtaacaaatttgtctactttagggcaataaataaagtcaatatacacctgactacaaagcttcgtagactatcaacatcagttacttctgacagcttggttgtagatgtgaaaggaaatgggttcattgtatctgatgctgccgttagaccaagctggcaccacagaagacctggaatttgttaatactgcttaactttcatgtttcctggtacaatcaggatgaagggaactgtaaccactaggtggcatcttttaattagaaaactgtgaatactccattgctcactaggatccttgtggcctacttagcaaagcaattgcctgtgagagcagctggtggcagtctttaagatgcagatttcaaataggagagaaaggaagagataaagataaaaagagaggaaagaagtgggagggcaagagaagagaaaaggagaaagtaaacaggcgtactgtgaaggaagtagtaaaatgccatcagtaattagctcaggaaagtggtatttatggcatttgttgcttaccattgtttcatttctttatttatttgacacgtatttaatgggaattaggaattctggctgaggatacgagatgctgtttctaccctcagagagttgatagctaaagggagtttaaaatatctcaacttaaaatcttgacccccttcctgtagagtatgttaaataatacatgaaataataccttttatttttagttttatttgtttcgtattctctatttcattcccctatcag

SEQ ID NO: 14805 - DNA, 1033 bp, Homo sapiens
tttctcttgttcagagtacagaccagtttgggtagaaaactgtttgcttttttactttctgggtaaggactgtttgcttttctctctttaaatgtagtaaagagaggaaaagctaataaagtagttggacctgctggttataattcatagagaattttcaagtgtgtttaataaagtctctcatataattataacagaaataagtaattggaggggaaaggttaaaatcctgtagaggtttaagaatcagttaaatatgaggcagtgtgcttggatgagacaactaactaggagctgcttctctttgctgatttctctgaactttccttttgagattttttcctctttactttcgtaatgcattttgcaactttcattaaaaaaatccatcaatgtttaaacttctaacaaataaacatatcctagtcctattatggaaatcacaatgtagcagagaatagcttgacttcagctagagagaggttaatgataggaaccctaaggattgataccaagatcatgcttgtttagtgttttaatgactccagaaggaaatggtgaaatctgctgatgacaccaaattgtttttgctgatccaaacaaggatttctgggaagcttcttcagagtatttggaatagtagaagaattgagaaatatggtggcagacacactgaacttaaagtgaaggtttacgtgaagtagcaggagtaacgtcaatacgttgaagttacaaagcctgccaaatcttccaaaaggaagattacggagtctatagtttcatgaaaggaagacttaagacaaagaacatttatacatatagcaaatgaaaactattatgggaatagttgcaattataaagttcagtgacttaaaaatatgatgtctgaatttctttttaaatgtcagcagtagtatatctaaataggtgttgtttctctcgaaatggtcatagaagattatatacccattttatgcatgctcctttcttggtacgttcttttgtcagttttctgtggtggcaggtctttatt

SEQ ID NO: 14806 - DNA, 1063 bp, Homo sapiens
attaaatatattaaatgaaatataaagtagtaaaacttattttcttttattgctttcaaaagtgattctaaaggacattaccaatgagaaattgcaaaaatgtttgtgtactaatagtgttagattaagttcttggttgatagatttcacaaacatcacttatttagatatgtaagttacagggcttgtactaatacacattttattatattggagacaaaccatgtttataagtgacctttttaaaatgttttctttatgctccctaaatatacacttagggaggaagaaggaggttttgaattaactggagatttccctaatgtgttgaatttttctgactaaagcctacatttttgtaaagaaaaagaccctgtgggataaaaaatacgataggcactatcacaggagctgtgggctggccatctatatccatccatctatctattattccacccatccctccatccatccatccatttatttaattaagttatttttaacggttggctctggagttgacattcatttattttaaaagaacagtgaatcatagctcttttcctcaagatgcttgcttttatttgcatggtggcatattgattaagtactcagaacactatttgacatatggtaagccctcaataaaagtttgttattattatgactgtacttctcccctctaatgtatagaggtaaacattttggttcctattgtgacacgtgggttataatgagttagggcctacttaagaagaaagtggaaagaaagcgggtaaaattgttgctcagatactagcatgtgggtggagatatagatatagatataggtatagatatagatagtgtaggtatttacatctaagtatattgtataaagtgacggattctgaatttgctacatttctcatttcttcagcactctgggataaaaccagcaaaaatgatgtgatctgaacagacacagtagatggcgctgtaggacttagtttttaaagaaaacagtacagccagggggagtgggggcatggagtgggaagaaaactaaagcacattttaatgg

SEQ ID NO: 14807 - DNA, 1026 bp, Homo sapiens
ttggccctttgttgtttcataaaaacgtggttgtaaagttaatttgaaccatatcaatatgactataatgtcatattttaaaattcagctatattttaataggccttaaaaatacaggtttacattaaagagtaacatagtgtttttgatactaccgtagtgtgtttatgtacttgatcttatttaatcttagtactaattgtatgaattttattattcacttttctaggtaaataaactatatcagagatacttagtaacttgccaagctcacatacctagtggttgaactagtagttgctgcaagagtttcgccagcatattaaagttgtattttttgagcacttactgtgtgccaggcaagctaaccactggaaatactatagtgtccaaagctgacctggaccctgcccttatggaccttacagttattagataccccacagacattttttgaaatctgctggattgagagtgggtcatgaagatgaatttgaatcattgtgattgttggataagccagagagccctttcaccaaaaagaaagtaagaatcatacctaccttgaatatattactgtattaaaatatttgttttagttgtactccctgtagccaagggaaaggcaagacctcctttggctacaatgagtaactaaactgtcttctagataagaatcaggaagagtaaggaaaatctggctatactataatgtcaaaattttccactgattaaatggtattaaaatatctaaagcaagaaggtgttagttagcagtggaagtctgagagattaatgtggtttgtgtacagcctaagaccatgttaacttctaattggcttctctagtgccatttggtgagatcttttagagtacagccagcttagtgataccccaaattgccaagtacccctttcatcttgggacattaattgtcaaaaatctttgaattgatttttcttcagaaagcttcactttattattttcacacaataccaagttctcatgatatttatgggtatgtga

SEQ ID NO: 14808 - DNA, 1030 bp, Homo sapiens
ctgacctcgtgatccacccgcctcggcctcccaaagtgttgggattacaggtgtgagccactgcacttggccaaaagagttcttttagagaaaacaaaagtctttgatataagcaatatgatcatacaaatggatattgtgcttttttaaaacaaacaaaacacacaggtttaaggagagaaggtatggatatactacttctgtcttccctatcttctgccatattctaagctttgcatatgttctcctgaggaacaggatagttataacttaaacttgcatttatatatttctgattaagttgttaactatggttctagatagaagaataaagaagtaaaattagatttcttaatttgatatatttaagtcccttattttgatctaatatatttgataaaatagtaatcttttaatagtagccctgttatacataataataatacctatcagatagggttgtggtgaggattagaccatatagtaaatgtaacatgtctagtgctgtgccctgaacttaacacgtgcttattaaatattaactattgctattaccattatcatcatcattaataaacatctatattttatatccccatgacttaatgtacagtataaagcataaatagtaaaattacccaaagacaaagaggaatgggaaggtccagttgattagcttcttgtttagagaagcagattattccgggggttaggaaatagtttcctgtaaggcatgtttagctttcattcatggattgatggcaatataaatcgctcttttgatgtgagaaaaatataatgatggcattacatcaattataaatttcatgagggtagggactgtgttcggtttaccttgtgtccttagctcccattttaatgtctgacccatggaaggcatttcattaaatatttgttgtcatctgtctatgttttcttctttgtctttctttagcttccaaaaagagttgtttttatattcataatttcttatttcatcagtaatgtgactcccctagaagtattggtt

SEQ ID NO: 14809 - DNA, 1839 bp, Homo sapiens
catgaaaacaacattaatctccttgtacatctccagcagagctcttgggtggccaggggcgttgtcaatgaattcttttcaaaatattttgaaaagaatcttttcttctgagcagtaggtcttaacagcgggcttaaaatattcagtaaaccatgctataaacagatgtcctgtcatccagaccttattgttccatttctagaccacaggccgagtagatttagcataacttttgggggccctaggattttcagagaatggccagtgagtactggcttcaacttagaaagttgccaactgcattagcctctaccgagagagtcagcctatcctttgaagttttgaaaccaggcactgacttctgctctccagctatgaaagtctgaggtggcattttccccccacctagtgtgaggctgttttatctgtatggaaaatctgtcgttcaggatagccaccttcatcagtgatcttagggagatcttctggataacttgctgcagcatctacatccacacttggtgctttgcttgcacctttatggaatggcttctttccttatacctcatgaagcaacctttgctagcttccaacttttcttttatagctttctttcctctctcagccttcacagaattgaagagagttagggccttgctctggattaggctttggccttaaggtaatgttgtggctggtttggtcttctatccagacatttggtcttcttatcagcaataagactgttttgctttgttagcatttgtgtgttcactggggtagcagcacatttaatttccttcaagaatttttttgtttgtattcacagcttggctatttggtgcaagaggcctagtttttgccctgattcagcttttgatacgtcttcctcattaatcttaattatttctagcttttgatttaaagtgagagatgtgtgactgttcctctttcttgaacatttaggggccattttatggttatttcattttttttccatttttttgtctaacgtgattcagagaaatgtagagttattaaatggactaattttcatatttttatgtctcagggaatagggagcccaaaggcaggcagcaagacaggagaatggctgtcctggtggaacagtcagaacacatagacttatctattaggtttgacatcgtacaggagtgtggttggtggtaccttaatagtaatatcaaagattgctgatcacagatcatcataacaggtatgacaataatgaaaaagtttgaaatattgtgagaataagcaaaatgtgacacggacatgaaatgagcacatgctattggaaaaatggcagttatagacttgctcagtgcatggttgccacaaaccctgaatgtgtaaaagaccacaatatatgtgaagtacaggtgaggtatgcctgtacgtagttggtgcctgtagttttgtatccattgaaatatactgtcactcattgggtctgcaattgggtgtaataataatatcattttattgttaatgggctttgagtcttcctctttcttctgtgatagtttgccattgtcaagttaaatttttatgagctttttcagagcagaaattaaacattaaatggtttattaaccaaaataaggcaactgcctttagactttaatgtagtacccattttttcctacagcttatcgtcttcccagtttaaaaggcttaagcagaagagtaacagtatagttaaaagtttttaagttacaaagttggaacttgcctttttttgattatatgatcccaagagtcacaagagagtaggcagaaagattactgctttatcaataggtgaaagttcaggtt

SEQ ID NO: 14810 - DNA, 1038 bp, Homo sapiens
ggctgcattcagaaatatgaagaattttattgtcagctaattcatgctgatgtacatatcttagatccagaaatataaatgatgatagtactattactacttagggctggatcacaaaaagccaatatgcacttaggatttgaaggtactttcaaatgttataaggaaacagtttcatcagggagtagttgtaggaatgtagtttggaattttgtcaagcatatcttttctgtcaatcaaaggcatggttttgtatgacacagtgtctaactcttgcttctgatttcttctgtttatatgaaagatatttctctaggtttggaagtataccaaattacatgcctaatgtgtaaaagatgtttgacttaattcaagaagaccttaattttcagaattggtgatgataaaaatgaaatactacatatatcaattgctgatagttcagaaaaataaaacatattagattctatgtagctaaaattaattgtatttaatgaacttgacaaacactatagaacaaagcagaatttaccagcttagaggactgtgtagacaagacagatccaatccttttgttaacatgaatgtgtcattaagaaggaacatgtgaactggacgttggagtacatgtagaatttggacagatgaagatgggattggggtaggagtttggcttttagcaatgaaaatagtgtgggcaaagatggaacagaggtggagatgtaggagatatttgggaacattctttccctagttcctttcctgaaagtaaggactttaggtagctttttgacactgtggtggatactcagttcaggtaacatctttttttgttttactttaacttggttgtctgttttttagttttcacttgttatacttaaactgggaagaaaatttaaaaaaacagagacaccagattctttaaattttaagagtcagtattccctttcagtttaactgaatgttaaatgttttaaaatgttaagtatctggccgggtgtggtggctcacgcctgtaatcccagtagtttggga

SEQ ID NO: 14811 - DNA, 1052 bp, Homo sapiens
tttcaaaaccaaagggacaaagatccccatgcaccttccatctatttggggagcttcttatttttatatctgtggatcctacagtcaaaggaaggcaagagaaagtgaaaagaaaataaatttgaaaaagaaggaccaaagaaatgaagatggccagaggaagttttagagaaataaaacaggtaacatttgatggagaatgatagtaccatttataacactcggatcgctgtctccagtcagaagtgaacaccaaccattccaaaagctagtgcccccaaatagtttacttggtatgtgaaatataatatgtgagaatattttttgatatgggatttaaaaattgaatttctgccctggttcatttcagcagaaatcatagtagaatttgctttactgtaattttcgtaaatgtatacctttgtagtgtatgcaatatggaagaaatttacattctattattttgtttttatagaatacaaaatagtcacagtcaggttaaaacttacatgagaagtcagagagagagtaggatcaggaaacaaaagaattgtacgttcattcagtcctcaccaattacagagaatattatatgtattatacaaaatacattgcacataataaatctctcacattttgtaaatatttagctgttgttgatttatttctgggctaatggcagccgtcacgtctctggtctgtgttgggaatgtctgtttatatgtctgtgtcacatcatctgctctagcatggaggcttcatggaagacaggaaccatgtctgtttattttgtgtgatagtaacatggagctctatatatgaagctttatttttatttgatgatgatgatggtgatgattttctgtatgaatttctttcctggcttcagattgattgaatcttctgatcactattaatccagtggaactcagaagtggagtttacttttgagtgcttagcctggctaggcagcaggcttttgcaaacacggctatatgagatcttatgccaccacaaagaggcactctcttgaaaaaagatgaaaaatacag

SEQ ID NO: 14812 - DNA, 1031 bp, Homo sapiens
agggctatacttgctaaagcttgaaacagaagaacaaaattggtcactaagaaagtaggagaggttttcattcatatccactgtgtatctgtgtctcagacaaagatatgctggctatcagaatgctgacattgcttactttcctatttttcaaagactgaacaccatacacatagcttgaggaaggatattattcttgtatacattttgacataaagatgtttagtccttggctggatatttcagttctctgaaaatgtgtagctatcctgtgagaagcaaacatcttggaaacagtatagtatagttgaaggaaacggtcctaccgtttccttgcttagacaaatcatttcatctcttcttttctcagtatttttttttctggaaatctactctttttctagaaatatgtatacaacatttaaatttgcatgtgtctgtcaacatcagtgtgtaaacatattatgttcactatgaaaacatttaggaaattcagataggcaaaaaggaaaagagatcgctgactacagcagaaaactataacattctgataaagttagataaaagccttttgggcttttatagtacatgtatatgcacacatacacatagactcacacacatacatgtacctacaaataacatcttaaaatgagttcatattgttaaaaagtgagtttatatagctaaggaagcacatctgaggacaagaacacctctattgcaaaactaacagatgatatagaactagtatggaatacaatagaggtgactaaaaatttaatggtttggagtgaaagcgtggaataatcacggtaaacacaggagtaagacacaaagatgaaagcaatttggttaacaatgatctgatatgaagttgaaaggattactggtgtctttgaggaagtggacccaacaaatcaaactaaaaaagtatttggagaagtgatatagcaaaacttcactgaaatgaggaactgaacctgcagatcaaaagatacattgaatcctgaaaattggtagagaaggtt

SEQ ID NO: 14813 - DNA, 1028 bp, Homo sapiens
cttgttggacccagttcaaaggacttcactagcattaacactctctctcctttctttctccttaacccacttctacccaattactgacattgatgggagttaaatgtaaccaggactctttgtttatatatacatctggttttccctgttccgtatgcctaaatcctccctccattgcttctgtttagcatttaatgtaaatttccaaattaattcaagaagaaaatttgaaatatataagatgagggcattaggtgatctctgagggcttttacagctctaggattctattaggttattaataatttatttccagaggatacattctgataaactaagaagttttctgtgcttgatttagcttttacttaattaggaatataaataactaaatatttaaatagataaaacttatgctatttgtcactttttcttgaagcatatttataatgatcatttaatgttcaaagtaaacctccaaaaggacttggtaactgccaaatattaccaccaaactgtagactaatcaattagaccactagtatttgaatttttttcttttactatataaaactaagaaacgtggactgaatcaaagtgaatgggagctttggataaaatattggtaagatgtttgcacttactgtctgcttttgaatgttcagatatttaagaggtaccatcatataccacgaacaaaaggttgggagtcaggaatcagggaattagtcctagctcatcactgtctcattttgtgattgcaggtcatgctttgctcttaaattttcccatctttagcatgtagtagattatttctgacccttaacttacccagggatgttttgtgaaataataaagataaccactgccagttattttttgctgctcagtaaagattctacacaaattaatggtagcagtagggtggttatttcattatttaagaaagttcttcaaagtgagagaactacccagcataggtcatttggaattgctgtttatttgttcttttaggccagcaaaagtgt

SEQ ID NO: 14814 - DNA, 1807 bp, Homo sapiens
ttatcattatgtaagtaagctcaaatctcattggtctctttatataaaaaggaaaaaaaggaaaaagagcagaaaagataaagccccatattttgctgcttctgttttgctgctattgacataagaaggcctatgtagtcctatgtaggcctttttatgtcaatatcagtctgagtaaaagcaaataatgaatttatgctgaggtacaaatataccatttggacagttttatattaacatctgacaatgtacaaaagttatacaaatttgttagcattttctcactgcaaaatattatcaaattaggaaatagcagacactagggatggtttttactatatataatgatgtttaagaggtacttaaacttgatttaaaagctctgcagtgatttacctaagatgagcctgaagagctaatagtctagtttttgttttttaatttttatttgtagcaacaagcacattaaccatttgattttttttatattttgggagaaagttgtgaccatgtggcagtttggatttgaaataataatggcaaataagtggcctgtgctgaaaattgttaggcatatctctttatggaaaactactttggtgatataaaaccaccgaggtctatagttatataatttaggcaagcagaaaaatcagacagggctggttttttttttttctttctttcttttttttcttgacagtgtctccctctgttgccaggctggattgcagtggcgcgatcttggctcactgcaacctctgcctcccaggttcaagtgattctcctgcctcagcctcccgagtagctgggacaacaggggcgtgccaccacacccagctaatatttgtattgttagtagagacagggtttcaccatcttggccaggctggtctcgatctcttgacctcgtgatctgcctgcctctgcctcccaaagtgctgggattacaggtgtgagccaccatgcctggccagggctgggtttttattaaagatttagtttcgttcttagaagttatgtcaatttctgatgagtaatctagtaataacttaatctgtctttctgaattaattctgcaaaacactgccacatactgattgttgtaaacattgttggtttcaagacactttcttattttaaccctcctaacctttcaaagattcctcattacttatggtttaagtcattccttcttgttttttatattcaagacctttcacagttgatcactgagctgtcctttaatcctctgtgtcactgcttttcagtatgaattgctaaagtttctatgatttttctgtttctttgccttttgtcaatctttgttcagtctggactctctgcctttctctcatctctacctactcttctaagccctagaatgcttcaggtaccacataaaccacatcagcataaaaccttccatgacattctattcatacatgttgtaaatgcctcttttgtgccgagctgtcagtggtcaccaaggtaaggacaggagcaaaggatgctccgtggtactccactctgatggacgaggaaaaatgataaatttacaaatattttatctcatcctatatacattttactttttatttatgtcttataatgtaagcaataaattggtacccaaatagaaagtgtaaaataattaaaatacatatgttgagggagtgcatgcccaaaatgttttactgatggggtatagaacaaaaagttaagaaaccaccgatctaattgtcaggtctgtttccgcatttgtaaagttaggtcaaggattggactagataatttccaaggtctt

SEQ ID NO: 14815 - DNA, 1043 bp, Homo sapiens
ttcggatacctggtaagtgctggtcgctctgctaggtactaggaagttgatatatactatagtttctctgaccatttacctaaaaatctgttaataggctccatttcttctaatcatccaagaaacatttttttaatttttaatttttgttggtacatagtagttctgtatatttatagagtacatgagatattttgatacagatacacaatgtgtaataatcacatcagggtaatcatgcttgagggtatggataccccatcttttagttattttaaaatgtacaaaaaattattgtaaactatactcaccctgttgtgctatttagccctatattttattaattctatctaattatatttttgtagccactaactatcccaccctccctccatcccgctacactccccagcctctggtcaccatcattctactctctatttccatgagttcaattattttaatttttagctcccacaaacaactgataacatgcgaagtttgtatttctgcgtctggcttacttcacttaacataatgaccaccagttccatttatgttgtcacaaatgacaggatctcattcttttttatggctgaatattactccgttttgtgtatataccacattttctttgtccattcatgtgttgatggacacttagggtgcttccaaatctcggctgttgtgactaggtctccaataaatatgggagtgcagatatctctttgatttactgatgtcctttttgtggatgtatacctagcagtgggattgccagatcatattgtaactctatttttagtggttttaggaccctccaaactgttctccatagtggtggtaataatttacattctgtcaacagtgtatgagggttctctagtaaacaattattactttgttttttgtgatgtaacctctaaagacaagtataaaagaaacactggaaaatactgatttttaacgctgtatgctagctattctaacaactatatgttaataacttaatatataactgttagtatatataataacagctg

SEQ ID NO: 14816 - DNA, 1035 bp, Homo sapiens
tgaccttgaggatgttatgctaagtgaaataagccagtcacaaaaagactaataatgtatgattccatttatatgtggtacctagactgcttagcagattaagggatcttcaggatttggagtataagacacactcggccgggcatggttgctcacacctgtaatcccagcactttgggaggctgaggtgggcagatcataaggtcaagagatcgagaccatcttggccaacatggtgaagccccatctctattaaaaatataaaaattagctgggcgtggttggcacgcacctgtagtcccagctactcgggaggctgagacaggagaattgcttgaacctgggaggcagaggttgcagtgagccgagatcacgccactactccagtctggcaacagagcgagactccatctcaaaaacaacaacaacaacaacaacaacaacaacaaaaagaacacactcacaataggatataactaagtcatctactccacatgtccaaaactgggaacttaggatctttttctcacacatttatccttgctccttccatcccaagttagaaatatggatgtcaacccatactgcttttttcccccctctgaatactattggagaccaagccctgctgattttatattctttttttttttttttcttttgagacggagtctctctctgtcacccaggctggatggagtgcagtggcgcaatctcagctcactgcaagctccgcctcctgggttcatgccattctcctgcctcagccttccgagtagctgggactacaggcgcccgccaccacgcctggctaattttttgtatttttagtagagacgaggtttcaccgtgttaaccaggatggactcgatctcctgacctcgtgatccgcccgccttggcctcccaatgtgctgggattacaggcatgagccaccgcgcccggcctatattcttcatttttaaaaaatctgccttctctacattactggtacaatttattcattcaaggagtacttaattatatagtattcca

SEQ ID NO: 14817 - DNA, 1060 bp, Homo sapiens
aggtcttagtcacagtcacgtcctaaattatgacagtttactttggtctttcggcctctagctgcctccaaccccttctctatacctcatctttttcctattgtctgtgatcaaaatgttctttaaaatgaacacagatggttttctttctatttatgctgtttgtcatttgttgagatgcttttacctgttttttgatattttgtcaaatatggtaaatttttggccattaatttttcacgtactgtcctgccctctcagcctacccatggtactgtatttacatgtaagttcaaccagttaatactgttccacagatcagcgaatctttgctaattttatttgtcttttttctttctgtgcctcagtgtggatattattgtgtgcttcaagttcattatctttctcgtgccaaatctgctattaatcccattattaatagtaatatggaaattgtgaatgtgatgctgatgaatgcagaactctattgtctttctgtaaagaatgttgagctttcttctaggaagtagtttgagtgaattgtggatcagtacaacccttttgacacttgttagagtttgtccagagttgtttttactctagggcagtggctctcaaagtgtggtacctggaccaacagtatcaatgtcaccttggagtgatgcttagcaatctgtgttttaatacatctctaagttattgtgatgtactcttaacttttaaccttttacccctttagaaaatataagtgcagcttactgccagtgcttttttaacgttacataaacatgggtctttgaggctgaagcaaatctgactgattttcaatgtggaaataaaatataaaaactgttcttagagttatttttaaactgaactaacatcagaatcacctgaatcatcagaatcgtctatttcggaaaaattagattcagccaataactgtttgagaactgtgttaacatcatgtgtaggaatgctatgttttctaggatttgacatttttggtgattgagaattactacattttgtaaatggatatatcactaccaaaaacaga

SEQ ID NO: 14818 - DNA, 1324 bp, Homo sapiens
tagatcatctcattacctaggtattaagcccagcatctgttagctattcttcctgatgctctccctcttcccatcccccaccatccaaggccccactatgtattgttcccctccatgtgtccctgtgttctcatcatccagctcctacttacaagcgagaacatgtggcgtttggttttctgttcctacattagtttgccgaggataatggcctccagttccatccgtgtccctgcaaaggacatggtctcaatttttttatggctgcatagtattccatggtgtatacgtaccacattttcttaatccagtctatcactgatggacatttaggttgattccatgtctttgctattgtgtatagtggtgcagtgatcatatgtatgtatgtatctttataacagaatgatttatattcctttgggtatataagcagtaatgggattgctgggtcaaatggtatttctgcctctaggtctttgaggaatcgccatactgtgttctacaatggctgaactaatttacactcccaccaacagtgtaaaagtgttcctttttctctgcaaccttgccagcatctgttgttttttgactttttaataatagtcattctgactgatgtgagccattgtggttttgatttgcatttctccaatgatcaatgatgtggagctttttgttatatatttgttagctgcatgtatatcttcttttgagaagtgtctgttcatgtcctttgcctactttttaatgtttttttttccttgtaaatttgtttaagttccttgtagatgctggatgttagacctttgtcagacagatatattgcaaaaattttctgccattctgttagaaactataatcagcttgatgatagtttcttttgctgtgcagaagctcttcaattagatctcatttgtcaagttttgcttttgttgcaattgcttttggcatcttcatcatgaaatctttgcctgtgcctatctgctgaatggtattgccaagattttcttcttgggtttttatagtcagggttttacatttaagtctttaattaatctcgagttgatttttgtatatggtgtaaggaaggagtccagtttcaattttctgcatgtggctagccagttctcccagcaccacctattaaatagggactccttttcccattgcttgtttttgtcagatttcttgaagatcagatggttataggtgtgtggtcttattcctgggttctctattctgttccattggtctatatgtctgttcttgtaccagtaccatgctgttttagttactgttgccttataatatagtttgaagt

SEQ ID NO: 14819 - DNA, 1047 bp, Homo sapiens
agttatgcatgtatttagcttagtgatgttgccaaacagttaagttgttgaactaatttatattcttaccagcagtgttggagtactggttgctgcacattcttgttgggcttcgtatttaactactatattttagctactctagtgggtatattgaataacatgtagtatgctgttaacttgcctttctttgatgattaagcacattaaacacttttttcatatacttattggttatttgtataattttggtgaagtgatgtattgcttctcgacatgctataaagaaatacctaatactgggtaatttataaagaaaagaagtttaactggcttatggttccataggctgtacaggaagcataacggcttctggggaggcctcaagaaactttgaatcatggcaaaagacaaaggggaagcaggtgcatcttacatggcaggtggaagagagagaggagggatgtgctctacacttttagcaggaggaagagagagaggaaggaggtgataacacttttaaacaaccaggtgtcgtgagaactctatgaggagaacagcaccaaagtgatggtgctaaaccatttatgaaggatccacctccatgattcaaacaccttccaccaggccccacctccaacattggggattatacttgaacgtaagatttgggtgggacacagatccaaaccataccaagtgcctactcaagtttttgtccatttgagttgtctgcctttttcttaatgacatgcagaagttctttatatattataaataccaattctttgttgattttatgtactacaactagcttctctatgggtatatttttattagttactcagtttttaaatagttatccaaactttctatttccttttgagatctttttaataacatttttccagaaagttgttgatttatcttaatttttaaacctactgataaaaagttgtttaatctatttttggtatcctttcaattattctagaaaattattagttgctatcgctttaaatattgcatatacaagtatatatgagg

SEQ ID NO: 14820 - DNA, 1120 bp, Homo sapiens
gcagcaggcccatttgagtagttctctttcactctgatctccttagaaacctatcacttttacctttaaatgatacatttttaaaaaactattgttgttgttgaatgggatttccctaaataagaagagccatctccctagtttcaggattgtggcttctttaattgtaatggagttttaatattatatctacggtggaaatcagagtcaattcaatcttattttgcatcccctgtatgctatcatactgattaggggtgtaacaaagaatggactgtgatttttgccattttgtggttttcactggagattttatagtacagagggagagaatggcatagtaaataaaagaatgagcttagaagtgagactttgtgggtttaaatacctgctctctaatttatcagtttgtatttaacttctcaatatccttatctgtaaagtagaaataacagcactatcattcatcactttctatttccttatctttttgccttttcttcatggaagttttcacttccaagacattatgtttttcttcatttatttacagtaatgtaaaatcctggaatacatgtacctttttggttcactcatgtatttttagtgtctagtgtagggtttgctacataatagctcctaatattcgttccttctactgggaacttcttccaacatgaatatccatatagcttatccccatgctttatttagttccctgctcaagcatcacctcactagagagaacttgctagacgacctcttctataaaatagcaccctttagttttctctattttttcctgctttatttttcttcataatactttactgactgctaagtagtaacatcaatttatttttatattttcgagtgccttgcaaaaattagggtcttcataaatgtttgtttaactgaaattaattatcttagactattctatcttattctcatatgtaataaattaccagcttgtgactgtttatttctaggctccttcaacctattcatttgtttctatgcttatttccacttcttttttcactacactaattcagttaactgccacctgttttgtgaacaattgagtagtttctcaattttgttttgttttcctcca

SEQ ID NO: 14821 - DNA, 1049 bp, Homo sapiens
ggttgtaatatctgttaccactctatttacttggtgtgggcgagtttcaacaaggattagattttttaaattaattctctatatttttatgggggagaaattgaagcattccattatattgtaggaattcccggaacttcttagtattccttttctaccttgttaaaccattaatttgtttctatcttattcattttacttgaagacttaaacatttctgtatcactgacagccactcaaacagtactcataaaaaatgtgtcataaacatgtactgagtcaagtagcaaaaccttttaaattattcagctttttatgtgtctggattttgagtcatagacttgtgtgtgccatggggtataatgaatgggtaatggactttggagtaaataagcctaagttcaaagtctgattcttccatttaccagctgtgaaaacttgggtaattattctttgggcctcagacgcatctctgaaatgaatataataatccctagcttgtggagttgctgagaggattagagataaaatatgtaatgttccttgcatatagtaagcattcaatacatggttagttattaggcattcagtaataattgagtggatgactgcttcagggaaaatttggtggctgatttactgaaacacccagtaaacatatatgaaaaaaaaaaacacaccaaaactgacttttagttagaacagtttagagaaactgagagtcagtttataaaggagccttgcaaggaaactgaaaaggtgaaatagacgggaacaaaacctacagagtaccgctgcagtggagaaaagaagtttcagaatgctagaatggtggcagtggcaaattctatagtgaattcaaacaagaaggtcaataattggtcatctctggatttggtcacctttgttatttcccaatttctgtatattctttttatgatcatggttgacaaaagtatagcgctgaacataagacatgctaggaaggaaaatgatttaggaggtacagttgattcttgaaaatcatgggtttaactgcatgggtccaa

SEQ ID NO: 14822 - DNA, 1035 bp, Homo sapiens
agttgggtagctatggcaatttcttaaaataagacaacaatgaagtttgttgattgactcttgaatcagtttatttgcttggtaataagagtagtacccaataggtagtttttcaacctatactcctctccattcctcccacccctagtagtccacagtgtctattgttcccatgtttatgttcatgtgtagtcaatgtttagctcccatttataagtgagaacatgtattgtttggttttctgttcctgcattaatttgcttgggattatggcctccagctttctccatgttgctgcaaaggacatgattttattcttttacatggctgtgtagtatttcatggtatatatgtaccacattttctttatccgatccattattgatgggcacccagattgatactatgtctttgctattgtgaatatcctggtgatgaacatatgagtgcctgtgtctttttggtagaatgatttattttctttcaggtatatccccagtattgggatggatgggtcaaatggtagctctgttttaagttctttgagaaatagccatctgttgttttttgacttttagtaatagccattctgactggtgtgagatggtatctcattgcggttttgatttacatttttctgacttttagtgttgatgggcattttttcatgtttgttggctgcttgtctctcttttttttttcttccaactcttatttcaggttcaaggggtacatgtgcacgttcattacatgggtaaattgcatgttgtggggtttggtgtctagataattttgtcacctaggtaatcagcataatacctaataggcacattttcagtcctcacccttctcccaccctccaccctcaagtgggctctattgtctattttcttcgttatgtcctggtgtactcaatatttcacttgtacttatatgtgagaacttgtggtatttgggtttttgtttctgcattaatttgcttaggataatggtctctagctccatccatgttgctacaaaggacatgatctcatt

SEQ ID NO: 14823 - DNA, 1049 bp, Homo sapiens
ctgtctgtacatgacctgacccttctctctagctgcctttacaatttttgtcttttacattgactttggtgaatctgatgtctgtgtgcctcggggatggtaatcttgtatggtatctagctgagcttctctgtatttcttgaatttacatgtcaacgtgagattagggaaattttcgtggactgtatcctcaaaaatattttccaagttgcttactctctttttttctcactcaggaatgccagtgagtcatagatttgatctctttacatgcgctcatatttcttgaatattttgttcattttttaaaattcttttttcttggtgtctgactgagttgattcaaagaactggtcttcgagttctgggattctttcctcagtgtggtctgttccactgttaatacttccaattattccaattatgaaattcttgtagtgaatttttcagctctagaatttcagtttggttctttctgaaaatggctattttgtctttcagctcttggatcattttactggattccttggttgaggtttcaactttctgctgaatctagatgagcttccttgccatctagattctgaattttatatctgtcatttcagactggttaagaaccattgttggggagctagaggactcatttgtagttaagtggacactctggctttttgaactgccagaattcttgcactgattttttttctcatctgggaagtttggtgtttctttatctgtgatgcaggttgagtatagtcagttggcgtcatttctgggtattttcagagggtcaggactctgtacagggtctttgtggctgaattcttgcccctggtttcatggagttaggggggcatattaccaaaatatttttggtggtgtacttcaggctgtgatctggtagatggcacttaagagtaatgatcagtagctaggcttttattcatctgtgtgtcttctttgtatttcctcatgttgcagtcatgccctctgtcaccagtacgttggggagagagatgacctttccaccaggtttgcttctgggc

SEQ ID NO: 14824 - DNA, 1059 bp, Homo sapiens
ctcctgcctcagcggtcagctgggttagagcttcttggagggagatggggagccctgggagatgggtgtctatggctgtgctctgctggcctctcccacgcacagaggtccttggctccatgctggctgaagccctgattctgtctactccctgggcatatccctttgccagctcaaatatccatggtggatgtgggttcccctgtagctaggattccagaggtccacagtgatagtgtgcagtcccacagtctcttcattaaccctctcccgtggagctgttcagggctgggaagtagccctaggctttgggtagctcacacagggttcccagcttcctgtctcatcagtctcagtatctctgtcacatctccatctactttcagtgtttcttctctgaagatccgttcaaattgtgttggtttacttgaaattttggtctctcttgtggggagcagtgcttcttggcttcatctagtcagccatcttgtcctttttcaaactttttttaaaatttgggtcagtcctctgaaaccctgccactgctttatcagctaagtttatggaatattctaaatcttttgttgtcatttcaacagtgttcacagcttcttcgccaggagtagtttccatctcaagaaaaaaagtgttatccataagatagatccataactctttttggtaatccataagaaataaatgcttttctctcttttgttcaagttttatggtgagattgcaacaattcaatcgtatcttcaggctctacttctcattctagttcttttgctgtttttcccgcatctgcagttacttccttcactggagtcttaaactcctcaaagtaatgcatgacagctggaatcttcttcactcctgtgcatgttgctattttgaccttttccagcgaatcaggaatgttctgaatagcatctagaatggtgaatccttcccagaaagttttcaatttgctgtacccagatccatcagacgaatccgtatctgtggcacttacagcctcttgaattgtgtttcttaagtaataagacttgaaagttg

SEQ ID NO: 14825 - DNA, 1025 bp, Homo sapiens
ctcaagtgatcctcatgccttggcctcccaaagtacaagtattgcaaatgtgagccattgtgcccagcctatttgtcttcttaagcctacaataagaatgttgaaaagatagtttatttatataaccccatttgatacaaaattcacatcaaatagagttaattaaataatggatgtcccttgttcatcatttcaggcagatacaaataccacttttagcaaaaaaggtaaatctcttgttttaagttacccagacgaagattatatagaaagttagggtaatgacattcccaaggcaaaagttcttcagggaaaaatagtaagccatttcagtttctcaatttctggagggcttatctgaagggattgggatgtctaatattgcaaattaggcaaattgtgcacatttatcaccatgcaccttggatttcaagcagaaataagaggaggatttgactgaagggaattaactttggtcttccaaacttaaatatataccagatgtgtactgtggaaggatcttcctggttacagtataacctctggttcttttggactcttgctaacttaatttacccagttcttttcccgtatagaaattagactgtggattgtttctgtggattatactcatggatttctgtggattatactcatggattttattgttttatcttatttacagattctgacttttttcttttctttctctttttaaaaataacttaagatgtttgtttggaagattggcaggatgttcgttttacagtgttcaaaaatgagttgtttgtgttttatgtatatgcccaaatactctgtgaaaacataaactgataaaaggaaaattaattcctatctttataaagtgaagaattgtttttttttaacaaattaacatatcctgagttacattcttgagtgagatatgagaatttaaacatataacatgaatacccccagttttgagtgctaatatgcaaggaaaggctttcctcattactgttttacaacttttatgctccata

SEQ ID NO: 14826 - DNA, 1028 bp, Homo sapiens
ctcaaatgaatatctgtttcctacctttctccctcaagatgcagtggtgcttttattatttgattttgtaaagcctgaagggcagaaatatttcttaagttttccattgttaactacaaacttggctatataaaatatacaaatcataatatctgtatggttatttttattgtcatttctttaacacacaaaatttatcacatttatgcaagaattttttaacttagaaaactcaaaattgatatgtaaattgggtggtagcaacaatgtgtgggatgtggtacgtggccaatgatgtgttggaggcagcccccaccagctcccaagatctagtgattaaattttcagaaattttgtgagccagttatcagtaaaaattaaactatataaacttacaattaaataaattatttaaaaacaaagataatactcaaaactcagtaattatgttttactacattttattatctatgctcttgaggttatttgtgtctcttgtatctgtattggaaatactatataatggtgtatactattgtatatctcttcacaacttcatgttcattaacatcatgttgatagcttcaaattagccatggtagaagtattaacaccatgaaaatcagcaaacacaaccaatcaggggctgatttattgttttgctgattgtctagacttaagaaagtgatggaaaaaatgttaataacacatattaaaaagtgtgttatatctggccgggtgcggtggctcatgctgtaatcccagcactttgggaggctgaggcaggcagatcacaaggtcaggagatcgagaaccatcctggccaacatggtgaaaccccatctgtactaaaaataaaaaatttgctgggtgtggtggcgcatgcctgtaatcccagctactcaggaggctgaggcaggagaatcgcttgaacctgagaggcgaaggttgctgtgagccattatggcgccactgcactccagcctggtgacagagcgagacttcattccaaaaaaaaaaaaaaaaaa

SEQ ID NO: 14827 - DNA, 1075 bp, Homo sapiens
ccatgcttttgtttccttgagaaaaggagcgtccctcttagagcatagaataaacattctttgtgaagtgtgacttatttatgcttcaggggttgtcagtgtatacacaatagagaaggtgatggaggctccgaggcatgccaagtcagcactttgtgcatgttgaggccaaagagcatgttaagcaggcttaaaaaattttaacaagtcagaacattttacaatttccatatttatcaaacatgtcaggggatgggatcacaaagccttccagggattaactgcctctctgacttgaactgttttattaagatggaagaagccaagttctcaacaccctgtgatttgctctaataaccacaagaatcagaatgtaggtgatccttgctgaatgaaagcaatcctaaggctaaatgctctttgaatggggaaaaaaaaaaactctctcaacagatgaactatgtgtgaaactttctaacagagcttaggagtttgaagtttatttacctagagcttcagttttattaattctctggttggtggttcttgacctttgacacccaaggacttagactgtgaagcctaaatagaaggcattcagaaacctgaagacattctcaaagaggggtggccattggcttttttggggttggcaaaacatcctagagttattatttgtttttacatgtttggggtttggcagatcctaagatgcattttgccaagcactttcctttgaattttagtacaggaatatcttgggtggaatttaattcgtgattcatttgcattatactgatcagaatgccattttggaaaagatatctgatgactgagaaatattaggagatttacaatttttaagtaccaactttttcttagatgggaagaaaaatggaattcaagccccaattattttcagtgagatttggaacttggaatcttgaactaagtagtagtttccaaatgtgtctgtattactttctctacaaaagcgaaccagactacttccctggcttgatctgcaaatctttagaaaagttacagagctgatatgcaaccttgggctggtatt

SEQ ID NO: 14828 - DNA, 1083 bp, Homo sapiens
aaacttgatcttcatctgcagaaaaagggaatcaaatctactgctcatttcattggaaagaatatttatttatcttgatgtttaatcgagctgtgggctctgccttttaaatactgattagttctccaatagaacagttcttttgggaactgggaagcttttattttagacatttagggtatagttttgaattaaaggctatttttccataagcggttctgaaaggttaagttttgtacgaaagaatgggctctagaaatttactttggaacttagatcacttcattgggaatgcctaagtgaatctttgacataagttgtccaggtgtctttgctttattctttggaatgaaaaaatgtatgggtcaaacagaacccatctgtttggaatatctttagtatccagactctgacctccatgtttttggttgtgagaatgtcagcatagtacctggcttctagaaaatgctctataaatataaattgcctgggtgaataactgaattaatgagtgacttaatgatagagactgagaatgagaagatagaatggttgttctggaagtgattgcttctctccagctaagcctttaactctgggctgtaccatcagtagtccttgcatactgaagtcagacttttctggtcaagaagaaccttttaggttcttgataaaataccttttattcttaattttcctgtaagtacctgaatgtattatcttgaataactccaattcaggtccttagattcctcacgttacttgaaattctttgtttcctctaagagttcactgtatctcacaaatatcctgatataattctgttggtaaatattgatctcactttgctctgagatcaggctgatgtatatgtgtggtaggtaataatccctatttaggctgatacattgttcacatatgcacatattataatacacgcaaacatacagaaatacacactttttccctctgaatttttggaattgaagacatgatactcctttatccttaaatgtttccatgcatgtttcctgaaaacaaggacagtctcttatacaaacatgatgtaattatcaaaaccag

SEQ ID NO: 14829 - DNA, 1055 bp, Homo sapiens
tctctcttgatgaatgcattcatacaattttagaattgttgagtatcaatataaaaagctattttttctgaaaattagtctccttataatttgtatttttcttaagttcatattttttagtaaaagtgtaaatttcataatttttattaaaacatttgcctccctaaagaaatttaactattttggttttttttttaatctgagaataggagtagggaaatttggagtctctaaggcatgccatgtagaagtttttgaacatttatatagaatggattgactttttctgcttgttcttctgtctgttgcctagtagatgtctctaactggatattcaaatgacacttcagaccatctgaaacttcacgtattatttccctcccaagtaaactagtcacccaaaccatatacacaacagtcagactcatttgctcacagctttaaagcaggttcttttccatttccactgctattacctattccaagtgccttgcacaactttgcctaaggagacactaagaattcttcattgaagagatgaagaaatgaatgaatacagggatgagttttcttcatttcattgcttctgtctagaccactggaaaaacgtatcttcctttattctgacctcttctaattcatgttctacaaagttatcaaaatgttattcttaaaatgcaaatcattcttaaaatgatatacaaacacacatcattccaggattcatttagtttagtgccaaggcctttcatgctaagttccctgcatctttctggtcttacctcccaccatgtctctttactgactttgttgcatcatcacgtggctgcatactccatttcctcccatgtgctgttcattctgcagaacatctcactgaagctttacctggagaactctactcactttgcctgtcggattcagatgtctttcctacttgttctcatagacatttatgtacagtctcgtgactcttttcatattaaactgttatcatgactgacttacttatctaggggctttctcttaatcaacacaggttctttattcctgga

SEQ ID NO: 14830 - DNA, 1029 bp, Homo sapiens
aacttaatgctgcggttgttctgcttagatggaattgtgtggggctgtgccaatgcctgtattgagaaagcccagtcgagcagaagagtttttggtttctgcatttagaactgccgaacaactgaggaaaaccgattaaatctggaaggtggcagctcacttgacaggcttctccaggcacctttgaggagaatcaaagataaataaacacattttatgagaggagtatggggtgagagggagtgtttggacaagagttaaaatttcaaagggagggggaagttctttttgacttttctcctgattagactcttgcctcatgtctttgttaatgtacaaattagagtttgtccctgtctacatgggtaagcttgatgggaaaggaagaagatagaagtatattttcaaagacctcaactatagaaggtagaaggaaactgatcaaatatgaatttctttattagaaaaaagtggctttaaaaactattttataagtcatattggatactcatgtgcctgtggaacatgcaaaaactctggcctgttgcacagaggtttgattttgaaactgtctaattttatttatttaaatttttttagagacagggtctcactgtgttgcccaggctcttgaactcctgatctcaagcaatcctcctgtctcagcctcccaaagtgctgagattacaagcatgagccactgcacgtggcccaaagtctgtaatttttttcagtaaagattgatggactttcattacggcctggtctagtgtgcagtgagttgccttgaggtcaggtagtacttgacaccccttatttactgggtatggaccctgttctctcatccttccattgtgctttactctttttttctccgtgaacaatttttacttgagcttgacttacctcaaaggggctatgaatattgaattggctaaaaataattcataacattctagatatatggagccttagagatcattgccctcttccccattttgcaaagagtaaataaagtgaagcccaaaa

SEQ ID NO: 14831 - DNA, 1025 bp, Homo sapiens
agtcccttggaaggtaacaatgttattacatgtgttttattaagcaagacaggtaaaatttaggcaaattaagtggcagaaaggaagagacattaaaacatttattctgtgacttgcgcctatatcatagagcgtgctcctgcattagggaaataaagaaataaaatgcttctcttttgttatagacttgatcatggtgcctatttgggtaattgtttatatatattcatatagttttatatattttttattttttgattatgagacacaaaggccttccaacacaaatttcaatgtatgaaatatctcaacttaatagctgaaggataagatcctgggttataaattctccattaaatgttgcagttatcatgatcaacagattggtgaatatgtctggtggctgctcagtattggtctagatagaatatactatgggaccaaaaaagatatgaccgtggagagctcactttggtggccacacactgcctgcaggctgcttgttctctgccactctgttttttgggaggactttcctttccctctcatagaatagcaaatttctgctaaaaagtaataaatttgctcaaaatatcaaaaaggtacgattagaatatcttccatagtaaaagagattaaaaataacctagactcttgcattagaaagcagagggagacatgacaaattattgcattcaattaacttttcttttacttactgagtgcccagaaattgctttaacaccctgaggtgtgaccataaggtaatgaggagtgatttttaaaaataaatataccataaggtacactgtttaaatgagtgctattcttcaatgtagccactctttacactaatccaacgatgctgtcattgcaagaaatatttttagaacttgtcctttcgaattgccgttagaagccatttatggactatagaagaaaacagtctcacattgacttaaagtcgcactacattttttaaatcaacccctcccctgcaaagaaatttattacccaaatagatt

SEQ ID NO: 14832 - DNA, 1045 bp, Homo sapiens
agcctaaaaggctgcaatgtcacttagaattttaaaagtaaactgtatactatacagctgaaaatatttaattttatagaagttaatataaaatgacttaagattttagttgtctataaaatcaaaatctgcctcagtgtcatgtgcttgtgatgtgggctttggagctgcattaacaaaagtacatgtcaagatcaaagatggacatattcgctgggtgcggtggctcacgcccgtaatccctgcactttgggaggccaaggcaggctgatcacctgaggtcaggagttcgagaccagcctgaccaacatggtgaaaccctgcctccactaaaaatacaaaaattagccaggcgtggtgtcatgcgtctataatcccagccacttgggaggctgaggcaggaaaatcgcttgaacccagtgggcggaggttgcagtgagccgagatcatgccacttcactccagcctaggtgacaaagcgaaactctatctcaaaaaaataaaaaaataaaaagatcgacatattcttcctatcgctctctgttctggtcagaccaccttttgtttgactgccatgtgttcacaaagatttttgataaatgttcatttaggagggaaccaatcagattatagattggaaatcaagtcacctgaagtacagttcaacaagctgagattacttagcctaaaaaagagaaaactttggggatatgtttaagatagacttgtttaattatataaactaaccagttaatagcatttcttattggaaggatattaaagagtttacagagtcaaagagaagaaggaagaatcaggctcagaaaggacagggaaagaacagcttaagagggctcagtaaacctggcagtcacattcttctgggcttcactgccaaagttatcacactccagcaactttcagtgtttttgttaagattcaaaactaggggatctggcttgggtcatatgttcactttttggctaaagaatggcagggaatcttgactcataatcccattaggctgcattcagtggggtagagg

SEQ ID NO: 14833 - DNA, 1048 bp, Homo sapiens
acaacaatgatgatgtcatttttccttcgaaagttttatgggatagatcaaatttcctatgaaatgagtatgttagataagaaaacataaagcataataaaagtaggactcctttcttttaacctgcctaactcatgtttatcctttatctcaggtgtcatcttcttcatttggccttcctagaccttcccaggctggtctgcagcccctcccatgtgctttcaaagtaccttttatcacaagacttatgactcagggtcattccattcatatgttggtttccccagttaattttgagtgcttttatgtcagaagcatcctttaatttccttattcccagaattaaatgatgcttggtaaagctattaaagactatctgttacactgaaatgaatataaagaaggaaaaactagttaatttaacttttactagttaatgaagtgttttttttttaaatgtcatatgacatgatttctatagtactggaagaaaaaattttttagagtaaaggaaaccacagtttgaggaaagaagatagattgctttgttatgaccttacatgcagattgatttacatctacctacccctccactctcaaactccttttcagagttagactcttttaagccctttaagggttacgtatttctgagtatgtgatttctgtcaatatcagaaattatttccattggcaaaaaaagttatgaaatgatttctataatataggtttacttttgttgcaagtaacttttcattctttatgtttttctttctttcaaatgaaaatattatcttctatatttaaatttgttccttgagttagaaatataatattttaaatccatgcttaatttaatttagaagacatctccaaggcctaaaattgacttgctgttttgtaaatcaacatgacaggataaacagaggccatagtttatttgggaagcagcatgatcgtcatgatttaataatagtgataattatatgtaataagtaaaagtaggaatctaagttttatgaagatggtttttaatgccatgtgtttt

SEQ ID NO: 14834 - DNA, 1046 bp, Homo sapiens
attttggataattacttaccaaacttatatgcaaattattgatgagagtcagaacacatcacagtttttatcaagtctccactaaaaaaggggttgggggcttgcagtgagctgagatggcaccactgcactccagcctgggcgacagagcaagactctgtctcaaggaaaaaaaaaaggcgcggagggcgagggggtggggggggagttattatgctgtctgagatggagtcctaaaggaacactgtgatttctgtggacaggtgactggctggatggggatgagagagctgggtacttgtcccaactttgccactttctaagttttggtgtgtttttagcatgtcaccttacttctcttagctgctattagtgtccccatctgtaaaatcagtctgatcaggctgggttagatgatctccaaggtcttttacaaatcatctaattctatagcttgtgtagtcttctgtcaggatttcttgttcttgaagtccctagttgacagataatggtgtggaaggaaatgatacatggcagagtcctgaatgaccaaaatggactttgtccacacttatgtgctaatctccaaagaagaagaaaatacaaatgggccagcggccaaacatgaaaatggtgacagtgagcaaaacattgaagcagacagctgaaagcttcatttcctggcccggctgccatgagaaatgctgtgcttgccaaacccttcaggctgtcaaggccagaactttggctagctcttattttgagctccccccataccacacacacaaaccacacaggaaaattgtctctctccctttatatttgtgccttttggctacacttctatttatgccaagtccttgcctaatctccttccttccagctgtcactatactctgcctgttgctttctgggggctttgaaaagcagctgcaaccttcagaggaagcgcagggtggttggcattggtggaagggtattgtaagtgtgtgtggactctatcagaaccaaccgtcacttttacctggtttatggacagtccaaac

SEQ ID NO: 14835 - DNA, 1062 bp, Homo sapiens
tctatgatccactttgagttaatctttctgaaaggtgtaaggtcagtgtttagactgatgtgaatgactatttggtccagcatcgtttgttgaaaagactatccttctgcattgaattgactttgcttctttgtcaaggttcatttaactatatttatgtgagtctgtttctgggctctattttgttctatttatctagttatctatattttcaccaatatcacattgtcttgattactgtagctttgtgaatgtatgcatgtattcatttaagagatgaggtcccactatgtggctcaggatggagtgcagtggctattcatgggcttgatcccacttctgatcagcatgggagttttggagtgctccagttccaatctaggccagtttattcctctttaggcaacctggttggttccctgctttcagcatattgatgctgaactaaatgtggacatccaattggcatagcacacaacagcccagaactcctgtactcaagcagtctttctgctttagcctcccaatagctgggactacaagtgcatgccaccatgcctgtcagattactgtagctttatagtaagtcttgaagttgaagactttttttttttttgagacagagtttcactcttgttatccatgctggagtgcaatggtgcaatctcagctcactgcaacctccacctcccaggttcaagcaattctcctgcctcagcctcccaagtagttgggattacaggtatgcgccaccacgcccagctaattttgtatttttaacaagagacagggtttcaccatgttggtcaggctagtctcaaactcctgactcaggtgatccacccaccttggcctcacaaagtgttgggattactggcatcagccaccgtgcccagcctgaagacttttatttctccaactttgtttttctttgtcagtattatgttggctattagtttgtttcctttctagataaactttagaatttgtccatatccataaagtaacttgtttggattttgattgagattgcaccaaatttatggattaagttgggaagaa

SEQ ID NO: 14836 - DNA, 1043 bp, Homo sapiens
gatagtataggggagagagtgtaaaccaaaagttgagatctgtattctgttttcagcttcattttaatggcctactggaagaccaggtacattatttctgctcttttttttttttttttttagtttctccagctatacatgaagaaaaaagtcctagtccactagccaacctgacaggcatgttgtgaaaactaatgaaagtataaagttctcatagtccgaagcataaaaggtgctgtaaccaataggtacaaaatactaattattatttttacagttcagcatagtaaatctttggagtaaatttttttcattatatttactagtctttcctttaagaattatttgccaaatttaactctttttctcttttaattagacccagagtatagtaaaaaaattgatggtttggctttcagaaagagttattttgttatctgtaccaaattttcaattaaatatttttagctgtgaatcaagtttcatcttcaaaagtgtcttcaattttaaataatttgagaatacttacctggttagtaggctaaactaacgtagtagggaagagagtgtaagaaaagtgctgttgaattcatcattcccattagcaccagtctgcggattcccaaacatgtatttctaggctcagatatttttcctgatccccagacttattaatccaggaactagtcaacttctttacctggatgccctgtaatgatttgtagcacaacatacataaaacttaatattctgttcctgaatttgctctctctgtgaatggaatatctatccaccccatctctcaagctgaaaaaccctcaccccatttcctcaacatctgtagatttaactgtcttaatactttatgccccttatctccatcccacaattactaccttaattcggcttttgctcttctgtcaccgggcagctgcaattgtcttcctgccaccagtctggtctcattacagtctactctcgataccatttccagattaacctttacaaaatgcaaatcatagaatattactgtctcattttaa

SEQ ID NO: 14837 - DNA, 1041 bp, Homo sapiens
attgatttaaataatgtctaatgaattttaagttcttcatgtggttagtgttttacattttatgagtaataatgaaatggaagattcaagcaaactccattttcctgagaaatatgcatctctttatttcccaatgttaattatctaaatgctgttagttaatgctatattactacaagcttttttttaaaaaaagagacaatatcctttcttaaaagaatgttataaatataaaaaagtacttgtgttaaataaatgttattgttcatttttagagaaatcgagtgttttcttggcagagatgggagaagaaatgtaattgcttaaataattaagtattcatgcttggaaacccaacttctgttgcagggttaacatatgaactggtgattaactgacaaaaattaagcatatgtgtttggatcatggtttctgtggaggccatagatttgctttatggaaacttgagcttctgtataacagagtttgaaaccattacatgatcaggtcatttagtaggacaacccaataaaaggtaacttgaggccccatgataagaaagtgtctaagaactaagtgatatggttacttaccaattaaaatgagaaaagtcatactcttttagttttcatctgttatggtcatggggaaaatatttctttgaattcggtcctgaacccatctgagacttggggaacattagcagcttctcagtgcatactttctagggaaggagataatggaagaccctttcttcctgtcttctgtggtctctcttgggagcccaggtcttactcagaataggttctcatacttagaggaaactcagattgctttggtcttagcctgtaaatcaaagggtgaagactttttctgttttccttaagagagttctgccctcagtagagggcagagaaagaatatgtgtcattaatcacttgagaattgtttacaactataatctagagagcacttacttgcccatggcaggcagtaaagttaccttggttgtgtaagaataacctgagtggtttactcaga

SEQ ID NO: 14838 - DNA, 1022 bp, Homo sapiens
aatgtttttcattttgagaagaggcaattgctattttgtaatggaacgcaaggactactggagataaaacttgcatgcaagaccagtacagcttgatgaagggagcagagtctagtttaacctctaaattaggagatgtttgttttaattttactgctattccaggcaagaaatattaagtgtctgctgtgttcaggactgctaaacattatggacaatacagtaatagtagaagacatggtgtctgcccttgagggagtgaaaattgaatagacaactcttaactatcaggatcaacaaaaaaatggtgttagttagggagtaataaaagtgccacacggctaactacaaaccagaaggccagggacggattactgtgaactcagctgctgtgtagctttgagtttcttgaatattgtccatgacccatttattttgttttaaatagagaattatatctgccctctaccaaatacacaggaataatctgagtaatgtttataactgtgatctgagaactttttgagtcttttgcaaatctgtaaacacagagtgagaatgagatatgacagtgtggtaaaagaggacttttgagatttattaatatttagaagtacaagggggaagaatacttttatagtatgattataatgttaaagatattcttcctttagttttataaaatgtggcttttgatcagtaagtggcaacttagaagaaaagtctatcctaagttgatttgctattccttgaccttaagaactatagaacactttattttctcctaagaccacttttttgtttttattttactccattcattaattcattcagcacataataacgaagtatgtacttggtggcaagcactgtggtaggacctggggatatgaagttgaagaagacctgggccatatctctaaaaaccttgtgaggggaaaccaagggggaaaaagtttctactattttaaataattagaatagattttattttatagttaaatttgaagaaaactacaatt

SEQ ID NO: 14839 - DNA, 1051 bp, Homo sapiens
tttggagatcaggaagattttgtcatccttcacattgcaagacttgaagacttgcaactcaaaatggtatatttttttcttttcttccaatagagaacaattccactctagcactcaagtatctaatacttttgggacatgttgaaactgtttccatttcatctgatttcactcagcaattatttatagaactctctgtgaggtaggcaccatgctaagtatcctgaggctgacaaagacatcctttctaagttgaggcagtgacagagggcacagcagccattgctaattgtccttgctgcagccttgttgggtgacacctctggcttccagggcctcatattttcacagcttcactgataactctctgagaggaattgtccctcccactaagattcccttctagaagatgagtttttccatgagcattttaaaattttctttgttgccttgttcatttttttttccaacatttaaaagagcagaagtgagggcgaagagaaaggagaatatttagatctgaaaaatgcaccagtccacttttaatctacttttgggaagatgattgtaagatattctgtacccacttagggatctcctgcccttcggatacacatgccttaactaccatcttgctagaatagaaggtcctgtgtttaggcatcaaagaaaggaattgcactgagaaattttagtgataattcttttattgtaatcgtgattttcttcctcctgctaatctttttaagtggtattaaaggaagcttcttgccaggcagtaatattcctccatgagcacacgatctttttccttatttggcactggaatttcatcaggctgtattagtctgagcgaaacatactctaggaataccttttttttttttttttgagacagagtcttactctgtcacccaggctggagtgcagtggcgccatctcagctcactgcaacctccgccacccgggttcaagtgattttcctgcctcagcctcctgaggagctaggacaacaggcgtacgccaccatgcccagctaatttttgtattt

SEQ ID NO: 14840 - DNA, 1429 bp, Homo sapiens
agtcacgggcagtgtgatatggagaaaagggctccaggctgagaggcaagggaacttgattgctgtctctgatgtactgcaattagttgagtgttcttatacttgtcacttaactcctctgtgcttcggttttctaatctataaaatgagggagccaacctaaatggctcaaaaaggagtttaaaagtaagaaagcataatattcagtaaacataagctaaaaccctctcccgggccagccacggagcaagacttcttcacgtattatcttctagagcatctcatctgatatagtttgattgtgtccccacccaaatctcaccttgaattgtagctcccataattcccacgtgttgtgagagggacccggtgggaggtaattgaatcatggtggtgggtctttcctgtgctgttttcatgatagtaaataagtctcacaagatctgatggttttataaaggggagttcccctacataagctctcttgcctggtgccgtgtaagacgtaactttgctcctccttgccttctgccatgattgtgcagcttccccagccatgtggaactgcaggtccattaaaccctcgggtatgtctttattagcgcatgagaacatactaatacatcctccaacccattttacaggtgagcaaactgagggccagagagactaagtgacttgccagttttacatagctagtttcagttctgggtagaacccaaatctcctgactcctaggccaggactcatttattttactgagctaggtctttgataatcatgctttgatacagtctttgagaatccattctagtttttctttacttcgtttctttttttcttccagaaatgtttattatgccctactaaatgataggcactatgttaggtacagaatggaactctgatggactcttccaggattttaaattcaaaactcaagtgtttcagttagtgaaggaggcttctggatctttccaggcatgtagatgtctttaaagatgcaatcaggcctcctcgtcacaagtgtgtggccagagatggagaaacaaaagattgacataagtatcctccaaggtttggagtcacttctggctttgcctaagaaggcagtagggcactcttgcctttcttcaaatagtctcttccctttctctccctccaggccccagatatggatgcttagcatgacttaggcgaaacttttccaactcccacaactgcacccctgttctctccttggggtccaaggccagttattcagtttgaagactgcctgggtttaaatcctactttcccacataccaactgttgaccttagattagttacttaatgcattctgtgaaatggcagtaatactgatatccacctcagagggttgttataagaattaaataaaacaattccagtagagctgtgattcttact

SEQ ID NO: 14841 - DNA, 1049 bp, Homo sapiens
ggaatattattgactttccatcaggaaggaaagaactcagttgtttttgatattactaagaaagagagagttttgcatttatttgtttgcatggacggtctacctaccgtgtggccttgttcatgacatggcggacctccctctctggggtcagtgtgaatagccaggctgcagctgtagctagagacaatggccagcactgttgggccttgccccttaagccccgaaggttaatttcctagtatttagtggcattgaacccgccaaagaaaatgctgtttcatctgggggaagataatttctgcatgtgtatttttttcatgaagaataaagaagagatatttttggaagaacataacttaacctgttggccttggctaggaaagctaaaaaagcaaggggtcagtactcttacaagtatcatgtcttaaacgtcagccaaccagtaattatttagatgccatcagaggggaagtcccatcccattgttattttttctctagactgtgagatgctttaaaaaaacctctctgtagggaaatgatctttaaaaaacaaacaaacaaaaagcctgagaatttagtgctgcatttgttgagaagtaagggccctggaaacggaggagtttttgttgttgttgttttggtgactgctttgccactctgcatgttacaaagggcaaattcttggccactgtttagggttcccaaaaaattccaagatgtccagttaaattagaattttagataaacaacaatttttgtatgagtacatctaaaatattgtactgggacctactcatacttcaaaattattcattgtttacctgaaatttaaatttaactgagccttgtatttctttttgccaaatctgcagtgctttgttacttcaataaaaaaactgtccaaggagcctgggagcttttatgattattgaaaatcactgtcaattttaaacctaaacaaaacaatagataaagctttgaaaatagaatcaagtccagtcataccaagtgaaaggagtcctttctcatttttttatcttcttg

SEQ ID NO: 14842 - DNA, 1046 bp, Homo sapiens
aaccctatgagacagatactgttatctccattttacagatgaggaaataaagacccagagaggtttagtaactttctgcaggtcacagagccattgaaaggcagaagtgggataagcattcaaatcaatctgactccaaaaccccttcagtaaccattgtactactgcatgtgatgcccttagattctccacttttcctctccctccccaagcccccagtttggcttgatattggaatcatccctttctctccttgttctttactggctggaattaatagagtactttcggtctgaaactggccttaaagaatctttgtccgtgtgtatcacactgcaatgcaatagacgcagaaatctgggcactagaagatgttaactttggatgcctcctgttttatatgcatatgattaaaccaatggggaaagaaagccctgaaactttattacaacatttttgtagtattaaatttgacatattaaaatgtgttatcattttaatatctttaaagagcctgaggagactctcaagccttagactgtaaatagctaacagctttgagatgagcttacataggagtcaaatgattgttccaagatggctgttctaattctgcagagctaccgtagtattcagcctactgcctgccaaaggcaaggggccttgcccctctcttcctcctccctgctttcctctttgttaagaagtaacaaaaatatactgcccaacacccactttcttttagaaccaacacatattccttctggctcactccctctataaaatgatttgtcagcattttgatctcattaaataaaaagttttacttggtcaaactgggaaagtttatgaagttagcccttccatcccatcatctgctgtggccacagttgttgactgtgaaatagctctgtgggtgtggtctaccaagtatcccaatagcatttcttacactgtgggctatggacccaaaggtctggaagagttgttttcatagggtcacactagaacactggctctttctggttaaaagcttccctagcctt

SEQ ID NO: 14843 - DNA, 1138 bp, Homo sapiens
gggttagtggcacagctgctgtttcctgcaagggacatctcaaatccagaagggaaaaaagacaaagttaaatatatagcaggaggataatgactgaacctattaacccatttatgcctagtgttccattagtggaacactaagcttgtgggagttatttatatcctcatgcttaagctcatcaccaaggtctgatttttcacataaaaattttgcaacctctggcataaatgggttaacaagaaggaagggatttgcctgttacaagatctgtctgtaatcacatatagccattggcagaaattacagtttacatttagaagacatgtttaaaactctttaccaaagggcaactgatccaataataatgatagcaacaacaataacatctatttatggcacctaataattttaaagttcctttgtgtacgtagttttatattcacaacaacctagtaaggcctgtaagttgactggagagggctagggtatgtaaaactaggtaaagaacttggattttatcctaagcataatgcaaagttttcagccagggatggacatgacttgactgacagtttaggaagattacttggcctgctctgtaggagtatagactgtaagggggccacatgaaagccaggagacaagtcagcaaacataacactaatccaggagagagattatggtggctcagactggggggtgtggtataggggatggcaagtggtcagattcaagataaatatgaagacattccttacaaaatctgcaaacagattgaatgtgaagtgtattttaaaaaatgaagaattggccgggcgcagtggctcatgcctgtaatcccagcactttgggaggctgaggcgagcagatcacgaggtcaggagttcgacccaatatggtgaaaccccatctctactaaaaatacaaaaaaaaattagccggacgtggtggcacacacctgtagtcccagctgctcaggaagtggaggctggagaatcacttgaacctgggaggtggaggctgcagtgagccaagactgtgctgctgcactccagcctgggcaacagagcaagactctgtctcaaaaaaaaaaaaaaaaaaagaaaaaaagaaaagaaaattaaaaaaaaagaat

SEQ ID NO: 14844 - DNA, 1030 bp, Homo sapiens
tagtatcatccttatattgggaaatctataattaagacttttctaaagtcatgagcaggtatacagaaagtgattgacttggtgaatgagagggatcaactatcctccagagcttgtacagtagagtggaaacaaatgtggtgttggactgagaacggtttaaggtattggaggcaatgattctgttcaagtgccaagattaaaccaatagactctagaggggctcaaaagtgaggctacatgtcatggtttgacgtctaaattatagctatgcaactttctttcctacccatttctactgtatcctctgtgctttctataatagccgctccagggaatgctgataataacattatcggctgccatttttatgccaggcacatgataagagctatacaaacatcatctttataatatgctgtgaggtgggtttttacaataacactgtgaagtgggtattactaccctgaatttacagatggaagaaatgggctatggagattatgaagtgctctgaagttaaaacaactagtaaatggtagaaaagagactctgaagtgacttgtagctactagtttgtcttgcctcataaacaatgtgatagacatctggtatttctgcttgcccttgatctcttaccccttctctcatacctacactatgattttcctgtaaggaaacatgcctcttcaatttttttcagcctatgttgtctagttagagctgagggctgattgtacccactgggttcatgtctgaccaatggaaggatcacatttcctttctacagagattggtttgcaatagttggttaacccaagctaagttgaatagagtaagcccagaattttgctgaacaataagagttgctaaattggtaggatataagcctggagctccttgtggctgtctttgccaccatatgaaggaactcacctcagaatgacaataaatcaacgtagagaaaaacaagagattgagagaatgttccaggtggaaggaggaattgaataattgaattaatataaga

SEQ ID NO: 14845 - DNA, 1034 bp, Homo sapiens
agagctatattgatgcacattttttgcaaacaattgaaattaaggtggtatcaatctgaactagttttaagttaaaatgttaatggcaatcctcagggcagcctctaagaaaataactcaaaaatgcatagtggaagaaacaacaagagagttaaaattgtacactagaaaaatacctaacacaaagaatgcagtaatgacagaagatagtaatggcaaaacagaggaacaaaaaggaaatacacacagaaaacaaatagcaaaatggcaggcatatatcctactttatcaataattacattaaacgtgagttgattaatgctccaaccaaaaggcagagattgacagaataattttttttaaaaacaacatgatccaactatatatgctgtctacaggagacacactttgagtcagacacaaataggttgaaagtaaaaagatggaaaaatacatgtcatgcaaacagtaaagaaagctggaatggctatgctactatcagacagattagactgtaagacaaaaatcattactggaaacaaaaaaagagacattttataattataaaaggattgctccatcaggaagacataactataaatgtatgtgcacctaacacctatgccccaagatacatgaagcaaaaactaatagaattgaagggagaaatagaaattcaatgataatagctggaggcttcaataccccactttcaataatggataggacaactggacagaagttcagcaaagaaatagaagactcaaacaatactctatgccaactagacctcaaaggcatctatagaacactctaaacaacagcagatacatgttcttctcaagtataaattagactacaagttgagcctcaataaatttaaaagattgaaatcatacaaacttctccaatcacaatggaatgattttttttttttttttttttttttttttttttttttttttttttttttttttgctttttttgagacagagtctcactctgtcacccaggctggagtgcagtagcacgat

SEQ ID NO: 14846 - DNA, 1033 bp, Homo sapiens
gatccctcagtgccttttatcccttggcaagccccaagatgcctactggcctgctagcccggagattttataatacctgaagaactcctgagtgctcaagcagagggagggaataaaaggtgagggcagaattcgatttaccagctccacaggccatttccctcaccggttctcaaggattaggatgctgagaacagtcagcaactgggggacttctacccttccctcccctttgttcactgggatgggaaggacaataaagcggcaggctggagagactgaggggctggttagagatttctcaggctgctttttgaaactcttgaaggagccggtccatgctattgttgtagtaaaatagaaagcggaactattctccttttgcaaaaaaaaaaaaaaggaagaaaaaaagtaaatgaaagaacccccctcctcccagcatcttcaggaggcctcaactcaggccattaacatggtaataccatcctgtttgcatctcctttgtctgtccagcgtttgtctgggatcctggcctctggatgctggaaatacttaggccccaaaggagagggagctcacagccaccagtttcctgagggtttggactctgagatcccaggcagagagagagttgagcctctctgtgcaatgaagtgggaaatgttggggtaggaggggatctcatgaatccatttttcctttggtccccagagttcaccatgcaagtctcagtgcccactaagtgaaaaagctcagcagtttggctagcctcttagagtgatgctcaagtgtgctggggcctagtggagaggtaagagcaggagttggttctgggaatcagctttaatggtgtgtgcccacagaagcatctggcagcagaaaggaaagggagtttacagtgagctccaggttgacccacctctcctctggtcatgtcctttgttcccttagcaagccccgaatgttgtgccacccagaacacagctgggactcaaggccaagaataaagattctgtcattgaaagcagctggg

SEQ ID NO: 14847 - DNA, 1033 bp, Homo sapiens
caggaacaatgctagtagtttgatcttctactctgagcagtgatgctcagaatatagtagaggttccatcactgccttatcatgtcaccatttttaaggagcagaagacatgcacaggaaagttgccccaggaaatgttcacaagaaagaaggacacaggtagcattcttccccgtgagctgataatctgccaagctggtaccacccatgagattctagtgtggcattttgtatcattaattacttttactgaaagtaattacttttactgaaagtaattaatgatgcaattcagagatattttaggggtgtgtgtgtgtgtgtgtgtgtatgtgtgtgtgtatcaaagttcaactttgtctccctaatcctgctagccttctggccattctattaaggtattgcagtcctggtgaagattcagaaatgtgtggtccccgtcagcctacagggtgaacattttggattaacccagagagccttgaactctgtgcataatgtcttttaggttgtgtgttgtgaacaaagcaaaatgactgctcagagacagggttgtaaaagtttgtccagcaaaaccaggattgccaaatgagaattctggaaagggaggataaggattaggtaatgggagaaaagtgagtgaaggcaaggagaagtgcaaaatatctgattctagcctaaaaactggtcttggaaccatttggaagggtcattttttccatgttttattttcaatatcatcaccatcacttttatcctgtggctgtgaaaggactttcttcattccactccagaattcaaagaggcttcttttgcacaaatggagggaaggcactcatcacacttctcagccaaacatcctaagtgtgagagaaaacacactgcctacttctgaatttcggtgagggcagggttcagatggaacacatattttccaaaactccaaatagatctgggaggagaggaaaccattaaatcactagacataagtcaggacacatttggttttgttccctatcaaacagtcccccca

SEQ ID NO: 14848 - DNA, 1035 bp, Homo sapiens
tttcaaggggtgagtgtagtctggcctgtctgattctcatccccactctctgatagtgctatgtttttcaccttgaaaatgaagacatactaccctgagcccttcactgggttgtcaagtggtcgtgtggcacacgtaagggagcattgccatgttaaagctccccagctcccttcattatggccatcccatggacagaggaccatgctgtgactcagaggcccagctcttcctagctgtgctgttccctgagtgaacttcagtgagttgctttatctcagtgactctgtttcatctgtgaaatgggactgtcgggttgtcagggcaagtacttggaaccttcactgagtggtatggttgtgggcattccttcttattgtcattgcttaaataagcatgaagatactttcctgaagaatgatgtttggaaggaaggaacctagactttggtatggggtgggaatggagtaaatcctaaatccatcccttgttaacaggcttgtaagtggaattcttgcctagcgagatctaggatagttctctagctcaggagtcagcaaatgtttactgtaaaggggcagatagtgactatttttggccttgcaggccacagggtctctaccacaactgcaaggcagccatggacaatacataaacaaatggacatggccttgttccaggaggactttatttacatcgggctgcaggccggatttgaccagtcggccatggtttgcttacccctgctttagcttatggggggtgccccgcaagcacttgggaaattaatttgttgaagataggtgagtagaggcctctgatagtccagatcctcggttttagctctgtttacacaggaccaggttctgtgttcttgccactgagtcacagctgcaagaccctcacctccccctagccccactcccccagctttgagtgatcccaggctccttcaagcccactgctgagtggggagcagtttctgtgccttccaggatctgtctcccctactgccactccccatccagggctttt

SEQ ID NO: 14849 - DNA, 1035 bp, Homo sapiens
ttgtttacctctatgtggataattcctcgattataaatcagagaacttggcactgagttctggattatctgtgatctttaactttcccagggcaaaagaaattaaaccagcaaatctctttgtttctcatggttcagcatccaaatcatggaagtgcgggtctgtgtagagtgagacagcctaagcccacctctgccctggcccccacactctaggtgagcagtcatgcatgcatgcattcatttattcactcaacaaatattcagtgagcacccatgtggcagcctctcttctagaaactggagatacagggttaaaaaaaggacactgttccttcttaccctgtttgcatcttagtatggatgacagtaagcaaacaaaccaacaaacatacatactagtgataaatgccttgagaaaggaagcaggttaagagatggcagtgaggggtgcactattttacacacagtggggtcaggaagacctctctgaagaggtgacatttgagcagagattggatgaagagagagtaagcaatgttcaatccagaaagaacatttcaagcagaaggaatagcaagtgcaaaggcctggaataggaacaagtgtgatgtgtttggggaacagtaaggaagccagagactggagtagagtgaaaaaaggggacaactgtgatacattaggtcagagcagtgggcaggggccagccatggaagtggtgactttgggttttgttctgagcttcacaggatgtccttggaggttttggaggagagtgatgcagcaaagatgaacattcagaggctatagagaggctcatggaacaacaatgggccagcttgggttaaacactggcattcagacacatggcaatggtagctgcacctcatgggtggtgcttccagtgggaactgttgagagctacatgtttcgacagggtgaggctgggcctgggagctcactacctctaccaattagtgttaagcccagaaaaaggaaatgctgcagtttaaattgtagggttggaacctgtgag

SEQ ID NO: 14850 - DNA, 1047 bp, Homo sapiens
agtgattattgttgttttaagccactaggttttaggatactttgctatacagcaatagataattaaataatttaccatattaaaaactaaaaccaaaaataatatttgttcatttaatatttattcattgttaatgaataaattaacatttagtaatttattaaaatgcatatattcattaatccatttaaacgttaaaaataacattttattataaaaataacttttttaaaaaatccaagtgagaagagtgacagtgttttacatttttgcaaatctcttgactgtccggcttaatagaagacagctggattctcatatcggcttctgcattcaatcagctgtgataatgttgttttggataaagtatgcgaaggaaacccagcctcacgtagttattttgttggaaaagggaggaatattttaatagtcttttcagataattgtgaatattcttctttgacattataccaaaactcaaccaatagtagattactaaggttagttgcaatgtggaatctgaaactatatcaatgaactttttgtgctcagttatgttaaaattcagttatctggcttgtactctgaatagatcttttgctcatgcatgattttgaaataatatgcatgggtcatttggaaaatattgcttcactaagtcatgcagatttttcaaatttgatatatttcttgatgaaaactaaaagttcttatttgttaatatcactgatctcatcaaaaacctctgtaagtgttgggaaggtgttaagttcactatggcagatacaggtttctaaaaattctaatttttgctttatacttctattttggcagaaaatactgttaattattgtctttcttgaagtgatgagctcagtttgttcatttttgagaaaatgcctgtcaaataaccaaatctgaataactatggttatttggtccttttgagtaaacattgtgttccatgaaagtgactagtgcagatcacaactcaggacactcacacaagtgcttttcctccagatgaccatcatacttcaggatgca

SEQ ID NO: 14851 - DNA, 1046 bp, Homo sapiens
gttgtgaaccaggcctgatgttaaagacaggtttcaccttctttgtttgtcttgccctctgagaacacttggcaataacattcctttcctgacaggctcattttgtagctgacggacattgttttctttcccctgtttacctaatgtggcccagagtaacagaacaggctgtgccagcgagagaggagagtgagcctccccagtggctcctgggtccccatacccaggtccctctgccctgagctccttgtcttgcatctgtttgccccacctgtgggaacagggactacccagagggctgtcctgcctggaatcaagcactggcaggacctgggtcaggggagcctgcgattaggagagggcccagaattatgactctctccccggggtcatttgactgcaaggttagaaggcctgagatcaaacaaggctatgagaaaccagccttgtcactttgcataggatagaccagtgggagccaagattggaggcatctgaaggtcactgtaggaccttaaaaataccaggggagggtactgtgagaaacagattcccatcaactgtttactaaacactctatgctatttaaagggacaaaggcatggccaggtcctatcatcagggagtctaaatctggggtctgcagctgagccaggaggggggtccagtgcccttggcagcctgctgtaaccttctgaccctctgtgtccagcccccatccccatttttacctccagccaagcttccccctatgggggttaacagggtaaatactgtccaggcccttccctcaaagaagctgcaaatctagtaagagaataatatgtgcgtatatgaaactataatttaagacactgtgatcaataacctaaagggaaaggctctgaggacatccaggggtcttgggctcaaaggctggagcgccacacacacacacacacacacacatgcacacacacacacatgcacacacacacacatcaaatcacatattagctcgtgtcttcatgagctttccagtttgcaaaccgctcacacatacagca

SEQ ID NO: 14852 - DNA, 1030 bp, Homo sapiens
aaatggagcccggggaaactgtctcaccacctaggactgtgtggagctgggcacacactcaggaggcaggtgacttccaggtagtcaaagagaagctcacactccctgtcctctgatagtcctactccctgaaggatctggtcaagccattccttccagatggccgtgatactgtgtcccctcagtattaggagggggggaattgatgctttccatgaatgaaagctcctaaaccccctcccccgcagctagggctgatggggaatggctaaaccccagatgtcttcattgcaccataaatgtgagcagggaggtacaaaggggtaggcaatgatgtgtgtgtgtgtgtgtgtgtgtgtgtgtgtgtatgtgtgtgtatcaaagagaggagtctgtcacaggaaaaatactgagtggccccaaatgttgtaagcgtatgcaccccagttttacaataataacaatcataatactaataattttgctatcatttgttgagatctttttctgggccaggtacggtactttgcacatattatctcataattctcaaaatctctgtgaggtacaagtatcactatgcaacttttcaaatgagaaagcgagcatggaaaaaaagttggttcaattgccaaagatcatagatctgagaagtggcagggccaggattagaatgctagagctcaaagttcttctgccacgtatcatagaagcgaccactacatcgataatggtaactgccaaccctcactgttcactggccacatgccagacacatagattcacttaattcattcttacaaaactctggatgtattcttattgcctcattgtatagatgaggaaactgaggcacagagcattttggcattgattcccttcggcaaatgtgatttgaacagctcctatgtgtgtgcagggcaccgtgctcttggctctgcgtgggatatgggactgagtgatacgtcattcttatggtctgagatcaggaaggtccatggccatggccatcagaatgggctcagggtgg

SEQ ID NO: 14853 - DNA, 1030 bp, Homo sapiens
gtaaatctttcctagaagaggagacagctgagctcatcagccagtgtcggatcagctcagaaagaatcctttccaactcccagaagacccctcagcggcttgggaaaggaatggctcactggggcactttgtttgtgtatgtgggcctgtcaggctgggcaggggtgtctgatgacacattaggacagctgaaaagagaggtgggacaaaaatgtttgcccaagggcagtcttgtgattcccccaccccccgtgctccccacccccacacgcctttgagagcttgttccaggacttttcatatgcatttgagaccacaatttcctctcccagaaaccccattaagctatgagtgagtgaggcggtgggggagagagagaggaaaaggaaaagagagacagagcaagagagagagtttgtgtgtgcacacacgaatacttcttccccacccgcattcttttgcacatgtctaccgttatgtacattcctatgccataccccttgaactctccatcaggtcttcctcaaccatcctcttcaggaagcctcagggcctcagagaaaggcaaaagggcctagactttgacttccttttttttctctctctcttagagacaacattttgctctgtcacccaagctgaactgaactgggctccagaaatcctcccacctcagcctcctgagcagctaggactacagatgtgccaccatacccagctaattttttaattttttgtagaggtggggtctcattatgttgcccaagctgatctcaaactcctggcttcaagagatccacccacctcagcctcccaaagcgctaggattacaagtatgagactttgccattccaatgagaattttgtccttagcaatctcatccaatggccactggagatgtgtgtagggccacaagaatgagaaagggggcaatggagtgacaggtgacctgctcaggtgcccctccccagaccaaatgtcccaggcacacagcccatgccctccaccatggagtacattttctccctg

SEQ ID NO: 14854 - DNA, 1038 bp, Homo sapiens
caggatagagagtagggaaggaaggaccagccaaggaacattttccctataaaatgagactcccaccctactcctgcccttgttaagacttcatacactatggaatactatgcagccataaaaagaacaagatcgtgtctcttgtaggaacatggttggagctggaggccattatccttaagaaactaatgcaagaacagaaaaccaaataccacatgttcttacttgtaagtgggagttaaatggtaagaacttatgaacacaaagaaggaaacatcaaacactagggtctactcatgggtggagggagaagaggagggagaggagcagaaaagataactattgggtactgggcttaatacctgggtgatgaaatactctgttcagcaaacccctgtaacacaagtttacctatgtaacaaaccttcacatgtaccctccaaacctaaaatacaagttaaaaaaaaaaaaaaggacacagatgtaaattgaccctgatggagagaactctactctatccttgccaggtcacaagaaggtgagatatttacttttcaaatgattgatgctgaaatggaaaggactgtatctcgggggcacaaacccaacagagtaaatgaagatcctactgcttcagctcctgggatttgttaaagtggggaccagcttagaaaaatagacggccgtcctagagacccatggcagtctcggtctgattttaaatctaaattctcaagtacaagtagcttcccaagaagagaaagctacttctacataaagaggtggtatcagtaggaactccttaagccttacctttttattattgatgatgatgaagtgaagcttcctgttgatatcattgtcagaccaagcacagcacaccaactcaaacctcattcattcattcattcattcatgtgtccttttaacagacgtctactagacaccttgtgtgtccatgaaccaaataccatgcttaagaccaaggattcagaaatgtgttagctgtcattccccctccaggaactctcagccagg

SEQ ID NO: 14855 - DNA, 1044 bp, Homo sapiens
gtcactacccctcctcacccttgaaagtcttattctgtcattcccacaagcccaacaggtctaaactgaagtcatcattgaccccaaaccaattcccatcattactgccctatttctcttcaccattctcatgggcctggattccaggtcttcctctccactgccaccccctctgtgcaagccttattgtcccaacctgcttggtcctttgaaaagcccatccctgggcagaaatgggatgtgtatgtccctaaactgcccccaaagacctctctgcactgtatttgacctctggccctcctgttccctaactggccttggtctcctgctcccttccgtgggccgctccagctcttcccaccatgtgacctgccttcctgcttgtccaccttcctgtctggtccccagactcagtttctactctccctcccagcaagctgggacacacaaacatagacatatgttatgttcacacaaacatagacatatgttcacatacccctcccagcatcctgactggcccagctgacctccctcacccactctgaataaccagctctccctcctcctgcctttgtccagtcccatctctattactcagggctctccagagaaacagaaccaacagggttggatgcggatagatgggtgggtgggtggatggatgatggatggatggatagctagatagatagctagctagatagatagatagatagatagataatacatgataggttgatattagatgatagaaaagcaaatagagtttaagaaattggtttatgcaattgtggaggctggcaaatctgaaatctgacctcagtctcttctcttaaggcctttgactgattggacaaggcccacccacgttgcggaaggtaatttgattactcaaagtctactgatggaaatgttaatgtcatctaaagaataccttcacagcaacacctagcctaatatttgacgagatatccgggtactatgacctaggcaagtcaacacataacattacccatcatgcttttcatctggtcagcagtg

SEQ ID NO: 14856 - DNA, 1054 bp, Homo sapiens
atatgttggctttaatgaatctgtgtgtcccctaaccttgtctcagaattccttatatgccccaaggatgcctccacagtgctctgaacactgtagggccttaggaaatactgatggctttgactggttatcaaaaaaaaaaaatgtaagtgatcaaaaagatgcataaccaggaagaactataatgttcagcaaaaactgcgagagtggttccaggtgctgccttcttggggtcagtggtataatgggttttcctttccagacagtcccttgatagtcctagaatcccacaggacagttgggtggacagtgtccagcaggcaaacaagaccataaacgcaaagccagagaagctaaacaatgttcactttacaactccaggtgatgataatggtatttatagactcagtgacatgtttgaagctgtgagtcccagaggctaatattttaagctggatatcctgagacccagacgttctgtttttgttctcctccccatccttccctcctgtaacccctggaactttccatgcaatctggacaaaagcatgaaacctctattgtttctcaatccttactagtgctagggaaggatttaagaactgcttcatggaagggtgacttgtgatgagtggaaaacattctgaggccttaaaatgacatttgccattacaccaaaacttccatcagagaatttcaaaattctaggcagagacaagggcctttctgccgtcagagaactccaatggtaaaggagctggggtttggaagagtgaggccttatttatagatgaactcatcttggccagaggttctggagagtctaggtccacctatttaagaactttctttctctcaggtccatttttatattggataatcattcctgaggcaaatctataaacaaagggtgggaacctaaaacttggctagttatatagcccagaataaaatggggaaatcagtgttttccttcaaagcaatctagaaagcactagccaaagaacaaattgcaaacagctacacaagcatcagggaaatcccatcgatcata

SEQ ID NO: 14857 - DNA, 1037 bp, Homo sapiens
tgcagttgtgacagtgtgccgaggaaccacggaaaaccgggaggaaaaaaactggttgctctccagatgtgtaatgtgaggaagttattctgatctcgcttcctcgaagatgggatctttgtcttattgacacctcagtaggtgttccacaaatggttgtccacagagtgaatgaatggatggcctttgcctaggctcatactgataccccaggctgcctctccctgatgtattctgtagggggcactctcacttctgccttcgccgcagccaccactggagaagtaggcacctgtgtctccatcctgggcagcgctggtcttggctttacttatctcctggatctggtgttttgaacctgacaaaaggcaggcatgtgggtacattaaagcacaaacaatgtgcagtacgtttatttgctggatgaccattccagccattccaaagtcccacttgagtggggcattacaggaacatcctccgtctagaaatctgagccctggttcttcttcttcaactgtcttctctatctcattccaccctgcttgagttctcccgcctgactgtgcaagcagcctctcccttcagacctctacctcctcttctgagatccaactaccgcagctaggaagtccattgtaaacccagaaccaaggatgttttccttttccctgtttcctgcttttcaacaatgcacaaaacctctttgagcctcagactggactgcccaagacccacctcctacagcacctaaatcttcagctcttattctccagcaataagaaatcagttccatacacgttaagagctttggtcccgggcctcagaccagatcattggtcccatcaacctcagaccatatgttcacgtgaggacagcaggtgggaggccacctgccttcccccatctgcttgccctgcctgggatactgaaacacaggtaaaaagtggagaggcatcttcctgtcccagcccagctgctgagaggtgaactagagagggcggcctcgatccagtcggcccagattgaggcccaga

SEQ ID NO: 14858 - DNA, 1035 bp, Homo sapiens
tcgacaccttaacaatttcaggacacaatggcatagtgctcattcttggcaaggatgtgaggaaataggaattgtcataaacttttggagggagtgtagattgatagctttcttttttagagcaacttctaaaatctatcaacattttaaatatacaaatatcaccttaggttatttcatgcctagaaatgtatcctacagagatccattcacacaagggctcaaagatacgtgagcagagatattcatttgtaatcatgtttatcacatttttaaaaactggaaataaccaaaatgtccactaatgagttaaatagtatatggtgtatctattatgtggtatactacgcaacagtttaaaaaagtaacatgaaaatctgtgtacatgaactgacgtgaaaagaagcccacagtcattcattaagttagaaacacaagttttcaaacagtatgaactaaatcatgagtgtgttggttttttaagtatttatatatatgtttgtctaagcataggaacatccagaagagatcattcactgcggggaggggattttggtggtggaaaagaggtagagggtttgagaatgggaacttttactttttattcttctatatcaaatttataaattttcatatatgaagcatatgtcaatttcaaaataaaggtggggttttttgtttttttgtttgtttgtttgtttgtttgagttggagtctcactctgtagcccaggctggagtgcagtggcacaatctcagttcactgcaacctctgcctcccgggttcaagcaattctcctgcctcagcctcccaagtagctgggaccacaggcatgtgccaccacgcccagctaatttttgtatttttaatggagatggggtttcatcatgtggcccaggctggtctcaaactcctgacctcaggtgatcagcccacctcagcctcccagagtgctgggattacaggcatgagccaccgtgcctgaccattttttttttaagaatgtatggaggcccttggcaatggaccttctga

SEQ ID NO: 14859 - DNA, 1053 bp, Homo sapiens
aggcaggagaattgcttgaactcgggaggcagaagttgcagtgagctgagatcgtgccattgcactccagccggagtgacaagagcaaaactccatctcaaaaaaaaaaaatcagtatggaaattataaaaagtttacatcctttttttgtagtaagtattcaaaaatttggtgtatattttacatgtataatacatcttacgttggttttttttgtttgtttttgtttttgtgatggagtcttactctgtcccccaggctggagtgcagtgttatgatctcagctcactgcaacctccgcctcctgggttcaagtgattctcatgtctcagcctcctgagtaactgggactacaagcacatgccacaatgcctggctaatttttgaatttttattaaagatggggtttcaccatgctgactaggccggtctcaaactcctgatctcaggtgatcctcccaccttggcctcccaaactactgggattacaggcatgagccactgtgcccacctacattttacagttgtttaaatgtttcacctatcctgtggtgcttcctgcccttcccatttgtgcacaagctgttccctccacttgcagtgccctcctcctgtctggctcctgcacctggagaactcttgctcctgtttgaatgccagtctcagacaccgtctctctcagcaagtgttttctctgttttttttttttttttttttttttttttgagacagagtcttgctctgttgcccaggctggagcacagtggtgcaatctcggcttactgcaagctccgcctcccgggttcaagcgattcttctgcctcagcctcctgagtagctgggagtgcaggcgcacaccaccacacccggctaatttttgtaatcttagtagagatggggtttcaccatattggtcagctggtgttgaactcctgacctcaggtattccacctgcctcggcctcccaaagtgctgggattacaggtgtgagccaccgcactcagccatgttttctcttaataataccccaactcggccaggtgtggtgttcat

SEQ ID NO: 14860 - DNA, 1049 bp, Homo sapiens
tgtcttcccatgtgctctgtcatacacttatgagcgctgctttccggctgggcttgttccaggaagaacgtgattccacatgagtaccggaagcacttccccatcgagatgaaggaccacaactcccacgatgtgctgctgctctgcacctcctgccatgccatttccaactactatgacaaccatctgaagcagcagctggccaaggagttccaggcccccatcggctctgaggagggcttgcgcctgctggaagatcctgagcgccggcaggtgcgttctggggccagggccctgctcaacgcggagagcctgcctactcagcgaaaggaggagctgctgcaagcactcagagagttttataacacagacgtggtcacagaggagatgcttcaagaggctgccagcctggagaccaggtacaaagcacaggaattgtggaatgtaccagggacattaaccctcattacttagtgagaatgcttgccagggagggggcattggctgcttaggcacagtgcctagcctcatgcttcacctagtaggtgtctagtagtttaagataccttggaagtggaatagaacaatctacttgaggagttcctttccataggaaacttgcttttgtgaggtgcctatctttgacctttttaaagatcatacacttaatttcggtcatttttgtgattagcgtgcgagtgcagttgtggtggagctgcatcttacacattctatgcagacgtaaatcctcatgccagcacatgagatgaaataatagtccaataacaccctcgaagttctgaagttccccatgagatacagtacattcacccctcagtatccatgggggattggttccaggacctcccttggatactaaaatccaccaatgcttaagtgcctgatatacaatggcatagtatttgcatatatcctgcacacatcctcctgtatactttaaataacctgtaaattacttataatacctaatacaatgcaaatgctatgtaagtagcttttatattttattgtttatgaagtaatgagaa

SEQ ID NO: 14861 - DNA, 1077 bp, Homo sapiens
aggggtgaactggtcactgggtaatcctggaagaaatggaagaccagcattcttcatccattatcagctggatggtagtgcccctctcgtgggagctgaacattatgaagtggccttcctgtcagtagagctcagaaccctcaaataccttctgttgggattgcgagtcgtatgttcagactataaaaagggcagagataagaaagaggatgtttcgaaaacaccaaagtaactaaccctttaggagtccttcaacctccccagttacccttggcgcgcagcatttgaagctgtctgtgaggccatcctgcgcttgtttccctcagacactttgtttttcatgttttggcagaatctccaatgaaaactatgttcctcacgggctgaaggtggtgcagtgtcacagccagggtggcctgcgctccctcatgcagctggagagccgctggcgtcagcacttcctggactccatgcagcccaagcacctgccccagcagtggtcagtggaccacaaccatcagaagctgctccggaaattcggggaagatcttcccatccagctgtcttgatagctgctttcctcccagttaggacaagtgggaagctggagccaaggttgaagagtcacctcttcccattttagtacatcattaattgtcaaagcctgtgtgacacaactcagaatactaacctagactaatcccaggatgcttctgctggagcaaagatattgtttgaaggagagtttatggttttggattttaaacgggcagggtcttttttcctctcatttttgtggacaagagaggccttcgcctttatttttactctccctcttctgctgtccctgtgcagaggaaaaatgaagaattctcccagaagtgacttgtcaagacttaaaaaaaatgtttttaatgcatttcttccttgtctagtgcctcggtttatctctaacaggggctgtccagtatatcggtcctgttaggaggggagaaaaagttcttccaaaggctggagaagtgaacaaggagtcaaatttattttcccaattcaacttcataattatcatttctttgg

SEQ ID NO: 14862 - DNA, 1046 bp, Homo sapiens
cctgtggaagttctcactggatagggagatgcggggcatgtggcaggcttggggcattatcccagggatgaggggaagtgcagcctggggctcagggagaaagaacacgtgatcgcctagtgatgtcttgctggggatctggtggtttgaaggggcgaagcagttaggactgagcacagcccccacaaataccgcaccaacctagaggccggatgaaggagaaccaaaggtcagggcaaacacaccgcagggaccagggaaggcaagggagcagcaggccaaagcacttctccaagtggaaagcagaggctacccacggtgatgtgtgagtgcagtcttggtggtgccttgcgggggcatgaacatggcaagggccttctcccaaaacaacaacgggacatggctcatcgctggatgcaccccggaattgccaactccagttgttttttgtatagcagagaacacagcgtcacccaactacctcttccagacaatgcagcatccctgaaccacaccggggccggggctctggaactgggactcacagcggggtgaggatgggctagctcaagacctatggaacttgggagatcagaaggccagcgctggggcaaagctgagggcaggccaaccagagagcccaagaaagggccctggcagagaggaaaactgggcataaggtgacaggtctgagcgagagtgctcagaggagccggcccctgggatccccgaagccaagctgagtcacaggagctctgatgggaggctggcatctgcccaaggctggggagagccctcctcatcacagggtccagactgtgctcaccagtgcagtggttgccggccacaggtggccaccgagtgcttggaatgtggttagtgcaactgaggaactgaatttttcattttatttgattctcattgatttaagttttgaaacaacactcattttagttgtggggaaacatttgggaatgtttagaacttcggtatgtggaatctatattttcaactgtaaatttttgtgaaatctcaatacagatcaa

SEQ ID NO: 14863 - DNA, 1064 bp, Homo sapiens
ctgtaatcccagcactttgggaggccgaggtgggcggatcacgaggtcaggagatcgagaccatcctggccaacatggtgaagccctgtctctgccaaaaatacaaaaattagctgggtgtggtggtgtgcgcctgtaatcccagctactcaggaggctgaggcaggagaatcgcttgtacccaggaggtggaggttgcagtgagccgagatcacgccactgcactccagcctgggcaacagagtgagactctatctcaaaaaaaaaaaaagaaagaaagaagcttgaagcaaatctaacaaaatataaacagttgttaattctggtggcagtgcaagtaatagtattctttgtctttgtcctttttggaataaaaaaactctgattttaaagcatgtttaaagtaaaaggaaagagcgagcttgtgacttaaggttgctggatctcagctgattgagaaggagggtgcagtggaggactgaaggcaaaatgcctgttcccccaagcctgtcacgcacgtggcactgtggtcacttgcctggaggacaatcaaagtgattctcgattcttctgaacctgaagatcaaccctgatggactggcattgaaggcactggtcatggagaaaggacttccctgctgagagccaaggcaagagagacgagatcccaggacctgcaggccaatctgtaaaagggctgaatagtcaaaatgggtgtgtcttcatgaaggacaaatgacaaattcttttgatagaaaggtatgagatcaaagacaaaaagcctttattattatattttctcctttttttattattatgctttaagttctagggtacatgtgcacaacgtgcaggctcgtcacatatgtatacatgtgccatgttggtgtgctgcacccgttaactcgtcatttacattaggtatatctcctaatgctatccctccctgctccccgccaccccatgacaggccccggtgtgtgatgttccccatcctgtgtccaagtgttctcattgttcagttcccacctatgagtgagagcatgcagtgtttggttttctgt

SEQ ID NO: 14864 - DNA, 1029 bp, Homo sapiens
gccaccacactggtcatattctgtccctttagacataatatgtgtttaatttacaaggcaggaaatcaaaaggaaggaaataaaaatcaccccaaatcctaccattcagggttactgctattaatgttttggcaaataattgattcagatcttttttgattgatttttaaaaaaaggaaattatagattctatactgtttgtaacttgttctttttatttaacactatatcacgaatactcttctgtatcataatcttcttccaaatatttttaaatgtctgtctaggatttcattgttgtctactgttccatagactatataatcacagttcataaatgatgaatgtttagattaggttggactatataatgttgtattttaggtaaaaaattgtcaaattggcagtttcgtatggtctaaccaaatgtgttgtccgtgtttcatagttataaacaacacagtgagcattcctgaaggcaaatctttgcacatagcattgattaattccttagataaatacctcaaaataaattgttgaacaaaagatcaaatttcaaataaagacaggatctgacagggctggaattagggtgaggcaaattatctatgcacagagccagatcctgtctttaccttaattttttttttttttttgagacaaagtctcactcttgtcgccgaggctggggtgcagtggcacagtatcagctcactgcaacctccgcttcccaggttcaagcgattctccggcctcagcctcccaagtagctgggattacaggcgctcgccaccactcctggctaatttttgtatttttagtagtgatggggtttcaccatgttggccaggctggtctcgaaatcctgacctcaggtgatctgcccaccttggcctcccaaagtgctgagattacaggcgtgagccaccacgcctggccatttatcttaaattttaatattttgttcattaagaattttttgcattaattttgatttttaaaaatacttcattaaaatattacttacct

SEQ ID NO: 14865 - DNA, 1026 bp, Homo sapiens
ggagccgccggaagtcgtcgaaagtgcaacgcaaaagagccttttggatcatagaggcacagtcacttccggcagctagagcagctactgactctgtttcagccatcttcgataaaggcaaaaaggtaagggaaagtttccaagctttaggaagaattattttttttcaagacgctgtcttccgtactttcgttattaaacatacggctcaagtgatcaccggtatagacagtgacatcagacatctttcattagccctactcaaaaatggcggcaacgtaagtatcctgggccggaggtcggttgtaacccggaagtgcctttgtaaaggagggggtggttagacaatccggaagtggatggaatgaagagatgccacttggcggccatggcagctgtagtatcggcgactccgggtcaaggcccggtcgagtgcagtaccatgggcagcaccgggtatagggcagagacagctttgtgtcaactttgctgctgaacccctaggacccatcgttagagacctgcaggactcctttcctcatcccaggctcggaggagagtttgctgggactggtgggctggtttcctgctctggggggcggatcaccttcggggccgcctcttggagacaggggcgcctagggaacgaacaggttcgcttgagtcacttacccgccgccgcctaagacattgtgccaccctcaatccgacaatcgaagaaatcgatcattcgcacattttccccattgacttttcccatctctgttaacccacgagaatctaatgactggcatctgagaacccagagcctgggaccttagattgctgtaagctttctctggtgctaatatcagcaaaaagggtctgttgccgggtacgttcaagaggaaggtgcctcgtgaacacatctgctggtgggaaggcctaaagaactggaaagcccactctcttggaaccaccacacctgtttaaagaacctaagcaccatttaaagccactggaaatttgttgtctagtggttgtggg

SEQ ID NO: 14866 - DNA, 1984 bp, Homo sapiens
atagatataaatatttaaatttaaggaccctttacagtaaactttatagataattgatgaggacccatgcagtaaaggataactgaaaaaattaaagaggcctttcctgaccctaatagcaacaagcagagggaacagtatagctgtgtgagagtaaatgcttggtggtcagcttggcttactcaccagcaaagtaatttggtccttcacacagctgaaaagcatacttgattcacatttgtgacttagcaaaatccgattactacatgtcatgaaacttcacagttacctgtgaaggattgacaccacagctgttaaatccatgagctgaatcctcaagtaccaagtctaccagatgttaagaatagtataaagaggtaggcacttccaaatttcttactagatacaatataataaatactttttcagatcttggtagaggaaaagaactgtgtcctttatccagaatggtgatgctcttaggcctggggtttgatagacaaagagttttggcagatataaatgaggattgcagaagtgttgcaagataggacaggggctgaggagtggtcagctgcattggggaacagtaataaatcaggagccttaaagcagtggtctctactttttttatggtcacacatcctacagagggagggaggaatgatttacatgcactattgcactgatttaatgtgtacattataaaatacactcctaaaacaggaatatttttgagacctgagatttaaatatacatagaacagtattttctttcatattctagtgggtcatcttgaatttttctgggatgtgattccactatagaaatcactatcctaacatttgtccttttatgggtggcagttgttttctaaagttgtctgataatgaaaattccttgaggaagaggcacattttaaaagtatgatttcctgacctccaggaaggatcccgggaatatctatttttaacaagctgtctgcaattcttatgaaacaagtttcagaaacactggagtagaggaaagaagtgcttcaagtatagtttctttgtgttatttttaatatcaatttgagatataatttacataccctgtttcaggtatagttgggggttttgggtttttttttttatttgtttgttttgagacatggtctcactctgtcgcccaggctatagtccagttttgccatcacagctgaaatctcttgggtttaagcaatcctcccacctcagcctcctgagtagctgggactatagtatagatgcacactgctatgcctgactaatgtttaatttttttttgtagagatagagtctccttctgttgcctaggctggttgccaattccgggactcaagcgatcctcccaagttggcctcccaaagtgctgggattacaggtgtgagacacctcacccagcccaggtgtagtttaagactaaaattatctaccgtgtgttaggttgtgtgtagagaaaaactctctctaaccgtgtttttcctgtgctctcacaccacaacaatcataaacacagaagaaaaacttctgtaaccagatgcgtggcaatatctccccactaccaagcagtggacaccagccaggtgtcctccaatttaattctgacgctgtctacctggaggcagtatcagatcccacagatctagggctcagtccccaagactgctccctccttcacccatcaccagtcgcaagcctgggcctctggaacttctgaccaactggcttcaagttggggttcccacaaccccctctttgggttcagtcaatttgcaagagtgggtcacagaactcagagaaacacttacatttaccagtttactaagaatgatattttaaaggatacagataaacagccaaacagccagatgaagaaatacaaagactaagtaaggtatggaagggtcctgggtcctggagcttctgaccctgtggagttggggtgcgccaccctcctggc

SEQ ID NO: 14867 - DNA, 1050 bp, Homo sapiens
tcctggccaatatggtgaaaccccatctctactaaaaatacaaaaattagctaggcgtgctggcgcatgtctgtaatcccagctactgggagactgaggtaggagaatcgcttgaacctgggaggcggaggttgcagtgagccgagattgtgccatgcaccccatcctggcgacagagcgagactctgtctcaaaaaaaaaaaaaaaaagtttatggggacagtgccccaaagaattcagcagtttacaaatggctaacttgttttaagaagggacaagatgatgttgaaaatgaagcctgcagcagcagaccatccacacctattttcaaagaaaaaattaattttgttcttgccctaactaaagaagaccaacaattaacaacacaaaaaatagccaaccccatagccctctaaattggttcagcttacacaattctgactgaaaattttacactgaacaaactttccactcgatagatgccaaaacagttgtgcccagatcagctgcagacaagagcagaactttgaatggaaatgggacccaagtgggatcaagatcctggaggtttttttcaaagaattgtaacagaagatgaaacatggctttaccaacgatcctgaaggcaaaccacattcaaagcaatggctactgagaagtggaagtggtcagtcaaagcagaagtgggtcggttaagagcaaaggtcactggcaacagtatttggggatgtgcaagacattttacttgttgattttctagagtgccaatgaaccataacatctgcgtattatgagatgcgtattatggtttttaaaaagttacccaaagttttagcagaagaatgcccagaaatgcttgatcagagtcctccaccacgacaatgttcctgctcattgctctcatcagacaagggcaattttgccaggttttcaataggaaagttttgggcatcagctttatagtcctgatttggctccttccaacttctttttgtttcctaatcttaaaatctataaagggtacccatttttcttcagttaataatgtaa

SEQ ID NO: 14868 - DNA, 1028 bp, Homo sapiens
gatctctaggctggacacagtggctcatacttgtaatccaccactttgggaggtcaaggtgggaggatcacctgagccccagatttcaagaccagcctaggcaacatagggagaccacatttctacaaaaaaattttcaaattagctggttatggtggtacttgcctgtggtttcccagttacttgggaggctgaggtaggaggattgcttgagcccgggaggtcgagggtgcagtgagccataattgcaccactgctgtactccagcctgggtgaaagatgagaccttgtctcaatttttaaagaaggcttaaactgcttaatctgattataaatgataaatgtctagtatgttattctctattcatgaaatatagcaaagataagctttttggccttttgaagcatttatgttttaaatgacaaatatgttactgtaaactgggattatcagctggccaggtatcatttactgcagttcagagtctcccaacctccatatttctagaactgaatttagactgaaggatgtgcctcttaaactgctctgcccttttggtttcttgctggcaattgtctgctgatattttataaagctaaaaattttctactcaatttgttccttattttacatttttatctcagcctaggtataaactagatgaatttgattgcaattattttcattgttactgctcttcatttgcctattttcatcagaaaaaaacagtgtattttctggtgagattggcatgaatttctcagataaaggaatatttggggatggtgtccctttgggaatatgattgctttcttgcatggtgatttgcttccacttcccaggtgttgagaataataggcagtcagaaggtctgcatgccaaaggcagaagacatttgggaattttttcatcatgaactttaagttgaaggagttaatgattggctggattacaatataaaaagtggatgtctttacagtaaagtaagtagagcttgaaatacaaagaatggaaactcctacatgaa

SEQ ID NO: 14869 - DNA, 1050 bp, Homo sapiens
ttaatacacataaatgcttttttcactcttcagcaaggatttattaagtaactattgggtgcctagtgctgtgctacattctgtcagacatgttaaaggaaaagagaggtagaaaatttaatgctttagcatttacagtccatctggggatagaaaacattcaagtgaaaatggctttgtatatctgaggtggtgtatagaggaacctttgaagactgcctgcatagatcactaggtctaggcaaggggagagttgctttgagctggaatcaattttttaaatttatttttaatttttcttgagacaaggtcttgctctgtcacccgggctggagtccagtggcatgagcatagcttgttgcagccttaaactcctaggcacaagtgatccttccaccttaacctcctagatacctgggactacaggcatgcaccaccacacttggctaaattttaaaaattttgtagagatagggtcttgtgatgttgcccaggctggtctcaaactcctggcctcaagtgatcctcccccatcgacctcccagactgctgagattacaggcatgagccaccatgcttagtcttcaattttttattctttcttgagggaagtggttctgtagttagactttgattgatgtccaagttttggcttaacaagctgagaagttcagtatgtgccaagaattacaggtgaggagacttggggaaaggagaataagaaggttttgttcgatggtgttaagcaaactggtttaactagactggacattgagaaataagttggaactagttgataaagggcttaagaacctatctaatatagcagtttgccctgaatttgaaaagcagcagattcttaaatggtaactgacacatcataagggtggtgggttttttgtttgtttgtttttgagacggagtttcactcttgttgcccaggctggagggcaatggcacaatctcggctcattgcaacttctgcctcctgggttcaagcagttctcctgcctcagctcccaagtagccgagattacaggcgcccgccac

SEQ ID NO: 14870 - DNA, 1053 bp, Homo sapiens
atttcattcattcaaccagtgtttacttattaagtagtaatcatctatatagagttctagtatctttattttatttatttctttttttgagacggagtctcactctgttgccgaggctggagtgcactggcacgattcggctcattgcaagctccacctcccgggtttaagcaatcctcctgcctcagcctcccaagtagctgggactattttgtttcttaacctataagattaagagatgcttcctttgaaattcttctttggtatttcccttgttagaatttgattaactaatcaatggatttttgattagttggaaaattgaatgttagttttccaataacaacaacagcaaccaaaataactaacattgaatactctgggccagatgctatgctctttacataagttatctcatttaatcctcatgaaaaccctaagaaatacatacttcattgaacacattttaaagataaggctggcatgtagaaaggttaagtaacattactagatccagctggacctgactgtaaagctcatacactcaaccactacactgttattgttgttgttgtttatagtattttatgtttccttgtttccaaatatagctgatggtgttgctttgggagcagcagcatctacttcacagaccagtgtccagttaattgtgtttgtggcaatcatgctacataaggtaagcaacattttggtgtaaggtttggtattgagtgtattcataattaaaatttctcatggtccttaatgtttttcctggaatgggaacattttcttcatttcataattgctattcattttggaaaattgaataaatctgttcatagcttcttgttcccattttcttaagcttttccttgaggggtttcaatttttttgtgtagacatatacacaaattgtcaaattctcctcagatttttatatttcatagtaataatttctgttcaaaagtatttttcttttcttgactgtttctcttttttactatccaagaaacacacaaataggatcttttcttggcttagaacattaat

SEQ ID NO: 14871 - DNA, 1032 bp, Homo sapiens
ggatcataaatgagaagtgtttgcctattgatttaaagcttattggaatcatgtctcttgtctcttcgtcttttctttgcttttcttctaacttttccctctagcctctcctcgccacaatttgctgcttactgctggtgttaatatttgtgtgggatgaattcttatcaggacaaccacttctcgaactgtaataatgaagataataatatctttattctttatcccccttcaaagaaattacctttgtgtcaaatgccgctttgttgagcccttaaaataccacctcctcatgtgtaaattgacacaatcactaatctggtaatttaaacaattgagatagcaaaagtgtttaacagactaggataatttttttttcatatttgccaaaatttttgtaaaccctgtcttgtcaaataagtgtataatattgtattattaatttatttttactttctataccatttcaaaacacattacactaagggggaaccaagactagtttcttcagggcagtggacgtagtagtttgtaaaaacgttttctatgacgcataagctagcatgcctatgatttatttccttcatgaatttgtcactggatcagcagctgtggaaataaagcttgtgagccctctgctggccacagtgaggaaagtagcacaaataggatacagttgtatgtagtcattggcaacaattgcatacaattttactaccaagagaaggtatagtatggaaagtccaaatgacttccttgattggatgttaacagctgactggtgtgagacttgaggtttcatctagtccttcaaaactatatggttgcctagattctctctggaaactgactttgtcaaataaatagcagattgtagtgtctggtttggtttggacagtagtgctttctatcatattgttgtgtgcaatggtaatttgttctactggccaaagcctctttcagcagtgccttgccatcatgcttaaaagtttggctagtatatcttgctggatggagccttgaactccggca

SEQ ID NO: 14872 - DNA, 2029 bp, Homo sapiens
attccaagtgctctcttaaatggcaaattaagttaaagaatactactgctccattcccctcacttattctccagttaattgcttgtcagttccatttcaagaaagcagtgatgttccaggtttgattcagttttcctgtgcacactattgccaaatttttttttagcaaagattctgcactggaacgtagacagttggaaacagtactacctacctagaggttatgtgttttctctttctccccgctttcacctctttctttcccaattcaaaacagccaagtgagccctgttctggtattttgaatcattagagaaaagaaagggagtggctgttttgagttgtcctttctttgcagaaaggagaaaatgtgattgtgttttttttttaccagcctacttctaagtgtcactgcctggtttttctctttttcaaggattagaactaagaggacacaccagcatcggagtgtattaagcccctgaaacacatggtagctagggactgaacacaggaaccgtatgacagcagcacaaacccccaaaggatgttcctgccttgtgggcccctgagccccttgggagactgagaatcatgaccagattcatccagaactgctgcagtgttaagtgaaaatcctctgtagttgttctgcagaggaaccttccttccattagaaaatttctgctcaatacagaatggtccacatcacccaaagtgcactgttggagatgctgtgaaattaaaacctctttgtacctgagacatctagattcacctcaggaggcctgaaggaaatgtgtaacttgtgggaaagaactagacaaccatttaggaattctctagatatactcagcctaacccagtggcttaacacaaggagattggctttgatctttttttcttgtggcatcttccagcaagttagaagtctcatgggataagactgcagttcccctggttcaatagctggaacagtgattttaaatgtccctttttctggatcccttgtaaacatgaaatcattccatggatggctgccttataattttgtctctttccactttaattgtgaatggttaaaaaaatgctgttttctgatattaaatttttattagtgcataccttaatctgagtggctcattacttatccttttggcagtttgtttgatgaccagaattgacctgtatttgaacatcagaaaagagaatgaaaagttgtgatggatggtagaaagatgtacctaccacaggcacatcctttagggaagggagggagaaaggagagaggggaaattaaggacttgatagaccaatctgccctgaaagacacaaatgcattgataattgtttttgccttgctgttgttagcaaatattatttacgaaggtagctctctctactctcagaaaagagaaagaggcaacagatccaaaccacagtggattcatttcatagggcagagttgttatatgagtagatagatgctatgaacaactgaccctggaaattaaagagatttgattagaaacgtgacgtgtgaatttgataaatgtttttctccctctgtggacttatggttagtcattagatttcattaaatactactggcccactttgtgctggttttctatatgtatagttacatgtatagctagttacaaagattgtgctcagggcaggcatggtggctcacgcttgtaatcccagcactttgggaggccgaagtgggtagatcacctgaggtcaggagttcgagaccaccctggccaacatggtgaaaccccgtctctactcaaaatagaaaaattagccaggtgtggtaggggggtacctgtaaatcccagctactcgggaggcttccctgagatcaaaacacacacacacctgggcttagccaaaatagccaccaatccttttctgtttggtgtcatttttattttattttttcctgctcacatgatctgttttttgtttgtttgttttttgagacagagtcttgctctgtagcccaggctggagtgcagtg

SEQ ID NO: 14873 - DNA, 1021 bp, Homo sapiens
ggaggaaatttattctgtgtctttccttctctctttctccctccctccctgtcttcttttatctttccttcccttcctttttcctcccatccattcactcaaatctaggcgatgcatccctgtagtgtgctagctattgtttctctaggtgaagaggcatcagaaacagaatacttcccctgagtcaggagcagcactgaattattcataggccaatgtattgcaagttttagagggaattttcttcaaggttgtggctgtgaggctgcagagtgaaaggagtaatgaatatgcctaacactcacagaggtgagaaatgctgcctggactcacacagcccagggtctcaggctcacgcagccctgggacaatcacagtgaagagaaatgccctgaatagagaatcacactgtcttggccttggtggatggaaccctaatctctctgaactcttcaatctgtgggttgatggattaaacacacatgtattcaacataaatggatagctgggtctcctcgaactctacacctgtatggaatccatttcctcttgttctggaccatttagaagggcacgtgggtaactggagctgtctgacagacatactggctggagaagcggtgaggtccccaatactgaaatggtttgggttggaaatgatgagtaaccatcaggcatgctgtgggaggggctcctgctctgggtggagatgggactggatgtctgtggatgatcaaagccatcttgttaatcaatttgagggtcaagatcatcctcacatctgagtatcttgaaaggttcctcacaaatctaagattcaactactaggaataatggtctcaaagtagaatctgaacatggattcccttagactcaaaactggaatctgaacttggattcccttagactcacaactgtttggctttgtcaggtgttgcttcttggatttgcctcctgactgttgccaatcccctccctacctcatagtcttcattcatcccctgcagtgccccactgatga

SEQ ID NO: 14874 - DNA, 1035 bp, Homo sapiens
tagcatactgcgggaatactcacgaggtttttaatttgagagtagtgttggaggaattttttgtgtacggtagactttcagcttgattgtttgggatttgtcagttacttctgtgctccaaaccacagtcatcctggaagggaagaacttgaaaagtatcgttagagagtttcccctagtctccccattaaataaatgaattgtctttctctgcagtgagctaggtctaacagtttggtgtgctttgaggattcctgtttcttgctttatttaatcaactagtttttaatctgggaatgttttcagaccttgacatatcctatttttaattaaaagaaaaaaggagatgtgggttcaactatgagaaactgggagaaggggaataagaggatcagtggcatgaattccttagggaatcttttttcttccatctccctcaagcctcaattttagatagaaatgttgatttgtgagatctttttcctgatatatttgtggctttacaacctgctggggacagtaaaggacctagttcccagtaaacgtacgccctccccctatattttacctctttgggtggccatctctgtgtaggccctggttccaggctgacattggaagttccctgaggttggtgactgtctgatccacttccttgtaccccctcctggattaattggatgattaataaatgattgaccaggtgtaggggattaaaataacaagtataggagggcagggtgactttgaggttatgagccttgatgacaaggaatgaaagagtggtattattgatgaaattctaaaaatggagtcatttgtagggaggcctggtttgagtgaaaaacaaatataaacagggtgttaaaaagctgttaacattcaccaagttcaccctgtctggtggcaggaaaagaagtcagctcaggaaccatggcagtgggaggtgaaggagagagagggtattagaggttgtccagaatgttttagcaaggccaatcagaaacaaactatagggtccccttattatggggc

SEQ ID NO: 14875 - DNA, 1030 bp, Homo sapiens
ccatgttggccaggctggtctggaactcctgacctcaggtgatccacccacctctgcctcccaaagtgctgggattacagacatgagccactgctctcggccccaaagtgactctgaactctgttttcccatcccctctgatcactttctctcaccacgtgggtcatttgtggtggcaaagtacaaagtgaccagccttctctctcatagaatttgaaggttgctgatggggctatgttactaatggggctgtgtgcttgctacagagatactgctggtgatgaaagtgtatgacatttctgttattcctttgggttaagacatctgtatttagcaggtattatacctagaaggagtgtctatatcagagtatcccagaaaagaaagaagaaaaatcccctggggagtgggaaaaggcagaaagtattgaatgtgtgccctgtgccaggcagtgtgctcagtgctttaactcggtaggctaatcttcactggataaatcaggaaaccaagctctgaaacatttcagtactgttaattactgtattggaactagaaccaaggttggagtgattctaaagcctgtggtgggtttttttttttttttttttgagacagggtatcactctgttgtccaggctggagtgcagtggggctatgtaggctcactgcagcctccgcctccccacctcagcccccaaccccagtagctgggactacaggcacataccactacacccagctaatttttgtattttttgaagagatggggttttgccatgttacccaggctggtcttgaactcctgggctcaagtgatctgccagccttggcctcccaaagtgctgggattacaagcatgagccactgagctcggttctgcctatggttattttatggcaggtaaagaatatgtggattcgaaagttgggtgggggatgaggtggtgagggaggcagagaacaaatgcctggagagaggagggtagggccaggtgggagttgcagtggaggggcacttgggagtgaatggt

SEQ ID NO: 14876 - DNA, 1065 bp, Homo sapiens
cccaatgtatgtgttgaatagtcactgagttccttaagaaagaagcatgttaggaatgagttcataagccctgtctggagggaaatatcaaattctctcattaatttatgatgtttcttcttcatcttctctgtgtttatcataatcccttttaacatattccagaatgttgcctgaattaattaattaattatggctgggcacggtggctcacacctgtaatcccagcactttggtaggctgaggctggcggatcacgaggtcaagagatcgagaccatcctggccaacatggtgaaaccctgtctcttctagaaatagaaaaattagctgggcttgggggcgtgtgcctgtagtcccagctactcgggaggctgaggcaggagaatcgcttgaagcaggaagttgcagtgagccaagattatgccactgcactccagccttgcgacagagtgagactccgtctcaaaaaaaaaaaaaattaattatttctcaggacgtgtcctcatctgatttgcctggattttataaagttattcatttggtgcctttgtctgaactttgcctaatttggattacttttggaatctctatttggacgtttgaaggactctcctttatgttaattagtttaagcaaactccttgattcctgatttagggccccacatgcagggaactggaagtatgactggagctagaactagaacatatagaccttggcagagggactttgtacaattagaaggtgaggtaagggtataggtggcggcaggggcatggggctaatcaaagggaaggaacagtgggcaagttcctacttctcatttttgcttgtacctcacagtcccaccttgacagcttacaggaagcttgggtaatttatgatgaagaggacaggaggaatcatggtttggttataaattaggaggcttcctggaagttacacaagatggagaatatttggagccagaagacaggatcttgtttggcttgagtgtgcacctcattggggctgttaagcttcattagatggaggtgaagacatgtccctggaatcctaaacc

SEQ ID NO: 14877 - DNA, 1060 bp, Homo sapiens
cttgcctgaggccaaaccgcttttcagtggctaggacctaggctgtccctcctgtcctgtgatcaggtccctgctgcagtcatcctgctgttaggtgctagagacttgttaaagagaagacttaggtggggtggtagtgtgtctgctggctttcctgttgtctgaagttggggaaagcgtgttgcccagatgatgtgagcaattctgggggtggaagacaagggcgcagggaatatcaaagcaattcaaaaaaacctctgacactgtgtaatggcttaggtggcttaagaggaaagctgagggtaatgtttgtgatttggaggctgtgtgattttaacaggagtttgatgtttgccttttcaagtaggagctggagattaaaggaaatggataagttaatattctggcctgaaaggatgtcagagtccggtaaaatatgtggctgtcgaagcactcaagtgttagtggcaaaaaggaaaggggaagatatagaagttagtaggactggaagaatccattgatccacaatgggagaagatagaaggcatctataaataactgaattttggggggtaggaggcattaaggtccaataagtgtttagatatgttttgatactgtagcctggccatttcagggtgagtaggagtacagaggggagatgttgcagggaagaaagagaggttaaggaagggcctgggcagctttggctgtattagtcatttctcttacttatcacacccctctggggaactttggacttcaaagtgttaggacttgttatcattacaacctgaaatgtaattagcgggttaatttctgttcatgtttctggaactgttctttgtcctttctcatcatgtggcaggatcaaggttggtgaacatagttaattaaaggaataaactctgttgttctggactctcaccactactaccattatcctctgtctagattagtctgaggcaagaaaaggatttatgttggttttatcatcccagttccctctcttaactaatggacagaggagccatggtttaggaaaaaatttgttctaaaa

SEQ ID NO: 14878 - DNA, 1049 bp, Homo sapiens
atcctctggagacaatttgtctgcatcgtctctggtcgtagataccacagtcatcataatctgtatcatctcatcatcaaatatcacagttttgatcacagtctaaggtaggaagaatcaggtacttgagagttctggagtaaaattacatcatgtttaaagttcagtttccatactggtttctctcatctacagctcgagatttgcagttatagcagaaaaggtgttagagaggcattgggtccagctttcctttggtcattcctttaaatggggagaattattgataagtttcctttttaagagtggcaaaaggaggcgtatcttattcttcacacctagtcacaccatgcagtggatagaccagaattaaaaataaaatctatgcacatgctatccaatttgcctttcttggactaggcggaattaagatcttttctctgtagcagcctttctcaggtctccaagtctttcattttacctgtagtcttaagaaacttgctgtatgacctgaggcaaatcacatgacctctttgtgtcttttgcaaaacagaaacaataatccttaagaatgttaagttggtgttgtgtagactaataaaaatgattggaaggcaggcacttggcatataaaatgaagtgtgtgatgtaattcccaaataacaacaacagaattggtatgtgacctactgttgagttacaaggtgcagtagactttttatgcagttgatattctttgctgtcattgaaacacaaaacttaaggtgcaaagtactgtttgagttggggataagagatttttggagcagttatcaaatttgaccagtaaggagggattaatttacttcaggaatccccattgctttccagaaagctcatgtttgcatagtttgatcttaatccaactggcttgctgactcataaaaagtttttgtttgcattctctttctttcctgagcttatttactaaacaaactcagtattttacttgtttctgatttttttccccttaaaatgttgccatgacatgttaggccgtgttaaacatc

SEQ ID NO: 14879 - DNA, 1051 bp, Homo sapiens
actttgtctagggtagctgggaatgttttcactgtcctaggggaatttgctgttcttcagattgaatttgaccccgttttcagcctttatttcccaccagagcctgatggtgtttgtattggcaagccagaagactcctggcttggagagaattagagttagtacagcctgcctggccctgtcttttcagcctctatctgaaggggcaaaacaaatttttcggccttggttaattgttacttagcccctctgatccagcctgggcaactttcaggtagctcaggcactgactagcctgaagtctctgttgaaacagggaagattaaagttgatttgattcatttgaagtaaaatcagcaggcttttgatgatttcattaatttcctcccttctgaacaccctcctgttagcagtaattggaaaccctgactctgtttctcatttcccccccacccctctgctttaatctgagacaactggaaactgcactcagctttttcatttactggaagaatggtttgaagatggttttaatgactggctttgacactgtttccagaagctgagactgttgccgtgcttaagttcacacctacctgggggcctcagttttgctcaccttgcttctataaaactgcttagttcttggtgtgcaggtggaagagggtccccatgagaattctctttttatcccaggcaatatatatgcaagcttttcattactcattttcatcactcaacatttacagactgcctggggtgtgtgccaggcactgtcctagtaactgagtgtgttcccagcacctcctcctggccctggtggacgtccagaggactaggtaggtgagattccagcaggatggtggctaaactcaaaccttgggaactgtagtctctggggctttctttctctatctgtttttatagttgcaacttcagtttctgtgctttttttttttcttgggcctgaagaggaataaataatatgaaccaccacttgatgtcagagaaatagcaggtagcaatagctgcaacagctaatcactattgg

SEQ ID NO: 14880 - DNA, 1084 bp, Homo sapiens
tatccttttggcaacagagatcattaaatttgttttaaatttgattgtgtgtttcttgaggccctgctgtgtatgcctgggactgtacttggcattaggagttaccattagctggtaggattggaaatgaaaccacaattttggcctttgtacccaagagtccaaccctgttttaaactctaagccagactcctaagtcagttatcacctgctcatcagctttccttctgagctgccgtaaacagccatctgggcctttcctgagaggaccagtcatctcctctgggagatgaggaattctgagaggggagagcaaacacatattttagctcaggtaggtgatatggtgaaggagatgagaacaagaagtgacaatggctgatgaggaaaaaataagcattctctgctttttcttaagcctttaactgccactgtcaagggaaacagtaacacttgctaatacacgtggaatagcctggctccctacctccattgtcatcccaccatctggaggtggaggtaggagacagctgtgggctctgctctataggtcactgtactgacctatagcagtggtagtggctttgggcactgagtgggctagccctgtacctggagcagcaggataaaggagaatggtcctctggcctgcccctccttgtagcagtggtaacagtgggagggggaggggttcccagccccagctggcagcctgtttccctgggtccctgagctgcaagaacaagaggaggtgaaagggtaacaggccatatggagtccatttgtcagccaagagcagcctgggctgtattgtcgagaacgggaagtgaaaaaggagccggcttattactgaactggaacaaggagagagcaaacaacaccccccaaagtgcttatcctgctctgttttctgcctgccccctctccaaatatccagaaatttctgaaataatcctttttctttttaccaaagcctttgcccattccaaaaatcagagataagggtttagtttgctacatgaaaatttatcagtgcctagtaatgtgccaggcatgatacaagaccctttcaagtatgcagttt

SEQ ID NO: 14881 - DNA, 2454 bp, Homo sapiens
tgaattttattgaggctgaaaacaactttaacttgccggctcactggaaccccactcccagtggctccttgattaggtttgactgtatggcagtgtcgttaagatactcttcccattctgtctcctgatttcagtgctcttaatgtgttgtagaatactcttctaaagccaatgttaagagtcttatgcttacattttaggaatttgaggatccaagggatgcagatgatgctgtgtatgagcttgatggaaaagaactctgtagtgaaaggtgagattcctgtgtaactagataaccctgggacatagagcagactgggtctgctggcatatttttctaagtagatttatgtagcttaagtgtgtaacggagatttttcttccctttttgtagggttactattgaacatgctagggctcggtcacgaggtggaagaggtagaggacgatactctgaccgttttagtagtcgcagacctcgaaatgatagacggtatgtgaagggtggatggctgcattgaacaattattgtaggggtagcatttaagattcaggagtcattagcagtgatgattttgggtcctgccgtataatctgttcttctattcccacgttagccagttgttcttgatgaatctatatgagtcatagaacacaaatctattgacggaagtcattagaatggcttgtgatatctgatggcttgaacttgcccacagttgaacacaagtgctgtcattgcatttcttccattgtgaatacgaattttcttcctcagaaatgctccacctgtaagaacagaaaatcgtcttatagttgagaatttatcctcaagagtcagctggcaggtttgttgaaatacagttttgagttattttgatgtggctttttaaaaaagttaatgggtagctaatgttgtattgttttattaaaagtagttttaaattaatggatttaatggaattgtaattttaaacatttaattaaatgtaatttgggggatattttgaactttaatattagtgatcaaatgtaaatgttttgaggatatttttcttgttttttaaaatcaatttttaaccaaatattaaaccctttatttgccagcctgtctgtgtcgttggccttatgacgaggagtgcctgtgggttatcctaatcgttgtcttggtcactcttggttgggcctggttgactttgccagtcagctcctacagtgatcagttggccacctctagatctgtgtttgccggtctagacgttatcggtgcacttccttgaagtgccaggttgcagcgatcccagagcgttgataacgtgatctgatccctaagttgagacctgtcttcctgtaacgcttccgaataagaggtccggtcgaaaagagttgaaagatacgaaattaggtggtcgttggaatcctgatcgcagtaaagtggtccttggtaactgctcgagtagaacatgtctgcatccgccaatagtccgctaatagggagggctgtgcgattaaaggcttccatcgattgggtagtgtccttcaagtgggtggcgaagagccagtcgggcatatgtcatgaaggtttctccgaccgattaatggtttgctgcttgactagcctagggaaataataataaaggtaaagtaaacttttttaatgacatatggggcacaaaataactggtgtcttgtaaatgttctgtttttttaaataaaacttctctactttagtctttactttaaaaatatgtactgtttccttttttgttgtttttttgtttgtttttttttcttttgtactgagctcagcatagactaatactaccttaatgttaaaatctgaatttcttttagcattttgcttaaaagcaatatgctatttgcttattccgtgccctgacatagataatttttgaattctgatagaatacaagtgtggtaaatgccatgtttgtactttatctaacatcttctctttcagtagtcttgttttttttatatcatgtgattgtttgtgtgtcccctttcctcttctttgcttaacacaattatcttgtgttaaggatctcaaagatttcatgagacaagctggggaagtaacgtttgcggatgcacaccgacctaaattaaatgaagggtatgtactggaaactgtgaaagtctttaaaaatatccggaaaattttactgtgaacttagttttgaggacttaaaatttgaatatgttagaatgcagagattctccagagacaattttgctgcttccctcctcccccccacacctttggcagtgtctggagacaagtttggttgtcacaactggttgagagaggatgctgttggcatgtagtcagtaggggctaggcatcctgctaagcatcccacggtgcatagggaaccccctcaacaatgaattggctcaaagtataacagtgccaaaactttgctcttttaa

SEQ ID NO: 14882 - DNA, 1189 bp, Homo sapiens
aggcacaggtatctctaattttttaaagtcaaaagttgtatttaatgggtttgttgtagagtcttatctaggctgatttcttttcatttttcatagtaggtcaagaagcaggtctcgatcccggaccagaagttcctctaggtctcgtagccgatcccgttcccgtagtcgcaaatcttacagccggtcaagaagcaggagcaggagccggagccggagcaagtcccgttctgttagtaggtctcccgtgcctgagaagagccagaaacgtggttcttcaagtagatctaagtctccagcatctgtggatcgccagaggtcccggtcccgatcaaggtccagatcagttgacagtggcaattaaactgtaaataacttgccctgggggcctttttttaaaaaacaaaaaccacaaaaattcccaaaccatacttgctaaaaattctggtaagtatgtgcttttctgtgggggtgggatttggaaggggggttgggttgggctggatatctttgtagatgtggaccaccaaggggttgttgaaaactaattgtattaaatgtcttttgataagccttctgctcacatttttgtgaatgtctgaagtatatagtttgtgtatattgacagagctcttttataactaaagcaaatttaatttttttgtactagaaaaaaatttgaacattttagttcttggttataaaaatgttaattcagaattagtttaatgccttaattaaactaattaatagctttggacacttaaaagagctctaaatttgcttgtacataaaggcttaatttgttttccttgttagggtcaagggtgtcctccactctttaacagctgctggacagacacattagagcagctgtttgttattgataataaaatattataaaactactttttgtctgtttgtctgaagaagtcctatgctgattatttctcatccttatacagtagatttaaaacacagaacacatccagaatcctggagttggttacggtctctctttaaaaataatgtttttgacgtctccaggctagtgaaaagatacagaagtaagtgaatgccaaaatcacaattgttgagttttgtgtccgtggcccccctgtcccccaaagttctttctctatctcctgaatttattggcatcaggttacttaagcttccagagccaaga

SEQ ID NO: 14883 - DNA, 1030 bp, Homo sapiens
attaaaaaaaaaaaaaaaagaaagaaaaccatctaacctactggaggaggagaggtcacgtggagcagaaccgaagtcccctagctgccccacatgtcagtgaggtcgtctcggacctcagccttgctgaccttccagctgaatgcagctgcactggggggcccaggtgaaaccagcaggtggatggccccatcagcccacagaatcagagttgttattttaagccacaaggtcttgggggtggctcattatacattaataaattcgctgataaattttttatttgcttgagtccatttgattttattttctgtcattcacaacagagagtcaggactgatacacttctgtaatgaactaaaccttatcagaaatgtacctctgtggaacttcttcccacctatgagtgaaaccagctgccttgatctggagcttcacttgccaagcatgcatgcatgtgtgaattctcttgctggtgggatctagttcttgctcatgtttgtgtaacttatctgaacaatggtgccactgtctccgaaggggtggatttctccagcacatgcccttaagggaagacctttcaacagatccttctctactggtcacttatggggtttagcacttggcattcctcagccttgttgtagctcctcttcataggctctcacacatgtgacttctggggttactgatctgtcctgaaaatgcccaggagaggtgaagcatcagctacttgagactaagaaaagtagtagaggcagtgcaatagcatgggccctggagtcagaccttcgtgggctcaaaggctggctctgccacctgctgctgagtgccttgtgctcatcatggagcctgtctgaaactcggtctcataggtgaaatgggaggtaatcatacttccttcatggggttgtggtgaccaaaacatgaggagatgcctcccatgcagtgttggtagcccagatttagcagcgatccttcaacattgttcctcttgaaggtggcaggatatcacagaacaccatcccac

SEQ ID NO: 14884 - DNA, 1064 bp, Homo sapiens
tattatattttgaacatctagggtagagtatacgatggccaggcaggaggcatgaagctggcaaagccactttggcaccttctgcctataagacagcctctgtttatttcatgccagagaatgtggagagtggcttaaatgatttatgtttgaaggatttttttttttttggttgacaaaaatgcctctattgcaataagccttggatactcaatttttaataaactgggctcagcagctgcatagggtcaagagagacagactgtgtgtatgccgaggaggtgtcaagtcaaatgcacctctggtcaggatccctcctgagcagacggattttccatggcctgacttgtagggattaaccctggatattcaggacttgagggtacgctgtcctctgggaggccatcaaggatagctgtttggaagcctgagactggggactttagtgggagcgggtctgttgtctgtgttattaccagggagtttccaaggacggagactgttataagctatagatttaagactgacacattgaactgtatccagactccatgttaccctgggcagatcctcaagtcctgggagttgggcagctgcaaaggccagtagcagggagtcatcatggaacttgttgctaatgtttatgcagtggcctgtatggcgcagcatacaatatagctattgttctgtgtttcaggagtgccagttagtggctggtgttaaaatgtgtccaggatttggatggagaatcctctctgtctaccactgtgttagattttggagggatatccagactgtgcctgggggtaaaggctggagatggaataggttagggcagatactgagactgggcccaaggtagaaggcccaggagagccatgtggcccagagatcacatatttaaactttcaaagtttatttcaaaattaatatacagtaaatgcaacacagtttttggtgaacagttacatgaattttgacaatgcatacagttgtgtaaccaccacaatcaagacacagagcagttccatccttgctccgcaccccaaatctcttgtttgctc

SEQ ID NO: 14885 - DNA, 1077 bp, Homo sapiens
gctttgtggggtatagggtctctgttgcaaatactaaactctgccactatagtgcaaaagcagccacagttaatatgtaaaagaaaagaatgggcatagctaagttataaagtaaataaagccttatatttacaaaaatggggagctgggccagatttgtgcacccatttccccacagtagtttgcagacccctgaaaaaactaaaaggcatcttcagagtagtcagacttgcttgttacttgcctcgtctatttagtgatacattcaaaatgctccttaacacccacacgatcagaagtgggagacaccagtaggaaggaaacaaacaaacaaacaaacaaacaaacacaaagctgcctaggtctggtgaagtagccattatcatgcgagaagatgcccagtgaccagagatatctgtccctctctaagtcttacctggtttccaactgtaatgcttattaatgagacctttctgactgttctcactagaaatttgttcttacttatcccaagtgctgcctgacagttctgttctcttcctctagtccattcatgcttctggtgtgctggaagactagtttacgtattcttttttctaatttattttattcattcattcattcattcattcattcattcattctgttgcccaggctggagtgcaattgcatgatcttggctcgctgcaacctccgcctcctgggttcaagtgattctcctgcttcagcctcccaggtagctggaattatagccgcccaccaccacgcccggctaattttttgtatttttagtaaagatggggtttcaccatgttggccaggctggtctccaactcctgacctcaggtgatccacccgcttcagcctcccaaagtgctgggattgcaggcttgagccaccgcgcccggccagtttacacattctgtcctcaaacttccaacacattggtcctccttcttcaatctcagccttgcttcctctttcactgagaaatccaggcaatggaagatagtttcttcaggttaccattactgtatctctgaatctacccatgtctgtgccctgaacctcctgtca

SEQ ID NO: 14886 - DNA, 1047 bp, Homo sapiens
attatttttaaaaattcattatggctgtttctgaaaaatgaaagactttttttttcactacggttagttaacacatgtactgtttctgaatttaaaactcgaaatatcttccacctctttttgtcatggttctttatacagctgtgtgttaaaaatcactgtaatacaaaattagaaagaaatgagctcacacaaatgtaaaagacatttttttgtttttgttttttttagacagattccttctctgttgcccaggctggggtacaatggtgtgatctcggctcactgcaacctgcgcctcctgggttcaagcgattctcatgtctcagctgggactacaggtgcacaccaccacgcctggcttatttttgtatttttagtagagacagggtgtccccatgttggccaggttggtcttgaactcctgacctcaagtgatctgcctgtctcagcctcccatagtgctggaattacaggcatgagccatcgcgcctggccagaaaattggctatttcacaaaatatacgaactttgactttgtttgcaaaccaatatctagaatccttgctaacttcagtgaaagtatgttgaaaccatgggatgcagtttaaaaaactgatttagtcaataatagaagtattaatgtagtaacatctaagatttttcaaacagtttttatgtgccaacccactcctttattctcagaacatcttcgatactgtaactgccatatttccctgccttaacagatgaggaaactgaggctcatagaggtatgtatcttgatcaaggtccaaggaccaaggactggatcccaggtgtgtctcactgaaagtccatgtttttaccgcctgccttgcattttctgcccagtacagaggaccttcccaagcagcacccctttctttgctgtgtcccgttgaaggctcacatctcgtttctgttagaagcatcacacctgattgacgactggggtattgtcattggcccagggctttgacactgagttagtctggcatccatctccatccaccgaggcatacatga

SEQ ID NO: 14887 - DNA, 1018 bp, Homo sapiens
aagatttgtgtacatttttttgtgtttatctgttttcaattctcttggcatatacctaggagtagaattgctaggtcatatggtaactatgtttatgcttttgaggaactgacagactgttttccaaggtagctgaaccattttacattcccaccggcaatgtatgaaggttccagtttctccacatccttgtcaacacttgttattttccatctttcttattagtatcttttctagtgggtgtgaagtggtatctcatggtgtttggatttgcatttctctgatgactaatgatgtcaagcatcttttcatgtgctttttggccatttctatatctttggagaaatgtctactcagatccttttcccatttcttaattcagttacttatcttttcattattgagttacaagagctctttatatattctagatacaagactctctctcttttttttttatttgagatggatctgactcactctgtcacccaggctggagtgcagtggcaccatcttggctcactgcaacctctgcctcctgcattaaggtgattctcctgactcagcctctggaattgctgggattataagcgcgtgccaccaagcctggctaatttttgtatttttatattagagatggggtttcaccatgtcggccaggctggtcttaaactcctgacctcagtaatctgcctgccttagcctcccacagtgctgggattacaggcgtgagccactgggcattaggtaccagactcatcagatatatgattcacaaatattttctcccatcctgtgggttctttttacgttctcaataatttcctttgaagcacaaaagcttctttttttcttttttcttttcttttctttttttttgagagaaggtctcactctgtcacctaggctggagtgtggtggtaccatcttggctcactgcaacctcggcctcttgggctcaagcgatcctcccacctcagcctcttgagtaggtgggactacaggtgcatgccactat

SEQ ID NO: 14888 - DNA, 1034 bp, Homo sapiens
ctgctctggctttcctgctgtctgtgggagaggagaggctcagtaatgggaggcttcagtcactctctctggtattctttttttttttttttgagacagagtctcactctgtcgcccaggctggagtgtagtggcgcgatcttggctcactgcaagctccacctcctgggttcacgccattctcctgcctcagcctcccaagtagctgggactacaggtgcccaccaccacgcccggctaattttttgtatttttagtagagacggggtttcactgtgttagccaagatggtctcgatttgctgacctcgagatctgcccgccttggcctcccaaagtggtggaattaaaggaactgctcttcttttttagataatcatcatcatcaacaacaccaccactttcttaacctatacacaaggtgccaggctgttttatatttgcctgacacatgttaagttattcagtcctcactataagcactgttacattcccattttattgatgtggaaactgaaccacagagaagctgtgtagcttgcccagggtctcacagtgtgcaagtggcagagtcagtattcaaacccaagtaccctggctccagagttcttgatcctaaccatgattccacactgcccctctaagagacattgccatcttttaaagtgatgttgccagactagggcatattcaggagggtgactcaggtgagtaaagttgggaaatgatgtcatgtgaggaatatccaatggagccagagataacaaccaaaggatggataaaaagatgactaggccgggtgcagtagcgcacgcctgtaatcccagcactttgggaggccgaggtgggtgaatcacctgaggtcaggagatcaagaccagcctggctaacatggtgaaaccccatctccactaaaaacacacaaaaaattagccaggtgtggtggtacatgcctgtagtcccagctacttgggaggctcaggcaggagaatcgcttgaacccgggaggtggagattgcagtgagccgagttggc

SEQ ID NO: 14889 - DNA, 1029 bp, Homo sapiens
tgtgaagacagaaaagttttattaaaagtgaagtcagacaggagaacaaggaaaggctccactcctgcaggccacttttgtcttccccaccagccagcgttctcacagttctcatctgagtaaatgctcctatttatgagggactttcttattatgtactttttaaacataaaaatatatttgatacttaacccccaagatagaaataaaattaaaggaacaagaggtatcatatttgctgtttacaaaacctggaccattctaggcaccagacagaggaacaggagtgaagacagtgaagtttcttgggtccccggagccctaacactcgggtgttccaaatgtctttatatgtcctttgtgggggatgctgttcaaactttttggaaaatacaaaaaatattcttcaccatataattggattggtggtcttaacactgacaattaggtactagtttataaatctcctccctactcttcaggagcaaaagttcaccttacagcagggttgtggaattatggaccttctggattaaagaggacctcagagacatctggtttatcttcttcctctacctaccccactccaatccagggctcacgctccacttacagtctctacccaagtagtcttccaccttctgcttaattgctctcagagacaggaagcttattctcacaatgaaaaaatccatagtgaattttgggacaatttttttggaaagtcctctttaccttgacttgagagctgtcttcctataacttccaagagatgacttcagttctagctatgggaattatagaatccacagaaagacttgaagatgagcaccattatatccttgtgaaatcttctctttcagccaacaatttatttcccctggcagaaatccttagttctagcactcattcccataccatagggatttatatatctttccatctggcctccttcttctgagtctaatttgccaaggcccttcttatagggccttccttatagcatccttcctcacattggacacaaga

SEQ ID NO: 14890 - DNA, 1051 bp, Homo sapiens
gagtgtggaattttgtaaaaatgtggtcaagactgtttccagggaacctagaaatcatagttcatcttaacagtgctgggttatcagtgacattgatgttaaacaaaccccactcaacatgtgtatatgtactaacattgtatataatatccttagatgtgtatacaatacatatatacatgaccatatgctcataacatcaggttttgccaactcttagaaagaaaccaaccacaatgcattctgagtggctatgtttttgtttcccttctcacccaaggttcagtcaccgacaagcccttgagccagggtaactcaggaaggaaaggtgagtggagttttatgctttatctaaatgtttgcttccaaaggtggtccaagcaggatttcttagatgagatagaaggagcctggggtgaaagcctaaggtgtcccgcagaacatcttctccattcttattccatgtttcctctctgaagcacccgaggtaagtaaggctcatacagtgatggacaccaagctcccagatttcccaagggaggtgactgagtatagagcccagagctgggaagcacctttagaatgtgagccctaggaatattggttccctggggagctcggtcaatcaactaccagtgtagccagcattaaaccagagaggatgaggaaggtagggtgcccaagtctgcccttggctctcttgttgtgtaagcacatttgggcatttttcccccctcgctgatgctccttcataattgtcccagcacatccagattctcttcactaaggcgaggctggctttgtgggcatgcgacctgtgcagttgctatcctgaaattctgaataattctgtctttgagtctgatgggacagtgaagatgcgagtgagtggaggagagacacgtcatatgagtgtctgctgaaccttgtcacctcattagcacaaagcttttgtgaggtgtactatgtggcttccatagcatgcttaaaattttaatttttctttatctaggacaatactaagtagcaaattaaaataacaccgtgacaa

SEQ ID NO: 14891 - DNA, 1093 bp, Homo sapiens
taagttgaactttaaaatttgctctgcaaaaagtgctgttagagaattaagaaaaaactacagcctgagaaaaaatatttgcaaaccgtctatccaacataggactcatatctagagaatataaacaactcttaaagcttagcagctaaaaaacagtttaattagaaaatggtggcctggcatggtggctcacacctgtaatcccatcacttcgggaggctaaggtggatgaaccacttgaggccaggggttcaagaccagcctacccaacatggtgaaaccctatctctactaaaaaaaaaaaaaaaaatacaaaaattagccaggcatggtggcacgtgcctgtaatcccagctactcaggaggccgcgaggcaggagaatcacttgaacccaggaggtggaggttgcagtgagccgagatcgcgccactgcactccagcctggatgacagagcgagactccatctcaaacaaacaaacaaacaaacaaacaaaaacaaaaaattagccaggcatggtgatgtgcacctgtaatcccagctactcggaaggctgaggcagaagaattacttgaacccaggaggtggaggttgcagcaagcgagatcatcactccagccttggtgatggagtgagaccctgtctcaaaaaaagaaaaaaaaaaaagaaaagaaagaaattggccaaatgcacaaatagacatttcaccaatttcaccaaggcagacaaacagagggcaaatatgcacacaagaagaggctcagcatcattagccacaggaaatgcaaaataagtccatggcaggatgtcactacatatctattaggagagctaaaagaaaaagtagtgtcaacaccaaatgatagtgaggctgccgagaaactggacctctcatacatcgctggcaagaataacatggtacagacacactggaaaaatactttggaagtttctgaaaaacaactaaacatacatataccatataatccagcagttgcactcctgagcatttattccagagaaatgaaaatttatggccacacacacaaaaaacctgtacacgaacaagaagcagctttatctgtaatagctg

SEQ ID NO: 14892 - DNA, 1075 bp, Homo sapiens
tatacaacccaatgaatttaataaattcatagtgttgtacaattgtcaccagagaacatctccatcaccccaaaaagcaaccttgaacccattcacaggtattttctactcctacctgtagctctaggcacccccagatctgttttctgtgtctatagatgtagccttactagacatttcatatagatggaatcatacaacatgtggtatttacatctggatttttatacttagcataatgtctttgagattcttcatctacattgtcacatgtattagtaattcattccttttaattgctgaatagtatgctatcatatggatatatcacaatttattcaccagtggacagacatttggattgttttcagtttgaagctttaatgaataatgctgcagtgaatatttctatacatgtctttgtgtgggcatgtttttattctcctagatggattctaggagtggaattttggggttaaaagttgatgtttagctttttaaagagactgtcaaactcctttccaaagtggatgcccagttgtacattctcaccagcaatgaacaagggttccatttcctccacatccttaccaacacttaatattgtctatctttttattttagccattctagtggctgtttagaagtatcttgttgtggttttaatttgtaccttcctaatgattaacaatgttggatatcttttcatgtatttattagccatctgtatctcttctttggtgaaatgtctgtcaaaatatgttgtccatatttaaataaggttgcttgttattgagttgtaaggtttaccttattttcaatttaaaaactttgataggattttaattttgtaaacccaattttaaaagtaagcagttgaataagatggtttgcactcatggaattatagatgccctttagtgggcctttaaagtgttttacacctacacaaaaaagtgtcccgagattttgtaggcaggtatccttcaattttagaagaggatattgctatccagagaagtaaaaggaggggctcaacttatccagagtaaacttattacatgtgaagggggat

SEQ ID NO: 14893 - DNA, 1164 bp, Homo sapiens
ggtgctgttcgctttggcttggcttcccagcctttgagcatgctggatgtcacaggtgattcctggcagcagggcatcttgtcttttctcacttcataaagatttccatttaggacctccccgtggcagagcagctgtatctcttcaccctcagtgaccctaccctgcaggaagattccttccctgcaagtggctttatgcctcatgggcttctctgactacatctgggaaatctgtggaggtccttgacctgcaaaagggcaaagcttccccaaaaaacctttttgccctccttgagtgcagaccttctttgctgatggctgggcccgatgggcagtccaagattttcatctggatgatgggagaaataaacagaatgttttcagttgtcttgctccagagaagagatacagttcttgtaatatgggaggattttcatacctacattgaatattaaaatattacataagccatatgcacttgagttctcattatcatccctcctggaatgtttgatttttcactttccctttgttagcctgtaagactcctaaaatgaagccaccctgtgtggaagggctgagcacactgtgctggactatttagactgtgaactctgtatctggcaggcacaaccaaatgtgcattgcagctgccaaaagactcaattcagtggctcattgaattcaatggaaagaggtgttaatagagtcaggggaagtgatgctattaaaaaaatgacattgtgtggctctgttctgtgtttattctccctcaaagacttccagatcaaactcacacagtttggcatcaaaagatgcctgttttggactccagtttgaggcaaatagtatatccagcatagatactcttctcttcctgctacatctcatttcttgggatgattgtcagataattcaggatcactttggcttctgcaagagttgggtcttggtgtcagtacatgagaataatatcagggtcaggtgtcacccgactgtcagctcagctgctggcctcagcctctaacaagggttagagtctccatagctcttgaatcttaagctcccaagggtgagatgttgatgcaaaaaggagatcaggactctgtattctctctccctcccccaataagatgcacgaaagtcggccaaaggtactgag

SEQ ID NO: 14894 - DNA, 1063 bp, Homo sapiens
gcttggaatttgtggtcctttcgcagagcacagtcagatggccaatgtcgggaagagaccatccagtgtcaatgtagaccccaggcataccaggggcactcctgggctaagcgatgatgctctgtactgcccctgccttcggcccccttcccgtgctagtagttctggtctgcacagcacacggaagccaagcaatggctgagtgtggtgagctcagatccaccgagctcagggactcctcctagccttcctctgaagcctttccaggcaccaggtgtctgccagtcccagctgacatacaggacctgacagaagcatccagagaaaactgaagtagaatgtagatttagggatccctggtcatctggatgttcctcctcaatccaggctcagctgcagacaagtgttagtttcagttatcctcatagctttgcccacagaggcccctagggtgctttggagtgcaactgtcattcttcttggcccaatacaccctcttgaacctctcacctcaaaggtaggactatggaaagtctggccagaaagcccgtgtctgtgacatgtctctgaatgtatatacacatgtctgtttgtgcatgtctctgtgggtaggcctgagtgtgcacctgtctgtgttcatgtctgtgtctgtttgtacatggtctacacttatgtctttaagtatggctatgtgtgcatgtctatacacatgtgtgcatgcattgtgcatatgtctgtgtatgtctgtgcatgtgtctgcatatgtgtgtgtatgagtgtgatggagtgagggagagtagaacattgagataagaggaagagggtatgtaggattaatcaatggggtggggtgaagtggaggctgagtagacttaaagcctatgcagaggcagaaaggattcctgtgtccccactctccatttcaacacacaccacaggacacactgctctggacccaagcagcccagagctagaaggctctgtgggtcctctagtccattttgcagtctaggagtcaaggctagcccagagaggagtagcgatttgctcaagggtacatgtg

SEQ ID NO: 14895 - DNA, 1645 bp, Homo sapiens
tgggttttaggaggaagttggactactagcccagaagtacctggaaaattaagctgtgttgctaagggcatcgctgctccaaacaagaggtggttatgaggcttctggaatacatctaggctcagtgaacccttgtactccacatggaagcctccaaaagaatagcaagaggacagctagaatgtgctaagagatgtcggtctaaaaacctatttggatgacttgaggggacgcatgaagggtgtgcaggcaatttgcaaagggcaccaggttgtggtctcttctggctgggatttccttttggttggaagagatctggccagttgtgctgggcccctgggtgtaatttttgcgtatcttgttttccaggaaattcaaagaaataggtagggatcgttctgtttctacggaattttgaatgatcctgatacaatgattagaaaagatatcctgaccttcctggggagacataggaatctgatctttacagaggctacaaaggaagcatgtattggcctgttgatggactcttcttgacattgaacaagacacaggactcccctggggccttggaatgttcagtgtagaaccctttgaagggcagagtcttttgccctacatctgttcctgtggggctgtggtggccctagcagaagtgtgatcaaagggatacaacacacaataactttgttggtattttcaaatgatgttcaaggctcgaatgccagcagtagagatggaaatcaacaaaccatggcattggacctgaaggctaggagcttgtgcctctgtccctgggataccttgtgaccttggataagcccctgccattttactttacctccattttcccatctactcagagctatgtttaggagatttttgttgatcttaccaaaggggcagctaatatccattgatcccaattgaagccttgggatagggatgtggcaaggcctagaaggaagtcacactgggaaatgcctgggatggtgctggtttgaaacaagctttgcttttcagtgcttgtggacacgtcttaaagccatgggatcagagccagccacataatttgcagggcccagcatgaaatgaaatgtaggactctttgttgaaaaggcagggaggaagtgtcgctaaagatcctgaaagataaagcttttctctttcttttgttctctctttctcttgacttgacatggtgttttgcatttgctatttgatgtcattgcaaataaaaaattttaaaatttaattattagcatagattttactattctttatgatgtgtggtgccagttttaaatgaacttataggaacactttacttatatgaggaattataaaaattatacaatttatacttctgtagctcatacatgcatatgtatttattcttactagaacagtggaaatgctgcaccaaataaactaaactatttttatttcacttttttatatgtgtactttatatgcatacttcatatgtgcactttccaccaggctttcagatgagccaggaaaggaaaagggaatacacgtgaccctaccctttccttctgtgtcatcattttcagcatgagtggttggctaatatgggaaagcaacataggtaggaaaggatatgatagggttcctagattat

SEQ ID NO: 14896 - DNA, 1048 bp, Homo sapiens
gcgccgggcctctttctctgcctggcccagggctggcggccggcgggggtcgcggcggcggcagtgggggcgctggcgggccgcgggtggcgggggccgggccgcggctccgggtgttaggagacaagatggcggcggctctcagaaggccggtctcctcctctccgccgtcctccgccccgccgctcgccgcctcctcctctcgggtctcctcctcctcgtttgctgcctcctcctcctcctgcagcagcaccagcgaccgccgaagcgccggctcgctcacccggagctccggaggtggatagacggggcagctgcaggctccggcgaccgaggccgagctggggccggggcggggacggcggcggcggcggcggcgacggcggcggcgccgggtggggatggggtcgcagacgctgcagatcctccgacagggggtgtgggccgcgctcagcgggggctggtactacgacccgcaccaggccaccttcgtgaacgcgctgcacctctacctgtggctctttctgctgggcctgcccttcaccctctacatggtgagtgtgggggcggggagcgggtggctccttccccgcgagccggtggggagatgctggggtcgcgccctcttcctcttccacggggtctcgtcccccgggggccgccaccctctcggtgtgaggctccccgcccccactgcgtgctcccactcctctcttcggggctttcctggtttcggaggtgacacgagcaacgagcccacggcaacccgcgccggccgcccccgcccgctcactgggaagcggcagcgtcctaggccccttctcggggttccctcctgcggccactcggctaggccgtccccgccggggccccccgcccgtggggctgtgtggcaggcgccgagcgctctgcggctttaggggacgccgcatccatccttggcacgctgggttcctcgggcgcccggcatccggcactgcccgcccccgccgcggccctcgtccggggctcccgggagaggccgcccgccgcctcgccgctaatccgc

SEQ ID NO: 14897 - DNA, 1521 bp, Homo sapiens
gagggaccctgatcttatagtcaggggatgaaccctagaccaggggtggtcaggacagagaatttgtaaacattttaggaaacatactagtaaaaggtagatagtttgaagtatacaccaaaaataaagcaaaatccaacattttgtgttaaaatctcagacagccataggttattatttgcatgctcttacaataataactgtaagtgataatgactgttttaaaagtacatgtataggttctttaaccccgtgacctcatgaggttttgctgttagtaggcaagttgtgagctgggatttacacagagctttctgaaggcaaagtcactgtacaggctgccttttatttattcccccccaaaaagtgcctaaatctgtggagagatcgtacattaagttaggaaacagtcttaggactttataggattcaaacacttttggtgtttatttaggagcatttgtggatactttgaaaggtggactctatatacatcaactagttaaaaatcttttaagtagtgaaaatgaagaaaaaatttttgtttcttaattctgattgtcctgtctgtttcctttaaggtactcattcttttttatctagttacagtgatttttgtacatgtcacagatgatgagatttttgggggtgagtggcatttttgtatggtggaaagcagattggaattagtgtcttgatttttgaatcttggctttgttattgattgtgtgtcctgtgggcaagactccacctttctgaaccttgatttactcatttgtgagatatttcatgggtgtttttcaagaaaatatttatgaaatagaagaaattatttaccttcagaatggccttcagtaaatgtcatttgaaaaaatggctaattggaagtgtttcctctataatgctgtatgactgtaggagactaaatagctctggattattaagtcaaatcattttcataacatattgctcaatatattgttttcctctgtaaagcaatatatccctaggtgatgaaatagaacattaaaatttatggctgggcgcggtggctcacgcactttgggaggccgaggcaggcagatcatcacgaggtcaggagatccagaccatcctggctaacacggtgaaaccccgtctctactaaaaaaacaaaaaattagccgggcatggtggcgggcgcctgtagtcccagctactcgggaggctgaggcaggagactgttgtgaacctgggaggcagagcttgcagtgagccaagattgtgccactgcactccagcctgggcgacagagcgagactctgtctcaaaaaaaaaaagaaaaaagaaaaaaaagaacgttaaaatttattacgtaagtggttcccagactcctccagttgacatcagaatcacttgacaatgttaatgatgtgcaagccctttcttattcggtagatctggagtgtggcctattgatttgtattttataaacattctaggtaagtttaaataacttgatcaatattcctaactaccagc

SEQ ID NO: 14898 - DNA, 1070 bp, Homo sapiens
ttgcagttgtcatctttaaaactttacattttgttataattttagatttacagacaagttgcaaagatggagttcctgtatacccttcacccagtgtcctctaatactaaaatgttacataaccatggtttcaaaaaattagaaattaacattagtgcaatgctattaatggactatacactttatttggatttcatcagttgtactttttctgtttcaagatccttcagtccaggccactgtgttgcatttagtatcatctttactatggctttcttcttttcccctcacaggctagaattctgttctttgaggatgtatacaatttgtcaaatgtatcttatgagaaaaatttgcaaaaggttttacatctatgatagatacatttcagatggacaaaagagagggagagtattctgaatatttttgaataacctaatacaggctaaccattaacctatattaggctattttaaaactgaggtattttacatatgacaaatttcgtaaaatgaaataattccaagatgaaaaagactagagctcatttatgacagtatggacacctgtctcttggctctctgtataatgctgtttttactaatttataaattgaggctatgagacaagtacacagccatattataaggtagaatatgactaatgccttgtgtgtcataaagtgctcaggaattggaaggaggatgtaattatttcctagaatgctttatgcagaggatattcatacattcagaaccttcactgtgtgctgggtgctgtggtaggccttatggtgggacctttatgaggttatttgtgctggaatagtgtttccataatcttcccactgggcaaattaatctttgttctggggaaaagattgttccttaaaagaatgtatgttcttggatgtagtgttttgctctgcttaagtattctaatttatctaacacattaagggtttctcagtgagttattttttagcttctgagaatattatttataacattcttggtatgtatctggaatggttaaaagaaatgatataaaaacaaacaattcagaaaacc

SEQ ID NO: 14899 - DNA, 1033 bp, Homo sapiens
ggtgttggtcctgtggatgcacagaagccaagaattgaggtttgggaacccttgcctggatttcagaggatgtatggaagtgcctggatgtctgggcagaagtctgctgcagtggtggagcccttatggaaaacatctgctagggcactgtggaagggaaatgtggggttggacccatcccatgcagagtccccactgggcatggcctaacagagctgtaagaagagggctgctgtcgtccagtccacagaatggtagatccaacagcttgcaccatgtgcctagaaaagccacagacactcagtgcaagcccatgtgccagccaggaggggagctgtaccctgcaaagccacagggatggagctgtccaaggccatgggagcccacgtcttgcatcagtgacctggatgtgagacatggagtcaaaggagatcatttcagagctttaaaatttgactgccctgctggattttggacttgcatggggcctgtagtccctttgttttggccaatttctcccatttggaatgagtgtatttacccattgcctgtatccccattgtacctaggaagtaactaatttgcttttgattttacaggcttataggtggaagtgacttgccttgtctgtgataaaactttgggcttggacttttgagttaatgctggaatgagttaagactttgggggacagttggcagcacgtgattgtgttttgaaatgtgaggatgagagatttgggaggggccagggtgaaatgatggcttggctctgtgtccctacccaaatctcaccttgaattgtgataatccccatgtgtctagagtaggaccagatggagataattgaatgatgggggcatttctgcccttcagttcttgtgataatcagtgagttctcatgagaactgatggttttataaggggcttccccgttcgcttggtattcatttctctctcctgctgccctgtgaagcggtgccttctgccatgattgtaagtttcctgaggcctcctcagccatgtggaactgt

SEQ ID NO: 14900 - DNA, 1062 bp, Homo sapiens
ctctcaaaaacttttcttttttttttaaagaaatttgatcatacctgtattctaaacctgtctggcccataaagacctttttatttttgtctcaagtgatttgaggttaacttttttttttttgaaatggagtatcactgtgtcacccaggctggagtgcggtggcatgatcttggctcactagaacctccacctcccaggttcaagtgattctcctgcctcggcctcccaagtagctgggattacaagtgcccaccactacgcctggctagaggttactcttttaaagccaatttggggtcatgttctcagataactgagattgaatcttgtgaaaacatgtgggatctagagctatagatgtctgggtgatttttctcatgaaattgggataagttgagcctagttgtattacctctgccagtagtgactctaggccttgccttcccagtgagctgttctccaagcctgccacctgtggactcaagttccccatcactgaatcctcctgtgtgatgggccttcagccccacacccaggatgtttggctgacttattttatttaatctgttacttgattctgtcctgtgttcttttattctttttgtttggcaggccacaatttttaagtattttaaatgtttaactattttaaaataaaacccacctggattttgcatgtcttccatatcttacctggttttacagtcacagttctaaggtcattctcatgacagttttaacttccaattttctggaatacgaagaatgtatcctaaaaaacggttgcacagagcccataaagaggcattatatttggatcacaaccttgatttcttcacatatactgtaatgtgatacctttgttctccaattgtatgataaggcttttggcatggactgtatacctgtgctgtccagtgggaatgtaatgcaggcaagccatatatgtaatttaacattttctagtagccacattaaataaaaagaaacacatgaaattaattttaataatgttttatttgaccagtataatctaagtattatttcaacatgtaatca

SEQ ID NO: 14901 - DNA, 1047 bp, Homo sapiens
ttttacattttttatattgaatctttgaaatgcagtgtttattctcactttacatctcagttcaaactagccatatttcagttactcagtagccacatgtagctagtgtcttttgcattgggcattgaagctgctaagttttgcagcttagcgctagtaacatagttgttgctttgtgtgtaaatgtgtttattattttagatacagatttatctaattgaatacgatataaaatattttaaaatgtatttccttattttctttctcttaaaggcccttccttctaccatgattatagtagcagtttattgtcctgtgatagctgctgttttcattgttctgaagatggtcaactatcgactacacagagcacttgatgctggagaagttgtagataggactgcaaatgagttcacggatcagcgaaccaaagctgaacaaggcaactgttcaaccaggagaaaagacagcaatggaccgaggtaaggaaacctatgtcattgattgatcgtaatgatttagattgtgttatctgtataatgatgtgattattatattgtacttgttttctttatatggttttaaggcagtgttagatcttaccactgtagatacaatgatgggtacatattttaatattagaacagagctaagctaactggtgtgtttgggggattaaatcaatattcttggcctcattactagacaggttagaacagtactgttgcgggaagacagggaccccgaacagagggaccagctgaagccatggcagaagaacataaactgtgaggatttcatggacatttgttagttccccaaattaatacttttataatttcttacgcctgtctttactgcagtctctgaacataaattgtgaagatttcatggacatttatcacttcctcaatcagtactcttatagtttcctatgcctgtcctttaatctcttaatcccgtcttcttcttaagctgaggatgtatctcgtctcaggatcctgtgatgattgcgttgtctgtataaattgtttgtagagcatgtgt

SEQ ID NO: 14902 - DNA, 1699 bp, Homo sapiens
aagtgtctactttattcatagtcaaaagtttgtgaccttacagaaattaataggtacccctaatataactcttggaaaatttgtgaacacttgacatacctcaaaacaattctagcaggtagatgctgttattatccctgatttacagatgtggaaaccaagttgagaaagatcaaataatctaagcagttgtttccactgagcataatatgaaatatttcagacatcaagacataaataatgtaagaaaaagtgggcactcctctcttaagacaggtgatatttctgtatattttccagggcattgaaagcctttgtttattccttttcaattacatttttttccttattcttaacatgagtaccctgtttgttaattaaacacgtattttagcctcataatttttgtttattgccttaatcactatctgaaattatcttaacatttatttgcattgatgaacttcttgaaggtaatgaccttattgttcttataaactattatattcccagttccaaaatcagtgtctggcaatgataggtactcagcaaatatttgaagtagtgaaaacgattattctgtgatattatgtttaatgatgcacagtatctcattatgccaatgtattttatcctattttaaattatatcaatcattttgaaatttaaatattagataactgtgatgtttaaattttcaatgattaaatgttctatcatagtttttcagaggtggaattactagaaatgctatgcacatttataagttttccaatatgtattgccaaattcccaagattttaccatttaatgactatgaccagaaattcagctgcctcttttttttgcacttttgacaactcttgagtatttagtattttgaaaaactgtgatatctcattgtttaatattgtttaatatgtaaataaattattgtttaatattcccgtttttgaattactagtgaaatggaggtatttttcttattgccatttatatttgttattctgtgaattgtatatttttctattggtggatttttttttgctattgattttggaactttttttaaataaaatatattagctcttctgtgtcaaatactcttcctcagtttatagcattttatttgtcagtgtctttatatcctgtaatttatttttctgtggtccaattttgtgtgtttgttatttctgcttttgataacgttttctaagattttccttccctcaaattatataaatatacaataaattaagatctttgtatctactttcagtatttttatcattttactttttactcttaaattgttgtcagtttgaaaacattttaacttaatttgtttaggtttgtttatcacaacaccattcattaagtaacaaattttttccctgtaaatttagatgctttctttttcatgtagtatactgtatatacttatgctagtttctgaacttagttttctgcttcatctttctgccttttttcatttataccatactgtttttatcatagtggctttataatatgtttaatacttagcattgtgagtgactccagtattttacttttttgatattattatttttttggggggcgggggttggttggttgtttgttttgagatggagtcttgctctgttgcccagacgagtgcagtggtgcgatctcggctcactgcaacctccacctccca

SEQ ID NO: 14903 - DNA, 1059 bp, Homo sapiens
aaaagagcaagttattttctgctatttgatctattcagataaattcgtattgttttcaccctatagttttttaggttaataattttccctgggaaggaaattcatgttgggtcaagttatgtaatttgcattcctttttaaattccacttgtttttaaagaaatagttttattagtttacattttgaagctttccacattgtttggtttgtagttctgtgagaataattaagtgctctgatagtccatgatacttcctgctagttcagtgcatcttccattattgtaacctttgatacacaaaaactactttagttgatagacattagtactccttgatgtattaatactccttggttatgccaccctacagccttactgttaatataaggtcctcacatgtttctcttaactttgtaggagatacagacactgctaagacttctgatgatatcagtttaagtctgggccaaagttctagtctttgtaaggaaggaagtgaagaacaaggtaagaacgttatactttaccatgatgtcatatactgtggtgaccagagttaatttgtagaatatgctgcatacaatttggcagaagtttataacaatttaatatgatatttaaggaaacattaacataaaatgttatggtgatagtagtaatacagagttacacatgcttttagcttacttgaactcagttatacatgttctgccagataaacatggagagagaaattctatgagcatatgccccagagtgaatatgagatgggagataagaatctgctattcttttagttggtcagaccaactagcccagcttagggataacctagtatgtaaaactgttactttccattcagtacgatctctaaatgccagctgcttcatctcttgccaactgcaaaaacagcaataagttttgacatagtgtcttagtccatgtgcattgctataaagaaatacctgagattgggtgccttgtacttgggtgcttttttggaattacagtaccctatcattgtttctttgcttctgtggactgccctatctaaccc

SEQ ID NO: 14904 - DNA, 1040 bp, Homo sapiens
tgaagttgatgtcccattttgcagatgaggaaacagatttacaggggggtaacccaaagttaccaagttagtaagttggagatagagcttgcatagaaatccaggcctattttaagtatagtcctttgttgctctttctttctttctttcttttttttttttttttttgagacagagtcctgctcttttgcccaggctggagtgcagtggtacgatctcggctcactgcatgctccgcctcctgggttcacaccattctcctgcctcagcctccggagaagctgggactacaggcgctcgccaccacgcccggctaatttttttgtatttttagtagagacggagtttcacagtgttagccaggatggtcttgatctcctgaccttgtgatccacccaccttggcctcccaaagtgctgggattacaagcgtgagccactgcgcccggcccctttgtttcctcttaattttattgttgatagtctatacaactctttctgaggccagttgaagaactcaaagatttggaagttcagttcatttcgtgagtagaatgctttctttgtgcagctgtgaaacagaaagcagctctttggagaactacttgagaaattatttatacttgatttactgtatgcagtgaattctttccattgttaaacagtagaaaagcagatcatacatttattttaacatttcaaaatatgtgtttgaaacagatttggcagctgatcggaagctctttcgtcttgtctccaatgactccttcatctctattcagccttccttatcctcttgtggacaggacttgccaagggacttcagtgacaaagtgaacctgccaagtcataaccaccaccaccatgttgatcagtctctgtccagcgcctgtgacacagaagtagcttctcttgtacctttacactcacactcttatagaaaagaccaccggccgcgaggtgtaccacggacttctagctctgctgtggcttttccagacacttcactgaatgattttcccctttatcagcaaagacgtg

SEQ ID NO: 14905 - DNA, 1001 bp, Homo sapiens
ctaggaatagcttgccaaaccaggttgcatttcctgaaggggaagagcaagatgcagtcagtggaggtaagtaaactgtaagaagagatttctgtaagactcactgctttttcatactattaattagagtagtacttactaaaatatgcttctgttaatattcccccttccactgtgttattaaaataagctttcttgaatgaagaagtaggtgattatcttagaaaaggttttggtatgaacaccaagaacatattttttggttgcaatacttgaatacgtcaatttgttcttgatggtgtcaagaacaccagtttctaagccagttgccacctgttaatgttttgctgggaataacaaaaattagccctcttcctttgtatagcaatagcaacaataaaatatataattatttaagggcaccaaaccagttttaatcaactcttatacagtatatgacactgaactttcaaaattagatcactcagcctattatataagagttttacaaatattactttagatctgattatgtacattgagaattgtggctctttttttaagtctgtatctttggttttatttcttgcttactcaagttttaggcgttacgaaaatactatttttttctataatttcacacattattcttaaagtttattaaattcagatttgtagtttatattgacatttggtatccattaattgatgtaagatgcccccataataacagtgatggtgttctggttaaagtaatagcttatttatttcaggtttttggagaattgtgcaaatttggataggtgattttatattctgtcagtgtgtgttggcctctttatttcagagttatttcttgctgtgttcttctgcccaagatagtttgtttatttggttctggtttttatggaatctgcttcttgaatagaatcagaaaaatcaggtcttttgttgttagtaccttagcatttttagcctctacccctattccctttatttat

SEQ ID NO: 14906 - DNA, 1048 bp, Homo sapiens
attgctgttctgaatattgtggaaatgtaaatactgaaaaaatgtgtacaaaaatatgtagtaaattcatgcgtttatatttaaaatgtcatttccttttcatggggactgtgaggtgttctgttttttaggaaaagttacctgaaaggtgttatttgcttctcggtgctgttctttaagctatattagcccttgtttttctaggctctagcttttgttttcttttgtttgtactgcttttttttaatttaaataactcaattaaatgttaataagagataatgaaataaaaatatctgctttggtggaagaaatgtaatagtctgtgggctgtttaaaaacatttttttgcctggggcaggcattgcacaggcttttttaatttgagcttcattgggtttagaatacaaataagagcaaaactaaagcacttaaatgtgttgggggttttttaattggtttttatcataactaaatataggggttttgttgggagtttacttgggctttttgaaaggttggaggtggtagaaggggatttgttttggttcttattatttaaaaattacagagactctcaaatactgtttaaagatacttgtttatgttaacattatctgttacagtcctgtctgacaatttagaagaaatgtttctgggctatccttccttacatactgtactactgaaacctgtcaaccatcatgttactgcttggccattcatatacctatgcataaaccataggtagattttatcctaaagaatatgaaggtgtcgataagttctccaacgatttcttttcattttattttaaggtaggtggtggtggtagtgtagagagatggaatttaggaaatagactttaaagtactaaaataaagtatgctaaaataggaggtaatctagtttagtgacatggagtcagatacctttgttagtatgtgggctccactgttgtgactctaggaaagctacttacaaacctcagcttcctcatcttaaaatgagatgattatagtatctatctcatagggttgttgtgagg

SEQ ID NO: 14907 - DNA, 1062 bp, Homo sapiens
caattgttcatctgatttttcatttcttccctcaattggcttgttttcttctctgctttgtttcatccttcatccattgattgcccttccctaatacatgttttctcctttgtggcaatgctgattgcattttcatttcattgaagtcatggttgtcaggaattggcaaagtatgtaatgtgccttgtagctgtggtcacaaaaaggcaaccttatctttctagataagcactgttcaatataactttgtgtgatgatggaaatgttctatatctgcactgtccagtaatggtaaccactagctacatgtagcaacggagcacttgaagtatgattcatcaatctcaggaactgaatttttatttttatttaattttaatttaagtttaaatagccacatatggctaatggctactgcattggacaacagttgtagatgaccggatttaatcagcatcttttgctgtcataggccatatataatttttgtatacatggacttttaccccacaagtaaaggaatttaaaggaagtttcatgtttggaaagaatgtttctgtgctaacttgtgtttttattcatatttagcatcaaaatgccctttctcaaaagcaaaatgattcccaaattatttagatcacacagttgttttgttttatatttaaatggatgaaaatcattttacattttgctttagaaacccaaatcggtcaatttttgtggttttgtaagatctgtgtagttctactaagccattgttgtgatgttctcatgttgtatgcttggctttagtacaaactaaaaaaagtacaaacaataaagtacaaacatttttgcttgtttgtactttattttttgtagattaagctatgagttcctgtgcttgccaatttgccaatatttgcttcctaaagttgagaggaccagagccaggggcatggagttgaataaagtttgatggtaatgaagtacctttagagtaaaatatattcatgctatgttgaattaacacactggttttgcagcttcacaaccagaggtttcatttaatgctgccaaaat

SEQ ID NO: 14908 - DNA, 1044 bp, Homo sapiens
tttgagatttcatcatactgcttgcatgtgtgagtagtttgttctttcttactgctgagaattccattgtatgagcaggctgtatattgcttatctgttcacctggcgatggttgtgttgtttcccgtttttggctgttgtgaataaaatttctgaactgtctttttgaaaagagttctacatccccaccaccaaattccagtagttccctttcttgccaacatttgcttttgttggcctttagaattgtagacataatgggtatagaatggtaactcattgtggtttaaatttgaatttctcttatgactaaagatagtaagcatcttttgatgtgcttattggccacatacatatatatcttcttttgtgaagtgtgtccagaaatttactcattttaaaaatcgggttgttggttgtcttcttttttttttttttttttttgagacagagtctcactcttgttgtccagcctggagtgcagtgatgcaatctcagctctctgctacctctgcctcctgggttcaagcgattctcctacctcagccccgcaagtagctgggattacaggtgcgtgccaccgtgcccagctatttttttatttttgtatttttagtagagacggggttttgccatgttggtcagactggtctcgaactcctgacgtcaggtgatctgcccgcctcggccccccaaagcgctgggattacgggcatgagccactgcgcccagcctgggttgttggtcttctaactgttgaggtatgagttcttttgatattttaaatacaacttatttgtcagatacaaattacaaatattttctcccattctgtggcttgtctttttgtttacctgaccagtcttaatgtcatcaatgtcgttattatagattattttacccaagtaagaagaacttgtctttttgaaataaaatgtgagtggataatgaaatcacagcaaaatatgaacttgtacattcacttttggaaagttcagctgatttggggattagcaagcaggagtggagtttttaacaattaat

SEQ ID NO: 14909 - DNA, 1044 bp, Homo sapiens
ctactgtccaacgttccttttcaactcacatcttgctgaattacatgcagatcattgttttaaaaaaattttttttaaaggttatggtgtattttcttaagatgtagaaacttacgaaatttagtatatcatgaaggaaaaattctgagtattctaatggctttttaaaataatcatttatttgctaggtaagttctcttctacgctgtatgagactggtggctgtgatatgtcacttgtgaattttgaaccagcagcaagaagagcatccaatatctggtatgtgtgaagtcatattaggagtgtgtgtactttcatatgtttgccatatttaatgtttttaagcctagaactataaaagttaatttttttgttttttataatttaatgttgttaattgacaaataaaaatcataaatatttatggcatacaacctgatgttttgaaatatcatatacattggcttaattgagctaaaattaacatgtattatctcacatacttataatcttgtttgcggtgaggacacttaaatctactctcttagtgattttcaagtatacagtatgttgttaattgtagtcaccaggtcagatataaaagttattttgaaaacatctttatatttactctaataatttgtcatagtgcatttgtttctaaaaacttaaggtagaattttttttgctatggaaaaaagaaagtattgtttttaaaacaaaagctattctgtgttttaaaaactaaatcaagatatcccgaagatcttacagtggcacagtgttttcccacagtgtcaaatttaattgtatttcattttctctatatattgtataatgtataaaagctaatcaggacttactcttcatgtaagttcttacataactaagttcaaacctattggttctctttctttatgtaattttaaaattttatttccttctaagtgtttggtcaagtacctttttaaataatcaactttcattttgtttaaaatttcttttactggctttaaggaagtatttcttaaaatatgtctcata

SEQ ID NO: 14910 - DNA, 1038 bp, Homo sapiens
caatgataagagactgtgggaagaaatgagagttgctgccatcagatccaatgcagtggggctcagatttaacactgataatgaggttcaaagcttaaggagaaaagactataaatgtgagaagagaagccactaacgattcacagtaagtggttttagtagattcgctagctatacagttataaaatcttaaggttttttcttaagcattccctgagaaaaatcttaagattttagacacttttctagtcaattatttacaataggtttattgattaattaactttgttttagttcacttcctattgtcaccttctatagtttctggtaatcataacatattcataaagagtaggctgggcgcagtggctcctgcctgtaatcccagcactttgagaggccgaggcgggtggatcacgaggtcaagagttcaagaccagcctggccaagatggtaaaatcccgtctctacaaaaaatagaaaaagaattagccgggcatggtggcaggtgcctgtaatcccagctgcttgggaggctgaggcagagaattgcttgaaccggggaggcagaggttgcagtgagccgagattgcaccactgtacttcagacaagactctgtctcaaaaaaaaaaaaaaaaaaaagtgtatgagagaagaaaattaaagggcttagataactgataagctaattgagtaactgttgaattatgaagatattttattttgaataaacatattaaataaatattgaagatattttaagcctttcaatgctgactttcttttagctctctctcccacagattcgattgaatagactattgaccattgatacagatttgttggagcaacaggacattgatctaagccctgacttggcagctacttacggcccaacagaagaagctgcccaaaaggttaaacactattatcgcttttggatcctaccccagctgtggattggcattaactttgacagactcacacttttggccctgtttgataggtgagattatagtgtgatattaatgatacgt

SEQ ID NO: 14911 - DNA, 1052 bp, Homo sapiens
ggagacatttatggttcatattttatggtgccttgtgtagaatactcaggaagatatttaaaagtggggaataattacccctagcaggagcactacttcacacccacctaacaagtaataaaaccaagacctgaagggatcaaactgtttccaagtaacataaagtctaagaagatttatggaaatccagaaatacccagcacccaacaagttaagattcacaatgtctagcattcagtcaaagatgaccaagtgtgcaaagaagtgagaaaacgacctctaacaagaataatcagttgagaccaaactgtagcttaaatagatactagaattagcagacaaggacattaaaacagttataactgctttccctatgtttaaaaagttaactacggacatagaagatacttttaaaagtcccaaatcaaacttagagagttgaaaactataatccctgagacgaaaaatatactggatgggattaatggtagattgcaccttgtagaagaaaagattattgaactcactcgaaggcataataatggaaactatccagaatgaaacagaagagtccactgtccccagtgaaaagaatataaaaacaaaatgagagaaagctgtgggacaactacaagaggaaacaaggagacaaaagattttgaagaaataaggagacaaaagattttgaagaaataagagtggagaactttccaaatttgatgaaaactgtgaatatacattcaggaagcccagtgaacctcaagcataaaatgcttgaataaaactacaccaagggacacaactgctcaaaaccagtgataaaattgttaaaattgcaaaagaaaaaaagaggagcaaggataaggaagacatcctttttattgttggaaataacgaagtgaaaagacagtagaggagcatctttaaagtactgaaaagaaaaaaaccctgtcaacctacaattctatacatagcaaaaataccttttaaaaaccaaagtgaaataaagacatcttcagatcagaaaaaaatgggaagaattcttatgagca

SEQ ID NO: 14912 - DNA, 1639 bp, Homo sapiens
cattattgggttagaagatctggatgagccttatgaactttcctttaaaagattgtcaacaagttgtaaacataaaaatttaaaaatttttgtagacagctttcagctcctcatgcatacttgtggtttatttttgttttttgtttggcgactagtgcaagacaatcagagaatggtagggttgaaaggactatgacaagtgactcacagatccttccttgcctcatttaagtagcatttatagagcatttatgtgtaccaggtactatgctaaaccattttctgctttgaaggagcttgtagattagctatgattaacaagtcagccagcatgttcaagacagtgtaacgaaggttatgaaaacagttctgtgggtgtacaaattaagactactttattctgccaaaagggattaaagacaattttccaggaaggtgatataaccagattttgaagatcaaataggcattagctaattgaaacaagaaatgaagacccatggacttgtaaagaaaatgtgttgtgtagaggaaatggcaaatgattaggaatttctggaggtttgggtacatgaggaaagatgacatctaaggtcattcctctaaggctagaaaggtaagcaaaggctggatcatttagttttaatttcttcttacccacattgtatgactatatcacagtttacctgctgtgttagagatgctcatttgagatgtttctagttgaggaatattatgaataagcctgctgtgaatatcatcttgcaagtctttttgtggacatgtgtattcatttctcttgggtaaatacctagaaatggaattaacagttttccaaagtcgttgtgctggacatcttttggtttttttagttttaatttttatcagagttgtacattcatatatcacagtgtcaaatagttttacaagacttatagcaagaacagcaatctcctaacctgttttaccttcctcagacttactatttttaactgattctttttggcatttacctgtatagatctacctttcatttctgcttcttacattttctgacagcttcagcagaacctgtggactgccctttatgaaagttggaggcttgacttcctttctttctttttttttagaagcttgtttagaatgcatgtggtccatttattcctcagagtattctagtttacgtgcctagattaggttaaaccatccgagagctgcatgtttggaccaggctgtctggccacctctagggtttccttgcccacgtttcccttcagcattatgcctgccatttgcacggaggcaccttccaagggtgtgtgtaagaaaacagcggtccctttatcatggggctgtaatgttgatgtccttcaatgctttgtttagtgtcccttctgtaaagactcaatcaagatgtttcttttaaatcttgatgacagccagttcttgtttgttttcctaagaaatctagaatgcattttggttttggctttttgttttttccccatataaccagtgttatttttaaaatttcccttggccattaagcagctcaaagccaaattccctgcttacgtccaggaatttatggcttttgtctcccatatcccttccctcatcatcataaatgaggtcctga

SEQ ID NO: 14913 - DNA, 1110 bp, Homo sapiens
tattggatgacataaatgtctgctaggtccatttgttctgtagtgcagactaagtctgatatttctttgttgattttctgtctaggtgatctgtacaatgttgaaatcgaggtgttgatgttcccaactattactctattggggtctatctcattagctttaataatatttgccttatgtatctgggtgctctggtgtagggtgcatgtatgtttataattgttatacccttttctgaattgatccctttattattatataacgaccttctttgtctcttttcatgtcttttgacttgcagtttattttgtctgatacaagtatagctccgccagcatgcttttggtttctgtatgcctggaatatatttttaaatttcttccctttcaatctatgtgtgtgtttacaggtgaagttagtttcctgtaggcagcatataattggctgtttttaaaaaaaaaaaaatttaagcagagtgtatttttatttatttatttttgttgacatcaggatacacatctggacagtctatatcttttaactggggaatttaagccatttacattcagggttttttgctaggtggaggcatactcccatcattttgttcattgttttctgaatgttttacatatcctttgttcctttcttcctcttttattgtttactcttcaatttgattggttttttgtagtaataacatttgacttaaaaaaatcatttgtttatcttctttatcaatgtttttatcctttcctgtgttttcatgatggtgatatcatccttctgcttctaattataggactcaataatttcttgtagagccagcctagtggtaataaattccttagtctttgctttttggtaaagatgttatttctccttcatttttgaaggataaagcttttcttggtatagtatttttagctgaagagtttttttctttcagcacttcgaatgtgtcacctcagtgtcttctggcttgtgaggtttctactgagaaattagatgttagtctaatgggggtttccttgtatgtaacttaaccctttttctcttgctgttttcagaattctctttttgtctttgacttttgacagtttgactata

SEQ ID NO: 14914 - DNA, 1032 bp, Homo sapiens
gctctcatgagggatgagtatactcttgctcacatgttgatgtgatctttggttacttccttttctttatagtgtgatcccctgtctcacctacccgtctgccaaatattaatcaaaagtgtcattattttgccaggcagatatttggatctgctgagcattttatctactttccaagacagactccattcagccaatttattatttttaaattttatttgtctatcctggatgcttacttttaagtaatattgaaacaagtttcttgatcagtttttatagctcttagttaaacccattcatatttctcatttccatttttattttacagatactctagattctttccatgtaaactttatgtgaaaaatttgggttatcagtcattttttgtctatatcagaattttctgattacactttctttcatgttaattttttactgataagtgtaaactgtaccaggtacagttttagaagtcaaactttacacatcaacagtatgttcggctgactggattcctttccatttttactcaggttaaacatgccttattttcatgattgtttgttttatttagttttatcagtaatattcactatgaagtgactggaagatttaggtaatccagggaacagttggtaatagttcctcatagaatccctattaattaatattaataattgaaaacagaatatctcctagtaatacattttgctcagaaaaaaaatcttttttcaattattaatattgctataattattgacttcattttctgagcaaaatatattagtagggcatattgggtggaaatagtcatgggattagaatggtagagtaaaaacattctgctttaattcaggtatcccattctccttattctgctgctataaacaaggacctcagttgggtaaatgtccaaacttttacatttcctcttgccatgtatgatttctgtccaccactaacagtgatctgcacaaaatacagctcttgtgttatttcgtcatttaaaaatctttgataaacttc

SEQ ID NO: 14915 - DNA, 1028 bp, Homo sapiens
tggtaaatgagcatttcaacttaaacttagcagctccgttagaccctatcaaagagagtcagcctgtcctttgaagatttgaagccaggcattgactcctctctagctgtgaaagtcctagatggcatcttctttccgtgtaaggatgtttagtctattttgaaaatctgttgttgtagtgtagccaccttcatcagtgatcttagctagatcttctggataatttgctgcagctttaacgtcagcacttgcagcttcaccttgcagttttatgttatgaagacagcttctttccttaaacctcatgacccaatctctactagcttccaacttttcttctgcagcttgcttgcttctcagccttcaaagaattgtagagagttagagctttgctctggatcaggctttggcttaagggaatgttatagttggtttgatcttctctccagaccactcaaacattctccatatcagcaataaggcttttttgctttcttatcttttgtttgttcactggagtagcacttttaattttcttcaagaatgtttcctttgcattcacaacttggctatttggtgcatgaggcctaacttttggcccatcctggtgatacggtttggatttgtgtccctgcccaaatctcatgttgaattgtaatacccagtgttggaggaggggtttggtgggatgtgattagatcatgggggtagattttccccttgctgttctcatgatagtgagtcctcatgtgatctggttgttcaaaagtgtatagcgcctcccccttaaccctattccttctgctccagcatgtaaaatgtgcttgcttctccttcaccttacaccgtgattatgtttcctgaggcctacccagccacacttcctgtacagtctgcagaactgtgagccagttaaacctcttttcattacaaattaccctgtctcaggtagttctttacagcaacacaagaatggactaatgcatttggcttttgacatgccttcctcactaagcttccttatttct

SEQ ID NO: 14916 - DNA, 1527 bp, Homo sapiens
tagagtaagacagccatcatatcagcctctttttactccatcaataagaacaggagcatcttgtacttcctttctgagcagtggcctttgagcttttatactagatgtgcagtatatactgagcagagtagtatatcttaaaagaagggatagtgagttggataaaataacctcacaaaaggttcagaagaccagcagacagtggctagaagtagaggacctcaaagctaaacttctttcttccaaacatataataaatagttttattttttcataaataaaatacacttaaaatacttcgcgtactgttctcaaatccttgaactgacttttgttggggagagtaatgggaacagtcatgttattctatatctcttctttggcttagatgatattggctattttgttatgagttaatcatgatgttttgggctaggagttcacagtctacccactcaggaacagggttccatcctaccttaaggacctttctcttagagattattgctgaagtcatgaacatggctcaaggaagtcctcctgattggtaataaatcatatattcaaaaggtttacctctaaacttgggtatccccagtctcatcaggtagcttatttcactaatcctggtctgttttgttttctactcttacaatctgtttagaaaaaaattatcagttgtatttttccagctatatagtcttcccatctgctctagtttctcttttaagttgaacaagattatcttcatctccttaagatcttgcatgctattccctgaatcaacattcccagaataaccttttcctggggacattaatcaggccagacttgctgactccaaactgtagtgccctcatctgaatgtttaaaagctgcctcagacccttcttccatagtttcctttcaagatagtgtaagattgatcctgaactaactgcattaaaattaccttcaatgggaaaatgaaaagattcatctcagcttctttctcctacttttcaaacgataagtatttctttcactttgttgttagtattagcaagaattcttggtgagaatttctaatgcaatttagggactagggcacacgccttctccaccagtaacaaaatagtgctaccaggcttgaactaatttttttctttcagcaaattaaagatgttgctatactgtcttctggcttgcattgtttctgatgagaagtctgctgtcattcttttctttgttcctctgaaaaaaatggtaggtacaatataatatcttttttcactggctgcttttaagattttctctttattactggttttaagcaatttaaatatgatgtgccttagtgtagttttctcatgtttcttttttaattattattatactttaagttctgggatacatgtgcagaacatgcaggtttgtggcatgggtatacacatgccatggtggcttgctgtacccatcaacctgtcatctacattaggtatttctcctaagctatgcctcccatagccccctacaccccgacaggcc

SEQ ID NO: 14917 - DNA, 1050 bp, Homo sapiens
tcatccttttttatggctgcatagtattccatgttgtatatgtgtcacattttatctagtctatcactgatgggcatttggattggttccaagtctttgctattgtgaacagtgctgcaataaatatacatgtgcatgtgtctttatagtagaatgatttataatcctttgtgtgtatacccaaaatgggattgctgggtcaaatggcatttctggttctagatccttggggaatcgccactctatcttccacaatggttgaactaatttacactcctaccaacagtgtaaaagcattcctatttcttcacatcctctccagcacctgactttttaatgatcgcctgactttgtaacttttttttgtttcctgactttttaatgatcgccattctaacgggagtgagatggtatctcattgtggttttgatttgcatttctctaatgaccattgatgatgaactttttttcatatgtttgttagccacataaatgtcttcttttgagaagtgtctgttcatatccttgacctacttttggatcgggtttttttttcttgtaaatttaaattccttgtagattctggatattagccctttgtcagatgggtagattgcagaaattttctcccattctgtaggttgcctgttcactctgataatagtttcttttgctgtacagaagctttttagtttaattagatcccatttgtcaattttggcttttgttgccattgcttttggtgttttagtcatgaagtctttgcctatgcctatgtcctgaatggtattgcctaggttttcttctagagtttttatggatttaggtcttacatttaagtctttaatccgtcttgagttaatttttgtataaggtgtaaggaaggggtccagtttcagttttctgcatatgggtagccagttttcccagcaccatttattaaatagggaatcctttccccattgtcttgtttttgtcaggtttgtcaaagatcagatggttgtagatgagtggcattatttctgaggcctctgttctgttccattgatc

SEQ ID NO: 14918 - DNA, 1009 bp, Homo sapiens
ggtatcaagatgatgctggtctcataaaatgattagggaggagtccctctttttctgttgtttggaatagtttcagaaggaatggtaccagctcttcttcgtacctctggtagaattcagctgtcagtccgtctgatcccgggctttttttggttggtaggctattaattactgcctcaatttcagaacttgttattgatctattcagggattcgacttcttcttggtttatacttgggagggtgtgtgtgtccagaaatctatccatttcttctagacctagtttatttgcgtagaggtgtttatagtattctctgatggtagtttgtatttctgtgggatcagtggtgatatcccctttatcatttttactgtgtctatttgattcttctctcttttcttctttattaatctaactagcagtctatttgttgatcttttcaaaaaaccagctcctggattcattttttgaagggttttgttgtatctctatctccttcagttctgctctgatcttagttatttcttgtcttctgctaccttttgaatttgtttgctcttgcttttctagttcttttaattgcgatgttagggtgttgattttagatctttcccactttttttctgtgggcatttagtgctataaatttctctctaaacactgttttagctgtgtctcagagattctggtatgttgtgtctttgttctcattggtttcaaagcacttatttatttctgccttgatttcattatttacccaatagtcattcaggggcaggtttttcagtttccgtgttgttgtgcggttttgagtgattttcttaatcctgagttctaatttgattgcactgtggtctgagagaccgtttgttttgatatctgttctcttgcatttgctgaggagtgttttacttccaattatgtggtcagttttagaataagtgcaatgtggtgctgagaagaatgtatattctgttgatttggggtggagagttctgtagacatcta

SEQ ID NO: 14919 - DNA, 1059 bp, Homo sapiens
tgtgggttaagcctaacatcaatgtcagttgtgggtcagttttgattgagtggttaattgattgttattatgggtcctattttcctgctacttgcatgcctgtcaattttttattagatgccagtctttatgaattttactctgaagggtgctggatatttctgtattcctgtaaataattcttgaactttgttttgtgacacagttaaattctttggggacagtttgatcctttcagggcttgctttggagggaccagagcagctgttagtctggggctaattcttccccatgaccaagacaatgccatcctgagtgttctagccagtcccaaggtttttcgctgttcctttgtattccattcggatgattcttttctcagcctagggtcctctttgcgtgtgtgctgttgccgtagatctccgagttccctcgcctccctctctcagtagctctctctagcactctgccctgtgagctccagctggctcagaggcctctgtctcaatttgtgctcccctttcttgtgctgtggtctggaaactctctaggtaataagctcagtcagttgtagggctacctcatttgtttcctgtctctcagggaccggtgtccagtgtctaaaaactgttgtgtcatgtattctgcccagtctttggctgtttcagctaggggggtaaatatggtctctattgaatcatcttggctgaggtaaatctgaattaaaaaaaaaaatttctcatcacagaaacaatacatttttagtctagaaagttgacaggggaagggaggtagagaaaaagaaaaaaagaatgaagatcacccgtcattttatcacccgttgtaactacctttagtattttttctttatacaacttcaagtctacacccactctcttttatttttcttttgtatttctttaaactagtgctctcatactctttatttactgttttgtaacctggacccaaattttttttcaaaatgcctacttgatgaaactagagtacgtgctgtaagaggtaatatgtctttagaaacaatctaattggcaagca

SEQ ID NO: 14920 - DNA, 1033 bp, Homo sapiens
acaaacagtagatcagtggttacttgaagtttagagagtaaatgccagaggcaggaaggaactttttgaggtgatggaaatgctctatatctagattgcagtagtggttacctgggtatgcacatttgtcaagatgcatctaactgtacacttaaaatgggtgcattttgttgtaaatcatatttcaaacttgacttttaagaagattctgtttccagagagctgaaaatataaaatttctattaacctttgcctttcagacatagtctttgatgatgtacttttagtacttcataggtgtttttgaacttttttctttatagttctttccccaccccctccaaccttatggattacatgtgcttactttttggtaattaaaactgttacgttggacgtgatgcctcacgcctgtaatcccagcaccgttgggaggccaaggtgggaggatctctagagtccaggagtttgagacctgcctggtcaacatagtaggactgcatctctgcgaaaaagaaacagaaatattagccaggcaaggtatcgcatgcctttagtcccagctacttgggaagctgagacgggggatcatttgagtccaagagtttgaggttacagtgagctatgattgcatcactgcactccagcctgagcgacagaccaagaccttgtctctaaaaaaaaccccaataagaaactgttatgatctgtgcagtatttactattgcatattgtcctacatgtacacagtactttcatatgcattagatcaccacgacccagaaagttattttaatcccaattttgtagaagattaaccaaaactcagatgaagcaaattgcttttttcatctgttctcttgtcctctatttaattgcttttgtaaaatatctttcctccttatttattttcctttattagtactctttgaggattacatagttattagaactaaaataaaccaatcaaaatccaaatgagtttacatatgatatgtgctgaaaattttacagtctgtgatatccttgagga

SEQ ID NO: 14921 - DNA, 1006 bp, Homo sapiens
atatatttttctcaaaacaagttgaattttgttaacatatataattctttagtgaatttataaattaggaaccctgagaagaagccctgttgtttttcttaagagtctaaaactgacaatcttttaaaaatcataatacttttctagtaattgcatcagggaattggtgataattgaagaaagatccatttcttaagaataatttgatctaaattattatatggaaataaacatacttgtgttaactaaattgatcataaattcttgttcctgcctcacccctcaccccccagagaatagtgagtgactcgtttagattctctgctttttttcagttatgtacaagacttcagcatacattaatgtctttagtttataaatttgccaatgctttaatttccataatttgaaagttaaaagatgtaactaaaatactagcttttttattcatttccttttggtggagttgtatgattgaaaactttgctttttcttgtttaattcttccgccaccccctcttttgagagaaaggtaatcgtggaatgagttataaattattgcctttttttcctttatttctttcattcagtggcaaaaaacattttataactcctaagtttttggttaatcttccaacttataccttggtgtgaactctctttttacaccattttcaacactggataaaactttaatgttgactttttgctaaagaactttaatttttccaagaatctagattaacataagatgttgatatttaaggaacttggaagagtaagtggtgaggctgtatgtatattttttaagagattaccttttaggaaattagtgaacaaacttaaccagtgttctgccttctttgactttgttactggaggatgataatctatttctattagattcgaagtattttggaaaatatttcaagtatatctgaactacttataattcttaaaacagaagtagtcagacaatatttgtatcctaagtgagatatggaaa

SEQ ID NO: 14922 - DNA, 1030 bp, Homo sapiens
gtatttgaatggtgaccatatgaatttttgtttgcataggtgggtctctaaggagtaatttattcacttttcctgtaagtgtttattgaatcccattatatgccagggactggtggctgctgctggtaaacaggatacatggttcctgtccttgtatagctgatactcttctagtgacttatgtggcccttgtcaatgttctgttcctctcctctagttggatttttcttttagtcaaaggccacctgttttggtgcaaaaacaattgcagttgtttatggtcctatattaaatattatttatatatatagagagaaataaacagtcaactgcattttggtttccaaggagatatatcttggcaaaatttattttatcaagtgcttttctaagaaagagtaccaaaggaaactggctgtaatgccttttggttaagattttcctgaggacccagatagggtttttaaatcttggtttcttctactcccacacccaccccaaaagaatctggaaagctagttatgactagtcctgggtttgatattgattgctggagctttgaagagtcatataacccttctgcatcttcattcattcattcatttcttcattcacttaataagtcttcattgtttacctgttatgtatcaaataatccttgtaaaagggagaaaattgagggttgaattcagttttctttaagacctactgtaaaaattctataaatttattactatgatttagtaagatttaggcctttttatagatagtagaaatatttttgaaagaactgaagaaagaaatttagagtatttgtttttaactctaaaatattttagtgagaaaattctataatggtggataattttagtgttagttcattctgagctgaaaccaatcaacatttaaactcagctcagagtttttctttttaattttggtagtagacagttctgaatctaacctttctgttgttacaggtagcaccctggaaacttaatgcctgtttcagatgattggtataatgtgt

SEQ ID NO: 14923 - DNA, 1036 bp, Homo sapiens
atgtaccatattttctttatccaacccactgttgatgaacacctcctttgattccatgtctttgctgttgtgaatagtgttgtgaggaacgtgtgagtgtatgtgtcttttcagtagaatgacttgctcttctcttctttttttttggagacagggtctcactttgttgcccaggctggagtgcagtggtatcatctctgcttactgcaacctctgcctcctgggttaaagtgattctcccatttcagcctcccgagtagctagaactgttgttgtgccccaccatacctggctaatttttatattttttgtagagatggggttttgccttgttgcccaggctggtctcaaattcctggattcaaatgatccacctgcatttttgggggccattttttgtcccccaaagtgctgggattagagatgtgagccaccgtacctggcctgttttcctttgggtatatacctagtagtgggattgctgggttgaatgtagctctgttttaagctctttgagaaatctccaaactgctttccacagtggctgaactaatatacattcccaccaacagtgtataagagtcccctagaaatatacagatttttaaagagatgttgatggaagtgaagttaattgaaaataccgaaaatacaagtgtaagttcagtcttggcttttccaagtattcatctaggaagcatgttcagttgatcagacagaaatgaaattgctggtaaagttcttgtagttaacttagattatgatgggaaaggagtactttttttatacctgaacttttctattgagttttggactgtgtatgttttttgaatccagtatacccactttaaaccttacgtacagctcatttctccaaaccaaatatttgagatttctctttcatgtttataaatcctcaagatttttgctttggtttattagataaggatttttggtggtataataactaggttgggtggttttatcttaatctctcgtttgctttaatatttagttttatttaatctcctaagaa

SEQ ID NO: 14924 - DNA, 1041 bp, Homo sapiens
ccagtgcctgacatatagtagatgtccaatagatgttggacccagggcttcttacaagccctcccaacttttcaggtttttaaaaatttctctatctgtctgtctgtctgtctgtctatcgagagagatggggtctcagtctgttgcccaggctggaatgctgtggtgtaatcttggctcactgcaaccgctgcctcctgggctcaagtgatcctctcacttcagcttcctgagttgctgggactgtaggtgtgcgccactatgcccagctaattttttgtattttttggtagagacggacggggttttgccacgttacacaggctgctctccaactgctgagctcaagtgatccgccagcttcagtctcccaaactgctaggaggtgtcgtgagccactgtgcctggcatgccaacttttcaattttttctagtgtctttctcttggattttgaaggaccttaatggaaagatatatttcatttgaattatcatggtggattcttggatttgtaaaataaatgtcatctgcactgcacaggaaaattccatctcatcagtagttttctttgaaaggtcatcctgaacattttcccctgggtgtctggggaaggctaagggtaggaaggctaagagcccaggtgggagtgggggagaaggagagcaggaggagtcaatttgggtattttcctggcgtagtttgctacctacccaccttagtaaggactgtactatggccatgtgtgactgggattgtaatggagcagaggttaagagggcactgtgtgggagacgggtactatgtggaagatatttggttctccgtgcatactcatgctctttcatgcacttattcagtcatcagacagttgttgacgctttcctatatgcagtgcactgtgccagtcctttgggattcaaaggatgtcctcacctctgtaggattaagccaagttgatagacaagtaacagaaagttacagctcagttttaagtgccaagttagagggaagctgggggagctttgccaaagcatattaaa

SEQ ID NO: 14925 - DNA, 1052 bp, Homo sapiens
ttttgtgactggcttctaataatgttttcagggtttgtacatgttgtagcatatatcatactttatttctttgtcttgtcaagtaatattctattctaataacattttgtttttttctgttcatcagttgatggacacttgggtttttctactttttggctattaagaataatgttgctttgcaggtgtaagttttaacgtgcacatatgtttccattttttcttggatatatacctaggagttgaattgttgacttatatagtaactctatgcttagtaactctaaacaatccgggcttttgaggaactgccggactgttttccaaagtggctgtaccattttccatttccacgagcagtgtattaaggtcccagtttctccacatctttgccaacacttgttactgtatggcttttctttttatttttgctgtcataataggtgtgaatgacttttatttccttaatgactaatgatggtgagcatctttttatgtgtttgctggccatttgtagatctttggagaaatgtctgtttacattttttgcccattttaaagttaaggtttttgtctttttttgttgagttgtaaatattccttatgtattttagatacagatcttttattagatttgcaaaatgtttcactctgtgggttgtctttctattcaggaggccagactttaagtggaatacaaaagagaaaagggcatgtagtaagcatgaaaacaaaagaataggccgaactgctacaaatattttagacagagtatacctagggtgacctgtggcttgcaggaaaaaaatttgaaattaccacagtgatttaaaaaaatttttggaagtataatccacatcaagtatgcaaactgtaaaggtacagcttgataaatgatcacaaaatgcatacacacatgtaaccaccatgcagggtcaacacagagactattaccagcccccacaaaagccatcttctgcacctttgcaatcattagccctcctgcaccccaaagataacagctcttttgatttctgtcaccattgattagt

SEQ ID NO: 14926 - DNA, 1048 bp, Homo sapiens
tttgccaaatcataaatggtaccttgtgtctgtgacatcacagtttagtttctatgttatttatatttgtatatcttgtttttaaatagtaataatttaacataagcagaaatagtccaggctctgcagtatctattctatagaaagtacttataataaaagtgatatacattaatactataatataaaggcaaatactaaatgaatttaataataagagtggtattttggagtgaaaaaggccactaaatgggggaagttgatctttaattctatttattaaataacaggatgaccttgataaataatgctgttttctcattggtgacatactattagactaagtagttcactttatatttaatcagccattatcctgagtattattagtgtgaataagaaatacttgttagaacattgggcagtggtaatcaaaatgaatttcgaagtggaattgtagtaatggttgccttaccttgagtaatgataaggacaatatttctgtaatggattgtttattcatgaaagatgaaagattaaaatggtctgtctctactgatgaaagtaacagaaggcagcctcaaagtttatttttatttttatttttttagagacatagtcttgctttgtcacctaggctggagtgcagtggtgtgatctcagctcactgcatcctcgacctccctggctcaagtgatcctcccacctcagcctcccaagtagctgggactacaggcatgtatcaccatgcctggctaatttttgttttgttttgttttgttttggttgggacagggtttcaccctgttgtccaggctggtcttcagctcctgagctcaagtgatccacctgcctctgcctcccaaagtgctgggattacagacctgcaacaccgtgcctggccagagtcttcaaagcatattaaaatatctattattattttattataggcataattgagtgttttatggagctatggatggttgtttctcaataatgttcactataattggagtttaagcaaaggtatggtttcacatgtattctt

SEQ ID NO: 14927 - DNA, 1046 bp, Homo sapiens
taatacaaggcttggaaagaaaaattcctatgctgtatgcttcctgcttctctctctgaggcaaccgttttgaaagttttttttttttttttgctgtttctagtcgcattcactgccatatatctaaataatatattttcactcctatagcctgtagttttcaattgcaaacattatattttgacttcttcctatacaaggtaaggatttggctcctcctatttccctttccccatcctctcaatgataattttacctaagttttggtcaagccatcattcagtatttacagtattatcatttgaatgttgatgacagtgaccacagagttttcagtgatcataatttctttctccaactgtttctccaatagagacagaccattttatttgcttagctttctatttatcaaacaataattttgttctaaatattcttatagaactataacaactcaaagggtaaagcagattagagaattcttcagttctggttttctcttggcactgtctctttcggggttctgtgtcctgttggttctgagctgcttgctttctagcctctggggagctgccattttggaacttctttttaccaccatcttggggattctcttgggctttttcctttggtggactttctatttcctagattctgtgtggtcatctttctttattttcccattttggtgggaaagagatatataagtattaatatataccaatatccatctgcccatgagtgggatttaaagcaaacttttatttcctaattgtctgctactaatatgtaagaatatacttgatttttttttacatcagctttgtatcctgcaatcttgttaaattcatttcttataatagtgtagttgttttttagattctggaattttctacacaaatgatcatgttccacaaataagagattttacttctttatttccgatctttatgctttacacctctttttcttgctttattccagtatagtgttgactagaaagtggtgatatcaagcattcttgctttactcttctcaggagaaaa

SEQ ID NO: 14928 - DNA, 1029 bp, Homo sapiens
tgggcaacattgagcactgagtgagtgagactccgtctgcaatcctggcacctcgggaggccgaggcgggcagatcacccgagttcaggagctggagaccagtccggccaacacggcgaaaccccgtctccaccaaaaaatacaaaaaccagtcaggcgtggcggcgcgtgcctgcaatcccaggcactcggcaggctgaggcaggagaatcaggcagggaggttgcagtgagccgagatcgcagcagtacagtccagcctcggcaaccgagggagaccgtggaaagcaggagatggagacgagggagagggggagacagtggaaagaaggagagggagagggagagctaatcttcttaaatgtctataggatctctggttttttggttttgtatttccatttctgatactaatgatttgtgttttgtctttttttttttgatcactctaactaaaagtgtgtcggttttgttgatatggtacttttaaagactcagcttttggctgtgttaattttttctgttgtctttttttcatttcagtgacttctgttttctgttattttcttctttctattttgggtttagtttgctctttttcttgtttcttaaggtggaaccttaggtaactgtggtagatctttcttattttcttttattaagcatttaaaataagacatgttttctatttgttgccatttggttcagatgttttctgatttcctttttggtttcatttttgacctatgagctctggaggtgtgttgtttcatacattggggattttcttagatatcctgttattgatttctaatttaattctgttgtggtcagagaatatttgtggaatttcaatccttttattgagagcccaccatatgatatgatctgtcttgataaatgtaccatgtgcatttgaaaggaatgtgtctttttcaattgccacattttctgtgaatgttaattaggttgatagtgtttttcagaacttctaggtcattcctgatttttttttttgtctaattgttct

SEQ ID NO: 14929 - DNA, 1031 bp, Homo sapiens
aggtgtgctggtacccgcctgtagtcccatctcctcagaaggctgaggtgggaggatcccttgagcacaggagttcaaggctgcagtgagctatgatcatgccaccctgtctaaggaacaaaagaaaaaaatagttagctaaaggtcacatcttaaagtttgtctttaattcagtaatcaaagacatcattactgtagccaagaaaggtgtgtgtgtggcttctgtaggtgtttaacacaggctgtctgaataacagaaggcacataaaaatttgttaaataaaaagactttatgaaaaggtatgcatacgtatgtttcaaacgattcttctagataaccatttcacctctgcagaagttgttttctagcaggaatgtgttacgatttctgttctacacgtggagaattgtcttttatatagaggaaactacttaaccagcatcgtaacccttcgttgcttaaattattggattttgtgtctttcttgtttcttgagccattaaaatggttggttttactgtgcttaacatttaaataaaaacctaaggcagatgcttttggtatgattcaatttgttatgctaaagatgaatccaagttaatttctagagtatcagtatgatacgaagacattgcatttcatcttccttttggataaaagccaagacagatcactctgcagagcaaggtgtgttgttaactgagatatcagtgcacagcacatacttcatacaaggtgttcaaatatttgaatttgtgagaaatgactctggtgtgcagaaaatggcatttattgagaaggcctaaaatatgatttttaattttccctaagtcagtagatactgcaaaatactttgttcattattgttcattttaggataatgtaccacaagtttgaaaaagtaatgcaaaaattattcaataaaagatacagacgcaggtttttgtcaaagcagaatctaccatctagactttaattgacccaagctacaaagaagttaagtctaatttatcttatgtatttgggagat

SEQ ID NO: 14930 - DNA, 1062 bp, Homo sapiens
ctgcccgccttggcctctcaaagtgctgggattacaggcatgagtcactgttcctggccttgggtaagatttaaaacttcactgattattatactccttcctaaaatagagataatgcccatgtcctaggattgttgtattggttatgtgatgtaaagaatatgtgcctggcatattggagacactatcattattatttataagggaaattacttaattggaagacaattagatatttggtatttaaaattaatatcaaggaggaagtttctagatgtcctagattttatttttactattataatagtatttgtggttattgaggactgtgtgaacagttttataactgccgctgtccccctctccctccacatttggaataggtagccatctttaaaataacatgtaaagatgcacgtttttgagagaccttcacatgaataatgaaaagcttctgaatataattatatatattgaaatatgtgcccctattaatgccacttatatgttcattgtagatcatctgtctccattcttcttaaactgggtatctttcatagcagtgccaaacagacttttcatgtacttctctgcctcaatattttctttttgagtttaagttttagaagtaccaattcatattccttctttttgctagcacagtgtacctattagttatttacatatatgtataatgagtttgaaaaatgttacataaaaagaatcttggcctggcgcggtggctcacgcctgtaatcccagcactttgggaggccaaggcaggtggatcatgaggtcgggagtttaagaccaacctggctaagatgttgaaaccccgtctctactaaaaatacaaaaaaattagctgggcgtggtggcaggcacctgtaatcccagctactcaggaggctgaggcaggagaatcgcttgaacccaggtggcagaggttgcagtaagccaagattgcaccactgcactgcagcctaggtgacaggctgagactctgtctcaaaaaaaaaaaaaaaaaaaaaaaaatcttaatcatattgttttcacattcta

SEQ ID NO: 14931 - DNA, 1028 bp, Homo sapiens
aactactaagttctgatgatttttattcttcttagcttccattttatgtgattgggaacagagtttggcaattacatagtttgaaatagtgtttaaaattatttattggaagctcttatggacgtgtctgacttatttaatacattttagaaattggtacatgtgctgtagatgattactattgggcatgtgtgtgggtattcttttaaccaataagcttagcattcataggaaatacaaccatggtgggagcttagtaggtgatctgaaatgagcagtgtgagaattgtggaatttccaaatatgcagtgtttggtttcttcggaacagggtttctaaacctcaccagtattttcgctttaggcaggataattctttgttggaggggactgtcctgtgcattgtaagatgtttagtggcttccctggtttttgtgtattacatgccaatagtgtgcccaccccccacttcacttgtgatgaccaaaaatgttaccagatgttgcaagatgtcacctgtgggtacaaaattgctccctgtagagaactagtattttggaatagtgattcccataggcatgtgatggaccaactcatcaaaatcactttgttgttgttgttgttttttcttctatacatacagcttccagggtgagatctttgagtagcagtctgtggacagactgaatgaatagccaagcaagaatttgttgtttaagtgggaatggctgttggttggcttaaatttaaatatgtgttgaggcggggcatagtgcagtggctcacgcctgtaatcccagcattttgggaggctgaggcgggtggatcacctgaggtgaggagttcaagattagcctggccaacatggtgaaaccccgtctctgctaaaaacacaaaaattagccggtgtggtggtgcacacctgtaatcccagctactcaggaggctgaggcaggagaattgcttgaacccaggaggcggaggttgcagtgagctgagatcttgccactgtactccagcctgggcgac

SEQ ID NO: 14932 - DNA, 1058 bp, Homo sapiens
tggctgcaagttactttttagtgtccttttatttttaccctgcagggacttcttttatcatttcttgcaagacgggtctaatggtagtcaactttctcagcttttttttttgtctgagaatgtcttcatttcgcacccacttttgaaggacagttttgacagaataacattctggttgataggtttgtttgtttgttttttgcactttgaatatatcttcctactgccttttggcctccaaagtttctgatgagaaaactgctaataatcttaggaggatcctttgtatgtgatgagttgcttttctcctgctgctttcaagattctatctttgtctttagaaagatattataatgtgtatcaatgggggtctctttgagttttcttgtctccttttggaactctcacaatgtatgtgttgcttagcttgatggtgtcccataggtcccctggctctgctcacttttctacagtcttcttcctgtttctcagacttgatcattttcattgtcctctcttcaggttcactgattctttcttctgcatcctcaaatctgcctttgattccctcagtggatttttcatttctattgtgcatttcaacttcaaaaatttttttctggattttgcatctctttatgaatattttcattttgcttatgaatttttttttaagtttctctacatcttcctttagttctttgtttatctttaacatggttgtttttgtctagtaaatctgccaacaagtatttttcagggtcagtttttaatttattttttcctttgaatgggcagtattttcctgtttgtgtttcttgtgattttgttgttgttgttgaaaactggacactttatttttttatttttattttttttgagatggagtctcatttttttgagatggagtgcggtggtgtgatcttgactcactgcagcctccacctcccagattcaagcgattctcctgcctcagcctcccaagcagctgggactataggtgtgtgccactgtgcctgctaatttttgtatttttagtagtgatggggttttgtttg

SEQ ID NO: 14933 - DNA, 1089 bp, Homo sapiens
agtttacagtcccaccaacagtgagaaagtattcctatttctccacatcctctccagcacctgttgttgcctaactttttaatggtcaccattctaactggtgtgagatggtatctcattgtggttttgatttgcatttctctgatggccagtgatgatgagcattttttcatgtgtctgttggcttcagcaatgtatgtgttttacctcccccttgcaggtagcgtgtgatttaacaattcaattttgcaaatttcataggtgaaaaaatggaattttatcactatttttctgtgcatttctcttgttataagtgaggttgaacatactatcgtgtgcttaagaacaatttccctttctgtgaattgactctgccaatttatctatggaaataatgtttttatataaaaaggaaattagcactttgtgataggggctgctagttttttccagtgggtttgtattttgtcgtttatggtaatttttgctatatatgaatttatttttggatcatcaggtttattactattctacttcatggttttggaattttatgtcttacttaggtcttaggctcttcaagattatgaaaaaatatcttgcttttaatactttgtggggttttatgtttaagactttaaatcaatttgggatttattttaatgtgagttggtatcccatcctcttttccatgtggctgtatagttgtgccagcaccatttattgaacaatttatcttttccacactgatgtcacattttatcttatcaaattcctgaagtctttttagaatgtttgttgtatccattgatttgatggcttgttcatgaaccagttttagaccttttaaattattatatatttataacatattttatactatctggcaaatattaaagctggtcccccttattactcttcttttttataattgccctcattgttcttgtttattttccatataaactacagacataccttctgaattttttttttttttttttttttgagacagagtctcactctgtcacccaggctggagtgcagtggcacgatctcggctcactgcaacctctatcgcccgggttc

SEQ ID NO: 14934 - DNA, 1089 bp, Homo sapiens
ggctaattttttgtatttttagtagagacggggtttcaccgtcttagacagggtggtctcaatctcttgatctcgtgatctgcctgccttggcctcccaaagtgctgggattacaggcatgagctgctgcacccggccagcttttgaatttctaaaagaatatcctgataatcttattgggattgcgttaaatttacttattaatttaaaatttttaaagcattgatcctctaagaatttgttttgtgtagctcaaatatttctcatctgcttttaaaaaaaagttgattttacaaaatttgctgggagtggtaggggcggctcatgcctgtaatcttagcacttttggaggccgaggcaggaggattgcttgagcccaggagttcaaaaccagcctgggcgatagtgagaccctgtctcttagaaactacatatatattttacaaatttatttttctttgaggcagagtctcgttctgtcacccaggctggagtccagtagcatgatctcgacttgttgcaacctctgcctctgtggttcgaggtatttcggggtgcctcagccacttaagtagctaggattacaggtgtgtttcacttcacttagcaaatttttgtatttttggtagtttcaccatgttggccaggctggtctcgaactcctagcctcaagtgatctgcccgcctggacttcccaaagtgctgggattccaggcgtaagacaccgcgcctggcttattgtacaagcatttcattactgatactacagagagcagttactcatcatactacctctatcacaacaaacatttctgttttccctttacttttagtgatgctgaatcatattttagggcctttattattatatattctgtaattagcaaggcatcatgcatacagtaggtaaaagtttagagagcttgtccataccactgtgggatcctcaataggaagtaatttggaagtatctattgaaatttaaaatatacacaggcatgtaccgtaactctttagttgtttactcagcatctatcctaaagaaaacatgggccgtgactcacatactgtttttttcagtaccttctg

SEQ ID NO: 14935 - DNA, 1154 bp, Homo sapiens
gggccatcgggaatctgggaattaaggaagtaaggaggtagaattggaatgtttaagccaccaagtaactattagattggtgcctgggttttgggtcatgctctcatgtgcttctgcctgcagcttacttgcctccctcttgggctggttggaaagccgtgggctggttactatgggaattgatgggtgctgctggcagtgagagaaggaaagtacttggaattgatacagaaatactaggagagcaggttttttttttgccctctgctttcctgcttactgttttttgatttgatttaactaatgtggttttagctgaagagagcctttccaagagctcacctgtggtaccctgaggaggagttgagctgtcatcactctaacccaggaagacctcatggagaggagggcaacacaaaggatggctagtttctcagatgaatttctgtttcagcaactggcttctcaggcttcattgaactcaaaattaaacccaagcctctttttatactgttaagaaatgtgctgcagacaggagggggaaagtcagtatttaattctctcttcttcactaccgtcttcttcactaccactcctctccctcttcttcactgccaccaccccttgcaaggaaaaggtaggtggagcattctgtgtttgtcataaatttaatgattctgaaatgttggaaatagaaaacagatgttttaatggggtgatacccacattggaaagcatcaaggtcaaaatatattttatgagtcaactttaatttgattaataacttaaaaccctctaccatagtatatgctactttattttcataactactcatgagtatggaatggaaaacattaatttatctttctaagaaaagtatttggctggaggagaaaagaatattaaagtgtcatggacattataaaatttggtagcacagtcttttttcccctacatttttagtttcagttcactgtttctgttgtttctaaatattttaccactaatgaaaaccttatttaggtaaaacgttttcttttgatttaaaagatttttgttgaattccttgcccagatgtgagagaagtgtctacatctattcaaactttaactttgggtcttagaggtgatgaatcacttggcagaacaaccatg

SEQ ID NO: 14936 - DNA, 1048 bp, Homo sapiens
ctaattgtgtcctcatagcagcgttatattttttaaccccaaaatggtacctaaagtggagatttgtatgcattatgaactaaatacattttcttaagtagtatttattgtgtttagggtttgccactatttctgactaaaatggatgttcatggtctcaagcacattgaccagttatcttttaataaactattttttattgtgcacagaaccaatgtaatggcattagttacttgttctttcagtttattttgataacaattttctcttccatagtagttctctccatttaattgaatttgggcatgttatgtgagtgcttttgatctataaattagtcattaatagatgtaatatttaaatgattttagggatataacgcaaactattttatctcataactcagacacagttttcaacatttctagagagaaattttcctgcctgcttggaacaacactttgaattgtcatgtgaaagcaattccattgccatttcagtgtccagatttatgtcagcattaattactgtcgctggggagttctgtgagccaacattgtatgtgtgtggatatttacaaatgcaccgttggattctttgtcgttcaagtgaatgttgactatttacaggtaaagaactctcttgtctttgtagatatcaggttatttgaatcaagtaatatttgcctatctatttatacattaatatgtttaaaaagaaatttctccaagaagaagcattcgtcattcactatttgtttgatgagatgatacttacattcttattgtgtaatcataaaatagctaattttgtcgtgcttaatgccaagagcagatgcactttctaataaaaacaacatgcaaagcccaaatctaagcattatgtagaagcctattaaaatcttggagtattttttttgtaatttaaaaacgtaattgtggtttgcattgtgcccagttttcaaaaaagtatgtgattggtgccacagcttaaaaaccgaagaagcaaaaattgtcccttatgtttttaagtataatgagtcattttg

SEQ ID NO: 14937 - DNA, 1064 bp, Homo sapiens
gcccccagtgtgtggaaaaattgtcttccacaaaactagtctgtggtgccaaaaagattggggaccgctggtttagggcatagacccccaaattgattcttatctaacaattcacctggcttgtaaaacacaaggaagcttttgtaaattgcttacatttgttgttgttgatgtttaacttccatttccccccctacattgcctatacaccctctctccagagatctttctgttggccctactcactctccctaattcagcacccagagtagatcagatgtttcaagaactgggtgtctttcctgcccaaagaaaacattggaaaacatttattttgatttaaaaagatgtttcataatcatacggatgtgcgatttagacagaaaaagatagtgaatcatgaaatatttttaataccctaaatgtatttgcaactgttttttgccaaatcttaccatgtgtactttaaatattctccagcatctgcaatgaaatttctgtttgactagtaggaacagctatctgactatacagggttcgattttctgtggggaaaccacttggggtggtgtttctatcaagtcatcaggaaaggacacaggctcctggctttcagccttttgggtgtaaggcctttgtccccaaatccacaggagctccagcctagttgtctgcaagaggaggggaaaggaaaacaggcaaatgagactttctggaatctctactcattgacttctacttgaaactccttggccactgctatcttcaagggaggctcaagtgtggtgtttaaatgggcactttgccagcccaaataaaatgatacttctatcgctaaagaaggggagcggagtggaaactgagtttgaaaaagttgactttctgccatcaaatacaacttttattttttaagtcatgaatctgcctaaccatcttgccaaaatttagagtgaagggtgttatttaagagtattttaaagaaatatttcagctttcgacaaattatttcccaggtcatttctatgcttttgtaaaattcttaatgcaccattattactttccaa

SEQ ID NO: 14938 - DNA, 1082 bp, Homo sapiens
agggagcaacctgtttgttgttgttgttgttgttgttattgttgttttgagataatctcattctgtcgtccagactggagtgcagtggtgcaatcatggctcactgcagcctcgacctccccggctcaagcaatcctcccacctcaaccccacaagtagctggaacaacagtcaaatgctcagcctgccttggcttcccaaagtgctgagattacaggcgtgagccaccgtttcaggcttaatgttttatttcaaacacacacacacacacacacacacacacacacacacacacacacacacacaccccttcccccgcccccccacatgaagagttggcatttgtaggctacattttcagtaaattgtaaatgaagagaattatgagaatttacctgataatcctcatttattatagttcgggttgtgcgtgtgtgggaaaaatgctgtcctgtttctgctaatccaagtctgtcagcaccatctcccctctgtcacctaatgatttgactgtatttcaacctgtgtaatggcgaggcaccacggtagctagcattggccgagatgcctgtccttgacaacaaggtctttgtttggctgtgttgggaaatattggctactaccagggctgagtgcaaagagggtggtatagtaactcagtttttcgtgctagcagcctgatggcacagttacagcaaggatttggcaggaaggagcaagtgtggattgcttgaagtttcaaggggagatgaggcaggagagaatttagaactgtggtgttgtttttattagtttagaagttttaatcttcaatatagccgtgtttttttccaacagcataaagggtcagcttgatgccctgttaaaaaagagccagaagtggggtttacaggtgacaattttagtgtgttccttttctttaagaaaaatctttgattctgaaagagcttgacagagctgtttaatagtgtggacatctgttgaggcagatagcagttttctggatataggtcatgttaatataaactctggatataaacaacctctgctgtctgcttcagacttgaagactgtgtgatagg

SEQ ID NO: 14939 - DNA, 1004 bp, Homo sapiens
agagacaggagctcactctctcgcccagggcacaattatggttcactccagcctcaatctcccaggctcaagcgatccatctcagcttcccaagtagctgggaccatgggcatatgccaccatgcctggctagattttttttttttttttaatgtagggatggggtccactctattgcccaggctggtctcaaactcctgggctcaagcaattctcccaccgtggcctcccaaagtgctgggattataggcatgagccattgtgcccagccagtaaatggcattttcatacatttacctccttttttgttgtcccggaaggcagaatctgggatctcttttacttatgtaactgttctccaatttccaaatcaatttatatcgaaagaatatatctgtggtgcctgcccctttatccctcccccaaaacataggtatttatttttttagagacagggtcttgctctgtcacccaggctggagtgcagtggtgtgactgtagctctgtagctttctgcagccttgaactcctgggcccaagcaattttcctgcctcagcctcctgagtagctaggactacaggtgcccaaaccctccacgcccccagttttttttatttttggagtgatggggtttcaccatgttacccaggctggtgttgaatcctgggctcaagcagttttccccattcaccctcccaaagtgctgggattacgggtgtgagctattgcacctggcgaaagtagttgttgaagaactacttgggcagatgggaggtcttgttttactgctatgtttgtgaacaatacaaattcaattatttttgtggatgtgacttctagagaaacaattaaattgattaaccagagtgactgaggagactttcattatgtttctccaaggacataatgttgaacaacaaaaaaagtattttgacaaagtatcatcaccaaagtatccctcatcagaatatatagcacaggctggaaacttggattattgttt

SEQ ID NO: 14940 - DNA, 1043 bp, Homo sapiens
tttcaccatgtttagtcaggctggtctcaaactcctgacctcgtgatccacctgccttggccttccaaagtgctgggattacaggcatgagccactgcgcctggctcaggctgatcttgaactctcgggctcagttgatcctcccatcttggcctcctagaagtgctggaattacaggtgggagccactgcacccagacagaggattttttaattgagaatttttgtttgtaaattcttgaggaatattggttcattgttttcttattttgtaatgctcttgtctggctttagtattgtggtaatataaaatgagctgggaagtgttgtctctttctctgttttctagaagagttcgtgaagaattggcattgtttctttatgtatctgatagaattccatggtgaagccatctagtcctggtattttctttttgggaagatttttaattagtaattcaatttcttgttttaggtatattgagattttctgtttcttcttgagttggtattggttatttatgtctctctaggaatttgtccatttaatctaatttgtctaatttgatggcatactgtttttatattttcttttatatatttaaaatatatttatattttatactgtagggtcaatagtgatgctccctcatttattcctgattttggtaattttgggggggataattttctttttttcttggtcaatctaaataaagctttgtctattttatttactttttcaaagaaccagcttttggttttattgacttttactgtttttctgttttcagtttcattgggttttgctctaaactttaacttctttcttttggcttgcttggggttactttactgtttagtttcttaaagtgaagacgattgagatctttcttattttctaaaataggtttaagtttaaagctataaaattctcagctgtgagcagtgtttcacacctgtaatcccagcactttgagaggccaaggtgggaggatcatttgaggccaggagttcgagaccagcctgggtaacatagtgacac

SEQ ID NO: 14941 - DNA, 1048 bp, Homo sapiens
tctactaaaatacagaaattagctgggcatggtggcgcgtgtctgtaatcccagctactcaggaggctgaggcaggagaatcacttgaacccaggaggcagaggttgcagtgagctgagatcacgccactgcactccagcctgggcaacaagagcaaaactccatctcaaaaaacaaacaaacaaaaaaacaaaaaaaaagatcctacagttttatttatttttattacaatggggtcttgctatattgcccaggctggtcttgaactcctagactcaagggatcgttcttccttggcctcccagaatgctggggattacagatgtgagccaccacacctggcccataccgttctaaatgatcatacacatatacaatcccaggaatttaaatacatgtatggatttttgtgactttcattataataaagattcagaagagttttgtaaccccctaaaactccctcatgctacccctttatagtcacctctttgcctacctataatctctggcaaccactgatctgccatccattcctgtagttttttcttttaaagaatgtcacttaacttaataaattgggatgttatataagtggagccatacagtatataatcttccaagactagctgctttcactaagcttgcctttgagattcatccaagctgttgcatgtatcagtagttgctttttatttcaggatattccattgtgtggatataccaatttgcttatacaatcacctgttgaaggacacttgagttgttgccagttttgagtgattgtgaatagagctgctatgaacatttgtgtccagatttttctgttaatgtaagctttcatttctctaggatagatgcccaggtgcatgatttctgagtcatagggtaagtgctttatgagaaactgccaaaccactttcacgagtgactgtatcatttttcgttctcaccagcaatgttggagagttctcatttcccattcttgccactacatggtattgccagcattttaaattttggccattttaataggtgtgagtgggat

SEQ ID NO: 14942 - DNA, 1046 bp, Homo sapiens
ggtttaagtgattctcatgcctcagcctcccgagtagctgagactacaggcacatgctaccatgcctggcaattttgtgtgtgtgtgtgtgtgtttttagtagagacagggtctcactatgttggccaggctggtttcaaactcctggcctcaagtgatccacccggctcaacctcccaaagggattacaggcatgagccaccatgcccagcctagaatcttgagtattttaaaagcccagaaacaaaaatttttggctattagggtagagtatgttaaatatgaaaacttgtcaacatttaaaacatgttgcagataactaaaataaaatactcttattcctagtgacccatttaatccagagagactatttttcacctacattagtgcaaatgtagttatggtttaatatacttctcagttttatcatccttgtgttctcgtaagactcctctaacaccgtgttctgccacatgttaatgaagttctttatgtttctttccctgttatactctgattttcttaaggacaggagctgctttttaaatttctcctagcatagtgcattccttatattaaataatcagaaaatattatctccatattttataaaagacttagtaataaaattccagaagttttgaattcttatgcatgtccccccttgctgtaggacagttagttgcaattcttgtatgatgtaacatgaaattttgtagtcatcatgtccctgacctctattgaaaaaatgtgcttgataaattttagcatgatgaagtttgtatgtctgagtttagcttcaaatggtgtagatagtattatttaaaaatgggaagatctggagttcttatatctaatagtatagctcattttatcctaagaacaatgcatgtgaaagtaaattacaaagttatacaactagaaggtcatgatggaattttctggcatgttacctgtttttgttttgatgctgaacccatgtgtatattcagtcacttttaaatgttctctgagtaaactgctgtcctcaataagctgattatgct

SEQ ID NO: 14943 - DNA, 1045 bp, Homo sapiens
atttttaaaaaaaatttccttcacaaaccaattgaataaaattagtctggcctatggagttaggtgccccctttgtaaaatggaaagctttactaaacagtgtgtgcagagagaccatctgtctctatttctatctgaatatttggctccctccctaaatttgatggtatccccattgtattactatgcagtggcctcaatttaaagatggagaagccaatgtacattcatctgttctgcatgtgtatagagtctgttgatcgtaaagatttaggccaagatcctgcattcattgttactataatttgatcctttagttgtattttgatgatcacttggaataacattcagttgtattcgttcagagcatcaaggaaaatctcatttaatacactattctcaacaaatgttaaaagtaacttacaaaaataatacatactggtaaaaaagtagaaaatgcaggtaaacataaagacaaaaatgaaaaccatctataattttaccgtccagaagtggccattactaacataggctaataataggttctcacagaacacagagcacaccattgagaaggggcagggggaccctatgccaacaattaataagggactggctggagatgatgacagctagaaactcttaaatacctatgtatggtgtgtgttagacttagtgtcttctaaactggaagtatttattagctgtgttcattttatttaagataaaagaaagcacctgttgaaggagtaactgccctattctggttgacttttgtttccattgattttttaggaagtgtttttcttatgcagggcatgtttctctatgtaagcatgaattttcctcttgattcttaagtgaagggataatataaaatgagctgctatatagaaagagtagaataataacatacttttaaaaggaatgccttctgctcctctgatggaaagataggaaagtcaagtcaccagaagctgcatgtggttattatcaagggataactgaatgtcagaatccctcctaggttttttttttttccttt

SEQ ID NO: 14944 - DNA, 1026 bp, Homo sapiens
cactaatcacttgctgtcagcagctagttcctctgaggggaagagcggggctgatcctgcctctgttgtgagactgcatgattagagggacatttctgaattcatgtccattccttcatttccagtgcatactgaaatcaaaataccatcaaaggctgatagaactgattcacagaatttgtttttaggaattttggattttttaaagtacagctaagcctggtggtggctcatgtctgtaatcccagcaccttgggaggctgaggtgggagaattgtttgaagccaggagctcaagagcagcctgggcaatatagcaagaccgcatctctacgaaaaataaaatttaaaaaattttaaaactaaataaaaagtgctgtgttatagctaggacaaacaaaaaaaaggttgtgtcatttgtcttggaagtgatgtctttgctgaatgagaaaaagaatacagtgacaagggaagcagtttcactgctgaaaacattctgactcttgttagaacagaattttcctcctccaagagagatggttatttagacatgacattgtttgaaattagggcaaaatcatgtagtgttttaaaaaagtactcaaatatacagtgaaaagaaagccaagctgtaacgcattaatcagaacttattcatgctggctgggcagggtggctcaggcctgtaatcccagcactttgggaggtccaagtaggcggattgcctgaggtcaggagtttgagaccagcctggccaacatggtgaaaccccaactctactaaaaagaaaaaaaattagccagacgtggtggcacacacctgtagtctcagctactcaggaggctgaagcaggagaattgcttgaactcgggaggtggaggttgcagtgagccaagattctccagcctgggtgacagagcgaaactccatctttaaaaaaaaaaagaagaagaacttatttatgctatatggaagataattttttctctctccttctggtgagaataatttgctgctccatgtgagg

SEQ ID NO: 14945 - DNA, 1029 bp, Homo sapiens
ccacagtgccaccagcaatatatgaatatattacgtctctaccaagggctggttttttatttcagaaacattgttttttatattgggttaggcatgagatagtagctaagttttatttgctttgtgtttctttgattcatgtttatgatgtctattttttctattaaacaatttaaattaactattgtaaacatgtttcaagcaataaattataactttacagattacttgtaaaactatatttttactgttcataattacattcagttcagattatgctatagatgtcctcagggaagtatgcaactgaaatattaatacatagcctgcagataccatgataaccagtgcaagtgacaaaaaattgatagttaaagccctgtaactcttgtaattgtagtttcctttccccttcacaagtaaaacaccaagcttaactttctttgccttgtacacacatgcttatatatcttataatcaggtgattggactgtacctgatctaattactttgagctttgaactattcgctgtttcccctcactaagaatgtgaaatttttattataatcattattgtgaaagtatcaaccaaaaataaaactatttacctggaatattttaatgatgacataattatttattgttactctttgtaccatcctggttaaaactcaagaaccagaactaataagaaaacttcacactaaacatttaaatgtgaggaatggagtaggtggaaggaagtcaaccgtatatggatataatgttaatctctccccctttcaacaaaaccttagctaaacagcacatcaagaaataaagcattatgtctcgtctgactagataaatagtttattcctttaggaaccaagttttatttaatgatttttttattcataataaaattttagaaacttatgggaacataatattgtgtgtaatggctaagtaaatgagctgattaattaacattaaatcagcagttaatatgtttaaatctggtactgctatatactacttctgactaa

SEQ ID NO: 14946 - DNA, 1075 bp, Homo sapiens
tgtgacatcttacatggttttttggactaagtctttgtaacctgaagtacattttagacttaccgcatatctcaattagaatgctaaattttcattggtgatacttgatgtatatttagatttcataaaatttataatgaaaaggtagatttaatatacctagattcttccaaatggacttttaaaaatctttaaaataacagaattaagtatccatttttaaatcatatattaattaaaatttaatataatttgatattccttggtcacactagacacatttcaagtgctcaatagccacagctggctgtggccactgtaatgaaccacacaagtctaaacagactgctcagggaggtatgttctccttcttcagtgctttgtttttttatttttatcatccctcccctgaaaattaggatttttgctttctctctcttatttttaatctgttgcctggagagcccaccgtttgaaccccatcatttaatgctagaagtctttgcgggaagtgggatactgaacacccctgctcaagacatgtgggcaggtctggaatttcctagttaccaggcttgtttgaaggcccaacacacagcttttaagctgtgaattttggcctgtttataaatccaagaaaacattagtttgtaacatcactgaaagaaatcacaagagattatagagcagtgacctatgcctattgcaaactttaaagatcaataattttttgccatccttctcaaaagaggcaggcacacctcctcaggtatgtggtgatgtcaggaagtgtttgaagacacagaataaacaggacacctttcttcaagcctttaatgttggggggaggcagggtaaggacgagcttattttctcatgaaaataaatgtattatgaggtagaatggaaaatatcagttttcagataaaacatgggtcttcaaagaatttctacacctgtgaatttttctcaagccccagccactccccgaactactagggatatgaatttataggcctgttttattaggggtggtttggtggaaaaacttagacatgggttgatttatactcat

SEQ ID NO: 14947 - DNA, 1016 bp, Homo sapiens
gaatcatctacctttgtttcaaagggttctagtcctgctttcaatcccatatacttgggcctgatggatctttcgaaagtgaaattgtggcctcatgatggcatcatttgaaagcctccgatgactgtttcccgaggagggtgaactttctctccttacctgctcttgctttcctgcctccattttgctcatggcattcccttgaattaggttctatgagtggaatacagctttgaaggcaattccagagatccaacaaaaacccaggagattggaaggaattcatatttgtcaaaaaatgtgtagctcaaaaatataaaaaaaaaaaataatgcaaataaaacccaatagagtataacaactatttacatagcatttatattgtattaggtattataactgatctacagatgatttaaagtatagaggagggtggcataggttatatgaaaatactacaccactttatattaatataagagacttgagcatctgcagattttggtatcctctgggggggtactggaggcaatcttcctgggatactgaggggtgactgtaacttattttcagtactttggtaatagtgtatttaacggtctattgtttctcagggtttgtggatgatagtccattaggatctgaaaataagatattagaagttctatttacttttttttgtttttctgaaattttaagtgtatatgaagttaagggaatacatgtaattttgaaataattaaatattcatgtttggaaatctgttcaaatttttgggtggctgggaacacaaccaaaaagatatgaaaaccaataacaattatgtatcagtaggcattttataaatagtctttgatattattttggatataagtgatttgattggcacttctcatttaattgcttattaggtgggtttctgttttgtagagaacatttaaaaaaaatttagacaagcaaaagttaataaaatcacctgtggtatgaccactcagaggtaagtataatgaatgttt

SEQ ID NO: 14948 - DNA, 1060 bp, Homo sapiens
ccacaacctccgcctcccaggttcaagcaatgctcctgcctcagcctcccaagtagctgagatcacaggcgcacaccaccacgcccggctaatttttgtatttttagtagagacgggatttcaccatgttggttaggctggtctcgaactcctgacctcgtgatccacctgcctcggcctcccaaagtgctgggattacaggtgtgagccacaatgcccggcctttttttttttttttttttttttttgagatggagtttcactcttgttgcccaggctggagtgcaatgacacgatctcagttcaccgcaacctccgcctctggggctcaagcgattctcctgcctcagcctcccaagtagccaggattacaggcatgtaccaccacacccggctgatttttgtatttttagtagagatgggattctccatgttggtcaggctggtctcgaactcccgacctcaggtgatccacccgcttcggcctcctaaagtgctgggattacaggcgtgagccaccacgcctggcatggattgttttatttcttaacctgggtggtgggtacatggctatatttagtttgtgataactcactgaactgtatccttacaatctgtacgttctatcaatgcaaaagtttattttaaaaaatattttttcgaagcacagtggctcatgcctgtaatctcaacactttgggaggccaaggcaggataatcgtttgagcccaggagttcaagaccagcctgagcaacatagcaagactccaatctctacaaaaaataaataattagccatgtgtggtggctcacacctgtgatcccagctacttgggaggctgagatgggaggattccttgagcctgggaggttgaggatgcattgagccatgatcacgccactgcactccagactgggcaaaagaacaagaccctgtcttaaaaaaaaaaaaaaaaaaaaaaaatatatatatatatatatatatatatatatagtttatttatttatttatttgtgtgtgtgtgtgtgtgtgtgtgtgtgtgtgtgtgtgtgtgtgtgt

SEQ ID NO: 14949 - DNA, 1032 bp, Homo sapiens
ggtccttaacatgcctttgttcaagcaccttccagaatgtaaggttcagcagctctggtttctattacggtgacttgaatgtcagattcaagggcccggcgtcaaaggaaattggttttgactttttgtaatctaggagcgacagttcgtgagatgtttattcagtgttaaagagcctgtttttctaccaaacaataaaaccaagagaagaatcatggtgtgacatgcacttctgtgaatgacttaggagatcatgagcttgggctgctgggaccagctttcatagccttcctggagagcttccctgggcccctccagacccactctgccctcatcatctgtccatctccaccctgctctgtgcatgcccaaaagactcacctctggactaggtcagggttccctggctcccagcagctaggtaggttcagccagtgggaagcagcagtagaacacagagggcaagaggagagggagtggttccccggctcccttctggttgggctgtgggtggctgtaaccaaaacccaccacttctattggaaagcgctcagagagagccgggttccagcaactcttcatttgtcccttcagacctacagctggtcatcacacctcactgttgctggcccagaatgcctcactaggtagactcgcagttacccacttgaatgtttcctgccagtaccctgactaatacagcatattctataaagaaccaaattttttttttttttttgagatggtgttttatacttgttgcccaggctggagtgcaatggcgctctcaccgcaccctccacctcctgggttctagtgattctcctgcctcagcctcccgagtaggttggattataggcgcgtgccaccacgcctggctaattttgtatttttagtagagatgggggtttctacatgttggtcaggctggcctcaaactcctgacctcaggtgatctgcccgcctcagcctcccaaagtgctgggattataggcctgagccaccgcacctggcccgattcttaaatatatt

SEQ ID NO: 14950 - DNA, 1025 bp, Homo sapiens
gccctacaactacgcataagcttttgcttttcaaaaaacctccacagcctttgccaattatttgttgatctcgagtagttgttataacagcacttggggtttaacactaaggttgcagatcgcgcccagttatcagttcctcgaacctcaaggaatcacaaagcaaggttccaccccccgaaaaactacgaaaagtgagaaagcctctaacactcctcgcgccgtgcccagccggaaccttgacctcaagatggcgtcccgtagtcgtaagattcagtcggctccaatcaaacatggtgggtcataatttacagttcgggcctttctagtaaccgctagacgctgcttctctatggttattcgtctcggcttggtgagtcagagccaacagcggagacgatctatatacgttcttctctatggttccgcgctccccgcccccggccgcagtgcacgccgggcaagaggaagacctccatcagctcgccgcgcagcgcggctgtatttgcggcctgtgcgagtaggcgcttgggcactcagtctccctggcgagcgacgggcagaaatctcgaaccagtggagcgcactcgtaacctggatcccagaaggtcgcgaaggcagtaccgtttcctcagcggcgggtgagtttgtgtctctgaacgcgtgtggaaaccgggagaccgggtgcctcagctggtggaggaggaaaagccggggtggctgcgaaagcgccagggtggggtagaggtaagggggagcgcggaggcgggggtgggggaggggtcggcacgaggcttggtttcttctcttctctaaggcctggaaaagctgtgggcccagccgtagctggtggaggccagacctacggcttgagctttccgtcttgcattgtcgcccactttccctttcccttccacgttccgccgcggagtgaatcgtctctgccccccctgggctccacgttagatacaaaacgatcgatctgccccaggggagcccttccctgagcccccttacttaccgga

SEQ ID NO: 14951 - DNA, 1024 bp, Homo sapiens
ccaacatggtgaaaccctgtgtctactaaaaatacaaaaaattatctaggcttggtggtgcgcgcctgtaatctcagctactcgggaggccgaggcaggagagtcccttgaacccaggaggcggaggttgcagtgagccgagattatgccactgcactccagcctgggcgacagagcgaaattccgtttcagaaaataaaagtaaaaattatgtcttaaacataacaaagttttcttggttatttttgtttcttttttaagaagaaaggtaatctagtagtagaagtttacttgtcacaaataagtttgcattaatgaaatgtgctatgcactttaggagctttagaagtatacaagcatgcagagcttaaataatgtgctatatatatttatttaatcctgatgtttttagcctaatgttaattgtggtaggaaatttaattgctggatcaatttttattttgtttcttcaccttaggtcttagtacccactgtgtctatggttggaaagcatttgggcgcaagaaaggatcatccaggcttaaaggctaaagaaaatgatgaaaattgtggtcctactaccactgtttttgttggcaacatttccgagaaagcttcagacatgcttataagacaactcttagctgtaagttaaactgtttatttttcattaaaaatttttttatcattctacatttcaaacttaagcagaaagaagactttcagtgattgctttttattttaaaaaatttcagtcctgcagcaaaggtgaaaaagtacagtgaacacgtttgtattcttttcctagattcaccaatgaacatgtttagatattttatgtacacatgtgtaccacacacacttttttcttggataatttgaaagtaaattgtggcataacatttcacctgtgaatccttcatttatctcctaagagcaaggacattctgcgacataatcacaatgccactatcacacatgaaatttggccgggtgcagtggcttttgcctgtggttgtcatcc

SEQ ID NO: 14952 - DNA, 1078 bp, Homo sapiens
tcctcagtgaattgattgctacctctttgtggccctaagctaattgtccaggttgaaagaaaaggtttagttttctcatacttatttcctttggataaacttagataaattataggaagtgttcttttaaaaatactggaagaagccagaagtggtggctgacacatgtagtcccagcaacttgggaggctgaggggagaattacttgagcccatgaacttgagtctagcctgggccacagagcgagacccttctataaagtaagaaaaaaaatcccacaaatattggaagtgttttatttatgtttttgagacagtatcttgctctgtcacacagactggaggatggtggcgcaattacggctcactgcagccttgaatacccatcctaaagtgatcctcatgtgttagcctcctgagaagctgagactataggcatgtgctaccatacccagctaatttttgtattttttgtagagacagggtttcaccatgttgcccaagctggtgttgaactcctgagctcaaatgatctgcctgcctcagccttccaaagtgctgggactacaagtgtgaatcactcatagctggctcaacgtgttttatatgcatgcattatgtaataaaaaagtactacgtggtatatatattatgattagttatgaatggatggttacattttatattattttaaatttcagtgcctttttaggccatattcagttttctttgtggccagatacatacatttttattatttggtatgtgtttcctcgtttggtcatagaacttttcttttttgttcccgcccctacccccacccaagacggagtctcactcacttgcccaggctggagtgcagcagctgcgatctcagctcactgcaagctctgcctcccgggttcaagcgattctcctgcctcagcctcctgagtagctgggactacacgtgcctgctgccacgcccagctacttttttgtatttttaatagagatgggtttcactgtgttagccaggatggtctcgatctgctgacctcgtgatccgcgtgagccaccgtgcccgacccataactttt

SEQ ID NO: 14953 - DNA, 1049 bp, Homo sapiens
attctgttaggaatggtaattggtagggtcagtaaggtacagggtaattgaggcctgtagaattcattcttcctctttcttcattagtgggaaaggagaaaaataacatatttgtttgatgtggattgggaggagataataaattcttcctctgtggcaggagttatgggtaaatattgttggtatgattagaaagccctgctactatgagagcaccttctatatttccatttcttgggggtgttggagtatccagagaggagggtagtgtgtgatcagttattgtaaaaagagtgaaatcacttctattcccaagtaatttgaaatcaagaaagcatcacagaagtgtactgtattgttcacgtcataaatgtatagggcattgctttgcagattagtatgagctctgtttttcttttttaaaaaagattcttggtggattttttcacagattttccgcagatttccagtggccccactgatcccttatccactcatcactaaggttagtttaaattgtaggctttgacaatacctgtgtttactgctgattgttgatttgtcattcttgtctatctgatttttcactatttaactttagattgttagatttgttattgtggatattctgtttacttatttactctttgagacctatacagaatatctaacctttaactgtttatattgaagtagggtgttctttattcattccctcctgtgcccgttttcttttaggaggatataaatgctatagaaatggaagaagacaaaagagacctgatatctcgagagatcagcaaattcagagacacacataaggtagtattcttgtcttttcacttgataccaatctagactttttacagaatccaaagcaaagagacaaaaaaaatcaaccttaaattagaatataattttaaatgttttttataggtttaattgatatttagatagaaaaaagaaacagaagaccaataccatattaaagtggtccttgacatgttgtgcttagttttttcagttactgactattctgcagtcatctc

SEQ ID NO: 14954 - DNA, 1458 bp, Homo sapiens
taggaataccttttctttagagctgagattaaaatttacattttatatttgtatagatttaagttgagtgggggagattttaaacagtaggtcagtggttaccagacttaccaaattttagatgcatggaagaactgtaaattcccataaagctaatctattcattgacccccaccattatgatagagatcatatggtgactaatgcaagatgaaactctcagcttggaaagtaacaaggaataggatgtaagtatgagcttctgttttttattatatttatggatgccccctcagaaaaatatgcaaaggggtaactggcttggaaatgggtatttatgcatagtaaatcccactcacgagttttgcctatttgaagcttctctcaatgacagtgcatctgtgaatgttcgctggtgttgaaaatgatgcttttgaacggtgcaatgcaaacactgcatgaaatgtattttgatggtcgagataataaggtgttgctggttcttactgatagactgagagatctttaactcagtgaaatgttaaatgttcattttctcttttattcttactttttcccattgctttcaaaatctgcagttcacaaataatgccaatgaatcagtgctgctgaacacttactatccagatgcccagcccttgctcacaaacacaatgctttttcaagaattaaatgtgtctaagagcacaaacataattctcccaaaattaattttgagagttgaaaaggtggtctatgggaaatcattttagatgaataattttggttaggtataatactgaaattcaggaccgagtaagcttaaaaatggtatatggttgtgtgtgtggtttaccccctttttgtttttatttatttgttaaaccctgtcatgttattggtaaattatgaggaaatcatgttttaagaaaaattcaaaaatatatttgctttaaagtttgggaatctgttaggcattttactgccttagtattatttcactggagggaatgttttgaattttcagaatgtcttttcaaaataaaaagaaatcaaaatgaaaaaccaaaacagttgttttttattgggtggtttggctaaaagggttgtttgaaactccagtaacaaaaaatgagctcagtgaacctttgcatgttttggtatgagtttattaaataaccacagactgtcagggtatcagcgtggcagggggcgtccatttacagcacggatgagtctgaagagagaataaggtaagatttatgattttttaatctgtcctttcctcttcatgactttcttacataattttagactcacctcatttcccttctccagtctttctttaaaaatatacatgtatgtttacatgtatacctgtatttgtatacatgtgtgtatatatatatatatatatatctcatatataaacttcaggaaacatttagtatggactag

SEQ ID NO: 14955 - DNA, 2018 bp, Homo sapiens
atctatttcagaaataaacaaatttctttataagtgtatgccattgaggtaagttttatatagtctagcctcattttacaatataaatttttatattcattggaactgtttcagaaatgagatttttccccctttaatagctgttagtttctgtcctctttctatcatatcttatttcatccctttgtaatttcaatgtattcagttttgactttgcccgtattctacttcgatatagactggcacagcaactgaatatattgctcatacattagctttcctttcataacctgctataagttctctgatccatgaggaagagaaaaagagtatctgacaggtaagattgctttttaaagttgttttaaatgcattacatgactgagaaaagaaaaatgcacattttattgttgcagtttaaaatttcattttggtgaaactaaacgtgaaacaaaagggataaatgtgttttgttttgttttgttttacctgtttggggtatttttttctgagtttgtgtagaaaccgtgtggtacactggtaatcttgtcagggtacaaacttggtctgactttgttatttggtttatttgtgaaccatgtacttgctcttcctcccagaaacatagcttgtaggcaaggttaatccagtgttggcgatccatgtcctagcacagcatctgtaagttaatgcacaatcgttccttccaaggatggatttatcattgtaaatatattttcattgtcttacaggcataatgggcataagtatgttgcttttaaatattttaaattaaactattacagttacatatattttgcttgaagtgagtgattttcaaactttttgtatttggtgggctgtccatcttgtaatggtgggagtaaatgtttccatagatgataaggcagttcttggctgaattcagcttgtgtttcttttggagggtgggcaaatcagagggcagagattatttagttgcattataggtattcttctataccacttgccctttgaaaccctcaacttgaggtaatgtgcagtctggggttttaattagtattaataatcttgtggatttacagaaatctataatgcacagagttgagttttaaccaatgatcgtattcatagaaaatatttcgaaccaccacattcttcatggtcattttagttagtacatagtcattgagtggccagccacacctgacacaatctcccagcatccaagattggagattcctggtctgtgtagagtatatggttttgcacgaaatctttctagtcttgtgattgcttcagtttaatttgtcacataaaaccacaagtatttaatattaatgtatcagtggtttggtgtttttgttcccagtactgggctttgcgccgggaaaaatctgaatactggagctacagagttaactctaaaagtgcttttattggtttctagaaactggaagaagagaaaggcaaaaaggaaaaagaaagacaggaaattgagaaagaacggagagaaagagagagggagcgtgaaagggaacgagaaaggcgagaacgggaacgagaaagggaaagagaacgtgaacgagaaaaggagaaagaacgggagcgggaacgagaacgggatagggaccgtgaccggacaaaagagagagaccgagatcgggatcgagagagagatcgtgaccgggatagagaaaggagctcagatcgtaataaggatcgcagtcgatcaaggtaaggctttacagaagttactgtttcctgatagctttaagaaaactatcgggtagtcctccagagtaccatttgcattcatggaatgagaacttttgtgtgtgtgtgagacattctcactctgtcactcagcctggactgcagtggctgagcaatctccgcctcctgggttcaagtgattctcattcctcagcctcccaagtagctgggattacaggttcataccaccatgcccagctaattttttgtatttttggtagagatggggttttgccatgtta

SEQ ID NO: 14956 - DNA, 1089 bp, Homo sapiens
aacttaatccatgcaacatgtcagaattctgttttccacatgtgccagcacttactccttgatctctagtaagctaaactatctcttaacatattcattagtccttcatatttcttttgggaattaagttttccttttttctgttttacaccatcaggggattgactattatttcagtatatgatgggcattaactaaccattcattttaatgatttataactattttatattcagattgtatttgttttctgacataccagtaagcattaggtattagaatgcattttaggatttgggactgcaatttatgtctttctgatgagtgtagaggaggttacatagttttatggaaatcaagtgctagattctggcctgtgagattttatattatttcataatgtatgttgtcctcctttactttggtcttgaaaacagaaagtagactgacagatttgtaaaatattttgtttacattagagaaaaaagcagagatcgtgaaagggaacgagagcgggaaagagagagagagagagaacgagagcgagaacgagaacgggagcgagagagagagcgagagagggaacgggagcgagaaagagaaaaagacaaaaaacgggaccgagaagaagatgaagaagatgcatacgaacgaagaaaacttgaaagaaaactccgagagaaagaagctgcttatcaagaggtaagttgagaaaatgcctttattcttaaatcttggtatcccttaataggttaatcaatatttatagaatgctatgtataaatttttaaagctttgaaaatttaatttttttagcgccttaagaattgggaaatcagagaacgaaagaaaacccgggaatatgagaaagaagctgaaagagaagaagaaagaagaagagaaatggtaagattctaggctaaaataagtgatttttcaggtaaaaagtcagattgtatctttactgctaactacaagtaacttaataattgaaatgcacaagcttctctattcatgtataatttaatttttatgtattttgagtaattttgagccaatttaagtacaccaaaatcttttttcctcttc

SEQ ID NO: 14957 - DNA, 1055 bp, Homo sapiens
aagtaatgaactgctagataggagagaacctctgctttctgttgattctacactactttctgagataatttttacaagtgaataaattgaggatacagaactctcagtgctactaatgctacttgatatatttttttaggttggtatctaggaaaacgaaaattatttgttgggtattccttgtgaaataggcacaaagtgtgagctctctttctgaaagtgactattttacttgtttagacacttattagaatgactttaagaatgaagggaacatagtgataaatgacaagataatgcttgttatacatttacatgtagagagcacactctggtgtgttccgtagatacagaacattaagacattctttaacctcttagcatgcaggttgtaatgttgaaaagaggtgctgttggagatgtcatgtttacttctcaatgatcggagtattaaatgaagccttttatcattcacttttacagaggaagtgctcttcagaaaaggttgcgtgatagagaaaaggaaatggaagcagatgaacgagataggaagagagagaaggaggagcttgaggaaatcaggcagcgccttctggcagaagggcatccagatccagatgcagagctccagagggtaagatactgtaccatctggtcgggcgcggtggctcacgcctgtaatcccagctctttgggaggccgaggcgggcggatcacgaggtcgggagatcgagatcatcctggctaacacggtgaaaccccgtctctattaaaaatacaaaagattagccgggtgtagtggtgggcgcctgtagtcccagctactcgggaggccgaggcaggagaatggcgtgaacccgggaggcggagcttgcagtgagccgagatcgcgccactgcactccagcctgggcgacagagcccctgactcctgggttcaagcgattctcctgcctcaggtacccgagtagtagtacggattacaggtgtgtgccacctcgcctggctaatttttgtatttttatttttatttatttatttttttgagatggggtc

SEQ ID NO: 14958 - DNA, 1050 bp, Homo sapiens
cactcctggggatgagtctccctgtggtattattattcctcatgaaaactcaccagatcaacagcaacctgaggagcataggccaaaaataggactaagtcttaaactgggtacgttagcatttccttccttctttattttcttcccttcacccctgcaaatacctgtattgtgctttaaagaaaaaaatttatatttgtgcttggttaggtagatagaagattactaaaaaatgcctttctagctcacgattgttttcatagttttactagtgctcctatatctgcagctgcctcgagttctgagaagaagtgaaaagtttaattttctagcacttgtgagtagtgagttattttttacagttgggatctttctctaagatttgtggaagtatattttgcattgcttttgagggatggtgggttataaaatgaaacatttggaaattaagtcatcttgctaagagagtgtttttactgtaggtgcttccaatagtcctggtcagcctaattctgtgaagagaaagaaactacctgtagatagtgtctttaacaaatttgaggatgaagacagtgatgacgtaccccgaaaaaggaaactggttcccttggattatggtgaagatgataaaaatgcaaccaaaggcactgtaaacactgaagaaaagcgtaaacacattaagagtctcattgagaaaatccctacagccaaacctgagctcttcgcttatcccctggattggtctattgtggattctgtgagtaggaaattatatttcatcatattattgggaacagttggaatatgccatacaaattcatttgaagaaaaaaaaacctcatttgattctattaatgacaaataagtagggatgatcatcttgacaccaactcaatgccatggtcaagaaattagtaataatggaaattttttttgtgctacttgaagacttactaaaagcagatgattgtatcttgatacatatctgtcttagttcaacttgtgaaataacattatattttagtctcaggaaaaatcatgaagctttaa

SEQ ID NO: 14959 - DNA, 1074 bp, Homo sapiens
gttagtcaggatggtcttgatctcctgaccttgtgatccgctcgcttcggcctcccaaaatgctgggattacaggcgtgagccaccacacccggccactaaaacaaccttaaaatcttaactagcatttaagtaataagtgcttattgtcagtggatgaaaaacttttttatactggccactgtttttggcagatgttgatgattgcttctcttacatgtgttgctgttttgtttcctctttaggtacttgatgaagaagcagaagtttttatagtcaaaatgtggagattattgatatatgaaacagaagccaagaaaattggtcttgtgaagtaaaactttttatatttagagttccatttcagatttcttctttgccacccttttaaggactttgaatttttctttgtctttgaagacattgtgagatctgtaattttttttttttgtagaaaatgtgaattttttggtcctctaatttgttgttgccctgtgtactcccttggttgtaaagtcatctgaatccttggttctctttatactcaccaggtacaaattactggtatgttttataagccgcagctactgtacacagcctatctgatataatcttgttctgctgatttgtttcttgtaaatattaaaacgactccccaattattttgcagaattgcacttaatattgaaatgtactgtataggaaccaacatgaacaattttaattgaaaacaccagtcataaactattaccacccccactctcttttgatcagaaatggcaagcccttgtgaaggcatggagtttaaaattggaatgcaaaaattagcagacaatccattcctactgtatttctgtatgaatgtgtttgtgaatgtatgtgtaaaagtctttcttttccctaatttgctttggtggggtccttaaaacatttcccaactaaagaatagaattgtaaaggaaaagtggtactgttccaacctgaaatgtctgttataattaggttattagtttcccagagcatggtgttctcgtgtcgtgagcaatgtggtttgctaactggatggggttttctt

SEQ ID NO: 14960 - DNA, 1060 bp, Homo sapiens
ctgtcgaggcaactttctaaatgagagggtccaggttcttggttaaagaaggaacttagaattaacaaaatagtgacaaacatttgcggcagcgcgcctcagggcaccagctgcaggggtctgcccacagaccctgaccctgcgacagatgaataaagtacactgacacacagatagtctgttttgccagtccagctgagggtgtcccactgcttacagactccctggagagttctgaaaacagttgcaactaggcctcagtcagctagtgagacttgcatttattcaaaaagattaaggatggcttgagtcaacaccattagagggtaattgatattgtggacttcccaagtaaaaagcacttaaccccccgtggtacatccaagattagtcttaagatcatatgactaaacaaactaggtaaactactctgccttcctttattactactttaatttgtttaaaagtaaagatcaggttgccttcaaccatatctatcaccgaagctatgcaaacttctcggccttccaagaattgtatctgtctctgtaacaatctttaatgtttttcccaccagcctgattgaatcccaacacatattcagaacttaaggctagaacaagatgaggaagatatgacagcccgtgattttaagcaatctaaggaaacccatgcttgcaaagaattcaaatgacgtgagagctactaagataaaatgtggccatgcaccaagccttgacggcaatatttaatctcataacaattcttctttcctcctatataagaagcatggcagcgacactgtgcataaattaaggcaaactgttgttatgtgaaaatgttaatgaggtagattcctttggaatcattagtgtgaagagctggtttttgttttcccattgcctaggccctgactttagtagtgactgatgcagcttttctagtctaacaaccctctcccccaagtaattctttgatgccctgcccttcagcttcatcttttaccacttactattgggttttgccaccatttattttatcattcacttatctgttcctc

SEQ ID NO: 14961 - DNA, 1041 bp, Homo sapiens
cagctccctttgctggaaatcagaagtcattaagtatctttgtggttgaaaatgtttggtgtctcaggcggttctacttattgctaaagaggtctaccttgagcttatagtaaatttgtcagttagttgaaagtcgtgacaaattaatacattcctggtttacaaattggtcttataagtatttgattggtttaaatgaatttactaggatttaactaacaatggatgacctggtgaaatcctatttcagacctaatctgggagcctgcaagtgacaacagcctttgcggtccttagacagcttggcctggaggagaacacatgaaagaaaggtttgtttctgcttaatgtaatctatgaaagtgttttttataacagtataattgtagtgcacaaagttctgtttttctttcccttttcagaacctcaagaggctttgttttctgtgaaacagtatttctatacagttgctccaatgacagagttacctgcaccgttgtcctacttccagaatgcacagatgtctgaggacaaccacctgagcaatactgtacgtagccaggtacagtgtcagtctctgaaactgcctttgccagactggattcacttatcatctcccctcacctctgagaaatgctgagggggctaggcaggctttctctactttaccacatttataatatatttggtgaacttcagctgattgctggaggacacagggctgtttaacacataggtgttgatacagttcctacctaattcacatatcaccacctcagttgaagccttctccagcttcccaaggtgtgcagcgcctcatagttcatgttgtttattattttacctatcttgctcttattcttctacggctgagtccattttatttactgtattcattacctaacagttccttttagtgctcagtaaatattcattatgattgtacaatgcaaggataagtgtagaagttctaagggttcaaaggagggattcaggaaaagaacgtaatctgtgctgtcggacaaagagattcctcaccag

SEQ ID NO: 14962 - DNA, 1026 bp, Homo sapiens
gaaaaagtgcagttgatcgaaagaaatggtggtataaacaggaataacaggcatgttgtttcctctctgatttattatttttgtaaaataagctacttttcagcaccacatacatatgttctgagacctgaatatttgtgaccaaagagtaaagaagtaataaactttatctcgcaaagagttattattgtgttttatttaaatttactgccctcttacttcaagtacttctcagtagtacgtaatactgcttttaaaaaggagaagggatgaatttcttctactctgctcttcatattttgaaaagttcagtcaaatcccctttattaaattcatctcagagtaatctttttaatttgtagttcatatccgtgattagtttagaagtgacttctccctgtttctgctcactgtaggttgacaactgcttaaaatagtctatctcatcattatctctgcagctttcctttaaactaggaagacttgttcctataccccagtaacgatacactgtacactaagcaaatagcagtcaaacccaaatgaaatttttacagatgttctgtgtcattttattttgtttatgttgtctcccccacccccaccagttcacctgccatttatttcatattcattcaacgtctttttgtgtaaaaagagacaaaaaacattaaacttttttccttcgttaattcctccctaccacccatttacaagtttagcccatacattttattagatgtcttttatgtttttctttttctagatttagtggctgttttgtgtccgaaaggtccacttcgtatgctggttgaaacagctcaggagagaaatgaaacgctttttccagctctcatttactcctgtaagtatttgagaaggatattgaattagtaatcagtgtagaatttatcggaactgaagcacatgtaactatggtcattttcatggtacttgttctcatcttaaatgcacagcattcctggaactcctgcagatctctttgtttccttgcaagcaattgtc

SEQ ID NO: 14963 - DNA, 1045 bp, Homo sapiens
ttgtgcttcccatatcaaaatgtcagggttacagagtggaggttgttcacttatcatgggaatggcaatgttctgggctattctggagatatccaaagttataaggaaaagatgaagtagcacataggaagaagggaaagctcccatttggacagctgaagatgattgggaaataatggcaaaaacgaagtgttgcctggaattccctctttagttctagctgagccccaccatcttcaccgacagttggtttgtttttttttttagatggagtctcgctctgtcgcccaggctggagtgcagtggcacgatcttggctcactgaaaccgccgcctcccaggtttaagcgattctcctgcctcagcctccaagtagctgggatgacaggtgtgtgccaccatgcccagctaattagagatggggttttgccatgatgaccaggctggtttcaacctcctggtctcaagtgatccacccgcctcagcctcccaaggtgctgggcttacaggcatgagccaccgtaccggaccccttcacagaactttaaccaataaatttaacccacactaatctctctctctctgaaaagttttaaaagggtaccttatatttattgcttgttcttgaatcatttgtgtatattagtcttattgttcctaccatagtgttaattttgtgaaagttgggacaatggtttttttgttttgtttttttttgttttgttttttgagacagagtctcgcactgtcgcccaggctggagtgcagtggtgcgatctcggctcactgcaacctctccctcccaggttcaagcaattcttgtgcctcagccttccaagtagctaggattacaggtgccagccaccacacctggctaatttttgtattttagtacagataggatttcactatgttggccaggctggtctgaaactcctgagctctgatccacctgccttggcctcccaaagtgctggcattacaggtgtgagccaccgtgcccggccgggactatgttttatatgtgtgtgccgaacactctgag

SEQ ID NO: 14964 - DNA, 1047 bp, Homo sapiens
agcgacgctgatcctggagcccgcgggccgctgctgctgggacgagccgctgcgcatcgcagtgcgcggcctggccccggagcagccagtcacgctgcgcacgtccctgcgcgacgaagagggcgcgctcttccgggcccacgcgcgctaccgtgccgacgcccgcgacgagctggacctggagcgcgcgcccgcgctgggaggcagcttcgcggggctccagcccatggggctgctgtgggcgttggagcccgagaaagccttggtgcggctggtgaagcgcgacgtgcggacgcccttcgccgtggagctggaagtgctggacggccacgacaccgagcccgggcggctgctgtgcctggcgcagaacaagcgcgactttctccggccgggggtgcggcgcgagccggtgcgcgcgggcccggtgcgcgccgcgctcttcctgccgccggatgagtagtctgcccagaatttggtcgagctctgcgacccccaccggcccctttcctgtcctgggaatcgcgtgattgtggaacatccctgaacttgttccttcgctccagagtctgtcatggattctgagtctgggcgtccgctgttgcccaggctggagtgccgtggctggatcgtagctcacactgcagcctcgaactcctgggctcaagtcctctcgcctcagcctcctgagtagctactccagtctttcctttttaagtttcacgtccctccctggaggcaccaccactttagctatgtgctgaatagtgcattcaacttattatatatttattgagagccactatgtgccagccatgtggttttgtttgaatacgatatgggcaaaaccttaagctgatgtgcaagaaggatttttgcctcctttcacatcaaacttccaaagaagctaaaatccacagtattggcaatgccctttaattgtttaaaaacacacacaaaactgcctgacagtcctctcccttctatcataaacatgctgtacgtggttctcaacctgcaatgattagccgccctccctgggggaaattt

SEQ ID NO: 14965 - DNA, 1031 bp, Homo sapiens
aaaatgggtggagtttggctctggtattctcagtgggatgggatggagagggaaattacagcaagccgcttattctcccctcgtccggaaaagggtgggaaacgccatcgttagggcaaaggaattaagaacattattttatgaaaagggtagttgttagggggacgttttaaggtttttaactttaggcggacaagtcactacagatcagctgaaattgctttcggtcctgactactcctgtgcggggttaagacctaaggaagcaaaagggcagccagcaacagccggacgggaggaccccggcggccgccacgcagtcccacaatgccccgctcgcaccaccctgagggcggagagaaaggaccgctgccggggatagggcttccgccgagagcgccgagaagtgcgcacgcgcactgaccccgcgggccctagcaaccagagcagtgacagtagcaaccgccggaatggtgagtacctttcgggccgcgtagccaaagctgagagaagattgggagtggaaaagggtgactgtggagtgttgagggtctgggggtccttgaacagcggaagggagccggtagctgacgctagctctgtggagtcaggggcccgaggcgaaagagaagccctggccgggggtggtctgtggtgagggcggcctggggtggatcggaggttgggttaaggtggagggactcagacaggagaaaagggagggcgaagagcaggaaattctctaaaaagagcgtattggagtgggaagggtgatgggaaggagagtgtagataaagatatctctttacatagaagtaattttagtgacccccccgtcgagatgcagggaggggctggttaccagagggttctgtataacacggattgcagcagttttcgtaacctgtgatgtacccaggttgccttctgaatgactacgagggcagttattaggtgacactgtaaagcacactctgatggatatattagagcagtgattctcaaatttcagtatgcataggtatgggcttg

SEQ ID NO: 14966 - DNA, 1057 bp, Homo sapiens
gatcacttgagcccaggagttcaaggctgcagtgacctgattgtgccctgtactgcagcctgcgtaacagatcgagactctgtctctaaactaaaaaacaaactaaaaaaatagattttatggcatttcataaagctctcccacttctgtaacctccaacatgatattatttacagagtagacatttacttttttgttttcaatacttacaatggtttgttgaccttaaaaaatcataaattttaatagctgagaggaaccttaaagaacttgtccaacttcctcattttttccaatgttttttatggtggtgaaatatacataacataaagtttaccatctaaaacatttttaagtgtatagttcagtggtagtaagtagacttgcacaaccatcaccatccatctccagaactctcttcatcttgtgtgtctgaacctctgtaagcatacagtagcttcctactgcctcttccctgatccctggcacccaccattccactttccgtctttacgaatttaactactctaggtatttcatataagtagtatcatacagcatttatctttttgtgactggcttatttaacttagcgtaatatcctcaagtttcatccatgttgtagcgtgtgtcagaatttcctttctgcttaatttttttttttttttttgagactgagtctcactgtatcgctgaggctggagtgcagttgcgcaattttggctcgttccaacctctacctcccaggttcaagtgattcttctgcctcagccgccaaagtagctgggactacaggcatgtgccaccatgcccggctaatttttttatatttttattagagatgggatttcaccatgttggccaggctggtctcaaactcctgacctaaggtgagccgcccgccttggcttcccaaagtattgggattacagatgtgagccactgcacccagcccattcctgcttaatgttaaatgatattctattacggtatgtatataccatgttttgtttatccgtttgtctatcagtggacacttgggtcacgtccatctttt

SEQ ID NO: 14967 - DNA, 1149 bp, Homo sapiens
aaaacatttttttaagatgttaattgggttagtttgtgtgtaactttttacttgagatttcttttcatgaccattttcttctatgcttaatattcaaaatcattgaaaaagttatttaacataattttatatgttgtaccttttggaaacaagtatgatagtgacatttatcttttcagataacctactttctctttttccagctgcattccagtccatgatgacaggaggtaacattggaaagcagatagtttgcatttcagaagaaatctctttgtaattgctgtaaatgtcatcaaggcaatcatagatttcttttccattttgcatattttcaaagatatgttaaaaaatccttagactatacatagctcttgatttaaatgtgatcataggtgttatttttagttgcatagggtatttgatacaatcattaatggatcatacacaataggtttttaaaaattaataacttttagtaattacttttattaatttaaaatagaacgcttgagaggcactttgtaaagatttgttaaactggaaacgttttacatgatctgatacaaccattaatgaatcatacacaataggttttttaaaattaatattaataacttttattaatttaaaatagaatgcttaaaataaaatagaatgcttgagaggcactgagtaaagatttgttgaactggaaatgttttacatgattcttaaactgaaacttggtgtaaaaatagaattgagatggcctttttttcacattgtagactgaaaagagacttaatggtatgatgtgtacatagggactgggggcaggattgggggtttcggagcttgtgtaacagtttttgggataggagaccagcggttttgggttgggattagtatgggaagataaataacttaggttggttaagttgacaagatttactccagaggatcatctctttgtatttgccaaataatttactgtatagcctaaaaactccatatatattgagaaaagcatatgtttattttaggttagcaggcacatactgtcaagttgtaaagattgagagggcaaacagatgtaaacatcacttgtaggtgattaaaaagattgacagccgggcctgatgtctcaagcctgtaatcctagcactt

SEQ ID NO: 14968 - DNA, 1034 bp, Homo sapiens
tacaaatatttagtacctaccagttgcttactgggaagcttgtatggaagccctttaagctcatagtaaacacattagaagtgggaagtgaccgttaatgggcacagggtttccttgtgaggtgatgaaatattgtaaaattgatcgtggttctgcttgtacaactctgaatgaactaaagatattttaattgtactctttaaatgagtcaatagtatggtatgtgaacgatatcttagtgaaactaatttttaaaaaagatttacattgcagttttggaaatctgttgagtaaggaattgggaataggaatgtttaattgtgtatttgccgttacacctatagctaatgtacatagtacgttgctctgttaaagatgagatccccacagtacacttgataagatactgagtgctctagtacaaattcttttgagttcagttgcatatcttaatgcatcctgctattttttattttattcataccgtacacatacaaatcataaacttggacacaaaaattgtatggtagtacttagttataatatgaatacccagtgcttgagaaaatgctcgtgttaatttttaaagattattgaagtgaaaacactgaaataaaaagatgtcatagataacataaaaaggacagtaaatagttgtctggttcctcagagattttacaatcctggaatctcaaagttggaggaaccttaaggatgacttaaacaacaaacatctgataatttcttggcttgttaagacaagctggaattggggaagaggaattcttgttttttttgagacagcctccatttgttacccaggctggagtgcagtggcgtgatcactgttcagtgcagcctcgatctcctgggctaaagcaatcctcctactcagcctccctagtagctaggaccacaggcatgtgccaccatgtgatgctaattgaaaaatttttttttgtagaaatagagtctcactggctgagatcgcgccactgcactccagcctgcgtgacagagcgagactcagtctc

SEQ ID NO: 14969 - DNA, 2032 bp, Homo sapiens
gatccctgtattataaggttccctatgaacctttcactttcttttttttttttttttttttgagacagtattactctgttgtccaggcgagagtgcagtggcgtgatcttggctcactgcagcctccgcctcctgggttcaagcaattctcccgtctcagccacccgagtagctggtattacaggcgcgtgccaccacgcccgactaatttttgtatttttactagagacggtttcaccatgtggccaggctggtcttgaactcctgacctcaagtgctctgcctgccttggcctcccgaagtgctgggattacaggcacgtgccaccacacccagccaacctttcaccttttgatttcattcctaaatgatacctgaatctcttatttcataaaggattgtaaaatggtggtttttcttattcctttactcctttcacattagttggaattcttctgtactgtgcgactctttagttggactcttccactaatatcaagtagggctatttgatcatttgcataggcaagacaggataaatatgtaattcttttaattgtgaattttgagaataaggaattgatgctctagttacttctagtatttcatgtttgatgctatttcaaatgaaatgttttcttgattttatttttgagttgttcattggtagtatatagaaatacaattgaattttgtacattgatcttgcaaccttggtaaatgcttgagttttagtagtttcttttttttttttcttccagctttttagttcaggggtacatgtgtaggatgtgcaggtttgttacctaggtaaaggtgtcccatggtggtttactgcacagatcatcccatcacctagatattaagcccagcatccattagctattcatcctgatgttctccccctcctcctacaccccatttttttttttcttttctgtttatttttttagagacaaagtctcactctattgcccaggctagagtgcagtggcaccatcatagctcactgaagcctttgaactcctgggaacaagtgatcttcccacctcagcctccccagtagctgggactgaggcagaaatttaaaaataaatatgcattcattcactccaagaaaagtaacaggcaaggcaagggttaaaaagaaaagaacaagttttcctctgcctagcaagctcacttcaaggacagttataagataacgctgtttgagaagccaaggccaaaggaatggactccagacaccccctcttccagagcaaggttgaaggaaaaaaaaaggaaagacaaattcctttactgttactcctttccctggcttcttaagcataactgtgttttgcaaatgtctgtatttagccagttcttatttttctttcaatgcagctataaggtcaccagctatgcaaggccacaagttatgctatgctataaagtatgtgacctgtcatgattaactgcttttgttttacttttgtaagtccgcttacaaaaaccccactccgtctttgtttaatgctcagctttttggatgtgaatccactgagctggtgcgtacctaaaataaacaatcctcctgttctccgtatcagtctctccagtcctcagtttcctgcaataggactacaggctcacaccaccacatctagctaatttctattattttgtagaaatggagtctttgtgttgcctgggctcgtcctgaactcctggcctcaagtggtattcccaccttggcctcccaaaatgttgttgggattacaggcatgagccaccacacttggctgagttttagtagtttttaaaaaatagatttcttagtgttttctacataaaagatcatgtcatctgagagtaaagatagttttgcttctgcctttccaagctagatgcctttaatttcctttctttcttgcttttttttgagacatggtctccctctgttgctcaggttggagtgcagtggcatgatcatggttcactgcagccttgacctgggcttgggcagtccttccacatcagtctcccg

SEQ ID NO: 14970 - DNA, 1028 bp, Homo sapiens
agtgatacgagattttctggtgactgatgagacagctcctccagtactttcctggggcttgcaggctgttctagagatccttctaaaccctgctctggatctctgatgctgagttttgtagtttcttggaacctgcagaataaattaaaacatgaaaaacaaaaaaaatttttttttcagacagggtctcactctcacccaggctggagtgcagtggcatgatctcagctcactgcagcctggacagcccagctgaagcaaccctcccacctcaagcaatcctcccaccttagcttcccaagtagctgggattataggcacgtgccactgcacccagctaattttttttttttttttaactttttgtagagacagggttttgccatgttgcccaggctggtctcaaactcctgggctcaagcgatccacccacgtcagcctctcaaagtgctgggattacaggcgtgagccaccgtgcccagtctgaaaaaagaaagtcttaaagcactgtgtaaggtttaagaacggtctctcccagcactttgggaggccatggcaggtgaatcacgaggtcaagagatcaagaccatcctggccaacatggtgaaaccccatctctactaaaaatacaaaaaatagctgggcgtggtagtggacacctgtagtcccacctactcaggaggctgaagcaggagaatcgcttgaacccgggaagcggagactgcagtgagcagagactgcagtgagccaagactgcgccactgcactccaacctggcgacggagcaagactccgtctcaaaaaaaaaagtctcaacattattactattttatatgggatgtaaaggaaaatttctaggggtataaaactgagataggaattagggtaggggctgctaggatttaagatacaaaacaattgagaataatggagagaagatactattttctccctttgactcaatatcaaaatgggttatggagggccgggcgcggtcactcacgcctgtaatcccagcactttgggag

SEQ ID NO: 14971 - DNA, 1024 bp, Homo sapiens
tacggcaggctgttggaatccagaatgtgagctggaactatgaccagtctgctgttgtggctactctgcatttatcagaggtaagatcctgagctgccatctggggactttattcataggcactaggtacttcacagagaaacttttctcctctctgttgcaggccacagaaaacaacgtagcctggcagagatttcttccctctgggcctattgctctgctcccggtaagaggtccttctgaccagtccgcccacatgcatgcaagcctttcctcttcactttctctcagcctttttctggtttcaagggaatctgcccaggctgtttgtaagttccctttttgtctttttatgcttgagagtttccaagtgcagcagagtcttagccgttggtattggtgttcttttgacacagctctcagacaccttgagttccttggtttggtccacgtcccatgaacatgcagcagagctagttagcatggatgaggaaaaatttgtggatgccgttaactctgcctttgtgagtatcaatttacccagctgatgatgtgctgcagggggagatacagaaaggtgttgtttttttttttttgaaacggatccttgccaggctggagcgcagtggcgcgatcttggctcactgtgcaatctccgcctcccgggttcaagcgattctcctgcctcagcctcctaagtagctgggactacaggcacgtgccaccatgcccagctaatttttctatttttagtagagatgaggtttcaccatgttggccaggctggtctcaaactcctgacctcaagtgatctgcctgccttggcctcccaaagtgctgggattacaggcgtgagccactgcacccagccagaaaggtggttttgagtcaggaaaaaggagtaaccagtcagctgtccctttctactttgtaactataatgcttggtctagattatgtggaggagtgtacacacggaaatgcaaaacaatagaaataataaataataaccttttgagggttgt

SEQ ID NO: 14972 - DNA, 1044 bp, Homo sapiens
aagtaaggaagaccgtaaatgacaatctccgtacagtgatagaagtatgcataggatgctgtggaagcatacaggggggaaacacagagaaagactggaggagttaaaaagaggcgacgtcttctggatgctctgagatgttatcctaatgaaatagagacgggcattctaagcagaggagagtcatggaggtagaaggatactgtgtgatgagctatactgtggctggtgcgtggttattgagggtggggactagtgaaaggtgaagctcagaagtaggcaggggccagctcatgtacagtttggctagatcttaaaacctctggggagtgatgagaagttgctttgcacttgaggggcttatcacttgtcaagatcagtgtaggcaagttgggtagcattagcctaagctttggttacaaacaaggtttctttattgaatttttaattccctgctactcacatttcaccttgtttgtcttgtggctgatgctgctcagtggagtgatgctgaccacacggacttcatcgacacagctggtgccatgctgcagtatgctgtcagccttctgaagcccactaaggtctcggctcgccagctgcccccaagcgtagccagggtggatgccaaaagccgagttctgtttcctcttgggttgggacatgctgctgagtacgtcaggcctcgggtggcgctcattgggtaagacgataacagagcagggccactcccttctcactttgctgccagaggtcacacctgaactctgctttattcttagggatgcagcccacagagtccatccgcttgcaggacagggtgtcaacatgggctttggggatatctccagcttggcccatcacctcagtacggcagccttcaatgggaaggacttaggtaaggattcagatactatggggaagtatccagaggtcatatagttaggcaagatcagggcccacagtagcaagagggagtggacataaaatatatctggcttgctaggagatggaagaaaaccttattattggattagggattta

SEQ ID NO: 14973 - DNA, 1020 bp, Homo sapiens
tctctctattgcctggtctagagtgcagtggtatgatcacggctcaccacaggatcgacatccgggctcagatgatcctcctgcctcagtcttccaagtagctgggactacaggcacgcacctccatgcctggctaattttttgtatttttggtagagacagggtttcgccatgttgcccaggctggtcttgaactcctgagctcaagtgatccacccgcgttggcctcccaaagtgctgggattgcaagcatgagccaccatgcctggctgatttttttgtagtttttgtggagatgggatttcgccatgtcgcccaggctagcctcgaactcctgggctcaagaaatcctcccaacttagcctcccaaagtgctgacattacaggcatgagcaatagcacctggtccagaaatttctatctttattttattttattttttgtatttttagtagggacggggttttggcatgttgttggccaggctgatctggaactcctggccttgagtgatccgcccacctcaccctcccaaagtgttgggattacatgcatgagccacaaaacctggccaatttttatttttaaaattactcttttaatagtaggtattattaaattgccctctataaagtattgttctaaagtaagtttttttagtcaaccatagaaataatttccaaatgtgttacttagatgctttgttttgtggcttgtaatagctcattgttattggtctacatcagtatcacttgtacttcctgattctcatctgcctccttatatcaaagggcagcatctggcagtaacaggtgggtaatttttataatcatggattgccattaaaccaaaagaaacaaccttgggaggaagaaacaaagtagactaaatatatcctcattaactagctttcccatagttttgttactcattttgctatatactagaaaaatgttatgttgttaaactttgtttaaactgtttatagtcatgttaattatagaaataatagaaatgaaa

SEQ ID NO: 14974 - DNA, 1043 bp, Homo sapiens
ttttttttttttttgcagaagaatgccaattaataaatttccaaggagtgatggagttagaaaaatcaccatttggcatcacagtaataactgaatcagtcaagaatcatcaatggatgctaaaacctactgggtgaaagtttgatgaggaggataattgcatagtctcaaaagattgtaccacaaattacttaataatcacagaagaaaaaataataacttttaggtggagaaagtgggcagacacaaccttaaccaactggttaaaattagcatcaatcacctaatgatgtgatgtactgaaaaggatacatcatcacttaggtactatatataacctaccaaaaacatacaacctgaatctactcatgaagaagcatcagctaagcccaaccctggccagtattctttttaaaaagtcaatttaaaaacaaagaccaagaaactgttccagattaaaggggactaagacacatgacagataaatgcaacgcatgatcaagggttgtattgtagacaagaaaaataaaaaattgcaataaaggacattattgggataattgtagcagaatttaaatatagagtatatattacatagtagtatattaatgttagacttcctgatctttataattttatagtgcttgtaaaagggaatgccctttttcttcaaaaatagatactgaaaggccaggcacagtggctcatgcctgtaatcccagcactttgggaggctgaggctggtggatcacctgaggtcagaagttcgagaccagcctggccaacatggtgaaaccctgtctctacaaaaaatacaaaaaattagccaagtgtggtggcgcatgcctatagtcccaggtacttgggaggcagaggcaggagaattgctttagcccaggaggcataggttgctgtgagccaagattgcaccactgcagtccagcctgggcgacagagtgagactctgtctcaaaaaaaagaaagaaaaacaaataaggaaatagatactgaagtcttctggggtaaaaggtcatcttgaaatt

SEQ ID NO: 14975 - DNA, 1034 bp, Homo sapiens
ggttgaagtgcagtggcgcgatcttggctcactgcaacctccgcctcctgggttcaagcgattctcctgcctcagcctcccaagtagctgagattacaggctcatgccaccatgcctggctaatttttgtatttttagtagagacggggtttcaccatgttggccagaatggtctcaatctcctgacctcgtgatccacctgcctcagcatcccaaagtgccaggattacaggagtgagccactgcgcccagctggctactgttattttttaaaaatataacaatagtttcattattataactacaatttttttaacaaacttgttaaatatcatcaaatagccaatcagggtttagatttctgtagttgactcataaatgcctttatacagttcattttttgagtctggatctaaataaggttcatatactgtatttgatatgtctctgaaatcttttttagcctgtcatacttccacctgcattttatttccccttgtcatttgttaaacctagtcatttgttctgtagatttttcaaaatctgggttttgttgattacattcctgtggtagagcttaacatgttcacctatcccttttttatctgctgattgttagatctagaagcttgcacagatacaggcttgattttttttttttaattttgataagaatatttcacagttggtgttgggtacattatgtgtgctggtctttctttttgtgatactaagattaatagttgatggattctagatctaactatcaggaaataaaaagggataggtgaacatgttaattaagctctaccacaggaatgtaatcaacaaaacccagaatttgaaaaatctacagaacaaatgactaggcttaacaaatgatggggaaataaaatgcaggtggaactatgacaatcagatttattcattgtaatattcttcatcagtcttatacctagagtagcaggctttgatcacagtctagatttactgttttattataggttgcaaggtagtaatattctgtcatttct

SEQ ID NO: 14976 - DNA, 1040 bp, Homo sapiens
tctccactggaatttttgtttatcatgtaaccagtaacaatattctcatattcccatgagaagaggttgaggaagaaaagaattcacactagtaatgtagtattttatttctgagatgctacagctttgacattattataacccaaattaaaagaacaggagtgtcattaaccaaaaaggagaatattgctaaacggaactgtagtaaaatttaaaacttatgttcaaattggagatattttattatggattgaaaatcagataattgtattgtgttaaattttttgagtttgttaattatattgtagctatgtaggagaatatccttgttcttaggagacaatgctgaagtatttagggatgaactatcatggtgtctgcagctagctctcagatagctcaggaataaaacaacaaaatttaaaaatataaatagatgaagcaagtgtgtaatgttaacagttggtgagcaggtgaagagtatatgattattcattgtagtattctttgtttctattttatttaaaatatgttaggatattttaggctctagaaaatttcactggacacttgtgagagtatgagtgaaaagagcatcttagtattatacaaataatttttacctgtccgggtgcagtggctcacacctgtaatcccagtactttgggaggccaagatgggcagatcacttgaggtcaggagtttgagatcagcctgaccaacatggtgaaaccctgtctctactaaaaatataaaaattagctgggtatggtggcaggcacctgtaatcccaaatacttgggaggctgaggcaggagaattgcttgaacctgggaggcagaggttgcagtgagccaagatcatgtgctacggcactccagcctgggtgacagagtgagactctgtctcaaaaaaacaaaacaaacaaacaaaaacaaaaacaaaaaccagttttgacctagtggacccccaaaagaagtatggcgagcccaggatctgcaggtgttccctgaccacactttgagatttgttgccttaga

SEQ ID NO: 14977 - DNA, 1100 bp, Homo sapiens
gcaaagatactcaacatcattagtcgttagggaaatccaaatcaaaaccagggtgataccactttataccctctaggatggctataattaaagaaaccccaaaacaaaaacagaaagtaacaggtattggcaaggatatggtgaaattagaaccttcatacattgctggtggctatgtaaaatggtatactccctgtgggaaactggtatttcttcaaaaggttaaaaggtagaattgccatatgcccagcaattccattgctaggtttatacccaaaagaattgaaaacaggtactcaaacaaatgcttctacacaaatgttcacatcagtactattcacaagagccaaaaggtagaaacaacccaagtgtccatcaacagatgaatgaataaacaaaatgtggtatatccatacagtggaatattattcagccattcaaatgaatgaagtactgatgctacaacatataaataaatcttcaaaatattatactatatgaaggcagttagacacaaaaggacacataatgtgtgatttcatttacatgaaacatctagggtaggtagatccagaagacatgaaaaggcagattggtggttcccagggcctagagaaagtgtggaatggggagtgactactttatggatttgggatttttgtggggaaggtgaaaatgttttggaacttgatacaagtggtgattgcacaacattgtgaatgcactaaatgccactgaattgtatacttcaaaaatgtgaatttcacctcaatcaaaaactagctagtatggtgtttgacacctagcaagctaccaataaatttaaaatattattacatagtgtcacctttatcagaaatttagcttcgtgaccttggtcatcaatttcctgagctgaaaaaatgaagttgttggaatagaagacctctaaggtccttacagcattaaaattctactatattaaggcctagtgtttctaattcatacagttaatatttattatgtaacttcagagtactatgctaggcagcaaggacttagcagtaaataagacagatatagttcctgctgtcataaagctaacattctagtagataagg

SEQ ID NO: 14978 - DNA, 1075 bp, Homo sapiens
tagctgggactgtaggtgctggcatcacacacagctaattaaaaaaaattttttttgtagagaaggcaggggttggggggaggtgtctcactgtgttgtccaggctagtcttaaattcctaggctcaagtgatcctccacctttgcctccctaagtgctaggattacagatgtgagccactgcacctggccaagaacagatttctgatactgatgatgcagttaagaaaactgtgaaattcaagccatataaaacctatactgttctagtgtagttggtttgtgtgtgtgtgtgtgtgtgtgtctgtgtatgtgtggtttttttttttttttttgacaggttcttgctctgtggtccaggtagagtgcagtgggataataatcacagctcactgcagtctccaactcctcccacctcaatctcctgagtagctggggctacaggtatgcgccaacatgcctagctaatttttaagtttttttttttttttaaatagagatgaggtctcactatattgcccaggctggtctagaactcctgagctcaagcgatgcttctgcctcagcctcccaaagtgttaggattacagggcggagccaccgctcctggcctctagttgttttaatctgtctttttacattggcttttgttttctaaatattgtcctccaagctattgtatgtttagattgcagaacaacttgtaaaatgaatacttgttttaatgtgcattatttaaaatgttctgagtgaagctaattgtcaactttataaggagaattgctctgtgcccaccacttagtatacaataaatcaagtaatacattcttaactgttgtggccctttttttttttttttttttttttgagatggagtttcactcttgttgcccaggctggattggggctcactgcaacccctgcctcccaagttcaagtgattctcctgcctcagcctcctgggtagttggattataggcacccgccaccacgcccggctaattttttatatttttagtagagatggagtttcaccatgttggctaggctggtctcaaactccttacctcagttga

SEQ ID NO: 14979 - DNA, 1035 bp, Homo sapiens
ccagcctggccaacacggtgaaaccctgtctccactaaaaatacaaaaaagagtctcagaataagagaatagtcgttaaaaccttcagaattattattctcagcctttagtgtggatgtattgtgtaatttttaggaatgacactccattaataataatttctttctagttaagggttaagttctgtatatgcgtttttacattttagccctttataagaagcatatggggtaatacttttcccccaaaagttaaagcatctgaatcttcagaagataactgtcacccttttacccattgcttggaagtggattgtgatccttgatgtgagagattctgactaaaaaataaatatagtataatcagcttttatttactcattaacaattcttatgcattattggcattactggttaattctgatacttccaggtactgtgctttgcactagagttatttgctcagaaagagtatgctgatattaacatgaggatatcacaaagtaggatttcttcagtagaccaaaaaaaaaaaaaaatggaactttagatttttgagattttaattgctgtggtttttcttctcccttggatttaatttacctttttcttcctagtaaagaaaaggatagattaaaacctaaaaagaaagaaaagaaggatcccagcgcattaaaggaaagagaagtgtgagtaatcaaacgtttgaagttttcctttaaaaccatagacctcttagaaatccaggctttccctgagctggtttgctaacttatttgttagtaagtctagcacaactatgtagatgaaagtcatatcgatgagcatatatcaattctagtggtttgaaggttttgggattttatggagcagtaaaatttcccctaaaatcctggagatattatctaggattattaactttttctttgccagggatcttttaagagacataagtgccattgtttaacacaccagcagttcataaaagagagactgtatcaccaaaaaatatttaaaatatattttcagaataaag

SEQ ID NO: 14980 - DNA, 1048 bp, Homo sapiens
acttggctgagctaaactccatttcccaaaattccctttctctctcttttttttttgagacaaagtctcactttgtcacccaggctggagtgcagtggcaccacctcaggctcactgcattctccacctcttgggttcaagtgattctcctacctctgccttccgagtagctgggattataggcacacgccaccatgcccagcttaagttttctattagtagagacagggtttcaccatgttggccaggctggtctctaactcctgacctcaagtgatccactcgcctccgcgtcccaaagtgctgggattacaggcgtgagccaccgtgcctggcagtctttcccatatgtttctgattaggttgggtcacagggagattttcacacctaacatgagacatttattgctggacaaccaaaaacattctctttccccagaaaagcacacaaagtcttttttttttgtctttaagataatattagttcatccttctccacctgattcacactccctctttcatgttctgtaacttaaatactgaaatataaggttaactcttattaacacatgttagataataaggaagaaaactaatgaaccaaaaaatatttggttaatacacacacacacacacacacacatatttaaacacaaatatatcaaattaaggaagaaatatttgtaactattgtagtccatatttctgcaatggtcatgtggtcatagctggtatatatgttcttccactactcattccatattccctttgctctaagtaagtacttcagccagttcggattccttgcctcatggggtgacccaggctttcattcttgaaagatatgggctattagcagttctttctgaattacttctgctgtttgcagttctacaaaaccctttgcaattttccgtggacttgaatctcaggacatgggaaatactaagagatgtcctagaggatctcttgcatttcagacacacttcacttcacctgtattgtgcaatagtcactcaaattcctcttgaaagttagggtcagttat

SEQ ID NO: 14981 - DNA, 1926 bp, Homo sapiens
caaagcagaatggaagacacacgggataaaggtctagtaaacagaggtcgcggccaggcaatcagtcgaggcccaggattggtcaagcaagaagactttcgggataagatgatgggtagaagagaagatagtcgagagaagatgaacagaggagaaggtagccgggacagagggttggtgaggcctggaagcagtcgggagaaagtgccaggtggtcttcaagggagccaggacaggggtgcagctggcagccgagaaaggggaccacctcggagggctggcagtcaggagaggggacctcttcgaagggctgggagtagagagagaataccaccccgaagagctgggagcagggagagaggaccacctcgagggcctggcagtcgagaaaggggactgggaagatcagattttggtcgtgatagaggtccattcagaccagaaccaggagatggtggggaaaaaatgtatccatatcaccgggatgagcctcctagggctccatggaaccatggagaagagcgagggcatgaagagtttccattagatggtagaaatgctccaatggaacgagaaagactcgatgactgggatagagagagatactggagagaatgtgaacgtgactatcaagatgatacactagagctctataacagagaggacaggttctcagcaccaccatctcggtctcatgatggagataggcgaggcccttggtgggatgattgggagagagaccaggatatggatgaggactacaatagggaaatggaaagggacatggacagggatgtggatcggatttcaagacctatggatatgtatgatagaagtttggataatgagtgggacagagattatgggagaccactggatgaacaagaatcacagtttcgtgaacgggatattccatctcttccacctttaccgcccctcccacctcttccacctttggatagatatcgggatgatagatggagagaagaaagaaatcgagagcatgggtatgatcgagatttccgtgataggggtgagttgaggattcgagagtatccagaaagaggagatacatggcgggaaaagcgagattatgttcctgacagaatggactgggaaagagaacggttgtcagacagatggtacccatctgatgtggatagacattcccccatggcggaacatatgccctcctcacatcattcctcagaaatgatggggtccgatgcaagcttagactctgaccaaggccttggaggggtaatggttctcagtcagaggcagcatgaaatcattttgaaagctgcacaagaactgaaaatgcttcggtaagttgactccttcagatcctttcttttaataaaaaccacattcagactgctctttttaaagtgatatgatatatttgaatggaatcattttacttcaagttcttatcacatacttttaatttatatttctggtcattcagtgctgttttagggttagaatgggtatttaggaactgtgttaatgataaacttatgccctaagatgtgaaaattgattgctgtcttggcctttgtagaagtgttgctggcatgccatgcctgtgcatgtttcaagtgtcaaacttcaacttttcagtgctctggatttcacagggttcatgtgtaaccttcattttttccagtaatcagtttgttctttggtattagatctgatagactttatattcactaatcattgataaaactttggaaagtgctgtatttttctttgttgaagctaagaatggtttgcttaggagcatcctcagatttgtcttaactattgatactttcttttggggatgttttatctttcattataactaaaagcagatatttctccttgaggatgttatttgtttctacataaccaaatgttttctttgtgaaatggaaa

SEQ ID NO: 14982 - DNA, 1033 bp, Homo sapiens
aacaataacaaaagctaacatttattgcatgcttactccgggccaggaactgtactaagtgtgttgtgtataataaactcatttaatccttaaaccagctgtatcttgggataggaatttagaagtcagtgacagattgaaaacttttttaaagcaatttttttgagaaagtcaattaatgattaggttttgataaattccaatgtatttcttccatttttcaattctggtttacatttgtggatcttaacaataaattataacttaaactttagaactaggaaagaaaaatacggtgaagaaaaggtaatgatgaaagaccagatacggcaggtttgtatggtctatagctaagaggtttattttttccagattactcatgaagaaaatgtggaaagcatgctatagaatatttagctactacactattcacttttaagttatagacacctttaattttaacacctaccgtgtaactgggcacttgctaataattgagtgtatattatgtcagtctgtctatctcaaaggcctgcaaagataaggtagtattatccccacttcacaaatgacactaaagttcaaagaggttaagttcccttggctagtaagtggcaaacccggcctttgaactcaatctgtctaaaactctaaaatctgtgttatttatggagaataccaagctgattggtgttgttaagctgccaaggtttctttttttttcctttttaaatttctttttaattcgttattgctttgcatggtaatgctggataaaaggtgctgctgctgcttcatccttttttaaagctttctaggcaacatgaacataattaaacaatatatagggagtgatggataatgtcatagccgaatacaagtcgtttatgttgtgtcagtgtaaagtcgtaaggagtatcataagggatgtgatgatgggatttacctgagcagtaaataatcttacacacttgacccttactttgtggtccctcatttgtggaccctcatttgggtcactttaatgtaagga

SEQ ID NO: 14983 - DNA, 1035 bp, Homo sapiens
agcaagaccccgtctttaccaaagaaagaataaaaataaaatgtatttggcaactgggtttcaatattgagtagataggaccaatttgctaagaagtcctaccatctccatcatagacatttctgatggtaactggtgatgctttgggaaaacaaatggaaggagggcacacaacagtggcactccttagattactagatgttcatttagtttattttgttgtttcatagtactcatgttctctgttggtctcagcttcaccacagatgactattgtcaaccagataactgaaaggaacagaagtgtggaggctatctaggatttctctcactgaaaatttactgtttttgtggaggagataggtctctagagtaggaagatagttcttatttatttattcatttctctccttcctgcacactgagcataggaagatagttcttaaccgagggttataaatcagaattattcatggagggtttttttaaaattttgaattactggtgggaccccacctacagaagttcagtagatttggtattggcctgggacatttgaatcttacgtggctaccaccctaatttggagtatggaaattttaaaacgttttcattacccctgtaagatcactgcaccagtttacagttagttaatcctcattcctaccccagtcccagcactttctgtctatatagatttgcctttctgggcattttgtataaatgaattatataatatgtagtcttttgtgtctatcttcttttcaaagtttacccatgttgtagcatgactcagtacttcatttctttttactgctttttaaatttctttttatttataacctgttacatgaatataccacattttgtttaaccattcaccagttgttggacattagggttgttgaatagtacggctatgaatgtttgtgtgcaagtctttggatggacatatgtttttatttttcttggatagataccgagaaatgaaattgctgagccatatgataaatttatgtttggccgggtgcggtg

SEQ ID NO: 14984 - DNA, 1034 bp, Homo sapiens
aaatgactgttggatttattagtataaaactcaccagagagatcagactgaactaacaaatttcaggaaatggtatttaaaaccgtgggactgaatgatcttgcccaaggaaaaagtataaatggaaaaggtaataggacgccagacctccaaaatttagttcagatagaggtgtttcaagaaggaaagagtatagtcagtttttaaatgatgcagaaaagacaagtaagtttggaacagataaatggctgctagatgttggcaacatggaggtcactgatgattgtagtttgtcatcagtctacagtgatgaggcagcagaaaccagtttggagcagattaaagaatgaataagaaatgatgaagtacagtacagcatatataggcaactttttgaagttttgctgtgaaagggaatagagaaatgaagctaggatattagataggtctttacataaatgttgaattcgatagtgatagatgtgtatatcctttaaaacaaaataaagcaaagggatcgtattatatatactgttgtgtagaagtctttttcagctaatccatcttgatctttctatataagcatatacagaactaccattctttttaaagggctacttggtgtcccattgtttggttgtacaatcagttatttaactagtccctttgtgttagtccgtttgcgttgctataaaggaatacgtgagattgggtaattcatgaagataaaaggtttattttggctcactgtcctgcaggctgtacaagaagcatggtgctagcatcagctcctggtgaggcctcagaaagtcttcaattatggtggaagacaaggggggagccagcatgtgacgtggcgagagaggaaccaaggggagggggtcccaactccttttaacaaccagatctcacatgaactcagagtgtgaactcgctcattaccgtcaggagggcaccaagacattcacgaggatcctcctccatgacccaaacaccttcagtatcggggattacaattcaacatgagatttgaa

SEQ ID NO: 14985 - DNA, 1032 bp, Homo sapiens
ttagagatattaacaaaatacaatagtttccaaaatattttaattccaacttcatttgttttttgtttttttgttttttatttttgagacagagtctcactctgttgcccagcctggagtgcagtggtgattttggctcactgcaacctctgcctcccaggttcaagccattctcatgcctcagcctcctgagtagctgggattacaggcacccaccaccacgtccggctaattttgtttgtatttttagtagagacggggtttcgccatgttggccaggctggtctcaaactcctgacctcaggtgatctgtctgctgcagcctcccaaagtgctgggattacaggcgtgagccactgtgcctggcctaattccaatgttaaaatcttgaacatttattcgcaaacatactactcatttcaaaaacacctacacattttttcttctaatcctatattctttattttatctgagtttaaaacttagaatttaaactgtagatttaaaagtagcaaggtgagattgatcagtatatttaactatgtgctgaggttgataagtatatttaactatgtgctgaggatgccgtgggaatggatttaaatttgctgtgggctgtttactttttctttattcaatgagccttaccatataaggggcaaactgtggccactgaacaaagaaaaagtaaccagcccacagcaaatttaaatccattcccacggcatcctgagcacagtattgtgttttcacataaatgcccaagacttagttcgtaatgatctttcgctaaaatgtgtatccttgatccaggtggagctgagagaatatacatgaattaaatttaattaattaattattattgaggtagggtctctctgtcacccaggctggagtacagtggtgtgatcttggctcactgccacttctgcctcccaggctcaaacaattctcccacctcatcctccctagtagctaggatttcaggcacccaccacacaccatgcccagctaatttttgtatttttagta

SEQ ID NO: 14986 - DNA, 1019 bp, Homo sapiens
attgcttattggcctacaatacatttctgtgtactgacctttctcagcagcctttattatgtagagtgaagatatgtcgcaaaaatagccaaatagaattattgtttgtacaaagactcatttactactttctaaagccacccaatgcctattatcaaaaacaaaacttccataatgtgttctctagttcagatgaaatggaggccgatatgttcttctgcaggatgctttatttcagttgtccttaaccttgtgatgttctgacagtagttagaatgccaatgaaatgagtggtgattatccgtgagtcacttggaatcatgggtaattttgcatatgtgtgttttcaccttacagccatggctttatgtctgtgctcttataccagggcagggtgggaagctggggaagagttaacatagtcagaaacggcctctgccaattttcagaagatatagattacgtgaccttagagaatgaacatagagtgctcctactttagaaaatgggtataacaaccttcatgcaaggagattaatgaaaaaagatttggcaccaaaaagagtaatagagacagccagctgataattgattttgctagtccaatgtgggacttaacaaaattcttgcacttacattactattagaagcagtatcgtataggaagcccaaggtatcttgaagaagaaatttggtgtgggtagaaaatgccttgataatacaaatattttaagtttgttaagaggtgtcctggaaatgcagaggactaattttggattccattatttgctagcattttattttaattttattaacattgtcttctcttagaaagttgctggtttaaatcatatgagttttattttaaatcttttgtggtgtcatgttacttaaaataatcttatgttgggaaaggtttctgataccttggtgggtatttcagctttttttttttttttgtcagctctgtaaaggatgatttcagacattttaaactgaaagtgaaatctctcacttaa

SEQ ID NO: 14987 - DNA, 1032 bp, Homo sapiens
acctcagtgactgatccattctcagttttcaggtccattgctttcacatttgaaatagtcaaggagcatctttatgactggggctgagcttctgcattcatgtacagccctctgcctgccagcagtgccttgcatttgtgatcctacaaagagcctgtggacttaatggtttactgtatagggaaaggcttgactttgtgtcttctacttaagaagcttgaactttttaccaaatattcgtactccttttcctgaaaatactgatctaggctacagatccatctcttaaccatatttgaaaaattgaaataatatcttctgccataacttgaaattccactctcagatctgttatttctgacagtgagtttgtatttctcaagtagatatgtctgatgcttatttcttttacagcatctggctcagtgcatggctcatatatctgtagagtgagtaaatacagggaatgtttcctatgtgtatggcaagggtcacagactcaggcaggtaacagatgagcaaggcagagggtggagactggtaaactagacaactagataggtcaggtcaatcgggggcagcacctgctcagccatagcagattgtggccatgtggggatataggtctcatattgccagatttcctgggttttcaagaaaaagtgaaaaatctggatttttatgtgagatcttccagtatttcagcatcaggttctttttgtttgtgagtgctttggccctcacagcctgcctgccacatctgacttgtggactgccggcttgaaacctttgatatttagagaagtggttagaccttagagttggttctggtgagatccttcttgttttacagatgaggtttctgagaccgaaagaagggaagtgacttgctcaaagtctcactgttactcagtggcaaaacaagactagaatttgggtttcctggtccataacctgtcactttcttttttcttaactacaatacctcctttatgaagaccttcataaattctaggatggtgaattctcctt

SEQ ID NO: 14988 - DNA, 1856 bp, Homo sapiens
taaataatttttatctttttctttctttctttttcttttttttttttttttttttttttagacaaggtctcactctatcgcccagggctgtgcagtagcatgattgccggctcactgcagcctcaacctcctgggctcaagtgatcctcaccttagcctcccaagtacctgggactacaggcacacgccattacgctggctaatttttgtattttcttttttggtagagacggggcctcaccacattgcccaggctggtctcaaacccctgggctcaagcgatcctcccacctcagccttccgaggtgctgggattacaggcatgagctatcgtgcccagccaaagatatattttcaaaagacacttgtaaaattagggaagtgcaattttaaattttttttttctgaggattctctctattttgtcattgaaagcaaagacaacattttaaaagtggacctacgtaagagggctgggtgtagagctttattaaagagtgctgtgctgtttgctgtttatactttgctcattctctgatggaaaataaattgtttaggtaccccttacatgtccttcagcctctcaccgtttgagtctggtttgggttttgtatactatatgaaacagtgtttgaaataaaggttcctaatgaacattttcctccatgggataccaatcaactgcctgcttttaattgataattgggcattaactcctcagtagtgccatcatcataaaccacagtgcagaccctatagtccaccattgaaaaattaagacaattatgcagtatttgaacatgtctaatctaggagagagtagcacccaaggccgggcacagtggctcatgcctataattctagcactttgggaggctgaggtgggagaattgcttgagcccagcagttcgagaccagcctgggcaacatagtgagaaccccattgctacagaaaaattttaaaaacttagctgggcatggtgacatgtgcctgtagtcctagctactcgagaggcagaggtgggagtatcacttgaacctgggagatcaaggctactgtgatcgtggcactgtgctccagcctgagtgagagagtgagaccctgtctcaaaaaaataaaagaatagtgccctcatataccttagtggaaaaaatgaccagatctttggcaaagtatgattgctaaaataataacccactcagcttacactccatgtgtttccaacagagagggatacgcacttgatagaaacagaaaattataatcaaatagaattcttctgttggcagagcatacatatttatacattcttctgtgtttagctcagtggttagagaacacttcctggaaagactgcagtacacaaatgttttcaatttgagcttgtacatttcatctcattggtccctgagacaaggttcactgccctggaggtgacttggctcagtctttaaacacacactaatgaatttcaggtttgggacagaagaagggctgctctctattggacagtcatgtgaacttgtttcccctgtatgtctaacttaggtatgtaatgtcactctggatagagggttcttctactatgtccggacacagaaaactgattgcccttgctcagagcactccatgcttgcctgtgtttaaaacttaggtttggcagattccttcatttttgtgaaaatagggcaaagatcttctgagtgcaattggatgtactggagggcacttaacctttagcctgtaaagatgggtttgggctaagtctgttttgtttttcctttcagctgtttgaagagaaaattcaaaggaaaattcatctttcatactttttatgctgatagttctagtaata

SEQ ID NO: 14989 - DNA, 1036 bp, Homo sapiens
tggtttgtgagattgaaactgacaaggtaggcttatcttatattcgtaccagcttttcatgggcttcccttagttaacctaatgaaagaaacagggacttaaccattgtttagagataatttttaactagctctaacttcagttgtaaaattattggatttgttcaatttaaaaaaaaaacaactttttacatttaactttttttttttttttttttttttgagacagacttgctctgttgcccaggctggagtgcaatggcctgatctcagctcactgcaacctccacctcctgggttcaagcgattctcctgcctcagcctccctagtatctgggcttacaggcgcatgccacaacgccgggctaatttttgtattttttgtagagacaggtgttgccaggctggtctcaaactcttgacctcaggtgatctgcccgccttggcctcccaaagtgttgggattagaggcatgagccaccgcacctgacctgcatttaactttaaattgtttgctgtgtgtgtactatgtacttcatttagtagctttagtcttgtagtgtgtggtgagggggtggggagggtaaataagctgtttccactttttcctgtatcacttggaaacatattaactgaatattgcctgaatgtttctgagaaaggacagaaagtgaatcttcacagtagcgatgacttgttatcacccttgctctgaaattatggccttagatgtttgtgtgcaaggccttatatattgtgttgcaactcttgttactcactggagatacgctgttgttgttgttgttttgagacgtttcgctctatcacccaggctggagtgcagtggcacgatatcggctccacctgccaggttcaagcgattctcgtgcctcagcctcccaagtagctgggattacatttttgtagtttttagtagagatggggtttcaccatgttggccaggctggtcttgaactcctgacctcaagtgatccgcctgccttggcatcccaatatgctgggactacaggcatgag

SEQ ID NO: 14990 - DNA, 1031 bp, Homo sapiens
gactcttgtcattccagctgcccttagttgagggaataaggggtaaatttatatatagtgtgaacttcaaatgtcaaattctaaaagaaaagtgtattttttaaaaaataaaccttatactctgttctttccatgggtgtttcttagcaggagctgagaaactggaccttttcttatagatatacagattgagcatacctaatctgaaaattcaaaatctgaaatgctccaaaactgaaaatccaaaatctgaaatgcttcaaaactttttgagcactgacagaatgctcaaaggaaatgctcattgtcttttatggggaattcagtgttgtttcttttcacatctgttctctcatatctctaggaagggttggtatttcttttgggaagaaatgagaaacgaatttgtactggacctgataggattagagattaataactttatctgactcttagttaaattttataaccactaaaaagtctatttctttttcctaagcgagaatcgtacccgtagaccaacgagtcacagaagtctatttctttttcactgttacactaataaggcagatagaccgcatgattgaggttagtcaggcaagaccagaagctcagagtagaaaacatgtatggtagaaggctgggaaataaggtagtcctcctgttgcagaagtttgtcttagcactaaccctggatataatgtccagatgggtgaaaaacagaaacaaacatttcatttaaagttgtgagattattacttggccacttcagtgatttatgagtcatcctggatgaagtgctttcttaagcctaagtcaaccctcgatgactattttattttttgagatggagtttcactctgtcgccaggctggagtgcagtggcctgatcttgattcactacaacctccgcctccggagttcaagtgattctcctgcctcagcctgccgagtagctgggactatgggcacatgccaccacgcccagctaatttttgtatttttggtagggacgggctttcaccatgttg

SEQ ID NO: 14991 - DNA, 1029 bp, Homo sapiens
gagatgggaaagtagaagacacatttgagaaattgtcaaaaatcatttctgttgtgaggattttgtatagcaaagaatggtaaagaaggttggatccttatttcagaatgttttgaatgccagggtaggagtttatatttaattcaggaagcaagtcaagtctcaggtcatctctttctttctttttgtcctgagggtttagtctgcgaatctacttttcattagagaaatttgcttttctttggaaagggtttgaaaaatagggagaagggagtgttttcttgatagtgcgctgtggcattgttcagagtagggctctgtgacctgttttactagatgtcatccattctgttgggaaactttccgaagagactggatgacattcaagccaaagatttctctcttgttcataggatgtaggggaaggaccttgactaatgaatcacaaaggctgcagcttatgtttcagtgcattagggccaaattgtacacaaattgaattggactttgaaattctacccagtttcttaagacaaaacatgtaaatatttgtggccctgaaagatgcagttggcccaacagctttgattggaaaggaagcgtaatagctggatctcctttcagcagctaatcaaggtgtcacttaacaatggcctgcggtcttgctgcagcctaatttggtttagatcgagtgccctttgggtcttgtgctgatcagctaacccataagggacctttctgagaccttctcccttcctctattgtcccagcctttgcctccaagggcagagctctgaaatagaagctacttaatgaccagacaataacatttgggcaggtttgagagcagagatgtttatcacatctctttccctcttctgcagctcttgtgtcttgggaaccagtaatgtctttagggtggtaatcctagcactaaataaggttagaatcaggaaaacaagcattttaaacccaatcagtcccccttggaaaaacttcctttttcaaaaacaaaagatctgaaggggg

SEQ ID NO: 14992 - DNA, 1033 bp, Homo sapiens
agccactgggattcatggctttgtatccaactgcatccaggcctgaggctgctgacgtttgacaccagggccagtagagagtgcccttttgtatcttaagccaagaagtgaggcctgggggtgggggaggggggaaggggtgggagccaatactgagtgcctgcagcatctactactctgtcttcactattcagaacttgtaactaaagtatttaaagaaactgattttaaatgcaaattaaagggcagatattctcaaacagggttcctgtatctgttccttttggctactgaggtggtacaagtccccagcactgttgcactgaaattattgaaagccactcaaggtcctgttgcttattttgtgaaatcagaaatcccttatgtggaacttaacactcataatttgacagaaggtagaaccctgactgccagccgggaaagtgttgccaaaaagagtcaacctctgtaaaaatatttgaagagatttattctgagccaagtgtgagtgactgatggcctgtgatacaactcttaggagatcctgagaacatgtgtccagggtcgtctggctacaacttagttttatacatttaatacattttagggagacataagataccagtcagtacatgtaagatgtacagtggtttggtctggagaggcaggacagctcaagacctggggatgttgtcataggcagaatcaaagattttctgattggcaattggttgaaagagttattatctaaagacctggaatcaatagaaaggaatgtctgggttacagtaaggggttgtggagaccaaggttttatgcagatgaagcctccagccagcaggcttcagagaaaatagattgtaaatgcttctcatcagacttaaggagcctgttttaacagtaattccaaaagggaggggagtataatgaggaatggctggctccctcttcccaccatggcccgaactagcgtttcaggttaactttggaatacccttgactgagacgaggggtccatacagatggttggggg

SEQ ID NO: 14993 - DNA, 1084 bp, Homo sapiens
acaaaaacatacatgagagtttacagtggcattattcataatagctccaaagtggaagcagctcaaatgtccatgaattggtgcatgaataaataaaacatggtctatccatacaatggattattatttagccataaaaaggaatgaagaactgatacatgctgtaatatggatgaaccttggaaacattatgctgggtaaaagaagccagccacaagagaccacagagtgtgtgggtccatttagatgaaatgtccagaataggcaaattcatagagacaggaagtagagccagtactgtggttacctaggggtggggagatgggaggagtggggagtgatggccaagggatatgaggtttcttttgggggtgatgaaagtgttctaaaattgtagtgatagttgcacaactctggatataatacaagttggtgaattgtatactttaatggacaaattgtatggtatgtgtgagtttgatctcaataaagtgcttttaaaaatggagaataataatatctgccttacagggttgtggggaggctgaaaaggaataatgtatacaaatcccccagtatgtaacaatgttccagaattagtagctagggttattaaaacccccttttagaccagcggcagtgaagaagccttttttcctttttattgctagtatctatccaggagcaaggagaacaatctgataggatttaatatagaactagggaggatatatggtatagaatagcagtttctaactctgactactgattagaattccccggaaagtctttcaaaaatattgatcctgattcagctggtctgagtggggctggcaggtgttctaacctgtagccattagctgaaaacctggtaatccagttaagaaaccagcccagttctttgaaggagcgaggacatctgtgttcaggtcagaagtcatacacaagcaatgcactttatagtttgcaaacttcttttgtagacgtcatctctgatctgttccaacaaccctatgaggtggtgttagtagtatgagttgttagagagctgacgctcagaagattaagtcacttgccagggtct

SEQ ID NO: 14994 - DNA, 1088 bp, Homo sapiens
gaaaatcagtagaccataggtgtatgggtttacttatggacttttaatatttcattgaactatacatttatccttatggtagtaacatactcttgattaccgtacctttgtattaagttttgaaattgcggattgtaagtcctctaatatagttctttttcaagatctctggccattcagggtcccttgcaattccatatgaatgttaggatcagcttttcccctttcttcaaaaatggctgttgggatgttgatagggagtgcattgaatctataaatcacttcttagagtgttgccatcttaatgatgttttctatgaacatggaatgtctttccaattttttgggcttctttaatttctttcatcatggttttatagttttctgtgtacaagtcttgtacccccttggttaaatttattcctaaatattttattctttttgatgttattgtaaatagaattgttttctcaatttcatttttgggttattcactgctagtgtatagaaatacacctgagttctgtatattgatcttgtatcctgaaaccttgctgcactcatttattagctctaatagtttttgtgtttaggtttgtctgcatgtaatatgttatctgcaaatagagagaattttagttctttctctccaacgtggatgccttttatttctttttcttccctaattgttctggctagaatttctagtacaatgctgaatagaaagagggtgtctttgtcttgtttttgatcataggaagaaagctttctgttttctgtcattgcgtatgatactagctgtgggttttcataaatgtcctttgtcatgttgagaaagtttgcttctattcctagtttgttgtgtgtttttatcatgaaaaggtgttagtcaaatgctttttccacatcaactgaaatgatatttcccccttcagcctgttaacgtggtacattacattgactgactttttgtgtcttgaacctcccttatattcctgagataaatcccactttgtcagagtgtaattgctagtattttattttattttgttttattttatttttttgcgacggagtctcgctctgtc

SEQ ID NO: 14995 - DNA, 1031 bp, Homo sapiens
ctctgttgctttgatagtgttgctgagacgggatgattgtccttggtgttactttttcctgcagttgacaagctggggaacaggttttccattaccctcaaaatcccttttcttgtttcgggtctgaaagacataactttttccttttaatccttagtgaatttacccttcttgaatgttgaactgctgactaaaatatggtcagctttttatataacaaattgcctgtctccatattggccccaagtttcgagttttctaagttaatctctctcattcatgttgctgagttggagaatgggcactgtttgagcacagggcttcaaatcaaaatggacacaattgctgagccttgagcagaacgggaaactgtgtgccaaaaaagacttttcatttcacaagggaaagggtcataggggaagtgtgagaagggaagtgaggctcctattccattatgtgtctgtcttttgtcataagaggccacctgagggtatcccttggcacctacattcttgactgtattgatctgttcacagatatgcctgcctctatagcacccattcagaagtctgccatatagaggcttttttgaatgagcacacatgcttttatagttatattgttatctggaatccagttcataatccatgtattttgatattgagtctgaaatttaaaaatttttgtttgcagcattgatggcccatgtagaagacctgatcattaagactataatctctgctgaactagctattgctactgcctgtaaaacctttgttcctcatcgcagcagttgttttggtaaggagactcaagaagcttaacatgttttgtgaagaggatcttgggaagttggacgggattttagggtagagaggcttagtgattctatagcagtaagaggtatgtgatggactcttctttctaagctcatgtagcatatgaagagcctactaagaggccaatagtgagcttggtcagaagtcccctgaggagtaactagctttctgtgtgggaagcagggattggaa

SEQ ID NO: 14996 - DNA, 1027 bp, Homo sapiens
atatttttttctaattttctcctttcctgtcttcttttgggactctggttacatgttaacttagtttatattttaccacaaatctggctgtgctcatgttttttcagactttttttttcttgctttccttaatttgggatggttttgtatttctgtgtgtctctaaggtcattcatcattttgtctgcagtgcctagtcctctattaattctacccagtgaaattttcatttcagatattttatttttcatcagtttttgtgtgtcctttttctctttttcattatgttcatgatttcctttacatttttgtttacatgttataatatttgtaataaatgttttaaaatacctttttctgttatctgtcattttggggtctgtttctattgactggttttcctcatgtttatgggtcacatttttgtttcttcacatgtacagtaatttttttaattgaatgctagacattgcagatgttatattgttgagtgtttggattttattgccttctttaaacccttttgaatttttttttttttggtcaggcacttaagttacttgtagatcagcttatctttttcaggcttatttttaagcattgttatggtttgtttatagtagctttttgtctagatccaggttagttcctccactaaagagtcttttgaggtgtctgttaaattacctccacgttcaatgagatcttttcattctgtctggtgggaactcaatttgcaacctcatgtgagctctgggaattattcagcttacaccttaccttctccttaatttgttctttatcctgatagttgcactttgctcagccttgtggactttcaccctatacctaagcagatttgtattcacccaaacattcaaggggtccctcatgatgatttttgaatatcttcttctgcacaacttcttctccaggacattgctctgaaaattctagctactccctagaaattagatttctcttgtctcttttcagagacagttgggctctatttgcatttcctctc

SEQ ID NO: 14997 - DNA, 1054 bp, Homo sapiens
tcttgccaaaggataggtttactaaatcttttatctcctctcctttccattcactaatctccagacgatatcatttatactaaacatggtaaagtgtgcacattgtttatttattgatattcccctataaattattaagcctcctttattaagttcttggcacaactaaagcagtaattggagaagctgttagttatcataaagacctttctcactgtactttttctgtaagtttcaagatcatgtctaatataaaaggtctgatggtcaaatcagggcaggaaagcagaggagtcagtgtggggcaggagtgagttcaggagtacagggagtctggttcattgtctgaaggcctgacctacattgcccctaggatataggaagaaggacaaggcatttcagagaaactagtggccagagaagttactaccataatttgctactatatcttccctgtcttattttttttttttttttttttttttgagacaagagtctcgctctgtcgccaggctggagtgcagtgcgctatctgagctcactgcagcctctgacttctgggttcaagcaattctcctgcctcagtttcctgagtagctgggactacaggctcacaccaccacgcccagctaatttttgtatttttagtagagatgggatttcaccatgttggccaggatggtctcgatgtcttgacctcatgatccacccgccttggcctcccaaagtgctgggattacaggtgtgagccaccacgcccagcctcttccctgccttttagttagcatatgcccttcttctcccccttgtagaagcagtaggggacagaaatgataagtcatatatggccggtgagtttttcttccaaagactggtccacactagagggtgcagcctccacagacactgggaattgctcctgacctatggaaaacaactttctttccaagaaaattatttttagtcctttggtgtaaagacacagtcctgagttgttttcacttactgaattctataactaggaatgaaacactatactcttgctaaaaatgac

SEQ ID NO: 14998 - DNA, 1033 bp, Homo sapiens
agttccacaaaaattacttagtggccaaatggcaaggttttgtttttatcctctgcctctgttataagggaattattctgaacatagtcctttaaatacttctctttcttgaaaagcatgttacctttataggaaatgggcccagcaatttctgttaggaagatggcatagtatggtgggaagagaagggactttagagtcagacagacctaggtttgccttattaagtgtgtgaccttgggcaagttgcttagcttttctgaaccataatttccccatctttttttcaatgcacatagttaaacccacctcattaagttgttgtaagattaaactgagttgtgtatgtgaaagtggccagcatggtttttactttttacttttttggtgtaggtttcttggtaactctcagttccctttccagaaaaaagaaagaaagaaagaaacttaaaattgaacttgcttgggatatggtattgctcaccacttagtttagtacctagtttacatcactctggccatcaccctgtgcagtacgctcctgggactggataacagaaatctggcctttctagccgaggatgggaaggcatcagagtggggccaacaagagactcttcctttttctttgaccccttggttggaggtcagcttctttctactcagcaggccctttttctctgctgtctcctgaatgttgaaatttccattgcagctcaatgttccagccagtaaacactcatattttccatctatcctgggggtcgagctttgggagagcttttctctggagcagtttggagcttataattttgtactttatcctgttatataaacaatgctttccagccaaagagcacaatcaaagagaaactactttttgtgggggggactaaaaaaaattcatattcagagtcctgtagaagtgatatttcactccttatgcctctttcttctctttcataaaataaagtttacctcacctttctcctgagtcttaactctcactattccttcccctgaggaaaacgat

SEQ ID NO: 14999 - DNA, 1025 bp, Homo sapiens
agttagtttggcacaggtttaaagcattaaacggtccattccaggcactgtctgtcatcgcttctctttcagtctgcaagctcctccttttggagctgtggggtggttgttttcttaagtctcccttcttctcctatcaggcccaggctgagctctctcttttaaccacctctgttcttagggcagcaggcttgtccatccagttcccagtttcagcgggaattgctgtactggtgggccagtctcctcagcgtggccacctgcctcccgcagctctgcccatcaggaacaccaggtgccttcatcattctcctcagccaagccccatgcccttatcagcacctctcagcctcacttcctgcgttcctctccctgtgcttatttttctgccaggccatcccctagcctcctccctctttcatatcatttcatcctgcattttctttcgttctctgagttctgacctttcatccagaaaggctgtttcatatttcaagactctgctgttcggtacatcttcaccctcctgtcacccagtccccagcatctgaaggcagctccttctcagagaagaataggataaataagtgctgccacattttgggactatcatatggcctgagaagctcccaattttttttattttaaaatatcgaagatcttccatgtaagtgttatgacctaatgtttgaaagcatgtagttaagaggcagaccaatttggattccttctttttttagccactcactagctattttgcctagggcaagttctttgaacttaatattcttatctctaaaatagagaataaatgcctacttcctagggatgttctcaggagcaaatgaaaactaaatggcataagaaaagcacttttactatatataatgcctgccatagagtacgtgcccagtaagtgggaatccatgtaaacatttctatgtcatctacccttacccatacccatacattagaaatgttaaaaatggagacccagagaaatgaagtagagtgtgcaaattctc

SEQ ID NO: 15000 - DNA, 1036 bp, Homo sapiens
gcgacataatacaatccagtctctacaacatatcattcacaatatccaggatacaatatgaaattatttaatgtaggaagaaataggaaaatatgacctatcctcagaataaaagataatcaatgaagaccaatccttagaaggcccagatgatagaattaacagacaaggattttaaagtgactcttataactgtgcacaaggatgtaaaggaaaatatgctttaatgaatgaaaaatacaaaatattgaccaggtgcagtggctcatgcctgtaatcccagcactttgggaggccgaggcgggctgatcacctgaggtcgggagttcaagaccagcctggccaacatggcaaaatcccatctctactaaacatacaaaaattagccgagtgtggtggcacatacctgtaatcccagctacttgggaggctgaggcaggagaattgcttaaacccaggaggcggaagttgcagtaagacaagatcatgccactgtgctccagcctctgaggtacaagagtgacactccatctcaataataatataataataaagacagatttccaaatggaaattgtgaaactgagaaaaacaatatctgaaatacagaatagacattctaacaatattgagtctcccagtgagtcaacatggtatatctttgtacttatgtaggttttgtttaatatctttcattagtgttttataaattcagtgtagtgaccttatgtattttctattagatttattcttaggtatttgatgtattctcatgatattataagttgtattgctttttttttttttttttttgagacagagtctctctctgttgcccaggctggagtgcagtggcacgatctcagcttactgcaacctctgcctcccgggttcaagtgattctcctgcctcagaatccccagtagctgggactacaggcacccgccaccactcctggctaatttttgtatttttagtagagacatggtttcaacatattggccaggctggtctcaaactcctaactttgtgatct

SEQ ID NO: 15001 - DNA, 1049 bp, Homo sapiens
gctagtggccagaagccaaccactctgccacaaaaagtggtaccacctccaagttcttgcgcctccctggttcccaaacccccacccaaccacgaacaagtgctcagaagggcaacatcccagaaagcttccaagtaagtttttttctgttcaatttctactgagttttatcagttctaagctaatagtactctttatttattactcttcaagaccgttcgtactgaagtactggaaacaagaacacctgctgggaaataaaggctaaccctagttctcagcgtgggctacaaattagaatcacccagggaactactgaaacaagcagatggcagggctttaccctgtgggagggacaggccctgcagaatcagatcttttcaatttcatataaaattcaacatcctgcttccccttggtttgttcacttttaggcatttgaaaggggagatacaggattgagatttcatctaagaggataatataacttcattgacattagtcaccaagctctgtgtagcaacagtgtttttaataccttttgtagtctacctgtttacaccaaaaagacatttcctttcctgagtcaaatttttgttaagtcaaaatccttcactgtatctccagccactttttagccagtgaactagaaatagattggtgaagagcgttggttctagcagcccttcttcagtttaaacttggggaacttttagagatgtctggaagaggcacgcattgcctgctgtgtttttgtgtcgcagacatttgtgtatttctcttgctgtcattgaggcttctcattcatttgtccttcggaagatcaatattagttgtgagaagaatcctaaaacatagaaaaagtcattactgttttttcctccttggatggtaaatcaaattctggatttagatagaaaacaatcccttgtggctgttttaattatattgctgccattattcatttatccaacaaatatttattcagtgcccactaagtaccaagcgctgttctgggaagagctggcattgtaatgactgcagaactc

SEQ ID NO: 15002 - DNA, 1047 bp, Homo sapiens
atttttatttattcatttatttatttattttttgagatgggagtttcactcttgtcacccaggctggagtgtgatggcgcaatcttggctcactgcaacctctgcctcctgggttcaggtgattctcctgcctcagcctcccaagtagctggttttacaggcatgagccaccacgcctggctagttttgtatttttagtagagatggggtttcaccatgttggccaggctggtctcaaactcctgacttcaggtcttcctgcctcagcctcccaaagtgctaggattacaggtgtgagccaccgcacctggcttaagcagtttttaataatcattgacagtttatcctcagagaagaacctaaataagaccattaccagagctgagattgtagtaagcttcttactctcaacctttcactacatcaagcagctttccatctcctagacagttgtaccatttccaagaagaacaattaaggactagatattcacatctatcactcttctcatgtttgaactctaacttttgtgtagtgtaaagttaatggcaccttttgtcccatcttttcagtatttctcactgtcaagctcttgatacttctataactccagtttttctaacttcatctttagccacttctttatattctggtgtactatgaccagagaacatcagataatggaactgtatcacacacatatttaactttatacattcagctattcagagagaaattgattgtaatttcaacaaagtggctgattccaattgattttacacttaggataagatgggagaaatatcactccagtcagtcagtttcagttcccgtgggactttcttatagcaagggcatcccactgcactcttattctcacgcttaaagatacatattttaggccaggtgcagtggcttatatctatagtccccgcactttgggaggccaaggcaggcagaccgtgtgaacccaggggtttgagagcagcctgggtgacatggcaaaactctgtctccacaaaaaatacaaaaattagccagacctgg

SEQ ID NO: 15003 - DNA, 1059 bp, Homo sapiens
tctgtctgcaagtaattagtgctgaaaactggaagccagcaaccaaaactgaccaagtaatccaggctgtcatagcacttgtgaacaacccccagcccgagcacccatttcgggctgacctagctgaagagtactctaaggactgtaaaaaattctataagaatgctaaagagtttacaaagaaatatgaggaaaagcgacccatggactaaaatctactgcagttgattccagcaagtatgagcagagaccccaagcagtgcattcaggactctgtggaaaattgacatgtgctaccacctggcattcgcttgtggcacttactaattttccatagttttcttagtccaaagtagtctaggtagcctataaagaaaggattaaaaatttaagatgttctaaaaaaaccatattgttacaagccagtcatctgcttacatttcagattgtttgtacttaatttcaaactgccacattatgatcaagttgcatcagcttccacttaaggcctgcattgtagagtaatgaatgctgagggcctcaaactcccaaagccatttcccggggacccttaaaatataatggtcaagtaacaaaattttgctacaggagagttatataccatccccagtatcactacacccttggatctggttgcttctggaatgcttttttctttacatttccaatccaggacaagccccactttgcccataaacttccttgacctctccttctcctcagcacttcctgagtgtgtacaattctgtttagcttttagacatatattgtaagccttatgcatgcttatcagagcagccttaataatgccccagtgaaaaccaccaagatggcaagaaaactgcaaattttggtggaagtgccccatggctgagggattcttcagcttcacctttggaccctggatgcagcctcttcctggaacaattctgtgtctccatcactgacgcctacttctcacttccattgtggccttttgagtttcagattaagcctgacatccaattacgtggatttcgtacaggcctgatacactga

SEQ ID NO: 15004 - DNA, 1041 bp, Homo sapiens
ctgtgagatcttcggccatccaggataagcatccacatctcagggatggtttcagaattaccttgttttaaataaggagaaagtattcctcagacttcttcctacgacatactctctcgcatttcttccatgcttaaactggcagaattttcatgctaaggtgtggtaattaagtcatctcttgttttacttacaggaagcaacatcacaataagattaaaaccatgggtgtctgattcagacataccagggtttgaattcagatttcagcatttaactggctatgtaaacctggggaagttacttaaccctgtaaagtggcaataataacgcctattgcaaagaattgttctgagtcttgaacacataggaagagtactcagcataaagctagtacatagcttgttgctgcaattaagttatgaataacaacagtgcataaggagtaaagtaataaggcaggtctctctgagttttatggttctaaaacaaagtgttaggtaacacgtgttctgtaaatggcatctatagtaggatggtgctggctgtcaccttcagccacatttgttagcctctgtagctgtcagcaccttccagatgctttaaacaggctttgattatagttagtctttgtgattcttgaagtttgattcattgcttaaatatagttattctaggccagcctgacagagaatatgataataagactgagacattttgctagcctttacctttggtctcattttatggatgaaataagtggagtcatagatgcctgtaagtcagaaggagcaagtgcttaatgtcttttattttagttcagagtccagttctaaagactggattacaaatcatttcattccttaatctcttgcaccaagtcttagatgaaagataaaaaaaatatatataccagtgggatggccagtgatcgaatttaactacttaagatatacacaggaatagtttctcaaagaatagtcattattctagtttagaatttccttgagcagttgttgccttcaaaatggcatatcttga

SEQ ID NO: 15005 - DNA, 1042 bp, Homo sapiens
tttcaggatcactcaggaacagagacttcacctagtggaccattcaggccccttgctatttcttcctcctctcatcctttaggtcaagtccatgttcattaatgcttccgttagaagaaagtcggcaactcaggaggagaaggcaaataagtttcagttttgctgcttagcaactggagtattcagctgaatgtctcaaggcttagggcagggagtcttgtctacgtgactaggtcccatttctggaagttactacctcagggagattaggagtaagcccagcccatgtacattgaaaaagcttccgggaatgagtctggtgcaccactgttgaagaatgactaatttaaaagattctctccagcttccaatttgctgtctataccatatcgtgccttccataaggagaggaagtcaagaagggaccgtctacacagtaaatccaagcagatgtctgggtgccttagggatattagataatcaactggtatcttcctttgaaaaggcttgaggcaaagtgtttggaatctagggtgaaagttgggagacatggattctagtttcagcctcatcactaactagctctgtgatttgggtgaagcccacagctgcagtgcccagcgtccctctctgtgtataaaattgtgctgctgaaacctgcttttcctcttctccagaactcagccgaggtagtgtttgtagatgtgaatatctttgaagagtattgaaaagtgctctgtgtgaggtgatctcgctggaattatgatttgccaggttccccaaacttctaatagccacttttggggaaaaaggcacaggggccctgagtacagaaataaaccggcagcccaaggctatactgatctcagctctgcagacagcctgtcagagggctgggcccaggtcacacaagcctcatcgacagcctcagtttcctcagaagttgggaatgaagtgtctctgaagaggtgctccaggacccataattctttacctcaacctctgtcctcacacagtctgggaggcagaacttccatatcag

SEQ ID NO: 15006 - DNA, 1030 bp, Homo sapiens
attgtgtagggaaggaacgattcggtcataactcctgagggtaattggagacaaatatgtctcttatgtacacaacgaaggcgccagccttccttcctagcctctttaatcccgggattcttcttttatccctgttttcatccaagcacatctacccttggtgacattagctgtgtcattcggacaatgggggtatagagtttaacttcatgaggacaattagaggcattggtccttggggacggcgtgaactgggaagacagcttctgtcctcccacacagacagaaggtggctttgatggctactgggtgctcttcctttaggattccgtttacttagaataggcattggaagcctatagcatccagcaacaccaggctggggatgccctgggcaccctgcagtggtttctctttggtgcctcccactacccattctgtctccttctgccctcataaccttcattgctgagtctcctttatctctctttaagggtcagaaactgcagcctgggagattcccttagagttgttacaccctgttcttccagcttgacctacccattctcccacctcacttcagccgtcattcttcctttttaaaaatggtacagttgatagagtctaaattccatggaaagcagtctatttaaactttgacttactttttaaaatcattttaattattttattttatattattattttttttgagacggagtctcactctgttgctaggctggagtgaaatggcgtgatcttggctcaccgcaacctccaccttccgtgttcaagcgattctcctgtctcagcctctgagtagctgggattacaggtgcccaccaccatacctggctaatttttgtatgtttagtagagatggggtttcaccatgttggacgggctggtctcaaactcctgacctcaaatgatccacctgccttggcctcccaaagtattagaattacaggcgtgagccactgtgcctggctgaaatttttattttttaattgacaaaaaaaaaaaaaat

SEQ ID NO: 15007 - DNA, 1024 bp, Homo sapiens
tcatgttttgtatttgttcaaagcaccaagagacttgcgttttaagtaagaaagcattaaactcaggaaaaaggattttagagttctttggcagaaacttctaaatggaaacacgagaaaacaaattgataatctatagaattatctggacttgtactctcctccaggcttttctccaccctgccttaaacctattcccaactcccttgaaaagacttctgaaattctactttctctacttttttcatcatggaaatactaaatttcaaggagtaactgctaaatgttatagcaaaatcgtctgagcactgaagtttacacatgttataaatacatggaattagaaagttgtactggccaccatcggggcatcatcactttaggatcaaattgttgcacctttaagcttctctaggacatctcgtccagacctgtcctttgtcatgttaagaaagtgaagttcagagattattatataaaataacaggactcaaagagagaaactctggtcctctgacttccaggacactctgctgtcatgccccagtgtccaccaacatcaccatcatcatcatttactaccaaacacttaccatatgccagctacattttctctcatttacttctcaaaacaaatcagtaggaaagttttgaaaaatcaactttactaaggcctggtttgtatacaataaacgatatccttattaaagtatacaatttaggttttcacagatgtatatacctgtgaaacccctgccacaagacagaacattcccatcacccagaagttcctccgtgccccttccagcccatccttcctctctctcccttggcctcagaaaactactaatgtgttgttcatactatagagtagcttgtggtttctagaattttatataaatgacagcataagtatttactcttttgcacctggcttttttttttcactcagtgtaatgattttgagattcatctaagctgttgcatacatcattagcctgtgtattttcattgctgaatagta

SEQ ID NO: 15008 - DNA, 1050 bp, Homo sapiens
ttttcactctttttatcccttgttttctctgcctgtctctttctgttgaattttctctgtgtctgtctctcctttgcatgctctctttttccaggtacaacatctgtgcctccacagtcggaagtcataataaagacaccaggcttggaactgacatttccatcctctggcgtcacttgactagagtgatcaaaagtcgaaatcacgaattgcctgaaagtggcaagggccttctcagctgttgttgaaatgatttgcacctctttgaaaactaagattgaattcagtccatgaaagcagaaatgaaagatgtcttcaccagtctacctttgggatttctccttctttccgtgtttacagttgctttgggaattccaggactgtctcaccccaccaggccttttttcttgcaccatccctcccttctcccccacccctgaccgtttaaaacaaaatgtctcaaccagtcagtgatactcacttggagaaggaaatgtttctttaggatgttaggttgacccatgagaacatggacaatttttggtcacttaagcaagttgccacaattaagggatggactggtttcccagttctctgtttgcatgattttgttggactggtggaagaaatggcctcgtgtctcctcgtatgttgtctggagagttcagagatggaaaatcttgagacagcaagaaaagcatgattgtagaatcagcatccctgattacattagacctggcaaatggacgcctggatcccagggagtcaggctatgtcattagatggaagatgcccttgagatgcaggctgagggccctgatgattgcactgcggggctaatgcacatagagatctgggtcatgaggagtggcactcactgcggcatccgctttgtgacactacatgttctcagttcctctgtctctgaccatgccaggctcacttgtcagttcctcttctttcctctaataagccctttgttacatttatttctttacatttctccttggagatccactgcagtggcttctaacctgttgcacgcgtcag

SEQ ID NO: 15009 - DNA, 1800 bp, Homo sapiens
ttccaggtggtagttggtaccagaatgggcgcaaacttagtctcttctccattctgacttcaaacctgggtcactacaatttcttggatcacgaaaactgcattcttccttaaatggtgtcactaagttgtctttctgtttctttctgccatggtcattgtcagcagtgaccccaggccaaagaacagtttttcattcattctcaatacctcgatgagaccatgtgctactctgtgtttccacaactctagtgtgattttgaagttgtatgtttttctgttcctgtctagtgagacagtctctaatctttctggatctcatcattaggtaattcaatgacaagtttaattggggaaaagagagaaggatctagtcccccgaatttgttttgggtcctgtcccagttgtcttctggttagtaggtttttgtgcttaagaatatgttgacttcaggcatttaacaagggacaaaacatctatttttagtgacttaaggaagtggtaggaacagaatctaagtgtagccagatgaaaggtgacttattttgtttagacaggcagaactgtggactaccatgatctgtttcatcaaattattccaaaacaacagatcctttttcaggctttctttttctttttcttttctttctttctttttttcctaaacttccttttggcagatgtggcctcatggatgagctggtacacgacttagcctcagccttggagcagacatctgagcagaataagcttggtgaactgtgggaggagatggcgctgagcccccgacagcagaggcggcagcttcggaaacgccgaggtcggaagcgtcgttctgacttcactcacctggcagagcatacctgctgctacagcgaggcctctgagtcaagtctggatgaggccactaaggactgtcgagaagtggctccggtgaccaattttagtgactctgatgacacaatggtagccaaacgacacccagctctcaatgccattgtcaagagtaagcaacattcttggcatgaatctgactcctttactgaaaatgcaccttgtcgaccactcaggcgcaggcggaaggtgaagcgagtgacatcagaggtggctgctagccttcagcagaagctgaaggtgtcagattggagctatgagagaggctgcaggttcaagtctgctaagaagcagcgtctgtcccgctggaaggagaatactccctggacctcatcaggccacggattgtgtgaatcagcagaaaataggactttcctaagcaaaacaggaaggaaagaaaggatggagtgtgaaacagatgaacaaaaacagggctctgatgagaacatgtcagaatggtgagatctcccttactaagtcaaagattttcctggttaatttttcccaaagtgcacatccatggtcttagtgggttctaccttctttcaaaccagccactctagtattgactttgaagccttccttgaatcaatcagtagtttagctttttaaggtaccattcatgagtctatttccctctgtcaggaaggctatatgtaatagaaacacagttgtttctaaaaactgtttaaaacgcgtacctcaaatgcaaaactaataattttattttaaaaaacaatttgctgcttattatgccatacagtttatacataaatattgttgtttagaactcaggtctcagcagaggctggtgtgtgtgtgtgagagagaatatgctagcgccaggtatacggagtttataaatgttccattaagttgcctgtcctcattaagaatcatggcttt

SEQ ID NO: 15010 - DNA, 1059 bp, Homo sapiens
tctttatgtgtgaagctttgtgatttttttggaggattgcattatcttggtgattagttgtaaaatagatgaacactgacaggtgaaaagttgtaggcttcctgtttgttgtgggtttttttgttttttttttttaacaacttagtagcttactgagttgatatacacgatccacattttagacttggaatcttcattatgaatttgctgtttcaaaatgaactagagtggtagaagacataactggtgtatatgtatgagatgattttagatggcatatagatgcccaatttttaagttatgtattatagtgtacattggaaaagatgtaattatggtatcaagcctgttatttcacggaaatatagtaaggacaaagctgagcaaaaataattgatatgaggaaaaataataagtaaacagtagtacaggttgtaggcagataaggaaagtcatgaaggtggtatgtgagagactgcagtttggggaacactaagctagagcactaatcatgtttgcatcagaggatccaaaggcagaaggggacctgtggcagtcacctgatccagatccgttatttgcaaatgacgaactggagatctgtaagattcaaactatttgcccaaagtgatacagctaatagaaccaagattggaacctctgtggcagatagaacagttgcttagtttgtattctcataaaacaagtttgaagttatcattccgggttcttccagtctttgtatgtcagagggtattaagttctaaactttttagagaggactgttatgttgtgggaaaagtccaaagaaagctagcaaacataaagtgagggatctcctttgatcctcacagccaccttttgaagtcaaatagatgttttgcagatgagaaactgaaattatactctgaaagcaatatttcatttagccctcataataaccctgtaaaataggtagggcaggcctggcacagtggctcatgcttgtaatcccagcactttgggaggctgaggcaggtggatcacctgaggtcaggggttcgagaccagcctggccaa

SEQ ID NO: 15011 - DNA, 1085 bp, Homo sapiens
gtgtgctggcgggtgcctgtagtcccagctgctcaggagcctgaggcaggagaatggcgtgaacccgggaggcggagcttgcagtgagctgagatcgcgccactgcactccagcctgggggacagagcgagaccccgtctcagaaaagaaaaaaaaaaaaaaaaaaaaagaatgttgaaccagagtgagaccttgtttctacaaaattttttttttttaaatcatttgtgtctggtgatgtacacctgtagtctcagctacttgggaggctgaggtgggaggatcacttgagctcaggaggtcaaggttgtagtgagctgtgatgatgccactgcactctagcctggatgacagagtgagaccctgtctcaaaaaaaaaaaaaaaaaaaaagaaaagaatgtggaaaattgtggaatgatataaactattagtagtaaggcctttccttcagtagcatgatgtttattcatcattaattcattcagcgtttgctggaaccctactatgagccagctctttgtttagatactgccctcaaggagcttacattctcatgggaaagtcaggtatggaagttgacaactacaataaaggtttgaaaaagcacagaggaggggcccctaatgtcaaggctcagggagatctttttagaggtggttgtgctcaagctgtcatagaagacaacaggattttaatccataggaaaacagtcctttagctttttgtcttaataccaaataaaataatgtctgtgtatactgtttgggaaaatgatttgagtagcatgatatcatgtcagaatgctgaaagtggattactttccctcctctctttacctctgctacctagagctgtgctgtgctgagatcagtattcgtacttttgtcaggtttcctgtttcctttaaaagccttatcctgtggctggactaggcatcagcttcttgtttctttgtgtatctcattatccataccactgtcttcactcttttgcctggcagtgtttgtggctgaacttggaaacctgaggaagtctctactatgcttctggtatgctcagctctagggtaatattgcttattgtt

SEQ ID NO: 15012 - DNA, 1107 bp, Homo sapiens
gagtgatttttgaaggtgaactattccttaaactagcttgccattcgcagacagactgttttctctccttaggagtgactctaaagatctttgttccaaatctaacgcagtcacttcagttattttttgccaacattggttctattaaacatgcatgtatttctcaaagtatttttttttccctaaaagtacattcctgccccaaggacatagtgatctgcccggtttcctaagtaacactgcagttttaacaactcacctgatctttcagttacctgcagtaaaaaagaaaatagaaatgttgtgtttatgcttggatagaaagaatcctctttccattaattgttaatttcagcattcaccttcacacttgtaataacaatttaatgactttttctgagataagaattttttttaaattcttatttaaaaataaaaattttttgcttttagtgctcattcttccaactctgccctggcaaataccaccacagtggggaaactatgacactcttaggggaagtactgatcccacacttacactatgaaagaagcgtataccccaggtttcgctggcctgagtgaagattgtccctgaggccctgatcagatgaaacagaacaggcatagcctgtcttttctctaattgcatatatactggggaacagtatttttatctaaatttatattcatttaatcattctattattctttaggttgaatacttagatctctattattgactaggttggctctgggaatttggtagatttttcaactcagtaattttcgaagtaggtaggtgcttatcagaattacccagggaaaaatttcaaaataaatatgttactgattctgctcccactcctccccagcctactgaattaggatcttgatagggacatgtgtatttagtaaaagctccttatataattcggataaccatttgccactccagttgagaatgaagttttaacttggtggagactttaacttatacttagccttttatacaatgtgcctaattgaaagatcacttcccttaacgtattacatggtttgcaacccaagaacaaccatatactacacttgaaaaagagttctgaa

SEQ ID NO: 15013 - DNA, 1070 bp, Homo sapiens
gatggaattttccaaaccactggctttgtattataaatctcagcctgtagcattctttgcattcctaaagaatttcttaggattttagtcaaattcttatattttcctatttataaattgaattgactcttaagcttttgctatttagagacatgaaagtgtgtgtgtgtgtgtgtgtgcacgctcatgcttgcgtgcacgcatgcatgcacccttttcaactgtgcaagttattttggggactttctgagtcaaaaaatttgtccattcaacagctgccttgttgccttgctaaccaggttttcttaggtttgtctgaggttccagttttaagactactaagggtcttaatcctcagctgggactactgattaggagtttatctggtataattttatatgttatttactttggctagttttttaaaattgtggtaaaatgtacataatataaaatttactattttaatcacttttaagtgttcaagtggccatttgatttttagaacttttattcattcatagcagttttaatcaacagctaatgaggatcgcctgtgtgccttgagccaaggttggtagatcattggaaaattatcaaagaagtgtaaataaagtttctgttctcaagatccctgttcttaatctcaaagagattaagccttcttgtttcattagagaagcaagatatatgcacaccagttaaacattgcttcatggtagatgaggccccaaatgttcaaggaacactttgtgtaaaggtgagactcattttggtctttaatcagaggcaggatctgtctagtttgagagggacaaaatcttcacatacgtaaagatttttattttacttcttaatttgcatacagtacaatacattcttggggaacagtggtgaactaaaatagcataccacgtagttcagtgttaatcccattgtctttcacagaatcgtttgcttttaaaataagctgagtattcagatgaaggaacatattgtcacataattaatatttttatttttttacctgtaaaataaaaagcataattaatatttttaaaagtcacaga

SEQ ID NO: 15014 - DNA, 1035 bp, Homo sapiens
aactaccatatgatccagcagttctgtttctgtgcatatacccaaaagaatgaaaagcagagactcaaaatagatttttgcatacctttgtttacagcagcattattcacagtcgtcaaggtggaaacaaatcacatgtccattgctggatgaatggatgaacacaatttgccgtatatatacaatggaatattatgtagcttgaaagcctttcttattcagaatgaaactctgccatgtgctacaaattggatgaagacatttgctaagtcaaataagttagacacaaaaggagaaatattgtgtgattccacttttataagctactagaatagtcaacttcatacaaacagaaaggaacatagtggttgccaggggctaggggaagagggaaatggggggagttattgtttaatgggtacagagtttccatttgagatgatgaaaaagtcctggtgataaatagtggtgacagttatacaacagtgtgaatgtacttaatgcgactgaactgtacagttaaaaatggataagatagcaaattttatgtatattttactataataaaaaatagcaaaaaagtttttctagggtagtgcttttttcactgcagtttggtgaccatgtaggtacagttttttgaaatttattaccagttaaatatgagtgagtatatgtgcctgagtttgttgtgagtgtgtgtgtatgagagagaaaaagagagagatttgagttgtcaaatgtatttcctgctgctgtggtgacgttccaaaatgtttgaaagctgttgccctcaagaaactcttgtatatagagtaacagctttcaagatatttttacattagcccacaataagaaattcatgtttgaatatgtgcgttggttgtacatgtaaatctgaaataaatcttgggtacatgccgatactttctatttttttcattgagtaaaaaaagtaatggccatgacccactaaattgattttgtgatccacaatttgaaaattactgttttaggttacgtttctgggactgg

SEQ ID NO: 15015 - DNA, 1530 bp, Homo sapiens
tgaatggggcagcacctccttcccccaaagtgcgattgcccctgtttcccatacgaagtgtaatgacgggttgcttttaaaattatagtccttatcaatggaaactccagatttctttatcaaagggaggtgggtgggcatgaatctagttggaaaaggggacttgaagctaagtttacatggcactttaagactgagaacatatcaattgttcataatcaggaatatggtagagggagagcaggtgtagatgatgggacgggaaagtgctgaaaccagcccagcagacctgtgagtcgcctctggttctcacgcagcagtgtgtgtgtgctcacagggatgttccacccctggttctcatgcagtagtgtgggagagtgctgaagccggcccagcatgcctcttagttgcctctggttctcatgcagcagtgtgtgtgcttacaggagtggagatgatgggatgggagagtgctgaagctggcccagcatgcctctgagtcacccctggctctcatgcagcagtgtgtgtgcttacagggacttcccaggctgcacttcccttccctgtgggctgcacccgtagaagtatagaaaatgtaatgtctgttgaatataaaatcgtaccactgaattgttctagtgatgaggttagattttgttgtcatgtgcattgtcaccatagtgacccgtggcatatatttttaacatacttggttgggtttgagagaaatctgtggacgtaattttttgtttgtgtcaagctctatgactcatgcagtgattggtcccatgatcatggcctattagtgaaaacctccaaaggtcaggtggccaaggtgttcccacattttttctatataacttgtttcctaatagtctgcctttctacctatgattaaaaataatttttatatacaacattatttacatttcaaacatctctacgaagtcatgccattttaaggagatgaaaacagccacagagttgagtgacttgctccaaatcacataactaagccaggactagaatcccagactttcagattttctctgccctgggttataatctcttgtttttcagtgatagacctgagtcagtctgagatgcttatttatgaaacagtataccatgaatatttattatctttcttgggcatgcttttctacacattttgaatactttcaacagggattacccaagaatgcaacatctacctgtaataaatggggagaaaattagttgcctgagagaacagaatattaagcacacaaatactttccaacacagggttgtaaattgtgctcctcattttaaggtgctgtacgtgcatgtttaaggaattattaatcagtgtattctgcttgctttctgtattaaccagttccagaggatagccttagaaatgagtgtattttgaatcttaaagtttctttatatgcggcacagtgtataatgtcgtaagttaagaaaaatctgttatctttcaaagaagttacgtagtttcaaaaatgaggttttgtaatcagt

SEQ ID NO: 15016 - DNA, 1060 bp, Homo sapiens
gcagctgtggatgcagtctagttggaggcatggcttggaggacgtcatggttcatgcgatggttggagggatggtaaaagcagttagctcttgtcagctgcttccctctgctagtgcttgagctgccaattttatttgtcagtatttcctgatctcccactcctgttgtgaaaggtcacagagttactgtcactggcaacaatttcgccccttagaagaaaactggtacagagggaaagggtgaggaaaatggtgagttccatcactcagaactaaatgcaagtggtagagagatgctttctcctgtgttaacgtctccaaaagatgaacatcaaatgcccggaaacagcaacatcaaaaagaaggaagatgagaagtattgttgaagagtatggacctacagggtttttaacaagtccagcaaaacaaactatggccaaaagaagaaatttttctgtcactgcgagtagacatcataaatgcttggtaaaattgccagatttagggaataaaaaatttttaaagtacagtgttgaagaatggggcatgtcatgaagacattcagcaaagaagcaatcttggcaaggtggagaagtgggaagcaatggggagagaaagggagatgcccagagcaggaattctcaatgtgtggtccctaggccaacagcatcagcacatcttgccctcaccagacctactgaatccgaaactcccagcgcaaggcccagcagtcttcaacaagccctccaggggtctttggtgcatgctcaagtttgagaaccataggctttgccacggttaaaaagatgttttaatggactggtctcctcctaagctctgaggtgctctcatattccctccataagtaaagagattttttttgtataattctttgcagaaactgttaatgtctttatttctcatattttttttttcccctacaagctcctgaaagatctttttgaagaattgacaaaggatgctatcaagggctatgtttaggtggatggaaataaccttttgaaaatggataaagcctgggtgtggtgactcacgccca

SEQ ID NO: 15017 - DNA, 1026 bp, Homo sapiens
tactccttccttcaaacaaaagacctttcctcaaccctttgaaagcctgagtaccactaaggtatactgcccttatctgcactctgtccattctgcagtctaccgaggcagtggtttttaaccctggctgcatgttagggtcacctgggaagttttaaaaagtcctaattcctggactggaccacagaccagttaaatcagcatggggaggtggggatgggtttcagtctttaaaaagaaatgtagctgaggctgagaaccaccactctaaaacctggctgctacccttgctaccattaaaactgttcttgctggattcacccaccagtgacttctactattaaaatttagcccataggttgatttttatgacactgatgctatataaccacttccttctttggaatgctccctttcctgaccctactttcctgatttttctgccacttctttgctctttctcagtttctgtggagttgtttggtaggtcagtctagcacagactggatgccggtctctgccgccacctccgttatttcagtgaacacctgtatgccagtgagttcctttgccataccaccttaatgcaccaacttaaaagcacagattagagtggagcattcacatttattactgcaggcttctaggaaagcatattaaaggtctctggtccttctctcacctcccttgttcctcctccaagcccagtgaggtaggaggaattgctaattagattagtgagattctaaggtgggtcactcctgtttacttatgagttgctatttatgaaaagatggcctggactgtgttccctcttctgctttctcctcttccgggtcttggactggtaagggggcctgtgcccaaaaggggctcctccacctaatgctgtctttaatctgtggctttctgctgctggttaattttttaatttggcttcctcaagcctttttggccttgaacttcatgttgatttttatcaaagaactttttattggggcatcagcactagccctatgaatacag

SEQ ID NO: 15018 - DNA, 1034 bp, Homo sapiens
ctgtgtattagagcgtacagaaaacataagtttcagaacggaaaaaaggaacaacagatggcatttgctgataaaaatgcaataaacttagaatttgaggataggtggtcagaaaaaaaaatgcaataaattaaagccagaaaacactgctcatctgcaatccaaaatgtttttaagctcttcaactattcttgggttgattaggaaatgcaaagtattaaaaaaacatttcatatctaaaatataaacttgttcctctgagatacaaataaaacagtgctcagaggaaaattcattgccctaaaatttatgtattaaaaaataagataaatgtcatataactcaaaatattaggaaaaggaatcttttaaaggcaggctaaaagaatcaagaaaaattaattagaaaaatgaggaaacaaagctaatttttaaaatatgtagtaaaatatgtaacattttagctaacattacaagagaagacaaacacaaaataagaattaccaagtattgaataggtaagagtcataaaatattctttgctcaactgtatgcaaacaatttaaaaacttggattaaatggataattttccaggaaggtatagtttgccaaaaaatgacatcaaaagaaatctaatataacaattgtcatagaagaaatgaagtaagtatttcaattagcatgacagactaaatacttttaaagacccaatgaaaacaaagaaatgcatttggagaattaacagaaactttttgtaacaccaattttttattttacattttaaagcatggaatggaatttattgtaaagacgtgtattttatagaatccaagcaaaagctcaccagccagagataaagtgaggccagctcagggaatgtgagcagtggcgatttattccctctggtgttccatgttagcctgacacagagccccctcttcacattctcaggggctcttgatccaaaaccttttttaaaaaaaataattttagacttaacagaaaatctgcaaaaatagatttcctgtgtgccc

SEQ ID NO: 15019 - DNA, 2973 bp, Homo sapiens
ctgcctgcgttggcctcccaaagggctgggattacaggcatgagccattgtgcccaatccttacccttcttgaaaggacactacacattttccactttcaggggtcagggagtttgggctctggtacttactctatgaacagttgtctatgccattcattgtgctatgtgtgtcctgtgtctggatctgtctgtgcgatttctgtgctggtgtgtttatgcatgaacaagaataagtgaaagtatccagccgagctactttactgagttatgattaaattacatgcaataagctgcgggtaggacttttttttaaagcagtgtttctcaaactcaagcatgttttagaatctccttaaaagtttgttaaaacacagattgctgggcctcaccctagagctgctgatttcataggtccaggtgggactgagaatttgcatttctaacagggttctaggtggtgtgctgctgttggtctcagtgtcgctgttgctgtcagtcttggtatcatggagaaccactgttctaaagaaacttcctttcctttcccttaaaccatcctaggttggacaaccagttgtggtccatttgggagctcccatctcattaaaaaatgagaacatcctgagccagacaaagatgctctttgtacttttagtttcattctgaacccaagccagaaatctacctaagcaactcacgtgggagtcatgaggaagcaaatatttagactttacgagcatgcgcattctatactgaccagtgttgaatttttccacgattttcatttgggcaaagtactatgtgttacaatcaaccaggtggtacttctcagatgcctgataatgttctgaaaattagagagataaacattatcctgtgtgacaaatacaggtatgtcagtacaggctggctgaagatctgatttgctgggtgaaagctcctttcccaactctttcacctgaaactaaaagttcttgctagtgagcatccattttggccagagtgtggctacatcaccaacccaaaagggtttagggaggacagggaacaagatttcatagctgcataataccaggcattcccagaagtgctttgccacctttgctggtatgtcttctgtggctttacatgtgccaggtaagctgacagcagaacatcagtatccacttgttgtggttttaaaatatgttcacatatacagttgaaagcattccttctgagaactggaacaagacaaggatgcccgctttcaccacttctattcaacatagtgctggaagtcctagccagagcaatcagacaagagaaagaaataaagggcatccaaattggaaaacaggaagtcaaattgttgctgtcagccaatgatgtgatcatatacctagaaaaccctaaagactcatccaaaaagctcttagatctgataaatgaattcagtgaagtctcaggatacaaaatcaatgtacacaaatcagtagcactgctatacaccaacaatgaccaagctgagaatcaaattaagaactcaatctcttttatgacagctgcaaaaaattaaaatacttaggaatatatatatatttttttaatttttaatatatattgtgccactgcactccagcctgagtgagagaacgagactctgttgagacactgctggagtgcagtggcacaatctcggctcactgcaacctccacctcctggattcaagtgattttcatgcctcagcctcctgagtagctgaactacaggcatgcgccaccacacctggctaatttttgtatttttagtagagaccaggtttcaccatgttgcccaggctggtctcaaactcctgacctcaagtgatctgcctgcctcagcctcccaaagtgttgggattataggcgtgagccaccgtgcccagcccctgacttaggaatatacttaaccaaggaagtgaaagatctctacaaggaaaactatgacacactgaaatcatagatgatataaacaaatggaaacacttcccatgctcatggatgagaagaatcaatattgtgaaaatgactacactgcccaaagcaatctatggattcgatacagttctcatcaaaataatatcattcttcacagaactagataaaacaattctaaaattcatatggaacaaaaatgatcctgcatagccaaagtaatactaagcaaaaagaacaaatctggaggcaacatactacctgatctcaaattacactacaaggctatagttaccaaaacagcatgatactggtataaaaataggcatatagaccaatggaacagaatagagagccgagaaataaagccaaatacttatatccaacggatctttgacaaagcatacaaaaacataaattggggaaaggacaccctattcaataaatggtgctgggaaaactggaaagccacatgtagaagaatgaaactggatccccatctctcaccttatagaaaaatcaactcagcatggatcaaagacttaaatctaagatctgagacaataaaaattctagataataacatcagaaaaactcttttggacattggtttaggcaaaaaattcatggctaaccccccaaaagcaagtgcaacaaaaataaaaataaataaatggacctaactaaactaaaaagcttatgcacagcaaaagaaataattagcagtgtaaatgaacaacccacagagtgggagaaaatattcacaaactatggatccaacaaaggactagtatctggaatctacaaggaactcaaatcaccaaaaaaccccccaaatcatcccatcaaaaagtgggcaaaggacatgaatacatttctcaaaagaagatatataaacagccaacaactgtatgaaaaaatgctcaacatcactcttcattaggcagatgcgaattaaaaccacaatgagataccaccttactcctacaagaatggccataattaaaaagtcaaa

SEQ ID NO: 15020 - DNA, 1043 bp, Homo sapiens
tcttttggtgagtttatgtacgcagagcaaggggctggattgatgggtcataggctaggcatttgttcagttttggtatgcatattgccaaatggtttttcaggtgttgcctttttattcatctttggatttctacacacacactcacatttcttaccctcttgtctctttttaccctaagaaaatactttgcacatagtgagtacctgacaaaggatgtaacaaagagtgtacatatatacacacgtatacatgtttgtaaatgcatgcgtgtatgtatacacatatataaataaatccccgtgttgtgtataatagctcaaatataacaacaaccctagcaagtcaacaatcaaacaggctatgctggggctgaaaggtgtgaagttggtgggggaatggctggggacttccattcccatctgagatttggctcatctacaggtgaatttcagttgcctttggtctgaattctggaagttgctccaacttacgtcttgtggtagttgacaaaatagaagcaagcctttgtaagaaaagggtgttactgaagaaagaggtcatccttcttcatggagaatgggggagagatgagcctgttagagtgcttggtgcagagaacaagacttttggagagaggatcgtccagtacaactgccaggctaagggtcttagatgcaatattgattttcttagatcatttagttttcaacaaactcccttttcctgcacactttttcctcattcaacctttagaaaggacttgggctgcgcatgatacgggcacagctcttctgtgaactgtctcacaagactggaacaactttcagaatttctataaaagaaaacattacagtattggggaattttttttaatcacaggaggactctaaaatgtgtactgccattttctttaatcttgattgacttcatgggaaaatttgatgccactaagaaatatataatttcccacagatgttatatctctgctattaaatgttgatgtcccagaaccccgtgtgctcgtggaagggtctagaatc

SEQ ID NO: 15021 - DNA, 1043 bp, Homo sapiens
ggcaatgttagcagagtggcagcccatgctttggcttagtatggcattctgcatcaatgcatgtgcacgcacatgctcacatgtgtgcacactcttacagggaagttaatagagatctacagccctcgttaccatttgctttcataaataaatatattaaattgggaagccagatttatttctggcaacagcttgcaggcgacacctccccctcttattcacagttcctgaagcgagcccagcctctcccaccccacccccaggcgtgactttctctcttaaaattctatttttaatttgttgtgatgaatgagtgacacctctgacagccgattcgcggagattaatagaaacgacacaatatttacgtcggcgctacgaacaattatcctgccatctatctctgagattatcttcctgattgaaaactactcatccgtgtaatcggaattatttggaattagaagggaatttatagcccccctagagcacgctctctcccctcgagtctacacctcggtctccatctttctcttgtctctcctctgggcctctggctttctcttccatcctggtgatgggcagagaaaaatctttttctcctggagggggccactggtcactcaggacagtgggcatctctttagggtggcctgggactccatgatatggatctagaagtagtggtttgtgggaaggaggatcttcgtggtgtcataagaattaggggtcagcgaggccagctcctgagctcaagatagatgaatatgatctgaagaaaagggtttaatacaaaggtggagaagaaaggtgactttggaaagcacttggtgtcagacggtgacaactgtaagaaatctaaaggagcaggatgggattgcaatgatggtgttaaggttgctctatttctgttatgactgtcttagttggctcaggctgccataacaaatactatagactagggggcttaaatacatttctctacagtgctggaggctgggagtcggagatcagagtgctaacttcgttggattctggggagg

SEQ ID NO: 15022 - DNA, 1029 bp, Homo sapiens
gaatgataaaaaaaaccttgatttcctataataactctaagtagttgtgatgtattttcctttttatataactctgggtttgattggcctatatttcatttttatacaactctaggtttgattggctagcatttatatttgtgagggatatggacctatatttttccttttctataatttccttatcatattttatatctgattatgctgaccagattatattccccacaaataacaagctgggaagtgttctctctttttccattctctggaagtttgggtacaataggtgccatttttttccctaaatgtttggaagcattcgccaatgaagccatctgagatgtaaattacagatttaaatattttaatatataaagataactattcatattttctgttttttcatatgtccattttaagatttttaaagaaatttgttcatttcattaatatttttaactatacccacacaaagttatgatagtctcttatcttttttttaagtttgtaggctctgcaaccgtgtttctcttttcattcctgtttattagtcttttctgagaaccgattttcagcttgttgttttcctcttatatacatttattttctatttaaataatttctactctaatatccattatttccttttcttccctttcaatatattgaatatatcaatatatattcaatataattgaatataatattcaatataattgaatataatattcaatataattgaatataatattcaatataattgaatattatattcaatgtaattgaatattatattcaatattcttttagacttatccatatataggcccttttcatttttcataattatttcctgtatttttatgttcacatatgggatcatttttgtcttgcctgagaagagctatctttagtgttccttttaatgtgggtccagccacaatggaatatttatttttgtttctctgaaaatgtaattacgttacttttacttttgaagtatattttcactgagtattccaggtt

SEQ ID NO: 15023 - DNA, 1035 bp, Homo sapiens
tgggaggtcccttagtccccctgagtcggggaccaggaccatcagcttctgggggactctatcaatgcccccaatccacacacaagtgccgcaggcagcctttaaaaatgtgcatatgtgcctatgtgtaggtgccaccgttcatctaaggccagggcccttcttgccccacccccgccccacacacctcccagggctcacacccacctccactgtcctcttgtccttccactgcccttgagtcccatgcaccagctatgcggcaacaccctgttttcctgaatgagggccaggctgggctgcatccctgtgtcctggctcacacagacccttcatgactctgctagattctccccttctcagagaagcctcctcatgcctcctcttgcagacatcatctcccctgctctggtccacgcatgcactctgtgccccgtctgcagtagcccctgagtcccagttatgcactgctgtgtctgtcttccctccaggactgagatctcttgaggcaggaactatgttgcaaatattcaaaggaatgcccccaagagctgtgtgtgtttgatctctggtgcacagagtagttgctcaatacggttttgtggagtccagttcaaaagagagcaggggctgaaaaaccaggttgtgaagggagctgaatgtcagcatggttatgggagtgggagggtaagagaagggaaggggcttggcagccagtattttatggtatttaggaaaaagcaattgggtacccgtttggccaccacacaccagtaactccagtgtcaaattggatcacattctgggaaaggggtcactcgagaacttgtcttcccagggcccaggagagaacaaggagaagtgggaggttcccagccctagaataaataaataatcgagtcaatctcaggtttaactccctttgaccttatgtccccaacactgctaccaggcagtcccagggccagcaggttctctctgtgtgccagttccccattcccgtccctctgcagggagctgggaggttccgtgaat

SEQ ID NO: 15024 - DNA, 1031 bp, Homo sapiens
gaggcagacaaaatagccaagatcgtgaacacatttagtgtattaaacaggcaagtgccgtagagaactagtaaaggaaggaagccagggcgatctccaccgcccttcactatccctgcaggaggtgagggagagagccagccctgtacaatcccagagaagagattcaagcagagggtacatgtagcaagtgcaaaggccctgaggtaggaacggactaggggtgttcaaggcacagccaggccagtggctggcgtggcgtggatgaggagaagcatagaaggagatgcagagagagtgaatctaggcatggacaacttgggatgctgctgattaaaggtgccagtgagagacagaagtcacttgcagtggccgagactctcctggggctgaggcatcctgtcccatgatgtgggaaggcagatctgacatctaacttggcagaggtagaggactttccccttggagctgccgtgggtgttgcaggatgcaatagaggtgttaggtaggaaggtaggaagcattcgtggtggtaggtgctcctgtttgttcaactcctgcctccagatcaagggaatttcagaaaaagacgggtccactcatacatcgtgacttcctctcaccttgtatggtgctgtaggtggaatccatagaaccttctagaaaatgagcaatgggtaggtgtgtgtgggcgggggctggatggggaagggcgggtgcttgactgttcacctgaagcttcatcagcaagctttcaccttggaaataatctttctctttgctccagcaaagggcttctcaaaactgtggttcccacagttgtcctaggaaggaggctttggtcgattaccaacttttctaggaactcatgagatcctggtccttgttctgagggggactgtgctgagagcacaccctctatgaacactgcctcctttgcccaatcctactcctactgccacggcctcaggtaggagtccctgacacggtgtagggttttgtgtggacacaagctccggggctgcagctgt

SEQ ID NO: 15025 - DNA, 1724 bp, Homo sapiens
cccccaaactccattgtatcattcttatgcctttgcatcctcatagcttagatcccacatatcagtgagaacatatgatgtttggttttccattcctgagttacttcgcttggaataatagtctccaggctgggcgtggtggctcatgcctgcaatcccagcactttgggaggctgagacaggtggatcacctgaggtcaggagttcaagaccagcctggccaacatggcaaaaccctgtctctactaaaaattcaaaaaattagccaggcatggtggtgggcacctgtagtcccacttacttgggaagctgaggcaggagaatggtgtgaacctaggaggcggaagttgcagtgagctgagacggtgccactgcactccagcctgggtgacagagactccatctcaaaaaaaaaaaaaaagaataatagtgtccaatctcatccaggtcactgcaaatgatgttaattcattcctttttatggctgagtagtattccatcatatatatactacagttcctttatctactcgttgattgatgggcatttgggttggttccatgattttgctattgtgctactataaacatgaatgtgcaagtatctttttcaaataatgacttctaagacttgaaactataaaaattctagcggatactttggaaaaacccttctagacattcgcttaggtaaagatttcatgacgaaaaacccaaaagcaaatgcaatagaaacaaagataaatagctgggacctaactaaactaaagagcttttgcacagtaaaaggaacagtcagcagagtaaacagacaacccacagagtgggagaaaatcttcacaatctattcatctgacaaaggactaatatccagaatctacaacgaactcaaacaaaccagtaagaaaaaaacaaacaatcccatcaaaaaagtgggctaaggacatgaatagacaattctcaaaagaagatacacaaatggccaacaaacatgaaaaaatgctcaacatcactaaagatcagggaaatgcaaatcaaaaccacaatgcgatactataccttactcctgcaagaatggccgtaatcaaaaaatcaaaaaacagtagatgttggcatggatgctgtgatcaggaacacttccacactgctggtgggaatgtacactagtacagccactatggaaaacagtgtggagattcgtgaaagaactaaaagtagaaccaccaatttgatccagcagtcccactactgggtatccacccagaggaaaagtgttgtgcttttcaacacttgccctggctgctctgtagaggaggagttgcagagtagcttgaataagatcagagagacccaattaataaagccaagacttgaattcagaccttccgggctctgtctcacgtttgttttttaggtaggtactgtgtgccaggctgtgtgtcttgctttcccagggctgctgtcacaaattgccacacaccaggtagcttcaaacaacagaaatggattcttttgcagttctggaggccagaagtccaaaatcaaggtgctggcagggccatttgaggaaggatctgtccatgcctctctcctggtatccggtggttgccggaaacgcttggtgtttcttggcctgtagacatatcattagggcccgctttaatctcacatgacctcatcttgattacacaggcaaagatcctatttgtaaataagcccgcattc

SEQ ID NO: 15026 - DNA, 1036 bp, Homo sapiens
tggcggttggacattcccccccacccccctttaactgcgagaaggcaggccttagggctctaacacccagtactcctactgctcaggaggtggggacctcgcgcgctgagcgtctcattccatgaagtctctctgtctcaccccctccccccaccccagcttgattctgtcactttaagtccagcccctgagagatagccaataggagccaaactatacatcagtctcccagccttaaagctacagtagggttagtgggctccaagtctcttgtgccccagcctcctccacggcttcgcatcccctctgcccgctctctccggagcgtgcggatgagtggagagctgggctgtgcgcgcacggctctctgcctccctctcccccgccgcggccgcctcctcccactctgcgttctcgcgctcactgtgccctgcccgggctcgcaccttgcccgtgcccttcactcgctcttccgcgtgatttccccgccgtctttctctaccaactgggaatgctaaaacgggactgatggacgtgtccgaactctgcatcccggaccccctcggctaccacaaccagtaggtgccctgcttctcggtctgtctgtccttctgcccgtctggcagtctctgtcctggggatcgcagttccttttctgcacattcttgtgtaaaagtggaagggacttcgggggggcacttgggggacgaaggaggggaaaagccgcacacttctgggtttctttctagggcataaaccctcctctaactttttcccgcacccccttttacaaatccacactttcaggcaagagtggcgctttctcatgcactttctccctttctctctcctctctgatcttgctccggggtgagaaaatatttgagtttttgtggaatggagcaagaagggaggcagaagcccagaacaggtgcagggatgtggttgcaaggatgtcctgtcccgtcagagaaagcctttcccgcgggcgctttgttttattatttccatcctggggaccaaaaatgatcccggc

SEQ ID NO: 15027 - DNA, 1008 bp, Homo sapiens
tctttgattatgcttaccaggaaagcaaggagtgagatggaggctttaacagctgggtaattcatcgagttgacggcagccctgactggagtttgaggagaaatatgggcaaaaaggcaatgtcagggaagcagcagaaggaagtcagggagctgaggtcctgggggtctgggaaaggtttgagatagaaatcatttataaactaagcctgacagaggtttagatccccaaccctttccggtttttttttgcaaagaattagcttgtccctccatggggcacaggaaaagccaaaaatatacctgctgtctccaccgaggaattgagcacccctgtcagatgtcatttctcaaagcccaggacccactgggcagcagcccaggcattgatgagctggcctcttatacatatatgtgccgcctagggagggtctgcatgtgctgtggcgcagaggggcatcatttcaaggacgagcttgtggaggtctggggctggtgtctggggagacatctttctgacctctaccccatggctttgtgacacagctttagagccatgggtagtaaagtaacagagcaggggactggattctttggtttggtagaaggatagtaggacaaagccattcattatagtgccggcatttcccagggaacatacagtaagtgggttcgtgtatgctctgctcactgttttgacccctgtggattggctgacattcccagacttgagaaaacccaagggcacagggactagagttgagggaggaggaactctctggtcctcccttttgcttctaacacatagagagcatttgttaatgctgtagaatcattctcactttcccaggtgagaaatgaacacacacagagagaaacatacgtaccttcctaccttgctctccttcattttcattttcctgtagccaatcctgtaggtgactccattacccattctaatcaatattttatgtacatatataatcacccagagtgggaggcagcgtgc

SEQ ID NO: 15028 - DNA, 1048 bp, Homo sapiens
ggtaacatcttaaaaaactacagtacaatatcacaaccaggatattgacattgatacagtcaattgacattgatatggtcaagatgcagaaaatctttaagagtgaagtgggtttttttttttattaattttttttttagatggagtctcactctgttgcccaggctggagtgaaatggtgtgatctcaactcaagatctccgtctgcacagggtcatgtattccagggattatcaatttttttctattcatggagcactcagaaatattaaaattttgacctgtacacattaagggattaaacggtgttaatggtggttaaaacaaaggatctgtatttattgcagtatttggaaatatgtgacactttacatttgagcattattaatgcttttttgcattcagaaaattatcaataagatgataaaatctaataatcctagacagtaattgtaagttaattagtattttaatgtgtttcctgagtctacttttagatattttactaatgtaaggacacaaacaataaggcaactctcatttcaagttcaagtcttcttgtttatttccagttagtgtttgtaagtcttaagcatcctaattttaaaagtaattgcccattgtatcagtcagtgaaaattgctttctgctgcaagttacggagaacctgatagctagcagcgtaagcatggataaatgaagttggtttttccaccttacaagaagcctggagatgcgcagctgctgtattgcacaaagttctcagccatggcggcaggggcgctccagctctttctttcttctctggtgttctttggtgtcctcagacagccatgtcatggctgcaaggtcgttgccacacctgtaggcttcaccttccaggctggggcaagagaaaggcaaaagagctgcactgaacatggctgtcccttttctcagaaaagcaaaaccgttccagaagtcctgccatggacttaacctgacatcccattgccgtggtggcacgcacctgtggtcccagctactcgagaggctgaggcatgagaat

SEQ ID NO: 15029 - DNA, 1045 bp, Homo sapiens
gcccactttgtgcagggagttggccgcaggcggggaatgtgcgcgtcggcgcgcgccccctccccgctcccggccagctgcgagtcttggctcccggacttgtctcgtcgcgtcggagaaatcgccccccagcgccgctctcccgcccgggggtcttggttccgagctcgcgcggccgggagtcgcctcggtcttccttggggcgcgcgcagatgtgagcgtgcgagagttgtgtaggggattttgttccctccgaaactgagacccagggcgcccagtgggcacccgtgccttgactctgtcctttctgcagccgctggtccgagctgtctggcctcagtttccctccgacttttctccgctctgccagccctcactgctgcccgtcattgttctcgcagttagatgggggtgctttgtgacggctgccaagttggggtgtgttctctttattccgtttttcaaacagaacaaggcctccaaggctgaccccagacaacccaccccctcggaccctaattcaccttattgcactgattttttttatcaagtcgtattttattgtacaggagccacgccctgatttcttaaaggcgccttgcactctggccatgtgttatctctgcagccggtgtgtgggaggcctcttgtgagccagttgttttcccgcctccaccacccccctcgaagatttagggatgccaggggggaagaaggtggctgggggtggcagcagcggtgccactccaacgtccgctgcggccaccgccccctctggggtcaggcgtttggagaccagcgaaggaacctcagcccagagagatgaggagccagaagaggaaggggaagaggacctgcgagacggaggcgtccccttctttgtcaaccggggtgggctacctgtggatgaggccacctgggaaaggatgtggaaacacgtggccaagatccaccccgatggagagaaggtggcgcaacggatccgtggggccacagacctgcccaaggtgagacacacgggtcaggggggtgatagcacagtcta

SEQ ID NO: 15030 - DNA, 1050 bp, Homo sapiens
acacagactttggggtcaggttgacctggacttgaatcgtggctgggctgctgactcactgtgtgacccccaaggaagttccttaacatctctgagcctgggagtcctcctctgcaaagggggatagtggcagtgtgtagagttgttaggacaatgggccgagccggtgccgtgagacgcagcacagtgctggacatggtgtctgctacacgcttctatccattcatgtccttctacccatttgttcgagaactttcactgagtaactgttgtgtgcccggcttgatgctgggccctgaagaacatgacagacaagggccctgtgcttgggaggtttgcattctagtggaggagacaaaataagcaagtaaggaaaaagaagcagtaaacactggtcatggtgagagtgccgtggaggaggtggacggtggcgcaggctcagcttcagtcctgagcagcagccaactttggcaggcaggggaaaaggccggtgtgagaaactcaggtgggaggccccgggggctggagaggtgagcaggtggggcagaggtgtaggaagtgggagtgggcctggggctggctgggggcacctcccaggcctcagtagtacacgtgattgtatttgaagggccacaggcagggttgcatgtggatatggggagaggacagggtgagggtaagagaagagtgaagccgcgtctgtggcctgtgtgtgtgccaaggtgcgggatggagggcgagggagtgaggcaggggagggaaggcttctcttccgtccttgggccactgggctctggaaagccctgcagtgtggcaccagccctgctggacttcagagcggtggccacaaatccctggaagccccgtgcctattcgaggttccctttattgagctccagctggataccaggctcaatgctagatggcaggaataccaggaggagacgccaggcgtatggagatgagcaggactggtgtctgcaccccaaggctggcggtgcgtggaccccgtggctcccggtcccagtccctcccggtgtgctggccccg

SEQ ID NO: 15031 - DNA, 1055 bp, Homo sapiens
ccgcggctggcggcgctcacgttggctgcagggcgctcgcgcggcgcctcggcccgggtcgcatcccttcccgctcgtgctcacgctcgcccggaatgtggggttgtgattgttactctacgttccggaggcgcgtctcggcgctcctgctccggctgcggctcgcgctgtccccggcttggccgcgcgggatgccgcccgggcggagcgctgacgtcaccgccatgctctgcaccagttcttccccctcccctttacacttcctctgtggagcccacttgttgctcaggcaaggcgcatgcgcggcaggacgcccagattcctcccagccggcccctcctccgcgcctccgccctcccctcccccctcgccgtgtgtgtacaacagctgaggcccggcgagctaatgctggaagtccagagctgggggtggaaattaaacagacgatgacctttcctttccctgccgggcattcccaagtaaaaacgcatttaagaaccactagcgtcgtttccgatccctgctccccaccccacccccaagcctcggcagtgaatttaaatgtcctgtttcaggatttttcgccgtgaatttcgtataaggtattaaccatttcatctgcggttgaaccttatcccccccggcatggatgttaaattcatcgccaccactgatgccgaagcacctgcaaaattagctgttttccaatcttccagaaattgtcttttctatttgtttttgtgccctgatctaggaacccgggcttcaacgatagagctaaatgaattcagagtgcgctacccttccccccagccgcactttaaaaattttggctgaacgtctgaagaagatacgagcaccccgaggcctttaaggaaaacaggcaactggctgcgcacagctgcagttcagggcagggagggggaggggccggagaggccaaacaggtgagtgttttttctagagtttgatttttaaaaggtggaggcagcatttaataatactgatacatttttgtaaagcacagccgcagttttcaaagttctttctcaggc

SEQ ID NO: 15032 - DNA, 1035 bp, Homo sapiens
tccgtttgactgctggttcatagctctgtttctgctttgcaggacggagagagatgcttcaaattggtccacggataagctgaaaacactgttcctggcagtgcaggttcaaaatgaagaaggcaagtgtgaggtgacggaagtgagtaagcttgatggagaggcatccattaacaatcgcaaagggaaacttatcttcttttatgaatggagcgtcaaactaaactggacaggtaagtctaagctgggctgtcagagagattaactgtgttttgtttaacctgttaagtagctggagagaacagttttgaggagttacagaccttgaagggagaaggcagatgttgctgctttggagtcctatgtaaagcagtatcgagtcctggaatttctttgccattgtgggatgctaaatggatttcctgtgtctgggtctcataagtcccatccatgaagtggccgggccactgcatctttgggccttggtctttgttgggacacctacgatgatatttcttcagactagctacatgtatcttgtgagtgatttaaaaggaggaaggagaggatttttttggtcttgatctttgtgcactgtcttcagtgtgaatcttaacagattaaaccactgcgctaatgaagcttgtgtgtgacagtaatttggggctgttttatctatcttctagttttatgtcccttgtgtatgacattaggaaaaaattgaggtcatgcgtatgaccgttttggacagtcctgactgtcgggagcctgaatgtaaaaaggcactaaagctaagggagtatgagatagctactgtctgtgtatggggcaaagcatgaaatttgtgctttgataaacatttccgaagtgaacagtcatatcataaagaagggtgcaagtagatctatctgtccatgatttttgttaatttgtttttaaagtacactcgaagcatagtagtgtggaaggaatcttcggtgtcatcttgctcagacctcctttttttttttttagacagagttttgctcgtcaccc

SEQ ID NO: 15033 - DNA, 1050 bp, Homo sapiens
ccgcccacctcggcctcccaaagtgctgggattacaggcgtgagccacagcgcctggccagcagtctgcttttcaggtcaggcaagctggggctgaaatcttggcttacccaccatgtgatcctgggccaaactgatttactattttattttaaattttagttttaatgagacagggccttgctatgttgcagggtggtgttgaactcctggcctcaagcaatcctcttgcctcagcttgccaaaatgctggcattacaggcctgagccactgcccctggtctgatttacaatttttaattgagggttagggagtcataataccaacaaagatggtaaaaggaatttgaggagaaaacgaaagaacaagggacaaataaaaactgcctgggttattcattattcatactgactccctaataaagtgattttcagtttgaatgtttttgcagacattgcctttcctcccttacagtgcttatttttttaaggtccaggttcacactagaaggccaaaacttccgcaaacatctgatgatgaaaagaaagatttttgagactgcagcctattaataaagttaacataactgagaattttgtctaaatgtttttatttgaaacaaatagttgcaccaagcaagaggttactttgcccactccaaattaaaacagagcacaataggggcaaaatttatttggcaggacagttccagtatgtgaacatcttcctcctcactgtggttggggtaactttactcatatgcagctgttcttacacaaaacattaaccccaaactactagtgtcacataaaagtaagtggtcttgactttgtatgtggggcagcatgttctataaatgctgaaaggtgggagaagcacaaacacaacccactctttaaaaaaaactaaataattcaaagtagaattttctatcccccccatttctccagtaataaaaagtagtgctgggatctggcacccagatttggtttttatcctgaccatttacaaagtgttcccccatatgacttgcatcattagggttatggg

SEQ ID NO: 15034 - DNA, 1105 bp, Homo sapiens
tttgagatggagtcttgctctgtcatctagactgaagtgcaatggtgcgatcttggctcactgcaacctctgacccccgggtttaagcgattcccctgcctcagcctcccgagtagctgggattacaggtgcctgccacctcatccggctacaggggaatcaactaattttttgtatttttagtagagacagggtttcaccatgttggtcaggctggtctcgaactcctgaccttgtgatccacctgccttggcctcccaaagtgagccgccgtgcctggcctacctcttgtttttaataaggacaactgtcattggatttagggtccacctgggcaatccaggatgatctcatcttaaaaattcttttttttttttttttgagacagtctggctctgttgcctaggctggagtagagtggtacaatctcttctgcctcctgggttcaagtgattctcctgcctcagcctcccaagtagttgggattacaggcatgcatcatcatgcctggctaatttttgtatttttttgtagagacagggtttcgctgtgctggccaggctggtcttcaactcctgggctcaagtgatctgcctgcctcagcctaccaaagtgctgagattataggcgtgagccaccatgcccagcttcatcttaaaaattcttaattatatctgcaaagacccttttttctgaataaggttacagtcacagattccaggggtagaacatggacatattgttttgggggccaccattcaacccactacaggaacttagaattaatgccaaatggtgcagctcctcaggctgtgcctgtaaccactctactccccggctcactaatctggactggatgagctcccagggttcctccaggccagtggtccatacagcatggggttctgtgttgtatcagggcatcagagccatctgtcaagcctcgagacatcagtgtttttttctctacctctctcccatcccctcagccctctgcaatttttcctgaaaccctttgggctgttcatcttggactcagaaaattcccatgtattaacatgttgacaaagttaggctgcaggtgctgtgaggacagactcatact

SEQ ID NO: 15035 - DNA, 1088 bp, Homo sapiens
agcagctattttctaccaaattaaaatccactcagctctcttcctgtccctgaataaaactactctcaaagctcttgcctgttacagcaagactttttaatagacttttccctgtagaaccgtgagacatatgtccaattagccgaataacttcacttaaatatacaaataaactgttgactgataacagcaagacatatgtgaagctaatttaaggcaaggtggttcaggaactggggtgctgtccctcccacagccccaatctgtctttaagcttctcttccctccaatctattattattatttttgagacagggtgtcactcttgtcgctcagggtggagtgcagtggtgcaatcatggctcactgcagcctggacttcccaggctcaggtggttctcccacttcagcctcccaggtacctgggaatacaggcacgtgctgccatgcctggctaattttttgtatttgtagtaaagatggggtttcaccatgttgcctaggctggtctcgaactcctgggctcaagctatccacctgccttggcctaccaagctgctgggattacactcgtgagccactgcacctgctcccgctccagttttttgcttatggaaaagatctttaccccctaacccccaacatgttatgggatgaagggggatgtctctctgctgtgcctggccacagtgcagactatctaagccactattcattcagccaattgttcagtgatatttattgaatgcctactatgttccaggcactgtgtggggtgctgggtgtacaatggtctgttcttgggaggacaagaggtaattcacaatgatgggactcaaaagcacatccgctccaggaggataggggacttgtttgtattgcttgctgctgtgtctgcagcactaagaacagtgcttgccacacacagagtggtctcagtgtacacttttcaggaaatcactgtgggtctaagtaaacaaggtcatttcagctcttgctgagtgccctaaaggagataaaatgtagtcatgggataaagaggggctgagggagagtctgggaagggctctctcgcatgatgtttttca

SEQ ID NO: 15036 - DNA, 1035 bp, Homo sapiens
tgttgagactgggtcttgctctgtcacctaggctggagtgcagtggcacaatctcagctccttgcaacctccatctcccgggttcaaacagttttcctgccccagcctcctgagtagctgggactacaggcacatgcatcaccacacccggctcatttttgtatttttagtagagatgaggtttcaccatgttgaccaggttggtctcgagttcctggcctcaagtgatctgcccacctcggcctctcaaagtgctgggattacaggcatgagccaccgcacctggccaaaatgttcctttttaaattgctttatctttctagattcttggtggacacagacacaaaatcatcccctgctcactccctctgcagtatccctcagagttgcctgtcagaaatacctgcttctctttcttttccatggtatgctctggaatcatttgggtttgaagtgctcctggaatttgcaatttcataatgaaaagtcccacagtactaataaccaggtgtgagatggtgctggatctgtaactacctgtggctctggggcagcttttgctatcgtacttcacactccagaagttcattttggtttgggtgtgtgatgcagctctggaggcttggctgtggttccccaagaaccagctgccacatggggcctctcttggccattttgcttagttgctcctctgaccagaacatcactatagtatctccttccgaccatctctgctcccctaagccagtgtatcttctcccacctaccctgaacctcgttcttagactggacttcaatagccagctggtgccacccccgtcttctcacagctgcctctcctataggcttagaaagcagggcctagtcaaagcctagacccaaagctatgctatggtcctctccccatcttaatccagccatgcaggaccctgggtaacagttccctttgggtgaccctgagggggacccagggaagccttgagaagcagtcggagtccatgactgtcctggaagccaggcctggtgtgatggggc

SEQ ID NO: 15037 - DNA, 1024 bp, Homo sapiens
agtctctctgtggggcaaagtggctcacgcctgtaatcccagcactttgggaggctgaggtgggtggatgacctgagatcaggagttggaaactagcctggccaacatagtgaaaccccgtctttactaaaaatacaaaaaattagccaggtgtggtggcaggcacccgtaatcccagctactcgggaggctgaggcaggagaatcacttgaacccaagaggcgtaggttgcagtaagtccagatcgtgccattgaaaaaaaaaaaaaaaaagaaacaaagaaaagaaaagaaaaagaaaaaaatttctagtctctctgatctccatttaacatgttcagtctacaagtattttggtggtacctaaacttattcaggcagtatgtctgtggtctataaatgtacataccccacctttgctgtagttgatgcctctgctgctgaaatttgtttcttttctaagtgttgcatccctctttgaaacagcaggggctcacctggcaaaacagtcctgtaagcagtagtggagaaacttggctgctcactgttcctgttttgagtaaattacccttcttaattgaacattatatgatttggcttcccaaatttgtgttcttcttttcaaaaatctaacagtaatagagtgtatttagttaggttcaaaatcatattttttaaaaagaaatgcaggaaaaaattcaaaggatgtttaatgagaatatgatagactttgaaatggaagatatcaccaggaaattctccatttcttaggactatataagtgacactgacttcacacagtggttttaaggttgagtgtactgttacaggaatatgtaagctgcttaaaacatttcacaactcatggtcagacaatgttcctttgagaggaaaattcactggcgtttctcaaaaacctgactgcttaaaatccaagtgacccaatgctggccttgcttatttctagggaaagttgccttagcaacctactagcattaagttgcttaaaggaatgtgtgtttaac

SEQ ID NO: 15038 - DNA, 1034 bp, Homo sapiens
gctaacatatgactaaaataggaactggcagctgggggtgatgagagaaatgaaggcagtcagctacacactgactgccggggagcatcctgcacctcagataagggagcttccgcaatgaatgcctgggcctttggctttgtttcaagtcttttgatctagcggagtccataggatcatttttcccgtgggccagacctctggagaagcaattggcattgttagtttgcactgttagttctgaagctagtttggtaacaaaaagttattgtagtaagtgcacttgtgtgtgtatgtgaggggtgtggatagatgatcatgttcaagtctgtagtagaaaatttctaattattgagtctagagaactaagaatacttataggaggtaattaatccttacccgacatgtggaaaatgtcttataacccttctgtttaatttaacaaaaatatagtctactgttcagatggttaccactcggagcaactcaaactatttccctacagattttcctgtagagaatgaatgagaaatttttttgtttgtttaaggcctgaaattttactaccaaagtcaaattttgagtattgattgttgagtcctgaggatggttatattatcatgacaaatcttgcttattgtttttaattagacaaaattttcaaataactgtgagttattacatatctcttttattatagtgttctatagattgtattttgtttcattacccacactacacacacaaaccacatatacacatgcacaacacacacacattctttctatacttcatgtgaatgctttgagacaatcctatttaacattgacaatgaacaggacagctggtctctcaataaaatctaagataccacagtagtatctgcaaataatatataaattagaaatatttggaatgtttagtttatttgctaaagctcttcagaactataaattacaatattaatgaacttatttttaattcccatcactttcatttttatagaatccagaaataatgcatgtaacttgcca

SEQ ID NO: 15039 - DNA, 1035 bp, Homo sapiens
aatgcttcctgcttaatccctgatggatgggggagagggtgaaaggaataaaagcagtccagtatcttaaaagctgttcataggctcatagaaaaaaatcaatctctctctccatatgtgttatcattggccttgctagtgttgctgaagggtttgttgtgtttctgttaggaatttcaaagatttctaaattgatgttaaccacttgccttgagccaatatagaatctacaagtttgctgccagcaatgagcaggctctttaatggtcatttttaaagccacagctatgtaaccaaaccggagattcttgctgtgcgcctatcttttggtgtctttctttagttccaaattatgggttgcttcctatatgttttcaaaacagattaagcctttctttaatagcattgctccctcctgaaaactattattatcattggaaactgttatttagtaacgatatgtgttattatttcaggacagggtacagtatagcatttataagtatgggccttggagtcaactggctagagttgggatcttggtttcatcacctgtgagtctaaagaccttgaaatgtcctaagcattgaaatatttggtgcctctccccacatgtaattcaaaatacagtaacactgaaccataaaataagtgtaagaatttctaagagtttttatttttctcctctgatgatttctgtaatgctttcaaaatatattagattctttcttcccaaattctcattttgtactttctctgttttgttgttctttaagaagatgttcattcttctccctgagactgtttcctagtctagacaaccagggtaatgataatacctggttaatgtgaagattaagtgagttgaccacatgtataatgctgggacaattaagtcaatcctcaataaatgttagctgtgaggattaccaatcatttggctagcattttaaattaggacatatttttgagtacagatttcttcattttgaagatgaaataccctatcaattagacaaggtagatattttttat

SEQ ID NO: 15040 - DNA, 1705 bp, Homo sapiens
ggccttagcatattgctgttctgataaattgcaataaattttaaaaagctcttactttgagtttgcttgggaaaaaaatctcatacttgagagttttataagtagaaagagttgggaggaattttagttgggtttcattcttctaaactctatactggtatgttttttcattttgatacttttcagagcagtataaatggtgtcaaagtgggaactcgaaataaagtgaactattgatattcttcaactcattaacacacctctatgtcattttaaggagttttatatgttgctttcttcattaatatccatccattttaaaaaatttattaaatctgaaggacaacttccccaggactggagcattaccaatatgcttatatttcatactgagggaataatttagttgtgggaccataatccatcctcctaaaaacaaattaatagagataggaatttatctctcatgattttgttaaccagaaaatagaatattatgcccaatgaagatttataggaaatgatacgtttggtgactagaaatgatacgtttggtgactagtagttcatttttacaagtatgcaatgaatccaagtctcttaactgaaatttaatttcagctaatttaattatcagacctggtttttaaatttagttttctgagtcacctcactgagtttttttggccatatttaattcttttcattctcattattttacttcgtagctttaaacattaatgcagtaggtatccgtaatttattctggtcatcacctgatttgagtgtttctttctgtcatcctcaattatatacccaagaagaccataatacttcttatcattgaaccaagatttcttcttcctcactatgaaggaatagagacttgattgttcaagttatcaaagattttcagctagacagtggaagagataaccataatgaaatgttacttgctaacgtcagtactgaggttttgttgtctattttttcctccccttcaattgctcaaggaagcctgttatgatgcctggtccattcagaccaggtaaggcaaacaaggaaaacgtatgagaataataatgtttcctccacccaacccactaggccggcagttaaccatcttcaacactcaggcgcaaatagccattggtggaaaggacaaaggacgcctcttccaaggccaactctctgggctctattatgatggtttgaaagtactgaacatggcggctgagaacaaccccaatattaaaatcaatggaagtgttcggctggttggagaagtcccatcaattttgggaacaacacagacgacctccatgccaccagaaatgtctactactgtcatggaaaccactactacaatggcgactaccacaacccgtaagaatcgctctacagccagcattcaggtaggcctttttccaagtattaattgcgtctgtatttttatctttgcaacattgttatcatggtcattgctttatgtagctaaagagtttgaattactatgtaagaaggatgctggcagatactcatagtaatgagacccaggagaagagaaaggtgaagtcattgctaaagaagtcataaaagtctgtggcactcctgggttgttattcttattgtatttatcactgaaatggtaaagctgttattcaaaacgagcaatggactacactttcagtatgaaatactctct

SEQ ID NO: 15041 - DNA, 1024 bp, Homo sapiens
catctgccaggccccagaattgtaagtccactgacagcctgcatcatgcgcctggaaaagccacaggcactcaatgcccacctgtgaaagcagctgaggggactgtacctggcaaagccacaggggtggagctgcccaagacctggtagctcaccccttgcatcagcatgtcctggatgtgagacatggagtcaaaggagattattttggaactttaagatttaatgagtgccctgctgggtttcagacttgcatgggacctgtggtccctttgttttggccaatgtctctcatttggaacaagaacatttccccgatgcctgttccctcattgtatcttgaaagtaactaacttgtttttgattttacaggctcataagtggaagggacttgccttgtcttagatgagaatttggacttggacttttaagttaatgctggaataagttaagactttgggggattgttgggaaggcatgattagttgtgaaatgtgaaaaggtatgagatttgagaggggctgaggtggaatgatatggtttggctctgtgtcagctcatctcgaattgtaatccccaacatgttgagggagggacctgataggagatgatgggatcatgggggcagtttccctcatgctgttctcatgatagtgagttctcatgacatctcatggtttaaaaagtgtttggcagtacctctcaaccacctccatataagatgtgccttgcttccccttctgctatgattgtaagtttcctgaggcttccccagccatgtggaactgtgagtcaattaaacctttatttctttataaattacccagtcttatgtagttccttatagcagtgtgaaaacagactaatacactatttttatgtctaaatgaactgagatcagatattaaagccaatctcacggggttaacaagaattcttgacagaaatttagttatgattaagcattaatgaggctttactttgacccacttccttggaactgaaagtcaggtaacgttagatac

SEQ ID NO: 15042 - DNA, 1034 bp, Homo sapiens
cttccttagcgaatttcacatctactggtgtttttggttttctttgattccttctactgtggctctttgaagtgattcaaaattaaacagtagctactttttcagggaaattcatcatgttgtgttcaggattccagaagagttaatgatgcagaaaaagttctgtaaaacatctttctaaaagaagtccttctcttgcaagcctcccacttactggcctcctgtaccatttgcagtgaattggaactccgttatttatttatttttcaaataccacctctaacttaatttaatgtaggatgtgttcctgcaaaagtgtgcagtgccatgtgccttgagtcacccaaacaaagcagtgtcattgttacatccggatctgttaatcagggaaggtcaaagaaaatattcttatataatttggaaagtcaaaaggacacgttgatgattctcaaacactggtcagttattctgctgatacttactaaggacatactttttctggcagtttaatggttaaagacctcagccatttttgaagcattcacaaagtaactctctggagctactaaccattagatgctcattagaactgagcagtttttccccccactttgttcccaggttacttttaagggaatgtgcaagaaacttggaaaaaggtcttctgttcccttcagttcacatgtcatactgttatatttcagttctctttattagagctttcaagacacagataaaagaatcttccatctgaaccccttaagaacctgagggcttttggatttcaacccactgaaaaaatatcaggtcccaaagtttatagatgatattaggcctcagaacaattgaaaccaccttcagcagggagcaaaagaacagtggctcctaaaattggttcacaaatatactgtccattgaagtcaacagaggtcatatggctgaatggaaaacattagacgcatatcagtcctgaaataggttcacatgctggtgtcactcttagccccagctgcctctacatgtcacgttcatca

SEQ ID NO: 15043 - DNA, 1340 bp, Homo sapiens
atcacataatatataatgtaatatatacatataattaatcaaattggacctgagagaagcaggcactagagtgtattttgtaagctgttaacatcttagtaagtagcttctgaaccaacattcaacccagcataaaacaaaaagaccttgttttgctactttaggaaatgtaagagagattaaaattctttgggaaatggttttaaaaagtagttttgtactcagataggtaaagaacaagtccagtggtgctgacagcaatggaatttaaaacttgattctaataatctctgagtcccgaaggaatgccacgcagacatccgtttgagtcacgagcttgtaactgaggatttgacaaagattgagtcctcactgtgtgccaggcaccatgctaaattttgtgctaggcacttgggatactctttcagacaagactttgtccctgctcacagagaaatctgataggttggcctatagtcactcttttctaaacttgacctatctacctgaattaaccgaaggagctggttagaaatacagattcctgggccaagaagaagaacctaaagtccaacttcctgtaaccatcaacacatttaaccctgtaagtttagagtttattgtaaccttctcatgccctttgctatactcagtgtgcaaatcatgaagactaaggtggatcctgttttggtggagattctgatgtgttaagtctgtgatgaaacctgggaatgtgagttcttgaaagctcccattattggaaatcactgagctagatagtttttagaattttttttctgaccggagaatcagtgctttttatagttgtctgacttgtagtcacttgtgactttctgaaagtttttctgtgtattttgccacatagaaaatattgctcaatttaactccatctgctagaaaagtaccttcagagaggctagatatcagggctggcttctctcttggtagcggcagtctcctgtctgttctccccaccatcagtgtcccctaaaccattgtactgtttttggtgtccccagaattaattttctaaaaaaaaaaaataaagaaatcacatcatattcctttagaaacctatatctttggataaagcccatcaaaacttgttatcatgccacgcaagatccgtgacaatctagatctcaaaccactcctcagacctcattgttcagcacccatcccctgtaccctcatgccaaacatggtgaggcatggccctcttgatactttgcctttcccatgctgtttaccatttacctagaacattatcgcatactctccatttggcaaactcttcctttaagaggcacgtggatgac

SEQ ID NO: 15044 - DNA, 1050 bp, Homo sapiens
actctccattttttccccttacccttttaccagcactgctaaatggattgatttgagattcacctctttttccctgtggaggtgataatggacaacggaatgaccagagggaagataatagcataaagtgtgtggcctctgagagggcctgggaaaaatggagaattgactgtgttattaataggtcagcttcactggttttcaaaatctatgtaattgctcaggcggtaagcttttattgggtgaaaaaatgatgagagatgggctcggaaaggcttgttccacattgatgaatggaaaataagcacagtatgtgcttgcaaatctttacactattgaattagatttttgaccatccctcgctttttgcactttctgtggttgcactcatctctacatgtatgaaagttgtgttttttgaattctagggttgtaattaagacccttcagttatttgtccatggtatttctctgtaaatattattaatactgtcgaaattatgtgatccattccttaattccttcacttccctttaagtagctagactgtggcttctgtcacttctgtgttcttttgtcaccatctgctcattatctgtcaagaggggactgtgaattatttctgccctgggccagtctaatggaatccttggtggggctgtttagggaagtaggtactacttaggtgtggtagcagttaggtgaatggctccacaggcagccagctccattaccacatgaaagcaccagcagcatttggcttcctggtgaattctgtggtgtttcttctgtctatggaagtgcaaatttagctgaattgggtagaaccgaaacgcttgccctctgcaatttgctcctgaaaaatgatcaggccctataaaggaaaccttaacataccaatgtctctgctgctagaaatggcttccttgtttgtctggactacatgcatccgtcaagaatcagcctatggcatggtgtccctcttccttccctccaagtgctgaactcacttgggttttccactggacttcagtgtcactgtgttttaga

SEQ ID NO: 15045 - DNA, 1049 bp, Homo sapiens
atggacacattccctcatttcttttctgtccttaagctttcttaccaattgaaactggtctcaagataagttgaagactctttcccgctacagggaatatgactaataccaatgcttagtgttagttttctgacagtttttacactttaaagctatgagtaaaaccttggactaaatgcaggcatctgagaaagtaagtaacaatgccgtggaaggaaaggcatcacttgtttacacacctggtcaccttctttagtccatgggactcactcatgtttccaagagaatatttcatttccacacagacatagacatttctgacagttaaatccaaagtaactcaaatgctacataacatttttacattgttttgtgtgtttcttgggtgtgtggcatttggcatcaagaagacccgtgtttcaatgcaatctctgccacattttggctgtgaagaccaaatgcaggttatttgacttttgggaaactcagtctcctcctctgagaattgaggtttgtaataccaactcatgaactcattctaaggatcagatgagataatagatcagaaagagtaggtgggtctataatgttagttacttgaagctggttcccaaatctcctcctaacccacctttctttctttcttttttttttttttgaatctagactcaagatatattaaagactatgctcatggacatcaattctttcctgtcctttagggcagtattcaggccacacggttcaataacgggaaagaatgtcgtcacatgattgcatcatgttcttcaaaatgaaatctattgaacagtataaacaacaaagaacatcatttgtcagaatgacctgggggaaatagtccagtgaaactaagcaaagggaactttataccgtgagggaaaatcaatggattgtaacagaaccctgcaagaagagacatagctttcaagttccagagacctagaggtgactgagaagcaggatgtaccagaaactgggcttcttgttctacttatctagcgcccttttcacagtgttgtatatgtaaa

SEQ ID NO: 15046 - DNA, 1029 bp, Homo sapiens
gaggtggtgtttgggcttcaaatccagttcctgcttttttgttgttgttgttgttctttttctctttgttttcatgaacttcttcagggactcaatggcctgatcctgcactcttcgccccacaattaatgaggccacttcactatggagcccaaccttggctgctctctctccctatttctgggatctttacctttcttctctcacctacttaacttttggaaacccagttttactacgtgtaacctggagatgccattacggacttcagaagttaacatatgtggtatgtaaatcatctagcacagtgcctggtgtatatcagccgcctctctctgcctctcactcattccgtctgtctcctcttttccctcgtctcccttctcttaaggatttgcctgccaatctatcttttattttagaaatcccaacggtggtactgatggatcagtaaaccctttcatgatacatagtagcagtttcctagtgactgcaactcttcactgaaacaaagacttcacaggtggtggatttttaggctttgtgacaaactcgtgagggctctttggggacaaaggaggacattttagccactccagattaccatttttgcctttgagcattgttctttaatttctcctagaaagaaaagaggaatctgcctgaagcagctctgccatccgccgacacccttggcagttgaacactgattgtcaagcccaccgtgggcaatgcaggtttccttttgccagcctggcatggagtgaaggggaagtttgtgctcctctggttgcctcagctgaccaggaaaccgtaccaggagcagcagggagggcagagtctagtggagtcctctgtgctgggactgtgggaccaggacagggcaaggacagcaggaaggaaagaccaactcatgcagcaaacaccacccacactggatgcattcaactcagtccttagagataaatgttagagacaaaggcaccattaggaaccaggacactggacgtgtactttagagttctcata

SEQ ID NO: 15047 - DNA, 1050 bp, Homo sapiens
aagtgtctcatgatgtggtgtgtcaaagctctcagtggctcttgtttctcactacggtgacctaaaccatttgtcaagagataccattgttttgcattcagtgaaatagaaaggtgaacatgtgtgtatgtgttttggaaggatgggatagtgccagtttactagcaatttcctgtaatctgcaaccagtcttacctatgcaaccccaaatattttggggtccagagccttgagaacgatcactattattatctgacagctgcataggggtgagacaaaccataaaatgttgagaacccccagcctagacagctatggcctcactgttgtgtctggcattcactgctacaaacaacacaaatcatgtactttatatcttgaagttgtcactcagccctgtgttttctcatttctgtgtctttacttagatcataaacctaggatttccttttctctgcttatctaagtcctactcctctttcaaggccaatcttaagtggcttatcttccatgaagaattcccagactgttttaactcacggtggttccctttttctgggagctcatagtcattatcagttataccactttgggctattcatcaggagctgccgtgtgtacttttatgttcttttgtagttgttatttaactgtcattttcattaacttctcaagcaggtatgcgttatctcctcaacccagacatggggagcaggacagtatatccagtaattttttgtactgtctgcataattattcacgtcccgtattcatggcaggggttgttattaagcatgtgttggctaactgattataagacagttatgtgcagacagtaggcctcgctattcttttatagctcatttttcctgcatgttgctaggcacagagtaagttttgtgctttagtccctgtaagtatatggtgactggctgacccactgggtccacagaaacacacattcatgcttctcattcaatacatttcgtgtgtgccttgtgccctgcttgtggaagatagttcaaacatgttaattgacttactcttcat

SEQ ID NO: 15048 - DNA, 2050 bp, Homo sapiens
acacatcacactcacacatcacacatatcacatacatcacactcacacatctctctctctctctctcacatacacacacatctttgggagcaaaaagtaattgagttttatttttaggtcagtgcaattagatttttctttactcgcttttaatattatattagctttctctgataaaatgaagaagcagtttacgcctgttgaggtaatttctgaatcagatgtgggtttctttatgctccaccatgattggccagttgctttgtaatgaaggagtttgcacttcagctaagcctggaaaaatgtctcagctccttctactgggtgtgccaaccctttcagctgttcaagacacaggatgtgaggaggaattgtttaacggtgacagcatggagtaaattctgacatcaggtgtcaggggttctattcttggttttgtttctggactgctaatttagggtgagaatgattttcccctcagcgtcctcatctgggtagtgaagtagtccaggacagtatttttgcagccattatttgggtttacatgatctccttttgacattctcaagtaaaccctgctttaagttttaagacttttataccacatctaaaggctcagtggagtgagttgagccatcagagaaatctggcttgttgtgtcttcctcatttcttttgattagtctgagttgccagatcattttcaaatggctgtgcatcaaggctcacctgggagcttgtaaacatagtggtgcttggcccgtaagaggccggatccacaggggaaggtcccagtagttcagattttcagagttcttcccaggaaaccgtgaagcatactagtgataagggcatctgggctgcaccattaaccagctcaaaaatagttcattcagaatttccccatgactatttcattattttgttattagggttgatagttttaatacataaaaatagaggataaatgataatattttatatataaataaaaaacatatatgtataatagtatatttaatacataagaatagaagataaataataaataaaaataggtatatttgaatttctgataatgcatattcttgcatgcatatgtcccacgcaatattcgaatcttgttttatcttgtttggcaatgcttcatgccatagagccaggaaaatctcaattctttcacaaaaactaatgcagagaggtcacaaaggaccttgagacagagggtttgtagaggctttggtactgcccattaaaatgtattgagtccttttgagaaccattatactggaaatttggagacgccttttcaatttttggttccttttcttctctttctgttgcattttgccagtgcagcattcacttttatttcttaaataaattgaagattttttttttagagtgttaaggaatttaaccacatggctcctattaagccatcattgcatacagaaatttgttacaatctttctcatgtggatactgccaccttctcctaaactgcagagtatcttgatgtgaggtgtgtaagaaatctaagacctcctcactggccaatttgttgtcttcacaaatagttattctttcaaatagaatatttcttactgtagttaaattgtacttctttaggctcctttggaaaaaatttacccaggacataccaaacaaggtaggaaaccaaggcattggccattgttcaagagcaaaccaggtcagcaccaacaaagtcgggattcatttctattgaaactgatctctgggtaccacccacagttattacaaactgactcagcaaaaaaggcctgtggccattcgaaaagcaaatatttttgctttggcttttatttaataagttttcaaatgtgattttctaggcccctaataggcacacttatcttgtgaatatggcagatactagcacagagcctgcaatgggggttgtgattgtcaaggatctgctgcttctgggtgctttggggtggaatgtgggtggatggagtaagggcttctgtgactgagaaccacattcctctctgtctgcaggtgag

SEQ ID NO: 15049 - DNA, 1246 bp, Homo sapiens
catcttctgcctactgggttcaagtgaatctcctgcctcagcttccaaagtaactgggattacaggcacctggcaccacacccagctagtttttgtatttttagtagagacagggtttcaccatgttggccaggctggtctcgaactcctgacctcagatgatccacctgccttggcctcccaaattgctgggattacgggccttcttgctttctaaacatagcaccttcctgactgtagggactttatctgtcttgctcacctgtgcgtcacacgggcctcctgcttcatcagacacagtggccactcaacaattgcctgatgaataaatgcatgagaaatactagttttaaagaaaggtctgatacacttcacttggtttggaatgtttaccaaaaacctttgcttttctagagagggttgcgggctaatccaaaagaattggtttataattatgaaattttaaaaagcgtcagagaaccaacaaggaaagatttttgaggaaatggaggctcatcaggaaagcacaacatgtgaagttgttgcccactcacatgtctttttccttgacctgtttctagaatgtgttgtctcagacagctgacctgtcttggagatgtagtactttataagatgaaccaagtatgatcctcccaaggaccagggcctacagtccagtcaagcttgggagtgtagctaagggaggaatgaataacccactgtcatttcaagcgtaggattctctcatcactctcactgttttaaatcttctttatcatcacagattttacattattcccttatgtatgaatgttatttttattgaccattgaagattggaacttttttctggaaaaacatcacatggttgagtcaaggatgaaaagtcaaaactaccttttcatgtgaggggagagagagagagagcgcgcgtgcgcgaaagcgtgtgtgtgtgtgtgtgtgtgtgtgtgtgtgtgtgtgtgtgtgtgtattgggaccacctttcagctgtgttgcctccctctggtggccattatatgcacaaggcctgggtgacatggactgagtcagaatgtaacttacttttcaaaaaaaaaaaaaaaaaaaaaaagactaagtcattgtgtgcacctgagtttttaaaattattattggtgggaactctttaaaaaaagaaaaaaaaaaacacagttaagtggttgaaattgattagcactacaaaaatatgagctttttgcctttgggg

SEQ ID NO: 15050 - DNA, 1030 bp, Homo sapiens
actctacctccacaacaaccaaattaataatgctggatttcctgcagaactgcacaatgtacagtcggtgcacacggtctacctgtatggcaaccaactggacgaattccccatgaaccttcccaagaatgtcagagttctccatttgcaggaaaacaatattcagaccatttcacgggctgctcttgcccagctcttgaagcttgaagagctgcacctggatgacaactccatatccacagtgggggtggaagacggggccttccgggaggctattagcctcaaattgttgtttttgtctaagaatcacctgagcagtgtgcctgttgggcttcctgtggacttgcaagagctgagagtggatgaaaatcgaattgctgtcatatccgacatggccttccagaatctcacgagcttggagcgtcttattgtggacgggaacctcctgaccaacaagggtatcgccgagggcaccttcagccatctcaccaagctcaaggaattttcaattgtacgtaattcgctgtcccaccctcctcccgatctcccaggtacgcatctgatcaggctctatttgcaggacaaccagataaaccacattcctttgacagccttctcaaatctgcgtaagctggaacggctggatatatccaacaaccaactgcggatgctgactcaaggggtttttgataatctctccaacctgaagcagctcactgctcggaataacccttggttttgtgactgcagtattaaatgggtcacagaatggctcaaatatatcccttcatctctcaacgtgcggggtttcatgtgccaaggtcctgaacaagtccgggggatggccgtcagggaattaaatatgaatcttttgtcctgtcccaccacgacccccggcctgcctctcttcaccccagccccaagtacagcttctccgaccactcagcctcccaccctctctattccaaaccctagcagaagctacacgcctccaactcctaccacatcgaaacttcccacgattcctgac

SEQ ID NO: 15051 - DNA, 1058 bp, Homo sapiens
tttttcatgtttgttggccacatcagtgtcttcttttgaaaagtgtctgttcatatccttcgcccactttttgatagggttggttttttcttgtaaatttaagttccttgtggattctggatattagccctttgtcagatggatagattgcaaaatttttctcccattttgtgggttgtttgtccactctgatgacggtttcttttgctgtgcagaagctctttagtttaattagatcccatttgtcaattttggcttttgttgccattgcttttggtgttttagtcatgaagtctgtgcacatgcctatgtcctgaatggtattgcctaggttttcttctagggtttttatggttttaggtcttacatttaagtctttaatccatcttgagttaatttttgtataaggtgtaaggaaggggtccagtttcagttttctgcatatggctagccagttttcccaacactgtttgttaaatagggactcctttccccattgcttatttttctcagatttgtcaaagatcagatggttgtagatgtgtggcgttacttctgagacctctgttctattccattggtctatatatgtgttttggtaccagtatcatgctgttttggttactgtagccttgcagtatagtttgaagtcaggtagtgtgatgcctccagctttgttcttttggcttaggattgtcttggatatacgggccctttttttggttccatatgaaatttaaaatagtttttttctaattctgtgaagaaagtcaatggtagtttgatggggatagcactgagtctataaattactttggacagtgtggccattttcacaatattgattcttcctatccatgagcatgtaatggttttccatttgtttgtgtcctctcttatttccttgagcagtggtttgtagttctctttgaagaggtccttcacatcccttttaagttctattcttaggtattttattctctttgtagcaattgtgaatgggagttcactcatgatttggctgtctgtctgttgttggtgtatagaaatgcttgtga

SEQ ID NO: 15052 - DNA, 1092 bp, Homo sapiens
actcttttagaccttctcttccaccttctaaacaagctaacaagaatctgattttgaaggctatatctgaagctcaagaatccgtaacaaaaacaactaactactctacaggtaatttaaatgtattatgtttacacttggtaagacatttctgtaattcttgagtaaggtgaaaatgattgctccttaaattgtaaaataaaggtgcctgtcagatgtcaagaccaagatgaggttcccatatagaaaaatggctttaaaaggaaattgacaagtttgagaaacttcgccaactgttattggactgtagtttttcaagcaccatataatgccttttatatctttccaatgtgtgtaaaatatatagtacgtaaatattttgaagagaattttgatgaagtaggactttcatattagtagcattagattcaacattagatatgaatttacgatgtgtaaaggggagtacaattggacaatgataggtatctgaagttatagaaatttgttaaacagtagtatataaacaaggttggtttcttcccttttggcggaactcattagtagaatataaggcagagaattgactcatttgtgatgttcctgctccaattctagtggaagtactgaataattttatgagagaatataaaagtattacgttttcaaaacaggagatgaatcagctgtaagctggtcttacggaaagctgattctgaaatgcaaacaactgatgggtgtcattttgtgttgtcaaattctgtactctctggccgacctgttgtagccaatgtgtaaacttgtgttaagaagctgatggtaatgagctactctaaaaagatttaagttttgctgtggatttggtgggtgtacttacagcattgccctgcttatccactctctcgcttttttttgtgaccccccttcctaaaatgaggtaaactgtagccatcagtttttttatttgttttctttttttgaggcgaagtcttgctctgttgcccaggctggagtgcagtggtgtgatcttggcttactgcaatctctgcctcctgggtccaagcgattctcctgcctcagcctcccaagtag

SEQ ID NO: 15053 - DNA, 1594 bp, Homo sapiens
tgtgatgatgtgcacctatagtcatggctactctggagaattgcttgagcccaggagttcgaggttacagtgagctgtgattgtgccagcctgggtgacagaccaagaccctgtctctaaaaataaaaaaaaaattttaaagactatataaatattacaaggccaaatttacattctgtttcttgtacagttttgtgtgggaactctctagagtttttttaatttttcccccttttttgtttcccttaggttcttcttttttcccttctttcattgcctacctgtactgtagcctaaaagtcttatcactctgtgctttgaaatctttgggtttcccactttttcttaggtaccttcctcctggagcctctctcctccttttctgacctcactgcttgctctaggcctgctcaaggccatcatcccgaggcgccctcctcccctgagtcggctctgcaattcctgaattccattttgtcttctcagtgcatttctccgttttgtaatcacgtcacaaagaaactccttaagaaagtatagaaggtaaattttctgagttcttggaaatctgaagctatccttgtacttgtttgatactttgactaggtacagaattataggttgaagtcattttcttcagaactttgaaggcatagtttcattatcttgaggcttcagtgttgatgctgagaacttggttgcccatcttattccattgtgtaatacctgggatttttttctccgggaacttttttttttctatgttcctggtgtctgaaatttcactgtggtatgtctagatgctagttaggtacattaggtacccttttaatttgaaaattcattctcttccgtgtgggaaatactcttgcattatttgttttaaaatttgctgtccttgttttcattgttctctggtggaaattctgttagttggatgataagcccttactttaatctgtcagttgtatattttttctctcttgatttttgacttgatcttgttggtctactcttgaatacttgcttgacttgatctttagtctccttactgaacattttaaaaatgtaggcaagcatattttttaatttccacaaactttttcttgttctatttttcatagtatcttactttgtggatacagaatcatctcaactgtctgaagatcctaattaaagggattttttttttcttttcaaggaattcactcttgtcttctaattaatggagtcagagtcagattttatgctttttttcttgctctttcgattatggaatttttttcaaaaacatctgcagatagtggttcctagtttaaggaaaggtagtgcagaggcttacctagaattgtgctgtgggctgagcttttctgcaggcaggtttagctttcaatgaagcagacaaggagctgcaattggccttgcagttgtagaggaatttcttgggggagcaggttggtatgcttacactcctactggttgtctattaaaaatattaaaattttgtcttttaaatgtctgtctctggcagtaccattcacaagccttcttctctgccttacatccttcttggtttttactcattgctgcaatc

SEQ ID NO: 15054 - DNA, 1310 bp, Homo sapiens
atttatgtgtttgttctgtatggctgttactgagtgcccagagcagtgtctggcatatagtagcaggagctcagtcagtgtttgttgtctgagtaaatgtcactcctgccttgcatctaacctgcagttttcacaggggctcatttgtggttttgcctgctgtgccttacagccagtatttgtccatatattttctattacccagagattgttgacatctcatctgctgcaccttgtaacccccatctctaaaccagtgatctccatcatatttttgacctgaaaatttttgtacagtagccatttttaagtatgtataccaatatatgtattttacttacgtacacatgctgtattgatatgaatattagaaaacataagaatagaaatctgccgggcttggtggctcacgcctgtaatcccagcaatttgagaggctgagacgggcagatcattaggtcaggagttcgagaccagcctggccaacatggtgaaccgccgtctctactaaaaatacaaaaattagccgggtgtggtgatgggtgcctgtaatcccagctacttgggaagctgaggcaggagaattgcttgaacctgggaggcggaggttgcagtgagccaagattgcgccactccactgtagcctgagcgacagggtgagactccatctcggaaaataaaataaaaaaagaacagaaacccaaagatcatagggtagagatgtagatattaagttctttaattcacttttatggactcttcagaaggagagattataattgtatatgcttgatacattgtgttggactggaagcactgtgaaagattcttagtcaaggggagattttacattcaaagaaaatggaaaatccccctgctttgctcggagggaagaactgcacttaaaagtttgatgtgtattggtgtcgtcttctaggcatttcttatatctgtgaacatgtgcaccctttgtatataaagtggaattacatgtttacttacgcacacacacacatgtacatataaagcaggaattatactacccagagttctctgtgacatttttgttccacttaatgtatcatgggagagtccttgagtgtggacctaggagccagactaccgaaggtgcagaccctgcagtttactagttgatttaacctttctgtaccctagtttcctaatctataaatgaagaataacggtagcatttacttcagagttcttggtaggagtaaatgttaaaatacataagctttctctgctgatgaatatttacactggagtcttaggaagggtccttgcttatt

SEQ ID NO: 15055 - DNA, 1020 bp, Homo sapiens
gtagtgatctttggcagcatttaaagtgaaaagaaataaggatctaagaattcagccctaatccactaaaaaaaggaattctaactgacaagtttttacaaatggagttgggctcattcattttggaaataaacctatggagtggcacacatctaaacaaattttcccaatagaaaaaaggctataaaaattttattccaagagtgattaaattgtataatgttgtatatgtgaatttaacacttttgtttacatgttaaacaaatgtgtatatattagactacattaaatatgcaattctttcttccagttaaatactgttgctccctaaaacccttacattgtacaccattgggaatgattgttcatcatactacttttccattagtgaggctacagttatgttttaaatgtgcgattacagagatggcatctgaacataaactgatggctcgaaaatgaaaatggaaatgtagcagccatatactgctaactttggatctgttcctgaattcaaaactactaggagaaaagtgtcctttataaaaaaggaccttattaatgcctaaaaaacatcatattctctaggaaagcttgtgtctgtttccttagggaaaatgtttgccttttaaaaactgtgatcctttaggatgatcatgactttccctttccttatggaaatgcaagaataaaatatttcattaaacaatgaaccttgaaaataaaatataaacattaagaaaccattttgctaaaaagataatgaaaattatccaaattgggtttttgagttcttctgtaaagagtgctctaccctaaattttcccagcaggtctgccgaaatcacacacttcccaatacagggggacttggcctttaccatcaagtattcgatccttccttgaaatggcattatctggcagtgtatggattacggattatacccagtgcatatagcaaatattttgaacagatcagtctttcactattttgatgattctgggcatttctccctgttac

SEQ ID NO: 15056 - DNA, 1709 bp, Homo sapiens
gtttttttttaatttttttacaaataagttagttttttgagtctatattctactcatctaattgtgttaaattcatacataacattcaaaacagtttgttctaaatttttaaataatccagtaaacctcaaccagaaaagtgcaagccaaaagccaatcatctaaccaaatgtattttcactttgggaacctaaatatgttgtagaggcagccatctttattcccattaaaatgaacgcatgatgttattcttttttttgtttttaaaaaaatgttcatagaatgcattccaattacttgagctcacaaaaggatctttgctttccaacatctataaaaccacacacttgtcacctgtcatatttcacccagtaggtgatgtgttcagggaaattaggatccgtgttttaatcttctcatgtttccttatcagaacctagcctgctggtatttaattagggggtgctcaatgaatatatatactgaatgcatcttgagttctttacgtggggactttctggacctcctgtagctctcacctgttcctttcgcagtcccttggccttcactgagcctgcttgacagccatatattcctagtatactgagcctaatgcccccaaatttcccttgctgctacttcctctaggctctagagtcactaatatgctgcagcttcaagagttgccttcttttcaaatcctccacagcacaccaagctttattgttttctgcctctattctgtagtaaaggaaaggtagaaatttcaaataaaacaatttcatatgtttaataagaaattgaatggtgtacatgtttacattgaatttttcaaggtaaagcaaagctgataaaatatttgccagtttagatttcttaattagcttttccctttttttcattatctagcaggttttctactgactagatcacaaagcaaccagtgttgtttcgttattggaatcggataaattgatcttagttcagttcaaccaacatttcttgaatacctactgtctacaaaaaccatagatattatggaaaattccaaagtgaacaagatataaaagtttgctagagtgtttttcaaatatggttaagtgtgtaataatagaggcataaagagaagtctctgagaaagacaagagtgtgtaataggtttagaactggaaaatcagggaaggctttataataaaggacttgaccttgaaggaggaaggcagaaagaacaatgtggttgtagctttattcatttgttttcaaattattattttagtaaaattttctctaaagatctatctttttatttataaaaaggagtgatagaagactaccaggtaattaccccacttctatttactatgtaattgatacattggttgtttcttgattaataatgatggcttcttgtattagtttttgacatggccctttaaattaaaataatgtgttaagaggtaaacatgtttaatataaaatgaaataacaacaatgaaggatggctatttctataagctgtgtagtatttctaatgctattttaatatatgttttatttatccatgggttttaggcagcttggatcttaaaagcaagagcgctaacagaaatggtatacatagatgaaattgatgtagatcaggaaggaattgcagaaatgatgctggatgaaaatgctatagctcaagttccacgtaagtattgggtttt

SEQ ID NO: 15057 - DNA, 1011 bp, Homo sapiens
tgaccttataaacagatgaaattattaaagattggagaactactaatactttaaaatccaccctcagtttctgtgggaaaatgtgtataaatatacaagtgataagaactatgcttggttcatagagtatgtagatctccaataaatgggaagatacaggttattgagaatactgcataacatgcttgtgttaaagttatagtttttatgctaatggtgttgttgatctgtttatttccttagtccatatagtatattataggtttactaacatgcatatttctgttatttttgtggtgtgtccttttccccatcattaacgttttatgatcaaagatttcaaacatacaaaagtagagggaatcgtcttcatagcctcttaacagagaattttaaagttatatgcgtatgacttctcaaattgttttgatttttgcatacttatatgcaaatgagcaataatggaacaactttggtcaaatcaaatgcagttcattctacagtgtctgattgcatgttttctcattttcctattagttccaggaaaaaggctttatatccatacattaagcatttaggaaaataaaaatgttttccttaattgtgttttctttttttcttcttttttttttgagacagagtctcactctgtcacccaggctggaatgcagtggtattatcacggctcactgtagccttgacttcccaggctcaggcgatcctcccatctcagcctcccaagtagctgggactataggcgtgtgccaccatgcccagctgatttttttttttttaattatctgtacagacatgctctccctatgtttcccaggctggtcttgaatttctggccttaagtgatcctcctgcctcagcttcccaaagtgctgggattacaggtgtgagccaccatagccatccccttaattgtgttttctatgtgtcaaccactagctatacactaggagaactaataaaaaatatgatactttttcctgcctctacaagcca

SEQ ID NO: 15058 - DNA, 1035 bp, Homo sapiens
aataagaattaatacctttagaataataaaactttgagctgggagagggaagctttgagaccatcaggcccaactccccttttcacatgaggaagctgaggccaagacagtggctgtaatttgcatcaggagctagtgagtaacagaccagggactagaaccaagtctgctgatttctagttctgttctcttggtaatcaaatctttttatttacactgatgcctcacatctgtaaaacacttcatagttaagagatactttgttcctacattataccatttcacttaagtctcacagaaccttggaggtagtggctatcgttagtccttttcccagatgaaaaaaattgagcctcacaaagataaagtgatttgtccaaattcacgtaaccagtaagtggcagaacaagaatttgagctccctttctgacgccaattctcttgctgtttccacaattccatattgtttctgtaggacctgagtatttttatattctcttaatgtttcaatgtattttaaagcaaattaactgagagatcagaagagtcgtaatgaattttatgaatatttatatagcaactagtaaataagatctgaaacttgttgctgatattgaaatgcatatagaacatttggaaaaatagaaacaaatgaacaattctatttttaagtataaatatcttttattattaaaatagggtagacttcagttactatgagcacacttcaatatttataagcttcagttgtcattcaagtactctgagaaaaaagaagactataaatgggacaaaaagcatgtttattgttctgccgttgaaattaagactactttccatttagatatttcacataaaactctaaagtgttttttcctgctgctagatggagaaagtgttttctgctaaaaggtaattttagaccattatatcattaaactcttatgaatgtaattcctggagacagtcttgaaatcttgagctgccaagcaaaaccttcagaaatgcttgataattaaaggaaagcaaaactct

SEQ ID NO: 15059 - DNA, 1030 bp, Homo sapiens
tccaccatccttgtatgtgacttcagttttcagagtcacctcgtggcccagtatggcagctagagctccagcttactcatctattccaggtagcaggaaggggaaaggaggaaaaggacaaaaaggcccacattctagctatgcccatctaagcagccttcctggaagtcccacacaacacctgcatctatttcattgagcagagctcagctgcatgctaaccagctgtaaaagaggctagaaatgtcttttagcttagcacaccttttcctgaattagccttttgttagggaaggaggagagaatggctgtctggaggcaacaagcagtttctgccttggctcctcctcgcagtagtatccttgggtgtcacattggcattttctgttcttcctcccttttcttaaagaccttgaaatcaaactgtcaccccattagagtgttggcaaagtgcagactgcagttcctttgtatctgttatgagttaaattatctcacccccaaaaaagatctgttggaatcctaagcctcagtacctcagaatgtgatcttatttggagatagagcccttacaaaggtaatcaagataaaatgaaggcattaggatggacattaatccagtatgactagtgtccttataaaaagagaaatttgggtgcagagacagagataagaccatgtaaagacacagaacgccatttacaagccaagctcctagaagctgggagagaggcttggaacagatgtgcctcacagcctcaggaaccaatcctgccagcaccttgatcttggacttctcgcctccagacctgtgagacaatatattgctgttgtctaagcctcccagtttgtggtgctttgttttggaggccctggcacactaatacagtatccactggactctcagtaactaaagggacgaaagtgtcctccttctccctgcatccccttattgccaaatgcatcttgggaaggctattacgagccttagaaggatgaggagtgacctaaatggtaagtttaagtaaca

SEQ ID NO: 15060 - DNA, 1053 bp, Homo sapiens
tcatattcacaattctggcttatcctcaaggaaaggggatatacaggcatgtgcaccaggggccatctttcgattctgctttccacagacttcactgatggagttccgctcttattgcccaggctgaagtgcaatgtcacgatctcggctcactgcaacctctgcctcctgggttcaagcaattctcctgcctcagcctcctgagtagctgggattacaggcatgcgccaccagaccacggctaattttgtatttttagtagagatggagtttctccatgttggtcaggctggtcttgaactcccgacctcagatgatccgcccacctcggccccccaaagtgctgggattataggcatgaactactgcacctggcccactgatatttctttcctggttcgatttacccatcttattctccaattttggctggaattaattttttactgtttccaaaattggggtttgttttttgtagttaagcaaaagtacccttgtacacactcaaaagactgaacctctggctccaaagctctttgagaagttctgtactttcttggagccaaaagaggcagctgtactggagtaagggaccaaccccgcagcatgactgctttggagaaccatatttacttgggtatgtagagttgttaaaaataatagtcctataaaagattcatagaatcacaaaagatctgatttcctaatcttaaaaaatctcatccccttaggaaatgtatttcgtatggttcctattgggtctacgtaatatcttattgcctgttatgtctctacccatcataagtagaggatgttgacttcctgatcatttggactttgtttcatccagttgacatttcacaaatgtgaaaactggctacagaaggtcaggaattggaatcttataaaaatgctagccttaatatagtttttaatcttcccttttattattttaaatataaatcatagttttcatttcctctctttcattatgtgttgtgattgaggttctgactgaaaacatttttcatagatcctgggtcacgttttagt

SEQ ID NO: 15061 - DNA, 1022 bp, Homo sapiens
ctggaaaagctgcagacactcaatgccggcccctgaaagcagccaagaaggggggctatgccctgcaaagctacaggggcagagcctgtccaaggtcatggaagcctacctcttggatcagcgtgacctggatgtgagacatggagtcaaaggagatcatttcggagctttaagatttgactgccctgacagattttggacttgcatggggcctgtagcccctttgttttggccaatttctcccatttagaatggctgtgtttacccaatgcctgtacccacattgtatttaggaagtaactgacttgctgttgattttacagggtcataggcagaagggacgtactgtgtctcagatgagtcttcagactgtagacttttgaattaatgccgaaatgagttaagactttgggaggctgttgggaaggcatgattggttttgaaatgtgagaacatgagatttgggaggggtaaggggtagaatgatatggtttggctctgtgtcctcacccaaatgtcatcttgaactgtagcttccataattcccatgtgtcatgggagggacctggtgggaggtaattgaatcatgggagtgggttttcccaagcagttctcttgatagtgaataggtctcacgagatctgatggttttataaagggcagttccctgcacacgctctcttgcctgccgccatgtaagatgtgcctttgctcctcctttgccttctgctatgatcgtgaggcctcccccgccatgtgcaactgtgagcccattaaacatcctttcctttgtaaattatccagcctcgggtatgtctttattagcagcatgagaacagactgatacaagtagatacagttaaaaatacttgatatggtttggctgtgtccccacccaaatctcattttgaattgtagctcccataattcccacatgttgtgagggagacacagtgggagataattaaatcttaggggcagtttcccccatactgttctcatggtactgaataagtctcagg

SEQ ID NO: 15062 - DNA, 1047 bp, Homo sapiens
ccctgggggctggaccatatgcagggcatatggtcattgaggatggccgtcggctctctgcatgatctttcatagggaagtcattccgagccatcacagatctctgctagggacctctgaggcagctgagaaatagctgtaatgtccctagatgggaacagccatcaggaagtctttcctagtcctatctgtagtttaattgaaaagggtcaacttgagctttattaagtctctcttgctcaagaagagctccaggctgacttctactagaaagtaaaaggggaattgggtgtggttagggagatggaacgggtgcggggaactcaagcaggacaggtgtcatcttcagtatgtctttgctgctaatagaaatcaagcacattgtctctaagaagagtaattgagatttttacttatttttgttgaaagcaagatattgtcatgttgccaattagtaaatatgctaataatttcagtaaagcctttcattcatactgtttttcataggaatctgtggagcttcctctcacccatcctgaatattatgaagagatgggtataaagcctcctaagggggtcattctctatggtccacctggcacaggtatgctctgtttttgacactttccaggcacccagctggtctcttgagcagcagcattggctagttataattactgaactaataagagaggacaccacaattccttagtttaaaacagggctgctcaaccttgtctgcatgttggaatcaccttgggagctttaaaaatactgatggaaaaaaaaaaaaaaagcctgagcaacttggtgaaaccctgtctctataaaaaattagctgggcgtggccgggcgcagtggctcacgcctgtaatcccagtactttgggaggcagaggcgggtggatcatgaggtcaggagttcgagaccagcctggccaatgtggtgaaaccccgtctctactaaaaatacaaaaattagccgggtgtggtgacgtgcgcctgtagtcccggctactcgggaggctgaggcaggagaatggcatga

SEQ ID NO: 15063 - DNA, 1047 bp, Homo sapiens
gatgtctctgttggcaagtaaaatctatcttcttttttaaaaattgaaagatcttaaaattttaagataagaacttactttgacaattttcaagccttcaaaaaagttgcaacaatagcacagtgatttgccaagagttaacattttacctgtttgctttttctctttctatacacaaaactttcttttcacccgaaccatttgaagtaaataacctgatggccatcaccaaacaaacttctgtgccaggattgtgttttttgccacatcttgtttttgccacagtaattactggccaaaagaaaaagaaaacaataacagtaacccacataatatgtttgtttgctgtccttctctatctatttccttcatttctctttcctttctaaacagatcaggcctaaaacaataacagtaacccatgtaacatgggttattgttttcttttactttgggccagtaattactgagaaattaaatatattggaataaatgctatactctgtagtattattccatagtatagatactgccacttacagtatctaaccagaatacatgttcttttatgactataagtaaatgaaatagacatatactgtcaattgcctctaagtttcagggcataattttgtttatttcctaggaatattattctctttaacaaaagtggtgttgtacaagccacatagcttgttagaacctgagccaaaactagaacccacagccctgacccttgggtcagtcttagttacagtaactcccagtttaagccacttcacatcctttcagaaaataggatgcttaaaacattttttttaaaaatcaaatctttcccaaataagcaatttgtgtttagtctaggtgtctcatgctttatttcagaacagatttttttttttttttttttgaggtagagtttcgctcgttgctcaggctagagtgcagtggcgcgatctcggctcactgtaacctctgcctcccgggttcaagcaattctcctgcctcagcctcccgagtagctaggattacaggtgcctgccaccg

SEQ ID NO: 15064 - DNA, 1023 bp, Homo sapiens
atcattagcaataacaattgctgaatgttcacaggatggcaatggttatatcagtgcagcagaactacgtcacgtcatgacaaacttaggagaaaaactaacagatgaagaagtagatgaaatgatcagagaagcagatattgatggagacggacaagtcaactatgaaggtaaaactaaattctctgagctcagtgtttcatagtcttacctttagatctgtaagcaagccaactgcttcactagacagcctttgactttattttatgtacagtaaagatgttgtgttcattaaagctgttttcaaagataaccaaaagttactattatatttgtcttttcagaattcgtacagatgatgactgcaaaatgaagacctactttcaactcctttttcccccctctagaagaatcaaattgaatcttttacttacctcttgcaaaaaaaagaaaaaagaaaaaagttcatttattcattctgtttctatatagcaaaactgaatgtcaaaagtaccttctgtccacacacacaaaatctgcatgtattggttggtggtcctgtcccctaaagatcaagctacacatcagttttacaatataaatacttgtactaccttaatgataaggactccttaaagttccatttgctaatgattaatacactgtttgggctggccagtttttcatgcatgcagcttgacgattgagcacagtcaggcctttgtattaaaaatgaaaaatgaaaaaacaaattcaaaacctattcaaatgggttctagttcaatttgtttagtataaattgtcatagctggtttactgaaaacaaacacatttaaaattggtttacctcaggatgacgtgcagaaaaatgggtgaaggataaaccgttgagacgtggccccactggtaggatggtcctcttgtacttcgtgtgctccgacccatggtgacgatgacacaccctggtggcatgcccgtgtatgttggtttagcgttgtctgcattgttctagagtgaaacagg

SEQ ID NO: 15065 - DNA, 1322 bp, Homo sapiens
ggggtggtcaaagagcctgattgctgacccagtctcaggcctgtggtcgatgacctctcggtagtttcaaagggggctggagggggatatttgacttgttttttcgaaatgtagccttctaaccctcaagtctttagaagctgggtggactcttagtggtcctgcagcgtatcctaaaagactacctttgaaacaggattcttgtatggccaggatcctgtctgggaaccagaaaccctacaccctccccctccagggaatgctgagttccagttttgagcagaggtgaggcagaatccactgtagccttccgccctggtatttggggggatgaccagcccaggcgttgggtgttagtctgcatgagtttgtgagaggaaatagctgggtgtcctggcagtgcccttgaagttggttaggaccttcctgtaaactcttgcccctacttctaactactctataaatatatacatatatttatatataaagtgattagttgaactggcatcctgctttagcctgagacttgccataagaaactgctgagtacttggcaaaccctttcatagttttgttctccatctgtttggggtaggtgttgagcgaggcaaatggatctcgatatttcagatgggcttttgatgcactgttgccaaggaaggctttttctgattttttgacaaatgaatttttgcacactttcattggtgtctttcggcaacttacacacattgaaaatgagctattgtacatatttttatattctctttataaatgcatgtctgattgtacttgtaacaatattgtaatgaacggctgtgcagtaggcccagcgctgctgtgtctcgtcagaggaatagcttaccacgaacccctcagcatactgggaatctcttcctgaacaacgaatgtaaatttggtcaagtctactcttccgttcattcaattattttaagcatttgaattatttattgtatatcctaaatatatttctcctttggcagtgactagatttccactaatgtgtcttaatctatccctccagctggcagttactgtttttttaatcccctgaagttgtcctgtaggagacagaaattctttgctgtctgtatcccttggagtaagaaggtagtggcatgggtggagtgtgtgttctttctccaaatctattatgatgtttattaaacacttctgtagcaaagatggtggtagttcttttgttactgaagttgcccttcaccatggctatttgaaaaggagatgtacttggacgtttctgtaaatcttgagataaactgtttggagatttaaccacctct

SEQ ID NO: 15066 - DNA, 1043 bp, Homo sapiens
gtctctactgaaaacgcaaaaattagttgggcgtggtggtgggtgcctgtagtcccagctactcaggaggctgaggcagaagaatcgcttgaacccaggaggcagaggttgcagtcagccaagatcgcgccactgcactccagcctggtaacagagtgagactccatctcaaaaaaaaaaaaaagaacaaaatgtaaacattccaaactcttatactgtgaacataattatacacctaacaaaaatggggaagtgaggggaaagggcagttggaagatttctaagcatgtaaatttactcatctttaatggctggaaaataatccagtctaaaaaatgaactccagccaggcgttggggctcatgcctacaatcccagcactttaggaggcccaggcaggaggatcgcttgagcccacgagttcaagatcagcctgggcaacctggggaaaccccttatctactaaaaatacaaaaaactaaccaggcatagtggcatgcacctgtaatcccagctactcgggaggctgaggcacgagaatctcttgaatgtgggagttggaggttgcagtgagctgagatcacaccactgcactccagcgtgagcaacagaatgagactctgtctcaaaaaaaaaaaaaagaactccatgaactgcagctttttaaaacagacacgattctaatttcttgatgatttttgtgttcgttttttcttatctttaaggggattattttaggaatttttgtggtttacaaacatttagctgaagttcagcaattatttctattttacttaatttctgttttctgtaaaattaaacttaattttacttaaaaataatttgcagaataaaattccattgttatctattgatctttttgctctgcatgcccaaattcagatgacatataccaaatattgatggctgtttccagaaagtgagatttgagacaccaaaaaaaaaaacaaaaaacaaaacttcctcatggtgctttctaaagctttttagaaaagctcattctatataaaactaacagtcat

SEQ ID NO: 15067 - DNA, 1032 bp, Homo sapiens
cttatgaaaggtggatattcagtttaccttagtttgttgatggccttgagtagtggtaagaaattattaggtaactcggtggccttctctcctacttgcatagttagccaggaaaagctcatttattttagggagctaaaatctgaaatgttgctgtggagttgaactttgctaatgaatattttcataacttctgcttaatagcacacagttccaggttctaaatcccatttttaaaaaatgtatatattttattttatttattttttagatacaaagtctcactttgttgcccagtctagggtacactctagggtctcactctgtgcccagtctagtggcgcactcatagctcacagtaacctcggactcctgggctcaagcaattctctcatcttggccttctgagtagctaggactacaggtacatgccaccagccagttttcttatattttttttttgtagagacagggtctcactacattgcctaggctggtctcaaactcctgaactctagcagtcttcctgcctcggcttcccaaagtgctgggatcacaggcgtgagccaccgtgcctggcctgtagatgtgttcatgttatattttcctgaaatatatgtagtaggcatcccaatttgcatttcatcagatatatgttgaagcgtgcatcaggttctatttagggagttgcaaacatatgccacctatgtttttcagttgctcacattccaatgcaagggttcttaatgttaaactccctgaaaagtttgtgaatttctacgtgtatatgtactcttgttttttgtttgagtgtgttgagagttggtgggggagggggagggtccataggtttttatcagattctcaaggggatctatttaaggaccactggtctaattaatgggagagaaagacatgtaaactaatcattgtaatacagtgaaatcagtgccatcacaaagcaagataaaagaggaagagattcaccttgaaggatgagttcattaattcctaaacatttatttattgagg

SEQ ID NO: 15068 - DNA, 1082 bp, Homo sapiens
gtcaagtgatgtcttcagccctactatgaaattaagaatagagagacagcctctgttgttggattcccttctagtacaaccctcaaaattgggaggaggaataagaatatttttttcttctgtgctaaagctaatgctcttcaaagtaatgtcaaagcagaaagcagcagcattaggcaagaaccactttcgttactgattgtagaacctatggcatccattacatttgctctgaggaaggagggacagggaaaatgggattggggaggaaacgtcttttgaagtaagcaaatgactgggatctagaaaatgaatttttggttcagtcctgcccatggcacgctagttgaccccattatgcaagtgggtgagtgaagagcctaacattaccaaacgtctctgttatgatgaggcatgactaacaaaactgattgtgaaacagaaaatgtgaagggctttgttaaataatgttaaataatggggtaaaatttagaataacaacttggaatgtgatttacagtcttgaaatgatctgtcaaaggacttcagggaataatagaaaatctcttagagataatgtagtattttactttattcagtacagttgtatgtctggtgttttacttgaagttattctttcccctttgaccttatctaaggttcctggacatcagtcagtttttatgaatgaaccaaggctgtcagacttcaagcaagttctcttacgggaggggattcaagctgaatttgtaggaggtgtacttgtttgcaacaatcaagtagcagtccgcagagtaagtgtgttttcaataagggctgaattgaacacatacgtctgatgttttgtcattttgaaattctgtaattcttgtttggtattttcacaaaactgaagatcagtaatttatattcatgatcatgacctcaaaggcttacagaagtcttattgacttgaaggcttatgaaagactcttgaagaaatgatatataattttattgtaaattttaattatttgaatcttctgacatttatgtctatgtaaaattcatgacttcaatattatatccatatgctgtgaatc

SEQ ID NO: 15069 - DNA, 1026 bp, Homo sapiens
tgtatttttagtagagacggggtttctccatgttggttaggctggcctcaaactcccgacctcaggtgatccgcccgcctgggcctcccaaagtgctgggattacaggcgtgagccactgctcctggcccaagatctgatggttttgtaagggaattttccccctttgcttggcacttcttcctgctgccatgtgaagaaggatgtgtttgcttccccttccaccatgattgtaagtttcatgaggcctccccagcctgtgggactgtgagtcaattaaacgtgtttactttataaattacccagtctcaggcaattctttatagcagtgtgagaacagactaatatgaataccaatactgaaaaattgtttcttgcctcaccttgtcctatgaacaggaattaaattttaaagtattgccttaagatggctgtgctaaataataatcattgcaagagcaatacttttacctgtttctagatgacaatattactaaaatttctcaaatgaagactttgttttagcttcaattacttcagaaaatataaattttaaagatgactatgagataaatcatgaactcagtggaattttcagatgagatggggcgcgttcagggtggtatgactgtagacggaattttcagatctttgttatttagaagcaagtataggtataacgtggactatcaactgatatctgcaaataatttggttaaaatgaaatttgattgtagtatttgttgctgtaggattataaatgtcaaatatcattgtaaacatttctatatttttagaaatatcttgggtggcctgaaacagaagtgaggaaatcaattttttaaggtgagccatttggcttttttaaaaaattgagattcaacttacataccataaagttcactcttctaaagtgtacaattcattggtgttagtatatttacagagttgtacaactattaccactatataatcccagaacactttcatcactccaaaaagaaacaccatacccactaccagtcac

SEQ ID NO: 15070 - DNA, 1051 bp, Homo sapiens
tgagatggagtctcactctgtcgcccaggctggagtgcagtggcgcgatctccgcctcccgggttcacgccattctcctgccttacccacccaagtagctgggactacaggcacctgccaccatgcccggctattttttttgtattttcagtagagacggggtttcactgtattagtcaggatggtcttgatctcctgacctcgtgatctgcccgcctcgacttcccaaagtgctgggattacaggtgtgagccaccatgcctggcctgtagcagctacttttatagttttgggaccacagtgaagattagaatggacaaacgcttgccgttatgtagtttacagtctcatggagaggaaacagcaagtaggcaaagtatctgatgtgctagaatagaatttctggctcattatttacatttttaatagaatagaattaatgtgcacacaaatcacttggggaatcttgtgaaaatgcagattctgattcagtagatctggggtggggcctgagattctgcacttctaacaagctcccaggtgagactgattattttggctcccagagcacacttggagtaccagggccctaaaaaatgttagatgctggctaggcatggtggctcatgcctgtaatcccagcactttgggaggccgaggtgggcggattgaatgaggccaagagttcgagaccagcccggccaacatggcgaaaccccatctctactaaaaatacaaaaattggccacggatggtggtgcacatctgtgatctcagctacttgagaggctgaggcaggagaatcgcttgaacccaggaggcagaggttggagtgagctgagatggggccattgcactccaacctgtgtgacagagaaagactctatctcaacaaaacaaaacaaacaacaacaacaacaacacaaatgttagatgcaatggggccaggggccctagagtacttgttggggtggggtggttgaaatatcatctaggctgtcctgcagaggcctcaattcgctgagaggtggtatgtgagccaagatgtgaa

SEQ ID NO: 15071 - DNA, 1034 bp, Homo sapiens
tttcacaggtgaagaaactgaggcacagagaggctgagttgcccagggtcatacaggaggaagggacagagctaggatttacacaatggcctctgaccccagaccccagatgtgcttaggggacaacactaccacccaaccaaaggactctttgctcttcttttcttgggagctcgtaagggaattggtttcctccgtctgggatgctagtcttctagtgtgtgtgcagggtgctaaataatttgtgtgtgtgttgagtaaactgtgttgaattgggttgaattaagggcctttggaatctcacatgctgtcttcagggcttggatggtaccacccagccttctcttctgttattatagcaaaacccggaacaggcaatcggaagatttcgggaagcttttagagcttttctccccatccacccccatcttcttcagttttaaatagctcttgagagggctctaccggtggggaggagagaggtctttgtggtccttttaagctcagaaggcggcactgcagaaatggaactctcttaacactccgccttcctgtcctttcctcttagcgtctcggcacgttggtgacagcagtgcaggaaatggggatgctgtgggctcatttacatgtgcagttccatacacagttctcgtctgttccaggcccccagagacacacagcactttgtagtgaaaatgattttgttcttaccttggtctcggaagccaccagagaaattgcacattcggttgactgtctcataagtcaaggtcagaattttaaaggagcttccttttcagtcactctgtgtgcgcagaggtatcagttctcagacaaattagaacaaaacctggctgagcgtccttattttttcatataacaggtctttttcacttatcataatattcattcctttaagtgtacaattcagtggcttttaatatagtcacaaaattgtggaatcgtcatcaacatcagtttctgaacatttccaacaccccaaaaggcacccctcacccataactgcccttccc

SEQ ID NO: 15072 - DNA, 1022 bp, Homo sapiens
aattctcctgcctcagccttccgagtagctgggattacaggtgcctgccaccactcttggctagtttttgtatttttagtagagacgggggtttcaccatgttggccaggctggtcttgaactcctgtcctcaggtgatccacccatcctggcctcccaaagtgctgggattacaggcgtgagccaccgtgcctagccatactatcttgttttaatttcttattttagattttctatcacttacaagcttagttctaatgaacacagagagctttctatctctgtcacatagcaccagattatatgcccgaagtactcagctgctttgcagggcgacctgcaagtccccatttcctagtggaggcaagaaggaggaagagaggggagagagaagaggcagctttgcatccactaaggctcttgtttcaaggactagattgcaaacatttttttttcatattaagtgtttatgagttttagattttgccagaagctttgaactgtttattctgactctcaaatccttgtgctttgacagggctaggtttgctgctcaaggcagccatgcctcttcccccagcctcagttctgtgctttaggctgagaactcgcctaggttaaccctccccatgccagtgttctccagctcctcctgagagttggtgtccccgccacaccagcacaagaaaggcctggagaccgggtgcagtggctcatgcctgtaatcccagtgctttgggaggctgaggtgggaggatctcttgaggccaggaattcaagaccagactgggcaacacagcaagaccccgtctctacaaaaaattttataaatgagctgggcatggtggtgtgcacttgtagtcacagctactcgggaggctgaggcagggggatctctcgagccctggagttcaaggttacagtgagctgtgatcacaccactgcacttcggcctgggtgacagagtgagatcctgtctgtatccaaaaaactaaacgaaaataaagacccggggcccagtt

SEQ ID NO: 15073 - DNA, 1057 bp, Homo sapiens
actatatttaaaaaagaattgctgggccgggcacggttgctcatgcctgtaatcccagcactttgggagaccaaggcaggtggatcaccaggtcaggagatggagaccatcctggttaacatggtgaaaccccgtcccagctactcaggaggctgaggcaggagaatggcgtgaacccggaaggcggagcttgcagtgagccaagattacgccactgcactccagcctgggtgacagagcgagactccgtctcaaaaaaaaaaaaaaaaaaaagaattaccaaacttctgatgcatttttttacaatacttcttgttttactgtcgatgaagagtcaaactctgtaaaatattttaagagatttattctgaaccaaatatgagtgaccatggcccatgacccagccctcaggaggtcctgagaacatgtgcccaaggtggttggggtgcagcttggttttatagattttagggaggcatgagacatcagtcaaatacaattaaggaatacatgaatacattggtttgtttcagaaaggtgggacaacttgaaaactgttgggggtggggagcagtgttccaggctataggtaaatttaaacattttatggttgacaattgattgagtttttgtctaaggacctgggatcaatagaaaggaaatgttcataaaagattgtgaaaaaccaaggttcttttgaagtctcatagtggctgcccttagaaacaatcgaaaacaaatgtttcctattgagaccctttaaaaggtgctagactttctgccagttttggtagacaacatataacagtaagtgtacatacaaataaacacatctagacgtgtatacacacacataaatgaaaatccagtagctcggaaccttagccatgagatagcaatacaagcttactggttttactttaccccaatagataagccaatgaaggctatgaaccaaaatttcgggtaaagcagtttggttgttaaaggccagacctccccagactccaaagagtgctggagccaaacagtaccaaaggagggcatcacacattaa

SEQ ID NO: 15074 - DNA, 1035 bp, Homo sapiens
tcccttaacctccctgagcctctgtgtcctctgtaaaacagaggtactgatgcctgccctcaaggtgcctgtgatttagtaagaatatcacttaaagcctccaaaacacctagccccacacctgacacatagtagatgctcagcaaacacccacgtcctgtgtgtgctttcctctggacggaagaggtgcagtggtgaattggatgggatgtggagaagcagagacgcatgagacccttgcaccccaggtcatggaggaagaagagtccatggtgtggcctcgaaggatgtatagaatctaagtagatgtaggtgctggggatgaggggctattccctctatgcgtaaactcagaggtgggaaatgagtggggcacacccactagaggaagataagcgtgatcatttgggagccagcaggagtcccccgagtgtggggaagggactgtggagggcggatgttgggggggcaagccggaaaggcagagcaaggccagaccaggggaggccctggatgctggggttcgagtctggggtgtgactgcagctgcaactgcagcagactgagtaaagtgacaaggtggcaggaggctgtcctggcagtcagggggtgggcacagatgagctgagcagcctctgctggctattgtgatacacacggcgacggaggaaccattggaaaccccactgacaggccaccacgtaactgaagtaaactgaggcaacttgggatgaatgttgccacccttcaaaattagagctggggttagtggtggtggggcagggcctgagatgggagtgcagcactgagggcccatccagtccggccatcagaagacctcaggatgcagcagaatcacacaacaatgacagaagatgccaacgtcagctggccggtccccagaccatttgacagtggagaagcccaaggccactcccgagacctgagaaagggcccagaacctgtgccacagcctgccctgtccaactcttccataaacacaagtgtcccagctccatcgaagcacttcccaag

SEQ ID NO: 15075 - DNA, 1044 bp, Homo sapiens
cagtgacaatcagttcttagacaggggtgacccccagggactctcggccccttgctcataagccctgggtcaggacctccatcagtgggaagttaatgatatgagtaagaagccctgtgctccccaataggatgaaggcagaggtgtggtttggtccaccccatgctcagtttcccttcccctttcctccttcccaccacatcctcccacccacttagcctcagccacccatccaccaagaatttcctgaggggcagccagtccagatatcagctctgagggagccctgacttcccctctgagacatcagcttcaaaggagggaaccatcctcccaggccctgagggttccccttgggctttgtggttcttgagatgagcagaccctctttgtatctgttcgcattttttttgcatgttccagtctctggggtgatagtttgatgagatagttccatgagttgttgacagctcaggggagcgtgttaaagccatgacgtttgctgtcatatataactttggctagtggcactgggacctctgtatctaccttttttttttctctgtagttaaaaatgtcctgtaatgggaacaagttgtcttctaggaagtccaggaattcaagagaagccaaggtttcttcagcaatggttatctgctgcccagtgtagccatatatccatccatctattcatctgtccatccatatagccatccatccacccattcacctacccatccatccatgcatccactcatccacctacccacccatctacccatccacccacccatctacccatccacccacctatccatctatccatctatacgtccacccacccatccgtcatccatccatgcatccatctactcatccaaccacctacccacccacgtattcacccacccacccatccacatattcagctacccatccacatttccatctacctatccacctatccatccatctacccaccaatccatcattcatccatccattaacccatccacccatccattcacccatccatctatgcac

SEQ ID NO: 15076 - DNA, 1040 bp, Homo sapiens
gaaagccactctgttgtggggtcctcgcttcccttccacgtctcccggaagcggtagcagggccccggcgggtcggggaggaggtttactcagcttgggccccctccgggccagccgccgagggggcgcggcccaggacggcggctaggccgtagtgcagcctctccggagtcctcaggtgaggcggaggcgagggcccactggacgagacgggggtgttaacggtcctaggagcgggggcgcagtcccttcagtggagaccctggtctctccgttttctttcgggtcgcgctcatcttcgccctgttaggggctgaggagggtaactggagagactccttgggcttcagccgacgtcgtttactgccctcctctgtcttcctttctcctgacccctgcctggcctggccgttcttcccgcacggaacgagatgggtggggagcagagtgggggtctctgctcgcttacctgagattccccaaactgacagaccccagggctctacggactgggcctgaccgactgacctccagcctccctccctctgtgctgacgcctggccttcgaagcaggccctgccgcagccctttgcagacccatccccatcccacgcactctctgcccctgggcagtgtctggggaattgacgggtgcctctgaagtccttcgtgtctttgagatgtttgcccagggcccatctaagtatttaattaggtaatcgacattaattgcaacattagtagcagttgcatggtatgttttaaagcccaattaattttgaaatgggaggcaagatataaagaattaatgagcgtgttttgattttttattactttttttgtagagacagggtcttgccatgttgcccaggctggtctcaaactcctggcctcaagtggtcctccccgctcggcctcccagtgtgttgggattacaggcgtgagccacagtgcctggcctgtatggtgttctgtatgttacagagcatttcatctccattttcatttgattttttataaactccgaaatacataggcat

SEQ ID NO: 15077 - DNA, 1002 bp, Homo sapiens
agtcttgtttggccaggtgtgatggctcactcctgcaatcccagcactttgggaggctgaggcaggagaattcctggaggccaggagttcaagaccggcctgggcaacatagcaagaccgtatctcaaataaataaacacaaattttttttaatctttttttttttttttttttttttagacggagtctggctctgtcacccaggctggagtgcggtggcgcgatctcggctcactgcaagctccgcctcccgggttcacgccattcttctgcctcagcctccctagtagctgggactacaggcacctgccaccatgcctggctaattttttttgtatttttagtagagacggggtttcaccatattagccaggatggtctcgacctcctgacctcgtgatccgcccgcctcagcctcccaaagtgctgggattacaggcgtgagccaccgcacccagctggaaaaaaaaaatcttattcataacaagctttcaactttaccatgattgtggggctaaagtccaaggacattatacagcaaggctctgttgtgttttttatccttagggatttaagaaaatctgtggactttctttgatggagataatggaattttttttagtgggttattttctgtatagtagatgatattcaatatacaaactaatctctgctttgcttaaacatatttcttcttttataatagtctaaggaaaaattgattaacagcttgaaagaaggctctggttttgaaggcctagatagcagcactgccagtagcatggagctggaagaacttcggcatgagaaagagatgcagagggaggaaatacagaagctgatgggccagatacatcagctcagatccgaattacaggtaagattcatggtggttcagcttagtagacaccatttaccctcaggtgttaacagtttgagaggtggggaaacagcattactaaagcgataggtttctcgcttctcttcgcttcgcttcgcttc

SEQ ID NO: 15078 - DNA, 1033 bp, Homo sapiens
cttttgtttttttgtagaaatgaggtctcactatgttccccaggctggtctcaaactcctaggctcaagtaatcctcccctctcagccttccagagtgctgagattacaggagtgagccactgtgcctggcgagtcttatcacttaagacatactttttataaggctattgctgccatagattccttagttggatcttgaggcacagtcaattgagaaccttctggaaaagattcactatactagatgccattaagaacatttgtgattcatgggaggaggccagaatatcaacattaacaggagtgtggaagaagctgattccagccctcaaggatggctttgaggagttcaagacttcattgaaagaagtaattgcacatgtggtagaaatagcgagagaactagaattagaaatggagcctgaagatgtggctaaattgctgcaatctcataataaaacttaaacagatgaggagttgcttcttaccgatgagctaagaaagtgatttcttaagatggaatccacttttggtgaagatgctgtgaacattgttgaaatgacaacaaagaatttagaatactacattaacttagttgatgaagcactggcagggtgttaaaggattgactccagttttgaaagatgttctgatgtgagtaaaatgctatcaaacatcattacatgctactgggaaatctttcgtgaagggaagaacccatcgatgtgacaaactttgttgttatcttattttaagaaattgccacatccaccccagccctcagcagccaccattctgatcagtcagcagccatcaacatcaaggcaagactctccaccaacaaaaagattaggactcactgaaggctcaaatgatggttagcatgtttatttaaagcaagcttgggccgggcatggtggttcacgcctgtaagcccaccactttgggaggccgaggcaggtggatcatctgaggtcaggagttcgagactagcctgaccaacatggtgaaaccccgtctctactaaaaata

SEQ ID NO: 15079 - DNA, 1014 bp, Homo sapiens
agacattgagtcagtatagagttttgagaaatcaatgaatgccacaatttacctatgaaaatgtagtagtgtgatttctgtattgtatgactttcattttatgtaagaattttgtgaacactttctctttcagcttaccaataaaactttaagcaatagcagtcagtctgagttagaaaatcgactccatcagctaacagagactctcatccagaaacagaccatgctggagagtctcagcacagaaaagaactccctggtctttcaactggagcgcctcgaacagcagatgaactccgcctctggaagtagtagtaatgggtcttcgattaatatgtctggaattgacaatggtgaaggtaatcaaaaaaggaatctcaaaagaacatttcattcaaacatgcttttgaaaagttatagaaggactatttttatttgaaagaaacttcatccagtgaaggactcaattttctgatatgagacctgggccacgtactgtttagtattgttagtgaaccggataatggactaattaatattcctcaccagtattagacttggggaaagtagtctgaggattgataattatattgtaatgtctgagacacttaacaagatgatgctgacaaggcgaggaattcagtagagaggagctttcaggacacttgaaacaagatttgctttaataatcttccagtaaatagttacgggtattagagctaatacatagttcacataaccatatctaaagaaatctatagattcccaacatatgtaattaaaaaataatgtgtaagatagtataagcatcaacagatcagatttttaatcttggaacttcgtaaagtctacaaattgtcattcagcaaatttctcagttctttggctttaaattatttcttttaataaaaaaaattgtttaagagacgctgggtgccaggtatggggatggcactgtaatttaaaaagggtgatcaggaagacctcgttgaaaagtgtcacttcttttttttt

SEQ ID NO: 15080 - DNA, 1048 bp, Homo sapiens
agccatgagctaaaagcttcaagaaatggcagggagtgatgggaggattgaggctgatttttgcaccttctgttacttggctgagaccaaggcgcctcttcctggggaggtggctgagctctttctagcaggccctgaaatctccagaactttggtcccagctgcctaagcaccccagtccctgcccccgtggcagccattgtcagatgttcctgccagccctgagagctcaacacaactcaggaggcccaggcatgctctgcccagtgctgcagggggcccagccacaaggctgggcagaggagacaggtgacttctgatgcggggacctggggaggcttcctgcagaaggtgccacgtgcagagccctgaggatggggccttcacctctgacctatggcctaggatgagtagggggcttcagaagagggaaagaatagcaaagttgaatttgagatgggggtatcagagagtacccactcccataggtttgtgtttgtttgtttgttgttgttgttgttgtttttgtctccaggcagggctgctgtagcagctgtggtcggaggaggtgagtctctatgggaaggaactcaagcccccatcccccgcctccccccagccctgagcctctgggagaaactggctttgaccaaacccaggattctccaagacatagctgggtagcggtggagtgggcagagtgatggggaccttagagcagcaggaagcaaagcaaagccattaaaggcacagggctttggaggcagccagagctggggctactctcagcttccaccaagtacaaaccatgcaaccccggatgagtcattggagcagtcacagcccgggattcctccccgtctaaagcagggcccatggtatccttggggacttttgaagggagtatgtcagctgagctgtgtctcattcctcaaaagtatttgacaaatgctggtagcccatccactgagtcagaagcttttgacctgctataaagcagtgtcctccaatgcaatggccaaaactaaagaaaatcataatgtttctc

SEQ ID NO: 15081 - DNA, 1044 bp, Homo sapiens
caagttcagttttctttaaagttgaacaagaatttaaatttgcttatgaagcagtctgaaagcatggttctaggtttttatgattttctacttgtgttttaaaagttttgttcttccatactttagtagcaattttctttgacaacttatgtttattgaatttagtttttctaaaacttttaacttaatttgatagaaacaaatatatgtgttcatatatttaggtaatatttaattaaattatgtaattgcaacagcaagtgaaatttgaaataaactagtttgagaacatacttagctgactcttaattacaactcaattagtgagagtggaattctgtgggctttccagagagtagcctattagcgacgagctttcagcttgcagttgcaagggagtagagagtattgcttaatcaggtcttttaacatcttgtcacatctcaaacacctttgtttgagagagatacataccatctcctttccaagtgtgctctgtgatgatcttgcttcattcttgatattcctctcctgtctctctgttgtatttgttcccatggtctggtttgttctttgtttgcctttatagatttaaaaaagtaatgaatttggaatatcagttaaagaagtactttcataagcttatattttattttttaacgcgaactttgaatgtatgcagaaatgtgcacaaatcataatacagcttgttgaattttcacaagtgaacacacccatgtacccagtatccagattaaagcatagaacattatcatgttagcttagtagcttcctttgtattcctgtcccagtgccctgtacttcctgcaaagggtagctactctactgacttctaacactatacattgatttacctgattttgcactttatatagtaggaagcactctgtgtaccttttgtgtatagctgcttttgctcaatattttaaaaaagagatttatccatattgttgcatggagcaacagattgttcattctcattgctgtatactattccattatgtgaatataccacaatttatt

SEQ ID NO: 15082 - DNA, 1035 bp, Homo sapiens
atgatgaaccaacctctcattcttggaataaatcctacctgttcattatgtattagtctttttatatgtttctagactctatttgctaatattttgtggaggattttgtcatttatattaatgagaggattaatcttcagttttcttataatgtcttattttgattgtattttatgaagatgaccctacaatcaaaatgccttgtattctgttacactgcttagtttcttcattattactacataaatagcatatggacctagtctttggacaacatattgaaatcttgacagggatatgtctatcttgcctaatatatatatatgtgtgtatacacacacacacacttatataaacatttatatcttgatatagtacctaaattatttgctgttgaattacatatgttgtaattaataattatatttccttagacatttgtatagttgaaatttgctaagagagtagatcttaagtattctcaccacaaaaagtcagtatgtgaggtgatggacatgttgattagctttactgtagtaatcattttacaatgtatacatatagcaaaatatcataatcactttgtagcctgtaaatacataatttattttttctcaatttacaattaaaaagggttaaaaaatcccatcacattgtatatcttgaatatgcagcatttttgtcagttatgcctcaataaaactcaaaaaattattttagaataactagaggactgataattcatatattgttgaatgataagtatgtctaaaacaattaccataagagaaatcagggagaaaattgactttttttctcttagagaagaaaatatacatatgtaaaatttatttaaatgaatagttatttaggaacccatgagagagattataggatcaatagtttttaaaaatttgctcttgctttgtggagatgacattttgaccctgatagtaactagctggttgacctaagttccataatctctgtagatgttggtttcttcattgtcacaatgtgaaggagatgtatttt

SEQ ID NO: 15083 - DNA, 1078 bp, Homo sapiens
ggccacaagccaaggaatgatagcaaccaccaaaagctgaaagaagcaaaaagcagattctaccccagagcctctagatggaatgtggccttgccaacactttgattttgaccaggtgatactgactttgaaattctggcctccagacctgtgagagaagaaatagctgttgttttaagccactcagtttgtggtaatttgttacagcagccacaggaaactaatgaaagtaacttcccatttcagatataatacaaccccctaccgtgtccttaaatcacccccatctacctttgtgacctcatcatctgccagtcttttccctttctttcataagggcagaatatttgtcagtctagtttctcactatacccccggaacctagaatagtgcctggcagataataggcactcaaaaaaattttgtaaatgagtgttcattgaacttaacatttagagacaatataaatatctacctgaaagaccaagggaacattggcctgatccactgatggcattcttggatgagaagtaggaacagaatttgtttggaaatttgacacgtacatgtagaatggtatataacgctgatttatgttcgagagagactttttgggggtttggagaggatttgggaaatatataataaagaaaggataaaagggacataatcaatgtgaaatgtgatttccttttatttcggtgcatgcccatagtctcagctgctcaggaggctggggcccaggagtttgaggctgcagtgaatagttactgactgcactccagctagggcggcatagcaagaccttgcctctaaaaaacaaaaaaaaaacagaaaaaaaaagaaagaaataataggaaaaaataataatttctcctaatatgattatttattatagaattttatgtctcctgtatatgggtagatttttttaacatcttattctagagtttttacagaaagcattcactttataaatacatttgtaaatagaaagcttaactttacttttttaaaagtcctatttcaagtagcatagttaagtgaacaaacaacacagattgagcattcctaatcc

SEQ ID NO: 15084 - DNA, 1047 bp, Homo sapiens
aataattcctataatgtaaggttgatagaagataatcatcagggtcagaattaagaggtcttgtggtttaggaagcataaaattatgtaacttattgtttatttcactcagaaaataaaagtattaatgaaaggaattagagatgaacagattgatacaaactgttctatggtttacagcttaaaaaataaaggtacatttaatgctatgcattttgagaataatgtcttttatgctttttctttttacatatatatctatttgtatttaaggacaaaatagattgacattactaattacttcactattaataattaaagttctgtgaaacatttactgagtatatagtttttctgggtatatatagttatattagctggtatgcattatagacctaaaaatattgcctttcagtaaattcctagtggacaccagtgttttcacatatgcttcctagtcattcagtcatttgttatttttaccctatctgcaataaaaacgaacagaaacttctgaaattactttaaatgtgtagttaagcttgtaagtgagtaaggaatgatactagggctcaaaaacaaagcaatccgtttcacttccatttaggatatagaaagctgcaagagaacatcactcttattctaataacagtaggttatccacaaaatccacacagtcataacttcttgagcacatcagagttggtcaccaggcagccaagtgagctgaattctcaagagtaacaaacccctcttaggatagatgggacacaggaacattgacttggcagagcataggaggaagaggtgcccaccacataaagtagttagcagtatcagctaagattttaacacatttttaaagggtgaatgtgcactcgcacagtttatgtgtttaggataacttgtagcttagacacagaggagctttgcatccatttgcaagctcttttccatacgtttccactgtttgatctgtgagaaagactaggggacaaggcaggagattggagagcatctcccttggtgataaaggtgtggtggtgat

SEQ ID NO: 15085 - DNA, 1093 bp, Homo sapiens
cagcctgggtgacagagcaagactctgtctcaaaacaaaaacaaaaacaaaaacaaaaactcgacacatatatagtgaagacttctacaatgttaagatttcccccgctcggttggaaaccctgaatttgtgtgtatgtatttgtgtaaggtaagttacattttttattggtctgcgtttttctgtcatgcctgtgtacttgggaaatctgaaactgagtgtcttaggaacttcttaaagcaaatgtgagggaacattaaaaagtatatttaaaatatagaataggtccattttctaccttaaagagtagtatattaaatacaattattatgctgttgttgctttgcagtgtatgtggtgggaagaaggcaggagttttttatctgcatgctatatgaatccttcaataataatgtacctttttattactgggtttggccatattgatttcagtgagtattgtgctctcacagacttatttttccagatttcatctcttaaaagtgggaaattggactggatgctactttattcctctttctactatttttccacaaacaaatctgactaattgaacacaaacaaggtgacttaagaatgtcagatagagttagtcctctgtctttggccctctagggcctagaattgcctgtcccttcataagtgtcaattagtactcttggaatgaatacaggaatgaattttattttattaatatgcagtctaaatactgacttttcatcagtccaggttatggaatgatgaaaagtcagtatttagactgcatattaatattattacctattcacattactctgaattatattaaacaactaatcaataaatgaattttaggtttttttaaacattagatagcagacagacagaaatccaattaggcatttagttaacatagttcacactgtaaatcagctctattcaggattctctgaatatagtcttttctgtttctgtgacagaaaataactgcctaaggaagatcagggatatttacgattttccttttcaccctgggacaaagttcatgcttatattctgtttaacccccatgggtagctgtagtgcatgctgt

SEQ ID NO: 15086 - DNA, 1045 bp, Homo sapiens
cgccctcactccttatggctctaaggggttgggtctgttctcaggttctgcgtgtgtccctgattcctgaagctacctggatgctccctgagagcaggagctgcttctgaaagaccatggatcccccccaccccactccccatcaagcagccagcagagtgccaggggcatagcaggtgctcatttaacaaaaatagacaagacccgttgccagagacagcttttgctcaagtgctggagttctcaacccagctgtctatgagaataaccttcccaggagcatttgaaaaatgctcatgcccaggctcctcactttgtattaatgatgcagttggtctgagctggagcctggcaccaggcattttcaaagctgctcatggacactgcattgttaaggttcaccaccagctccgaattgtggctgcactatgtgggcacatgcccggtctttctgggcctgttcagtcatttgcaaatagccttgcagaaatgtacatggtgggtccagtgtgtgcctggcacccagagccactctggctaatgctgattcaaagtcgcaagacgattttgccctgttttggtggatagctcccctgtggagatgactgctcagggaaactggcagatttccagaagagggaagaggagcagccattgctgattggatcatccaagctgggttagcgtctggcttcgagcactggtttaaggtgagcattaaggtcccgtgggatgttgagagtgtttgaggagaaagaacacatctccttggtctagatctcctttcaatgaaaaatgccattttgtcagaaattcccctcttttgggatcaggcagtgcatttgatgttaacgagctctcattgaacacacgctatgtgctgcatttgtgcaagggcttggggaccccctaaatgaattagacaaattagacagtcatgccctgttggagcccagtggcttttgggtccccgttccccaggcaccttaacccaggacagccacactagcaggaggagggcggggagggagagattcacacgtga

SEQ ID NO: 15087 - DNA, 1029 bp, Homo sapiens
attgtttcccattgaatccatacaacagtaatcaggtgggcattgttactccattttgtagacaggaaagctgaggctcagaaacaatagagtggggccatttagagcatggccttggcgaacatgagagaatcccagctctctcacaccctgaggaaaggggagatgtttctcccgctcgctgattccactttgcccatttataaaatgtgatgatagtgtcttcctctcttctgttgttgcaagcattacaattattgatggacataaagtgcttagaacattacttggcccctgggaagcagtcagcaatgctaggggctctgctgactgctttaaatgtgaccacagtcactcagcaagcagaaagagatgatgacatcagcacgattgtccctgtgcagaaagaccaagctcaaagcccagagaccccttgagatcaccagcgacaaacattccacacagatcacaaatgagcattgttctgctcgcagagttcttgctcagttacctgtggaattattctccccactttacagatgaaaaaaattgacattcataaaaagccctcttttccttaaggattgcaaacaaaagcctctttcagccagtgttcccgttacctattgctgtgttacaagccagtctaaaacttagtggcttgaaacagaaggtcgttattatctcatggggttctgtgggttgactggactcagctggtggttctcactttaggtctcctgggtactgggggcagatggtggctggggctggagccactgggctggcagctgggctgggctggccggcacagccagggctgtagggcttctctgcccatttctctccacctggctcgctggggcttcctcacagcaggtggcctcaggggagttggatactggcatggcagccagcttcccaagagggagtgttccaagacacaggaaatggaagctgctgggctgtaaggctggcccaggaacttgcatgagctctcacccaaggggagggaacatggacccctgc

SEQ ID NO: 15088 - DNA, 1029 bp, Homo sapiens
tcccataaatattcttgtgctttgttctgggatgcagttcagatgcttgagaacagtttgatttttgcaagtactgtttttaagatttgttaggcaggatcaagccaaatttaatctaagagtaattattccccatcacaaaggcaatgctgttctgagtattctacctgctcagtgtctcataaatgatgagattttcaagatgggtgatggaaacaggcactatttctggccctatatgggttccaggcactattttctataattttttgggtgattctttccctgcctcaggcagtttctgtacaaacatgcattcatctgtcctttgttgaatgtttgagtggtccctctctcaaaccccagggttctctctgtgggcggctgtcttctctccatactctgccatgtggtctccagctgcctcactctcctcagactctcacttccattcttcaactcagagagtccattgagccctgcctgagtttactgctccatggcctggaaactttccataggcagtaaaccggagcacctgtatggctcatcttgccaatttcccatctctcgagggtcactgtccttcattgtctgatgtccggtgtcttgaaaatcattttcatgtattttatctggtttttcagttgtttcagttgggagggtaaatctattccctattactccattttggctggatgtggaattttcataaggctgtgcttttaacagctatatttccaccgttcctccttttctcccgttgtgggaaaaggaatgttgacacttgaatctaaatctagaccattacccctacctcccagctatgggcccctgatccagccagcatttctctttctccctgtctcccaaatgccacaaaatgtgagtaacatacatacatactctacaggtcaagtgagcctggggaataacaagtgaggatgccaaatcatgcatggaccagcctaactcctttccagtctgccgttgccacttggagttcttccaggtatcctgtgacaggat

SEQ ID NO: 15089 - DNA, 1054 bp, Homo sapiens
tttaagtttttgctatttgcttcattatctatgaacttcgttcattgtaagccagatgccaggtttcatttggggaatgtcttatattggtaaagtagcatttctgtagcgtgtttatcaatgtttaagaaacagattttggcttcttttcaagaggtgaaatttctcagaagtttactatattctgaattagtgttttctctagcaatgtatttggtctggattctaacttagatgtttaagtagtgacagttaaaatccttggggcaggattttctctttggtcacttgcttttggtcactttttgtcaaaaattttgggggtattgcagggaaccaatcatgtttagaaatgtgtgttactaaattagtttttctggtcttactgatttgtttcaaattgtagaattcttttggcagtaattgtatccaattttgtttatagtccagttacaacacagggatcacaacaaacacaaccgccacagaagcactatggcattacttctcctatcagcttagcagcccccaaggagactgactgcgtacttacacagaaactaattgagacattgaaaccctttggggtttttgaagaggaagaggaactgcagcgcaggtaaatagatattctatatttttttaactcggaaacttttattaatgttgacataaactaattttgaggcattctctacttacttagaagaccagggttatttgcccagatctatatatctgttttggagaagagggatacttaagagagaaaactttttgtttttgagacggagtcttgctcgttacccaggctggagtgcaatggtgtgatcttggctcaccacagcctccgcctcctgggttcaagcgattctcctgcctcagcctctcgagtagctgggattataggtacccgccaccacgcccggctaattttttgtatttttagtagaggtggggtttcaccatgttgggcaggctggtctcgaactcctgagccttggtctcccaaagtgttgggattacaggcgtgagccaccgtacctggctgaaa

SEQ ID NO: 15090 - DNA, 1033 bp, Homo sapiens
tggctaatttttttgtagtttttgtttttgagacggagtgttgctctgtcacccaggctgtagtgcagtggtgcggtctcggctcactgcagttctgcctcctgggttcacaccattctcctgcctcagcctccccagtaactgggactacaggtgcccaccaccatgcccggctaatttttttgtatttttaatagagacggggttcaccgtgttagccaggatggtctcgatctcctgacctcgtgatccgcctgcccaggcctcccaaagtgctgggattacaggtgcgagccactgtgccagacctgtattttttttatagagacagggtttcgccatgttgcccaggctggtcttgctcaagtgttccacctgcctcagcctcccagagtgctgggattttttgtttgtttgttttttcatagaaatgccttaaaagtagtttgacagatatggaatgttgttttgtttgtgtttcagattgatattttgtttgcaagattagcactgcagacaattcctgaagatttggatctacgagatgacagtctgctaaaaaatttagatataagatgtataagaagtcttaacggtatgagaaagcctacttccttttgtgtacttcagtttttgtcagatattagttgtttttacacaagttttgtattgaagctttttatagctatattgttaacacagtagtgagttaaataaaatgaactttgcctaataaactacagaagagtatgtagtagtttatttcactctacagtattttatacactgtatttcttctgtcattaatggtatactcaggacacttaaaaagaccatctgacttttgtactctgttgctagtgatttaggtttcatggcctaacccaaattaattttgatcctgttattctttagtaatgctttcagcattgctgagatcagaaggactactttggtacaattttatattagcatagcttgttactgtgctcttgaagagcagttcttggaaactttagtggattaagtcttc

SEQ ID NO: 15091 - DNA, 1365 bp, Homo sapiens
ggcacactttctagtaaggttgccaaaatccaaattgaagcagatcattagtttagatgaaatctttgattctataaaaaattcctataaaaacaatgtctctctacatggtttttctttctcaactccagctatgaatgaaataaaaaatagaatcattggttcagtttaacaaggggtaaaaagcccaagtatctgttgcatatgtacttgaagaaactgattggctgttgttgtatgtaggtaaaccccagtgataggtaccatcttatgcctataattacaccagcatacccacaacagaactccacgtacaatgtgtccgtttcaacacggatggtcatggttgaggagtttaaacaaggtaagtgtttatccttatgctctgatttatacaggaaggatttacgtaccattgtagacccagtagtcagctgtgcaacttaaattgaagaaggattcactgaagtggattttggtgttcatttatttattacagtatatatttgagaactgacttcaaaaaattaattccttttaggcaatttgttttttataacaagttggaagattaaccaacagttaaaaccagtaagctggtttagttgcatactattgccttgtaaaattataaatgataacagtttgtctacactggttgaaatgagagatgtttagcaggctgtatactcctgggaaagaactttgagcaggaatggggccaaaccacccaattacattccattattttggaggaaccttttaacttttgaaccctagttgtactgttaatttgaaggtatagctactaccaaatagtctttgagagaaataactggaacagattggtttgactgaaaacagtaaaggaaatagaatcagttgtctgactactagctttaaatttagacgtttaaaattcctgaatattttacactttagtttcatctttagtctaaagaggcccatcaagggaagatgcctctatccctttagaaacaacagggaaacttggttttagaaaggcaagaaacaaagtatattggaaagttttccttctcgggtaactggagtgtttaagaaagaaggtcattctatgagcatggcattttagaataattgtactttaccagaaacctggttctcaaaaaatcttccagctttttaaaaaaaaaatgtgtatatatataagagtatgctctaaaatcataagctaaaactatatatgttaaaattctggttttaggattatagtgagtgcatgtagtatgattaagattatttaaaattctagattgtagactgaagtatgcaaacattttaatatgtttttaatttaggtcttgctatcacagatgaaatttt

SEQ ID NO: 15092 - DNA, 1079 bp, Homo sapiens
taatgcttgaagcttttctgaccatttgatcttgtgttggattgtgttttgtaataatctaagcaagattgctttatgctcttccccaattaaaaacaagaatgatgaccttcatgatgtctctgtgttttgtttctgtatcttttgcatgagaaagcaataacggagccagtaattgtgttctcgaagcactacgttgtcagtaaaaattaaaatagcataatcattaaatactcttattttactacgaatccccccataaattgtgatttctgtttgacagataatttttctttgtttttattttaaccagtgtagaggaagtaccttggaacatttaaactaataaacatgtatgtagatacttttaaaactatgatataaaagagacacagttacatgtaaggagaagaataaaggaattggttttacaggaaagtgctagtaccccttaattcctggaatcaatgatgaaactagattcaaactttgttctattcactttcgtataggactgtgacggggcttctttcactttaagaaagattaatgtttacactgaacaaaccttaataatgtcattttatttgaacaaattcacatcattagaactttggtgctttttctaaagcttgcttaatgtttcttttaaaagttttaaactatgcttcagtccttgctggatagtacctgtaagttctttgactggttaaaagatatattactaatcttcactgaagtttttgtgaaataatcaaatttttttaggttgtaaaaaaagcagcaacaaatagaggaaattacatcaggaaaatttgcatttcagctgagtgtcttgtgaaaacttttaaaatatgacaatgggctagttttatccataccaaattctatttatatttttaattgttctccagaaatttgcctctttaagataaagtgatgactatcattaggcttttggaggtgttcacagatttgaatttttaaagacatcctcatataaaatactccaaagattgactgtacaaccaaatggaaatgtttagtcttcccatgagtcacaagttgattcaatctta

SEQ ID NO: 15093 - DNA, 1048 bp, Homo sapiens
atctctagaaaaaagtaaaagaattaggtgtggtggtatgcacctgtagtcgtggccactcaggaggctgaggtgggaggattgcttgaacctgcaaggttgagactacagtgagctgtgatcccactgctgtaccccagcctgggcaaccagagtgagaccctgtcttaaaaaaaaaaaaaaaaaaaaattttgagtctcgctctgtcacccaggctggagtacaatggcgcgatctcggctcactgcgacttccgcctcccaggttcaagcgactctcctgcctcagcctccggagtagcttggattaccgtcacctgccatcatgcccagctgattactgtatttttgtggagacggggtttcaccatgttggccaggctggtcttgaattcctgacctcaggtgatctgcccaccctggcctccccaaagtgccaggattccaggcatgagccaccacgcccggcctgtattacaatttaaccaatggcagaagtgcgggttggggaggattccctggatgagtgtgaaatagaaaatgctgaggtgttgtggatgtgtttttttctttcttttggacttcatgtgtatatgtttttaggcaaatcatgcataatccaaagacttcaggcctgaatatgtcctgtaagtgttatcattttaaaagtttttttttaagtgaagaaactaacattttaataagaattttgggatctgtgaaagtctgtgtcctttgagtgtgtgcacaaatataaaatgtgtacaactgtactaaataatttcacaaatttagttttgaagtttagtttcttgaagtaatactaagtaacttctgtaaataaaacttctgggtttttagaatacgattgtatatttgctcaacaagcagtgagtgtttattatgtactaggcaccttgctagccatttcaggctttcttcagcatctgtggttgttctctggccaactatccttttctttttagtcatttaatatttgtgcccttgagggctctctcattattcttttgtctgtttatcccctctt

SEQ ID NO: 15094 - DNA, 1025 bp, Homo sapiens
ttttgctaagaatgtatttagtaatttacttactacaacacaatttctttagagtggaaaaaaaacccctctagatttctcatggattctattatgttttgattaagaatggtgaaaaattattttattattttattatttagcttattctctgaagactttttctttcttttttttttttttggaaatagctgctattaactaaaagtaatctgatgaattttgtcactcttaagatggtaaatgagaatgaaaaacgggtattgtatagtactttaaatcccccagattacttacgatgcctaatacaatgtaaatgctgtttaaattgttgttatgatgtattttttaatttgtgtcatttttattgttgtattattttttatttttctaagtatttttgatccatggttggttgaattcgcagatatggattccacagatatggagggcccactgtaaataatcataacttagaagatgtgttctgaaaactcatctgtgtctgtgtaattatctcttagggcagtgattttcatcattggttgtacaacagaattagtttttggggttttttttgttgttgttgtttttcaataaagattttagggctttctccaaactgaatcagagatcttctagaagttaggcctggagatcctattaagagccctgctgccacatgattgggttgtgcagcagctaaagaatatactcaatttttgtgtcaattacacattcagactactgatactggtttgaagttgtcacggcatttcagaactcaaatttcttttgacattagtaaagtgtatttaagcataattctatgcatttaacatttggttttctttatgttaaaaatggcaccctaagagctctaaataagtttgtactagtgcagtattttgcaattttgtttgcacttaccttggtagaataacacttgtgtttcttgtctggtttagaaaagcaataagaatatagaatttttaaacttaagtatggaaaattaaaaatacata

SEQ ID NO: 15095 - DNA, 1051 bp, Homo sapiens
taaagatccatctctgtatttttttagtgttaaagaacgcttgtgatttaatctaattaatatgaaaataatctacctaaaatttaggatgattaaattattgcttagctgtatatatttgtttaatttacagtgtcagaaaataataaatttactgctgcttctgtatataaaatgagctttgagtattctcccacttgggggtgctccaatactagttaatattacagctattagtgttgtaataagtgaatacagtttagcagtaacttaagcattatatgataggtgattcttagaggaacaattttaaaaactatttgaaattacttaggagtttttaaaatattattaaaatatacctatttgaaaattcctttgttgaacacattatttgttgaacaaataatgtgataggcatatttacattccattttgacaacattatagagtttttaaatttgtaatacttttcttcttagaaggtttcttaggaagtaaagcaatggaaaatacatctcattgttaaattatggtgctttgaacaatgttgtgttctttgctttcattctcagaaaacatccagtacagacctttctgatatccctgctctccctgcaaatcctattcctgttatcaagaattcaataaaactgagattgaatcggtaaaaacaacctcaggggtccataaacaatatctgccaactcaacctgttgtcttcaaatgctaaaaaaggagaatggagggtacaagactagacatgactgaaatggatttgggttttttggtgacctcccttactgggctaatcagcacttgatcggaagtccaggttagtatgtgaagccaggagtactattattattgtgttagcaacagttgcattaactatttcaaaaattactgcctttaaaaaaaacaacctcaagctatatttgtattcataattgacatctggattgggtttatgtttgatgcattgtttggaaaatttgcaatacaaactggcataagaattacttattctgatgatgcacttttatgtatt

SEQ ID NO: 15096 - DNA, 1155 bp, Homo sapiens
tgattggtttgttttcttactgattttagagcattctttatatgttgtgtatacaaaatcctttgccaaatatatgatttgtaaatatattctctcagtctctggcttgtcttttcattctcttaacagtgtctttagcagcaaaaaagtttcaaattttgttaaagtccaacttctcaatatatggatcgtgtttttagtgcctatcttagaactctctgcctaactctaggtcaggaggttgttctcattttttcttctgttttacccttatatgtcttacatttagatccgtgatcctttttggtttcatttttgcacaggatgtgagctttagatcttggtacatttttcttttccttttgtccatggatgtccagttgttccaaaaccatttgttgaaaagtctaccctttctccattcaataagttttaaaaatcaaaaatcagttggccatatactgtaaattaggtatcaaaacaaagacaggaagaaatgaatgagcaattaactattaataaatacaggtttattgaaggtataacatggctggagtctggaaaaagtgggaaaacattttagagaataacatgggcaaagatctgttctagagaaaataagtaagaactggctatttttgggagtcatgcaagtgaagggaagtagagaagtaaaggaaggatcattggttcgtgaaaaagaaagagtatataaacttctggctagattgaagcatttgtaatcagtttcattggctattaggaaggtgctgtatattcttaatcaggaaaatggtatgatagaaatggtattaaagagaagttgttttaggaccatttgtggcagtgatacgttggtaggaagaacaggatataatcatgacccttgacttacaactttgttttacaaatatctgccagaaagctaaaaaagtggtgttacttcagaatgttataaattcctagtattttctagaaggcagtggtagatttcaaacttttgctgctgtcctcagtgatggatatggagaagtcagcaggacttccaaactgtttcgtatttatgctactgttattaagttgtacatttgggaaaaagagtagtttccgttggctcattgttgatgtgggtgacatttcttaccaggcctgaaa

SEQ ID NO: 15097 - DNA, 1025 bp, Homo sapiens
ctgggcagaaaggaagtaagaaaggagaccaagaagtggtggtcaaaaagttgggatgaaaataataggagtatcttgtaatgctggagtgactctgtgttaagtactgtggtagatacttgaataaaaaatgaataggacatggtccctgctttctgcccctgtttttgtttaattgttcagtttatggaactgcctagtcagtcattcctgaagacttggaagtcatcctttatttctccctcatacccttgcctctttgggttaccaagctccattgattaaaaaaatttttttgaagtgtaacaaaaaggtgcagaagcatcaagctcaattatttttaaagttttacaaagtgaacaccctgtaatcactactacccagatcaagatactcattttctagccctcagaagcccagattatgtggggatatcttgcagacagtagttactcccacccaaggtaaacacgattctgacttacataactatagttttacctggttttgaactcatgtgtaaatggaataatgccctctggactttttttttttttttttgcttgacttcttttactcgatgttgtgtctgagattcattcatgttgttgcatgtagtttgttatttttaaaaatagctctgtagttgtggttatctatccctgcataacacactagttttgattattggttattgcgtaacacaccactccaaacttactagtgtaaaataacaaccattttattatgctcatggattctgtggattgggaatttggtggttatggcttatcactgccctacaatgcttggggtctagaatcatttagaggcttctccactttcctgtatggtaccttgactagaacgtctagaagactgggatcatctgatactgttgaccaaacctacatgtggggtcaggaggttttggcttttcacagcatgttggctgagtaccttgactagaacgtctagaagactgggatcatctgatactattgaccaaacctacatgtggggtc

SEQ ID NO: 15098 - DNA, 1072 bp, Homo sapiens
ttcattttggttgggtatatatgtaggagtagaattcctggtcaaaatgtatatgcatctagcttgcttgcttgcttgctttcttttttttttttttttttctgaaacgaagtctccctttgtcacccaggctggagtgcagtggtatgatcttggcttactgcaacctctgcctcccaggttcaagtgattctcctgcctcagtctcacaaatagctgggattataggcgcctgccaccacgcctggctcatttttgtatttttagtagagacagggtttctccatgttggccagactggactccaactcctgacctcaagtgatctgcctgcttcggcctccctaagcgctggggttacaggtgtaagccactgtacctggccatgtgtctagttttaatagacactgccaaattgtttttcatccttgttgtacctatttatacttttaccaacatatgaaagttccggttactctgcagctttgcttcccttgatattgtcagttaaatattacaaaaaattaatcactagtggctgtatagaagatcttagtgtggttttcgtgggcatttctctaatcactgataatttgagcacttcttcatatgcttgttggccatttggataccctctgttataaagttcctgttcaagtcttttgtccattttcaacagattggattgtcttttttcttattgaaatgtggagtttataaggtatctggatatgaatcctttgtcgaatatgtgaattataaaaatcttcctgtcttacagcttgtcatttcactctcataaagtttttgatgaactgaaattctgaattttaatcaattccaatgtatccatcttttcctttacgggtagtgtttttttgtgtttaagaagtttttgctactctagggcgatgaagctattttcttatgttatcttctagaagctttagtattttgcctttcagatttaggtcaaagtccccaggaatttgtttgtgtgttatgaggtagggatcaagccttcttttacttttttcatatggttatctatacaagtagtaacaggtggcat

SEQ ID NO: 15099 - DNA, 1271 bp, Homo sapiens
ttctgtctcaatcataggatttttgggatcaaaatgaagaaaatatatgaggaccctctgtgtcactgggaagtggctttataaactcaagattctgtattttatttttcaaatgatttcttagcactaatcaaatgcattaatcaacttctgattagctggcacatttataagaggattgtctttagatgtattgctttcaaattgttcctgatgtaatttagcaaaggaggtgatggagttctttgttgactgactatctttcgtttgattttattctgacttactgtagtttggcaggaggccagttataccaaaatatgtaattacttcttaatcccaaataagtttgaaatataaatgagtcattttgtcttagggatatgatgggttgggaaaaaagtggtgtttttggctcctcctaaatcactcatgaatttattttttacccaacttctaaaatgaactggaaaggtcttttattaaaatcctcagatacggtagacttgtatgtaatagagcaattaaagtgaaaatgaatgacttaatgaagaaagtaagatgtaccagaatatctaggtcagtgggtcagtctgtgcatcacagtaccctgtgtagcatgaaaatataaagatgctggggctgttgtggagtaaggcctttactgttccaaagttccactgataattaggttggtgcacaaataattgcggttttggactgtgaattttaaatcattataactaggctcaaacacatctttatcaaaataggagccattgcagtcaacacatttttgccaatgagaagtaagttagtttattcctgtagtgtaaaaatccgtgttttgggattcgatgaactcttggaaagcattttctgcatcctgctggttgtgcaagcgttttccctgcaaaaatttgttgatatgcttgaaaaagtggtagtcggctggtgagaggtcaggtgaatatggcggatgagacaaaactttgtagcccaattcattcaacttttggagtgtttgttgtgcgacgtgcagtcgggcgttaccctggagaagaattgggccctttctgttgacgaatgctggctccaggtgttgcagtttttggtgcatctcatcgatttgctgagtgtacttctcagatgtaatggtttcgccaggattcacaaagctgtactaggttagactggcagcagaccatcaaacagtgaccatgacctttttttggtgcaagtttggctttggaaagtgctttggagcttct

SEQ ID NO: 15100 - DNA, 1067 bp, Homo sapiens
ttttctccctccctccagcctctggcttatttcacttagcataactgtcctcaagattcatctgtggtgtagtgtgtgtcagaatttacttctatttttcaaggctgaataatattccattgtatatacatgccacatttattcattcatctgttaatggacactcaggttgcttccaccttttactattattgtggatagtgctgctgtgcacatgggtgtacagatacctctttgagactacaaactttttcctagagatctgttaacttaaaggaataaacatcaattattttttcaaataaatgtcctgaatttccaaagatcttaattttattgagtagcacatttttaaatatataatttattttcacataataaaatttgtattttggtgtaagctgtggaaatgtaggtggtctgcttttttaacatgataaaaccctggaaaactgtatatgataaagtggaacaagctccctgaatgaaagctcatttcatcttgaaaaaagaatttactgtattcctcaaattgcctaggactgtgagtagcctaaatggtagactggaatccaggatactactgtattttgaaagcaaaaggaagagaatgtttcaagaaagaaagaatgagcagtgttgagtgcttctgggcaggcaaatgagatgattcagtgtcagctagatttcatagcatggaagtcactggtgacctcagcaagggttattagagaggaatcatgaaggcggatctcggagtgagttggataagtaggtgaaaggaaatattggcaagtacagacgattattgaaatggcaagtacagacatttggcattgaaagggaaaagaaaggatgatagcagagatagcagagggggattaaaaacattaattttttttttttttttttccctctgtcgcccagcctggagtgcagtggcgccgtctcggctcactgcaagctctgcctcctgggttcacaccattctcctgcctcagtctcccgagtagctgggactacaggcatccaccaccacgcctggcttattttttgtatttttagta

SEQ ID NO: 15101 - DNA, 1046 bp, Homo sapiens
gaactagaaaataaggagctgccaaattcagtgaaggtcaaacagggtatgggaggatgctgaaagggaacctgagacacagatgtcaggaaagctggcagaactgtgttctctaaagaaaggggcacaccctgagaggcacattaataagcctttgtctgggagaacaggaataggtgttggcaggcaggggcactagggaactttatggtgtgatgaaaatgttctgtctggtggtcgcacaagtgtatgtacgtttgtaaaattttgtcagtttactttgtgcaagttagtaatttattgcctctcaactccaaattcacccctttttgctctatttatatactcgagccagaccttttaaatattttttcttttcctggacagtgttagattttgtcagtagaaggtgaggaagggatactgcaagacttagcagagaaagtgcttctcttgttgccatgtgcttgtttttttgttcgtttgtttgtttttcttaatctcttaaggtgtggctgtcagctctacttactctcctgtaagcttcattagcaccctggtaggcagcttcttgctcccaccagtatctcgtgggcagcagattcctgtggataagctgtagctcactggccctacagagaactaccctaccgctcagtgggtcactgccacagtctgtccagtgaagtgttcctttcttgggcactctcccttagccttggagacagtaactgctccctatatttgctagttccatattccttcaaattgtcttttacatctattagcacttgacaactttttacaaattaataattttttatttatgttacattttcttgttttaattgattgtttgttttctagctcctgaatggacactgactgttatcacacacttgtgatttgtgtaccttacttactgtgttaattttacataaataaacaggatgaaataataagtatacttcttgattactttctataacatgaaccaattgtttaaacaccaagattgggatatagaatgctaccagatccctagg

SEQ ID NO: 15102 - DNA, 1027 bp, Homo sapiens
ccagctgtatttaagtcttttgtgtttctcaagatgctaaaagataagtattgaacaagtatttattagtacactgccattggccctgcttatacctggctgaagcaggccctaaggattgacagggcctttggttgcctgaggccacctgagattataggggccagcaagagcaagagggaatcctccacatctttttccattagaagccacaggagggagtttcatttagatacattttaaagaaatatttctgtcatagtggcctcttgcagagcagctgagtatatttcagtgacttcttaacgtttatgcgcaagacacagagctactctgtttaatatacaacatataagatgtgcctggaaataaaaagcaagactaataattcaaaagaaaaatgagccgaggttactcatagtttacaggaaataaagtacagattttgcttaggagtgttttcttttaatttttttttttttttttgagagggaagtgggaatggactgggcatgctcattgagtatgagaggatttccagttttgatcccttggtgaatattaattataggagcaataatcattttgttaaggaacctggtttcttttcatgggaagtggtattttaagactacaatttgtttgctagggatgctctttgctgctgggttgattattgtttctaagctttttagtgaatggggctaggaaatacaaagatgtgtttctgtgtatgtgtttattttaaagatacattctgaactaaaaatatttccaagtacagcatttttacctttacctattctatcttttatctctgtctctttcttccatatctgaatcctgatgttcagggacacaagagaatgatagaataataatatcacataattactcatttgcatcattccacatgtatgcacacaacagtcttagttaacaaaatcaagtatcacaatatgatttctggaaagttgccttttttgcgtatgttatcccattttttgatagttgtactatatctaca

SEQ ID NO: 15103 - DNA, 1025 bp, Homo sapiens
atggtcattctgggttgatttttcaaatgtatgtgatatgacctttcaaaatgtagttttatgtttaaatgaagttcaggaaagttttcttgaattaaatgatttttaatattctgttcccttgctttgattttctttgttatatgtatgttggtttttttgtgtatgttttcttaaacattttttggtcctttttgatttttttgtttttttccttttcactttctatttctcttgtcattaaaaagttttatttactcttatgttccttctcatgtagtttttatttccgaactgatttttgtctttcattttcaattattctgtcatctgatttctgaatttttctaattctgattgatgttagtctgtacataaagtgttttttagcttgttttgaaatactaatttatagctatcaaccttttgggaggcatgttttcttatgtacttttctaaagggattttttttctctttaaaaataccaacttagtgtggcactaggctttgatccatttttgttgctgagtttcgtatgcagccagttttcccttatatgcaattagttttagatagtctggttcagggtgagtgtatgtcattctctagatcccactcttcacttgtttttgtgtagtattccaaaatactgaggctaacttatagatccactttcatttgaactttctttttcctttcttcgtattatccttgtgatgttcactttggcttcatccctagcagtttctcctcagcctgaggctttgacctagaaggggctttggctggttagttttgagagttgtagaggcaacaggcttcagcctcttgagacctcaccaaggaccccttgcacttcctggctgtgggagtggcagagcccttcttctttcagttgcttttctcacagtgtcttgtgtgcttctaagaagtagctcctgataatttttggatcctaagatttatcagaggcaccatactttcttctgcttccttctttacagttgctgataccacacagatc

SEQ ID NO: 15104 - DNA, 1062 bp, Homo sapiens
tgattactataaggaaccagtcaaataagagattactctgatgatttgataaagtgggttgaaattcagaagggcatctgttttaatatttggaagtactatgtgttttagttgtttcttttatttggtttactaccataggtgtaaaagtaacctttcttggtgttttgagtctaggctagcttggttggcacagaaattccattttgcaagattttaccatgagtaaaaacacattaattaagagaactaattgacatgaagaaataagagacacttttatttattttgaagatgtttttgttaacttagagaagatttagacagcgaagatgcattagtattctataggaaaaaattcaatttaaaaagtccccagtaaattaataaggaacattttcagataaggagtttgtgtatttggagtgatagtgggtgagttggtgaaaaattccagttgaatctagtgtgtatgtatgtagcatgtctaggctcaaaactgagctcaaaactgagctacagacttctttcatctgaatagccatttcaagtgttgcatactgtcttaatcattcttattaaccttctttcttttctatatctccagtatgtttttagggaactgtggaacctaacaaatacttattttaaatcttttttgattaacatttatagaaccgagagtttgaaatcacacaacaaacacatgttcacatgcatactagtacaaattgagttccttcagtcaacgaagtgagttacacctgagggcacttgaagcccagtgtgaagtgacttgatcaagattacccaaccagctggtgtcatacctgcaatccaggtcttttgattccagtcagtactcttttcacaataaaacactgctttctctgaatgttatgttaaacttatgtgtcagtgagaaaaatgaatcaagattcatctcctaaaggatagctaatgggaaagaaagcttaggaattctgggtgtcaccagccttgcccagatgattaagccacagtttttcctgtcactcttgaaagttgtgctccttcctcaca

SEQ ID NO: 15105 - DNA, 1050 bp, Homo sapiens
tgggctcttctttgtggtaaggtctgtttttgccagtcctgataaagtagatataagtgtaatgaaaacaggaaaggaatgggattttggcattaattggttaaattaggtattgaaattttattaaatctgagaaatatcttatagccccttggtgatacagttaagatgattgctcatctttgcttaagggaaagcttaataaagatgaaaattagtttaaacatttttcttaaacttctgcaggctgagctatatatctgattttgtataatttatcacttatagaaatggaacttgagcaatataagaaatatagactaatatttctctgaacatttctaaggagtttgacttaatcttaacacagttataaacttaagtatcaaaattacattggacagaaaaatagatttgttggtcttttttgaaggttcattgaaaatatctcagtaattttaactactgctagtactaattaactcttatattttaaggaacccagtgacaatggacctctttttactgaattaaagttctaccaacgagctgcaaaaccagagcaaagtaagaaatacagtacacatacgtttacacttttaaaatgaccagttttttgttttaagccaagacctagagcattgtatcttattttatgactctttgttatttttttgctttataaattccacttacatgggatttgtgtgaaagaattctggtcttttaatgggtttgttgcatcaagattttatctatatagatacatagaatgaagttaataataaatgacctatgatttaggaaatattgttaaacattgagaattattgatgaaatagaacaggatatcaaggtagagagccagaacctctcctagtcactttggtcccttctgtccttcttccatgtctcttagatcttgatttcctggttgaggacttttatattgaggaagaaaaaccttttagattggtatgaaaaataggtcttcctgtagaagcaagtaaacattacataattagagagagaaactgcaacttcaggata

SEQ ID NO: 15106 - DNA, 1057 bp, Homo sapiens
cttagttattttatttattaaaagatgtttagacaagatgattttctaattttcttccagttcaaaaatgaatagaattctgagttacttgttcaacatcttgtcttttaatgttagtcaactcttccttccctattgaacttgtcatattgttatcatagaagcctataacatataaatgggatttttgtatcctactgacatttatttcagttaatatgtagtacaggggttaaaagcatgattttgccacatactagaggacaaattatcagttttcttctgctgtaaaatgggtatgataggagttacctactttatagagtgatgtgaggtttaaatgcattaataacgttttaagtacttacagtagtgctgtgtgcataccaggtgttcagtaaatgctagatgttatggtgttgatgattcataatcttcctcattggagatgtcctgatacattctgagtgtggttttgatttttattgatttactgaatgatttcaccagacaagttagaatctggaaaactattgaagataaaagtggtcctcagagcagaagctaagcagtgttattgcaaataggtgatgcttttctgtacatactgaaatataacgtgattattgaatctgagttttgggtgttgaaagtgaccttagaaagggtgagtccctgctctctcattttacttctgtggaaattgaggcccaggaagtaatgtgactcagccaaggtgacatagctgctttatgcaaagccagttatcttcatgttttttcaggatatttgtttttccccaaatcttggccattgagtgtttaatgtacaatccttttacgccatttaaacaatggtattgaatctggcttttgttaaagcatctcacgagaatcttgattttagcagaatgttgttactgctgaaatataccttaaaaataaggagaaacagtcacaggaaggaagctgatatccagaaacatgaattaattttaactatgagaaaaatcaatgctgtcatttttattcagcttgttttatttttaccgtgaata

SEQ ID NO: 15107 - DNA, 1691 bp, Homo sapiens
tttgcattctaactttactataaccatgaattattttttttagaggttagagagaaatatattgaaagttataaaatgattgtgttattcttttaggtgaaattgccaaatacatggaaacagtgaaattactagactacactgaaaaacctctttatgaaaatttacgtgacattcttttgcaaggactaaaagctataggaagtaaggatgatggcaaattggacctcagtgttgtggagaatggaggtttgaaagcaaaaacaataacaaaggtgaattttgttattaaattattctttggtcttcttgtgtttataattgcaataaatactaaaagaaagtatagcagtagttcaatgaagaacaataacagattgcatggcaattaaggcaaacattttttgtaatacagaaaatgtgtagagggttgtagaaaaataaatatttatatatttcttatgtttagtagcaagttactaaattcctgaactgattttaacttggaatactgatatctgacagggaaattttgatggtgcactgaattcataatttatatgttcttttctcccaagtcaccacttagggttcatcttgtcttggttgtttcttatttgtggatatggtcagagtatttaccagttgaaaacgggcatttgaaaaattaccatttgaaaatttccttgtttgttggtgtggtgcattttaccatttgaacattattttgctctgtgaagaaatattatataaagctatatatcagcatataaggggattaattgtttggagagaaatgttaaataatgaactttatggtagaagtattatacaagcatgtaaagaacttctggcatcactttagattttacaggtatgcattaacttactgatttgctattgattatttttgataattaacttactgataaacttactgatttcccttataatctgaaattatttaatacaatgtgttagctatttttatatgaggaaggaaaacaacttttagaagaaaaattttttttacattattaaccatttttactgtcattaactttgcaaattctaatagatttatttggaaatctcgtattccaaactgagaaaaagcgttaaaacaaatttttctctctttaaaatcagacgcagcacattgaaaagtttttatcttttcaattaacaaaggagataggaattttgaaattggaccaaaaatttaactttgccaaatagcaggtctctgtaatttcatcatagaatctgaaattatatacatgcatctacatatacttttttttctttgataagttttatcttaattgcatctgctccagttttgtggtcaacaagtgtgctgaaaactgtatctgtttgaaatgaagagggtaaaatggaagcctgagtggaattttttagtaaggtattatagtaaacttactctttgcatacatgcataaacaagcagcatgtttcttattgctcaggatagatttctctgcgttaatatttataggtagcttgtatagtgtttttctctaaaattttggtgattgagaagtaaagatctctgctgctatgtgagaacttgtccagagcaaccacctccctccgcccaacccccatccccctgtccccgcccctaccttcctttgcaaatccctttgttgtttggacttacatgctgg

SEQ ID NO: 15108 - DNA, 1059 bp, Homo sapiens
ttgtatactatgtattattttttagagttaatcatgagtctaacgtattttgtgttttttgtttgtttgttatccatgtcctttctcttgactttatgtttcagagtatatgctcaatctttttttaaagaaagcttctggatggtaaacttgtaaatcttgggaagtccaaaaatgtctgttttttccccagttgaaaactaatgtggctatatagtttttaattgaagacattgctttgttgccttctaacatctaattttcctaatttttgttttttactagatttctattttttccactcttgctttgaagcttcttgcctttctctttgtcctggcattctgcagatatctgtgcacaagtgtgtgtgtgtgtgtgtgtgtgtgtgtgtgtgtgttctagtttgtttttacactttaattagttatctttcttggtacttggcagacctttttcatctaaaggcttaatgcctgtcttagacgcttgaacaatttattttctgtgtatgtgaggctttcctttcctttccttctctattctgtccctccggaactcctaccacatgaatatgggaactctggaagctagcttcttttctccatgtctcctaactcttcgaccacatgttcatttccttaacgctgttttgtatagatctgtgggcttcttcttgcccatttgttacatctgttttgttttttagtcatattttaagggtactagttctttttttaatatgtcagcatattcttgttttattggtaagatagcctcttaaatcctttgagaatagtaattatgagacttttttatattaactgttttggcagagggattgttctttttgagtttaatgcctttctgttttggttctgtgatattgcttagatttttttcaatgtttattatctagtcatgttttttgttgtttgacttattttaatagtgtatacctcagtcaaagttggaatacctattttcctgttagtttaatagaattttcattacagacatctacttccagtgatttcagaaatgagtgaaatttgtggc

SEQ ID NO: 15109 - DNA, 1962 bp, Homo sapiens
tgggactggtgtgtgccaccacacctggctaatttttgtatttttagtagagacggggtttcgccatgtggccagcctggtctcaaactcctgacctcaagtgatccacccacctaggcctcccaaagtgctgggattgtaggcgtgagctactgcgccgggcctctagcaggatatttttagattattcctcaaatttgtctgtctcttttcaagtcattcattcatttcctaactctccatctttttatttcttctccctgtagttatgtttgacctttctctgcattttcttaaaacatatatgtaattaatgtccattcaaatattacagtttttgagagacttagaggaagatatgaaattacctctttattacaagaatagttcaatagttactctacaggtgcacatctgtatatgtgcaaaacactgtgccaaactcattaagggttagataaatgaggaaaaccatagtccttgccctcagggaacatacgtagtagaagagaaatagaggaggttatgaaaatagtttacatgaaatacacaaatgtgtgtactataatataactctggaaaaaaatacattaagaacacagcaactagaaactgctgcttcctactgaaagctcacataggagaccgcatagtgctgtggaaaggaaattgcaataagaataaagagctctgagttctagtcttttcatcaccatcagctgagaaatactgagcacattctctggcttttttccgtccctagcttcagttttttctgtgtatatagtagattttaactaaatctattagtttcataaatattgtggcataataacatgtttgctgtaaccttcatagaagatgtgtcctttttcttttagttactactaatattctattttcagccacttttagggaatgtaataatttaatcaaataaataaaataagattaactgattagtcacatggactgattagtgcagtgtttagaacaaagaactttgttctaaactgtgttctatagcacatatgacatatgtgctatatgaagcattttaaaacttctaggctgtatattttaagtttctaaagtagacatgtagacttttgtcttatgggatggacaaaacccaaataacactgcccgagtacgcatctcttagagacagccatgaatctgattggcttttcttagaagctgttgaaagcatctagaggtgatcttttgatgcttgacttgggaagcaaagaattggtctttggtttttgcttctgaagattttttttctcttttctattaaaacagctttaagtctacagcaggtctccaatcggtgtttagactattagtaaattatcagttcaaatgcatctagcctgtttgtcttcctgtttctaaattggaagtgagaagctgctaattaactaaactttagcatatctgaacacttcaaaaatataatgtgtaatatatatgctggtgccctttgaaatctaagttttgaagatattttagctgtgctgaattaaaagaatactcaagtttattttataagttattttagtatatcatacaatattttggtttcatattaaacgcaaaggcacctgtgagacctgatacagaatgtgacaaaaatcagagattagcatagtcactttgtgaagacatttttctgttcaaaaggaaccaaaatatgcactatctgaagcctaaggatgttgacaaataacaaaatgaagcatttggaaagattcagaaggaagaagctgggagcagattgcttagaattttactcattgccttataaaattgataacatacttaggtactactaaacttgaagggttttattttggttttttaattggtctgtagaccactggccctttctatgcagactacgtacattattagaaaagttgggcaggagttacctggctgaagtgtggattaatg

SEQ ID NO: 15110 - DNA, 1073 bp, Homo sapiens
gtttatggccctcttaaacttttaataaaaagtatgctaaaagagaaacaattattacaagtttttcattattgattcataaatagaattctaccaccaatgttatgtggtacaaacactgatttaataaatggggcaagacatacattttttccatttatcaaatagattatcctctccaccccacccatgttgtacaatgtggagagtatcattggcctgagtggtgatcgtgagtttgtaaaacattttgttttaaaagagtttctgtatgattagtcctgatggttaaaccatagctttgaataatgaagtatataaagcatgaaaagttagaggtggatataacaaatatatctaccatctgggttaactgtctagttgaaagttcttgtactccccctttcttccatccctcatccattcctttaggtaactactatcctgaagttgagaatattcttcctgtgtgttttgacacacccacacctatatacatttatacacacacacagacaaatatgtgatgagtttgtagtttacttgactgtcagatatctctctctctctctttaattttatatgtaagaagcgaaagaaagaaattgaagaaagcaaggaacctggtgttgaagatacggaatggtcaaacacacagacagaggaggccatacagacccgtaagttgaacagttttgcctagctgctttcataggtaaacacaaatttcatttcctcccattagatgaggggtcaactatttgggtcatgaccttttgattttataataaaataccacaagatttttatatagtatgtattgtgtcttttgtacacaggttagattattttctctccacaataattataaagttgagactgggaagcttccttcattttgcagatttggaacccgagacactgaatgattaaatggcagagctgccaggcgtggtgactgatgtgtgcctgtagtctcagctactcaggaggctgaggcaggaggatcacttgagcccaggagtttgagtccagtctgggcaacatagaaaccccatctctaaaataaataa

SEQ ID NO: 15111 - DNA, 1050 bp, Homo sapiens
ccctgccccattttgccagtgtcctattttgaaaagaatagtttttctgtttcaaaaatctacagattttttaagactccaaatgatggctttttctattgccccattcagaagctattagaaattgtatttaatcttaaatttttcaaagtcacaagaggttcaaatactttccatctccctctatttgaccattcttccatagctagctttctctatcacccccagaactgtgatcaggctttgtctttgatgatgttatcttccctactgaaagccacctggcagacaaaatctgggtggaggtaattctgctaaaattacgtttccattttaggagtccatattcacatgggatttttcatacaagtttactttttcagtctttggctagatggctgaggcaacatcaatgaaagtataagagcttcacatgtcttagcaaagcaacagctggatggtctctgatgatttttgttctataccagaagctgatagaaaaggacaagagaggtcattttatccatgttaagattataatgcagtaaaattaatatgttattgtatatgtaactaattgagctttaataaaaataaaactggctttaaaaatcatgtcacaaaactctctaagagatgagtttgatggcttctcctatggaagacaaagcaagaacagccctgctgtgtgttttttgttttgttttgttttgttttttgagatggagtctctgtcgcccaggctggagtgcagtggtgtgatcttttgggtgctaactttcccatgctcctgaattgcacatgtggaatgcaatgttcctggtaggcatctcatacaacccctagagaaggaaaggagaggggccttcaggaacctggtagaagcctgggcagagttggctgacgtcacttggtctggaatgagagaggatttgacattgcacacagtacaggaggcacctcacgtgttaccatgtgattcacttaaggtcttttctcttggactggtctatttccttagagaaggttctatctgttgcccagagggct

SEQ ID NO: 15112 - DNA, 1045 bp, Homo sapiens
aaaaaacccatatcaatgaggttaaaagattcaaaataggcatttttgaattccaattgtataaaagtctctgacgggagaggattttttcattgtttttcctttcttagtgttacataaaatactggtgtgtctcacagtggaatgagccttggtttgaagggaatacagtgatcctgcagaatgaccttctaagtcaccatgtaggccactgtgggaattcctgtggactgtaaacctggaagtggaattgtttgtggcacaggatgtctagtttggctaagtcgtgccatgtcatatcttcaccagcacttggcacaactcatctttctaatttttgtgagtctaatatgtgtacagtgatctttgttttaaatagcatttctctaattgctaatacttttgagtgtctcttcaggtacttgctggttcttttgttttcttcctctgtaagttgcctgttcttttcttttgcccattttcccattaggcctgctttttcttatctatttgcaggagtttcttgcacattctagatgtaatccattgctggcttagatgtttcaaatatgtttttcttttctatcccccagagctctttggaaactgccatgtgccttctgggcactggttaattacaggttctcagtgtgatgtggatatgggaagatttagctttgccaaaagagcaccctgccatgacctggcccctcagtgtgctgcgccttcccctaaagcagttcctgaaggagctgcattttgaaagagtgctcatgccactcaggagacccactttcagctctgcagttgccatgcaccagactggcaagttaaactttgcattgttgtttagaaacagctccctgtgtctgtgccccgggtgtctccatgaagccagctagtattttctgagcacaaagttgcttttaggctccaggcttccacagatgactgggggaagctcagatatggcagaggcactcagactagcacaaagtgtaatgtgaaaggggcaacagggagcagcttgccaggtgctgctcag

SEQ ID NO: 15113 - DNA, 1031 bp, Homo sapiens
taatggatttgctgtaaggtagaaagcttgaagagttcagggtgagtccaggggtggactggaccactggcagagtggtctctgtgggcagatggggggaaagggagagagcccaggcacttgaggacgtaatgagccgctgagcctctgaccttctttcctatgggcagacgctggctagctcctcaccaagcccctttccctttctcctgggtgtgccgccagactgtttcccagtctctttttgtggttaggtgcagacctgtgaatgggttctagaccataaattgtaggtggaggtgatgggcacttcttccccatccacagcccccagcccatcctctgtgctttttgcctttctgcatgtttgatgtagtttccatggcgacattgggagccacatattgaagataggggactcacaagatggaaggagcctgggtctctcaatcacgccttggagaagggacacctgctaatcagaaccctgcactgggcttcacatgagtgagaaataaagctcgattgtgtttggagctcagtatttaatcatctgtgagtttgtttttgcttgctgctagggatccttgaacgaatacaatgtgcctggagtttaccccaattctagtcttgtagttttagcaaggaaaacatttcctttaagagaaaggcagctcaaggcagagctttggtttatggcagccctgctatggtctcaatgtttgtgccccccccaaattaatgtgaaacctaatgccccacgtaatgacaactggaggtggggcctttgggaggtgattgggtcatgatggtgactaggccatgaggcctcatgaatgggattaatgcccttataaaagatttccaagggagcttgtttgtctcttctgtcgtgtgaggttacagtagaaagatggctgtcgacgaaccaggaagcaggccctcaccaggcactgaatctgctggcacccttatcctggacttcccagcctccagaagtgtgagagataaatttcttttgtttttaagcc

SEQ ID NO: 15114 - DNA, 1158 bp, Homo sapiens
cccagttaaaaaaaaaaaattacccaagtgtagtggtgcatgccccgtagtctcagctgctcaggaagctgaggtgggaggattgcttgagcgcaggaggtcgaggctgcagtgacccatgtccacaccactgcacttcagcctgggtaacaaagtgagaccatgtatcaaaataagtaaataaataggtcgggcacggtggctcatgcctctaatcccagcactttgggagggcgaggtgggtggatcacctgaggtcaggagttcgagaccagcccggtcaatatagtgaaaccctgtcgctattaaaaatacaaaaattagccaggcgtggtggcacatacctgtaatcccagctacttgggaggctgaggcaggagaattgagcctgggaggtggaggttgcagtgagccaagatcacgccattgcactccagcctgggtgacagggcgagactccatctaaaaaaaataaaataaataaataaaataaataaataaataaatagaaagaatagcagtgaaacttgtcctatctactcccgtgcctcagccattcctcctctacctaaagacaaccaatgtcaccagctgcctctgtgtcctatcggagacatttcacaaatattcaattgactgtatatatatccccttctgcccaatggcagtattctgtgcattctgttctgtgtaataatttcttcatttcataatatattttgaaattatttcatattgatacattctcttttgaaacatatcagtgctttctctttgtgattaaaatgtattctatgatagatgtgacataattaataacttcccattgatagacatttaggctgtttctaatcttttgtcattgaacagtgggcatttaatggaaaagtgaccttattttgttgtcccaggctggggcagcttggatatgctgtttatatctaaggtagagacaggaaaactcacttaatattccattcaccttcccacatttctcagcttccttgcaggtaggttgggtcctgtggtcagttctagcccatggacttgagaaggaatgatgtctgagacttctgggcaggggtagtggaaagcccatgtgagattctctaatctctcttcttctaccattgcaactaaagaggcagaatctcacag

SEQ ID NO: 15115 - DNA, 1082 bp, Homo sapiens
gccagattgaaatccatacggcctgacattaattgagtgctgccacatcaacgtattcaagtttcataaaccactgaagagtgagtttttactggcttgaattagaaatattccaaccctcttatgctaaaatggtattgtttatgtagcgattctttaagccatcattaagtggtataactcttaataaaatgcatttaaacagaccatatgcagagtatggctgtgtttttaagaaattgcattttttttttcactaaatagatgattacatcttttttcttgtggggagtgattcttttgtacaatatatttcagtaaatactgcttttcttttgcaaagagatgagacagatgcaagattactgtcaatttttcctgtcttctctccacccctccttcttttctggggggtgggaggagaccaagtggggaccgtttcaatatttgtcctgggagagagggtggtagtgggcaaacctgtggtcaattgcctgcaaggagtcactgtggtacttggttttattttaatgaagccagaatcaatatgctcaattccagtgagaattataaacagtgtgtcgttcagaattcctgagttatgaccgagatgttctctcctataggtgggcctcatgagagatgtggagtcctcatcacggggttgcctggtgattatggaataagcagcggacttacagacactcagcgtccaggcgcaccaggccaccacatcccagacatgagtacctgtgcaaaatgcattcattcctccatcttggacgagtttactgagcacctgtgatgtgccaggcactaggggtgctgcagcggaagagctaagcattgagggtttgtttgtttgttttttgttttttgagacagagtttcgctcttgttgcccaggctggagtgcaatggcgcgatctcggctcactgcaaccgctgcctcccaggtacaagcgattctcctgtctcagcctcctaagcagctcgaattaacaggcatgcgccaccacgccccgctaatgtttttgtatgtagtagagacggggtttcaccatgttggtcaggctgatcac

SEQ ID NO: 15116 - DNA, 1041 bp, Homo sapiens
ccactgagcggctacagcagagacgtggcatggagagtgtttgccttggccaaggatgaagatatttctccctagggtggtggatcgtgggctttaacttcagaaggacctgatttctagctttccctgtagcactgatgaatcagttaactgttccgagtcttcacgtggccatcttcagaataaagacactgatgacactgatgcagtaaagttcttggtatatttgcagatgtttgatacacactggccccccaagagtgtgctgtggcgaaggcgatgtgtaaactgacatttttcattcgctttcccattcattccattgtcccaagagcctgcggtttaggcagggtgtgtttttattcccattttagagatgagggaagtgaggcccagcaggggccgctggtttactgaagccttgaccctcagccttattttcatgacatcgcgaggccaccatggtggcttttgccaggctctgcagcctacattgattctgatagaacgtgggctcctgagggaacccatcaacccttgcctcatagctgtgacaggttttaggaggcctgccttctggaaagttccaagtagagagagaagcaggacccaaacgagagatgctgaactgaacaaaactgcatgtgaggcagcgttaaaggcagaggctttgggctcagacggacggggtgtgggtcctgtacccacttcctggactgttaacaggtcttctgagcctcagtggccttgtcagtaccgcggggacagcaggacgtaccctgttgggctgttgagagtctaaacaagctcacactctgcaaaggggacacaagaagcagctgaaatggcccctgttgttcctgttctgtttctttgcaaagagtagctcagaggaccagacactgggagtcccttcctcagggaggtccctttcatccacactaggtcacctcccacctcccttctccctcgtcaccctgttcatttccttcagagcattcatcacaatccgcattttccttgattgtatacttattcact

SEQ ID NO: 15117 - DNA, 1050 bp, Homo sapiens
aactgccttctgaatgccattatgacttgactcagctgggaaccacgagaggacgagatgacatctcttcaggatggtgtagagacgtgggcggagtgtgcagggctggcgtgcaaggggtggggacacgttgcatccatggtgctgtttgtgcaggtaagatgcacaggtgacaaggaggaggctgttttaaagccaaggcaggcaccagtgcctggataggactttttggtccttggaacgggttcccccagatcttcgtctgtgtcttggagagaggtcctctagttccgcctagccctggctgccccagccactgggatggaactcttttcaaccacgtggaagaaaacctgcccccagatcttgctggcgttgctgccgtgtgcgactgcagagagggcctggttcttagcagaccttgaagtgtcccgcaaagattggaaagtcccacatttgggttcatgtttctaacaggtactggtctaacaggaggagttaaaagatgggccctagctttcctgagcaaggcaggtgaagagcacaagatcgtgggaagggtgaggctggcctgaggcttatttcccacccatcagagaggccagcagctccatggccccttctcccccggaggggctcagttgcagggagtctctgagctgtgcccctgagcccttcgcgaagtcctagccggaaaccaggttcccacagcctcgggtccctggggctccgggtcagcctgagctgggttcagtcccactctcttcctgccatgagatcttgggtggctccctttctttgagcctcaacttctccatctgtgaaattgagacaaataacatgacccactgtattagtttcccaggcctgccataacacaaggctgcaaaagagcagcttaaacagcagaaacgtcctgcttcccagggctgcaggctggaagcctgcgtcagggtgtgggcagggctgtgctccctctgaaggcattggggaggctccgttccaggtctccctctgagcttctcgtagctccttggcttgtggctgcag

SEQ ID NO: 15118 - DNA, 1066 bp, Homo sapiens
ctgaaaaacaagttcactgattcagaccccacagggttttggttgggattaaaaatgtgggtgatcacctggcatttggctggtattcagctgatgaaagacccttcactatcctccctttaccccaccacaattgttcagcgagtcctgcatctccagtttggtttggaggtagcaggtgctcctggggcattcctgaatcccagccccctggacttgcctcttttggacctctccttccttgggggatctgagacacacctttgaggacaggggcagtgatttgcacatctgccgtcaatgtatttgatggcctagttccactcaccgcttccaaaactgtgttttattcttctcctaaattactaataacatgagaattgaagaatctagatgtttaaaatctgttaaaaactaaaaacctaggagcaaccaagatgtctttcgataagtgagtgaataaacaaacgtggtacagctatacaatggaatattatttagagataagaaatggactgtcagcttacaaaaggacatggagaaacttccagtccacattgctgaatgaaagaagccagtttgaaaaggctagctagtgtatgattccaaccatataacattctgaaaaaggcaaaattatggagatggtagaaagatgggtggtggctaagaattgggaggaagtgcagagggatgaaaaggtggagttcaggggcttttgagggcagtgaagctattctgtacaccactgtaatgctggatacatgccatttgccaaaatccatggaatgtatgacacagatggttaaccccaatctaaagtaaggactttcattattaataaggtgtcagtactggttgatcagttgcaacaagtgcaatggcaacactcatgcaaaatgttgacagtgggggaagctgtgaatgtgagggcaaggggaatacacaagaagcctctgtattttacactcacattttctgcaaacataaaactgctctagaaaatagtctaaataaaataaaataaaataaataaagttgattcctttgaagagcacaaatctca

SEQ ID NO: 15119 - DNA, 1918 bp, Homo sapiens
aaaatgtgttatatacatagagtgggatattattcagaaatattatttctttccttgaaaaggaaggaaattctgacacatgctgtgacatgaatgaagcttggagacatacgagaaaaataatctagacacaaaaggacagatactgtatgattccttatatgaggttcctagagcagccaaacttgtagagacagaaagtagaacagtgattgccagggtaggggagagggaatacagagttgttgtttaatgggtacagagtttcagttttgcaagatgaaaaagttctgaagattggccgggcatggtggctcatgcctgtaatcccagcacgttgggaggccgaggcaggtggatcactgtaggtcaggagtttgagaccagcctagccatgatggtgaaaccccaactctactaaaaatacaaaaaattagccgggcatggtagtacacatctgtagtccgagctacttgggaggctgaggcaggagaatcttttgaaccagggaggtagaagttgcagtgagctgagattgtgctactgtactccagcctgggcaacagagtgagactccatctcaaaaaaaacaaaaaacaaaaaactcaaaaaccaaacaaacaaaaagctctggatatggagagtattgatggttgtacagtactgtgaatgtacttaatgccactgaactatacacttaaaaatggttaaagtggtacattttgtgttatgtatattttactacaattagtaagaaagaagtgttaactatttatgagattgttaatcaggtccttagaaagagcacattaaggtatcatgggagcaggaagcagccccagggtttgagcttgtcttctgcccttctgccataggatgacccttgctggatgccagtgacatgctcttggacttcccaggctccagaatcataagccaaataaacctcttttctttataaattcctcggtgtgtggtattctgtttttgcagaaaatggcctaacaccctcccagggctggggacaaaggaagcaggtagaattgctagaacttagaaagcacagcagagcctgtggagcttgaacccagacctctgaggagcgggcactgcttggctggttctggtgtctctgagatgagaagggtgaccaaccattctggtttgccttgggatggagggaattcctagggtatggaactttcagcactaaaacttggtctccctagcgtggtgcacaggaaagctggtctgataggtactgaaaacattcaaactagattcagttccggctgcaggaaggaactgctgctgctggagtgaagaagcaaaacaggaaggacagaagaacaggaagtgcaagttcattttttctgcaagcctaccagggagcagcagagaaaacaaaaatgcagcttccagagcctaacccagtgtctcagagcagagagctctgaagggtagggtttgaataagagatgatatcttggtgtgtctgtcacttcactgattacttcaatccccactgatactttctaaagtcagggtgattcatctttgcttacaattatttgctaatttcttgtatcatgttttttggtactggtttccctgtgacacccacctggactccacccttcctgaggataggcagagactagcctaatttattttttagcccaataataaaaatgcaaattacctatcatgtgcttggtactgtgatgaggttttaatacttatgccatgtaattcttgccacactctgtccccttttcgcagttgaggacattgcagctcagagacattaagtaatagctcaaggtcactgctgtgatttgaatgtctccgccaaaactcatgttaatatgaattgccattataatggtattaggaggtgaggcctttaagaggtgat

SEQ ID NO: 15120 - DNA, 1050 bp, Homo sapiens
gggagggaatcccagaagtgcagggaagaccagcggattattcaacgtcagccagcacatcagtaatgggcaagcactttgatttcctggttcccagccaggacttgatctactagtccttccttctgtaagggccagagagtaaacaccaggctttgcggcagggccacgtcttgacttttgtgggtccttggcacttttaccttcttgagtccctttcttggtaagaaaatataaaaaatattacaacatattatacaatttttacaatattttgtctatttacaataaagacaaagatagcctaggttggatttcttattattatattcatgtttttcttcctattttaaagtaaattagaattaaaacatttttgtgagcccctaaaagtaactgaggcctgaggcactgtgtctggtgggcccagtggagtgctaggccctgcttgtctggcaacctgctctccccttttcctacccatctctgccgctatatggcaacagctgtcctggatggtataggaatgaacatgtggactgtgttcccgtcagaccttattgatggacacagcaataggaatttcctataattttcaggggtcacaaaggcttcttctgagttcttttccacccatgtacaaatcattctttgctcaaggaccttggaactatgccatgtaggtttcctgggcaaagcctcccctgacgttggacttggtaacatgagaaacaagttctaggcatatctgctgagaaataatattttatttttcctttatccattagggatggccccattttgagggagctgtccctttgcccaccaagtgctaatgacacagagaattgtgctgtctcccaggcctggggctgaggaggctgaaagcaacgaacagcacccccatcctctccagcgtttttctccacctctggtagaaaattgtaagggaagttctgtctttgtcatcctcatttcaatgcatatgaataggcaagcgcttcaggtaaaggaaaggacactctctctgcgccttctcccctggcactt

SEQ ID NO: 15121 - DNA, 1048 bp, Homo sapiens
gacccttgaagcagcaaagcagatcttctaacatatgttgcctggaacctgccctgcctctggtcctccacggttaggggctaatcaatcatctcattgttgaagccagtttgaatttgaacttgctgttacttgtagctgagattatcctaacccatggcagggatggcaaacattttttgaagcagtgtccaaaactgagcaaaggatgtcaaactatattaataaatgagatcattacaggtagccagtgccagacaagttgattgggctcaaaagccaagaggcaagttggaaaaggggggaagcacaggctgtggattccagaagacctagattcaaggtcctagctttacctcttgccagctctgtgacccttggcaagttacataccctctctgagccctctctggtttttcatggagtcctaatgcctactttgcccagttgctgaaactcttcacgtaagtgctggtccacagaccacctttagtggctggtaggtaacttgttcttagcttaatggacttgctcagggaagaaagcttctatttctccaatgtgtcaagtctttgggcccaattacctcgtagatcacctcccctcacctgtgcagacaacctcatggaggtggttttagatctgatatcccattttaacatagcaaccaggtcagactctctattattcatattctgcagtaatgggctcattaagcattactgtgtgactccatagaatctgcaacgaaaccaaagaccacttctccagtggttattttcttccccgatatgcttacactttttggaggtaatgccaacacatccagcgaggtactcaaatcctctttggagggagacaagatataaattattagtaagtaaataaataaatcatcatttgattctgtcagtttaggaggaaaaaaaatcagtcaacctgaagtttgctgtcacgcagaccccttgatggactgaattatgaacttttttggggaagaggggaaggaggagaagcatcagcattatgctgctgtctggaagttttg

SEQ ID NO: 15122 - DNA, 1035 bp, Homo sapiens
tgagttatgcacacactcagatatccaaacagatgcatgaatgaatgggatacccccatccatctggcacatcataataaatgaattagataagaacagctggaaaaatattgagatcctttgccaatgacaccggcaaattctagttctatctccgagtcagatctgccccccacccccagtctgtccaaaagggtaataacgttggataataacttacattgtgcagggccctatggcttcagagtttacaaaaccctcttattgaaatcatcatcttgcagatcctttaaagctcagtggcatcaccttcccacctcagaggctgaatttctccagctgggctaaattgcttatatgatcctacatgttcctcactctctctggtctccagattgctatacatgctggtacctccagccctgtgcccttgtttccctttgtgcctgctcacccctcagatcttggcttcatcattgcttcctccaagaagccttccctgactccacgtctgggtcccctgtccctctgtgctcactaagcctctcagagcctcttccccaccatcgactattctacctccatcttttccaccagactgtgtgcttctgaagccaggatctgtcttacatatggcacagagcaggtgtcttcaaataagacattacaagaatgtggaatggcagaaccccataaggtggatatggtgtacctccttggacacgtgaagaaagcgacactcaggggcactgagctgacgcccaagagcacggctctctctcagatgccctgtgttagatgctgctaagatgcgatcttcccaaagtagctttgattcctttaagcttctgctggcctggagagcatgtgccaagttgaaatgagcattaaaagaatgttgtgggctgagcagatcatgggaacaactgctatacaaatactgtcaaatggggcatgtatttaaaaggttagacaaaatacccccttggctttttcctttggttgtctttttatagtccactgcaaaacaataac

SEQ ID NO: 15123 - DNA, 1049 bp, Homo sapiens
cctgcaccacatccaccttcccgaggaacacagggatggggctgggcgaggtccagctggctcagctccttcatttaccaatgtgtgaactaacctcattctccaggacattatgatggtgcccagtgctgtggcactgggtatttgccggagctcatccagggaagctcttttgcatactgcctgacacatggttggtgctcagtgtaacctcatcttttttgcctccatagctgttgctgctattctaggctctgcttctatcatcatagagctgtgacacttgggaaagggcccttcacctttctgagcctcagtttccccatgtgattgccaagggcacctttaggatggccattcaatgactcccccacctggtttcacctcttctgcctggaccacaggcaaagggacaagcagcagcattgggacatctggggaaatgtcttcaatatataatatggaactttcgggggtctggcttcaagttcataacattggaggattaaaaggaaaatggtaatgaaatggtgatattagggaagctcactgggctgtagagatgggacaggatgccgtgtgaggagcagcctgcacaggcaggggctggggcaattgaatgggcccaggagtgagatgtccacaggtttgactcctggcttgaccgcacactaccatagacctcacccaagcaatttgacctcaatttttctcatctgtaaaatggagagataacagtatctaccttatactatgggtaaggattaagtgagataatacaatgacaatgaaatgcccagttagtggtgaacactgggtctgtgctagcacttattattgttattgatcacccatggctcctactctatagctgggaggaggcaagatctttgtccctggtgcggcccagatttaacccctacctcctttccttccccaaagacatgtgcttagctctgtaggtgctggggctatatctactgaatacactgaataagaaaacccagggctgccctcaaggggctgtctgtctccctgcagagtcagcc

SEQ ID NO: 15124 - DNA, 1032 bp, Homo sapiens
cccattcagaatcatttcccaaaggcctcacttcttcataccgccaccttgggaattaggtctcaagctatgaattaggacataaacattcagaccatagcagaaagaaaaggaagcatgggcagtgctgagatggattccacaggactgtgctagaaggaaaaggaagcatgggcagtgctgctgagatggattccgcgggactgtgtttagttgtgctctttctttttccacggcaaagcttgctgtttagggagttaatttcagattggaatatgagaagaaaatttatttatgtgactcttttcctttttggcattttctttgtttacatgactttttttttaagaaagttaaattttaaataatttatgaagctagagtttgggggatttatatgtataaaatttccttcaagcttctagagtatcggagtatttgtgaatgataaaaagaaaggtaggggaatgaggaagaccagtttattacgaaggccaaaatttattgtatctatttctgtgtgacctttgataacaaaaatcaagaacttttgtttcccttttaggtgacaggagcctgttgcctctttctggctgggaaagtagaagaaacaccaaaaaaatgtaaagatatcatcaaaacagctcgtagtttattaaatgatgtacaatttggccagtttggagatgacccaaaggtaagaatgataataacttcctgccttctggtcttgattccttatggtagtattgtacagttccacatgttgacagtgcctgtagcccttgtgtctgccagtctcttgagttcctaagagggccttctgtagaagttacttgatgcttttgtaagaaaggagggaagatcgtgtagcctacacttactcagtgcttccttatgtgcccagcagtattctaagtactttggggcagtggcacatttcatggatatgagcaaaaatcctcttaattgccattaggactctgcttcttaagtgcagtggtgatggcagggttacaactccagctagct

SEQ ID NO: 15125 - DNA, 1030 bp, Homo sapiens
ttttatgttcacagcaaaaatgagtggaaagtacagagatttcccatataccccccacccaacacatgcacagcttcccccattttcagcatccccccgaccaaagtggtacatttgctatgactgatgagcctgcattgacacatcacccagagtccaaactttacattagggttcattctcagtgttgtacattctgtgggtttggacatacgtatagtaacatgtagccaccattatagtatcatgtagtctattttcatagccttaaaaattctctgtgctccacctgtttgtctccttctccccgctaacctctggcaaccactgatatttttactgtctctatagtttcaccatttccagaatgtcatcgaattggaatcatataggatgtagctttttcagattggtctctttcacttagtggtgtgcatttagatagtagtatccattagatgatttttatcaaattatcacacacataactccctccccttctcagctgtaagatgcatgaaagcaaagactatctgttttgtctaatgcctcattcagtggcaggacagagtaggcattcagcaagtactcgtggaataaatgtcaaactaatggtctgaggaaatttctaaatcacagttaaagctaaagcgatgaagttcagccccattcatggtgttgtttttcctaactagcttgtattgtctcacaatagttatctttttctctgccaagcattatgtatgtatatacaaaatgtatagtcattctcctcattgctttgaggagttaacaagggcccagaacacttttatacatattgtggttgtgattaacactagtattttctaagtattgccaatgtgggtaactcttttgaacttaattataaatccattaatctgtttataaacatttgaacctattaggaactcatattaactataaccaaaaatgcagttttatagaaataatttcaccatcagataatgttttcaatgtgcatgggtatttgatttttactgagtag

SEQ ID NO: 15126 - DNA, 1431 bp, Homo sapiens
aattatggctgtaggagaactgttgctgcaattttatttttagagactatttacccccatcacagcagcaggagtcctctcccaagcaccaagccacagcagatgcgggggggcagtagggggtggtgtgctgcccggacagcaccagcccggcccagcccagctgcccttgcaggcaaggcctctttgaaacacacttgggttgaggtgctgtcacatgtctagaacccaaagttagttcatgtcaatattggaaataaacagaaggagtgagcaaaattggaacaattacaaaacagaaagttagaaatgttttgtcacagggtcagtccacctatcatactgaactctttgaaggcacagaccctattgactcatttgtctttctttgttacttggttcttagttccagtagttcctggttcttagaaccatgttctcggttcttagttccattcattaaactgctgtgaaatcttccagttatgatagagctactttttttttttttccagtatatttgagggaatgatgagttcagtacaggtgaattttttttttttttttgagacagagtttcactcttgttgcccaggctggagtgcagcggtgcaatcttaactcaccacaacctccgcctcctgggttcaagcaattctcctgcctcagcctcccgagtagctgggattacaggcatgcaccaccaggcctggctaattttgtatttttagtagagacagggtttctccatgttggtcaggcaggtgtcaaactcccgacctcaggtgatctgctcgccccagcctcccaaagtgctgcgattacaggcatgagccaccgtgcccagcctacaggtgaattttttaattagcttcaaattgaccgacattaaatgttagacacaagaacgggctacactccatgccacatgaaatgcaattgagttgacgtgcaggtctgtcagaggcaggaaacaaactatatatgaccttgaaggaagagttgcatttgagcagcgagagcagagggggaggatggagcaataagttggaagtacgcaagtgagcaaaggaattgagaatcaggggaaatggagaggagtctttctggaatgtgatgaattgaaaggcaatagcttctgataggatctaaaatgtgggttaggaccagatcacagagtttacctggaggactgtgagtttggcagaggcaagggaagccattggagatttagcaggggaatggcagagtctaaattcatttgagaaggagtcccctggcagcagtaaatagggcaagtggttaggaatggggagaatcttgctggcactcatgggaaacatggtggcctcagcatgctggctgcggggcaggaagggcagatccggaggaagctttatagaggaactcagctgcactgtgccatgccga

SEQ ID NO: 15127 - DNA, 1058 bp, Homo sapiens
tcctagtaattggccgggcacggtggctcatgcctgtaatcccagcactttgggaggccgaggtgggcggatcatgaggtcaggagatcgagaccatcctggctaacacggtgaaaccccgtctctactaaaaataccaaaaattagccgggcgtggtggcgggcgcctgtagtcccagctactcgggaggctgaggcaggagaatggcgtgaacccgggaggcagagcttgcagtgagccaagatcgtgccactgcactccagcctgggccacagagcgagactccgtctcaaaaaaaaaaaaaagaaattctcctagtaatcattttagactcttctacccactgccccatatctcagttggctcagtggattctgcaccccaaacgtctcatcatccatcccttcctccctggctcgggccctcatcagttctcatctaggctagggttgggtttggttttggcagcagacctaaagcagtcttcctaactctagtcttccatccgttcctttaaacaagcactcaagtactcacagcgtccattattacactgttttaggggttccagcgaaatgcgaggatgacatggtccttagccttaggaagcctaatttgtttctcaggagctaaacatccagtgttattttcacactcacttcatgacaacagtgataggttgttctaagaagtgtaaggaacaatggtagggtattgcagcactggggggcatgtatcagggcgggcttcctaagagaggcatccgtgagagcgtctttctagtctgctcactgcaggcgggtaggtgggagtggggagagccattcgggccagggaagcgtctaagaagccctgggtgggaaagaacctttagagaactgaaagaaggttgcctgtggtgaaagggaaaggagtagcgtggcttgcagtaggactgggagcgtgttttggggacatggtaaggagtttggtcttcttcctaggagcagtgggaatacaggggagaattttgaggcaagggagcgacttgttcacattttttgttttaaaagatcac

SEQ ID NO: 15128 - DNA, 1070 bp, Homo sapiens
tgctacagagccaggctgtaccagagtccaggcccatgaaaacaaagttcagggagactctgttgactttgctaaattcatgggttccttccttccttcatttctttgttcaacaggaatttatgtatctgccataagaagacctgtgcttggcttgtgaaaagtagcagtgacacttcacatgagtgtaacatctgcggtttatggttttgttgcagtgtttcatttcgtcctcgcaaccattcagtggaccagctggtgttggcccttttcatagatgaggaaactgagggctaaatagcttctccacatctgcagattccaatcctcgtggcttttcctgttctgcggctttcataggccctctgcattatttgttaagactcagctattttctaaccccaacccacttgaagcagtggctttttcagatacccgggacaaatcacgtgaccttgtggctcagttttctatgccataaagtgggattccttcctaatccttgcaactcttaagtgaaataatctatgtgactgctttgtgaattgtgaaactcaatctggtgactatagttaataataacatattacatgtttcaaaattgctaaaggagtggatcttaaatgttctcagcacaaaaaaatgatacatatgtgatgtgatgggtatgttaattagcttgatgtaatcatccacatacatatacatgtatcaaagcattgcattgtaccccctaaatatatacaattattgtcagttaaagaaaaaactctgatcacatggtaaagtatttctgattcttcttcctcttttcctacatccagatatgtctgtctgggatcccatatggtggttctccccgtctcttatgatgttcacctcatacacggttgacccttgaacaacgcaggggttagggggtgctgagccctagcacagttaaaaattcatgtataataggggttttttttttgtttttttgggtttttgttttttgaaacagggtctcgctctatcacccaggctagagtgcagtggttgatcacagctcactgcagccttgactcact

SEQ ID NO: 15129 - DNA, 1023 bp, Homo sapiens
catttcatagatgtttgagagttagagttctttcttgttatgattctagtcatgtatgtgttacccaacaatatttcattttatattaaaattacagatgcttgttagctcttttgttttgaatatttctgttcgctattcttatacagcagtcttccgttattcagttttgctttctgcagtttcagttacccacagtcagctgcagtctgaggatattaaatggaaaatttcagaaataagcaatttctaagttttaaattgtatgccattctgagtggcaggatgaaaccttgtgccgtctgctttcatccctttgtcccatgcacccacactgtagacgcccctacccatgagtcacttaataggagtctccgttatcaaatgactatcatggtatcacagttcttgtattcaaggaacccttattttaccagtagtggcctcaaagctcaagagtagtgatgctggcatattgttataattgttctattttattattagttatttattattacttaatctcttacagtgtctaatttatgaattaaacatcatcataggtcaccataggtatatatatacacttgacccttgaacaatataggggttacgggtgctaatccccacacagttgaaaatctacttttgattccccagaagttaactacaaatagcctgctgttgaccagaagccttaccagtaacataaacagttgataaacacatattttgtatgttatatgtattatatgctgtattcttcaaataagctggagaaaagaaaatgttattaaggaaatcataaggaagagaaaatgtatttactattctgttagtggaagcgggtcatcataacggtcttcatcctcgtcgtcttcacgttgagtaggctgaggaggaggaggaagaggaaagcattggtcttgctgtctcaggagtgacaagcagaaaaaaatccacatagaagtggatccacgcaattcaaaccagtgttgttcaactgtctaggaaaaaacacag

SEQ ID NO: 15130 - DNA, 1030 bp, Homo sapiens
catgcatttgtaactcacttatgctggttaatgtgaaccagacatggtctcattggtgaatcatcgaaagcaactgtgtttctttccattatttgtggtgagtttcgttttggcaaacactaagcaatggagaagatggtccatggagctggctcctcagcagtgaccccagggctggaaaaacttcaagaactgggcaggcagtccaaggccttggagtctgcagaaatacatgctcatttggctcttattccagtcacctgtgtgacctcctggggcctcagtttcatcaccctctggacaagtaggttggatgagatgccctttgaagacttgctagctctgttatctgtgactctgtgactatcctgaacccaacaaacagccaaaatcatctttcctgcctcccttacaaatggaaattccagcccaggagcgcttggaggcatgggtcgtcagcctggctgagtgtcctgcacccacacacatcagatgtcatgaaatcactgactctggcaaggaaactttccaaatcctaggactggtgacctccagaaataagtcattcgggggagccacatgtccaaatgttaattttctttttatcagaagaatggaaaacatgaattcatgtacttttaaggaataaagcctttgttcagaaaatgcaaaacgtgccaaatagactgtggtttcaaattatgtttcgttaaggaagaggggaggggaggcgagggggagggtactgaagaagggcagaaaaggcctttctcgggatctactttgtgtggacatcggcatctcatctgagcctcagcagcacctgccagatgggctttaggattcccacctgccagaggaggaatggaggtcagagaggtgtgagctggaggattaacacaaggagcctctgactccccaagcatcccagggtctgtcagacaaagaccaatgcccactcaggtggaagcagggcacaggataggatgtgagtggtcccaatctgtcgtctctcagctcctcctgcagc

SEQ ID NO: 15131 - DNA, 1085 bp, Homo sapiens
agtgtgtgcctctccttgggtaataaaggagagacatgccattttatagctctaaaggtgtgtttcctatggaacttaaagagacagtggaccttacaagagcttggttttggcagccgcctacacccttctccagtccttttcccatgtatttgtcctgggcctcttctttaaaaggttccagcactctcaaccattctctgggtcctgcctgctgctctgctgcttttgtggagctgtgtttattgcacttatcttctcttctcccttctctctcaaagaattcttaaataagaaaagatctgttgctaaatcatgcaagttgatctcagtctagctgcttccttttcctctttaccttgctaacttcttagccttcaaatcttatttgaaacatcacttcctcagggaggcagcctttgacccttagcctagctgagggccctttcctgttaattacctttgtgatatcccatatttcctcttctgtaactgtttatatgtatgtaattacttaaaatttccctgatctactgaaggctttataaaggcagagattatgcttgttttgatctctgctagaaccccagaaccccaagcactggtacttggcacttggtagatgtttaataaaacattgacactgccacctgtacctaagatggatagttgatcgtggcattcatcccagtttggcatggatccttctaaggacagcatttcaggtggccacccccaaatcgtagaagctagcatccaagcaaaagctattttattatgtgcttaatgacttaatgcattactgaggtgtcagtgatttagtctgttgtgtccttactgctgccataagacatgatttgtttggtgatgtgtggatgggtatttttttctgtgatttctttgtaaggacgttatccactgtaacccttagtatcccagatgtttctcaaacttgaatatgtgtaggaatcactggagggatgtgtatgtatgtatgtgtctttccaaaatggagaccccagccccatccccaaggatgaatgaatgcttttctttcttttttaaattaatagactttgtatttt

SEQ ID NO: 15132 - DNA, 1065 bp, Homo sapiens
atagccaagaagaatagcatggggcatatgagatggcagtgtcagaaaagaggtatgaacgacataatttttatttattattattattacatttgagatgggcctaggggaactggcaggattttgactgggcttatcttctgttttggttcttcacctttgtacttccttgaactggtctttcttccagttggcttttcagatgcttgaagacaatggacttcagtaagtcttgccttttcttggttaaaagtccttggtcttggccaggcgtggtggctcatgcctgtaatctcagcactttgggaggctcaggtgggcggatcacctgaggtcgggagttcgtgaccagcatgaccaacatggagaaaccccgtctctacttaaaatacaagattagctgggtgtggtggtgcatgcctgtaatcccagctacttgggaggctgaggcagaagaatcgcttgaacccaggaggtggaggttgcggtgagccaagattgcgccattgcactctggcctgggcaacaagagcgaagctccatctcagaaagaaaaaaaaaaaaaagtcccttgtcttttagccattcattactaattagtggcccttctgtggaccttcctttcactgagctctggcctgctgaagtcctttagcaatttagatctctaacttcggcttgaatacagaaagatgttcgacctagcacacaaatgaaaccctgaatacaaaatggaaacatactaaaccttggagcctctttgctgatagatcaaaatcaaatgtattggctgggcacgatggctcatgcctgtaatcccagcactttgggaggccaaggcgagcggatcacctgaagtcaggagttcaagaccagcctgaccaacatggctaaaccctgtccctactaaaaatataaaaattagccagacgtggtggcatgtgcctgtagtcccagctactcgggagggtgaggcatgagaatcgcttgaacctgggaggtggaggttgtggtgagctgaaattgcaccaccgtactccagcctgggtgacagagtggactctg

SEQ ID NO: 15133 - DNA, 1050 bp, Homo sapiens
ttgtatcattaaggaaaaatcaaacagtaagcaacagactgaatcagatagtgtcccaattagaggagcagcgctaggaagggaaccagctggtgccttcacaagatcagagtgatatgcttcagagtgtccaaggctatgggtgatgaggcagcatgactgtgaagtgcacatatggtaataattgcacaaatatttattgagttcactgtgcagatttctggactatgaattgaagacatggttttctacacatgtagcctagttccaaggagatagagcataagtacgtgcaattcagcatgtctacaactggacttactacccctacatttatgagcaattgttttttgacaagagtgccagacaattcaatgggggaaaatagccttttcaacaaatactgggacaaagtacccacatacaaaagaatgaaattggaccctacctcacaccatatacaaaattcaacttaaagtagattgtaaacttcagtgggaagactaaaactttagaactcttatgggagaaaatacaagagtaaatctgtgtgaccttatgttagacaatggtttcttagaaatagcaccaaaagcacaaatgaccaataaataaataaattggattttatcaaaattaaaaatgtttctgctgaaaatggtaccgtcaataaagtgacaagacaatcctgataatgggagaaaatatttgcaaatcatatatctgataagagatttatatctagaatatataaagaactcttatattttgctatggtctaaaagtttgtgtgctcccaaaattcatatgttgaaatactaccccccgccaagattatattattaagaggtggggcctttggaatatgattaggtcatgagggttgaactctcatatatgggattagtgtccttataaaagaggttagaggccgggcatggtggctcatgcctgtaatcctagcactttgggaggccaaggcaggtggatcaactgaggtcaggagtttgagaccagcctggccaacatggcaaaaccctgtctctatta

SEQ ID NO: 15134 - DNA, 1023 bp, Homo sapiens
tatttcactggatggtagtcgataagttctttgaggttctcttcacctttctttattcttttttcgttttatccctctgactcagtaatttcaaatgtcttgactttgagttcggtggttctgtcctctgcctagttaagtgcttttgaacccctctagttaatttttcaattggctcttcatagtttttctttgttgatattctcattttgtttatgcattgttttcctgatttctttagttttctatctgtgttgtcttttagttcattgagcatccttacagtggctattttgaattctttggtaattcatataaatctatttagggttagtttctggagatttaacttgtggttttgattgggccatgtttccctgtttctttgtataccttattatcttttgttgagacttgagtatttgaaaaaacagcacccctcccagtccttacaatctggctttgtacagggagagatcatcaccagtcaactttactagataatctggagaactctcaagccttttcttgggttgagtcttctctatgcatgtaataccctagttgaggtttacctatttgtactcaggattttcacttcccgatttccatctgtggtactgtttcctctctggtgctgtggcaagccttggtactggagttctccctagcgtctgtcagtggtactgcacactctctggtgctacagccagttgcagtgatctttgttttcagtggcttccaacctggtgcccacttctgtcttagattcagttaagaaaccagtccctcaggtagcttcccccctcccccaccaccccatcaaagtgagaacattgaatgtgtgctctacttttatcttttcatccaagaaagaagggatttgggattttttttttttttccaatggtgctatgctgtgctggggagaggctgtggaaagtatatgccatgaacttttctgctggctttcatgaggttcttcttggcatacttggggtacagaaacctcttaactggttt

SEQ ID NO: 15135 - DNA, 1050 bp, Homo sapiens
ctatgaactaacttggtgggcttggcaagtctcttgatctttcttagtgtcagctgaaatggggagagtgattctcaccaagaaactccataacactgttagaattaaatgggataatataaactttatgaattacagcagttcttcctacatgaatataaagggggaagcacatcctggggccggctccatcaggttatccacacgtgcctgtaggcctcgtttgtggacacgctcctccacacatccccagccctgagagcagaaggaagggccacattcttggtttgttttttttttttttttggagacagactcactctctgtcacccgggctggagtgcagtggcacaatctcagctcactgcaacctctgcatcctggattcaagcaatccttctgcctcagcctcccaagtagctgtgattacaggcatgcaccaccacgcccagataatttttttgtatttttagtagagacagggtttcaccatgttggccaggctgttcttgaactcctgacctcatgtgatctacccaccttggcccccagaagtgctgggtttacaggcgtgagccaccacacctggctggccacattcgtttttaaaaggaagtctgattttgactcagatgcatttacttattggactatgaattccatgagagcagaattcataaaaacaacagaatcctgcctgtttttgtttccttggcacctacaactgcttgacacacagtaagaccttaatgagcagttggtacagtgcattttaaccagaacttaaggaaaagcaagcaagctatccagctagctcggcacagtcctgaggtcggtgccatggtgccacgtgggctgttttgtgtgctggttcaggagaacgtgtggaaaagctgataactgatctcctgagaaaagcgtggtgtcctcagcacaccccacttgctggagtgccagagaagtcatcacgtttcattaaggaatccctgcagatgatctcactccactgagcactgatggttgtgatgatttactgctgcctgggtccca

SEQ ID NO: 15136 - DNA, 1053 bp, Homo sapiens
gcaactaccagctactagaacaattaacagttggaggaatgaatgaagtttgccttctgtgtctctgggttctgtaactggtatgttacaactgaaaaacttttaaaatgagacattattcctcaaattttctttctaaattgtgtttttgctggtttttgtatttttggagttaaaatgaagtcactcaattagaaaatcagaacctatgtttccttcattcactgtattgtaccctggtttggactgttaaggcagtttattatgtgttttttttggcaacaacaaatgttttgcatagttccaagatggtaatttcattcaacagtgtatgtgtttttttttctttttatatgctgctcactccctcagatggggccatctgttttctcttttttttttttaataggaatttctaatgtaccaccctattgatgtagttactcttactgtttctatgataaagtctagctctaatttattaagaattgtcaggaagagaaatgtgctgccgttttgcataccagtgtggttttcactgatggggagagcgctgagatgtacaggtgcgtcatttaccctctttgagacatttgttttctagcacctggccaaagaaacaagtatcagtttgagattgttccaataggtaagacattgcacaaagattgagaaatttaaaagaaaagacattcaggtcatttttagcacacctatttgtctgctaggatcacattattatttctagaaagatacgtgttttgccagcaactggttagttgggtagaagggagctagcattttctattcaacagtaatctgacctaactacctgtcatgtagtttatgtgggtctaatcccccacctcacctagggggcagcacatgacccagacctggccagaccaagactcaatcccctggctatggtgactggtttaggggcagttttgtcatctaagaattctctatggcaggggtccccaacccctcaggctgaggaccagtaccagttcgtggcctgttaggaaccattccacacagcaggaggtg

SEQ ID NO: 15137 - DNA, 1046 bp, Homo sapiens
ctttaacttctcaaagctaaacttgtcccaatttgcagagtcaagggtagaatcgaggccctcctgatctctattttgcagtctccgtcattctgtgctgttaataccacaagagacaaaagagacctcgtctgtcctgtagcaccccgtgcctgcgtgcgtatctcttgtcgatgctctgtcggctcaggatctctcctaccagcctagagctctttcagagcaggacgcttgtgttatgcattcatgtttgtccctgtgcctagtaaatagcacagagtccaagtggctacttgtgtcttcaggggtgtttgtaagggcagagccggggtcttcattcccaggctgttgattcatccttggagctgaacatactgtcccaatccttggcccaagccaggcctctacagttgtcccaaggctgtgctaaaacctgttccacttcacaagtgatcagagtcacagactctggggacacaaattttgagatgaagacacagagcaaaatatataaatgtttttgaggtttgagtagccttaacgtccacgtggctgtcagatggctccccaaagaaagggctacgccggtggccttgaaagagtatgggagatgcatatgagacagggtcagtctaggaatgtcagactcccccaacagttggttggagtgtttttccagattgcaccagacttcacagagtaatggagaccagctgtccaggcatctgagagggtgacatccaaggagaaaaggcaaacgtcttgattgcccatgatgtgggcaaccaatttggatagaaaagaaggtgtcagggtttaacactgaatgtagactttatttacccaaagcctttctttaattctaacactctcaaaaatggggctcagtcaccatttgggtttcccatgttaatatgcagagagctaattcattgtctttcattgctgtaatgcagcagttctcaaaatgtactccagagattgaccctcctaggagtctgtagatcagaactgtatttataatattactaagacatcatttgcca

SEQ ID NO: 15138 - DNA, 1047 bp, Homo sapiens
atggtataaatgtctttctagaaaccttctagaagctgccttcctaaaattccaattcactaattctagatctgcctttcagtgacacactgtgccacacgttgcaggatatacagaacctttggccccaattatggtgacagtcaaaaatatctcaagctttcagaacacctagtggttggggcttgtgagggcaatacctccatgtctttgacacaaggtccaccttgtgcagttcctgaatcatagtaggtgttccataagtgattgcttttattatgacaagtttcccattcccttcctgcctcttggttgccctccagggcgtagtaggaagacggcatggtgtactggaaagggcatgggaagggagagctccccaaaacccaaacaccgcctgttctcagggacctcagcacctcacagcctccttcagaggaaaccacatgttgagaaagagaccttttccccactccgggagggactgacggcagtcttcagtggtatcctgtttaaatttggagggctgtgttgattctaacttagagacctcctagagtgtgattgagaagttcagagcacagcctcccacttggaatcacatgttcaggagacaggctatcagacaggattgaggatatctccccacatggatggggcatgtttagctaggaatagaaaagagattcttggtaaaccaagacattagagaaaatggcaggaaatctggtccataacaacttttagggacctcagtagaaagactgattttcacagatttggttttagtccgtgtgggctaccaccttaaagtggtcagacatgttgagagaatcaaagattcctggttttataactaaatagggatatcttacatgtttaatgctctttatggttaatggagcacttttcatgtctattatttcattctcccagtaaggataatggtacaagaattatcatcaccattttgctaaataggtggacataaaaccaggtaatcagttatggagaaaatatatagtaagttatagtaccattagccaa

SEQ ID NO: 15139 - DNA, 1110 bp, Homo sapiens
gggtccgggcatggtggctcatgcctgtaatcccagcactttgggaggccgaggtgggcagatcacctgaggtcaagagttcgagaccagcctggccaacctcgtctctactaaaaagacaaaattaggccgggcgcggtggctcacacctgtaatcccaatacttggggaggccaaggcaggcagatcacctgaggtcgggagttccaagaccagcctgacaaacatagggaaaccccatctctactaaaaatataaaattaggcatgatggtgcgtgcctgtaatcccagttactcgggaggctgaggcaggagaatcgcttgaacccagggggcgggattacggtgagctgagattgtgccattgcactccactttgggcaacaagagcgaaactctgtctcaaaaaaaagaaaattagctgggtgtggtgacgcatgcctataattccagctactcgggaggctgagacaggagaatcacttgaacccaggaggcagaggttgcagtaagccgagattgtaccattatgctccagcctgggcaacaagagtgaaactccgtctcaaaaaaataagtaaaaattagaaaataaagttttgggaagtcttgccaaatgccttctagcatgactatactggtttacacgctgtccagcacaagacagttgcccactcctcagacttcataattcataagcactaggcattagtactctcattaatctttgtaaacacaagagaagggaaacatttttatttgcatttttctttttttgggaggatggagtctcgctctgtcactcaggctggagtgcagtggcactatctcggcttattgcaacctctgcctcctggttcaagtgattcccttgcctcagcctcatgagaagctgtgattacaggcgcccaccactatgcctggctaatttttgtatttttagtagagacgaggtttcaccatgttggccaggccagtctcaaactcctgacctcaagtgatccgcccacctcagcctcccaaagtgctgggattaaggtgtaagtcaccatgcccggtctgacttgcatttttccttactggtaagggtgaacatttgcatacattag

SEQ ID NO: 15140 - DNA, 1478 bp, Homo sapiens
ccggggtccctccttcagggtccagggcagggtgtggccagaaagttccacaccagtctagaacaaggggagcaagggcagggtctggctccttcccacccgcagctccagacaccctttgtagacagcaggggtcaccccaggtctagaagcataggcctcagctcagacacacccaggttttaactctgaccaagacatccgccagctgtcagtgtcagtcctttgctcagaaagtggaatcaagtggacttgttaggtttggcaattcccagttccccgctgattttaattagaacatcctggtgggatgtaaagaggccagattcaatgttaaagggttgagggggtggtggccagcaagaaggtcgaagcagtgagaagatagtttgagagagaaggcgagcagggtcagtaactgaaagggttaatttttaaccatgtgaaagtttgggtctcatttattggttcagaatgaagagccgtgagagagagagggtgattgagagaggagatggagtgagtgatgcacaggtgtgagtgaggccaacatttaaaaagattcttaaggatgtctcttctgcagccagaaggtgggcagagatagagagcactccagttgggtttgctggggcctttcttcctctaaccacactgtttctgtgcttctctgcccacaggcccctccagccagcgtcaggtgcagaatggcccctctcctgatgagatggacatccagagaaggtaacccagcacccgcaggggccaggctggtcatctcccaatcaggctgggtggccaggggtgccttcagcgggtgaggatgcaccagcagccaaggccaggactcctagaggcatacactgcgggagggtgcaaggtgcaagccagaccaggaagaaagagggggccgatgcgcagccgctggtcccggacaccaagaccaggaatgactgtgggagtctggcattctacagagagtgctgctgacctccagcgggacggctctcagggtgacccagcagggcccaagtgctgctcccttgttgcctcacttgcccttccccaacgtagcaggaggcagtccaggcatgagggattcagcctgttggggcagtcacgcccatgggatggggctagggaccataggaatgaaccccctcaccccatggagcttctaaagtgttaccacagtggggaagaggaagggccaaggctgttgtcccgaaattacagagtcgtggtgagtccccatggagcagcctcccaaggtcacattgctctgaaatggcagagtcaggacttgaacccaggtctgccctctcagcgatgggtcctctgcctcttctgtgtcgagggaggtagggcctggcccgggccttcctcactcagctttgtcagatagggagtcaagctgcagctctctgtggctacacttatgtccagccctggactaggagtcaggaaagccggcttct

SEQ ID NO: 15141 - DNA, 1415 bp, Homo sapiens
ctgccccaggaaggcctgagcagcgaggctggtggggcagaggcgggcgctggcgccgattcacatgtctgtttcattccattgccgtagaaccccgtctgtggcaaagagccccgaagctaagagcccccttcagtcgcagcctcactctaggtaccgaacaaccctcctgctcacatgtcccccagggtttggggctcctctgtcccccgtcccgtgactaacacccttgcacgctgtctcacgtcctggcatttaacaacttgctctgcgaaggtggtctgttctttcagacccaggacctcggggtcctgtcagtcagctgctccgtcttttccctctgagagagagaccaagggcaaggagggcagtgacctgtccacagaggtagtgcaggggggggccaacatggagtcccagctctggactcactacgtgtgacagtgggcaagttaggggacctctccaagcctctgttttccccccacaaagtgaggtctgttaacccctgctgcacagggtggtggtggggacagctgtgagcaacagctggacatggggtgtggtcactagccagggctgcaccctacagttcaaccagtcctagcactggcgctgagccctacccctttcctccagcccagagtccttcctctgcggccggcacacagaatcagtttccccacagacatactgaccatatttcccaagccaaaagctggcatgacaacatgatagaatatttggaactgagattgcccaaaaaggcagaggcagccagccacatagtatctggaggtacatgtggcctgaattggaaggcctctagaacctgcgtcaagaatgtctccatcgccaccacaaattgaagggaaaccacccttatcacagagcaggaggcattgaaactggccttgcagagctgaacaggtggtgagagcagagcagtgcaggtggacagagatgaggaagtcttagcagtcagctggggtttgtccaaggcttgtggtcagccaggccgtgtgctggggacagtccctgcctgcaaagagcaccgtgtgaacaaggccactgtggtcctgaggggtgctctggacagggtgcagggccacatggtggaagggacagggtgctttgcggagtggggtggggcaagcctctgtcgggagctggcattttcgttgacccggacgaggaggagtctgctctgcggagatcatggggacagcctcccaagctgaaggaagggtaagtgccagggccctgagcctgcagccacccgccaagctcccccgcacctccacctggaagcagacaggccatggggcaggggaacgggaagggtgaggaagagggtgtgggggagcgcggagttagaagtttgcattgtgttcatgcgcagggcccagtcatgg

SEQ ID NO: 15142 - DNA, 1152 bp, Homo sapiens
cggccgcctcctcgcccgcccgcccgcagccgaggagccgaggccgccgcggccgtggcggcggagccctcagccatggcctcgggcgacaccctctacatcgccacggacggctcggagatgccggccgagatcgtggagctgcacgagatcgaggtggagaccatcccggtggagaccatcgagaccacagtggtgggcgaggaggaggaggaggacgacgacgacgaggacggcggcggtggcgaccacggcggcgggggcggccacgggcacgccggccaccaccaccaccaccatcaccaccaccaccacccgcccatgatcgctctgcagccgctggtcaccgacgacccgacccaggtgcaccaccaccaggaggtgatcctggtgcagacgcgcgaggaggtggtgggcggcgacgactcggacgggctgcgcgccgaggacggcttcgaggatcagattctcatcccggtgcccgcgccggccggcggcgacgacgactacattgaacaaacgctggtcaccgtggcggcggccggcaagagcggcggcggcggctcgtcgtcgtcgggaggcggccgcgtcaagaagggcggcggcaagaagagcggcaagaagagttacctcagcggcggggccggcgcggcgggcggcggcggcgccgacccgggcaacaagaagtgggagcagaagcaggtgcagatcaagaccctggagggcgagttctcggtcaccatgtggtcctcaggtgagcgccggccgcgcgccccggccccgggatgtttttgttttgaagggaagccatgttttatgtgtgtgatgggcgccgccatcttcttcgccagggcaagtatggcggccccaaaagatggcgggccgtgcggcggcgggggcgcggcggcggcggcgggcggcgggccgcgaagatggcggcaggccgcgggggggaggggccggcgccgcccggctaggccgcaatggcgtagtttctccgagagggggaagcgccgcgcggggcggagacggccgggggaggggccggcgcgctcgctccccgacgccctcgctccccgcgcccgcatcaacgggcgcgcccgccggcccgttgtggcggcagctgcgcgcccccggcccgggcgggacgcg

SEQ ID NO: 15143 - DNA, 1034 bp, Homo sapiens
tctgatttttgcctgttgctaagcagtgaatcgcaaatgtttagctctcccctgtttcagtgaaaggttgggtgatggcagcggtgactcttttttgtctttttttgccagaagtaacctggagtggcctaagatagaaggtgtggagaaacaaaatctagccaaacatatacatgcatacatacataggtaaatatctcagttggtgaaggtgaatatagaaaatcgggatcacaggaaaaattaccatcaaccctaatgaggttactggcagtcaaaattaaaaaaaaaggaacttatactaccttcatctgatattaattctgaggaaataaaatgtttcttaggaatgaattcctttgtgtatgaaggggaccactgagtggtagtactggcatttttcagccaatgtgacaaatttcacagtgctgtcttagagatgcctaaaaaatgtattaaggaacgtggctgggtatggtgcacttttggagactgaggtgggaggatctgaggccaggagtttgagaccaacctgggcaacatagtgagaccttgtctccacagaaaattaaaaaaaaaaaaaaaaaggccaggcatggtggcatgtgcttttgtagccccagctacccaggaggctgacgtgggagaatcacctgagcccaggaggtcaaggctgcagtgagctccactccagcctggatgacataatgagattctgtctcaaatgaaaagagagagagagaaataatatataaggcctttgatttttctgattaacatattgactaactggttgactggttgactgaataatgactcccaatatagccagatcctaattcttggaacctgtgggtgttaaccttatttgcaagtgtgattaaaccagggctcttggaatagggagagtatcctggtttatccaggtgggtaccaaatgtaatcacacaagtgtccttgtattcacaggaaggcagtgggagattgactgccaaagaggaagtaggagaggtgtgagaggttggagtccagtg

SEQ ID NO: 15144 - DNA, 1066 bp, Homo sapiens
ccacacaacaactttatagctctgaaactgattctcactgctggcctctagaactataagagaataaattcctgttgtttcaaaccaccaaattggtggtagtttgttacagtggtaataggaaactaatacatgtgctagcatcccctgtatagcttcattctgcaggaacttggcaagtccctgttatgtgcaaggcacaagacctactgttcccccttaaacctaggagaggggggaagtggaataaaggggctttttttgcacactactcaatttcccagacatgatgattggcatttaacatgttaccttgttttagccttataagatcagtggtatccttcctccctccctccctttgtcccttcctcccctcccctccctttgcttctctttcttctctttatttctttgtagaggcagggttttctctttgttgctcaggctggtctctaattcctggcctcaagagatcctcctgcctcggcctcccaaagtgctgggattacaggtgtgaactcctgtgcctggcctcattgtttaataaatgaggaaaccaggcgaggttaagagtagaggctggagtgacaggaatgaatggcttcttgaaaggaagagatcttaatttgggttttggagagtggactgggcttaggtaggtcatgagaggaaggcaagagggtaaattgtattgagtaccttttactagacactgagaaaaccactttgcttggagcgtggagggcaggtgagactccatctttttacttctctggacttgtagagtgcttctagcctttccatttatttagttccttaattatatctttttgactggaaattggagtctacaaactcagtcttatgctttgctcctcaaactagacttggagtgattattgctttggtaacatagaagaacaccgagcagctgggagattgggatgggccagcggcttatttatacaatacctttaaccttctgaatagtaccatatgcagaaatagaaacttttaaatgtgagttaattgtccttccacatatatgactagtgttggctag

SEQ ID NO: 15145 - DNA, 1028 bp, Homo sapiens
ttagatactttgcttcctgaacatgttttacctagatgtacatttgatattaccccatcgctagtcaatagaaatcagtaacattcatagcataatttgacattcaaagtggatcagtaaacactctcctctatgtagcaaatctttttcagtagtaattatgaagggaatagtatttttagtagcaatggaggtttgccatgttagccaggctagtcttttttattttttgagacagagtctcgctctgttgcccagcctggagtgcagtggcgtgatctcggctcactgcaacctctgcgtctcaggttcaagctattctcccacctcagccacccgaatagcagggattacaggtatgtgccaccatgcccagctaatttttgtatttttagtattgatggagtttcaccttaacctcaggtgaccagcctgcctcagcctcccaaagtgctgggattataggcgtgagccagtgtacccagccaaccagggtaatcttgaactcctggcctcgggtgatccgcccacctcagcctcccaaagtactgggattcaggcatgagccactgcgctgggccagggttaatactttttaacaaagatttttattattattattttttataattttctttttttgagatggagtctcactgttgttggctcagggtggagtgcaatggcatgatctcagctcactgcaacctctgcctcctgggttctagcagttctcctgccttgccttcccagtagctgagattacaggtgcccgctaccacacctataatctttttttttatatatttttgctagaggtggggtttcaccatgttggccaggctggtctcgaactcctgacctcaggtgatccacccgcctcggcctctcaaagtgctgggattataggcgtgagccaccacacatggccaagatatttttttgaacaaagaaagaaacatatgtacatatggcctgtaatgtaataaataaaaattactagcttcttttacagcatcataaatttc

SEQ ID NO: 15146 - DNA, 1289 bp, Homo sapiens
cagtgaaaagaagagagaagacccttctcgaccacgggaagcatcttccagaagtgtgattgggaataaatatgcctctcctttgtatattatttctaggaagaattttaaaaatgaatcctacacacctaagggacatgttttgataaagtagtaaaaattaaaaaaaaaaaactttactaagatgacattgctaagatgctctatcttgctctgtaatctcgtttcaaaaacacagtgtttttgtaaagtgtggtcccaacaggaggacaattcatgaacttcgcatcaaaagacaattctttatacaacagtgctaaaaatgggacttcttttcacattcttataaatatgaagctcacctgttgcttacaatttttttaattttgtattttccaagtgtgcatattgtacacttttttggggatatgcttagtaatgctacgtgtgatttttctggaggttgataactttgcttgcagtagattttctttaaaagaatgggcagttacatgcatacttcaaaagtattttcctgtaaaaaaaaaaaagttatataggttttgtttgctatcttaattttggttgtattctttgatgttaacacattttgtataattgtatcgtatagctgtattgaatcatgtagtatcaaatattagatgtgatttaatagtgttaatcaatttaaacccattttagtcactttttttttccaaaaaaatactgccagatgctgatgttcagtgtaatttctttgcctgttcagttacagaaagtggtgctcagttgtagaatgtattgtaccttttaacacctgatgtgtacatcccatgtaacagaaagggcaacaataaaatagcaatcctaaagcaagaatatggcagaacaagatctgtaagcacagtcttattttcttttgttgtccagaatacttataattcttgagcctcccagaaattggaagctaaataaagcaactcaagtttcctttattttgcactcaattacagtgattattgatgaaagcgatgcatggatattttaatacttcctacatgtcctgacttctgaaagagagtaggtaacaggcatcccgagttcaggaactacctcagaacaccccaggccaggttggtcataggctgtgattttagcccccggcaagtgtgagtgaagcatctgtaccaccgcgcaggctgagcgcctgcgcagggtaaggtgccacctggcagtggggcacacagagggaagaccaggcctgtccatcagccggctgccttcagagg

SEQ ID NO: 15147 - DNA, 1099 bp, Homo sapiens
tgctctgctggcttgctgaagccagctctgagtcacagggttgccttggaccctcggctgtagggggcacctgtctggctccgggccctttgtcctggatacactgacagtaatgtgagcgcagcacttcagagttcaggcccagcaggtcctggcaagtgcattccacccgaacttttaacccaagcggtggggaaggaagccaaaactccaagctgcactttcttggggttctggccatgcacttcttagccttctctctgactttacaggacaaaaggtaccccacgccttcagaatcatgcttacctgcacggcagcatctgactggatggctggctaggtctcatccaccccaaattactgacccttgatttatgttgttactgctcaggttatgctcagatgccctggttgcctgaagatggtttaagtgcaggcccttcagacaagtcacgtcaggcaagagagggctggcctctgacccacaagagggcagatttgtggccaagaggcttcctggcatccacccccaggcccaagggatcagtgtggtgccagagaggatctttaagctgggactgtactgaggcttgatgggaagtatgggcagcatgtacttgacacgttatcacccagtccccttgtaaaatctggaatggagcgtttaagctgagcgttagcatcaggtcagcaggcaaagcaaacctcccacaaactgggtgccgtaaggtgggaggtgacacatggagagcttcgtcctggccgagcaggcacccagccccatgtcccccgccagcattctggatgtcagaggagggtgcgtgtgatggcgtcacattcatctgaagcacactgattgattttccacaaggtggcaagtttgatcaaattgaccgcttttcatgagacacccagatgctgtaaaaaaaaaaaacagcactgggatgtgttgaggagggggcagtttgctgtgctctgttctgtctgctgctctctctgggggccgcacaatgtccgcacacatcacggaggggagaaaggcatcagtaccaaacggaacaacctcttttttctacattgtccatacccggacatg

SEQ ID NO: 15148 - DNA, 1023 bp, Homo sapiens
ctgcactccagcgacccagagagcaagactccgtttcaaaaagaaaaaaaagtttggaccctaaaacccacttgatactcactttaactttgccagttctgctttctctttggttacatgtgactggtatggttttgtccaacttgtaattttggtgtttttgttttttgagacaagatctcactctgtcacccaaactggagtgcagtggcataatcttggctcactgcaacctccacctcctgggctcaatcgaccctcctgccttagcctcccaagtagctgagacaacaggcatgagccaccacacccagctaatttttgtaattttggcaggatgggtcttgccatgctgcccaggctttgttcaagaaaactcctgacttcaaaaaaagccaagcctcccaaagtgctgggattacagacatgagccactgtgcccaatgtgtagttttgaaccttttcttactatcttcttttagatgtttgttgtaaacaactgtatctggattttgttttctaacccagtctaaagcagtctgattttgctggaacaactgagggatctgacatttttatgccactttattttatgtaaatggtttattttactcctttttccatacttttgatggtttgggaaaattactatttattccctttcttttatttattttttattttttgagacagagtctcgctctgtcgcccaggctggagtgtagtgttgcggtctcggctcactgcaagctccacctcccgggttcatgccattctcctgcctcagcctcccgagtagctgggactacaggcgcccgccaccacacctggctaattttttgtatgtttagtagagacagagtttcaccatgttagccaggatggtgtcgatctcctgaccttgtggcccgcccactttggcctcccaaagtgctgggattacagactttagccaccacgcctggcctattccctttctttttttgagagtcttgctagtgccgttgcgcgatctgggctgac

SEQ ID NO: 15149 - DNA, 1048 bp, Homo sapiens
ttgcatttcaccaggttttccactaatgtcctttttccgtttcaggatccaatctaggatgccatattgcatttagagagctcttgctatttaataagtaatttgtttttttggggggtggactgggcagtaaggaatggactggagcttgtcctggccactaattttgagttccctgttctgagcaaaccctgcacatcctggctgatgtcccatatcaggagaccagagccttgaagctacagttaagctcgtactggatgtcttttggttttcaagacttgcttcctagttcaatcatgaacaagacaagcagaagatttgcaccttaatgaggcttaaagagcactcacttataaagtgccattagtgacttgtccttaatggtagctgtttagtgataacaggtttctcattccttttttcttttttttttcttccttttttcctccttctggatttaacccagccagccttttgggctaatgttgacattagctagaattcgaatttagactgcttaccacattgatgtttttacacaaccttcctgtggtttatcggataattgagtgtgtcttgaggcagtaactgagttgaaatgtgttgcatttaatgagtgaaactagagcatgctttgcataccgatagatgcacatctgtaggtgatttttccgacaaaagtcccagcctaggacgtttccttccattcctttcccttccttctcttgcatttccccccttttcctttctctctcatcctttctctcatgtctttttcggtacttttttcactatgctctcctttggccttgcacctggtcctgtctccgcctgccttttctcctttgcatttcctcctttccgtccccctgtgcccctctcgctctctcttgccaattcccatcttctatgcctttccctgcaacaggccagtgaagctgttgccacggaaacagaagcccagcagaagctctgttctgctttccggatgcttctaacgatgatgacgcagataatattgatttctagaatcagctaagccctg

SEQ ID NO: 15150 - DNA, 1045 bp, Homo sapiens
attcagcctctgctgtccaatcagccactgagttgtgacttctctacttagaggtagttctttatcaaattcatctcattcctcgctgccgtttggtttctccctgtgaagggtattcattttcatggttgttttaagagtaagaggcagtacaagggaagtgcctggtatagttcctggtaatcgtagatgcccaaattgtgactactgctgttgtaatttctattattacgtattctcaactctgattgtcattccttgatgtaaaaactttgctgtttgccctcatactacaatacaggttgcagcccaaacagtacgggatgcaaaccaacccatgtcaccggcccattcaccctgccccgatttctgttcctatcacaaactgcctgctgtgtgccttgaattctttccagctctttcccaaacatgacacacccttttaggccttttccctttccttccttcttttcaggcaaagtcttccttatccccctggacttggctcaagggtccccttctctctgtacccattccttgaggttgcctttctcccttgtctccagactgcataaatggcagtgtggcctgtgttgctgtagcaccatgtgcacctgggctgtgccccggcagtgttctgtctttgggctcactggggagggagcactggaccatcgtccccagatgcccagggagaagcttggtgctcgttactgactgtagggtacttttctgtagcaggcacttggggctcacttatgggacccagtaacttcacagtcatgaggtacttgatttgaactgaggagaaaatgtgtcaatacctttcccagggagagtcaccctcacaaaccttggtctggaaggcccatcttagcccaggggtgagatcttgcgtggatgattcagaagtcacagtattcctgaaaactagtgactcaacagaattatatggctttgggagaaagagtccctccaggggcaatccaactaccacaggccaggggccaagctttggtgagccgagcctgggccctgcccctcc

SEQ ID NO: 15151 - DNA, 1086 bp, Homo sapiens
ttccccttataattgctttccttatcattcttttaaaatttgttgtgtgtacatgttttgtaatgagtataacacatcaatagaatagggtttatgtactcaaagttgtgtgctcagaaaaatttttaaaaatgatagtgatatgtgatcaaaaaagtttggagatcacggaaagagaagctcactcagctgtcttgaagtggagagagccctggcctggccttaacatccagagatgagggcttgtgatcccacctgctcctgctatgggggcaacaagacattcattcactcaatcattcgttcattcattcattcattcattcagtatggctgagcggtgaggttaacacagtgagcaggaaggtgctgtcctgacttcagagagcatctgcaagtccagatggggatcttcatggctggaaggacagtgaggcctgtcagggaaggacacagtgctgtggatcacctaggaggggcttgtaagtgaggtttgggggttagatgtgacttccagggagaagagtgacgcctaagtgtgtatgagagtcctctggtgtgaggcttggagaggagggagtgtagctgctggccagcaccgtggaagagttgactctgagcaaatcattaatctttttgggccttaattgtcttctctgtaatggggaaggatagtaccactggcctctccagcaagttctttgcatctgctgaggccagattcaggtgtcaaattctcagctctgctgttgactagccatgtgtctttgggatgtgttatgtctggagctttgctaacaaagctttctcaccttatctcattgagtcctcccatccagcattttccatatgagtgctttgagtttcagagaagtgaagcgcttatggagggtcccacaagcagtgggagccgggacgcagggctgactactacacctgggcccgccttttcaccacagactgtgtgtgcttgtcatacttagactttgcttgtacttgggaaaggagttcagtttgctttaatgtcactttaatgctttttagaattcatttcctttgtttattttgcagcggtataatttgcaa

SEQ ID NO: 15152 - DNA, 1021 bp, Homo sapiens
ggatctgccatggtacagaaggttggccgtgtgccccatttttccatgcatgccccgcctcagccagtgcatgctgggtgtgtactgctgctgaatttggtcaaatgccatatgatttttctccttaagatgttaagattataattgctgtgttgatagatttttctggttttgaaccatctttgcatttgtcagttttgtcgccgtatattattccatgcgcggggcagagcccatgcaagtaccggtgtgtgccggcctctagcatacttcctttacctcttctgaggagtcgctgcacaagcctctttctacatctgttctacatctgttttctattctcaacctccgtttccttcgtttttcattatacctagtaagaatggcatgcaatatacttccactgacgcttacattttcacttttccccaaaatggtaaattctccatagtaaatccacatatccaggagaatttcacatgtatcaagccagttcccctcactggtcttgtttgataattctctcttggctgttctaaaacattaatgcctctgtatatatactaaaataatttcacctagttcagaaaaataataattgattggaattaaagttatatattaatttggtgaaaattgataccttttttccatctaggaagatggtatatatcccccatttttctgggtcttgttttctgacttataaaattttatggttttcttgtaaatctctaactttccagtaaatttatttctaaatactctatagcttttgtcacacttgtgactgggttatattttttcccatttccacttctaattggtttttgttaatctcatgcagagctattggtttttaaatattttcttttgccgtcaccttaccacattttcgtattagtcttaattaatttttccactacagtctgcatatatagtcctgttgtttgcaatagattcttttatctctcttccactatttatgccaacatagactagttattttaattttattctg

SEQ ID NO: 15153 - DNA, 1056 bp, Homo sapiens
cagtgatataatgatatataagaagacctgaaggtgtagggggagtgtcgtattcagaggatatacatcaaggcaaggatactctgtatgcttgtacacacacacaaatacatatacacaaagaacatacctattattaatttctgtttctaagtatgatcattagaagctgattaggtaaataaactttctgctttgggacaagcagaaagatttaattaacacttaactgaaattcacagatactcttttttttttttttttttttagacagtgtctcactctgcctcccaggctggagtacagtgacacgatctcggctcactgcaacctccgcctcctgggttcaagcaattctcttacctcagcctcccgagcaactgagactacaggcgtgtgctaccatgcctggttaattttttgtatttttaatagagacggggtttcattatgctggccaggctgttctcaaattcctggcctcaagtgatccacccgcctcggcttctcaaagtgctgagagtacaggcgcaagccaccgtgcccagcctcaaaagatattctttttcttacctcaaaaactatgttttccaacttttcacagtggaaagttgaagtcgtgaaaatatcctcaggataaatctgaatcgtgtttcttttattgctgagtctggttggcgtgttcctggtatttagtggaactctggtcaacacaggctgaagttagtggggttctctctgtggggttctaaccttgaaataggagcatggggcttgccttccccttctccattcctccaagaaagagaaaggaaaggaagagaaaagaaaaagcatcctgtattatgtgtaagtttgtaagaatccttactatgagttctgagtacaacatctttttaactcttttctctccctctcctgcttccttcttcaatctccagctaccattcatttcctgatttcatttataggtcttaccaggcaagaaggccaagcagaaggaacctacatcagggaagtgctgggctacgggccccacctggacttggggttctg

SEQ ID NO: 15154 - DNA, 1033 bp, Homo sapiens
ctactacgatttttactattctacctaaattttaggttaagttcattgagttcatcaaaaattcagtttaagattgtgtctgctttatacattgctctgcgaagttccatctttgtaatatgatctcattccacatcaaaggttcctccgttttttcgggcattcttcagtgccttttattagagttttctgctttctccatcaaggccttgtaactaggtcagtaattcccaggcactttgtagtttttgtgtctgggtagctggagtcttcgtctctgtttcttttttgtatttgcttaattgttagtggaaaggtggttgctgttggtttcatatttttgatatttgcatgtggtagtctagttgtgatggtctgtctgttgcttctgttttccagctatatcatttgcaaacaaatgacaattttgtacttaaatatatatatattgcgaaggggcttaacactttctgcccttcccagaaatgtatctcttagcaatatgactcgtagaacctaacagttccatcacaggaggaagtgttctgcagtaactgtaatttggcctttgatggattcatctgttataaatcctgttgacatgaataaaacagagaataaataacagaataacccttgtggttttgaacagagaactgtaaataatcaaacctttctttcctgttgcctctaaagttagactgtcagcggtttttttttttaatgtatcccttcatgtcttaaaatttttatatgttacactgctgcagttatgttacggcataaatattcactcattggtaatgaatgataacacatacagaaaggctgcatgatattgctgaattgtaagaattttccgtaaagttgcttcttgggccattctagtttacatctaatttaataaatttagcaatttggagaacatctgcaggactgatgtaagtactgaaagtggaagtgtcagggaggcagcagaagcaggtgcttcctgatattaaccagagacggtcctggcacagatggggccgtg

SEQ ID NO: 15155 - DNA, 1079 bp, Homo sapiens
tggccctgtctttgcagtggccccatctggagggagacaggctggcacagagggtagggtgcgtgtcctggggctcccctagaagcaggcgcagtggacagagatgtctcagaggaagggagctgggtctgtcgcagatgggtgcttcagaaagatcgcacctgagacagcacggaggatgcgtgtgggtgtcagtggggaactgggcaggtagaataagaggagttcaggaatcacttctaccctttgcaggaactgtgctaaatattgcgggctttaaaattaagtaagacattggcctatgttgaaatacagcaaaaacgtaagatggattaatgaacgagtaaaagatggatgaacagatgtgcgtgtgatcaagcagatggagcacattgctcgtggtcgaatctggtggttgaaatgggtgttcactgtagaattctttccgttttcctagatgcttgaaattttccaaaataaaatattgagaaaaaaattcgtgcaagaccaagttctctgccctcgaggcatttacagctgcaggccttgaggagtttctttggttcctgaagggctgcttgctcaccacgagcagtgtttgcacaaatagatgcgcttcttgttgcctggctccatggctcctcctagagcattgttttcttattcaggttagttcagtgtctaattctaatgggaaaattgttttttctaggtttatttatgaaacagagcatcataatggcatagcagagttactggaaatattgggaaggtaagcctctgttatgggtagcaaacggctgtagatggaatttataccagagtgatccatttcattgagtccagctgcccgctttaaagcaaggcagtttaaaccattctctaaaagaattcaaatacaatttcactgaaagcaggagttggtgagctcttagattagagcacgccaaatgacaaatctctcccatttttatggttctgtacgtagattctacttcgtatacctcagtatcattactatggaaacacaattccagttatttcctcaagagcaatgttaaaaatagttaacctaagaa

SEQ ID NO: 15156 - DNA, 1032 bp, Homo sapiens
tattttatgatcattgaatcacaagtgaacgttagattactgctgttctgtgcgtggatctgtaattttttttcagcctccataattatgtcagaggatttataattttcttaacattttatgtttattaaaataggctatcatagccagggttaacaaagccagacatgtcaggtgccagtttaagcatttaaatacattttttgaaacaactttattgagatataattcacataccacacaattcacccatttaaagagtacaattcaaaaatttttgatacgttacattttgaatttttttaaattgtggtaaaatacatataacataaaatttgtcattttaaccgcgttaaatgtacagttcaccagcgttaatgacattcatagtgttgcgcaaccatcaccactatttccaaagctttgtcatcatcccaaacagaaattctacccattaaacaataactctccgttctccctccctctggcccctgctgacctgtaatctactttatctctgaatttgactattctaggtaccttatataaggagaatcataaaacgcttgtcctttcacacctggcttatttcactcagcgtaatgtcttccagggctcattcttgggttgcgtatcagaacttcattcctcatcatggttgaatgctgttctatcatatggatagaacacattgggtttattcattgttttttcagtgtacacctgggttgttcccaccttttagctattgtgaataatgctgctatttggatactggtgtacaaatatttgctataatccccattttcagttcctttggatatatatccaggagtggaattgctgaatcatatggtaattgtatgtttagctgcgggacagacccccatactgttttccacagtgactgtcccgttttacattccctgcagcaatgcacaaaggctcccatctccccacattctcaccagtgctgatgctgctgctgctgctgttgctttctttttatttattttattttatcttattttt

SEQ ID NO: 15157 - DNA, 1046 bp, Homo sapiens
ccatctcaaaaaaaaaaaagaaaagaaaaatgggggaaccaccctctagtggcttcccgtgagtaagcgccagtgcactcaggccctgttcccctgccctcctactgttcatgcccccactgccctctgcagtggtcctcagccagccccgtgctgacaactcaggacctctcctccctctggtccttgctcagatgtcacctcctccccattgaagccaccccaccgcacacgcaccgccgctgcctgttctcctgccctgctgccctttgtatgtgacttatcgtttctagtaaattaataatcatccatcacctgtctcctccccactagaatgtaagctccgtggagtcaaggatttctgccttgctttgttcagtgctgaatgctcagcagaacacagcacgccctcttgacctgacagatgggggaggcgggtggataggtggaatggcctcctttgagttgtctcctcagcatctagccagcatctagcataaatgtttacggaataagtagagaaataggtgacaatgttcttgatgagttgatgtacaagaagttgtctgcctctttgttgaaggctcttcagggttacaggttacagtctagaatattttgaatttgtagaaataatcataattttctggtccaaggtagttcattacccgactcacaggtttaacagcaaggacagccacctgatgtctcaggcacaacctccagcaagccatccacttgtgtctttcaggtggcagagcgagctctctattactggaataatgaatacatcatgagtttaatcagtgacaacgcagcgaagattctgcccatcatgtttccttccttgtaccgcaactcaaagacccattggaacaagtaagaaagaactggctgccatctttttcagtcattttaaaatatggcacgttttactgctacttcagtaagaataaatatcagaattttaaatatcaattaaaaaacaagaaggtcagttgctttgtggactcataaattaagtagcagcgtgggttgtttctgtg

SEQ ID NO: 15158 - DNA, 1049 bp, Homo sapiens
ctgggagtttgtggccacgtgttcatttttaagacacgaggctatacacagttaaaaagccaattcttggccgggtgtggtggctcacgcctgtaatcccagcactttgggaggccgaggcaggcagatcacctgtgctcaggagtttgaaacaagcctggccaacatggggaaaccccatctctactaaaaaatacaaaaattagccaggcttggtggcaggttcctgtaatcccaactacttgggaggctgaggcaggagaatcgcttgaacctgggaggtggaggttgcagtgagccaagatggtgccactgcactccagcctgggcaagaaaagcaaaactccgtctcaaaaaaaaaaaaaaaaaaaaaaaccaattcttacacattaaatagcttagggttggggaatttttatttttggtatagcctttgacttaggtcagaattaaagctagacaaagaataaactaggtccaaaatgtgatgtacctgaaaggtgtgtgcatatttgcaatttaggtcctgctctgtagtagatcaagaacttgatcaagaatgcaaaccaaaatagcattctctcctgagtaaagctgcctttgaaagtcaggcctagtatctgtgtgatattcggggccccagaacgtccaactgcttggtctgtccactgcccttagaaaggggcacgtcccctcctgggagggttaccttatacagtgacaggaaggaaccagtcctatggccatccacgtgtctacttgtaaatacacacacaggcaggacagttcttggagaactcctgtagcatgtctgcttccttgttttcacaactcttgaaattgtattctgtcaccgggtttcctgtgtgactgatattcttacaacagtgattccctcacctcatccttagatctctatgaattatgttcctgagtcagaagactcagaagagtcattgggatgtctgttttccccagattaacgtgctctccattagaatctcagcaggctttttatcctcaagaagttgagaaagctaattctaaaa

SEQ ID NO: 15159 - DNA, 1033 bp, Homo sapiens
gctttgtgagatgaatacttcctgagaaacttgacaagtatctctccattttaccattatgaaaactatcattaaaaaaaacagtttagatgccttctccttttgagggaaaaagggtgctttttattgtataaagcagcgtcttatgtattttgatataccattgtttgaacttccgtctttagctgatagattctcaaatatccttgattttggatgttcagtatgtttgtgagagaggtttctgggaagactctctttttgccctcgggaaaaagcaaaatatcaatgtttgggtgactgtgtaaagctcagtgtgtaagaacatctttttgtctaggttttctttctgctctttattgaagacaaacactcaccaaaaagaaaaataaaagttttcagagaaactaattttctttggcaagagtattacttaatattttggcctcctaaagtttccctagttagtactcggactcctgtgctaattgtcagcttacatatcattgtatagagactgtttattctgtaccaaactgatttcaaaagtactacattgaaaataaaccggtgactgtttttcttcataaagttctgcgtttggcatcttcactctttccaaaatgtatctgtacatcagaaatgtcactattccaagtgtctttttagtgtggctttagtatggcttccttttaatattgtacatacattgtatctttgttttatggtaataagtaataaaaatgtagacttcatattttgtacaaaatgtcctatgtacagaataaaaaagttcatagaaacagcaaatataggtaagtggcacaattatttttctttagaaaatatctgtaactttatgcattagtgaaatgttaagtaccgacatattttttaacattttgtaattcaaaactttttgttttgacattgtttatgaagagaaacttcatacacttgccatttaatatgctcttttatctaattttcaaaaactctaaaaaacggtgtatcatatggactaaataaagaa

SEQ ID NO: 15160 - DNA, 1050 bp, Homo sapiens
ccgagactacaagtcccagaagggcgcgcggcgacatcgccgggcccgccccccgcgcacgcgcggcgccgtgacgctaaggccgcgagcgagcgcgggtggctgcggcggctgcggccggcggggcggggcggggccacctggcagtggctgcctttagggcggagccggctcccgctctcctcagtctgcggtgggctagcggacggtccggcttccggcggccgtttctgtctcttgctggctgtctcgctgagtcgcggccgccttctcatcgctcctggaaggtcccgagcgcgacaccatgtcggagcccgggggcggcggcggcgaggacggctcggccggattggaagtgtcggccgtgcagaatgtggcggacgtgtcggtgctgcagaagcacctgcgcaagctggtgccgctgctgctggaggacggcggcgaggcgccggccgcgctggaggcggcgctggaggagaagagcgccctggagcagatgcgcaagttcctttcggacccgcaggtccacacggtgctggtggagcgctccacgctcaaaggtgcggggccgcggagggcagggtcgccagagccaggcctcgcggaatgcagggcctgccaggtcctccggggtcgcagatgtccccgggatgggaggagcccggcagctgcagatgacccctggatgggcagagcccggcggccgcagacgtcccgccggccgggtccccagggccgcagacgccccgcagaggccggcgcggcgcccggggctcgccctcgccacacccactgcccggcccggagcccccagggcgccccgctcctggtcgcggggaggggaaaggggtccccgtctgccgtcacccaaaacaatggggtcgctttgtctgctcgggcctctcaagatggccgagttgggtggagacagcgtctccctgggctgagagcgggcgaggccgcatccctgcctccagtgtcacatgagcttttcggtttcgatttgtgtccaagccaagtggccttcgggagggatgtgtcgggggcaga

SEQ ID NO: 15161 - DNA, 1050 bp, Homo sapiens
ccccatagggttaaatgtatgatagctgtaaagtgcttagtaaaatgcctatcacacaggtgttgctgagtgaacggctgagcagaatattcttgagagcaggggtggaaagtgacttctgtgtttgaagcacaatgaatgagcttcctgggatgggatgctgagaacttggccatagccagcagcggctagcactgcccaccgccaggccctgttccagtgctttcatgcaccaactcagttatccttgcagaagccctggcatgctcacgctaccccacttcacagacaaccgccttgcccaaagtcacacagcaaagtcaggagtgaggaaaaaaacggataggaagggaaaaatagtgccaagtcatgtaggtgtcgatatgtcaggctgggagtagggagaaaatagtcattgtctaagcagttgataaataagaaattggaaatgttgatattaatttgatatatttattatgatttgtagaggacgtcggtgatgaaggagaagaagaaaaagaattcatttcctataacatcaacatagacattcattatggggttaaatccaataggtgagtagtacaaatattaccattatctcaggttataaatttgtgagaattaatatgaatcttttttcttttcaaactcagaaattcttactaagagaattaatataaatcttttttttttttttgagacggagtttcgctcttgttgcccaggctggagtacaatggcgcgatctcggctcactgcaccctctgcctcccgggttcaagcaattctcctgcctcagccttccaggtagctgggattgcagacatgcaccgccacgcctggctaattctgtatttttagtagagacagggtttctccgtgttggtcaggctggtctcgaactcctgacctcaggagatccacccgcctcagcctcccaaagtgctaggattacagacgtgagccaccgtgcccagcctaaaattaatatcaatcttaattgactcagacaaacacattaagaaaacactcaagcccggcacggtg

SEQ ID NO: 15162 - DNA, 1044 bp, Homo sapiens
acaggtaaaaactgtggtttgaatgttatatttcacttaatgttcacaagatagtatagaactcggtgtaaaacttgggaattgggagggtaacgctagtgagccgaggggatataaaccctgtgtattaataaatatgtgtgtcattactatttgacagacctgaaatgatgggatctctttggagaccaatagcacactaaatgttgaggtatgaaatctgtttttagggatggtgataaaatggctccttcagttgaaaagaagattgcagaactcgaaatgggactccttcacttgcagcaaaatattgaaattccggagatcagcctgccgattcatccaatgatcacaaatgttgcaaaacagtgttatgagcgtggagaaaagccaaaagttacagactttggtgataaggttgaagacccaacatttcttaatcagttacaatctggagttaaccgctggatccgagaaattcaaaaagtaagagcacaggattgaaagttatgtaaaatatgttactctttaatatctttgggaaaactgatctggattttgtaagtgaggtaaattatgtgataacttgttagtggtgccgcctcttggtcctgggactgtccagtgcaggactagccttggtctgggtggaatggtcaggggacagtgtgagattgcttgagtagtcaccctgatagagcattaatctcagcagtcgtatacctttgatttcaaatcaagccacttttgatttacagggaaggaaatctacttgaaatataaaaattgagttgtaatgcatgtgttttgttaacgatatctattctaccttgtttaaatagtgaatacccttgggtgttattttattttcaaaggtgaccaaactggatcgagatcctgcatcaggaactgccttacaggaaattagtttttggctaaacttggaacgtgcgttataccgcatccaggagaaacgggagagcccggaagttctcctgactctggatatcttgaaacatggcaagcgcttccatgccaccgtca

SEQ ID NO: 15163 - DNA, 1039 bp, Homo sapiens
aagccatcctctcacctcagccacccaagtagctgggactacagggatgtaccaccatgtccaactaatttttgaatttttgtagaaatggggacttgccacgttgcccatgctggtatcaaactcctagtctcaagcaatcctcctgccttggcctcccaaagtgctaggattacaggtgtgagctaccactcacagtcattattacaattatttttaaattcttttaaaaactttgtaacttgactgagctgcattagcacgtactaggtctacaatgtttgaacacgaggcattattaggcatttctgttcaactctgtgctcacaaaagacatgttagaacaagtaattaagacaatagcagttgtcatgttctcacttcccccaaaaaacgtatggtacccacatcttaaatgttagagaaaattgtaagtagaaaccttccggttacttagatcacattgcacacattacatgcgcattcactatgctgaaatgtatactttgatttttttaacacctctgaaacttttgtttttttcctaatactttttttgatcttatgccaaagaaagtcaataaatagattaggatccaagcactttcgtgattccatgtccttagttagtaatatgttcacctaaattaagccatgaatgtaaaacttaaattttaatgttttcaaggataaaattttagttcttctaaacttaattgttactaataaacgttaaaataatatagaacaggggtccccaacccccagactggtactggtccgcggcctgttgggaaccaggctgtgcagaaggaggccagcagcggcgagtgagcattactgcctgagctctgcccccgtcacatgagtggcggcattagattctcataggggcgcaaaccctgttgtgaactgcgcacgcgagggatgtagattgtgcactccttatgagaatctaatgcctgatgatctgtccaccatctcccattacatcaccctcagatgggacctcctagttgcaggaaaacaagctcagggc

SEQ ID NO: 15164 - DNA, 1030 bp, Homo sapiens
tgggcgacagagcaaaactccgtctcaaaaaaataaaataatagaaataaagtgcacaataaatgtaatgtgctcgaatcacctagaaactacccacccccccaccaccccccaaccatctgtggaaaaatcgtcttccacgaaactggtccctgttgccaaaaatgttgagggccactgatatagaaagcaaagcaaagcatggtaaattctctgaggctgccaccttcagcctttagagtatgtaggaattgactcatactcttaaataagcaaaaatggagcgccactagggttatcctgttaataacgtgttgttttttcaaatatgaatagtttttgtctcgctagatattttgcaacatcaaaatgttccattgtaatggcatattttagtttacttagttttgttactttatgtgaaaaccattaactctttctctgttaatataggtctaaaacaggctttggaaactgtgaatgactacaatcctctgatgaaagatttccctctgaatgatttgctgtctgccacggagctggacaaaataagacaggcgcttgttgccattttcacacatttgagaaagatccgaaacacaaaatatcctattcagagggcactgcgtttggtggaggcaatttcaagagacttgagttctcaattactcaaagtattgggcactaggaaattgatgcatgttgcttatgaagaatttgaaaaagtaagtttgaatatataagacaaccaacctcaagacattgagatgaaaatatgtcttaataataagcctcacttttgaaattatatcctaggttatggtagcatgctttgaagtttttcagacttgggatgatgagtatgagaaacttcaggtattgttgagagacatcgtcaaaagaaaaagggaagaaaatctgaagatggtgtggcgtatcaaccctgcccacaggaagctgcaggcccgccttgaccagatgagaaaatttagacgccagcatgaacagctaagagctgttatcgtcaggg

SEQ ID NO: 15165 - DNA, 1050 bp, Homo sapiens
agttttattgctgctacagctgaaagcagagcaggctctaggtctcagccacgaaggccttacccagagcctgcggctgccagcggaccagatgcatacgacagcgaggctggctccccaggcacaggaggagcttaacagagcacgtttacttccttctcccagatttacccatcagaggccacctctcccattgagtgggagtaagggaagagaagctggggaggctccatgcattttcctttcctctgcaaggacatgcgagtggggattagtgttctcaccccagcagctaggattagctacttatggaagaactgtgcctggagcatttgtcaatgtataatatttgagaagaatgttatgtgagaataaaggaacagagtgtgagtgggtgttttaaatattaaatatttcttccttcaggtggatgatctgctgatcattgaagaaaaaatagacctagaagtccgttccttggaaacttgtatgtatgaccataagacattctcggaaatcttgaacagagtccagaaagcagtggatgacttaaatctgcactcctattccaatttgcccatctgggtcaacaagcttgacatggaggtaagggatagaatttgctagcattttcctcctttttcttctgctgaccctccagtaagcttattagtttgtcactaaaaagcatttttccttggaaattatctgtgatagttcaattcccctccaaaatctcatttaactagtgatagaactgaattgtggccaggcacagtggctcatcatgcctgtaatcccagcattttgagaggccgaggcaggcagatcgcttgagcccagaagtttgagaccagcctgggcaacatggcaagaccctgtctctactataaatacaaaaactagccaggtgtgctgatgagcacctgtagtcccagctactcaggaaactgaggcgggaggatcacttgagcccaggaggcggaggttgcaatgagccaacatcgcaccactgcactctagcagagtgagaccctgtcacacacacac

SEQ ID NO: 15166 - DNA, 2104 bp, Homo sapiens
tcacccaggctggagtgcagtggcaggatcctagctcactgcagcctcaatctcccgggctcaaacaatcctcccacctcagtctcttgagtagctgggactacagatacatgccaccatgcctggctaatttttttctttttaagtagagatgaagtcctgccatgttgcccaggctggtcttaaactcctggactcaagtaatccacctgcctcagcctcccaaagtgctgggattacaggcaagaaccactgtgtctggccagtcttacgtgttttataactataaagtgccttctctttcatggggctctaattaataatttctatcattgttatagaagaaaaaacttgatttattttttaactctcaaagctctaccgcaatggccagcgcttactggaaaagcaaaggttccagttcccaccttcctggctttatattgacaacatcgagggagagtggggagccttcaatgacatcatgcggcgaaaggactctgccattcagcagcaggtggcaaacctgcaaatgaagattgtccaggaggatcgggccgtggaaagccgcaccaccgacctgctgactgactgggagaagaccaagcctgtcacggtgagtcccgccaggtggggacgcaggagactcctcacccagcagtgtgatttggtgactttctttcaagcctaaaaggccttgctgtgactgagctttctagtattgaagactcttttcctttttgtagttaaaaaagcagatggagatagcaaatgtgaaaatatgaagcccagcttagacctctttttactcagaatggcattcagtagctggttttaaggattaaagtttttctgttcttagatcattctcttacgtagatatgcgcagaaattagagtttaatttcctgtagacaaaggccaagctttccactgctgctgctagttaatttaattttggttggatggtctctgtttttgccagtgctgccagtggattgtggggaggcaggttctgttgtcttcgtcattgtagccatttaaaccttccaccacccagaaactgccacatccacttttcttcatgcattgaagtatttattgagcaccgactgtgttccaggccttgttctaggtcattgagatatagcagtgagtgaaaaggacaagagcctcctaccttcatggaatcacgctccgtgggagagagaaaaaaaatgagcaagaagagacaggaaaggcaggtggtggtgctgctgcgacagaagcagatgagagggcgctggctcagtggctactgctgtgcctgggagggtggtgtggaagggggctggcaactcatgctgatagcagaggtgatgtagataacagtgtgtgtggttactggaagtggaattcaaaattttatttattttattttttgctccctttgttatttttatttgttattttctaagagtgcatgaaattatctggagagcatataaatacaaatgcctggacccctctcccctctataaacgctgatccgataacacaaacgcctggacccctctcccctctataggcgctgatccgataatacaaacgcctggacccctctcccctctataaacgctgatccgataacacaaacgcctggacccctctcccctctataagagctgatccgataatacaaacgcctggacccctctcccctctataaacgctgatctgataatacaaacgcctggacccctctcccctttataaatgctgatccaattgggttatggtgggtcccaggcgattggtttgttttctttttaattttcaaatttttatttatttagggaatataagcatagaaaagacaaatggaaaagatgtgaacatattttgaatattaatctgtttttctcatttggggatgtaagtttcccacagtaggcctaatgacaatgacagatttagccttccacaaagatctgctggttaattgtcccatcctgcctgtaaccgtttccgtgctgctgggcccctgcaggttctactgtgtgcttaattttgatttgatggtctctgcttttgccagtgctgctgttactgctaggttatgagtg

SEQ ID NO: 15167 - DNA, 1061 bp, Homo sapiens
ctatgagtttgttcagaggcttctgaaaggttacatgaaggtaggtggccagtatcgcacggtgatgagtgtccattagaaacgcacctgcacagatcactttgtttactttctccacagataaatatgctggtgattgaactgaaatccgaagcacttaaagaccgccattggaaacagctcatgaaaaggcttcacgttaattgggttgtttctgagctaacccttggccaaatctgggatgttgacttgcagaaaaatgaagcgattgtcaaggatgtactgcttgtggcacaaggggagatggctttggaagaatttttgaagcaggcgagtaataggactgaacggctgctttacgttgtgtttcgggctgttacatagatctgagctatgtaaaaatggagccttgtcatctgtggtccttttggttcttataatgctgggtcccttgtgcaggtagtgaatgcccacatattgataacatgcatctttctggtttgaattcagataagagaagtgtggaatacttatgaactagacttggttaattatcagaacaagtgccgcttgatccgtggctgggatgacctcttcaacaaggtcaaagaacacatcaacagcgtctcggccatgaagctctctccgtattacaaggtgctgttgctggggaagctttccctccccaccagtggtctcccacgctttcactgtaatgccttttcactgacagttactaggtacctgttttttattgtattttttgagacagggtctcactctgtctcccacgctggagtgcagtggcaccatcacagctcactgctgcagccttgacttcctgggctcaagtgatcttcccacctcagcctccaggtagctgggaccacaggcacatgccaccatgctgggctagctttttattttttgtagagacagcatctcactatattgcccaggctggtctcgaactcctgggcttaagcagtccttctgcactggcctcctaaagtgccgggattacaggcgtgagtcaccacagccagtcaatacttgttttt

SEQ ID NO: 15168 - DNA, 1081 bp, Homo sapiens
tcattgtttaaatatttaaatcgttaaatataatgtatttcagcataaagtgagcagcttgaatctaactttgttctggacagttatttatccaattgttccaacattgtttactcatttggagacggagtctcactctgtcgccaaggctggaatgcagtggcgcagtctcggctcactgcaacctccgcctcctgggttcaagcgattcttctgcctcagcctccctagtagctgggactacaggcacccaccaccatgtccagctatcttcttaaatatttcagggtctaggttctttaatgtaaacatgttttgccacattttaccttttgaccacttctctgtgtcttaagatatttacgtgtaccttccatttttctcattgccataggagagattcacccaggatacacaacctcactatatctattcaccccgtgaaatgactaggtgggtgagaggcatctttgaagcgctgagacctctggagaccctgcctgttgaaggcctcattcggatttgggcacatgaagctctgcgtctcttccaagataggtaagggaagccgaggatccagttggtcccattctcccctgctctgagttcttacagctgtcgaagctggggtctttgcaggggtggtctgcctaagttagagccaggtggtgccagtggtggaaggagcagagtcagccagggcagcctcccgtctggacactggtcacagttgccccagggtaacaaagtcacagtgcgctgaatgcaccggctggcccaccactgtctgcttacacaaggcactttcataaaccttgtggctgtgaacagggtacttttttttttaaagatacatcatagaagtcaaaaaacggggcactttaataaaccttttaaactgtcaggtgggaccacaaaaggtagcagctgcctgtgataaccttaccagagcacgggttcactgctgagttaaaaggtctcccaacaactgcccagtgtgcgtgttccgtaaccaccacccctcttcctgtttctcagtctgtgttctcatcaaaggctttgcagctgcagctctggggca

SEQ ID NO: 15169 - DNA, 1022 bp, Homo sapiens
ctttgggaggccgaggcgggcggatcacgaggtcaggagatcgagaccatcctggctaacacgatgaaaccccatctctactaaaaatacaattaaaaaaaaaaaattagccagccttggtggcgggcgcctgtagtcccagctactcaggaggctgaggcaggagaatggtatgaacccgggaggcggagcttgcagtgagccaagatagtgccagtgcactccagccttggcgacagagagagactccgtctcaaaaaaaaaaaaaaaagtgagactctgtaagtaagtaagtaaataaataaataaataaaatttcaggttgcctaagctgtcatgagttcagcttttaggttcatccatgcatagtaaaggaagatgtgtgataaagactgactgcatcctttggaagagcccacagcacccacaaacatggtgaacatggtgcttcttcaccgtgccctctagttacctaaatgcacatgctgctctccccacagactcgtagaggatgaggagaggcgttggactgatgagaacatcgacacggttgctctgaagcacttccctaacatcgacagagagaaggcaatgagccgacccatcttgtacagcaactggctgtcaaaggtagcaaactcgcatcatttcagacatacttctttttctgccatccctttctaacactaacgaattctaacgaattatcttctactcaaaaatatctttaggctgggtatggtgtctcacacctgtaatcccagcactttgggaggctgaggcaggaggatcacttgatcccaggagtttgagaccagcctgggcaacatagtaagactccacctctacaaaaaaatttgaaaatttagccaggcaaggtaactcacgcctatggtcccagcaacttgggaggcttgagcccaggaagtcacagtgagctgtggtcacaccaccatactgcagcctgggtaaaagagcaaaaccctgtttcaaaaaatacttcagaaaacaaaatatcagcc

SEQ ID NO: 15170 - DNA, 1026 bp, Homo sapiens
aggctacaaaaaaaaaaaaaaaaatagggcaggccctcacacctggttcttttctggagggatctttcctgttccaaatgaaatacagaaatggcttgtcaggttgcaccaggacaataagcacctcccaccactgagattttgactgggattacattgaacttatggatgagtttgatggaactggcatttttatagtagagtgtttttttcctccatgatcatggtatgtctcttcatgtattgaggtcctcttcattgccttttggtgaagttcagttttctctataaaagtttttcatgtttttagatccattcctagtgaatttatatttttttgctatgttataaatgataccttttttgttgcatttttaacagtttcttcatggtatgtggacatacagttgactttggtctaataactaacatttttttctaagtaatttgggtattacctttttttctataggattacatcccagtagaccaagaagagttaagagattatgtcaaagctaggctgaaggtcttttatgaagaagaacttgatgttccgctggtgctgtttaatgaagtcctagaccacgtgctgaggattgacaggtgggcttttttgttgttacagccccacctctcgcctaagctgctcttgagtaagtgtgtgtgccgggtcacaccaggcctcatgctgtcctaccacctccacctcagccttctccaccaagcagcttcccccttctcttctttctaagtccagcttaaccatcctcagtttatcctaagcagaacttcattcttcctcccccagcactgcatacctgccataattatggccctttgaccttctgctggaattgcattagtctctcatgtcagtctagaggacaggaccgtgtcttactggtctttgcattcctcctggacttcacaaataacagttgctcagcaaatgtttaatatacaagttcaagttaaaacatgtccaaaatactgtagacactagatatgagtcaaaaggggaat

SEQ ID NO: 15171 - DNA, 1050 bp, Homo sapiens
ctggctgtaaaaatgaaaagatagcatttataatggatgaatctaatgtgttagattctggattcctggagcgaatgaatacccttctggccaatggagaggtaattaggtgacgtgttgcgttgcattacgtgttaccgggggaccagtaagtcagcactgtgctgtttcccaggtgcctggtctctttgaaggagacgagtatgccaccttgatgacgcagtgcaaagagggggcacagaaggaaggcctgatgctggactcgcacgaggagctctacaagtggttcactagccaggttatccgcaacctccacgtcgtgttcaccatgaacccgtcctcggagggactcaaggaccgggcagctacatcaccagcacttttcaacaggtacgtgggcctttacttggctctgggtcaggaaagtcggtgtccttccaagggacaaagcctgcccctcatagctgtcctgaaacatgggcctctttctcaggtgtgtgttgaattggtttggagactggtccaccgaagcactgtatcaggttggcaaagaattcacaagtaagatggatctggagaagccaaattacatcgtgcctgattacatgccagttgtgtatgataagctgccgcagccaccatcccatcgggaagccattgtgaacagctgtgtgtttgttcatcagactcttcaccaggtgggttcagttttgagatcaacagataaaccacaaaactaaccatcatgctaatataaaactaaattgctataaaaatagaccttaaggccaggtgcagtgactcatgcctgtaatcccagcactttgggaggccaaggcgggaggatcacttgaacccaggagttcaagaccagcctgggcaacatggcgagaccccatctctacaaaaaatacaaagaaaattagccgggcatggtggtgggcacctatagtcccagctactcaggaagctgaggtgggaggatcacttaagcccaggaggcagaggttatattgagctgagatcacggcactgcaatccagcctgggc

SEQ ID NO: 15172 - DNA, 1045 bp, Homo sapiens
atcctcagtttagagaagttaaagggcttagagaggtttggaagtgtaaggggtatctcgaaagctctaagtggctaagctgaggcccgactcgagtgttctggccccgagggccaggctccttctatcatgtcacacccatctgccaaggccaaaattgttttctgaggttaagtcacagagtttcctgaagagtgagaagatgtaactattttctgaaaggcgaatgctcggctagcaaagcgaggcggcagaacgatggccatcacccctcgccactacctggacttcatcaatcactatgccaacctgttccacgagaagcggagcgagctggaggagcagcagatgcacttgaacgtggggctcaggaagatcaaagagacagtcgaccaggtgcgtcacaggcacaaattcctcacgggagtgagctgcagtgaggacccctttccatataatttctgcatgtttctcgtctctgagtgtgggctttgctctttaggtagaagaactgcgtcgtgacttgaggataaagagccaagagctggaggtgaagaatgcagcagccaatgacaagctgaaaaagatggtgaaagaccagcaggaggctgaaaagaagaaggtatggtgtcagggaattctggcctgtaaggactgagcattttcagtctccaatgagagagtaggaaatgtagttccaaatgggtcttagggttagagagagggagggagggagagagagtgtgtgtgtgtgtgtgtgttggcagagtgaagaatgttgtttagaatttagtcagcaaattaaccaatgcttaacccatacctaagccatccctcctttctaggttatgagccaagaaatccaggaacagctgcataagcagcaggaggtaattgcagacaaacagatgagtgtcaaagaagatcttgataaggtggaacctgccgtcattgaggcccagaatggtatgtaaagactgtcagagctttgatgtctaggaagggtggtctccgtcaacattactgtggagttcaggtcactgaa

SEQ ID NO: 15173 - DNA, 1023 bp, Homo sapiens
gtctagaaggatcgtaaacatgaaaaagctattctaacagtgcaggatgctgagaggatgattgtcccagaaggaaaaagatttttaactatggccctcttggtgtatgactcaagctacctcctcatgccaatagttgttcaaaaggatgaggtgatgttagcattaagcatgtaagctttattggtaaacctgaaaacgtctccggaaaccactctcgggtggtggtaacagcctatcaatcagggtctctcatcagggactcggctaaccgtgatcctgtgctttccccattcggtgtttcaaccttctcttctgtggcctcatcctcaggtatccgctgatcattgacccctctggacaggccacagaattcattatgaatgaatataaggatcgtaagatcacacggaccagcttcctggatgacgccttcagaaagaacttagagagtgcactgagattcggtaacccccttctggtccaggttggtgttggcctttgaattcttgaaacactgcattcaagagtgaattcctttttgggggctgcctttagttttcaactttgtaagacttcattttgtatcagaaggataaagctttgcggtggttctgtaatagataaattcaacagaatcattatttgcatttaaaattctattcagtggtcgggcgaggtggctcacacctgtaatctcagcactttgggaggccgaggcgggtggatcatctaaggtcaggaattcaagaaaagcctggctaaaccccatctctacaaaaaatacaaaaattagctggttgaggtggctggcacctgtagtcccagctactcgggaggctgaggcaggagaatcacttgaacccgggaggcggaggttgcagtgagccgagatcatgccactgcactccagcctgggagacagaaagagactgtatcttaaaaaaaaaaaaaattatattcagtacagccataaaaagcaagaaacagccaggcgtggtggcttatgcctgtaatcccagc

SEQ ID NO: 15174 - DNA, 1035 bp, Homo sapiens
ctcttgggctgggaccccttcctggactgagtctgctcaccttggattaggccacctactgcttcttcctcttccttttctcaggctctgcaaggaagagctccagcttcctcttggagaaggagattctgggccccttttctctctcccaaacctaggtggtggccatgcccctcgagctctgcttggcacgtgtctgccagtctcagggggctccatgggagtgaggaagggctcggcggccctgggggtctggtcctcctccgccatcctcgagtcctcgggctacgtgccctcatctttggcttccagggacacgggcccagctggccacttctatgacaagaatgtgggttttttgtgacagggcgtctactatatgaacttcctctggactctgacttcagtgtgtaggaagccaccttacagctcatgtcacccagagaacagtcgttgcagctccagttggaatgactgggggtgtcttccgaatcgccatcataaagatctaaaagctgaggacaaaagtgtttctcagtccaagagcagttctgcgaggcggaatcaagtctaacatgctcgcatgcgctgactcttcctcccgtcactgatgctggtttttgcaggctctgccttgcaaatgaatttttctttctttttttttttttttttgagacggaatcttgctctgtcgcccaagctggagtgcagtggcgcaatctgggctcactgcaacctccacctcccggattcaagcgattctcctgcctcagcctcctgagtagctgggactacaggcgcccgctaatttttgtatttttagtagagacggggtttcaccatattggtcaggctggtcttgaactcctgactcaggtgatccacccgcctcagcctcccaaggtgctgggattacaggtgtgagccaccacgcctggccgaatttttatttgttttttgtttgtttttgttttttttaaaaaactgagtctcgcactgttgtccaggctggagtgcagtggcgcgatctcggct

SEQ ID NO: 15175 - DNA, 1050 bp, Homo sapiens
ccaccatgcccagctcatttttgtattttaatagagacggggttttgccatgttggccaggctggtcttgaactcctggcctcaagtgattcacctgcctcagcctcccaaagcactgggattacaggctctatgttcttagagcatcttgtgctttgccttcctagcacttttctgaatttgtaattctgtgtgatgatccaactgtgccttctataaaacaaagctcccttagaatagggacattatctttcctgctctccatcttctcaatgcacagtgcagtgtccagtttagagttaggcccttgctgtgtacttgttgagtgaatgactgagtaaagccatgtctgtctataccaaacttgaaagagatctttagaagatgaaaaacctattcagttttgggcccaaaagtaacttgggtattttttaatagctcatatcttttaaaagacatttaaaaatattgctagtaggtaaaaaatttaaccttcttaaaatagggaaatcgtgtaagagacaatgaagtaatagtaaacaaatgacacagattacttttgatctacttctgtcaaaccatgtcacctacaagatccatgtacaacttttaaaaactgttctcaggccaggagtggtggctcatacctataatcctaacacttttgggaggccaaggcgggaggattgcaggggtccagcctgggcaacacagtgaaacctcgtgtgggttcgagaccagcctggacaacatagtgaaaccctgtctctacaagggtgggcgtggtgtcatgtgcctctagtcccacctacttggaaggctgaggtagaagggtcacttgaactggggaggttgaggctgcagtgagctgtaatcgtgccactgcactccagcccgggcaagagagtgagagcctgtttcaaaaaaacaaaacaatcaataataaacaaaaactatactcagaattacttaacattcaagccaaagaaccttcctaccttcccacatcttaagattccaggtcacaaatgtactgcccagagaagttac

SEQ ID NO: 15176 - DNA, 1026 bp, Homo sapiens
gccaaatcagtttgtgttacagcttatcttgctttgtatcaataggaaaatagcttaaatatataggttttataagaaagaagcaagaatcattcatgaggaaggaatttataaggattttatatttacaaagtaagaatcaggcctggcataggattacatcacgcctgtaatcctagcacgttgggaggctgaggtgggaggatttcttgaggctaggagttggaaacaagcctggacaacatagtgagaccccatctctacaaaaattaaaaattagctgagtgtggtggtgtgcgcctgtagtcccagctactcggggccgaggtaagaggattgcttgagcccagggtggggaggtcgaggctgcactgtgattgagccactgcactccagcctcagcgacagaatgagaccatctcaaaaaaaagtaagaataattcagtaagagggaatattttaacatcttagttaccgcattgtagattattgctctgccatgaagctgtttttttctttagttgactcacagccagcttacccttttactacccttttttgttctgctacagtaaaacttgtacaggtgctcattctctttacttacttggatctctgctttagagctctgtcttgccttaatatttcatttaataaatatttgagtagtttttgtgtgaaaagcagtatgccagactttgggaaatcaaagaagtatgaggtatgggccctgaccttaagagtatcatctaaccaaggacggacatgatattcacacactcattctaagaggacttactgagtgcctgctctatattgttaagaatctctgctgtcaaagagttcacagtccaatggaataatcaagggcttattcattcaactaacatttattggacctgtggatccaaagataaataagacatagtccctggcccaaagtgcctacagtctagtggtgagacagataagtaaaccagcaatgataaggcagctgctaaaaggcattcagaactgaacattgcc

SEQ ID NO: 15177 - DNA, 1023 bp, Homo sapiens
cttcatgttccttgctgatgttcattttgttgcctgcttactgactagtcccacctaaaatctacaagaggagggctttatctgtctttgttggtgagataccaggatctaaaatggtgcctgaagcatatagaattcaataaatattggatgaatggatagtggatattctcaagtaacttttttttttgaggtgaagtctcactcttgtctcccaggctggagtgcaatggcgtaatgctcactgcaagctctgcctcccgggttcaagtggtcctcctgcctcagcctcccgagtagctgggattacaggcgcctgccactacacccggcttatttttgtatttttagtagagacagggtttcaccatgttggccaggctggtctcgaactcttgacctcaggtgatccacccgactcggcctcccaaagtgctgggattacaggagtgagccaccgcgcccggcctttctcaagtaacttagtgagaaagtctgcattgggaattaggtattgtgacgtctcataggcctattttattttttaataggtaatacgttcacatggttcaaaattcaaagagcatgcaatgaagtctctcacactttgccctccagtgccaccctgtccccctcctctgaagtaaccagtattaagttcttgtatgtatttccagagatagccaatgttttaatacacaaaattacagatatagttttcctcctttataaaaatgcaaactttagcatctgcactgttttacaccttgttttgatttgtatacttcggagattgttctttgtcaataaagacattattgtgtaaaagcatctttaatgcctgtacaatatcccattgtgtacatttatcataattcttcttttgatggacattgatgtttctagtctttacacgctatactgcaataaatcactttgtacatacatcattttgccttgttgctagtatatctgaggaataaattcctgtgaggaattgctgggtgaaaaggatatgtgcat

SEQ ID NO: 15178 - DNA, 1109 bp, Homo sapiens
aaaacaaacaaacaaacaaaaacaaaaaacaaaaaattagccaggtgtggtggcaggcgcctttaatcccagctactcaggaggccacggcaagagaaacacttgaacccgggaggcagaggttacagtgagccaagatcacaccattgcactccagcctgggcaacaagagggaaattctgtctcaaaaaaaaaagtgttgactagacagaaggtgatattgctgttggggaggatggggctgaaccctggagggcaggggtgctaggtactttttcctacattgacttgatagaaattaggaggccacaggccaggtgtggtggctcacgcctgtaatcccagcactttgggaggctgaggcgggcagatcacttgaggtcaggagttcgagaccagcatggccaacatggtaaaaccctgtctctactgaaaatacaaaaattagccgggcatgttggtgcatgcctgtaatcccagctgctgaggaggctgaggcacaagaattgcttgaacctggaaagtggaggttacagtgagctgaagtcatgccagtgcactgtagccttggcaacagagcgagactctatctcaaaaaaaaaaaaaaagaaaaaaattaggagacattttgattagagataagatgtggctggaattaatgaataatggtagctacccaaatacttctgtgtgctctgtgctttctgttatctgcagccttcaccattgccttgcaggggaggggtgggcctttgatctcctattagtgagaggaaacttgcactttgcccaaggccacttggctaccaagagggaaggcaggatttgaacttaggcttgcctggtctgggctctttctctcgctaccagactgcccctgcctgggaagccatctgccaggggctgatgaccccatggggaagaggaatagctggcttgggtggttactcctgctcctaaaaaggtatgtgagctcagagtgcatgttggcagacaccccatcccccgccccccagaagaggaggaaataggatggtcacttatcagtggaaattgagttagaactcagtgattaatggaaagaggacaggcgagtgggagacggttgt

SEQ ID NO: 15179 - DNA, 1036 bp, Homo sapiens
cctcctacctagtatgcccaagtttaaatgtggtggattaatttgttgaccttacctgttcttccttggggtgactgttttgtgcatttttatggagcatgctcaggtgtctataacaggtgttttaaaactcttctataatggagatagggacagtactgtaactcggtatttataatttaagtaagaaaatgtggaattccaaagttggttcacatcaccagaacatttcatgcagatcaaagaacttgatgacatttccttaggctgcttaaattgtagccaaagcttttgtatgtatgtttgacagtcatttggctaaggagtacttcacttgctcttgaaaatagttactgtaaactcatctttgacatagttggaaatcctggcgcttaaagtttggtcacatgacatagcttttgccagtgttgtagtatgtactggggtttctagtatcttcaatttcattctggaaagagcctgagatatctgagctgtctgttcaggaacatgtcaggactgttaaatgtggcatatagaaattgccaagtagattatattttttaaagctgttggagcatctttcagcctcaagtattgctatttcatatttaatattcttcctcgtctgtttcagtatgacttttctaccaagtggaaaagataaggtaggcttgctgagttagaagccctgggttccaatctctacttgggaccttgcccctgaggcgcaagggtcaggctatgtgggaccccctcccttttgcattgttgcatggttttaacatcattaacttggaacaaaaacacattatagagtatggtttttaagaaataattttgtttggggaagaaaattcaaattgacaaatggcagttaaaatttggattcttttgcagttatggtacttgctattcatgcaaatcagtatccacccagggtgctcctgtttgacattgccagtggatttgataagatcttatgaaccatgccatctcttctagtttcctctgagttgactggaaacaaaacttg

SEQ ID NO: 15180 - DNA, 1179 bp, Homo sapiens
ttttatcatttctgtatacttgagtttattagagattgttatgttaggcgacactgtataaaattgtatggatattttgagtgaaaatcaaaagtaaaattcacatgtatttccttttttatattttcatccaatttcttgacaacttgaataaatttcataaagagccttcctaacatgaaatattggtaaattaaattctttactgttgcaataattaatgaaactttagtatcagtattgttttataattttaaggaaatcatgtttgtttcactgctttgtttttttttttagctgttgccttgtcactgtcacagctaacaagacttactacatacttgatattctgaagtactgtggggctgtcctctgtatactgacattaaataaacgtgtgtgagtgaactgtaaatgtagataattttcagtagtcattttcacatctaagctttaaaaatcccagtgaaccaaaaccagaaaagtttttaaatgctgtaaaattaaggaccttgttaatgtttatagaacagccagccaccggaattgctccctcttactaaagctgactgtttctcatagttggcagcgtactcgatgaaatgttctgcgtctcagatactgttttatgtggtcctcctctgtgccaactccagtccgggagaaggactgttgattggcgtttcggctgagctgtgtagaggcttctgtttaatgagaatgcagacattctgaagtcgtcctgggccacgagctggcttttgttacatggactcactatcccggatgctggacatccgacattctgtccagccacccagccagcagctgggagagtggagaaggtagcggctggtaggctgcttgcttttttttattttgctgtaagttctgggatatatgtgctgaacgtgcaggtttgttacatagggatgcatgtgccacggtggtttgttgcgcccatcaacccgtcatctatgttttaagccccgcatgcattaggtatttttccttatgctctccctccccttgcccccaggtaggctgctttcagtaggagctcttttcctggctagagttcattgtctgcctactcctcatcttgaatagtgtttgcttaaggctttgtgctggcgtgaggttgtcctgctgtagacaccaggcccgtcgtcggtgcag

SEQ ID NO: 15181 - DNA, 1117 bp, Homo sapiens
taccctgctgaatatggccacagctttttgggtttggaatccaaaaatgacatatttttcgtaaagcaaaagcaaacttattcgagcttaggcagcatgatgggattgtattttgtagctaatctaatggagacgatataaattctacctgcaataatatacctttgcagcacattcttttaatactctttcagccccagctgtgtcatggaggccacaaaggcaaaccggatgcgtactttgcccctcagtagtttatgaactaacaggagatgaaacaagacccagataacttctagtcaaggccagaaagctaaagatagtgaaaaagaactgaatgtatttagagaaagggagattgttcctggctgaggacatcagaagcagctttgttgaagaagtggtatctgaactagatttgaaagggtgcgtctgagttgaaaatgcagaaggggagaggcaggttctggggcggttgggggtgcatttcaacaaccacagcagaaggcccagtgttcgctgtgggggtggtgtggatcagcagcacagaccaatggacacacttgggtcagatcgaggcccctgtctctccccatcctccctcttccccaccccacagaaatttccagttccatccaacatgctgtgccccttttcatgcatccgtgcatttacacatggatgtgtgccctttttcacctggcaaaaattcccagccttcaaaatgcccctcagagatcacagcttctgggcagcccaccacctctgggctgttcctgcctcttgattgcacctgttgtaccatgatgacatttttcctgtctgcctcacctgtctgcattccttagggaagcttgtctgccttcagaatcatcagtggagcttttgaaagggcagatcttggggcctcaccccaggagatccgattcagcaggtctgcggggactgaggtatggcaggggaaaccgcccccatctcaagggtgaggttaggacttggctcctgtgtatgtattccacccagaaatactgagttaacattagctgaattaactaaacaaagtatcaagcataatacccacagggtaagccagtgaggatagaggataaatacatta

SEQ ID NO: 15182 - DNA, 1683 bp, Homo sapiens
cctacccatgttaatgtggataaaattcacgaagcaaaatgaagtaaagaaacccagaaaagccctttcaagttgcaggagatgatatcatttatataaagtttaaaaacatttcagaactgaactatatatttttagaaatatctgcatatgccacataaatttttaaaatcataagaatgctaaacagcacattcaggacagggtgaagaaacaggcatgcaggttgtgcagtaggaagctgggtaacattgttccttatggctttgttgtcgcttccagaatttcattaaaaactttttaaaaaacatgggcccacattatgaattacgtctgcttttagagtactaaaaactccaagcaaaaacacatgggtaacgccgggcacggtggttcatgcctgtaatctcagcactttgggaggctgaggcggacagatcatgaggtcaggagtttgagaccaccctgaccaacatggtgaaaccccgtctctactaaaaatacaaaaattagccaggtgtggtggcaagcgcctgtaatcagggctactcaggaggctgaggcaggagaattgcttgaacctgagaggcagaggttgcactgagctgagatagcgccactgcattccagcctggaccacagagcgagacttcatcttaaaaaaaaattagctggtcatggtggcacacacctgtgatcccagctattcagtaggctgaggcaggagaatcatttgaacctgggaagtggaggttgtggtggcactccagcctgggcgacagaacgagactccatctcaaaaaaacaaacaaacaaaaagccagccgggtgtggtgaggcaggtggatcgccagaggtcaggatttcgagaccagcctgaatggtgaaaccctgtctctactaaaaatacaaaaattagccggggcgtggtggtacgtgcctgtaatcccagatacttgggagactgaggcaggaaaattgcttgaactcgggaggcggaggtcgcagtgagccaagatagtgtcgctccactccagcctgggcgacagagcaagggtccgtctcaaaagaaaaagaaaaacctcacatgggtaaaactgttaggaaggctcttatctcttcactggtcatgaaatcaacttagtggattatgactagtattttttaaaaagtgatgtagaatagggctgggcgtggtgtctcacgctggaaatcccagcacttcgggaggccaaggcaggtggatcaatcacttgacgtcaggaatttgagaccagcctggccaacatggtgaaacccgtctctaccaaaaaatacaaaaattagctgggtgtggtggcagctactccggaggctgagatgagagaatcgctgaaactgggaggcagaggttacagtgaactgagatcgcaccactgcactctagcctgggtgacagagtgagaccctaatctcagaaaaaaaaaaaaaaaatgatgtagaatagatacaatcagcgggcatttatatagggatggtaagtagttccatcaactttattttatttatgtatgcagatatttatatacacgtgtactaggtcataatgtaaaatgtatcattgtggtctctgtttttgtttttgtttttttcagatggagtctcactctgttgcccaggctggagtgcagtggtgcgatctca

SEQ ID NO: 15183 - DNA, 1097 bp, Homo sapiens
taagtgaatgactcctttcccaatcctatttgaaggcatgggaggcagaataggtagtaagtgttaaaggatggggtgtcctggagtcagagccgggcaggtcccagcggccccttcctagctctgtgctggggcaagtgccctacctcactccgctccagtttcatcaccagtggaatggagatgagaatagtttctacctctggcttggtaagaggattaaatgggtcagtgcatgtaaagttaagcacggtgcctgccgctgtacatttcagtaaaggggagcccctgctgtcatctgtgctagcctgcgttctcgccctctagtcccttctgatatgtctctgacttctcatgactttagtttctccttctctacctccatttctcttccctgcacttttttcttcctctcttattgggattcaggaattttattctgttctgtgacttatgttccatgtgttggcagaatgtgggataccagcctgggtgcatccttttctcatctattggagtgaccagttgcacttgtggactgcctccttgcagccaaggtcttgtagacagagttctgggaaatctcaaaacgcaaatcccaggcataggtagaatctgggaatgaagccactgtagctccttgtgatcaccagcgattcctggtcttttaggctgcaggactttgtgttttctcacacccagctataatgtaccttgataaacctctgaccttatttttgttgttgttgttgttaacctgacttacgtcccatattggtggttatttggccatcgtgtgccagcactgtgccaggctggctctagggatgctgtggtgaaccagacagacccttcctgaggtcactgcctcagaaagatcatggtctggcccatgaactttaaaagggagaactaagtgcaggtgtaggggacacacaaattgaattttcaggactgccttggaaaaccagtggtggggaagatggaatgaggataaccctcttctgaaggagtgactaggaagtagcttttgttaggcatcagctatattatacccacgtgtctttttcaatagaagactggcatctactggattt

SEQ ID NO: 15184 - DNA, 1031 bp, Homo sapiens
gatcaccatcttaaaatccatgcacagaggcgtcctagtcacactgctgaagatcacagtcttaaaatccatgcacagaggcgtcctagtcacactgctgaagatcaccatcttaaaatccatgcacagaggcaccctagtcacactgctgaagatcaccatcttaaaatccatgcacagaggcgtcctagtcacactgctgaagatcaccatcttaaaatccgtgcacagaggcgtcctagtcacactgctgaagatcacagtcttaaaatccatgcacagaggcaccctagtcacactgctgaagatcaccatcttaaaatccatgcacagaggcgtcctggtcacactgctgaagatcacagtcttaaaatccatgcacagaggcaccctagtcacactgctgaagatcaccatcttaaaatccatgcacagaggcgtcctagtcacactgctaaagatcacaatcttaaaaatagccagagaacaatgacgtattacctgtagaggaacaatgatttaaatgactgtggatttctcatcagaaactgtattagcccgttctcatgctgctatgaagaaatacccaagcctgtataatttataaaggaaagaggttttattgactcacagttacgcatggctgcggaggcctcaggaaacttacagtcatggtggaaggcacctcttcacagggctcactgtcacaagaacaggaggggggaaaccatgcccatgattcagttatctctacctggtccctcctacgacatgtggggattatgggaactacaattcaagatgaaatttgggtgaggacacagccaaaccatatcagaaacaatggaagctggaagacagtagcatttttttggttttttgtttttgttttgttttgagacggagtctcgctctgtcgcccaggctagagtgcagtggcgcgatctcggctcactgcaacctccgcctcccgggttcaagcgattctcatgcctcagcctcccaagtagctgggactacaggtgcccgcc

SEQ ID NO: 15185 - DNA, 1031 bp, Homo sapiens
aattataacacatgctctgttttccctctgcacacggtgacgtactcatagtggcacagagggagagtccaccctgcagagaggagccttcctcactgccatgtttagcactgctggggcacagtgattatgaaaagcaagccgcctgtcgttagtttcattattgtccttaaattctctggttgcccgcacccaggtggactcctttgacacaccactgtcaatacgttcctttttttccttctaacaactttatatttttccttttaagttacaacccgcataacataaaatttcagccttctacagtgtgcagctcagtggctttagcatcagttagcagcagttagcaccatccaattccagagggttcccatcactccaaaacagagagaacacccttacccattagcagtcacttcctgttctcacagaaccagcccctccgcccatggcagccactcatctgctttctgtttctatggctttgcctattctggacattttatataaattggatcatataatatgtggccttttttatctgacatctttcactttgtatcatgtttcggagttcatccacgttgtaggtgtatcagttcttaattcctttttatgactacatcacagctctgttgtatggataggccacattggtttatcatttcaccagtggatggacatttggattgtttctgcttattggctactgtgaataatgctgctgtcaacatatgtgtgcaagtctttagggaggatgtatgttcccagttctattgggtatctgtctgtaagtggaattgcaggtcatgtggcgattctgtgttgaactttttaaggatgtcaaagtgtttttcacagtggctgcaccatttgtgttccaccagcaagatatgagagttctagtttttcccatcctcaccaattttttttttttttttttttttgagccagagtttcgctcttattgcctagtctggagtgcaatggcgccatcttggctcactacaacctccgcctaccgggtt

SEQ ID NO: 15186 - DNA, 1032 bp, Homo sapiens
gtggcatgatctcggctcactgcaagctccacctcccgggttcacgccattctcctgcctcagcctcccgagtagctgggactacaggcgcccaccaccacacctggctaatgttttgtgtttttagtagagatgggttttcactgtgttagccaggatggtctcgatctcctgaccttgtgatccgcctgccttggcctcccaaagtgctgggattacaggcgtgagccaccatgcccggcctattttttatttttgagacagagtctcagtctgtcattcaagctgaagtgcagtggtgcgatcatagctcactataaccacaaacccctgggctcaaacaatactcctgcctcagcctccaaaatggctaggggtatgcaccatcacacctggctcattttttaatttttattttgtagagatgaggtcttgctgtgttgtccaggctggtgtcaaactactggtctcaagtgatcctcccacccctcagcctcccaaagtgctgggattgcgggcgtgtgccactgtgcctggccagttttgttttttggttttgggtttttttttttttttttttttttgagatggagtcttgctctgtcgcccactggagttcagtggggtgatcttggctcactgcaacctccgcctcttgggttcaagtgattctcctgcctcagcctcctgagtagctgggagtacaggcacccgccaccacgcctggctaattttttttttttttttttgagacagggtctcactctgtcacccaggcgcgtagtgcagtggcacaatctcagctcactacaacctctgcctcctgggttcaagtggtcctcccacctcagcctcttgagtagctggggctacaggtgagtgccactatgtatttgtatttttagtagagacggggtttctccatgttggccaggctggtctcaaactcctgatctcaggtgatctgcccgcctcggcctcccaaagtgctgggattgcatgcgtgagccactgtgcccagccacacccagc

SEQ ID NO: 15187 - DNA, 1061 bp, Homo sapiens
tatttgcggtatgccagcttgaccctatttaggtttgaaagcaaatggttggagctaagactatctgatatttcctatgcagttcaaaggaagatttaattctgtcatgccttacaaagagtgaatgaggtggatagagcacgttagtcttaaaatcctgattcagttcttttttttttttttttttgagacggtgtctcgctctgttgtccaggctggagtgcagtggtgtaatccgggctcactgcaagctccgcatcctgggttcatgccgttctcctgcctcagcctcccgagtagctgggactacaggcgcctgccaccacgcccggctaatttttttgtattttaagtagagacggggttccaccatgttagccaggatggtctcaatctcctgacctcgtgatccgcccgcctcggcctcccagagtgctgggattacaggcgtgagccgccacgcctggccctgattcagttcttataaaataattaatacctagattagatcggtgtagtgtggcattgcttggtagttagaataccatttgtgtttacactgaaataaaaagttttaccaacttttaaagagttaaaaaaaaaaagagttaaaaacctaagtgcagccctacacttttaacttaggctttgttcttacatgtgttgtccagactgcctttccatgctgtctgccgcagattatgctgagttgtcattggtttcttttaatattcagtagttacagaataatagggtaagaggggggatgcttatctatcctacctctggttggttctttcctacataagcaaagcatcacttattttgaaatgaataatgtttttctttccttttttttccttttttttttgagatagggtcacactctgtcaccagtatagtggtgtgatcatggcggcagtgaacttgaacctcctgggcgcacactatcctcccatccatactttacctcgaaagtagctgggactacagatgtccacgaccatgcctgactagtttttttgtattttttgtagagacaagagttttgccacgtagtc

SEQ ID NO: 15188 - DNA, 1050 bp, Homo sapiens
caaactgcagtgcagcttgcagttcagagaaaatctcagccagagtagattgttagaagagtctgttgggcaggaatggtccttctttgtgaacatctgctgtgttcagtcattggctgggagcagcctagagtagcctagccttggtatgggtgctgtagtagatttctggtagctggggctgtcagttaactacactccttgcaacattttctctcttgaagggaaatctgagtggcacactcaaggctgtcagaattcccatacgtgtttttgtacttaaatacatgtgtgtaattccagcactttgggagggtgaggcgggaggatcacctgagatcaggagttcgagaccagcctggccaacatggcgaaaccccgtctctactaaaaatataaaaattagctgggtgtggtcgcgggtacctgtaatcccagctacttgggaggctgaggcgggagaattgcttgagcccgggaggcggagattgcagtgagccgaggttgtgccactgcactccagactggacgacagagctagactccgtctcaaaaaaaaaaaaaaagtgataatatgttttcttgttattgttagtgtttttgtaaatggaataatctatgctattcatgtacttttatgctttccaaacaagtacatttccactagcaaggtaaacaactttgttttcaccttgtcttcgtcatggtgttagttaggttattaattttttttaaatgctatcctttaatggcttatattagcatttttttcttttcttttcttttctttttttttttttttttttggagatggagtttcgctcttgttttgttccccaggctagaaatgcagtgacgcagtctcctctcactgtaacctccgcctccccggttcaagtgattgtcctgcctcagcctcccgtgtagctaggattacaggcatgtgctaccacgcctggctaattttaaaaaatatttttagtagagaaggggtttcaccatgctggccaggccggttttgaactcctgacctcaagtgatctcccgcat

SEQ ID NO: 15189 - DNA, 1049 bp, Homo sapiens
gtttccatgtggccccaggtgttggggaattttatgtttcgggttgccagagccaacttgtagtccagttacattcctcttcttcctggcagtgagaacaccggtgaaatgggaggtggttagcttggttgcctggggacaaattggactgagttgctttattcctgcatgtatgttgaaatagtcatcttcacaacttagaatatagttggagttttttttagaagagccatttattttgatggtgtgactgaaggctatacatacagtcatgtattgcaaaacaaatgtcattttggtcaaggacagtggtcccataagattataatggaactaaaaaatttctgtcgcctagtaacttcaccttgtctatagtgcaacagcgtgtagcattacttaggtgtttgtgtggtgttggtgtaaacaaacctactgcactgccagtcttacaaaatctagcacatggagttatgtatagtacatagtacttggtaatgacaataactgtattactggtttgtggatttactatgctatactttgtatggttattttagagtgtattcctacttataaaaattatcagtttgctgtaaaacagcctcaggcaggtccttcaggaggtattccagaaggaaggcattgttactctagaatatgacacctccatgggtcttattgcctctgaagaccttccagtgggacaaggaaggtatggagttggaagatggtgatattgatgatcctgactgtaggctaggccaatgtgtgtgtctttgtggttttttttgtttttgtttttgaaatggagtctcgctctgttgcacaggctggagtccagtggcatgatctcggctcactgcaacctctgcttccctgcttccagtgattctcctgcctcagcctcgtgaatagctgggattacaggtgcgcgccaccatgcctggctaatttttgtatttttagtagaaatagggtttcatcatattgggcaggctggccttgaactcccgacctcaagtgatctgcctgcttcggcctccgaaagt

SEQ ID NO: 15190 - DNA, 1105 bp, Homo sapiens
attgatacagatagatctcagttggtctctgatcttgtttgtagggattttgttggatgaatgcaaggtgggatggtcttcagattgtaccaatttagctggcattgctaaccaactgttggaatctctgaaaataaaagatcttgaaattcctccccctctccccgcaaagagaaatacgaaggcagacaactgggtaaattgtcctacccctaactgccatccacagaaaagtaacattttgttttatttgattaactgtgcttgacaacattagaaacagtggaaaatcatctgggacttgggcaggtagaaactccagaggtaggactggaggaggggctgtgtaacctctctttcttactcttaagaataacctttttatctacccgagatttattggctccttaaaatcataactaaaacctgtagcctctttcagcagaaagcaatgcttagagtaagacttctactacactgccagcccgaaggcttgaacagaaggcaagtggaagccctaaaactttggctgttcctggcacgattccagtcccactctccctaccctcacccacagcttccccatcactgtctgcttgggaaccgtgagcattgttctcatcttgtgcttctttctgagttatcaggcagccggaaggccagattcccttgtcttccctcttttcatggactctgcattttcttttctgatcctgtttttcaccttgatcttcttggaacttttccctgagcccttttaaactcacggtatatcagcaaaattcccctaatcttcagtttcttctgtgatttccgccccccgccccacacattcttattctgactgaaaataggccatctcctgatgacactgcctccctgcagccctccgaaagagtacttgcctgcccctccatcccttttgtgttactaggcttcacagtagcatgtcctctttttctttgttgccatttctttacttttcttctcgcctccctaaaaacacctctgaatgtgatgtcatgagtttgtactatgcgctcctgatttttgctgcttaatccagtgtgctgtggaggattgaacctcttatgatggagttccc

SEQ ID NO: 15191 - DNA, 1050 bp, Homo sapiens
gtcagtaattttacaattaaagaaaaagttatctgaacaaagggagagtgcccttaaattgctaagagggagcattgctttgtttttttctagtttcgttgtgtcttacagtgttcaaacactgtactggaagtaaataattaagtttaaaataattttcttctccagtgtttgattatccatttctttttgttccaatttctgtatctgaaaaacaatattggcttcaaaaacgaacaaaaaaaaatttaacttcccccagattgcagatttaccatgtaaatgtgtttccaccctgttttcaagctaatgtgacaaatttgctacattataaagaacagaaacctgtgtacagattttggggatagcacacataaaatagtccaaggacattatcaactcaggtgcagaagttcttgctgaagttctattaacaattgtgtttaaaaacaccagatgggagcagatttaaagagggagattctaatggaaggttagttgggatttgtagggaagagagagaaggattttaattgaaaagatactagaccgtattcttacctttatagcgttgtcttcttttctttcttttctttttttttgagtcatattttcgttcttgtcacccaggctagagtgcagtggtgtgatctcggctcactgcaacctcagcctcccgagtagctggaattacaggcccctgccaccatgcccagctcatttttgtattttcagtagagatggggttttgccatgttggccaggctggtctcgaactcctgacttcaagtgagctactggccttggtcttctcaaaggttgggattacaggtgtgagccacctcgcctggcctatagtagtgtttttttttcttttcttttctttttttcttgagacggagtcttgctatgttgtccaggctggagtgcagtggcacaatcttggcttactgcaacctctgcctccctggttcaagcaattctgctgtctcagtgagtagctgagattacaggtgcgaaccaccacatccgggtaatgtttgtattttt

SEQ ID NO: 15192 - DNA, 1046 bp, Homo sapiens
cccgggaggcggagcttgcagtgagccaagatctgcactctagcctgggcgacagagcaagactccacctcaaaaaaaaaaaaaaaaaaaaaaaagtcaactttaaacaaagagacctgcctgtgttggcaccttcagcaaatattagtatctacccagaaattaatgacatttctttattttcattgtatttatattttttgatttacatatagcaaaactgaataatttttggtgcacatttttgtgagtgttaagacatgtatacaatactcctcccttatccatgaaaggtatgtttcaagacctctggtggatgcctgaaactgtgggtagtactgaaccctatatatatactatggttcttcctatgcatacatacctatgataaagattaatttataagttagacacactgagagatcaacaacaaaaaataataaaatgaacaattataacaatatgccaacatcgccaatactttggggctgttagtaagtaaaatacaggggacttgaacacaaatgctgcgatgctatgacagtccagctgataactaagatgacccaagtgactaatgggcacatagcacctacagaggggatgtggtgcacaaatggatgattcaggtactattcctggaattttcatttgaatgttttcagaccacagttgatcatgggtaactgaaatcacagaaagcaaattccaatgcggggcaccactggagtttcatataccaccaccacaattaggataccaaagagttccagctcctccaaaagctacctcagactttcttaagcttcctcacacttctagaccctggaaaccttggatctattcattatccctgtacttttgcctttttcagagtgtcgtatgaatgaacttgtactggcttctttcactcactgtaatgctttggaagtaggtctaggttgttgaatatattagtagttcactatttttgttgctgtgtactgttccagtatatggatgtactacagttggtttatccatttacgcattgaaaacatctgaat

SEQ ID NO: 15193 - DNA, 1046 bp, Homo sapiens
aagttgattgcctaaccgggtcagtgctgttaaaaggcggcatgatggaaattcaggaagtcaagtcaggagtatcttaacttgccccaaagagatggagaccatagaattgtgggcttagtgactggttcaggcagcctttaacatgcctgtaaagactattaaatgccgttaagtataggtgcactgttccatcatttactccacacgtttctgttgaacccctatgaggcactccgttgctgtgatacggtatcatctctcctcagtccccactgtgatattgtgcagccaccctttgcatggattccacaccctacctctgcacatcctgtttataccattccaggctgcccgcctttggggactccatcctcattccagttgatctgcaccctaaatgcccaccttgctcagccctacccaccagctttaggataccacctcttgccttcatgcagacaccactgcactgcgcagtgtacttttgacagtcccctcttgtcactgtgcttacgtgtagacctacctcaagtttggacttcgtttgtttagagaagcagctgaacgttaacaaagtgggcgtattagagtttaaaatatatgtagagtttaggccagattgtaggcccagtctggttccttttactgacttaggaaaaacaaagtttacccaggcacgtgtggttaaatataatgcaaaactgtggtccaagggtcttaatgaaatggatagattaatctgaggattttttttttgttgcttgattattattattttttttaaggtagggcttgaaaagaaggggagtggaactagaggggaagctcgggtatagccttgtctgttgtttatagtctgctttttaaaaatatataatcaactaaattgctcatgctgaatgatgttgatagttcccagaaggagcaaatttctcagatgggctgctgttgccttgggtgtagaatttagcaaggtgacttttggctattggatatccatagaaacagatggtcttgctcatttatgcattatgcattttata

SEQ ID NO: 15194 - DNA, 1031 bp, Homo sapiens
ctctcgtctctctccactgtagtgtaaaactgagtggaggaacttggtatgtgtgttcagttctctgtcagtcccctcttggcatgtggtgggtgtataataaataagttattgaatgaatgagaaggtggtgggagtgcaggattcccctggatagagatttgcaaatacaggcttttctgccatttgctctgtaacttgggttgtctggaatcttataacatttccttctttgtcccttaccttgtggctatcatttgtttactcagtaacttgcacaactgcttgtgtaccaagcgctagcaggcactggcgaaatacacgaacagtccgacaagtccctgcccaagtgtagcttacagtctacgggaagctgcactggtaaataagttcattgagcgccgtgaaggagaagtgtgcttaaacaaataccacatattctcacttacaagtgggagctaaacattgggtgcacatggccataaagatgggaccaataaataagacactggggactacctaggatggggagaggtggggacaagggcttaaaaagaacctgtgctgagtgagtcatgggttcatttgtaccccagacctcagcatcacgcagtgtgtctttgtaacaaacctgcacacgtgcccccgattctaaaataaaaagttgagggaaaaaaacaaaacaaaacaacttattctttgacttgggtgtgagcagcagtagcgatagggtaagcctatattggcctagttttcagctttttaaaaatatatggctagaagaggttgaaacttgtgattaaaatgagtcttttgagtgtgtgaaaagtattttcatcactttaatttttttaagtgctctagaactagctaaaatgggcaaaacgtactagaataaacatagctgaatgagttgaatttacaaactagtggaagccttctattaaacagtaatttaccttgtaatcatattaatgtctaatctgtatctttatacagaaaaacgtttcattgtgttcagttttagttta

SEQ ID NO: 15195 - DNA, 1039 bp, Homo sapiens
tggcatgtgcctgtatcccagctacttgggagactgaggtgatcaaggaggattgcttgagcctgggaggtggaggttgcagtgagtgccactgcactccagcctgggtgacagatccagaccctgtctcaaataataataataataataataataaattttttaaaatttattttagaagaattatttatagtttctctgtgaccacttccctgatgatacatatgttgccatacttaacaaataccaccttcccttgttgctgtacctaacaagttatcaccatcctgaattgtatacttatcatttccaagaaaaatatttttattgtatgtgtaatttccaattaaaacatattgcatattgtttgaaaattaaataatttatttaaattgcttcactctttcttgatacttatacctatattaaaagacattatacctataataaaaattacatcacctgaaaaaaaagtatgtgtatattaccacagttacaaagaatagaaaaaggggcctctgacagtgtctgccacttagcgctgtagatgagttagtttgtctaaatatgaagtcgtttttacttttcttttgctggtctcatttccattttcattgttttttgtttgatctaaaattttactgatatcatttttgtaggctcttgggatgctcttctggcataaacataatatcgaaaagtcattggctgatttgcccaactttacccctttcccagatgagtggactgtggaagataaagtcttatttgagcaagcctttagttttcatgggaaaacttttcatagaatccaacaaatggtaagtagatgagaccactgagttctattttttttctcctatctaactctcttttgcagcatacttgagatagggatatcatactcaaacataaatattcccatttttgataaagttcccctttagattcagcttagtacatgctgctctgtggatgggagttttccagttacaggagtaaagcacttctagcacttcccatcctgtcgtctgtgact

SEQ ID NO: 15196 - DNA, 1034 bp, Homo sapiens
taccagcactaattgcccctgttagcactcagtttcggaagcattgaaaagctggagactgctggggaagaaccattagaatttgcaggaatgaaagcttgcttcttgtgtgtgtgttttccggcttcggtcccaggatgactggaagcagaaacagttgggaacgctggctctattccctcttcgcatttgatcaaagccagtgttggctgggctggcataacaaatctcatagtaaatttaggaccaagagtccctaccaacaggatgtcagttgttgtgcatatgtttttttcttcattctcttattcttggatcattggttgactgacttaagtgagtcaagtattttttttttaaccttgttattagcccagaaggttcttccgtaatgatccacttaccgtgtggattgcattatcaaagtaccgtctttcttttcacagtctagttatggctcctccaagcagcagatcatagtttttccttggtgattgatcttccatgtctctatttacccagccttctctgcaaaacaaaatgaagaatggtattatctaactcgtgtttagtttcatagtccttatatccctttacaaactttttcactccgctagtcatttaaaatgtaccccctcatacctttcttttcttttttttttgagacagagtctccctctgtcacccaggctggagtgcagtggctcaatctcggctcactgcaacctccatctcccaggttcaagtgcttctcctgcctcagccctcagcctccctagtagctgggattatgggtgtgcaccaccatgcttggctaatttttgtatttttagtagagatggggtttcggcatgttgaccaggctggtttcaaaactgctgatctcaagtgatccgctcgcctctgcctcccaaagtgctgggattacaggcatgagccaccgtgcccggcctatttcttgagtttctttctttttctgcttcttgtagtgccacccctgccctgccacctagttttatgttctccatatgtta

SEQ ID NO: 15197 - DNA, 1055 bp, Homo sapiens
aattctttgctcgttcctccatgttggcgccacttcccagagagctccactgcatctcacactctgcccacgtgctggggaagtctcacggcctgcacatctcttgtgactctgggaaccgcctctcccgccggagcccccgagccccaccaatggcagctcttcccagtcagcagcttcagagcaggcagtctccttggaaggcccgactctgttcctgcatggcctgcagtttctactttgtgcatagagtcattttcagagtcaccgcgaccctgttggccttctagaaagtttcttttgttcttttctgagacaaccacctaagtgataatacgcttttttggaaactaatatatattgccagactgcatcataacctttatcatgccaagcatcctgatgcaactcacatttccctaaacatggggtacagttatgatttataaattgagttggcttaaatctccctcttctcccttcccaagtgttacaaagatcatttactgcaactgtcgttggacactgtagcttaaagggaacgtggacctcaatgctttctgccttcaacttttcagcattgtgaccccagggtggttgccaccccatcttttcctgaccccccccacccccccacctccaagaggttcggcccacatcactgtacctggtgcttgtaaatttggaattggtgccttctccttttggcaaccatggttatcaatcctttttctgttttagtgtcttatttcttctttcaagttatttgctagccaaagatgacatcactgagattaggagacaggggagagcttgctgcagattctgacagtgcagattttaaatgtcaggatattagaatagctggcgctggtttatgaaagctgcgcgttgttccgcgttctctcggtgtgcctggccttttatgtggcactctgtatgtcagtttgtgtccttcatgtgctgatgtgattacacaaacaccatgcactctcttttcatatcagagtacaggacagagaagtgatcaatgtattggtctagtgagactgaga

SEQ ID NO: 15198 - DNA, 1033 bp, Homo sapiens
tgtctggctaatttttgtgtttttagtagaggtggggcttcactatattgggcaggctggtctcgaactcctggccttgtgatctgcccaccttggcctcccaaagtgctgggattacaggcatgagccaccactcccgtcctagaatggctttttatagactaagtctccactgaaatatttttatcttgtcatatatcttgcccattgttttctctattttctttaatatacagagctggaagaaaaactggcagaaactctgacatgagagaattgcagaagggatgagacccaaaatcggcatataagctttgctaaatctctggctgaccgcaaaactatacatgagctggcagtgagcagagatcgcgccactgcactccagcctgggcgacagagcgagactccgtctcaaaaagaaaaaaaaagaaagaaagaaagaaagaaatgccaaagcaaatttggggtaagtggaaatgaccctagatggcatctcagttctacagatagaaatgaatagcaacagaagggtacatatgtgggtagacatattaataaaaaaccagatggggggctggtggcaacccagcactttgtgaggccaaggcaggagaatttcttgagcctgggagtttgaagctgcagtgagctatgatcgcaccactgccctccagcctgggtgacagagcaagactccgtctcaaaaaaaaaaaaaaaaaaaagttactatttatttatttgttatcattatttttttttctttttttttttttttttatttgacacggagtctcgctctgctctgttgcccagactggagtgcagtggcgtgatctccgctcactgcaagctccgcctcctgggttcacgccattctcctgcctcagcctcctgagtagctgggactacaggcgcccaccactgcacccggctaattttttatatttttagtagagacggggtttcaccatgttagccaggatggtctcgatctcctgacctcgtgatccactgggaggacctcgtgatc

SEQ ID NO: 15199 - DNA, 1051 bp, Homo sapiens
cacctggaacctcccactcaacaaatgcagctcgggccctaccggcccccatggccctgaggagggaattaaaatggggcactcccgtcctcaggatgctttgctccatgtgccagaaggcagccgtgacatactgattagttacaacacaggtcttttactatacacaggctaagatgtctgccctgtgcagtgtcccacctgtgtaaccttacaaggctgccccttgtgcagtgcaccacctgtgtaaccttacaaggctgccctttgcagtcctcctcctgctcttccttgtaagtgttgaagcagttgctcattaacggtgcaattcggatcgtatcagtgcatgtttgtcacttgagatgtgcaaagatccctacgctgtgctcacccagtgccctgcctggcaccaagtaggacaccaataactgtagaatgagcaacattgaaatgtaaatgagacttttttttttttgagacaaggtcttgctatgtcacccaggctggagtgcagtggcgtgatcactgcaaccttgacgtcctgttctcaagagatcctcctgcctcagcctcccgagtagctgaaactaggcacacgccaccacacctggctaattttcatattatttgtagagacggggttttgccatgttacccaggctggtcttgaactcctggactcaagtgttcactcgcttcagcctccagaagtgctgggattatgggtgtgagccactgtacccagcactcgaataagactcttgttaagagatgtttggaaccaaccccaccagggtgaatggaagacataatatctatctatgcctcagaatgtgcaggaaagagaacactgaattgattccgccagcccagactttcttctcttctctctgttgtccatcacaacaacctcaccccacaagacatctccactctcaccgcaagacagcaatggccacaaagggacccacttggaggaccttggcaggatactccccagacatgctggctgagtcctgctccaaactccggcttttggaggtgatgagct

SEQ ID NO: 15200 - DNA, 1045 bp, Homo sapiens
gtggggacttcggtctagtatttggacccgaggagataattctgtgtggaaaattctctcccttcggttggaaacagtaacaaactggaaacggatgaggtgttatggacgtgcttggaaatgcaagaaaccttcagattacgagctgttgacgggaccagttgtatttcacgtttttcgaattaagctcagaatcagttttcagaatgacatgtgatgcgtggtgcgtggtgtgtgtgcctgtgtgtgtgtatggatataattcattcatttttgtggcgtcagaaaggttatgtcgagcgttgtagcggcttcttaatttacattcacggcatacaactgaagaggagccattatttattttttttcctagcatttgctgcgactacacactgccggagcgtttggaaatgttgtttgctgttaccctgtatttgtctataaaattcttactgtagggaatggccaagtggaccatcagttcgtcctgagatcttctcatgtctctcacgtctttgaaaatggcctgtgaacagactgcatcatatgtaggatgtctggcaaaatagtgtacagcgttcttttctcaaatgagaggaaatgtgtaccttttcgccgcgttgtgacaatgtaaatgttaagaattagtctaaagatgaaaattctttggccaaaacaagataagccttatcgatatgaaaactggaaaacatcacatgggactggaaatcctgtgagtgggtgctcatgacggaaaccctgacagaccttggattccagcatcgctggtgaaaatcagaccttatcatggataagggttaagatgtaaggtgtctcacccagacgccatctgttccagctgtcaatgcagaagccaggaaaggagagagagctggccagggagaattccagctttttttttttttttttttttttttttttgagacattcatgtgaatttctctgcgaggggaaagaagaccaattattttccttggatgctgtcccttcttttggaattaataagatggcttcactcagtgag

SEQ ID NO: 15201 - DNA, 1050 bp, Homo sapiens
atatccctactcttgtttgtgccttgaagaaagtccttcatttaactgagacatctgagcctgcgttgcggattctgattctctaaatactcctgcaagaatccctttaatttttcactgtgcaactcaagaaggacctttctagggtattgtcaggatacgtatgctaatgatattgtcaggttaggtgagaatgattgatcactcccttaaaatccttttttatgatgttaaagctgtactttaagaaagataaaactgccactgtggcgttgcaagtctgagctagctcaagcaaacaaaggaaattgcgttaaatttgcccaactctattttctcatcttcatatagcaagactctccaaacagcaagtgatctaacctatcaagtattatgcaatagctgaatttccttgcaatggtcagtttaaagaactgttaacttagcagaggcgacgtctcgtggccaaggcccttagggtccactccatggaatcaggaccccttgctgctgctttgcgagtgttcatggaggaagaaaaatcacttggtgttctttttttgcatggaagagtcataataactgacttcagatacagagaaagtgggaagagtgagaaagaaggaggtgaggccagaggatttggaaggctaccagagagaagcagccgaggcctgattgtggaaatgatgcttagacttgctttcagcaggagtgatgaagccagaatgagggaggcccagacgcccgggagaggtacaggggataggtgccatgtggtttgcaccaccgcagcaggctttgggtcccaaagacgcgaatggaaatagaagaaaatgcagttttaaatagaaaagaaaaaaaaaaccgagaaaatgttatgtgtgcttgtgtaaaatttattattcataattaaaatacaaaatggctttctcatttgagaaagcctttattgactaagttctgcacaacactattccaggaaagggggtggggagacagaccaccctagggagaaggcagagttttttactattaagcataatacct

SEQ ID NO: 15202 - DNA, 1037 bp, Homo sapiens
gaagggctgtgaataacggaatgcagccagacactgaggccactaggtcaggtccttgggatgacagagggtagatttctttgttcttagacctaagttggcccttgttgggtggaggtggtggcgtgagagccttccctgccttctccaggttgaaggatatttctgtgcatctgggataggtctctagggttgagacgacaagcttctcaagggttggctcacttcattctttctatttctgcagtctggtctatgatgtacacagtaaaaaggagatcagtttatgtatggaaggaattagacctgctttgaattctggtctgtccttcagctaactatgctgttaaattactcttcctttctaagcctcagttttctcatctatgcaaaggtaactgtagagttcacagtcacgtggaaaagcctctgaaacctaaattctccctctggagatggatggtggtgatggtcgcacaacattatgaatgtatttaataccactggactatacacttaaaatgattacaatgataaattttatgtgtaatttaccataataaaaaagtaattgtgagacttaaaagtgagcctgggctgggtgcggaggttcatgcttgtaatcccagcacattgggaagccgaggtgggtggatcacctgaggtcatgagttcgagaccagcctgaacagcatagtgaaaacccatctcacctaaaaatacaaaattagccgggcgtggtggcacatgcctgtaattccagctacttgggatgttgaagcaggataattgcttgaacccgggaggcagaggttgcagtgagccaagatcgtgccattgcactccaccctgggcaacaagagtaaaactgtctaaaaaaaaaacgagcctgtgccaggtgcagtggctcatacctatagtcccagcactttgagaggatgaggcggggggatcgcttgaatccaggagttctcaaccaacctgggcaacatagtgttataagaccttgtctctacaaaaaatttaaaaattagctg

SEQ ID NO: 15203 - DNA, 1043 bp, Homo sapiens
ccccaggctggagtgtagtggcacagtctcggctcactgcaacctccgcctcccgggttcatgccattctcctgcctcagcctcccgagtagctgggactacaggcacctgccaccatgcctggctaattttttgtattttttgtagagacggggtttaactgtgttagccaggatggtttcaatctcctgatctcgtgatccacccacctcggcctcccaaagtgctgggattacaggtatgagccaccgcgcccagctgaacttgggatgtcttttcattcaattatgtctcctttaatttctttaagcaatattttgtagtgttagtgtacaaatcattcatctctttggataaatttatttctgggtgctttatttttgtgggttctattgtaaatgaaattattttcttacctttctttttgtattgctcattgctggtatatagaaacaactgatttttgtatgttggtcttatgccctacaaccttgttgaatttattacctctagtagttattttgtgggttctgtgggatttctttatacagaatcatgtcacctgcatatataatttacctcttctttctaatttgaatgccttttatttctttttcttgcctaattgctctggctaagacatttagtaaaattttgaataggagtgatgaaagtgagcatcctcatattgttcctgatcttaggggaagcttttcaccattgattatgaagttagctgtgttttctttctttcctttttttttttgtttttgacacagggtcttgctctgtcacccatgctggagtgcagtagtgcaatcatggctgacttcaacctctgcctcccaggctcaagcgatcctctcacctcagcctcctgagtaggtgggaccaaaggcacatgccacaatgccctgctgtttttttttattttttatttttggtagagatgggtttcgccatgttgcccaggctagtcccaaactcctgagcagtcagcccaccttggcctcccaaagtgctgggattacaggtgcgagcca

SEQ ID NO: 15204 - DNA, 1050 bp, Homo sapiens
atgtatcccaaatgaggattatttttaagctttataataaaatctttcacagcatagactttttttttttttttttttttgagacggagtcttgctctgttgcccaggctggagttcaggggcgcaatctcggctcactgcaagcgccgcctcccaggttcatgctattctcctgtctgtctcctgagtagctgggaccacaggcgctcgccaccacacccggctaattttttgtatttttagtagagatggggtttcaccatgttagccaggatggtctcaatctcctgacctcgtgatctgcccgcctcggcctcctaaagtgctgggattacaggcatgagccaccgcgcttggcccacagcatagacttttaaagaccatgtaggcaagaacagatctttaaagggaaacctcagtttggcttttgaaagttcatctgattgaagttaaactgatgaaacatactccatccatgcattaccaaaaacgttggagcacggcatggcagtagtatctaaaacagattggcaaactatgggtctaagaatagtttttatgtgtttaaaggattgtaaaaataagcaaagaagaatatgtgacccatgaaacataaaatagttactgtctggctctttatgggaaaaaagtttgccaactcttggcttaaagggtcaagaatgctttaccaaaaaacaaacaaccccctcccccctacaactgtaatgtttgagcaggagttttacaagataaagaattttgatcttgaggggatttgggtgaggatggggcggtgcagtgggagagagagtatagatactgttcatcacacccagtgcagtcggctctggtgggaacatagggtgacctcagtgtgtggtgaggacagtgatcatggccccttttacaagttgaagcttagttctggagtggtggaccatcagaagcttttaagtaggagaatgtcaatgtcataaattagagttaattgtgagaaattgaaataagtattccatttttttctgagatgtgctctcctgaacttataaa

SEQ ID NO: 15205 - DNA, 1034 bp, Homo sapiens
cggtgctgtgatgactgacactgtggatgggtagtcatgcactcctgtgcccgctgccaggaaagagctcataaggaggacctgggaagcatttgctgcacttctgaatctagcgcatgcagactcgaccctgtgggtcgagctttggtgagaagtggttggatttggaacgtatcttgaagacgaagctgactgtctttgctgatggattggatgtatggcatgtgaggaagggggtcctttatgatctaaggaattggatggtgccatttcctgagccaggcattgccagaggcagatcagagaggaacgggtaccaagggctcagtgttggacctgttaggtttgagatgcctttttgatgctcaagtggagatgttgagttggttattggatatacaggtctgggggaattacagggaaaggggtgctggagatatatttgagaattatgaaaagctgtttgagcatcaagcaggatgggtgagacttgaccactggattttgcaacttgaaggtctttggggacttggacaagactggtgtcaggaggcatgacaagtggaagttttcaggggagaatgggatgtgtgtgttaacagcttcttgaaagagttttctctaaagtagaatgatgggggagtgggggtgctggggacacattagcacttaccgtgctctggaaggcagggtgttcaggagggaggttgacagaggagggcctgggatccagtgccagagtagagggtggaccttgcccatgggatctggagggagggcagagtagacaggcaggccttcctttcagcagtgggaggaggagaaaataccagcttgcccctttccaaaagctgagagtaagggtgacaagggggaaagaggtattataggtatgctatggagttaaaggtaaagtttgcatgaatttcgaatacaaaatgtaatacttcatatccattgagttgcttcaaagtgcttatcctcagggttctctctcctgtgcctttgggggtactttggtgaaaaagtttgag

SEQ ID NO: 15206 - DNA, 1025 bp, Homo sapiens
gcatgttccattaaaaaaatgtggaaaatccccaaagcacatgcatatacagtagttaatcatgttttatcttaaatttattcatattatagaaatttaccttttgaaatttcatttttatttatttgagatggagtctcgctctgtcgcccagactggagtgcagtggtgtgcatgatctcagctcactgcagcctccgcctcctgggttcaaactattctcctgccttagcctcccaagtagctgggattacaggtgtgtgccaccacgcccagctaattcttgtatttttggtagagatggcgttttaccatattggcccggctggtctcgaactcctgacctcaggcaatccaccctcctcgacctcccaaagtgctgggattacaacatgagccactgcgcctggccttgaaatttcatttttaaaagctctaaaaattttccaggtgagaattgaccaactattattattttctgggtaagggactccactacagtaattaaagaaggataaggttggcgttgctttgctcctttttttattgaagtccttccttcctgatcaagcttccatatatctccttaaaacatatgacacacaggtatgccactaaaaaacttaatttgtgtagatttctttcttcagctgttactttttcatcttgcataaaaatcaagtaattaaattttaaaacatcctgaacatattcatttttggctttagcaatttcattcttcagcagatgtatttgactttctatatacatggcactttggtttggtttgtgtctgaccttatttttatttttcattttttttcaaaccagtattaaactgaaaataatagacgtcatacctcatggcccaggaatgagtgaataagttggaaaaccaagagtagtggcctgcatctctttgtccaaggcctactttccaaaatctctcggccctacccttccctagaaggttccccactgcaaggaaggcacaggcagcctgggggtgtgacctgcctcatgga

SEQ ID NO: 15207 - DNA, 1050 bp, Homo sapiens
agtttggggcctttgaacttggtctttgcttttggagctgtacttgtaggtgttgttgttccagcctgggaacgagacatgaccgactccagtgcggcctgcttgctgtcctcaccatcagtcagtgtggtccgtgtgtgaggctgcagttgtcctcttggccacttatttctccttaattctctgcatgtaatttaaaacattatcccctgaaacttagtttttcattgacttctaatatctttacttctccttttaattttcctattgagatacttaggatgacatgaaattctttggatctacatatggacaaacagaattgtgtcacataaggttcagtgtgctagctgtttaaaaaaaattaaaaacagtttgttttttttagagacagaatcttgccctgtcacccaggctggagtgcagtggcgtgatcgtagttcactgtaaccttgagctcctgggcttaagcagttctcccgcctcagcctcttgagtagctaggactcacaggcatgtgtcaccatgccaggctaatttttattttatttttatattttatttttattattatttttttgagacagagtctcactctgtcgcccaggctggagtgcagcggcacaatctcggcttactgcaacctccacctcctgggttcaaacgattctcatattctcctgcctcagcctcctgagtagctgggactgcaggctcacaccaccacgtccggctaatttttgtatttttagtagagacagggttttgccatgttggccaggctggtcttgaactcctgacctcagacgatcctcctgccttgcctcctaaagtgctgggattacaggtgtgagccattgcacctggcctttatttttttttagaggctgactgagttttgctgtgttgccaaggctgatctcaaactcctggtacttcaagcagtcctcttgccttgacctcccaaagtgctgggattacaggtgtgagctaccacgtcctgcctgctagccatttttttatgttcgtggtggtggtaaggagtggcta

SEQ ID NO: 15208 - DNA, 1369 bp, Homo sapiens
tggagaagggctggctgcttttacaacgcaggagcaaggctctccaagtaaacaggtactcacactgaagagctgctctgcagacagctagctttggtttctgaaataaaatttcacttttacattaagtggaaggggctttccaagtgggactgaactaaactgttctacttggtaacttccttttgaaaaatcagcattttaaaaaatgtagcccttttctcccatggcttcctatgtaaagtgaatcaccagggcgtcctgaagctctgctggttgctgtgagccactgtgcagacctgaccataaagtgaatgctcccagaatctcctgagtcctctcaagaaagggacttccactctaatgcagtcacttgtgtttccctgcagctcttcaagtccaaaatgtacagcgtgtcaagagagcatcgttaaagataaggtattctggggttttttttaatcattttgtcacatgttttcagctgggtaatacttttcacatagtttgcattcggcactctggcacaacacattctctcagttttggcagctgatgcggcaggctcccaggcaggacactgtgccatgtgatcacctgggcagacagtggattcagatccacttggccacttccctactgtgtgaactctgtgagctacttcaccccctcacctgtaataatcatatcacctgctaagaccgcagggagctggtgtgaggagtaaggggttgatgtgagcaaagtgctgagatgcctgtctgtggcagggctgtctgtggttgggtcacttccgtcattgcaggtctttatcccagacagcttctactcaactcttacactaggttttaccttcagactcgctaggctgaggggttcatttgagtttgtgctccctgccccccaggccccctgtgatatctttaagtcattagacatgagtgagattagccccttctcgccccctgtggctgtcctcagctagagcccgtgggcgtctctgcacattcagaggatggggctgcccagcctgccaccagcttctctcctggggcctggtccttctcatggagactgacagtcatccatgtgctgctgtaccctgccaggtatacttggagtttgaaacaattcttttcttttctttctctctcctttctttcttctttttcttttttttttgcgacagagttcactcttgttgcacaggctggagcacaatggcacgatcttggctcgctgcagcctccacctcccaggttcaagcaattctcatgccgcagcctcccgagtagctgggattacaggcacgagccaccacgcccagctaatttttgtatttttagtagagacggggtttcaccgtgtt

SEQ ID NO: 15209 - DNA, 2111 bp, Homo sapiens
cattccacaggccttccgctcaattcatagataatccgttccacaggccttccgctcagctcatagataatccattccacaggacttctgcttagctcatagataatccattccacaggccttccgctcaactcatagataatccgttccacaggccttccgctcagctcatagataatccattccacaggacttctgctcagctcatagataatccattccacaggccttccgctcagctcataatctgttccacaggccttccgctcagctcatagataatccgttccacaggccttccgctcagctcatagataatctgttccacaggccttctgctcagctcataggtaatcccttccacaggccctccctcaactcatagataatccattccacaggccttccgctcagctcatagataatccattccacaggccttccgctcagctcataggtaatcccttccgcaggccctccctcaactcatagataatccgttccacaggccttccgctgagttcataaataatccattccacaggccttctgctcaattaatatatacttcttccactgtacagcttcttaaagactattctaataggactaaagagaaaagataggaataaatagcactttttatctgactttatttcagaattaagctttgttttgcctattttgatttatgtagttaacattttccattgccttgattgactatcatttagtatgtcaaaaaatgaatagttattcaaaaaaggtaaaatttttatcttgtcctagggaattgcctcaaaatgttgatagattgcctggtcttattacagctctgtgacataaccatcacttacaacaggctaatttgtcctacagcattgaaatgcagctgtttatcttggagagagacagcttctcatacttcggttactttggcacagttttgcattgtgtgtttctgtgggggtgagtgtgtgaatgtgggtgagtgtgtgggggtaagtgtgtgtgggggtgagtgtgaatgtgggtgagtgtgtgggggtgtgtgaatgtgggtgtgtgtgtatgggtgagtgggtgaattaaagaggaaagcagagatgttgggggtggaggacacacttagaaaacaatgcatttgttgaacaaacacctattgggtacctactgtgcgccgggcagtattccaggagctggggactcagtggtgaggctcctctagtgggaaaaaatactaacaaatgtgtaacatcgggtagtgatcagttccatgaataaaaatcaggtggcatcaagggaagagaggtgatcagcactggcttgtctgaggcagccaagggacagtgggggagcatgtggaccctaagctggaactggcagggctgtggggttcaggagctgtgtggaacacaggtcagatgtgagggcagtggggcagccagagggtgaggggaaaggcactgggcagcccagaactgggagggtgagaggggccccggggcaaggcctggtgttgctggggtgggggaaggttgtactggggtgtgcctgagggtggagcggtaggattggccagcaggtggggtatgaggtaaaggtgactcccagtgcttgtggagaacctaggtgtcctgccgagggggtgcccagtgagtggagggtgatgggcttgggggagaatggggagtggagccatgcaggctgcagatgggggtgagtttggtggctcgcaggatcatggggctggagcgagtggagaggaggacagagctcgtgggggcctgggcacaccctcagaggctgcctagaggctggggtgggcttggccatgaagtgactgaagggaggcaccagggcagctcagccagggcgtgggccatcatccagttcctggtagatattgtggaatggtttgttttgtttgagagagagtctcactctgtcatccaggcctggaatgcggtgacacaatctcagctcactgcagcctctttctcccaggttcaagtgatcctcccacctcaggaaccataggtgcatgctaccatgcctggctaatttttgtattttttgtagagacagggtcttgccatgttgcccagtct

SEQ ID NO: 15210 - DNA, 1071 bp, Homo sapiens
aagaatgagtttaaaatttaatttcttgatattacaagtgtcaacccttgataagaagccacttgagatgagctgaagggatgcggagataaccctgagatgctcactgtggcactgcagggtgctggctctgctgctcctggcggcctcctcacctgcacgcagtagccaggtggccctgagcacagccctccttaggcgcagagattccctgttcacttgacgcaaataggtctcccctctttgtgtttagtgctgcttttagggtcgtatgttagccgttctgccctttgaaatgcagcgaggttcgctgaatgcctcacatgtttgctctcgcaggggacaaaccagcagatcaaggcccacgaggccagctccgccgtgcagcacgtcaacctgctgaaggagtggagcaactcgctcgaaaagaaggtgggctgcacactttcctgctgctatgggatttgtatcatctcttcagattatttaaagacaaaacctttttgtagttattaatgggttttggataaaagaaactatcaagagaatgtcaaaaaaaactctgtgtgatcttgagcttataaatgaaggtgttttatttttgttatttgttttttaattgccaagcaagtgtgaagtgcttttttaaagtcaatcacattgtgattattttagcatccatccagcacagagatgatcagatgcccagtccccaccctgctgttttttttttgtaaacaaagttttattggaagacagccatccttactcactctgtgttgtctgtggcttcttttgctcgaaagcagcagagttaagagacatgtggactgtaccgcttgagatactgactacttggctctttacagaataagtttgccagcccggacctgggtggttacccctctaaatgcgttaaacttctgtgttttttacaagagacaaacaggaaaaaatatttgatatgattacaattgattttgtcatttgacaccttgtgaaacttggtgcgctctccacatagacagggccacttcccaaagagactctcccatgctgttcttttttttt

SEQ ID NO: 15211 - DNA, 1074 bp, Homo sapiens
cagcagcagcttcaagaagcccactggagagatgaatatcgcctctggctgcccagtctttgtggcccaaactgttctagaaaatgggacatatattaaagatgatacaatttttattaaagtcatagtggatacttcggatctgcccgatccctgataagtagctggggaggtggatttagcagaaggcaactcctctgggggatttgaaccggtctgtcttcactgaggtcctcgcgctcagaaaaggaccttgtgagacggaggaagcggcagaaggcggacgcgtgccggcgggaggagccacgcgtgagcacacctgacacgttttataatagactagccacacttcactctgaagaattatttatccttcaacaagataaatattgctgtcagagaaggttttcattttcatttttaaagatctagttaattaaggtggaaaacatatatgctaaacaaaagaaacatgatttttcttccttaaacttgaacaccaaaaaaacacacacacacacacacgtggggatagctggacatgtcagcatgttaagtaaaaggagaatttatgaaatagtaatgcaattctgatatcttctttctaaaattcaagagtgcaattttgtttcaaatacagtatattgtctatttttaaggcctcatctggtctctgttttaataatttgtttgtcagaagaccctgaagtatatacctaggtcttttttttgaaagtctctaaattcagaatcattttttaatttaaagttctacaaataattgttactgcaaacattttattttaaaacgttgatagactgatatttcttggaagaaaatataaaatatcaaacactggttatcacttgtgataggaaagagaatattcaacctgttgttatttctcgttagaaatgtaaaccttcaaatatctgtcgtagttaatgacacgacttcacaattctgaacggagcctcgctcatggatgctgtgcatcattttcagatttataattgttttcaccctaaaatagggcatccgttgaactttggagttctaaacaaaatcctgta

SEQ ID NO: 15212 - DNA, 1090 bp, Homo sapiens
gcgggtgaggaggccccggtggccaagcagagcctgcgtttcatttctcctgctgcactgtgtctagtctgtcttgtgaactctcaccgtgaaaagaggctagaagtccaggatcgctgtaccgctcctgtaattaggtgatgactggatttgacaacttagtcccctcagacaagtaagataccctccaacagcaaattcaatgacttaattggaaaacacacaagctggcatgatgtccggtgatttctgtaagaaatgcctgtaggagaaggtctgtgaagtgtggagggcagtgtcgacgctgcacagcatctgcagattcgcagcctcttctctgccggtgcctctgttcggttctgttacccaaaaacaaagaccaaagaaggccaatctctcatttgaccctgtctttttaatctgcctgttttaaaagttgcgtctgtagtagccgcttgctgtgaagacacatcttgacagtccaagtgattttgtgaccagtgatttgggtcctgttttccgctcttctaagaaaaaacaaaaagaccgtgagttattgcccagcaataatcatgttgttactgtgagttagcaacatgcctgacttcctgatagcattactgttttctagttttgtttattgtatattatgtgtggttttatttggtatttatttgtgttttgaggtcttgcaatgtttttgtgtttctgatgctaataactaaagtttgtaagactgtagaatgcaaaactcggagatgctaaactgtcttattagaggaaaataaatctgattatggagtctcagtctctgatcacaccgtctcttgcaggctgggccccaggtgagtggcttccctcctgccggactccccgggctgtcctctcagtggctgggcccagtatggccgcctggccaagacctgtgtggccagaggcccgtgcttggtttgctgccctctgtcaccgtcttgaaatactttgcaattctcagcgaggggcctgccgtcgccttttccactttgcttacagttttgcctgcggcctttaacctgaagggaatcccaggggccaggctcgcaaatctgtg

SEQ ID NO: 15213 - DNA, 1999 bp, Homo sapiens
ctgttccgtgaagaagaaatagctgcatctaggcagtttcctcctctgtgaccacaatttacattgatttgttttataaacagatttatcagcttatgttgaataaaatcattcctcttaacaggtggtgtattcgaaggctgccagtgtaccgaaagttgagactgtaaagtcagacaacaaggatgacgacatcgatattgatgccatttaaagggatggatgcaacctagcttaacagtataatgctgcaaattttcctccattatcagccagaagtgcaacatgtatgtgcaaaagctaaaatggcttaacatcatgctacactttacactaaaaatctattactgtgagtggtctgttattaagcccaatgagacatctagggagtccatacacatcagtgagcagatgtagtttgcttatttatagcatgtttctttttgaaaaactagtggtggacacatttggatcacatttatacagttataaaaataaaggtttgattttggtcgttcttcagatgtttggctctgaatgacttaagctgaagtaactggctccttactttaaatgttctgccatcatttcacctgatgagcattcttggagcctgccagatattgttaggtcctggggctgcaaagaggtcctcaacaggatgtaaagcaaacttaattgtaattaatttattcagcccattaagaaagtactaaagttttatctctgtagttcctcaaattggcatctggtaatgtacattgtgaggtagactgataatgaaatgacagtgtaacatcttaaccaagaagtaaatatgacctcagtgtcctataaataatgtaagagcaggatttgaaacttggagagctgttttctcatttcatgtacacttgccccaaattgtctttgaagtcgtgtgcattgcacgttggatgagccagggaaattattacattaacaagcattttgtgtgtacgtagtagttactttgtactgagagaacttgctttggggtgcaattaataaactgattttatttgggagaaacaaggaagggtgcacttaactagcaacctaagcatgatttttcagcttttgcccttagggtttaaattacaattccaaaatgttagacatactgtattttttcgttcagtgtggctttaattttcccctcttgcagtttgttctgtaatgccttttacatttggacacatagtttatgctttttagattttggttgctttcttgccaaaataagtgttaactgtgtttcaaacttgattttctttcctttttcttttttttttcttccagaatgtcttatttaaaaagaaagctaaaagcatacttctaagtcagagcctctattttggtgtaagacttgggatattttttacttcacattgaatatagccaggcacccaagaagtctgatggccacctgagtgcaggtgacaaggacctgacagagcccatgcagggctttagatttggacacacaagagttgataacttcctcatgaactccttgcctgatctaaactcatattatgggttctgactgtttgagtaatcatcttcaaggttaaacctcttggcagttacccttttcacaaagtgcacagtgggaatcgagaatcgatagggttaattttggagcagtggcttataccattcacctctgtttttttgtgattatttcacagataatgagaccttaataacaaataggcgtaaaaaaattttcacattgaaatgatagaaacatttgatgtaataaaacttggttggcttgatattttaaggaattgaaacctagcaatcttattggagagacaagaattggtctccagctgcctttgatcaagattcgggtgcaagtggagcaggagccatatacctggagggaatgtgctttgtcacaccaaagaggatttttttttcttcaaacttgtatgttgcctaggtttcaaattctttgccgcaaggctga

SEQ ID NO: 15214 - DNA, 1015 bp, Homo sapiens
tcttttatatgtgggcaaaattaagaactaatatgtaaaacaaaatggagcacattcccatttttcttattgctttgagttgatatggcccctatgtcagtagtgctttggctgaacgtcacaaagacctaacacagtgccctaaacaaatagggggtttgtttttctccaaaaagaaatttggggtagggtgcggtggctcacacctgtaatcccagcactttgggaggccaaggcgggtggatcacgaggtcaggagatcgagaccacggtgaaacctcgtctctactaaaaatacgaaaaaaattagccgggcacggtggcgggtacctgtagtcccagctactcgggaggctgaggccagagaatggcgtgaacccgggaggcggagcttgcagtgaatcgagatggcgccactgcactccagcctggggcaacagagtgagactccatctcaaaaaaaaaaaaagaaaaaaaaaaaaaagaaaggaatttggaggtatgcagcgtctagctttggatcagcagttcagtaatattggagttggtggtattttaaggtagttttgtcttttctgtcatgtttgagaccctgtagctacaggataatgttttacagttacagctacatggttgcattcaaggaaggaggaaggaactgtactggcaactctgtccttacccccccaccctccttttttttttttgagatgaagtttctgtcactcaggctggagtgcagtggcggaatctcagctcactgcaactgtcgcctcccttgttcaagcgattctcatgcctcagtcttctgagtagctgggattacaggcatgtgccaccatgcctggctaatttttgtacttttagtagagatggggtttcaccatgttggccaggcaggtctcaaactcctgacctcaggtgatctgctagccttggcctcccaaagtgctgggattacaggtgtgagccacagtgcccggcctccccttttatgataaacaaaggcattacc

SEQ ID NO: 15215 - DNA, 1033 bp, Homo sapiens
cacctcaatcttcctccctcccttccttccactggccttatcgtgattgtaaaatagggcaacactacattccataaaatagaataagtgtccctatgagctgagcagaagttggctttagagacaggcaaaggctgaagaaggctgaggcaggcccggcacagtggctcactcctgtaatcccagcacttggggagcctgaggcgagaggatcactcgagctcaggaattcgagatcagcctaggcagcacagagagacccgtctctaccaaaaaaaaaattaaataaattaaccaggtgtggtggtgtgtacctgtagttccagctacttaggaggctaagatgggaggatcacttgagcctagaagttggaggctgcagtgagctgtgatggtgcccctgcattccagcctgggcaacagagcaagaccctgtctcaaaaaaaagctgaagcaaagaacaaagagtgtattggtcctttcagaattccttttttttgtaaggcagggacagggaaacagaacaatagaccacaatagactataccacatagaaaagtaaccgattagttaatgtcaggttacttcacactacatttttttctgtaaggattaaagcagtaggaactttgttattgtgccaattgaagttttttcttttcttttcttttcttttcttttttttttgagacagagtcttgccctgtgacccaggctggagtgcagtggtgtgattttggctcactgcaacctctgcctcccgggttcaagagatacttctgcctcagccccctgagtagctgggactacaggtgtgtgccaccacgcctggctaatttttgtatttttagtagagacagggtttcaccatgttggtcagactggtctcccaactcctggcctcaggtgatctgcctgcctcagcctcccaaagtgctgggattactggcctgagccaccgtgctcagccaggacagtttaaatcttcaatcaggggctggacgcagtggcacacgccaataatggcagtact

SEQ ID NO: 15216 - DNA, 1079 bp, Homo sapiens
cagtgaataagggactgaactagccttagaacctaaatttataacatcaaatagctttctttgcataagttcccttggagccagtcactcatagtactttccatatgggaaggataacaaaggaacatatggaaattcagcttgcatgtggtagatacctagtaaaatctgataagttaattttgttagtaccaaattcattttaacactaaattaatttttcctgatgttgctctgattctaggaatcttgaccaccagaaccttgagtttgggagatgggaagattcttagtttgtctttgaaatatttgatcataaaaaacacattattggccaggcatggtggctcaagcctgtaatcccagcactttgggtgaccaaggcaggcagattgctgagctcaggagttcaagaccagcctgggcaacatggcaaaaccctgtctctacatacagaaattagccagatgtggtggtgcgcacctgtagtcctagctacttagggggctgaggctggaggattgcttgagcccgggaggtcgaggctgcagtgaaccatgttcatgccactgcattccagcttgggtgacagagcaagactccttctctaattaaaaaaaaaaaaaagcacacacattgttgctactcttattttacatttttagaaaactgatttgttgtattactcagctaaagctaagcaattttttaaaatttagtttttaatttttattaaatactgactgcatacaaaagaatgttccatgtttagcatataaatatgtatatgagatgagcacccttatactacctgcttcaagaaatagatcttcaaccatacctttaaaccagtcccatattgtgcccctcctcaacctgattccccttcttcattgcccacctactgggtaaacactaacaaggattttgtgttattattttcttgctttgtccgtgtaattttaccacatatggatcactcatcaatgtagtgtaaaggttttttttggtctgttttttgtttcttttgtgtttgtttgtttgtttgtgactgagtctcgcactgtctcccaggctgg

SEQ ID NO: 15217 - DNA, 1030 bp, Homo sapiens
attggcttttgctttgcttccttttttttgtttttttgagacggagtttcgctcttgttacccaggctggagtacagtggcgtgatctcagcactgcagcctctgcctcctggattcaagtgattctcctgcctcagcttccaaagtatctgggattacaggtgtgcaccaccacacccagctaatctttgtgtttttagtagagacgggttttcaccacgttggccaggctggtctcgaactcctgacttcaagtgatccacccacctcagcttcccagagtgctgggattacaggtgtgaaccaccatgcccagccgcttttgctttcttttacctacattgtgttccatgttgatgtattttgctgtaattcaccttcactgctatgtccattttcaagaatatgtagtatcccattatgtgaatatgccactctgtatttattctgtgattcagagacatttggattgctttttgtattgcaaacatgactgctgtgaattgtcctctgtgtgtcctggcacacttgtgaagagtttcttaaatatatatacttagaattcttgtatcacagagtctgtctgcacatcctccttcttcattagagaaggccaaattattttcagagcaggtatgctaatttatatttccatcagtagtgtgtaagagagcacaagtaatgtagcatcctcatcaaaatttgattttctctgattttttaaaatttgtgccatcacaggagaattgcttgaacccgggaggtggaggttgcagtgagctgagattgcgccactgcactccagcctggcgacagagcaagactgcatctcaaaaaaacaaaaaaattgtgctatcaatttggtaaatataaaagtgatatttggccaggcatagtggcttcctccttaaattccagcactttgggagcctgagatgggaagatctctccaagccaggagttcaagaaccagcctgggcaacagagcaagactctgtatctacaaaaagattttttttttttttaatta

SEQ ID NO: 15218 - DNA, 1046 bp, Homo sapiens
ctacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccaggatttgtctttttgtgtctggctgattgatgcagcatagtgtcctcaaggttcatccatgctgtagcatgtgtcagaatttcattcctttttaaggccgaataatactccattgtgtgtgtgggacacacacctcacattttgtttatcttgagtatgtggctatttaaacatatgaatgcttagtctgtttgaaacaaatgtgtgctttggtttagatgcttttctttaccagattttaatgtcgctggtgtctgtcttccccaaggccagaaatgatggttacagtacacatcactagagtttccttaaaataaagattaatgactagtaactatttgcctatggttttgtaaaaatgtagacattttctgaaatgcgtgtttatagctgctgtcttttataatgatttgtattttatggttgagattgggctgggtttgtagtttgcgaccacacgtgagtttcattgtctgtgaagggcagaagctttcttgttcatctttttgtgtcccctgcctctagcacactgcctggcacacagcagatactcaacagataagaattagactgcatttaggaattataaactactgggtacacattctgttaaactctatcgtaattttatcattagcactttgatccatgttacaaaacctgaagatagaaagttggattatagtctcatttgagtgagtttaccattgaaaataaaaagattgtaaacctgttgtggaaaacaatgagttgtagtaagcatacctttgacaccacttttttatactcctaattcattattagttgtgtattttatactttatatatgtctagtttgggaatttcattgggattttcaaaacttcaggggtagtagaaagaggggaaggttaatttca

SEQ ID NO: 15219 - DNA, 1049 bp, Homo sapiens
tgagcttcacggtgagcataggaaccccctctgagggctcagtgcacttggcaacattgtaagagcctttaatcatttaatcgaaggtggtggttctgtattaccttgggtttttttttttttctttttggagacagggtctcactctgttgcccaggctcaagtgcagtggcgccatctcagctcactgcaacctctgcttcctgggttcaagcaattctcctgcctcagcttcctgagtagctgggactgcaggcgcacaccacacctggctaatttttctaatttttatagagacaaggttttgccacattggccaggctggtcttgaactcctgacctcaagtgatccacctgccttggcctcccaaattgctgggattataggtgtgagccacagcacctggcctctttaacagtgttttgttgagtttattaaaacaatttccgggacatatgttttattgttgatgtgtttgccattgtgaaaagttttattaaattggccacccattccaccattgcatctcccccacccgccagcctgctgccttttgatttggtaaactcatagaattttagaattgaaaataatcttagaaattttagggcagcggtctaatttttacagatgaaactgaagctcagaaagtttgttctatgccaaggggtccatagctagttagtttcaggacctgaactagaactaagggctttctgaactggcctgtcagtgtccttccatccagccacctgttcctgcccaggcaggagagccactctttgcttcttgtttcttttatctctaataaatagccttagtatttttcagttcagctgcttaacctgaatgttaatacatttttaataaggaaaaaagatctggattgaattcctggtttaaaagttgaactcctgaattataatttagtaattatgagtgtgacatatggttccacaaatctcttaagaggtttgtattgaattcaaatttagaaaaaaaaatctgtcaattatattgacagacttggattttatctgtgttactc

SEQ ID NO: 15220 - DNA, 1050 bp, Homo sapiens
caacgtggtgaaaccccatctctactaaaaatacgaaattggccgggcatggtggtgcacacttgtaatcccagctactcgggagactgaggcaggagaactgcttgaacctgggacggggaggttgcagtgagccaagatcatgccattgcactctagcctgggtgacagaacgagactctgttaaaaaaaaaaaaaaaaaaaagttgcaccagagccatcggagcctaggggcagccagggtcctccagatctaggcaatttgttgggtcctggcactacactgtaagtggaatgtcaacggatagggtccaaaaagagacttcagttaaaacagtagaaaacggaagaacgtcctcacctatttgtttttgccctcacccatgaatttctccagactggaaagttcaaggcataggaaaattgtttttagaaatccacacggacattcgagcgtatactgagtattcattatgtgtgaacattaacaaagttattttcatcttaattacgaatctgcaccagtgatgactgactctgcgtctctcctattcagattgtgtctgcagttcaatactgccatcagaaacggatcgtacatcgagacctcaaggtgagtagaagtgcctcactcagtgtatgctctgtctgtttgtgtgcagttctctcagtggtcattacacaaatgaggtatagattagccttattagcattttttaaaatcccacaataattgaatcctcttaatcaagttatgggaaagagcattaaaaataaagaaaaataaaggttattgaaagtattttacatttcagttacggtgactggtggttgatctctggagaacagtcatcacacagccaaacaaatgtgggcctccagaaatgtatggtcacgcccacagcatcctcagtgccacccggcattcatttctgctgctttcatcagtattctctcccgttaacagcagtgcctgtttgagacctctttcaaggtcctcagcctctgccctcactctggcataggatgaggtttcgtatcgcacagaga

SEQ ID NO: 15221 - DNA, 1448 bp, Homo sapiens
aaatgcctaatcctgtcataattctaattctattttggctaaatttcatttttgtcttgatgttttccctctaggctgaaaatctattgttagatgccgatatgaacattaaaatagcagatttcggttttagcaatgaatttactgttggcggtaaactcgacacgttttgtggcagtcctccatacgcagcacctgagctcttccagggcaagaaatatgacgggccagaagtggatgtgtggagtctgggggtcattttatacacactagtcagtggctcacttccctttgatgggcaaaacctaaaggtataagaagctgcacccatgtacttcactaaactaaaagaagtttcctaatattacatggcttaatatttttaacattatatcagtgcggggggtttcagggggttttttgttgtgttttgttaactaaacctaaaggttgacttactcgttttctttcctctgtacctctccaaaggaactgagagagagagtattaagagggaaatacagaattcccttctacatgtctacagactgtgaaaaccttctcaaacgtttcctggtgctaaatccaattaaacgcggcactctagaggtaatcatgtaggtggaaacaagcagtaactttggagagtctttagagtgaccttagatctttgcttgatttgtatgccatactggatatatcctgcggctttttaagcaagaattgaaacattaaaaaatattttttgagtttatgctttgaacgatagtcaatgaaatgttgaaaataaatttttgtaaatattacggttatcagaatatttcattttactctgctaatgaacagtttaccttttttagcaaatcatgaaggacaggtggatcaatgcagggcatgaagaagatgaactcaaaccatttgttgaaccagagctagacatctcagaccaaaaaagaataggtaatcactccatgcctgcatgttcatgtgtttttgtctaagtaacatatttctgttttgactcatgtctgtgcctaaaatgtgaataatggaaagttaagcacaagtcatatgaacagtttatctgttctgtcatatttaggaacgtaactacctgcagtttcctataatggcacccagtaactctgaaacaagtgcccatttatgttacaaaatatatgtaatatgtcatcttttaggtcaaatgaaaattattttaccctacaaaagaatgatttctggccgggcgtggtggctcacgcctgtaatcccagcactttgggaggccaaggcgggcagatcacctgaggtcgggaggtcgaggccagcctgaccaacatggagaaaccccatctctactaaaactacaaaattagccaggcacggtggctcatgcctgtaatcccagctactcgggaggctgaggcaggagaattgcttgaatctgg

SEQ ID NO: 15222 - DNA, 1028 bp, Homo sapiens
attggttcttactaggccaatctttgttttatcagctttcctgtgggaacaataaagttaatgacacagggagcataggttagggccagttgttactttggcacaaacacctgtgattcgttttctgagactagttttaaactggtcgtgctgaaggccagcccactttctgctgtaattattctgccttctgatgttattctcgaaaaatggccagattccaggcgtgactaatggttggtgtaaactaggcatgagaaggtttgattacaccttcaattgtatgattctatcatgatggtataggtttgcagtgagtcttaaaccacatagcactgacacgtagtgagtgctcaaacaaatgttagctttcattattaattatagactgttcagacaaggttatgcagaattttcttagtttgcactgactaaacctaatctttcaagttaataatgttgctaaaccacctacatagcagagacactctgctcctacgatttcatatgctttagatacccggacgacactgtttagactacttcatttaaagaccccagagaagtgacgtgctggtgttacagtaatgcaaacagaatcttttcttttttttttttctttttttctttttttttctgcgatggagtctcgctcttttacccaggctagagtgcaatggcacgatctcgggtcactgcaacctccatctcccgggttcatgcagttcttctgcctcagcctcccagtagctgggattacaggcacacaccaccacacctggctgatttttgtatttttaatagaaatggggtttcactaggccaggctggtctcaaattcctgacttcaagtgatccacctgccttggcctcccaaagtgctgtgattacaggcatgagccactgcaccaggcccagaatctttcaaataaattttagatattggatattactgtaaagtttcaaaattgtgaagtggcttattattttatccactttaccctgcatcaagtcacatagagattgag

SEQ ID NO: 15223 - DNA, 1061 bp, Homo sapiens
gaaggcaaagcctagagagatggcaggggccagacttcaggggcctggggatgtgtacttgcactccaagtcgaggagactgaactttttaccaaagacttggtgttctgtagaagtatgagcagatgagtgacaagatctggtttatatgttaagaagttctcagctgtaaggtgaatagattggaggtgttggggcaaaggcaggggacccagtgaagacaaggagcgaggctctatactgaggccctggtagaagtggagcagatgggccacctgaagagctactaggaagttgacaccaataagatgtcgttagtctgtgtatggggagtgagggaaaggaagaacttgccagtttccaggttttaatccttccaaaggatttctgcagaaagacactggaagagctgtattcctacttatccttaaaggaaagaaactgcccttgaattccaaggacatgattactgagctggaattccaaataatgtgtcccagtgagactcctgggggtagttttgtccggtaactgtgtgtgttagatgaaactgcagacttccagccactctatcttaccatgtctgttaacagttaatttgctctgatgaatttgcccatcttggagaagggggctctgctgactgttttttatcttggagtaaatgtcctttgattaggaaggttctagactatattgttaaaacaacattggaaggctgggcatggtggctcatgcctgtaatcccaacactttgggaggccaaggcaggcgtatcgtttgagcccaggagttcaagaccagcctgggcaacatgacaaaactctctctactaaaaatacaaaattagccaggcatggtggagtgcgcctgtattcccagccacttaggaggctgaggtgggagaaccacctgagcccaggaagttgaggctgcattgagccatgatcgtaccactgcactgcagctaggtgacagcaaaaccctgtctcaaaaaaacaccaaacaacataggatactgttatataacagctagttcctatacctgtaatcttattaat

SEQ ID NO: 15224 - DNA, 1029 bp, Homo sapiens
cctggccacgtccctgcgaggccctgagtggcgtggtccaggctgccccagcagccccagctctgctgccccatcaaggcagagcactagggtgagtgccaggcagcattccctctccaggcctacccatcccagccaggagcaggctctagatcctggtttgtttccccacccataataggaaggtgacataataggacctacgtgggcatcaagtaagttggggcctgaccaccacaagtgctcattaagtgccaccagctgttgtgggggtgatgacactgtgcctccagttccactcagtctgtgtactttattatgccacagacacatcctgtactttcctacctcccctttggctgtgatcccctctactcaaaacaaacactcttccctatcttcattgcattttgttgaaatcccatggctcttcatagctctcctcagatgcaggcccacccccacccgtgctgtttcctccttgtctcatcctgcctgtcacgttctcctgctcggcgggctccacctcttctgctgccctctaggagatggccagcctttcctgtgctgccactgttgtctcaccttacagtcttcctggctccagatgagtttgagagcttttgcttatctttgtaacccatttagtatctaacgtggcattttatacataggaagcttctctcatcagtattggtggatgtgaaccaaattgaatactggcaggttggtgacacggagagctatgtgcatatgcaaaagctgtagcccctcacctctggttagttggccataggatggagtgtacttaaggtacatagactattttactcccaagaatgctaggcactcactgtcttaattgaggccaccagatacacacatgagaatataaataacggcttgtggcaataatgactaaatgccaaggagtggctggtaaaccgcggtgttccctagagaccccggcctgggctctacttaggctgcctcttggacatcagaccaaggcttacattctgaatccac

SEQ ID NO: 15225 - DNA, 1192 bp, Homo sapiens
ctgatggtggttgggttttggacatgttttgaaataagaggcaactgcattttccctggagttggatatgaggtgagtagagccaaggacagcttcatgatttttgatctgaacagcaaaaaggccggaattgctgtttgttgagatgcggaatgtggctggggagatgtttgggaacaggaggggaagaagatgaagagagcaagctggaatgtgctgagtttgaagtccctttaaacactgagtggcaacgtctagtgggcagttggataaacgtgaggggttcggccaggcgcagtggctcactcctgtaatcccagcacgttgggaggccgaggtgggtggatcacgaggtgaggagatcgagaccatcctggctaacacggtgaaaccccgtctctactaaaaatacagaaaattagccaggcgtcgtggcaggcgcctgtagtcccagctactcgggaggctgaggcaggagaatggcgtgaagccgggagacggagcttgcagtgagccgagatcgcgccacagcactccagcctgggcaacagagcgagactctgtattaaaaaaaaaaaagtgtgagggttgggagaggtcgggtctgggagagaccataggaagccctcagcaggtggaaggctcctgctcaaagctgtgagacagaggagaaaccaggactgagccctggacacagcacggggagaggccccggggagaagaagtgaagctggcaaggcagcagcaaggagggagggccctccaggtgtcaggcaggtggacatcatgacctaaggctcaccttgcgggaactttctaacttgacttttagcaagtaagtccccttccctctctctgtccagtgcctttcagagtggagtcctctaacggagctgattgtgcccagtcacagacagtgaggacttccccagctttttttgcctggtgcaagctggtttttatatcccattaaagcatcataaagccaacccggacaagagaattgggatgtctctctgcacacatgagcctttttgtttgtttgtttgtttccccggagacggagtcttgctctgttgcccaggctggagtgcagtggcgtgatctcggctcactgcaagctccacctcctgggttcttgccattctcctgcctcagcctcctgagtagctgggactacaggcacccgcca

SEQ ID NO: 15226 - DNA, 1035 bp, Homo sapiens
gcatcagcagtcatagcaccaggccgaggcgagaccctccgagcggagtccggctggttaaagggcctgcacgggtctctcacagaagaaggaaagctggtcctgagggtggagccaggggaatctgggggccacttcagcattctttgttgccattggctttggttcagtaagctttgttgatttattttgttgttgttattgttgttagagtgatggggctgattgcttataagttctgaggttcttatttgcgtttccagctccctgggtattcattcatacctggtttctggctgtggtgaaatgtcttctgaccaagtgggttgataaacagggggcttcgctggagcgggggcagggggcgcggtcactgaacagagaaaaaactcaactcatcctcatctctgaggggactctttcccccagccagtgccttctgcagtttcctgctctatctatattccacccacttaacccacctctaagagttattttaaaacagcattctagaacccatctctcaagcaagagggaagtctccaatggctcatcctgtgccccgcctgcatctgcgggcacctgcagtgccgggacgctcacagcccgcccccaggacctgtggggggagttcagctgcttcggctgcttctgctgctccgcgtgcacatgggcctccttaccaccctggcagtctcctcctcttggaagttttaactattcaagactcaatggccaggcgcggcggctcatgcctgtaatcccagcactttgggaagctgaggcaggaagatcacttgaggtcaggaatcgagaccagcctagccaacctggtgaaaccccgtctctgctaaaaatacaaaaaataataattagccaggcatagtggcagtgcctgtaattccagctactcaagaggctgaggcaggagaatcacttgaacctgggaggtggaggtcggagtgagctgagaccacgccactggactccagcctgggcgacagagcaaaactctatctcacaaacaaaaacaag

SEQ ID NO: 15227 - DNA, 1042 bp, Homo sapiens
gtgttgtggccgccgccgccgcgcgtcgcggaggcacgtgtggagccccggcagcaggagcgtcgcaggtgagactccgcggggtacagggtggcagggcgcgggtgagggtgacccgggccgggcacggcgcgcagggcctgtccctccagcctcgcatgggcggcccccgccggcccggcctggccccttgttgcctctgcatcggctgggcggtgtttgcgtggacggccagctccgcgtccccagccccttactggggagccctgaatcctctgtcataccctgccacctagcccccgtgggggagactggggtgaggaatcaagcctggcttggaggtgacctcattgaccatttgcctctcccccgccggtggacacctcgcaaaggcgcttcctcatctcacatcttgggaatgggagtcaagctcctggagaagggtgatgggagggtcgggtcctcactccgggaatccttgggaccgaactccgccattgccaagcctcagtcttttcatctctgatttaggctcatagtccctgtctcttgtcctagaccaagaaaggcttcagaggccaggccagagtgcagcgctattgggctccctgtcaggcagtggcagagactgaggctgagctagccacaccccgcccatgcccactgctgggatgtaggcctcgaagccttctacctagaccctaggccctcatcctgcctcctgacttgctcatgcctacacacacccctccccaggtccttggcccttgccagacattagcaccatgagcttcgtggcatacgaggagctgatcaaggagggtgacacggccatcctgtcactgggccatggtgcaatggtggcggtgcgtgtgcagcgtggggcacagacccagacccggcatggtgtcctgcggcactcagttgaccttatcggccgccccttcggctccaaggtgacgtgcggccgaggtggctgggtgtatgtgctgcaccccacgcccgagctctggacgctgaacctgccgcaccgcacgcagat

SEQ ID NO: 15228 - DNA, 1014 bp, Homo sapiens
ttgtaacctctgccaccccccaccggccccagtatttttagtagagacggggtttcaccatgttggcccagctggtctcaaactcctgacctcaggtgatccacctgcctcggcctcccaaagtgctaggattacaggcgtgagtcaccacatctggctaatatttgtatttttagtagagatggggtttcaccatgttggccacgctggtcatgaactcctgacctcaagtgatcctcccaccttggcctcccaaagtgctgggattataggcgtgacccactgcacctagcctattttgtatttttcagtgtacacatcttacacgtctcctctcaaatttattcctaagtcttttattatttttgatgctatcataagtagaattgttttcttgatttcatttcagactgttcattgctagtgtatagaaatacaattgatgtttgtatattggtcttgtatatatcctgcaagcttgctgaactcatttattagctctaatagttttttgtttatcctttctccttaagtcttaatgtttaagctgaaattacctttcaggtcagaaagcaacattgaatgcagaagaaatggcggacttctacaaggaatttttaagtaaaaattttcagaagcacatgtattataacaggtaggtgtttactcttttcctgaaaatttgaatagcacatccagattaggtaggagtgttttcttacctgaatttaacaacattcatgtttatatcagaggtagaagttgcaagactttatcaacttttttttttctttttttctttttttttttttttttgagacggagtttcgctctctcgcccaggctggagtgcagtggcgccatcttggctcactgcaagctccgcctcctgggttcacgccattctcctgcctcagcctcccgagtagctgggactacaggcacccgccagcacgcctggctaattttttgtatttttagtagagacagggtttcaccgtgttaggcaggatg

SEQ ID NO: 15229 - DNA, 1047 bp, Homo sapiens
caggtgtgagccactgcgcccagccagttaacttctttttatttttttttttactttttttttgagacgaagtctcgcttttgtaccccaggctggagtgcaatggcgcgatcttggctcactgcagcctccacctcctgggttcaagcgattctcccttctcagccttccaagtagctgggattacaggtgcgtaccgccacgactggctaatttttgtattttaagtagagatggggtttcaccatgttggccactcctgacctcaggtcatccccccgcctcggcctcccaaagtgctgggattacaggcgtgagccaccacgaccggcttcagttaacttctttttaaagaaaatttctaaattttggaattattttattttacttatttttaattttaaaaattttaccctcctctcaagtttccaatggaataattttaaattgattgaaaagttgaaaagttagagaagaaaattgatgtgcccataacccagtctcccctgatcgtccataatcatagaacagtggtcagaactaagatattaacatcaacactttactgttaactgaaacacagacttggttggatgtcaccaggccttccactagtatctcttttctgtgctaggacctagtccagtgttccacattgcatttggaactaacgttttttaaatacctgtatgatgccagacatgttcatgtacataatcagaatactagagaggtgcacatttgtgtgtctcgttcgaatccccatcctaagactactgaaacagttttttgcgtagcaccagcaaacctgcatttcccctctgtcttcatctgcttgggctactgtaacaaataccacgggctggatggcttaacatttattttctcatagttctggaagtccgagatcagggtaccagcagggtccggttctggggagggccttctttctggcttgcagactgctgccatctctttgtgttctcatatggtacagagagagagggagtaagctctctggtgtctctttttatgagggcactaatc

SEQ ID NO: 15230 - DNA, 1069 bp, Homo sapiens
aaaagcaatgtgtctttatcacattttcccttccggagccaaacagtgttcatctgcctcatgacaaagctaatttcttactggtcaggctgttacctgtcttttccattatgtagtttctgattttatttctttgactaatcagcaaaatgtagggaaacatgggtcacaggcctttaaagctgggaggtttcaaactgctcccagggatcctgccccagagccgattgtggtggtgaggaatctagcccctccacttctctggggatcagagatgcaccattttcacctgttgctacatatttggttcccaaataagattttattttgagtcagggttttccctgctctcctagacctccctcaaagcgcgggagaaggatctgaggcatgaaatgcagccatggcccatttcgtcaaactgtggtctgcactcaagtatttgtattctagtctaaaaagcttttcattactcctgttcaactgatggataagccagattgtcggcgatcctacatttgatgttaaaaactgatcatcttttctaagattcttagttaaaatgtatttaatattaaaaattttcaggacaggatgtgtatagcacgtgtaagatgaagtgttgtcctgggtctgttttataggaggacaaagacactgattctaccaaagagcctctggatgaccttttccccaatgatgaagacgacccagggcaaggaagtgagtgatgggtgatgcaggcatgttaccgagtgcagaagagaggtgttcctcctagaacacggtcatagcaatcagtggcagccttagtgcatgcggcctgcctggaggaagcaccaccagagcggggttgcctttggttttccaaaataatctgtgttgtgatacgggaatatgctagagcagaccctaggatacagcggcatgcacgtgcagttcaggcgtggtctgcagattcttacagggtgaagaggtcagaattacttatcctgcttgtttcatggcgccaagaggagtctcatggcactgagtggccatgttgccatccctgacactgtagtcacta

SEQ ID NO: 15231 - DNA, 1035 bp, Homo sapiens
gcctggtgcgctgtgcctccttttggaatccgggattcaacttgccctttgccccttgtgtgctccccgaaccctttcacccctgttgaaggacgccccgggggagtggtgggctctcagttgtgtggtagaagagttcctttggctcagtgcctaggatgcagttgggggctggagccggaggcagggtgtcctgttgggacaggattgaggttgtcggggtggggcgaggggaacctgagcaaggaggaggacgtggaggaagaggagagtacagggcctaatgacgcttgaagagaaatgcggtgatatgactacccacacgcataagtgatttctttaaaaataagttttgaaagttgataaaataaaaacacacaaataagaaagtaagccccctgttataacaacactatttaaaatgaggccgttccctttggctctgtagtttgtcagcagcttggtctgccccatgactatgcagcagggtttcgtggacattctggacattttttgactgttttcctgttggtgaatgttgagattgtttgcatattttcttttttcttttttttgagacagagtctggctctgtcacccaggctggagtgcagtggtgcaatctcagctcaccgcaacctctgcttcctgagttcaagtgattctcctgcttcagcctcctgagtagctgggattacaggcatgcgccaccatgcctggctaacttctgtatttttagtagagacggggtttcaccatgttggccaggctggtctcaaactcctgacctcaagtgatccttctgtctcggcctcccaaagtgctgggattacaggcatgagccactgtgcctggccaattgtttgcatatttcactgcaggaatttcttagtcagagatatttgcatttagctcttaattagattgagacatttcattgcaaaaaaattttttttttgagatagggtcttgctcagtgatgcgatcatgggtcattgcaacctctgactcctggcctcaagcaatcttcctgcc

SEQ ID NO: 15232 - DNA, 1075 bp, Homo sapiens
actttaggtagcttattttattttattttttttacacggagtttcactcttgttggccaggctggagtgcaatggcacaatctcagctcactgcaacctctgcctcctgggttcaagcgattcttctgcctcaggctcccgagtagctgggattacaggtgcctgccaccacacccagctaatttttgtatttttagtagagacagggtcttgctatgttggttgatcttgaactcctgacctcgggtgatctacccgcctcagcctcccagagtgctgggattacaggcgtgagccaccgtgcccagccttggtagcttatttttaaattgcatttgctacaattctcctgcctcagcctcccgagtagctgggactacaggtgcatgtcgccaggcctggctaattttttgtattttagtagagatggggtttcactgtgttgcccaggcttgtcttgaactcctgagctcaggcagtctgcccgcctcagcctcccaaagtgctaggattgcaggtgtgagccaccgcacctggccactactttttggaactctattttgtacttgctgactttcacaaaaagtttgaggcagcttacaataggatgtaataggatgaaagaagaaacaacaatatattaatacgtggccagaattagtgtgcttcagaggttgtagaagccttattaacctttctcacgtttttcaggggaaagccttgccaggcagttactactactcaattgagaaagatgtgtgctaagtctcaaaagcaagtacttgttctcagtcacatcagtagtgagtagcacgcttaaactgagagtttctggttctggggtgtttctgttttactccaatcaagaaagattcttcgttcctccatactcaacaaaatggagggagactgggtaccaagttcagacacaacaatatatttacttttgtttgttgttttttaaaatattttttcagtatacatgtagcatatcatcttcttacagcaagactgtgcaatagatcatatacttgctttgtagatgggaaggctgggactgcgtgaggtcacgtaa

SEQ ID NO: 15233 - DNA, 1677 bp, Homo sapiens
acctggaggcagaggttgcagtgagccaagatcacgccaccgcactccagcctgggtgacagagcaagagtgtctcgagaaaaaaaagaaaaaagaaaaaacaactatacctgttatctgtataatgagaaaatgtgatttcaattatatatatatatatgtatatgtatgtatatgtattttttttttttttttttgagatggaggttgcccaggctggagttaggtggcacaatctccactcactgcaacctttgccttccgggttccagcgattctcctgcctcagcctagaaggcattttaatgctttttaaaaggttgaaaactactaccatagggaaaaacattgtgcctccctgttgggaagttacagcttcagcagaagtgactgccaggaatgaatgtgacagcttttgattaagttataataaccacatacaccagatattcggctcagtttttctcaatattcataagtaacattgaaaacaaagagttatgtggtcaaagaaaggacaaactggttaatgataatcgtcccctgtgggccctgggcgttggtgtcacacagaactgagaagcaaagcgggtggtgacagaccctggtaatgtgcagggagcgtccggatcggagtctcgacctggtgggtggtttgtccagggaaggacagttctcttctttaggtacacacggtagggactatgattaaactacttgacagcggcacctctgtgacctcattttcgtgtgacacatgcagatctggaagccgccgtcaccgtgagtctcagttggctctctctcacggtcttgcctctgaaaatgcaactgcattgtgcacagaaatccttttctgggtaaaactgggtcttctataactgctgtccgtgtggcttcatgttcatggtgtgatgtgcatgtgtcagccaccagcaccaggtccctgttgggatgtgggagccccttgggctgtctcatcatttagcagttgtctttacagtggtcccatcctctgtaaagacacacagagccacatcacacatcctctatcctaggtggagcccggggtctgcctcccagctgcaccacctttgtctgtctgcaggtcgccagctctgctggggccttctgaagcagcctctctccgtcttgccattcttttcacactgctcccatgttaagatttctacacgtttcgaagacactaaattcttacctaggattattggggaatggaatatatggttagaaatagatgaatttttatttttaaaaaatgacaataagggctggacgaggtggctcatgcctgtaatcccaggactttgggaggccgaggcgggtggatcacttgaggccaggagttcgagaccagcctggccaacatggcgaaaactcgtctgtgcgaaaaaaacaaaaatcagccaggcatggtcgtgcgcgcctgtaatcccagttactcaggaggctgaggcagggaattgcttgaacccagtaggtggaggctgcattgagccaagatcatgccactgcactccagcctgggtgacagagccagaatctgtctcaaattacactagtaagacaactagaatatgccaaaaataaataaacttaagcactaaattatctgagatcctactgtatacagataataacgatgactgcatattt

SEQ ID NO: 15234 - DNA, 1050 bp, Homo sapiens
agccaaggtcctcaggtggcaagttcagggaagcaggcagactgacccagagtggggcagacccgctccactgccaaccccaggtgctggtctgggtctgcagaggctcagggaggaggaggcagctgggtcggaccccaattctgggactcctgggcccattgcccagctgtcagctgtcagcttgctactccagcagctgcagaggggagagagagcatgagtgagcgtgtgtgcacgcgtgtgtgtgtgtgtcacatgaaatacttttgaatctgagtgaaatgaatcttctgtgttctgccaagcatttagttgaggtgtattataaactactgtagtgtagcgctgagttttgaaatgaacagcaggggctgcactgttaatgacgatacgttagcattttagcatcctttttctcaagagcagcaaaaacttatgttttcttgtcctccccacatttttgaggtgttggtaacaagtgttatttttccattttaaagatgaggaaaatgaagctcgggctggttaactgacttgctcagcgtcccatggtgagtccgagcgggcggggcgcaggccctgccgtctggcgcttctgtcgagacgtcggctttccaacctggcaggacccaggacgcattgctgcctgtggaaattaattttcttttggattatcaactgcatgtttaaaatgggctgtagacttttaaagtccgtggtttcctaaagtttctgaaatgtctaaaatgtgtttttaagagaatgaaagtcatacctgtagcctttattttggtccctatgtttttcattgcataatctccttatatacagttacttgtaaagccttttacaccaagtgtcaaggagatttctaatacgttgccaatctttacgcttaaagtgttgacatttactttgatgaccattgggaatggaccagtctggattctgtgaaatgcaccatgaggcccagcacctgctttatgctggactggtagaagcaggcagaaggtcatcccagtcctaaagccactcagaaggctgctg

SEQ ID NO: 15235 - DNA, 2795 bp, Homo sapiens
ccagtgctgcccgctgtgtctagcagcctctaggatcttgtcagagctgcacctctctgtgaactggccattcctttcggtgctgctgtcctttttgggggggttcctgatttctgtatacatgtagctttgccagatatgtacttagtaatataaactgtattaataaaatccatttactgtgtaatacacgagtttaaaaattaagagcgattagctgttcactttggtaacaggtagttaagtgtcacacaaggtgttgttgcaatggcatgacggtgacctgttgacgtaactaagccttacagcaaggcatgtgccgcacgtgctccgtggtacttagagccctgggggccccgctcggactccgggtctccctaggatatgccccagtagcatttgctgtgtagtctgtgtgtgaaatttgggcattctgcttttctctactaatcttgaagtgctcagtgatttgtgtatttgtgtctttctaacttctaataaactcactccgactgacctgtgtcttggtgtctgtctgcttggtagaacttctcactctttatccatgaaacgccgcatggcacagctgctaggggtcatggggtgacagttcatctcaccaaggagttccttccaagaagaaatgctgctgtatgcacatcttcttcactctgtgttttttattttcatgttcagatactgccaagtatttcacttattaatacctgaatcaattaagatgagagctgggcactctcacctccctacaaggttgtctgaggatttttagttatttgtatagaatgggcattttatttaattttccaaccacctttgtagttaacatttaatgaaactgttctgtaaaatttactgaaggaaacagtacctccaactattgcatttagacgaaactgttaaaaggaagagcctctgtcagatccaaatggtttgggtcctgtactgtgttacttgtaccagatgcttatgtatctgttaaatgtggaagtcgattttgatgatattcttagaagctgctttaattttcctgagactttgtgtgttggcttttgtctcaaaatagcaggattcacattgcttttgggatgcgatcacttgtttgaatgagcttccttatgtccaaaggttttcatgatcattggattatctttaatgaaacttaaaaagaacaatttctagttaaagtatattcacgtacatggtaattggtggtttctgcaagactctgtcagcagtgagctgctggcaagcagggcggccttggtggagctcttatttgcacccggtgtggctcttgtgggaaggagggagaaccacctgcagcttcacgtttgttcacgtttttttcaggatggcactggatctttaaaacgcagtggttcctttagcaaactccgggcttccattagacgcagcagtgagaagctggttaggaagctgaagggaggaagttcacgagagagtgagccaaagaaccccgggtaactatctcttccagctctcccgactccctgcacgccggctgctgggccgcttctcttcctagcgcagccttcctcacccacagacttgaggaaagacactccagttggttcccgtattctcacaaccgaagggtttcatagttgccacgtaggtttttcccaggataggttgagaagtaattgggtaacttcctgttagtggctaaagggcgaatacctttaaaagaaatttatggaattttttgattctgtcacatgttctaagaaagccttagcaacgaaatgtgggcatttatattaaaatgttgagcattttgaacttgtttactctagatatgcattattttttaaattagcattagtttaaattctttaaaaattttaatcttttaaataaatcagatgttagctatgactatattaaatctcatacagtattataatagggagaaaaatggtttcaaataggatcagaacttttaagactttattataaggagattttcaaaacctcaggcttttcatatgtttaaaaaaaggtttgagtcatgggtcttagaggcttttgaaaaataacatttaagttgtcaaaggaatttggttcttaagatatcctttgtttttaatatggtgcacaaagttgacagattgtccctgccgcagtgtccagggtcacctctgggcagctgctcctggcttggacgtatttctcatgaggcagacttttgccagccactctgtgtaactctgacttcctaaatggtgaccgactttttagagactgattcctagtaaaactattttacaagtgatcccactttaagttctgtgagtaagaagtctgatcacctcaggatggtgaaaccgagttcttctggagaacatattggaaataataaagttatgtgcctgatcagttgtttcgttactctgtctttttcgttgttgttgttgagatggagtttcgttcttgttccccaagctggagtgcaatggcaccatctcggtcaccgcaacctccgcctcctgggttcaagtgattctcctgcctcagcctcccaagtagctgggattacaggcacatgccaccacgcctggctagttttttgtatttttagtagaaacggggtttcaccatgttagccaggctggtctcgaactcctgacttcaggtgatcttcccgtctcggcctcccaaattgctgggattacaggtgtgagccaccgtgcctggcctattttgtcttttaaaagctatttaaaaaaaaaagtatgtccactttttcatct

SEQ ID NO: 15236 - DNA, 1040 bp, Homo sapiens
ctgttgggacttggcagtccctgcccctgtgctggtgctgagagttcgcgacagtggccaggcactgccctcccagttgtccagatccactaatcctcacagacaggccagtgccccgacctgtcccccaacactcttgggaggcagccatctcgggaaagcttttccccagcccccttctcggtggctgttaaagaggcttgtagggtgctggacatgttgcttgaagcacccctaatgacaagaggaaagaaagtctcttcattttacagggtcctgtagctgacccagtgtttgccctccagtttcttggagtttctacatgcacattgacccctgggcctctcgagtgccaacctagatttagctgtgcagctggtactgttaggcctgaggccatttgaagctggcatcatttgaagtcctggttaagtgtaatttttctatttgttttttcatgcaggaacgaaataattgtctggccgactcgcgagctctgagtgccagccacactgacctggcccactgagagccagcagggctaggtaacctgtcttgggagtgtgagaccgccccgccctgccacgcccctcaccgccctgcccggaggcgccagccgcactccttggcttcctttcctagatagtgacgtccaccaaccttggaggtgccttttcaaaacacccgggaggccgtgcctcagcattctgttactcggcctgcagccccagtgccaggagccaccccgaccgcgacccggccaggctggctcagggaggccgaggtggcgctgaggtggcttcagcacgctggggattggctcctgctcacggatgctgttgcatttcctgcctgccacctttttgccatgacaccagactctcttttaaattgtaatattgtaataaggctgtaaattaagaatctggaaacataaagtacccctttcagaacgataggcatttagtgatctatggcagtaaagcctgaagcttagcggacactggtcagtgggaagtgaattccttcccagctggagc

SEQ ID NO: 15237 - DNA, 3225 bp, Homo sapiens
ggcgtttcactttttaaaagcttaagctttatggaatgagggagcacggtggactctgacaggaaccttttcaaatcaatgctgaggctgtatttcttagccgtccacaaactagtccataggtaaagagcatacaaaacagacgccgaggtgatcagtgattccaaaggctgacgctcagcagcgccacctccatgccagccaactaggctacgggatggaggggcggtctgtgaaacaccagccatcccgtgaaagctcagcttgccactgtcatgtaacagggtgggtggtggcacagcagaggctcacacttgtcaccttcagcctctagaagctccccgtggggcacgaaggctggggacagagtgtcctgaggttttgttacaaggctagactttaaaatacctttcaaagtttcatcccgcctcatgtcgcaggactgctgtgtttgtgaaagcgcgtttgtttccacaagacaagctccgtgtagtcgccagcgggtgcctggcccaggagctgccctgtggagccagcgttgtccccgagctgctcgcctgtggccgtggctccttttctgaggctcctgactccattcttgcagattctggtggatcaggagcttacattctaaatgctacatagaggtgttgaagaaaatttcataggttctgtaatagtggatgggattaaaagaaaaaatgttaaattatatatatatatatggctgggtgcggtggttcatgccagtaatcctataatcttagcactttgggaggctgaggcgggaggatcacttgagcccagttcaagaacagcttgggcaacacagcgagtccctgtgtctagcaaaaaaaaccatgtgtatatatatatatatgtgtgtgtgtgtatatatatatatatatatatacatacatatatatacatatataatttgatgggttgtgagaagccaaccccccccaaaaaaaggggggtgtagagcagcttcccctgacaggtgccgtggctgcccccgtagtgggctatgtctgtgcacaggcgacagggaggagggctccggagcttcccttgtggtgggggtgccttctccctgtgaggatgctgagcagagtttggaacccagacagtttcccttagtgacagttatctggaaaggaaaaagggcatttagaaggaataaacatagggctgaatatggagttgaattttaacctcttcagactgatgggtgcagacgaggttgtgtggggcctctgtggagcctgctgtggcttccagccatgggactttagggccgaggtggcctctgcagcactgtggctgtgggagcactgtgtgttggggtaagagaagccagggggcctccctgaagccagctcataaaggaaggttcgtgtttcagagggaggcggcaagggaatctgagtacctgagtccccgatgtttgaacccttccacccaatagaagtgcggtgatttcagccatttcccatctggcggtctgaatttttcccttcagaggagagaagtggtgggcccaggcatccctcctcctgtgtgtggtcgttctggtgagaggaaccccacgcgagagtcagcacctgtttcttcagagttgctgtcaaaataatcactgcgcccccgccccccgcccccccccacagcagccgtgtgtgcagcgcccgtccccagcaaccatggcatgggagcgtctggatctgtgggcggacagcatatctctgggtagttggtgcagctgtggcagaaatcaggcccctggggaagtcctgtgacatggatgcttccctgaagcagcagcagtgtgtggctcaggggtcctcagaggccggtggtgcccgcgggtggcacggggcactctcatgggcagcacttggtcttgtgtttacagtattggagggattcacatcgttgttttctggattaagctgctaggagtatcatgtacttagaaattcagtgtttatagtaagatgtattaaacattgctaatgatgtatcgttacaatgtataacaggttttccattgtcataactgtatggaattttcttggaggatgtcattagcttctgtttgcactgacttgtgagctgtgtgtacgctgtggtcagatttctgaatgctgtagagcacttaccagctctgaccgtgtcttgctggggccagcaggctgcgtgtgcagcggggccagctgtctcagggctgatatgtagacgtgtattctgtttacaattagttccccaactctgtggggaagaacttaagcggttttagtgttttataatatggtgaggcaatgagggtcagggcgcgtggtccctgagggagggtcttcagggcaagacccatggccctggcctggaactgtgctccccagggcgtggtgcctccctaaggggatggtcagtgttctgggactgactgccaggccagcccgtctgcagactcctgtggtgggagttccctgggacgggaagcccctcggccccttccctccaggggcaggaactgagccagcatgggcggggccggccgagcttccaggcgtgttttctctgttaaatgtacctctgtctttaagctgtctcattttctaatcgctggcatgtcttgcctagaaaagcatttggaattgcttatgttcaattacagaaataaaatgtcttacttgccattgtagaattcctgcacttttgcagaaaggctgttttgtaaaaatccaaccccaaaataactttttcccatgttcatgccagtgattcttaactttagggtcatagagagccttgataacatgatgaaggtttaaacggattgtcccaccctggaaaacggcaaacagaaaaattctgcacagtatggccccagcccttacctttcccccaaccagtgccagccccccttcctcccactgtaggagcacccacaggctcaccctgggcacataaggtggggggtgacaatttctgcctctgggttgtgggaggagtcaagctacttaacggttctgggcctgaatttccctacctgcaagtggagatgtaacagtacctatccctaggagttgtgaggagaacatacttcaatgtgtataaattactcagagcagtgcctggcagacagcaagaagcaggtcctggaactgcatccattgaacatttatttgtcaaaggcctggtctgtgccaggcagcatgtgga

SEQ ID NO: 15238 - DNA, 1949 bp, Homo sapiens
cttccaggctcccgcgacgacccctccgcctccgggcggccccttccccagccggcccccgcccccgctctctcccaggttggccgcgtccccgggccgccgcctcaggctcctacgcccgcggggagggcgggaggcgcgcggtgtcccggtgcgggggtcccgggagggcaggaggcacctgtccagggcgggcgccgggaggcggggtgcggggcgcgggctggtcccgggggtgggtgcggccctgcccgaggccggttcgtgctgggctagcgcgtgtggactgcgtcccgagagctggggctcgctcccgagaaagtggaaggcggagcgccttcctcgcaggctcggtggggagggcgcgtgctgtccgcggaagcgctggagctggcggccccgcaggggtccctcccgggaaccgggggaggcgtcggtgccgcgggcgggtggccggttccgaagccacctcctgctcggaaggagggccaggacccagtctgcgggccaggctgccccccgtttcccttcgtctataccaccctccacctcggaagcgaggtcgcagtcgcccactggacagtttgaaggagaccgcagatttgcacccgtttcccatgggcccagacacggcaggagttgcccaggccactcctgcagacattggggcgtgggcgtggggtccctgagccaggccatccgctgggcctcccgtggggttccctgtgacctgatcggaggtgcctttgcctcacaccagccccttggccaactgggaaggccccgagtgcatttaatcccactggctgtgcgctaacaggtgtgtccagtttctgttctgtggattttaccacgataaaaaaaaaattgggggagaaaaagaatttttgtaatatgactttcatacttaacacgtgttacagattcgtttaattccctcagtgatagaactaagcagacgttggaactaggttcaagaagtcaaagtagcactaattgactgggttcattgaagcttggttggaggcctggtggggggtgagcggccacagagcctcggggacaggacggaattcgagtgactctggggaagtgtctctggcatctacagtgtacggagccatcaccggtcactgagcgtgtcctggagagttgagaccagtgctgcccacctctccccagtatcgccaccatgaggagtctttttagacactttccgccaatcatcctccttcatcttttttaaaatttacttttaagttgacacgtgaaaattgtatttatggtgtaacgaactcttaatagcacagaaatactctacgtctgtatgaaccgtaaggagcacgtgagaaagtgtggccaagatgaggcagaggtttccaccaaagcacaatttctttctccctgctgtacacatgcactgatcttacggttctgttttatagtgaaccactgtgttcccctccttcattctctcttccagagcccttctggtatcagctgaattgtttagcatttttccctgcctttctttgtggcctctgctgaggcactgtgtggcagtcccgcggtgacttccgactgagtggagttgaaacacttgagtcaaggtggcacccctcgtggaagagaagattcattcccacgctggcgtggtggcaggatacccctccagagccccccaccatgtttggatgattaactgggatctgagcagctgagggaggtcctagcattgggtgggcttgggggacagagaaaccattctaataagatggactttgtctctgagttttgcgttgtgaattgtattggagcatggtcttacaggccagaaacgaccaaagacagtgttctggaggaacttagaacggggcagtaagggctggaagatttggaataaagtccagctttaggtgcaatagctcgaggggacatgtacggtaaca

SEQ ID NO: 15239 - DNA, 1083 bp, Homo sapiens
gggagtgccaggccagccggggccacacccggggccgcttgttccctgcccctcctcactgccaatcctcccgcatctgcccagcaccactgtcgccgctgcgggaagtgcttctgcgacaggtgctgcagccagaaggtgccgctgcggcgcatgtgctttgtggaccccgtgcggcagtgcgcggagtgcgccctcgtgtccctcaaggaggcggagttctacgacaagcagctcaaagtgctcctgagcggtaaggacgggtgtcctgcacagtcccgcgcgctccgccagccggctcctcgtgtctgtggcgatgctgtgggctgtgcacggggcgttctgcttctctgacgttctctcgccctccctcccttccccgttttcttctggattcgtttagaagcggttatagagccttcccttcttttcagaggcggaatgtcgtctaaaatgttggtgctgactccgctgggcacgtccatcaggtgggaggggaggccctgggcccaggcagcaccttcctccttcccccgggtggaacccggcgccggcgctcgggcgtttgcaaccactgtggctcctcggaggggccggagacctttgcccaatagcacgatgcagacccggttttgagccatctctggggacctggtgtgggagaagggcattctccaggggcatagggtgtgcctccctggaatctgaacaacgagcagcgccttctccccactgtccgtccacctctggccactgccgtcccagcctcctgtcccctgcctgcccgccgtggggtctgggaccacctgccttcctgcccacagctccatcctgtgtgaaacgggcatggtccctggctggacggtgggctttgttgtgcctcctttctgctgtcttggtcctgtcctgccagctcttaggacgtgtgagcagagtggtttattgttctttgatctggaccttggtgatgaattccctgcatcgtttgaaggatgtaaaagaatttctaggagctttgtaagcaagcagaacctgtctagagcagcgcctttgggtttacctcttaaacccttgatccatgac

SEQ ID NO: 15240 - DNA, 1064 bp, Homo sapiens
tgtgatgggtggagggcacgtccttgtgctcgtcttgtctctcttgcttctttggggtcccaggggttgaggatgggcatttgggggaggacttgagcttgagggatgtgaaccattgtcctctgaacaccagccagaagcagagatggagccctagcggcttccggggtacaagctttatgtcggggcagggacgtgctctgggggagtctggccgtggtcacatgtgggctgggtggggatgggattgtggccgctggcctcactgcctctctgctgccaggtagaggacagggaaggagggggactgcaggctacccccaaaccttcagctgctcagagtcctgctggaggggcttgtgagggtttggagtgggctaagggaatgggactggggccttcccaaagctcccttaagtaccctggaaggatctcttatttgggaatcagaagagctggtttttcccttaagtaacaaagaaagtctagttcttctcttcctttgcctgctaggaagctcacagcaaatgtgctgctcagctctgggccgcgtgggacttttcttctgctctaatgggaacgggtcattctttttgttccagttatgactgactgtagttgcatggttttgtttttagcttatattttgtagttcctgcgagccaccgcacaatctttgtgcaagacagtgtgggctatgagtaaataagtaagagtaaaagtggactgaccgtgccttggtcgtgtctgcttcagcctgttcatctggtccatggaagcggagcttgtgctgttggggggagtggctgtcagctgggctttccctggttcctggtggcagccaggctgggtggtctggcctctggaagtcctggcccaggaatgggcagccctcgtcagcctctgagctctgcacccacgctgctcccttcctgctggggtgaacactgtgcttggtgagactttctcagggcaggctctggaggctgccacccccaccacggtgtgtccttgtcctgcggggcctcagtttcccgcctgtgaacagtccttgggctgcgtcg

SEQ ID NO: 15241 - DNA, 1048 bp, Homo sapiens
gtggcagagcctcctctcatcctgatggtgtaaggatgcggattacaggatgtaattgccataatgcctggtaatggcaggcccagccgcgggtcagtgtcccattagcagccccacgcgggtgctgataagcttgaacatgcatcacacccagcggccagagacgagggcgtcttatcagcgccggccctggggaccgtgtggtctgattgcagagtgacggggcatatgattagggcattgtcgcacgccgtgtgccgggctgagggctgatgagcacaccatcgcgttggagcacagccagaccgcgcacgtgaccagtgtggcctcagcgccaccccaattaggtgccgagagcacggctggctgggaccctggtgggagcagatgggggtcttgcccatcctgctctggggtcccccgtgtgtgggacagcccaccccgtcacaaccggcctagtcctgaattaaagggcctgtgcggctgttctgggcacagccctgtggccgtgctcctttgggtcctgtttggcaggaggatttgaaacgtggagacttccagaaaagaaagaatagctccagtgctcagagctcccccggtccctgatgctaagccccctggtgccaaggagggttcctgacactgggaagtaagggtagggtgtcggcccccaggccggtgcgttggtgacctggagcccagcagagcggccctggctgccttttgtttgggagccgaggccggtgccgcttgccagccgcgctgcctgctgaccttgggaagttaccatagaaaccagcgcatcgggctggggacccagaggcggttctcccaaggcgggggcgctgccggctgccattacttccagcctgttaggcaccctgggtctcagcggcttctgcgaggccactgcaggtggcaggtcgtggttcaggttgtggcgggggacatcctggcaggtgggccctgtcggtggatgcctgacgtgggctggggtcggtggtgggtgacctcctctgtggggctgcagtaccctgaaccctcaggg

SEQ ID NO: 15242 - DNA, 1028 bp, Homo sapiens
aggcaagtgagggagccgaggcctgggggcttcagtggctggctcaggtccctcgcgtgctgggattcaagtctgggtaccctaaccctggcctgtgtgccgctcagaaccatgggcccatgcaggagcccccagctactctccacagctcggtgctgggcctgcctcaggagcccacactccctggctctggttttctgtctgcaccgcaggggctaggcacatggctgcaggtctagtgaaggccagcatggccctgtccccacccacaccacacactcagcttgactgttgactgctaggcggggcggtggcccggtggcttcccgagagtcagtgcagctgccctagcatgtaggcattcggatggaggtgctggcatcaccacaccaggctggccaggcccaggcccagagggggaccctgcctgccagagctagagtcaggggagaggcatggccccgtcctctggaagccccaggctattggttgacaaaagcaagtgctgaagaaccatggtgatgtcccactagcatgggtggggtgagcccctcagacctcagagtcttcatctgcaaaagaccctgccctgtgcagttccattggtgctggtggactgccggggggggtggatgggacgccccttcttggtgccctgacccttttgctgtccaaggcatggggtctggcctgagccatgggtactgggccctgcagagcctggatggtcctgccctgcctcagccagagctggtgccggctgtagaaaagattgcgaagaacgcaaattcctgtgcctgtggggaggtggccacgccctacagccggggctggggagctctgaggacacattcctgcgctggtggccccgccaacccactttccagatggagagcagaggggaagggtagcctgcccaggggcacacagctcagcaatgagactcccgcccccttcccttctcagttggcactggcaccttccagcgtattgttccccatagccccgtgcccctgagatcagtaaac

SEQ ID NO: 15243 - DNA, 1021 bp, Homo sapiens
ggtcctgctctgagacatcagaggaggctttctggggaggaggttttgcagggcgttcaggtagacagcggaatggaggaggctgcacctgggctggctcgggggcagggtgcctgcccttcactggtgtgtccctccatccagtggccaccagtaaccctgcaggagatcccgtgggcagcacgcgctgtcccgcctctgagcccggccttgatgctacaacagccagcgagtcccggggctgggaccttgtagacgccgtgacccccggccctcagcccaccctggagcagttggaggagggtggtccacggcccctggagaggcgttcttcctggtatgtggatgccagcgatgtcctaaccactgaggatccccagtgcccccagcccttggagggggcctggccggtgactctgggagatgctcaggccctgaagcccctcaagttctccagcaaccagccccctgcagccggaagttcaaggcaagatgccaaggatcccacgtccttgctgggcgtcctccaggccgaggccgacagcacaagtgaggggctggaggacgctgtccacagccgtggtgccagaccccctgcagcaggcccaggtggggatgaggacgaggacgaggaggacacggccccagagtccgcactggacacatccctggacaagtccttctccgaggatgcggtgaccgactcctcggggtcgggcacactccccagggcccggggccgggcctcaaaggggaccgggaagcgaaggaagaagcgtccctccaggagccaggaaggtaactcagggaggggccccgggcaccgtcccacgccagggcgctggcacccagccggtccctccccttccccattgggcactgcaagttccagcggcacccaggagaggtgacttgggtgcggcacgggagaggaggcggcagtgcgtccaccgcagggcggctatgtgggctgccgcggcccgtgcaactattcctccaacctactaattccgaccttcac

SEQ ID NO: 15244 - DNA, 1050 bp, Homo sapiens
cccctgacccaggtggatggcactgtccagtctagccgaggggcctgcaggtgcagggagctgccctgcccactcagacgttgcctcctggatgcaacgtgctactgccgcacatgcccgggccatgccaggctctgacgaggtgggcaggcctcaggctgtggtgaggggtcctggccatgtgcacattccctggggcagacagtgtttgtctgcctctacccagggcagccccacccgatattgctgcatgtgtcctgctgtggcgggaaggtttgtgtcccctgcaattcggaggttgaagcttcatttccagcgtggtagcttcaagagatggggcctttgggaggtgagcagggcgtgaggctttgcccttgggaatgggatcagggaccttaaaaagaggccagaggaagctggctcaccccttctgcccagtggggacgcagcattcaagataccatccttgaagcagagacagggccctctccagacaccaaattggccggcgcctagatctcgggcttccagcctccagaaccgtgagcaatacatttgtgccatttccacattactcaggaattttgttacagcagctgggatggactaagtccagacatcccagcttctccccaggcgtcctctgatcctcttgagtctggacccagcaggtctctcaccttgtggttggttgttccggctctgaagttctttaatctggaacattctctcccttttttctcttttctttatgcctttggtagcgggagagagtcggtggctgggggcaggagtcggcaaatgttttctacaagggcctggtaaagattttaggttttatggaccacaaagtatccactgcagcccaggcctgtggccgtggtgaggggcagccagggagcgagcgtgggcgaccgaggtgggcgcggcagcacctgcacttcatttatggatgttgaagtatcaatttcccataattttcatgtgtcatgaaatagccttttgatgattttcaatcatttaaaagtgtaaagatcattcttagttctc

SEQ ID NO: 15245 - DNA, 1042 bp, Homo sapiens
ttccctgggtcggctggttctgctggcctttcctggggctggatccccaggcctgtggctcctgaggtttgggggcaggagggatggagccaccacccagagccccaggcagcacagggtgctgtgtggagtggaggccgggtgggcagcagccgtgcttgcagcgctgtgtggagttgggggccgggtgggcagcagctgtgctcgcagtgctgtgtggagtggaggccgagtgggcagcagccgtgctcgcagcgcttaagcaagtagaaagtgactcgcctctgcctccgtctccccatgccccagtggggcagtgatgggggcttggctgtggccttatgattggacgaccgggcttgaccttgtgagggcactagggcacctgtcctccgggggggtggtcctgggtgggctagtggcccagaaagggtcggcagcacttggagtgggagcaccaaaggtgtggacactggctgagagttgtgtgtgttcctgtggggctgggccaggagtgggggagggctccctgagacaagccccctcaccgccagcctggctgccgccacctgaccttgggagggagcagcgtgtgccagatgaccagagggctcccagcactcccacggcccagcggggagcatctctggggagggcggtcatgaggggaggcctggggcagcagcagagggtgggggacgtggccctggcatcttggcgaatcctgctctggagacagggtgggcacagctctgtggtcagaggcctgggggccactgctggtgttgtgctggggcaggggatggagcaggggtgcctctgcctcttgggtgtcacctcctcccctggagcacctgagggctggctgtgtgtctctccagtcccgcagcgtggacaagcagcatgccgtcatcaactacgaccaggacagggacgagcactgggtgaaggacctgggcagcctcaatggggtaagtgtgagaggccctggcctggccttttaacagctcgacccttcagccctggcccctccctctcagtt

SEQ ID NO: 15246 - DNA, 1035 bp, Homo sapiens
gcctgacgcccagcgccagggagagccctacccaggttggtcttggggccaggctggtgagaccctgagggctcccagagggtggtgtgtgaaggggatggcctgggcttgaggagcccactccgggggacatggggcctgtctccccctcttgggtggagtggatggtcctggctgaggagggtggtggcaggtggttaccctgaggcccggtctgaagacatcttcccacaccagagcgccccaagggaccagtgcagcaggacggggagctccacggcttccgcgcccctgctgagcctcagggctgctcgttccggcgggagcccagctacttcgagatccccacgaaggagaccccgcagccgtcgcagccccccgaggtgccggcacacgagatgcccacgaaggatgcagaggcaggtgggggcggagcggcccctgtggtgcagagccacgcctccttcaccatcgagtttgatgactgcagccctggcaagatgaagatcaaggaccatatcaccaagttttccctgcgccagcggcggcccccgggcaaggaggccacacctggcgagatggtgtcggctgagaccaaggtggccgactggctggtgcagaatgacccgagcctgctgcaccgggttggccctggggatgaccgccacagcaccaagagcgacctgcctgtccacacccgcaccctgaagggtgagtgcccagctggcggccgtgccagtcccgggacaggcaggggaccggactttggctgggtctgcactgttgccatgcagaggggcccattcagctgggttgacttcccatttttcagttaattgcctaagagccacctgcctggtcaggagtccggtcctgcgtcttcccgttgcacttctttgccctgtgtgggggggccctgagggctggggtgctttgtcaactcagctaaggcatggggtgatgaggctgcctgagatcgacagctgtttcctttctctcggcctgacaaggtggggtcccctgtctcccccaggc

SEQ ID NO: 15247 - DNA, 1059 bp, Homo sapiens
gatcttcgataacctgatgctgaacccggtgtcccagctgtcgcaggccatccgtgagaacacagagcaccttgccgagaagatgaagtgagtcggcttcctggctgaggtggacgcccagacaccagcacagctgcatgagctgagactcagcctggctgaatccctcaagggcagcggtttcatgggtactcgtgtgcacctgtggagcagccctcccgtgtgcacgtgtatgtggctcccagcaggcagaccctgaactcagaggagccagcgcctccagggcggcccttcctccccttctcccctagccctcatcccgggcccagccctccccaccgccgagtgtcaggcacagatgggactttggtgcccttcatgcatcaggcctcagtttcccccttaggcccaggtgggctgggatgaacttcaccatggcagaggaggtctgggagaattgtgcctcagctctgtcatctctgtccttgtccccccatttctgcctccccctacctcggacaggatcctctttcagaacacagggagagcttgggaggacctggaagccaggatcaacgccgagaacgaggtgcccatcctgaagacatctaacaaggtgagcgctggggccccgtgccccttggcctgcccccagccagcctgcctttgcctggctggccccaaaccttgtcccagctcctgcacacagagccccggggcagggctgcagcccgtcagaagttgactccacctcccttcctgccacgtttccaggaaatcagctccatcctgaaggaactgaggcgggtgcagaaacagctggaaggtgagtgtggcccaagcctggggcagcaagggaggctggcagggccttgtggggaaccctgactcacagggtgggagcaggtgaactggatccgcagcctgaccctccctccccacctccagttatcaatgccatcgtggaccccagtgggagcctggacctgctcacaggaaacaggagcttggccagctctgcacagccggggctggggaagggccgcgtggctgcccaga

SEQ ID NO: 15248 - DNA, 1049 bp, Homo sapiens
ccctctaacgagcctgtcctgcccttcagtggaggctgggttttgggtcaggctgctctggagtccttcccatggaggaatcgctgctgtccccacaccacgggtgcgtcctgtgatgggttcgtgtctgcatcctgctcagcacgtgctctggcccaggattggctgagcaggagcaggacaggtgtcagttctgtgaaggggctagcgacaatacccgagcagggcgggggcagcacccagaggtcagaggggtggctggagttccctggaggggaaagaaggggaagtacctcaaaaggaaaagaaacagccaagcagcagcccaccttgctccagagaacccagcgttccaaggaggctgcagtagggcgtgggggcctgggagaagacaccccaggctgaggcctcggactttctcatggaccctttcggggctgcaagattggctctgggagaaggggcagcccagggccccagaccagtttgtctcttttgcttcagaactttccccatcgtggggttgtgttcaggggtccaggggctgcgggcgtgagtggtgcttggggcatgtgaagctgggttgctgcctgcctggggcctgggaaggtcagccagcgcagcccctcattgggagccggagatgccagagccccccagcccctcttcttcccactttgtccccctgctcctggggcttggggctgggacagtgggggtgcccacttgtagctggttcccccacacccccaggcccagcctgcaggcctcctgtctcccaggtcaagcgctaggtcccccagatcctcacacacccccacttacgcatccaggacaagtgccaagtactactctgggctcagccctccctgctaccccaggagatgggagcgtggagggtacaggaagcagcagtggcgtcccgaggcctcgcttctccgtgccgccgcagggcctcagacaagctttgcagtcttcccgattccttcggcaaaccacggacagcacgggtggaccgggcctccaggctgcacttcccagggccctgg

SEQ ID NO: 15249 - DNA, 1047 bp, Homo sapiens
aaggtgagacttgggtggggacacagtggaacatgaagtgtgccacgctgggtggatgacgccctcctccccccgccaccgagagctgcaggccacatgattccttttgggtagcactcgggaaagggcagaatgtacaggaacagagtgagattcgcagggcctggggctgagggaggggacgcactagaggaaggcaaaggggagcctcctgggtgtggggagcactttctgtcttggttttggtggtggctgcacagtggcccacacccgtcagagctcacctgcctgcacccaggccctccgtgcaccctggcagcccagatgactgcaccagcccaggggaggtggaggaatgccacacgcaccggtacctggggaccgggggtcctcggtgatcatcccgagctccaagacagaagctggactacagccgtgctgagtggaggggtttggtggctgggtgcccgcctcctattgctcctgcagactctggggtctcgggcgcccccagtggggcaatgtgggctgctgcagggaactcacgcgtgcctggcacccgtgcaggtcctggactcggagcaggaccctgcggagcacatccccgaggcagaggaggacctggacctcctgtatgacaccctggacatggagcaccccagcgacagcggccccgacatggaggatgacgacagcgtcctcagcacccccaagccgaagctgcggtgagccctacagggcggggcggggaggaacagccatttcagatgccccggccactctgcgaccactctggcagacccatgtccagccctggagacggggtgggcagggccagctgcctcgaagcctgggaaggctctggtggctggaaggaggggtgtgcggctgcctggcaggcccaggctacggctgcactgagccaggcagctttcctttcataggccagggggtgcaagctctgggctggggaggaccgagaggggtcccccagggtgctggctgggctgggtgtggcaccccgttgtaggggatccgtctctgggg

SEQ ID NO: 15250 - DNA, 1045 bp, Homo sapiens
ggaaaggcatgggtggcctggatcagcctggatcagcctgggtggtccggaaaggcatggatggtctggataggcctggatggtcgggaagggcctgggtggtccggaaaggcatggatggcctggatctgcctgagtggtctggaaaggcctggatggtctggatttgcctgagtggtctggaaaggcatgggtggcctgcatcagtgtggatagtgtggaaaggcctgggtggtccggaaaggcctggatagtctggataggcctggatggtttggaaggacctggatgggcctgggtggtctgatctgcctggtgggtccggaagggcctgcttcatctgatgtgcccttgttgttttgtcgagcatgttcacctgtttgctgcaggctggctgcagatcccagggctgccctccagcaggattggccagtggagctctccccagagccccttcgtgtttgtggcagccttgcctggagctaaggctgcgagtttcaggggtgtgtgtttcctgcagctgatgtcagggcaggtggaagaaccaggacggggcagccaggttggcccagcgcttagtgttgccagctccagaatcattctgtgccctgtgctgcagctggtgcgagcggggtgtgcgctgacacgggctcttctctggacccagctctgctctgccgttggattctgcagtctgtccctccaggtgtggtgggagaactgcgctttcagtgcaagaagggtcctggaaattaacgtgtcccccacccctgttccctgagccaggccatactttgaaggcctgtcgcactcgagctcgcagacggagattgggagcatccacagcgcccgcagccacaaggagcccccaagcccggtgagtggggccacactgatctcccagagcagaccgtggtctgactgggctgtggtgtggcccaaatctcccagcatgtcctgggcccagggccctgtccagctgtcctggagccactctgcacccactgtccagcacactgccacgcaggtaccccgggcctccctg

SEQ ID NO: 15251 - DNA, 1057 bp, Homo sapiens
cccagcttggtggggaagtggaaatgcaagccggacagggctgagctggctgtgtgggcgtcgggcacctaggatggcagagtgaatccctccgtggagctgtgccctctggcctgtcctcctgaccatgggtgcacagagacccctttgtccttccagcatgtcagcatgtcagaaggggcccaggcgttggtcctgggggccaggccagggctggcagtggttggagatgggtggggccgggacacacagggcagggctgtccggcagggccatccggcagggccgcggccccagggctgcgccaggttctcaggccaagagggagctgtgcccaccaggcggggctgtgccctgaggagagcttaactgtctgtttccttgctcttagccctgacgaagagtcctcccaaaagttcattccctttgtcggggtgagtactggccagctttatgtgatgggaaaccgcacacctgccaacttgtcgtttacagtcagaacgtttggggattgactcgatatattccagaaccttcccacagatacgagctggggatttgccttcccatctggcctgtctcaaagctcgcttccttccctgctggagtggggtgtggggccagaggttgttagttccccttagctctgccttgggggctgataaatggaagcagagacaggtcggtggggcgaggcctcagaacacccaggaggcttggccccacgtctcaggagaggagagactgcctgcccgggttggggagggcgcctctgtcctttaggagcccaaggccccgggagcttcccagtgctcacttgggctgcagcctgcagtgtgtgggtttcacttcctgccctgcccagggttagggctgcttctgccagccaggccatctccctgccagccctgggtctccacagcctgtttcctgccatcttttcgctctgttgtgtggcctccctcccgccaggtgtctgctgtgagacagacccacagggcctggcagacaggttgcccaggcagcggaagggtctctgggcctcggtttccccact

SEQ ID NO: 15252 - DNA, 1052 bp, Homo sapiens
ataaatgaagttgtatgtaaataaaagaagattgtaacccaaggacaaaggaattttgaaatctgtaaataaagttcagtaacaacaggtggaaaatcacatgattatctcaatagatgttgaaaagtaatactaataaattccagtatctttccttaagaacaaaagaagtcgcagccataaaaaaggatgagttcatgtcctttgtagggacatggatgaagctggaaaccatcattctcagcaaactatcgcaaggacaaaaaaccagatgctgcatgttctcactcataggtgggaattgaacaatgacaacacttggacacaggaaggggaacatcacacaccggggactcttgtggggtggggggaggggggagggatagcattaggagatacacctaatgctaaatgacgagttaatgggtgcagcacaccaacatggcacatggatacatatgtaacaaacctgcatgttgtgcacatgtaccctagaacttaaaagtataatttaaaaaaaaccgaagtatagaaacctgtaggttctggataagatgggaagagatggacatctccatagcctgacggaggggagctctcaagagcttgcagtggccaccaatggaagtatttcagatgcaagcagatggatgcatggtaccactatgacgtcagaaaaatcgccaggtgcggtggctcatgcctgtaatcccaacaattcaggaggccgaggcaggcggatcacctgaggtcgagagttggagaccatcctggcaaatgggatgaaaccccgtctctattaaaaatacaaaaactagctgggcatggtggtgggtgcctataatcccagctacttgggaggctgaggcaggagaattgcttgaacctgggagttggaggatgcagtgagccgagattccgccaccacactccagcctgggcgacagagggagactgtctcaaaaaagtaaataaacagtattctggaaaccgaagcccttatagtaaatcaagaaaatgagatgtgtaaatatctgaaaagatgacaatca

SEQ ID NO: 15253 - DNA, 1086 bp, Homo sapiens
gtatagttagaagacggtagagtgcgggtccgtctctcaaaaaaatgcacacacaaaaaacattaaacccaaaccatgtgagcactgagagagtatatgagagaatatttgggatctggaagtgataagtgcctttcgtaggccaaacacaaaatccttgaaggaaaagcctgacaaatctaactacagagtttttaaacatttctgtgcaatcaaagacacaaaaatgttaaacgacagcctggaagaaaatacttgtaatatttataacattcaaatgtttaccaaccagaatctatgaagagatgcttgaaagcaatgaggaaactatttttaaaactggatagaaaagtgggccaggcacagtggttcactgctgtaaatcccagcacttcaggaggccaaggcaggaggatcacttaaggccaggagttcaagaccagtctggacagcatagtgaaaccctatctctgcaaaaaataaaaattagcccgggtggcgtgccactgtaggctcccagctgctcgggaggcagaacaagaccctgtatctttaaaaaaaaggaggaaaaaaatgaattaagtctacgtacttgcagttcctaaaaaaaaaaaaaaggaactaaatgaaacagtgaaaaagttggcaaaaattataaaggtggatctatgtggagttggtgaggatgtaaggaaagagtaagtctgttttattggtttttcaaagagcccattgtgatcattattcaccatttttaaattttaatttagtcattaatctttcctaatttcatctttaagctttcagaccatttcttttgctgttctttttgtatcttttcaaataatttgcacggtcatggtttggggacctttttctaaagatgtatttaaagctccagcttctcgcagcacagctttgaccatacctcacgttttggtgtgtcctgatttcatcgttcgtttctcagccaccatgtctggctaatttcttaattttttttttttttttttgagacagtctcactctgtcacccaggctggagtgcagtggcgtgatcttggctcactgcagcctccacctctt

SEQ ID NO: 15254 - DNA, 1019 bp, Homo sapiens
gcctcagcctcccaagtagctgggactacaggcgcccgccaccatgcctggctaatgttttgtaatttttttttttttgtagagacggggtttcactgtgttagccagtatggtctcgatctcctgaccttgtgacccacccgcctcagcctctcaaagtattgggattacaggcgtgagccactgcgtctggcttttttttttgtttttgagacagtctcactctgtcacccaggctggagtgcagtggcacaatcgcggctcactgcaacctccgcctcctgggttctagtgatttgcctgcctcagccccctgagtagctgggattacaggtgtgcaccaccacacctggctagtttttgtgtttttagtagagacagggtttcaccatctaggccaggctggtctcgaactcctgacctcaagtgatccacccgcctcggcctcccaaagtgctgggattacaggcgtgagccacggtgcctggccccatattgttctgagtggagaatttgatcgttaagctctcagaataataaaaaagtagctgtcagtgagagatgttggaatatatggtccaatgaagcacatccctcgcgcccgacccgccctggcagtgccgttcccgcccgtgtgtgtgggttctgggtgtcaaaactgctgcagtggccctgcaggcatcctacctagaggtgggtccccagctgcgcatctggacgctggtcagcaggtgaggctgggatgccagaggaggtgccgtgtgcctggccaggtacccgggaggcggcttgggggagcactggctgcagggcctccttcctcctcctgctgaacttggagtgctcttgccagattatgggctgagtcctgctagggagggtggccccccttccccaggaggagcccaccctgagacctggttggggggcagcttagaccctaccttagactccagcaggctgtcttgggagcatgtaattatgttttttttgagacagggtctcctgttgcccaggct

SEQ ID NO: 15255 - DNA, 1030 bp, Homo sapiens
tcgtgttgctggtgtctccacccccacccccaccccagctggcctgctccattcctgtcccggtgggctcatgtctgagtgtgcggactgggggatcttggtggcgatggagccaagcccagggaggctggggccaccctcatagtgcaaggccacccagcacctcgcccctataccccacccgccccaccaatgtgcccccggcacccccgagcccaggccccaaggcttgcttctatgggctttgcaccaccctctaggctgctcccgcctgggccatgcagcgcacctgaggggtctgaggtgaccgctcctcagagccgcccggcagcctccctggggcgggcctcagcactgcagccccgtgatccggcctggcgtgggctttgctgctttctctgcccggtggcctgaggagctcgagtgcccgcctgcccccagagccctttcacggtcagggcctgagctctgtgggtgccattaggaggagggtctgcagatctgtgcggttgggggacccctggggcatggaggggaccacgcgtcccttcccgtccgtgccctgccaggctgtcctcacagcagcgtcgtcacaggggaggaaaccagggcagcggcagcggctcctggtaccaagcataccttaaaaatgagcccatggatgttgcagtgagccgagatcacgccactgcactccagcctgggtgacagagcgagacttcgtctcacaaaaaaaaaaaaaaaaaaaaagagcctcaaggcctgtgcagttggtcagcggtggagtcaggtatggggcacacctgattctgccctggctcatcccctgccttcagaggacagcaagggcgcagcgcacgtgggggctggccctgaggtgtggcgttctctgggctgggctagggcagttctgagggaggggcgtgttctgtcccattcctccaggagacacagtgcctgggccatctggccacttgcatgagggaacgtctgtctgcatcccctgggggccgctgtccccatcccttga

SEQ ID NO: 15256 - DNA, 1049 bp, Homo sapiens
gagctggccctttccaggaaagggagtagcgaggctgctcacttagagccacgcacctggggctgacagtgtgcctggcagtacctgtgtggaaagacagttacagaggaaacacatgaactcactataagccagcactaatggatgcacctttgttgttgattttggtgataaagaacattaaatttgaacccagtgaagcaatatgtcatctcccaaaacaagtcctctcatgagtgcatctgtattatagaaagctgcactcagctttttaaaaaaatttttttagatggggtcttgctctgtcaccaggctggagtgcagtggcacaatctcggctcactgcaagctccgcctcccaggttcaagcgattcccctgcctcagcctcccacgtagctgggactacaggtgcgtgccaccacacctggctaattttttgtatttcagtagagacaggctttcaccatgttggccaggatggtctcgatctcctgaagtgatctgcccgcctcctgaagtgctggcattacaggtgtgagccactgcgcctggcccagttattttgatttcatcagtatgaaatgtgtagaaattgttacattagtccctatgtaatatccttggtgtggcctcttggcctgcacagcctggagtattgactatctggacctttataggaagctcaccaacatgtattttaacccttgacaccttatctgttaccatttatttagatctttgctgatttttctcaccagtgttttgtacttttcagcatgtagatctttgcacagatcttttgatctttaaacatctatagatcttttgtaaaatttatattgtaagtatttaatttttcttggtgctcttgtgaatagtacttttacaattttgatttccatttgttagtagtacgtagaaagaggactttttttttttttttttttttgagacagagtttcactcttgttacccaggctggagtgcagtgaatggcgtgatctcagctcaccgcaacctccgcctcccgggttcaagcgattgtcc

SEQ ID NO: 15257 - DNA, 1027 bp, Homo sapiens
agttatatttagagatggcatctcactctgtcacccaggcttgagtgcagtggtaccatcatggctcactgcagccccaaactcctgggcttaagcgatccttctgccttagcccccaagcagctgggactacaggcacatgctaccacacctgcataattaaaaataatttttttttagagatggggtcctgtgatgttgcctaagctggtctcaaactcctggactgaagcaatcctcctgatttcttgtgtgtctttggttttggtatcagggcaatggcgttctcactgtcagctggggagtgttccctccttttctgttttctggaagagttgtgtagaattggtgttaatttttccttaaatgtttgatagacttcaccaatgaagccatctgggcgcagagttcttgttgttgtatttccgtagtatggatagggttacctgtttcttcttgaatgagctttggtgtttatatctttcaagcaattggttcatttcatttaagttgtcaagttctgtggcataaagtcctccataatactccttacaccccttctcgtgtcagtaggatccgtagtgatgtcccatctgtcgttcctgatgttggttacttgtggcttctctctttgtttctttgtcagtctggctatagatttcagtttattgatcttgttaataaccagcttgtaggctgggcatggtggctcatgcctgtaatctcagcactttgggagactgaggcaggtggatcacctgaggtcaggagtttgagaccagcctggccaacatggtgaaaccccgtctctactaaaaatacaaaaattaactgggcgtggtggtaggctcctgtaatcccagctactcgggaggttgaggcagaagaatcacttgaacccgggaggcggaggttgcagtgagctgagatcgctccattgcactccatccagcctgggcaacaagagcgaaacttcatctcaaacaagcaaacactcagcttttggttcctctgatattttcccctc

SEQ ID NO: 15258 - DNA, 1033 bp, Homo sapiens
cgcgcctttccaacacgagggaggcgcaggttcctcccgcccaggaagatgcggcccctggtgcaggcagcaagcagggtggaccccagctctgggaggggcctcgcaggcgccctgatatgagccctttctctttgggagctctgctgccgagcactttagggaagaatctgtgatgattccatgaaaaactaggcaagtggagaaaaaagacgattgttaatctcaggaagcaaaggtgttcgaaggaagagaagaaagaatggcctagtgtggcctcaccgcctttacctgtgtgtgcaggagcgtctcagaacagaccccgagtgtgactgagtccgctgtgtgcaggaacacaacacaacagaacagaccccgagtgtgactgagtccgctgtgtgcaggaacacagcagaacacaacagaccccgagtgtgactgagtccgctgtgtgcaggaacacaacacaacagaacagaccccgagtgtgactgagtccactgtgtgcaggaacacagcagaacagaccttgagcgtcatggaatgcacacagtgatcctggagggtggggtgcatgtgtggcaatgggaggcctggcctgaggcgctgagctggtgggaacctgaatgcggaagagcctggccccacggtcccagctgcccgggtggggtggctgcggtcatgtgttcttgcagggttcatggctcgctgagacattggatggtctgtgtgtgtcactgtgatcagatgtggatgtaaccccactgcggtggagcctgtcagggacacaggagccaacaaagcgagaacccggcggccagggtagggacagctcgacctgcaggagggtcaggccacattggatcatgacttgaagcagagcatggtggtccctgggttcacaccaccatagtgagcagatacagatgcgaaggggagaggagatgcacgtcccaaacagaggaattccaccctcgagaacgcccggctcccggcaggctgtgcagagcaactgagcacttttctctttatt

SEQ ID NO: 15259 - DNA, 1026 bp, Homo sapiens
aacgtggaggccaaagtggtgtgcttctaccggaggcgggacatctccagcaccctcatcgccctggccgacaagcacgcaagtgagtccggccttccctggggtgcccgcctggcgggagggtcggctggggagggctggcggggtccttcttccctagggcccatcggcatcctggcctcgtggggccaccctctgcccaactcactctggcgtctctttttctcccttccacagtgggcgggggtgtcctggctccgtttcctcgggggctgggtgaatgaagtcctcgcacgccccccggagtggtctgtctctcactggcatcctctgcaagcttgtcatggtgtggctgggtgtgggcatcattgatcgaggcttctttttcccttctatgatgacttctggagactttccaggctggtgggaccctgctgcctgcacttgccaatgtctctctctttttaattttgcggagaggcttctgttgggattctgagtagtgttttcaggaaagcagtcctctccttattctttacgattcaaacccaagtttagtaacctggctgggaggggctgctgtggccagcacagcgtgtgggaggaagccactggctgcatgggaatgccctcagccttggggacccagcttctcccccgggaacaggtgctcgcaggtggtggagtctcctgtgccgggggatgttgacttcagagccaggagccagaggcacccccacgccctccacatgctactgacacagggcctgccgagctgggccccacctgcaccagacacagtgtggtaccccactgaggcccttcatgtgtcggtgggggcaggcatgaggggcatttttggcttccactctgacacatcacctggggtgggatctgagcccaggctgaggctgtggtctgtagggtgacatttcccagtaggtgaggcatgtgactgcccgggtacccgtgtcgctggggtgggccaaggtcccacctgtaacctcccacgacccctaatggggt

SEQ ID NO: 15260 - DNA, 1045 bp, Homo sapiens
tgtggctggcccaaagggagctgccagttgaccatgggctttctctggctttgtgaggaactggacctcctagctctctgctcagaggaggggagcgttcaaggtggggcatggtgatccttgacctctgaccccaaagcctgtgtactccactgctgcactcggcgggctccaggcaccaaggaggagagctggggatgttgaaggtccacaggctacacattctggaggggtgtttggtgtggcccttggccctgcaggtgctgggtgccagtcagcagcacggctggcggttcttagtgttggaggctggcctatgtcgactctgcagggctggcccgctggagaagcagtggtggggagcggcctggctcgctggagaagcagtggtggggagcgggctggcccgctggagaagcagtgcccaggctgagcggccgcagtgtggccctgccagtctgtgtggcctggggagtcaggcgccaccgttgagttgggcatgtttatggctggcccagggtggatcctgtctctgtcctctggcacctgggggcacagtgtccctgctccagagagcctgtatcagtggtttagtggtttttgagggtactgtggcccccttggctgaggttctgctctcagacgccccagaggatggccttttgctggaagagccccagaaggggactccagacataacgtgattagaggtatcagagggcaggttttccagaagggcctcgttggggctgataggactgggtggagagcagtgtcccagctcgagcactggcccccccaggtacacagcacagcccctttggacggtgctccctggaaagctgcgtggcggcccctctgcagggcgttcctatgaactgagagcccagctgcagggagcaggcgtcatgggtgatgggtctgccgctggtccagggactcagagcgcggccccactcttgcctggcggctgggccttgcggtgattctgcagggcccacaccccccggggttgtgtcaatctccgtttctcctgcttctctgt

SEQ ID NO: 15261 - DNA, 1050 bp, Homo sapiens
ccccggcctgagggtgacctgctggtgtgggaggtctgtggtgggctgtatggggctgtctggccacgagatggggacggacagagggcggctgcccctcgccctcctggcctgggctcttggcagccgccgactcccccgctcctcttgctcttgcctgctgcttctggggctggcccggaccttgttctccctcctccttccatcttcatgccctggggagtctgggcctttagggtgcctggacttaaagggcacgtgggcaccagagtgtctgcaggggtacctgccaaggagccgccgggccgccatagggtggggcagtgggacagtgtccggcagcaggaggaggcacgcctcccaggactgggcctcctgcgtgctggcgccaggtggggctggtggggtgggccttggtctggcagtgtgcgtctgccgcggtgctgacaggggctccttgtccttcaggggaaatagaagaggaaatggagaacccggaaatggtggacctgcccgagaaactaaagcaccagctgcggcatcgggagctgttcctctcccggcagctggagtctctgcccgccacgcacatcaggtagcccccagcagctcccgccctgggcccctcgggctgccctcgcctttccagcctgcccgtccttctcttccaggggcaagtgcagcgtcaccctgctcaacgagaccgagtcgctcaagtcctacctggagcgggaggtgaggcccagcccggcctggtctgccgcagccagtcccgggccactgtttcctctacctatgacctctgctggcctgggcggcggagacgattttccctcctccctctaggcccaggctgttctggggggaagcggggattgcgtcctgactgtcacttccaggtgtcctggtgtgtggccgcccccaccctacgcgtccagagttgtgggccaggagcttggagctctttcctcttgccactgccacccagacagccagcgaggggaggtccccctggggagggtgtggctgaggcaggtgggggcaggggcc

SEQ ID NO: 15262 - DNA, 2058 bp, Homo sapiens
ctgctgcacgatgcagcccttcccccctttttctttttctttttttgttttttttttttttttttttttttgagacagagtttcgctcttgttgcccaggctggagtacagtggcgcgatctcagctcactgcaacctccgcctcccgggttcaagcgattctcctgtctcagcctcccgagtagctgggattacagacgtgtgtcaccatgtccggctaattttttgtatttttagtagaaatggggtttcaccatgttagccgggctggtctcaaactcctgacctcaggtgatcatcccgcctctgcctcccgaactgttgggattacaggcatgagccactgcgcccagccacttccctcttctttcttacctggggtttctgaacagccccaatatgggaatttaatgtaacaggctcagggtgagtacacttagcacctggcagaagcttgtgccactggcccctgggcgatcgtgcccctgcctcgcctcaaataaccctcactgatgaagtcctgataaacacaggctcatgtcacagataagcaagagtgcagaaacagcacacagcagtcacagacacacccaggccctgaccagtggcgcagtccggcaccaaatagaaaccacttgtgtttattaatttaaagaaacaggccgggtacagtggctcatgcctgtaatcccagcactttgggaggccaaggccgggggaatcacttgagctcaggagttcaagagcagcctgggcatcatagtgagacctcacctctacaaaagtaaaaaacattagccaggcgtggtggtgcacacttactgttgtcccagctactcaggaggctgaggtgggaggattgcttgagtcaagaggcggaggcttcactgaagcaagatcgcaccactgtactctatcttgggtgatagagcaagaccctatctccaaaaaaaataaaagatccaggcagagtaggagctgaggctgaggctggcagctggcctctggatagtcgtgtcagttcaagaggacgaaggccctgaagcatggctcgtggtcacacatggagcaggtgtcatgctggactttaaaggtagctcttgaaagaaaacacgcagagtagctttcagaataggagagacagggaaagcgggtaagggctggaaaagacgacccacaggaatcaggaggatgacctggaaacgggagggtgattggacgccaggcacacatgcagaagaaagtgcagccctggctgaggccaggtgctcaggctgggactccagggtcaggcccggacaggcctgcttcaaaaatcatcagaaccagcccagtgcaggacacacaatgccggacagcaaaaggttggcaaaggccatgtcctggaaatgccatcccagaggcagcctgggggccctggtgtgaggttgcctgagatggaatgctggcgggaagggccgcgcctgctgcgcgggtggcggccggcggtgctgagcctggaatgctccgtagcgctccagcggtggccgctcctccaaggttgtgcccagaactcctgatttctgttgctcttaaacaccttggataagttacatcttcacattgctgctgctgatagggatggctttgtagccgggcatagcacacgcctgtagtctcaactacttggaggctgaggtgggaggatcacttgaacccaggaggcggaggccacagtgagctgtgattgcactgctgcactccagcctgggcgacggagcgagaccatgtttcgaaaaaggaaaataagtctgctgggcgcagtggctgacgccagtaattccagcactttgggaggccgaggcgggtggatcacctgagctcaggagtttgagaacagcctggccaacatggtgaaactctgtctctactgaaaatacaaaatattagctaggtgtggtggtgggcacctgtaatcccagctacttggaaggctgaggcaggagaattgcttgaacccgggaaacggaggttgcagtgagccgagatcacgccattgcactccaacctgggcgacaa

SEQ ID NO: 15263 - DNA, 1088 bp, Homo sapiens
ggggcggcaggtgtaggcctgggctctgtccacatgggtgatgcgtgtaggctggtgtcccggagccttcccccacccactcctggtggtgttggggttctggggaagcctcagaccctcaggcaggacgtggtgatcagctgtccttgcacagtgacacctggtttccttctggcagttgtttttctttttcttttttttcagacggagtctcgctctgttgcccaggctggagtgcagtggggtgatctcggctcactgcaacctccgcctcccaggttcaagcgattctcctgcctcagcctcccgagtagctgggattacaggcgcccgccatcacgcccggctaatttttttatttttagtagagacggggtttcaccgtgttggccacgttggtcttgaactcttgacctcaggcctcccaaggtgctgggattacaggcgtgagccaccgagtctggccttggcagttatttttcattactttttcttttttttggacaaggtctggctctgtcgcccaggctggaatgcagtggtgcaatcacagctcactgcagcctcgacctcccaggctcagatgatcctcccacctcagcctcctcagtagctggaactacaggggcaccaccacacccccctagtttttttgtatttttattagagacagggtttcgccatgttgcccaggttggtctcaaacccctgaactcaagtgatctacctgcttcgacctcccaaactgctgggattacatgtgtgagccactgcacctggcctcattttttaaagttctttttgcctccagaaattttcttctgtgtgaatctgcccacgtttcttgtcttgcctgtgggtgccccacccttgaggcctgctggggccgtggagctccgacgcagtgctcaccccggatgctggcagcctcctccctccaccgggtgcttcggtagccctggtgggaggtcctggggctcactgtccccttctcagccctgtccctcatctccccgctgggcaaggccgcgaggctgccctcgagacgcagggctctgcccccgagggtgggcggggactcgcctccc

SEQ ID NO: 15264 - DNA, 1055 bp, Homo sapiens
tagtctcaagagctctctccatgctggacctgcagccgggcgccccagtggagggcagccccgcactccgtggtccttggtctggaacctcggtgctgcccagggctggaggggagctgcttgcagagtctgagcctggcaccctgcactgagctatggaggcggctgagaggtggacagaggacaattgtggagctctttctccaagtcctcccccaggagtcaggctcagccatgctcagacacacattctcctgagggtgtctcccaacaccacggtcttgttttttggcgagtaaaaggctgtttcgtcagaaaccctcctggccctggccgactgcaggcgtcaggtggcctcttcaccagccttgagttctccatcgtcccagctcccagaagacaggaaacaactggtgactccagaggcacgcccactccctggcccccggctctggctgtgccaggcttagccgcagctgccccagaaccccctggggtggaagaggggccaggagggagcctgtgcccccagaaggtccctggaggtggtctgcctgctgctgtgacgtggcagggccctcttgcaacagcatgtgaacccaagtatctcaaaataaaaagcttgggccgggcacggtggctcacgcctatgatcccaacactttgggaggctaaggcggatggatcacctgaggtcaagagttcgagaccagcctgggcaacatggtgaaaccccgtgtctactgaaaatacaaaaattagctgggcatggtgtcggtgcctgtggtcccagctactcaggaggctgaggcaggagaatcgcttgaacctgggaggcggaggttgtagtgagccaagatcgtaccactgtattccagcctgggcgacagagtgagactccgtctcaaaaaataataataataataataataatataaataaataaataaaaaggcttgatttaaatttacaaaccaaccttcccatctcttgtggccacagttcttggagccctgcattctgggtgggctgggaggccccttgcgtgtgcaccc

SEQ ID NO: 15265 - DNA, 1367 bp, Homo sapiens
ggcgtggggtctcccttccctgtacctccacctcaggacccccaccctccaaccgtcagccctcctaaaatacttctaaattaatctgttagaagagcatccctatgtgggggtggtggggcccccaaccatcagccctggggaggtggagactgtggcagggcagggaggagccccaaaggggccgggacacagcggggtggctagtatctgatgaaagcaccatccgggcagcagcgcacaggccagcgcagcagaggctggagacgcatctggaattcggaagaaacaaacatggggttgggtagggtgcctagacctgaagaggaggagggacagcagccagctgtgaggctcctgaggacgcatctgctgggggcaggagtgcagctttgtgtgggggcctctggccaaggggagagcttggccgggcgggaggagtccctgactgtccctggggccagcggcctctccaaggcggatacggatctctccaggcttaaaaacaaaccaagatgagcagaacatgttcagacaagaggacgagggctagaaacaaaattcaccaactaggctcagaccagggcggaatttgagggagaccctgctgcacatggttccagcggaggagaccccagtgctgagcccacgtgatgcctagcgaggcagcgctcaggggactgcggctgcggggccatgcccaggcacggtctcggggggctgcggctgcggggccctgtccaggtgcggggatgggaggctgcagcttcggggctgtgtcgagggagcaggccccgctctccttcctgccagatgcagtggaccagactgaggaactatctgaacccttatttaataagacaggtttcttaaatccatgccacagcccgggcgcagtggctcatgcctgtaatcctagcactttgggaggccgaggcaggaggatcatgaggtcaggagatcaagaccatcctggccaacatggtgaaacgccatgtctactaaaaatacaaaaattagtcgggcatggtggcaggctcctgtagtcccagctactcgggagacagaggcaggagaatcacttgaacccccgggggtggaagttgctgtgagccgagatcgcaccactgcactccagcctgggcgacagtgcgagactctgtctcaaaaacaaaaatggctgagatggccgggcatggtggcttatgcctataatcccatttgggaggccgaagtgggtggaccacttgaggtcaggagttcgagaccggcctggccaacatggtgaaaccacgtctgtactaaaaatacaaaaattagccgggtgtgttgagaggtgcctgtagtcccagctactcaggagacag

SEQ ID NO: 15266 - DNA, 1035 bp, Homo sapiens
cgcccgggcacccgccgtgcgtgctgacgctgtcttctctccctctctcccaccccggcgctgccaggcaacatgaagaagcgcctcttgatgcccagtaggggtaaggcctggagccgcgggcgggcgctgcgccggccccgcccgtgatgcctgtgctgtgctgctctgtgtccccgcggcgggcggcccagggcccatgcttggggcagtccacgtgagccaggccacagcccagttccccacattcctcccgacatcactggtcccttggtgaagaccccccgagcccaggcatctggccctcggccccctggccccgcctcctgtcagtggactgtcctggcacgtgtggccctggcgcccctgcctgcgctgtctgccatcgcgctgtgactgcccgcatgctgccagcctcagctcgtggggccgcccgtgctgtgcctgcaatccttccgtgcgcctgccaggcgggacagtggggagggtggtcgggggtgtctgtgtgggccgtgggcaactgagcttgtacacatgggtgccttctgtcggaggactggctcaggtgctctgtgccggttgcttggagcaggggctgcgggaccccaggccccttggggaagagcagataggaccaagcctagcatgaggaggccaggtgtgtggggcccgggtgtgcaagtgctgggcctgccagtgtggatgtgcctggagccccttcgccaggcggctttcactgacggtgctggccagggcagcagggccggtttggcgacctggaggtggatatgggtagtggctgcccagcccagccaaccctgtccccttggggcattctctcgaggctgctgggtgtcctggcaggcacgtcctgtggggtcagcacgccggctgcagcgcagggtgggcctgagatcgggtgccgggccccccatctccacctgtctggacacgcacccctggcctgtccttgcagcttcctcccgacatcccttggcggtgtctgtgtctcggccccagccccagccctccttt

SEQ ID NO: 15267 - DNA, 1051 bp, Homo sapiens
agcggcggcggatgaactggatcgacgccccggatgacgtgttctacatggccacagaggagaccaggtggggccttcccagggcaggcgggagggctccgcacagcgtcccggccctcaccaccacctctgcccacaggaagatccgcaagctgctctcatcctcggaaaccaagcgtgctgcccgccggccctacaagcccatcgccctgcgccagagccaggccctgccgccgcggccaccgccacctgcgcccgtcaacgacgagcccatcgtcatcgaggactaggggccgcccccacctgcggccgccccccgcccctcgcccgcccacacggccccttcccagccagcccgccgcccgcccctcagtttggtagtgccccacctcccgccctcacctgcagagaaacgcgctccttggcggacactgggggaggagaggaagaagcgcggctaacttattccgagaatgccgaggagttgtcgtttttagctttgtgtttactttttggctggagcggagatgaggggccaccccgtgcccctgtgctgcggggccttttgcccggaggccgggccctaaggttttgttgtgttctgttgaaggtgccattttaaattttatttttattactttttttgtagatgaacttgagctctgtaacttacacctggaatgttaggatcgtgcggccgcggccggccgagctgcctggcggggttggcccttgtcttttcaagtaattttcatattaaacaaaaacaaagaaaaaaaatcttataaaaaggaaaaaaaccaaccggtccttccctgtgtcttttgttcccagtccctctccctgactcaggccctgggccccccacccccatcgggcggccctaggctgtggctctgccgtggagctggaggcccctggaggccacctcagccaggacagccaccccagcctctgggctctgttgctctcccacctgcccacagaccttcccctgctggggcctggcgcggtgccctctgccctccccagggggcagcaagcggttgca

SEQ ID NO: 15268 - DNA, 1051 bp, Homo sapiens
tgcacgctgtctcacttgggtctctgtaggacacggtcctgggcacctgtgccccggaggtgcctgctgcagcctcacagcccaccttcctgccctgggtccccgagcgcgggggtggcgagttggacctggtagtgcgggagctgcaggcactggaggaggagctgcgggaggctgcggagcgcaggcgggcggcctgggaggccaaggtgagtgccagcctcgctctgggcaccagcccagccccaccttcgggggatggctgacctgagggcactttggacttgctgaatcctacagttgcatttgtcaagcatggcaggggacacacttagaggcacgtaccctgagggagcgggagggcacctggtgaggagccgcagctgctgcgagacagcccccgcccctcctgcgggaggtctgttgtctgattctttgcatgagggagggaagcccgtgctgtgtgggccctgctgctcccatgcgtccgccacacatgcatcacacggtagtagtcactcctccacacctgcctgggacccgtctaacctcctggtggccacctgggcctccaccctagactcagagctgcccgcttaacctgcgcaggttcatggctgtgaacacggggctgtgttggctccatctattttctttttctgaagagttttaacttaaattgcaggcatgattttccccttaaaattttcagtaagcctctctgaagagcatgggcgtttcccgcatgcctgcagcgcctgcacctgagtctgggctcagggaatgctcagggagcctgaggccagtgtcctggggggacagagccattgccattgtgtcccacgcaggctggaggctgtggacgggggccagagtggagtgccgcgcggcgggcctctcgggaggctgtggaaaaggagctgggagctctacagcagtgctgggagcgagacggtggcccggcccagccccatgggccacaccggctggtgagacgagaggatggggcagcaggggaccgggacctgcgggcagctgtggtgatcaggac

SEQ ID NO: 15269 - DNA, 1046 bp, Homo sapiens
cattcttcccgtagttctcgagccttggctttcagctccatcagctcctttaagcatttctctgtattggttattctagttatacattcatctaactttttttcaaagttttcaacttctttgcctttggttttaatttcttcctgtagctcggagtagtttgatcgtctgaagccttcttctctcaactcatcaaagtcattctccatccagctttgttctgttgctggtgaggagctgagttcttttggaggaggagagtcgctcactttttagagtttccagtttttctgctcttttttttccccatctttgtggttttatctgcttttggtctttgatgatggtgatgtacagattggtttttggtgtggatgtcctttctgtttgtttgttttccttctaacagacaagaccctcagctgcaggtctgttggagtttgctagaggtccactccagaccctgtttgcctgggtgccagcagcgttggctgtagaacagcagattttcatgaaccacaaaagctgctgtctgatcgttcctctggaagttttgtctcagaggagtacctggccaggggatatcaccaccaatcccacagaaatacaaactaccatcagagaatactacaaacacctctacacaaataaactagaaaatctagaagaaatggataaattccttgacacatacaccctcccaagactaaagcaggaagaagttgaaactctgaatagaccaataacaggctctgaaattgtggcaataatcaatagcttaccaaccaaaaagagtccaggaccagatggattcacagccaaattctaccagaggtacaaggaggaactggtaccattccttgtgaaactattccaatcaatagaaaaagagggaatcctccgtaactcattttatgatgccagtgtcatcctgataccaaagccgggcagaaacacaagaaaaaagagaattttagaccaatatccttgatgaacattaatgcaaaaatcctcaataaaatactggcaaaacaaatccagcagca

SEQ ID NO: 15270 - DNA, 1051 bp, Homo sapiens
ttttccactgtttccccagttggataattggcagctcaatgacagtcaagtggaaacaactgtctggtaagttttctttacatgtacaattgctggtattttatacacacttagactatacatgatgtactcagtgctgtgtaaatgtattacagtatttgggttctgcccttaaagtgctaatacattttttagaactaatgcagatagatatttatacaataaataaagaaaaccctgacatttaggttgttataccataaaggaatgccttttgtgacaataaatagaaaatccttaacaaagatagcatagtgattataatatgtagttgaggtaaaatatgaatcctgaccttatcatttgcatatactcatggttcgaattgtccatgaaaccctgtcaggttgaagaaaattactagggtaaaattattcagaagaataatatttattagcaattacataatttatatcataaagactggtattattttatgatgcttttgtcgtggcataactctagcataatattaattgacatcaacccttatttatatatagtttatgtttgaggactcaaatctaactagtggcaaatccaagtttatgtaaaaattaaatctcttctaatgagtgtaatttcatgtgcatttttatagcttctcttttatttaaaaaaaccttatgtgccagactctaatttactgttatatcttagaattatatatacaagaatttaaaaatgaactctagtagctattttgactatacacattgccatgcttggggattttaatgggcaagttatatagataagcattaatttttattccaaaagtaacatagtagtgcttcatcagtatatatacatatacatgagctccttcatgggttatctaattttgaattgatggtgaatctagtgaatgaaggtatgggaaaaatttaaggtacaatgaagtgtaatacatgctttttctcataattattatctaaattaggtattaatgaaattcaattttagtatttctaataatattatttctgtt

SEQ ID NO: 15271 - DNA, 1943 bp, Homo sapiens
tgtctttggttctgtttatatgctggattacattttttgatttgtgtgtgttgaaccagccttgcatcccagggatgaagcccacttgatcatggtggataaactttttgttgtgttgctggattcagtttgccagtattttattgaggatttttgcatcaatgttcatcaaggatattggtctaaaattctcttttttttgttgtgtctctgccagactttggtatcagggtgatgctggcctcataaaatgagttagggaggattccctctttttctattgattggaatagtttcagaaggaatggtaccaactcctccttgtacctctggtagaattcagctgtgaatccatctggtcctggactttttttggttgttaagctattgattattgccacaatttcagagcctgttgttggtctattcagagattcaacttcttctgggtttagtcttgggagagtgtatgtgttgaggaatttatccgtttcttctagatgttctagtttatttgtgtagagatgtttatagtattctctgatggtagtttgtatttctgtgggatcagtggtgatatcccctttgtcattttttattgcatctatttgattcttctctcttttctgctttattagtcttgctagcggtctatcaattttgttgatcttttcaaaaaaccagctcctggattcattggtttttggaagggttttttgtgtctctatttccttcagttctgctctgatcttagttatttcttgccttctgctagctgttgaatgtgtttgctcttgcttctctagttcttttaattgtgatgttagggtgtcaattttagatctttcctgctttctctcatgggcatttagtgctataaatttccctctacacactgctttgaatgtgtcccagagattctggtatgttgtgtctttgttcttgttggtttcaaagaacatctttatttctgccttcatttcattatgtacccagtagtcattcaggagcaggttgttcagtttccatgtagttgagccgttttgagtgagtttctgaatcctgaggtctagtttgattgcactgtggtctgagagagagtttgttataatttctgttcttttacatttgctgaggagagctttacttccaactatgtggccaattttggaacaggtgtggtgtggtgctgaaaagaatgtatattctgttgatttggggtggagagttctgtagatgtctattaggtccgcttggtgcagagctgagttcaattcctgaatatccttgttaactgtctcattgatctgtctaatgttgacagtgtggtgttaaagtctcccattattaatgtgtgggagtctaagtctctttgtaggtcactaaggacttgctttatgaatcttggtgctcctgaattgggtgcatatatatttaggatagttagctcttcttgttgaattgatccctttaccattatgtaatggccttctttgtctcttttgatctttgttagtttaaagtctgttttatcagagactaggattgcaacccctgcctttttttgttttccatttgcttggtagatcttcctccatccctttattttgagcctatgtgtgtctctgcatgtgagatgggtctcctgaatacagcacactgatgggtcttgaccctttatccaatttgccagtctgtgccttttaattggagcatttagcccatttacatttaaggttagtattgttatgtgtgaatttgatcctgtcattatgatgttagctggttattttgctcgttagttgatgtagtttcttcctagccttgatggtctttataatttggcatgtttttgcagtggctggtattggttgttcctttccatgtttagtgcttccttcaggagctcttttagggcaggcctggtggtgacaaaatctctt

SEQ ID NO: 15272 - DNA, 1037 bp, Homo sapiens
tctatctatctgtctctatctaagaagtcataaaggctgagtctaataagataaaattttcagtccattcttttggtccaaaaaggcttacattctcaggtatagcttcaacatcatatatgaatattactaagaatcttagtagataagctaaagtcagtatgagtaaccagtctgatatagtttgcaagaacactcttcatggactgcaccaaaaaaacctatggtagcaagagacagtttttattagaagtactgtctgttataccacatatggagtcttaaattagttttgggtgtcattttgaggcctagagtcatagaagagtgattaggagcttgtggggtataaaaataacttgagaattggctgaaagcaactagggaagatgggggtagtagtatgtgtaaacatttgaggcagtagagatgtgggacccaaatactgttccccttttactcaaattctgagatgagttgacatgttctgtgtagggctagagagtagaaaaatggccagtaggtggtagccacagagaagcagtgcgtacaaacaagtaagtatgcaaaatttgtacatacggtttcaggaataactagaatacccataaaatatccacctgccttaaaaactagaacatcattgataacttggaagcccttgcatacctctccatgatctcatttgtcttcacagctatataaatctcattgtatgattataccataatttattcatcctgttgttaaaggatatttgggtttccagtttttctttttttactaccaaagcactacattattaatattcttgtatatgtcctgatatgtaagtgcaaaagtttcttttacagcaatggctcttgaagagtggttcccagaccagcagcatcagcatcccttggaacttctttgaaatgcaaattctcaagccccctacccagacttactgaattcaaaactatgtgggaggagcccagcaatctgtgtttcgcaaaccctccaggtgactctgatgcacagtaaaatttgagaac

SEQ ID NO: 15273 - DNA, 1143 bp, Homo sapiens
tctagtcacaggtcctgcccacgtgcaaggggatagggagttacacaagggtgtatgtaccaggagacgataatttgtggttgtcttagagtctattcttcatgctctggattacttgaaaaatgggattatatttcttaaaaacctttggaaaacatgtcacttgttaagacaaatactcagttcttttggtggtataaagttagtggtttgagagtattcttccagactttttttctatgcatttagtaacataacttattgttttctgtgcctcattgtgtatcctgattgcttcttaaactgggttctaaatgataaaataacatccctatataagcatctttcttttccttttgtgtttgtataacattttacaatatataactttgtacccaataccttaaaaatcttttttcttttggaaccaggtacatcaggaacgtctctatcaagaatacaatttcagcaaggctgagggccatctgaaacagatggagaagatatatactcagcaaatacaaagcaaggatgtagaattgacctctatgaaaggggaggttacctccatgaagaaagtactagaagaatacaagaaaaagttcagtgacatctctgagaaacttatggagcgcaatcgtcagtatcaaaagctccaaggcctctatgatagccttaggctacgaaacatcactattgctaaccatgaaggcacccttgaaccatccatgattgcacagtctggtgttcttggcttcccattaggtaagaaaggacatgtatcaagtgtctgttctttaaatcaatgattttttatactgctctgcccacttccaagcattcagtcgagacgataaggataagacaagcattgagttgtggtaggctctgaattcttcacccatgtttcaacctgtacatcattgcttttatctattgtatttgcttacatttaaattaaagctttaatttgagcagttaatctctgcaaaatgaaagtttgcacattgctacattaagttaaaagctatgtagttgtagtaataataatattagctgtcatttattgattcctaagtgctaggcactgttgtgttttatataaattcatataatttacaaaaccttatgaagtaagtatta

SEQ ID NO: 15274 - DNA, 1012 bp, Homo sapiens
accacgcctggctaattttttttgtatttttagtagagacggggtttcaccgtggtctcgatcttctgacctcatgatccacccgcctcggcctcccaaagtgctgggattataggcgtgagccaccacgcccggcctctagttcttacttagatgtaatgattcctatcttataagagtctcttgatgtcttcatttttttttttttgagacagggactcattccattgcccaggctggagtgcagtggcataatcagggctcactgcagccctggcttcccagcctcgggtgattctctcacctcaggctcccaagtagctgggaccacaggccaccatgcctggctaattttttgtatttttttgtagagatggggttttgccatgttgcccaggttgggatgtctttattttttataaacgtttcttaaattaatgtggttggagttaaactttgatggctgttcctctcactgcttgaagccttaggcagtgggattttgatccatcatatatcaaaaatggcttatcttcactcagggcaccatgaggatgggctggctgtccgttagtgccttctgatttttgcggagtcaaacaattactaaacgggtggtgattccagattaagaaaatgtacctgtgattaaaaaaataaaagaagcagcctagtttcaaaacacgagcatatagtaattagatagctgtcatctggtgctgtgaaataaagccagttgattctgagagttactgaaacattatactctaaagtcattcatgttcaaattttaaatggtttactcagttttttagagtggttgctcacacacgtcagggcagttttaaaaatacactttttggctgggtgcggtggctcacacctataatcccagcactttaggaggctgaggtgggcggatcacctgaggtcaggagttcgagaccagcctggccaacatggtgaaaccctgtctctactaaaaatataaaaattagttgggcatggtggt

SEQ ID NO: 15275 - DNA, 1948 bp, Homo sapiens
gctcactgtaaccttgaactcctgatcctgccctatttgatattgagcttgggcatttggtgacattctccaaatagatgagtcaataatttatattaatgaatggagagttaaataaaggatgaacggttactctaaattttcttgtgacttggtatagaacatgctggtgtgagttgtcatgtaatcataacctttgtgaatttatttatgttttttaaattttccagaaatgatcctagataattgatagatcctgtggttcaactggatttctagatagaagctggattcatgtgatgccagaggtaagagtaagagcaaaatcttcgtttttacctcatttggatttctaatcacttagcaagacttgggactcggtgttattagtggatggaatttggtaattaaaaaaaatccccagttctaaccttaggagaattttcctgtttagggatgaggagccagtgctggtttgcccttcctcagtcatttacagtttgccatgatgaaatgcatgttaagtccgtgtttcagctgatcagcctgattaaacacatgctctgagcagactaaagctaggggcaaacacctgcaattgaattctgcttgttggaattcatactgggatttagtctgtaatcccaggtaattcttaaatcttaataaattatgaatttgagactaatgttttgttgtgctttgatcttttgtgatatctctatatccccaaaaaatcacttttgtgagttagaactagggtcaggaatcattaatctaaaagttcaaacactacagaaaaagcactggcaactggtataattctataggcaatttagcctggcagttttaaactaatcattattttatcaatctatacatgtagattaaaggaaacacagagttggttaaatcaattttgtgaagactatacggtacaacactatagaatcacttaaaagttatgatacagttttatgtttattgaaatagaacggtattcatgacacatgaaaaacagattatatagagcaatatgtttctgcttaaatatttttatatgcatatgtttgcttaagaaaactgaaaggacatatatactaaaatactagggggttattttctctagaattgggttctacaagtaatcttttattattataaacctattttctaattttattgtattcatgtattgtaatattttaaaagttattttaggtaacttaggacaagcttatattctttacccgtgcctgcattttcagcagagaattaggtagaaagaagggtgaaatacaggaaatacaaacaactcaaagtaacatcaggacttgaaataattttttagcttttgttgtcttttgcaggagtaaaatttcaagagactgaaaccagatctgagtttcgctgttccagtctggacctctttggtgctgtaaatcctggatatactgtagatgagtactgcgtttttcttttatggtaaggcttacgttgagattgagaagctttgccatatatatgagtctttgaaaattcaggtttgtgacttcatggccagctgctaaggtgctataaatttcactttttttttttttttgagacggagtcttgctctgtcgcccaggctggagtgcagtggcgggatctcggctcactgcaagctccgcctcccgggttcacgccattctcctgcctcagcctcccaagtagctgggactacagttgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggctaaatttcactttttaaaagtcagttgaggccaggcgtggtggctcacacctgtaatcctagcac

SEQ ID NO: 15276 - DNA, 1343 bp, Homo sapiens
agtactggcacattagttgttacagctccgcaaggctttatgcacaattatgtaatccccaaagctctgaaaaccgaaatttacaaaatttagcaccccaactggtttggtagccaagtgcaggttatagggagctggaaggggaagggggtcacagtaggtggcatcgttcctttctgactgcccgccccccgcatgccgtcccgcgatattgagctccgaacctctcgccctgccgccgccggtgctccgtcgccgccgcgccgccatggaattcgaacgctgacgtcatcaacccgctccaaggaatcgcgggcccagtgtcactaggcgggaacacccagcgcgcgtgcgccctggcaggaagatggctgtgagggacaggggagtggcgccctgcaatatttgcatgtcgctatgtgttctgggaaatcaccataaacgtgaaatgtctttggatttgggaatcttataagttctgtatgagaccactttttcccatagggcggagggaagctcatcagtggggccacgagctgagtgcgtcctgtcactccactcccatgtcccttgggaaggtctgagactagggccagaggcggccctaacagggctctccctgagcttcggggaggtgagttcccagagaacggggctccgcgcgaggtcagactgggcaggagatgccgtggaccccgcccttcggggaggggcccggcggatgcctcctttgccggagcttggaacagactcacggccagcgaagtgagttcaatggctgaggtgaggtaccccgcaggggacctcataacccaattcagactactctcctccgcccatttttggaaaaaaaaaaaaaaaaaaaaaacaaaacgaaaccgggccgggcgcggtggttcacgcctataatcccagcactttgggaggccgaggcgggcggatcacaaggtcaggaggtcgagaccatccaggctaacacggtgaaacccccccccatctctactaaaaaaaaaaaatacaaaaaattagccattagccgggcgtggtggcgggcgcctataatcccagctacttgggaggctgaagcagaatggcgtgaacccgggaggcggagcttgcagtgagccgagatcgcgccactgcattccagcctgggcgacagagcgagtctcaaaaaaaaaaaaaccgagtggaatgtgaaaagctccgtgaaactgcagaaaccctttgggaacagagggaaccatggggcaggaagcccacgaaaattctaattggtcttctggttcttggtgacatcaggtgaggggcgcccaaatgtttggcttcatgagaatcaccga

SEQ ID NO: 15277 - DNA, 1054 bp, Homo sapiens
atgctggagggatgctgataatcccactcctctgacttctgactctgtagatatcctgctccagtgatggctctgtggggctctgggacccagagtcaggacagcggcttggtcagttcctgggtcatcagagtgctgtgagcgctgtggcagctgtggtgagaaagcaatggagatcccactggggggtctctggaagggctaagggggctttgggagacggtgcatggagtatctaatcccagaggcaaaatgagcataaaaatgagatacctagagattaggcaacataggaagaccccccatctctataaaaaataaaaataaaaattagctgggtaccatggtacatgcctgtagttctagctactcaggaggctgaggcgagagatcacttgagcccaggatttcaaggctacagtgagctatgatcaaaccactgcactccagcctccagtgtaacagagtgagaccctatctttaaaaaaaaaaaaaagagaaaaagaaaatgagatacttgggattggattatggtgttgaggctaagggttggtgtaaagggagagaggagagcatgaaaacacagcctcttggtatcatgaacttgagccacccgaccccactgtcctgagccacccaaccccactgttcctgagttctcctccctcattgacatcttccatgctcctaatgctccacccacctctgtggaggaagttctgtttcccatgtcctgctcaatatgactctgctctgatcttgtgctctgtgggcaggaggagcacgtggtgtctgtgagccgggatgggaccttgaaagtgtgggaccatcaaggcgtggagctgaccagcatccctgctcactcaggacccattagccactgtgcagctgccatggagccccgtgcaggtaacaaaacgtcagccacctccccttccctgctgtctcttcttttctcccctgctccgtcccttcttctgactcagtctctgtgtcttatcagctggacagcctgggtcagagcttctggtggtaaccgtcgggctagatgggg

SEQ ID NO: 15278 - DNA, 1033 bp, Homo sapiens
tgttatcccagtgctgtgggaggccaagtcaggaggatcccttgagcccaggagtttgagcccagcctgggcaaatagcaagacaccatctatttgaaaaatgtaaaaattatctgggcatggtggcgcacatctgtagtcccagctccaagggaggctgaggcgggaagatagcttgagcccaggagtttgaggttgcagtgagctgtgattgagccactgcattccagcctgagtgacagaacaaaaccttgtctcttaaaaacaaacaaacaaacagcctggagattggtctaacttgtaactctaaaactgcctctactccgtatactttctcctacatgcacatccatcggcaggcttgaggaatgcccgcagatgcacatccctccgtaccacaaacaacagaacgaatctcatacccttaatcttattgatgttgatatcaatcatcacaattagtcctaaactactgagtcatctcatcttttacacttaataaccatgtatctccactctgttttgtctccatctacctaccttttccaactctagaagctcttccactgtgccctctggaactgatggccagtcatttgtcaaattctctgtgtcctcaacctcttctctgaacgttcccttcacatttatgctcttcagacttggtttcttatgaggactctgcttctcctaccacctcagtagtggtggcattttcccttccacacccagtgtcccactgggcctggaggtggtgcacgtgtcctcatactgtttccagaccattatccctcatccctagtacccttctgctttgaaagaaactaccatacgaacaccacgtttgtcataaatcttatttcagtattcaggtagatcatactaacacccgcttcagccacttatttccttggtcatgttctggagctgcagatcctccacatctcagtttcagacgtcccactctcgactaccaccacctcctgttcttccagttcattttctttagtatgctaaatccaacagttcatcc

SEQ ID NO: 15279 - DNA, 1062 bp, Homo sapiens
cttatctgtccctgacaggaaactgtgtttgcaatgctggtagagatcacagagcgagccatggcacattgtggctcccaggaggccctcattgtgggaggagtggggtgtatgtattattgaaaagtgttcctctttcctattcttaacactatgcgtcttcctcctggtactctaaatcattaagcgtttggagtaggcttcccaatccttgcccctaatcccctatgtcattgttctaagtgagtgcacatgacgtgttctgctggaccatgaagagatggctaaaactaagctaatcctgttccctgcctctttgtaggtaatgtgaggctacaggagatgatggcaacaatgtgccaggaacgtggagcccggctttttgctacagatgagaggtaaagacactttccctttggtttcttttttacttctcctgttatagtgattttccacccttagatcccaattttcatctctcttgcatcccagattctgtattgacaatggagcgatgatagcccaggctggctgggagatgtttcgggctggacacaggaccccactcagtgattctggggttacacagaggtgagtgattcacctcttggtgagggtagattattgggacatagacaaaaacagcagggaagagtccaggaacatgagggcagagaagaatgaaggatgttaagggctcgctctccaccatgtttcttctgtttttccacaggtatcggacagatgaagtagaggtgacctggagggactaataagatcaacagaatcagagtagatagttccttaatcggaacccaaaggaccccgtgcctcaatctctatcctgatgtcatgggagtcctagcaaagctatagactccaagcaaggcttggggtcctttatggaaccccaggatgactcagcaataaaatatttttggttttttggttttgtatgttggtgattggattgtgttgttcaggaccaatgtagatttggtgctggataaattcttgttggagcttgctgctgtggaaccaagaatgaggtatctttttttt

SEQ ID NO: 15280 - DNA, 1029 bp, Homo sapiens
caggaaaggaatgaatgggattgaaaaggattgaaatcttcaaaataatgaatatctgaaagctcttgcattattttgaagcttattttttctataaatcttagcaattgaaactaacagttgctgggtatggcaactcatgcctgtaattccagcactttgggaggtcgaggcgggtggatcatctgaggtcaggagtttgagcccagcctggccaacgtggcaaaaccccatctgtactaaaaataacaaaaattaatttgatgtggtggcaggtgcctgtaatcctagcaactccggaggctgggcaggagaatcacttgaacccaggaggcggaagttgcggtgaaccgagatcgcaccattgcattccagcctgggcaacaagagcaaaactccgtctcaaacaaacaaacaaacaaaaaacaaaaaaaaacaactaaaggacactacctgatttattattttggggcaagtacatgttttgtttttatattactgggaatgattatgtagactttgttattctaagagtttagaaatataaataactttaaaaaatactttgtaaattatagaaggtattttattttatcttatttatttatttatttatttgagatggagtttcgctcttattgtccaggttggagtgcaatgatgcaaccttggctcattgcaacctctgcctcccgggtccaaactattcttctctactcccgagtagctgggattacaggcacccgccaccatacctggctaattttttgtgtttttagtagagacgggatttcaccctgttggtcaggctggtcttgaactcctgacctcaggtgatccacctgcctcggcctccctaagtgctgggattacaggcgtgagccaccatgcccggccagaaggtattttaaatttataggtgaagctaaagttgtttgggttaccttatatgacctttttaaggttgggattggattcttttccaacagaacacttgattatcattagaaatagttcagcattgtcccc

SEQ ID NO: 15281 - DNA, 1057 bp, Homo sapiens
aacggatcttgctgtcacacaatgcaggtaacagagagtgggacaacaaaaagtaatcaaggcgccaaccaacattcttggatcgagcattcatcatataagtccaaaaggtgtaggcatagggtgtgttggggtagaggtgcctaaagctgtcagccagtggcacagcctgcagtaattccccgaagccttggcgctcttgtggcgtgaagccagcattctttttgttccccttggggttgcgaaggtcaatttcttcatgtgccacattgaggtctccacacagcacaaggggctttcgggaagccaggcccttcaggaacttgcgaaaggcttcatcccagcgctgccggtactccagtcgtaccagacctcggcctgcattaggtacatatgctgttaccagcacaaacgagtcaaattcagccacaatcacccggccttcctgatcatgctcctcatcgcctatagaaatgaaacagaattagcataaaaaactataagaaaagggaaagcaatcaagaggtggggcagagatagagaattagcaattggttttgaagagttcaggcattaggcatcaatagggtctcacctatgccgtaagaaactttgagtgggcactggcgggaaagcaggcccacgccactgtacccttccttgtccgaaggagctgaccagtattgatgagagagtccaggcagctcctgaagttcagctggtagtttgttctctgaacatttggtctcttgaaggcacagtatatctggggcttcttcctttacccactgtaagtgaaaagaaaggtggaaaacgtattatcaattcagcagaacatttattgaataatctatatgctaagtcatagatacgcacgggttaaacagtctcttggcctaaggagttcgagtcaagcagcacaatattcaaacaattctaagctagataaatgaaaacaaatatagagaggtaagaaagtcttacatgctatgccaaggagatgtgttttttctataggcagtggatagcaagctaagatttttaagctatggttaat

SEQ ID NO: 15282 - DNA, 1028 bp, Homo sapiens
aactggaaagtcaaaaaaggatgagcgtatacagagaatgtaaaggtgagagagcctagtgtttatttaggagaaaaggctttgaagcatgtgcctcaggaatgttatagctgtctttctcgtttctcaataaaaatattgagatgaaatgatgtcgtttcggagaatagagagccttggggactgggtgtgttatcctgaggtcggaggggaattggggacctgaagtttaaacagtgctctttctttctcaaggattcttgagggtatacagttgggggacagagtatcttaagtacagagaagtcgagtgacttaatagacagggagtgggggatgtggaacagggactgtgaagatttttaggattaaaaatttttcaaacacaagtttgaaaatacaagtctttttcttttgtatagcaaaagaatcatcaacctggggcctgtgcatcccggacctctgagtccagaaccccaacccatgggtgtcagggttatctgtggacattgcaagaatacttttctggtgaggaaggggtattgggaaggggaggggaaaggagactaagagtcatttcgagtatatttcttagagtaatggtaatgacccctgaaaggtctgtcctatgggaacatgttctgcatccccaccccaaggttctcattgagggagaccctgcttgtgctattatttttgttttctttctccatagtggacagagttcacagaccgcactttggcacgttgtcctcactgcaggaaagtgtaagtgattagggattgagctggtaattgatgtatggagtaaaaactacaaggccatagaaagcatccatttctatttgcctccccacaggtcatctattgggcgcagatacccacgtaagagatgtatctgctgcttcttgcttggcttgcttttggcagtcactgccactggccttgccgtgagtacccttgccccaacctctttcattctgcagcctcatctccataggctaagatttgggaaactgctaccctaa

SEQ ID NO: 15283 - DNA, 1050 bp, Homo sapiens
ggcctcattaccggccaccaccagaccctgcggctcggctggggttggaagccttctaccagtgtccattccaggtctcctcctttctcctccagcaacccttccctcaccggacccccgcaccctgcatccacctcgccaacccctctgcctctcaccctctcacttttttttttttttgccactgaggtctgtcatcctcacctgtagaaagggggatgcacaggaggaagaagatagcaagtgagagcacactcccaccactacccccacgccccctacccggctcgcccctcatgggtcgttgttatcgatgccggggaaagccagtcaaccacagccagaggattttgttccgccgcaaaaggagcgcggtggcgatcggcgcaggattatctctctaaggcgagttccaaccaacttaaagcttattggacgactagagttgcaaggagtcttgcatttgctgaaagatcaatgacccaaccccagaaacgtgcgcccttcgatagctcagctggtagagcggaggactgtagcctgtagaaacatttgtggacatccttaggtcgctggttcgattccggctcgaaggagctgccgtattcttttgcacacgcacgcaccaaaactacgtggctgcatctctgcctggtcaaaggctttgccagccagcatccacactctcccaggagaaacctagcaaggcctttccggattacccagcttcccacagcctatgctgtggccttgggagtctgctcattcttcaagtcattgctttctctactatcttcaaattttttatataatctgggatttttatctccaagtcattgatttttatggccattaggtgacactataactgatattcttatgaaactagatgaaatatttgaataacatgttagaaaattgaattcatgtatattaaaacaatgtcttaacaattatttacatttacatataagttctatttctttccttgctcataaattttttgcatctcactgttttgtgattttattttttattttcaggagttca

SEQ ID NO: 15284 - DNA, 1074 bp, Homo sapiens
taccttaaatatttgcctcttctttatgttagaaacattcaaattattctcttctagctattttgaagcatacagtagattatcattaactatagtcatcctcctgatctatcaaacactaggccttatttcttatatcatttcttatatttgtaccccttaaacatcctctgttcatccccattgcattttgagcacacagatgcatttgctaagatttcagagctcacacaaaatgaattattatataggttagtgtctctttaaatgaagttgttatataagttttgtgttacagcgatgtcgggtatagattttgtatagtcttgtccagataccagctctgacattttctatttgaggctcttactataagagttgtacagggccaggtgctgtgactcatgcctgtaatcccagcactttcggaggccaaggtagaggggtcacttcaggcgaggagtttgagacctgcctggccaacatggagaaatcctgcctctaccaaaaccacaaaaattaggtcgggcgcggtggctcatgcctgtaatctcagcactttgggaggctgaggtgggcggatcatgaggtcaggagatcgagaccatcctggctaacatgttgaaaccctgtctctactaaaaatacaaaaaattagccaggcgtggtggcacgggcctatagtcccagctactcgggtggctgaggcaggagaatcgcttgaactcaggaggcagaggttgcagtgagccgagatcacctgcactccagcctgggtgacagagtgagactccatctcaaaacaaacaaacaaacaaacaaacaaaacacacacacacacagacacacacacaaattaaccaggcatggtggagtgcacctgtaatcccaactactcaggaggctgaggtaggaggatcacttgaacctgggagtcagagtctgcagttagccgatactgcgccactgccctccagcctgggagacagagtaagatcctgtctctttaaaaagaaacaacaacaacaacaaaagagttggacggttattcatccttgctatgcctctgtttta

SEQ ID NO: 15285 - DNA, 1098 bp, Homo sapiens
cactgcaacctctgcttcctgggttcaagtgattctcctgcctcagcctcccaagtagctgggattacaggcacccgccaccacgcctggctaatatttgtattattagtagagatggggtttcaccatcttggccagggtggtcttgaactcctgacctcgtgatccacccgcctcggcctcccaaagtgctgggattacagacgtgagccactgtgcctggccaataccctgaactttctcacctgccttctcctcatagctaacaggcctcacctcttccattccggagatgatccttggacatcttttcagccaggtaagtgggtgtaggagatgtagaagagtcgacgggagcagcagggaacttgaatgcttgggctaacttccttagctgggacaggatttggggaaggaagaaggcttacctcttttcctccagtaattgttgttttctctttccatccctaatttttctccttgttctctccttcaggaagagctctctggaaattctgagttgatacaaaagtacagaaatatcattacacatgcacccaacctggataacattgaattgtactggaacagctacaacaagtgggtgggctgtgtgtgtatgcatgtgagagaaatgcagaagcagtaattgggcgtcatgggggaggcacagaggaggagagggaagtctgggtagtgtgcaatgtgcaaggaatgcagcatttagtgtgcaatgggggcagcttcaggacagagtcagtgggaaggattgcaaggggctgtcccccttctcttgtttacctcctttggattattggactcccagaagtaagatgatcttgtgtcctgtgtccttcctccccttttgttgccctctgaccagggatctagggcacaagtgactataggggctgtgcttggggcctgcctgcccctttctcctttggtttccacctttaataaccaagatttgaccgtaatttttagacaaagatagttccatcatgggagagatagcttatatctggttagatagcattgcccacctaaaattcctactcttttaacccctttctagccgccgagacctgaactttg

SEQ ID NO: 15286 - DNA, 1942 bp, Homo sapiens
aaccatcatttaaaccataagataaccatgaagtgtgaacatacgaatctactataacttggcagtatgttttattcaagtgttaggggaagcaaaacccagtgtataatatagaaagtacagaagtagagcagatgatacactatatgcaagtactagtgttttgagataaccttgatgaaacaatgtgcttttgaaagtagtcgcaggatagagaaattgtgtatatttaatgtgatcagctcaggaacatatgcctggcctgtcagcattgactgaccaattttatttcaggggaaaaccagaaaacatacttattcctactgacagttgacctttttatttattaggggaattcagctacactgatgtcaaatggagtttcagtttctggaccctagttcacatcacattgaccaaaaaaatgcatttcataggaatttagaagcatccaagaaaaagtaccctgaccagaaaaccagtcgacagtagtaaacatatgatgtagaaatgattgaccagtaaatgagttacatataatatgtggattatggtctgagtacctcattcacactaagaaggagcactctgttggagaattctagtgtttggagagaacttggtataaagtaaaaatgtagccagttgaactgcagagtaaaagaacgtagacatacctgaccagacaaaagctttccaagtgttaggagacaggaagtaaataaagtagaaaactgcagaatttgtgtttgcattagtaactttcaagttaaatctcaattttgaaaagcagggcttcttcattggagttaacgccctttgtgagtagaactacaaagcatagtaagaggaaggggagaacagtgtaagggggtgaatgcaaatgacaaagggattagtaggaaggagttagaacccaagataaatgcagataggaagaggaaagcatgtttggattgtttttttcaagtggcactcagaaataaaagtttggagaaacatggctctgaagctctgacaaatttgcatttgcaaaaataactcctacaagactttcagaagtctaggaaaattgtggcttttggattattacattaccaaatttgtggagtttaataggtttcaactgtcaatgtgcattaaaatttcctgggagcagggggatgggcttttaaattctgatgtccaggtgtgtgctccaggcctactaaatctctggggttgggactcttcgttgttttttaagttgccataattccaatttttggcccaaattgtgaactactcaccaaaggcaaaacaaaacaaaaaaccctgtgtgataaagaggggtgaggattaggaaaggacacgggtttcaagaaacggtggctgggtggctggccaataagtttagtagagggatgactgtatatgtcagaattaagtgcagtaagaggatgtgtgagtggtatgttttcatcaaagaactgaaggcagctaaaagggccaaggtgtaccctcattaaagtctaggccccagagtaaagaaggcacccaaagagtcatctggtggttagggagggggaaaattccttgttatcaacgcatgttacagtgagctgttaaagctatagtactgtcagtaacacttcgtggcgatggaagtgttttatgatgcattgaccagtataacaactggtgactttactgagccttgagatgtggctagtgtgaagagttagatttaaatttttatttagagacgtgtgacgtgagactactttattggatagttaagtgctgtagaatattgagaagtttccacacaagtactgctagtggttactaactcaaacgtacatgaacaaatgtgactccaatattttgtgtgtcctgagttcattgatgttttctttcctagaccttaggctttaatattgaagatttccctagtgagggc

SEQ ID NO: 15287 - DNA, 1037 bp, Homo sapiens
ccagtgttggtgatacctcatccttgaaaggcttagttcatttgtgttttatacttcagtttttccagcatagcagaaaatgccgcttataatttttgtgcacacaaaccttggattcccctgtaaagttgctattgtttcatagcatgcggcactggccttttttcatcctactcattacaggcaaaactcatgtcttatttatgaggattttatagatcattttctgtaacaggtgacaaaagcagaaaagaatgaagaggctgaagtatgaactacccttggagcccatatacatgatataggcaatttcttttgtatgttaattcagtcaaaaatactacccacttgatgttttctaatctgatgtgagctcatgttacacagacttttagtaagtaacccgtgactagaaaataaactggatgcttaggagagagtgtcagatgtataagatgctaataaaacctgtttaatattattgttagctgtaagtttttgggaaatactgaacaaattagtccacaatcaagtgtctacttttcccttcactgtagggcctctccctgcacagagcagtctgtttagctgtgaacaccacaatctgcagatgttcaagtcccttacataaaatggcatagtatttatatgtaacctatgcatattctcctgtatattttaaatcatctctacattaaaatacctgataaaatgtaaatggtatgtaaatagttgtaactttttttatttatatttttgttaactttttttagttttttttctttgctagtattttcgatctgtagttggctgaatctgcatgtgcagaacccatgaacatggggggccaactatacattttattctaggaaagcaggtattgaatgaagctgtggagagcgctttttaatattaggttggtgcaaaagtaattgtggcttttgccattacttttaattagctgcagttacttttgcaaatagccgtagagcatgatcacagattgaaaatctatacacacatatggtagggttgtt

SEQ ID NO: 15288 - DNA, 1047 bp, Homo sapiens
cccggagtacctgagattataggaatgtgccaccacacctggataattttttctatttttagtagacactgggtttcaccatgttggtcaggcccgtctccatgtcctggcctcaaatgagccgctcgccttagcctcccaaagtgctgggattacaggtgtgagccaccctgtccggcaaaacagattatttcaatctgttcacatttttaagatgagaatcagctgtggtccattaaatggtccatgtaccaaatgatagctttattattaatagattaacgtctactctggtgtagtgttgacatgtattactaggttttttgagacccaggaaatgtcactgtttgcagctaatgtcttatggtcagaatttccatttaagaagcttccctttgaaaacctcttcttagtacatgtcttgtaatgcttttactttggaattggggtagacattctttgtctttttttttttttttttttttggtggtggaggagacaaaagtttttactctgtcgcccaggctggagtgcaatggctgtctgcaacccccacttccttcctgggttcaagcaactctcgtgcctcagcctcctgcgtagctgggattacaggtgtgccactgcatccagctggtgtgttttgttgttttttttttctttttcttttccttttctttctttcttcctttcttttttttttttttaagacggagtcttgctctgtcactgaggctggagtacagtggaatgatctcagctcactgcaacctctgccttccagattcaagcaattcttctgcctcagccctcctgagtagctggaattacaggcgtgtgccaccatgcccggctaatttttgtatttttagtatacacggggtttccccatgttggtcaggctggtctcaactcgtaacctcatgatccacctgcctccgcctcccaaaatgttgggattacaggcatgagcctccacacctggctggtgtattttgtcttaatctgttcaggtgattaatgtctctagagtgttttaatttctta

SEQ ID NO: 15289 - DNA, 1033 bp, Homo sapiens
gtctagtgagagtgtggtggtatctcagtcaggatttaattgcattttgtttaaaaatattgaatgtcttttcatgtgtttttcagcttttttttttttttttttttttttttgagacggagtcttgctctgtcactcaatctggagtgcagtggtgtgatctcaagagccccgtctcctgagttcacaccattctcctgcctcagcctaccgagtagctgagactacaggtgcccgccaccacgcccggctaatatttttgtattttttagtagagacgtggtttcaccatgtttgccaggatggtcttgatctcctgacctcgtgatctgcctgcctcggcctcaaagtgctgagattacaggcatgagccaccgtgcccagcccagccatttgtttactcttccacacatgtattcagattattacccatttttgtattaggttgtagaattagttgtaggattcgttatatattctggaaacaagactctgagtacaacatctgatactgttagaaaattttaactgtttcttataattccaccatcctgctctgtagttataggagatatgtaactatccatttgtgctaagtcgttttgtagagtttttaaggattatgggttttgtaatagacagtaaattatagattactggactctggtaattacatataagcggtagatggaagtttgtggaggcaacaaactagaacattgcttgctgttcagtagaacatttaagttcagtggccacatgtgactagtgactatagaattggatagtgcaggtctagaatgctgcaaaaatcagttttactgggtagaataagtctagagttgtgtaagttataagaaatgtaatgactaaagcctactcttcaggaaggaaataacccagactgcagttgtagagcgaatgttgaaagagtaaataggagaaagtcatctgtagaaataaactggtatttgtgatgtccttacagcaggcatatgatttcacctccaaattcacgttcatcacaggcaca

SEQ ID NO: 15290 - DNA, 1467 bp, Homo sapiens
caggcgcccgccaccacacccggctaattttttgtatttttagtagagacggggcttcatcgtgttagccaggatgatctcgatctcctgacctcatgatccgtccgtcttggcctcccaaagtgctgggattacaggcgtgagccaccacgcctggcctgattttttttttttttttttttaaatacggaattttcctctcgtcaccaggctggagtgaagtggcgtgattttggctcactgcaacatacgcctctttggttgaagcaattctcctgcctcagcctcccaagtagctggggttacaggcatgcaccaccactcccggctaatttttgtatttttagtagaggctgggtttcaccatgttggccaggctggtctcgaactcctgaactgaggtgatctactcgccttgacctcccaaagtgctgggattacaggtgtgagccactgtgtccagccctttcctcagatttttacagttatgtgtgaacattttgaaaactaaggagttctgtaattcttcatttttatttttgttgaaatttttgaaattcttaaaaaataaaaatcagctgggcacggtggctcacacctgtaatctcagcactttgtgaggccaaggcaggtggatcatgaggtcaggagttcaagaccagcctgggcaatatggtggaaccccgtctctactaaaaaaatacaaaaattagctgggcgtggtggcacgcgcctgtagtcccagctactcaggaggatgatgtaggagaattgcttgatcccgggaggtggaggtttcagtgagttgagatcgcgccactgcactccagcctgggtgacagagtgagactccttctcaaaaaataaaacaaaataaaaatcaatggagaacttccagttgaaaataaatcaggacattactagtgaactcagcccatttattcctgaaattgcaattttttgaatttttgcaatcagaccttggtaatgacctaatgcagtaggatataaataactccgacaagcttagcattccagtaatggaacattaggcatagatgggttaattattggtcaggtgtcttgaaggcactgaaacccagtgagtttgtctgaagcatctgccctttaaccctttctgcacatggtaattgcttgaccacatttaaaatatactcatgccagcttctcctatagggattcttacacaactggtcttatgcagactttcttaagtactagtatatttttcagtgctttctatgtgttcttttgtccagtcagagttgagaatcattaataaaagattaaggacgtggttgtgtttctgtgtattattatcctatttctttgtcatggctcaattcagaccagtttaataaactcacacttttgttggtataatttcagggatgtcatggactcttagttgatgttttttatgagtgtatcaagttttagcagtat

SEQ ID NO: 15291 - DNA, 1048 bp, Homo sapiens
agtgactgttcattccttaggaggacacgttactaagagtggaattaatccgtattgtgagtacgtctgtctttactgttgcctccatcttgaatttaagtcctcatagtaagtatgggtattttattaattttaggcaaactttggaagttgggatttttgtattttaaaaataagtagttgatgatttttgtagcaaatttaataaccagaccataaagaaaatgagaaatcatatccttaaactcataacaaccattgctagcatccttgtatgcctggatgcttttctactgagtttttcctttgtggatctttgagagaattaaggcctgatacacatgaaaaatgccgtggggtatgaattccttgcatcttgattagtactagctatgtactcagacttgtgaaaataatactagctatgtactcagacttgtgaaaattgagaaaatggtcatttaaatccatttctgtcttattccaaagggtacccctttcaatcacatctgtatttttctgcaaatgtccatttggaacattggactgtggtttgatgggttttttcccttatggtcagtattctgtgttggcttacggagcccctcacccctggtaatttcttctcattaaacctatggagattatattttctattgataaacctatttgtgaaaaatagttgcttaaaaccagattatacctccacttgtaataatgggaaatcttaataaccagcagtagtatctgaaaccagttaggcctcaatgcagatttttgttttaattcctctttttagtgtcctcagactttctggcatacttaatagctgaaaggctgttggtggatttcagtggctactgtttgttaatttttattgcttagtgttaaaatattaagaagtttttgtaaagatatactttagaaagtaacaaagacagacttttgaatttcagaaagatttggaaggaagtgaagttttgtttgagcttttaaatcagtactgcctgttaaatgactgtattaagcatcagaatgataggagtca

SEQ ID NO: 15292 - DNA, 2176 bp, Homo sapiens
gatcttggctcgctgcaacctccacctcacgggttcaagggattttcctgtgtcatcctcccaagtagctgggattacaggcatccaccaccacacccagctagtttttgtatttttagtagagaccgggttacaccatgttgcccaggctggtctcgaactcctgtcctcaggtgatttgctcgcctcagcctcccaaagtgctgggattacaggtgtgagccaccgtgcctggcctaattttaggtttttaaagtctatccttttcatgacagagcttttcatgacatgttgagtttaagaaagaaatagcacctaaggttctcatttgttgaggacattttttttttgaggtagaatctcactctgtcacccagactggagtgcagtggcgctatctccgctgactgcacctctgcctccaaggttcaagcatttttcctgcctcagcctcccgaatagctgggactacaggtgtgtgccaccataccccgctaattattttcatatttttagtacagatggtgtttcaccatgttagctaggatactgtctcgttctgacctcatgatccacctgcctcggcctcccaaagtgcctggctggaaatgtgactaaactactgcttcacttttgaagtatttaaccttctgatttacaaataatggaggctggaatatttgaactgtatgtttgtttgtttttgagacagtgtctccttctgttgcctaggctggagtgcattagcacgatctcggctcactgcaacctcctcccatgttcaagcgattctcctgtctcagcctcccgagtagctgggactacaggtgcaggccaccacgcatggctgatttttgtatttttagtagagatggggtttcaccatgttggccagagtggccttgaactcctgacctgatgtgaactgcctgcctcagtctcccaaagagctgggattacaggtgtgagccactgcacccagccccagatttcttaatgttaaatctagttcatgtaaattagtgccattttattatctaacagcattattcgactattacatactagtaaatggtgatagagtaggatccctgggttagcttgcattaaaaaaagaaaaattctagaccccttcaactagaagaggggaaatatgatgatgaggggcattgacctcaaaatatttgagtatatacaggtgcattaagacttggactattattactaatgtgattaaccttttaaaatttctaccaaatggattttctgttttaaggaatatttgtttggcttaaatgagtttttcctacagaaatcccaagcttgtatgtacattgtagtgaatttgggaaatacagagaaactgtgaaaatgattgtaaagattaatcacaagcagagtacccacagaacattttaagatattttgatgtgtttctgtactgtccgttcttaaatgatttttatgtagttcatttatgtctcctatgtattgtacgttttcagatactatttttttgactcaaattataatttgcacatcacttgaagttgtatttttaaaagactattattgctggacatttattactattgggttgttagttgttagaactcggttataaaaattcatatagaatatgaccaagtaatttagatctgtatgaggcaaaaagcaaaagtagacctattcattctacaagtggtttttacaccttccagatgtaaagggagtaacaaggcaagaaaatgggatcagggccgagtgcagtggctttcacctgtaatcccagcactttgggaggccgaggcaggcggatcacctgaggtcagaagttcaagatcaccctgaccaacatggagaaacctggtctttgctaaaaatacaaaattagccgggcctggtggcgcatgcctgtaatcccagctactggggaggctgaggcaggagaatcacttggaacagggaggcgtaggttgcagtgagccaagattgctccattgcactccatccttggcaacgagtgaaactccaactcaaaaaaattaaaaaaaaaatgtgatcaaggagtttgttttacttatctaaactattgtactactataaaaggatgctggcaacctgttacatgaaagaactgagggactgttcttaggatttctaacaacagtctgcg

SEQ ID NO: 15293 - DNA, 1034 bp, Homo sapiens
tcttgctctgttcccaggctggagtgcaggggtgcaatctcggcttactacaacctccgcctcctgggttcaggcagttctttgcctcagccccccgagtagctgggattacagacgcctgccaccaccaatttttgtctttagtagagacagggtttcaccacgttggccaggctggttttgaactcgtgacctcatgatctacccacctcggcctcccagagtgctgggattacaggcgtgagccttcgcacctggcctagttgaggttttaagatacagtaataaaggaaattgtaaggcagggttttgaatttccaaatctgaggtaatatatattttcctttgtctctagtgtgagataatgtctggtaagtgaaagtgacagcatgtttaatttttttctcctggaccattggataatgtgttttaagtataatgtgattaacccatgtggagaggtggccagggcttgctgaaataaatgcccagtagaaacatcttgtactttgtttaacttgtatacttttgcactaaataagccaagatatactgaaaacagttgggttgaacggcacctatctcctgtgacctgaactctatcaaagctggcatacagtgcccagataaaaaaggaagctgaagtcttgactccatgttcaaattcattttggctcagctctcagcaaattccagggctctcacaacctgtttgtggaccacttgaactttatttatgtaaaaaatcttcagataatgcaaactgccgtaccttttccaagtagaattgaattacttgagatttaaagttaatgtaatggtaatgaagtatttttataaatatattttcaaaattttagctagattgacaatccaagattggtttccctccattaaaagggtgaagaggcatgatagcacctcacacttacaatgaacagttggaaataaaatttacagtttggctatatcccaactagatagagtttttacttattttttgcttttaagctgtggctgggatggtgagagtg

SEQ ID NO: 15294 - DNA, 1647 bp, Homo sapiens
gtagctaggattacaggcatgcaccaccacgcttggctaatttttgtatttttagtagagacgcggtttctccatgttggtcaggctggtcttgaactcctgacctcaagtgatccacccacctcggcctccaaaagtactgggattacaggcgtgagccactgctcccagcccatttttgaaatcttttatactgtatttttactgtaccttttcttttttgaagtacacaaataatattgtgttagaacttagactcagcccttgttttctcttttgcttttttttttttttttttttttgagatggagtctcgctctgtctcccaggctggagtgcagtggtgtgatcttggctcagtgctacgtctgcctccgggattgaagcgattctcctgcctcagcctcctgagtagctgggactacaggcgcatgccaccacgcctggctaatttttgttattttagtagagactgggtttcaccatattggtctggttggtctcaaactccgtgttgggattacaggcgtgaaccacctttcccgccctgtgttagaacttcttatagtgttcagtactgtgcatgctatgcaggtttgtagtctgggagcaataggctatacgatacaggctaggtgtgtggtaggctacactatctagcttggtattgggtaactacactcttacgacattaacacagtgacaaaattgcataacgatacaattctcatgcatttccctgtcattaagcaatgtgtgattaattggtttactgatgaatgtaattccaagaatagagctaagggaagaattaaagagtcaactatgatttagaatcgtatatcattagattgtgagttctctgactttggcaattcaaaagctccaccattggtaagtgagaaaggataccttaaatggaatttttagcatcttttgagggacctcgggggaaattaaatgacatgaattagttttttacatcgagatgttttaagaccttaattttttatttgttgcattacatcactcatacattgaaaggaaacaattttgattataaaagtgctttatagagagaacttgcgggcaggcgtgggggctcacgcctataatccctgcacttttggaacgtggaggtcggcggatcacctgaggtcaggagttggagaccagctatggtcaacatggtgaaaccccatctctactaaaagtacaaaaaattatccggatgtggtggcgggcgcctgtagtcccagctactcggaaggcagaggttgcagtgatcgaagatcgcaacactgcaatccagcctgggcaacaagagctaagcttcgtcttaaaaaaaaaaaaaacttggaggaaatatgcagataaaaatagtatttactcatttacttatgtcatcagcactcagaggtaaccaccatcaacatttttatgttttgttctctgtcttatgtagctacaggtatatatatatgtatattttactaatatgtaattattatagtgttagaacctctacgtggtagatgttttccagtcagtaagtattctaccatgtttttgtttaatggctgtcaagtatcttttgtcacagatttatataaaagattcagttccaagcaaacatggaagtacttg

SEQ ID NO: 15295 - DNA, 1610 bp, Homo sapiens
gtgtgagcaactgcacccgcctggtgctatcttttaattgtgaaaaaatttcacatacacaaaagagaatagtataatgaacttccatgtacttgtctcactttaataatccttggccagcctttttgtttgtatctacatctccccatccacccccttcccatgttattttgaagcaaattcttgatacatttcatctgtagatatttcagtgtgtattttaaaaagaattaggacttaaccacaattatcccaccaaaaacgtttaataaattaactattttaatactaaacatatttagaggcctggcatggtggctcatgcctgtaatgccagctctttgggaggccaaggtgggcacatcacttcaggccaggagttcgagaccagcctggccaatgtggtgaaaccctgtctctgctaagaatacaaaaaaattacctgggtagggcagtgcatgtgtgtaatcccagctacttggaagtctgaggcagaaggatcccttgaactcaggaggcagaggttgcagtgagccaagatactgccactgcactccagcctgggtgatattgtgagacttaaaacaaaaacaacaacaaaaaaagaccaacaagtccatttagtatcagaagtactaccctgagaactgagtaaggcattcctcaatgctgttttatttctacggggataacatggttggtggggtctttttgtttatttgttcttttgctaacagtcctgtatggaattttggaagtgttgtttactaaaggtaggttttgaaattttcttaggagttgggggtcttatggttatactcattggtgataaaaatcaaaccttttactattctcaaatttagatataatctcctgttttggctgtttaagagaatactgtaataactttaagccaaatatccttgttaaaaattattctgggctgctaggttattattttgttatacctgtctaaaatcttatccataatttagaaattttaaaatctctgacaaattttgcatttgacaccaagactcaatttggcaaaaaaaactgatcttaactgatgtgagattatttatgttctatgtgtgaaatttactgaaaatttatatgtattcctgcagaaatatttgatgtggtaactgtgctctcccagatgctacacaacaaaaaaagcatagtatttctaaaatctgagactatttttcctaatacgtgtgtcttttttttttgagacggagtctctgttgcccaggctggagtgcagcggcgcagtcttggctcactgcaacctccacttcccgggttcaagcagttctcctgcctcatcctcccaagtagctgggattacaggcacccaccactaccacgcttggctagattttgtatttttagtggagacagggtttcaccgtgtaggccaggctggtctggaactcctgacctcaagttatctgcccgcctctgcctcccaaagtgttgggagtacaggtgtgagccaccacacctggctgcaagcattgtagaccagagtagacttaaagtatactttgttacaactcatgctcagtctgaggtcactgataaaattgaaactttctgta

SEQ ID NO: 15296 - DNA, 2560 bp, Homo sapiens
tccctccccactagttttgttcttaaaagtgatagctagattgatcctaaaatgtattgtttgaaggattttttttttgggggggagatggagttttgctctctttgcccaggctgtagtgcagtggtgcgagctcggctcaccgcaacctctgcctcccgggttcaagcagttctcctgcctcagccttccaagtagctgggattacaggcaccagccaccaagcccagctaatttgttttttatttttagtagagacagggttgcaccatgttggccaggatagtctcgatttcttgaccttgtgatctgcccgtctctgcctccccaaagtgctgggattacaggcgtgatccaccacgcctggccattgaaaaatgttttgcctgaaaacaaacaacctaatggctgcctttttcagcattgaagtcaaaaatttttctgtgatttacagggcatcccacgtgatttgttgtgtcccttcccttgctgttaatatactgtgcttcagccacactggccttcttaactgtattgaacacattggatatgtttccactttagggcttttccttggaattttctctgactcatacagtttggttcctcagttcctctgagactttttactcagaagctacccccttagtgatgtgtcttcccttatttagcgctttaagctccccttctcctaaatactctttagcacttatcaccaactgtagaatttgtttttttctatgtaaagacataagagatatgtccagaaatacatatgccaaacaattaacattgattgcctctgggcaagaagtgggatttaggagatttgaaacttgtgtactatgtgcttaagactattataatgatcaatgtggtagtattttccttctaattaaaaagcttaaaaatgtacatcaactcttgtgattctgtgtgggcataaatagcatagctagtctgtgtaataggggtttagtaagcagtgttaatagttgaagaaactgctttaaaaggtttagctgtgatagagtcgagttagcatttgagcacatagactaccgtgttgcctgtatcaacatttgggagagcttgaccattttaaaaatatgtattctctactgagaaagcatggctatttgtaagaggtagagtgaattagagaactttttttttattatttctacctaatctgattctgactttaccagtctgaaatattcttcctgttttctaattatattgacctatggctcctgagttgattttaaaactgaaaaaactccaggagttcattgaaccagatttaggcttttctggctagtcttgaataacatttaggagtttagtagagtacattttgaacaaaaattttcctccagtcctctaactaaaataggtattctgaagaggataaactattcataatgcattgtcactccctatattgatcctttaaataaaatcttcacataagtgggttttctagcttcagagcgagaagaaaagttttctcatgctattacccttaagtttgtggaattcatgctagagttatggctatgctgtttaaaatggagtttttctggtttttttttttgttttttttttgagactagagtctcgctctgttgcccaggctggagtgcaatggcacgatcttggctcaccgcaacctccgcctaccgcaacctccgcctcccggattcaagtgattctcctgcctcagcttcccgagtagctgggattacaggcgcctgccaccacgcctggctaatttttgtatttttacaagagacagggtttcaccatgctggccaggctggtctcgaactcgcgacctcaggcaatccgcccatctcggcctcccaaagtgctgggattacaggcgtgagccaccgcagcttgctaaaatggagttttattactcctttgaaaaggaatactagtcaagtgactgaagattgatgtggatttgggagaggaggtacctcatctttatcttacctttgatccgaataaagtaatacatgctcatagaacatttttagaaaatacagctatccaaagataacatttggggtgttcttccaggctttttggggcttatataaacttcaaaaagcactgtcatacagcatatatatttaagtaataattttaaatttaacctgaatagcttatgttagtagatacagatctctgaaaaatttgtagtagttacatagtattatatactctataatactacatggtacattgtatacttgtactatattttattttaccaatacactgttgtactcgtccccattttttcttttgtaaacaaagctttggacagtcaaaactacagttgtgcatatctttattttcttacatttaagccccagaaatataattattcaagggtatgcacatcttttttgccggggaggtgggcagagtatgcactttttttttttttttttttgagacggaatctcactctagcccaggctggagtgcagtggcatggtctcactgcaagctccctctcccgggttcatgccattctcct

SEQ ID NO: 15297 - DNA, 1041 bp, Homo sapiens
catgagccactgcacctaacctggaataattttttgaaggcatattcggtactgttgtactagggtaaatcacaaacttgcccccttataccatactcggatgaaaagtgaaatctagttaaagtgaacaccagaggtacactcaaaacagaatgggagaaaaagcaaaagattcctggaagttatctagaaaaagaatgggaatctttattttttaaataagtgcaagttttattgatgctctctattgtatgagagctattttttcttctttgctgctgtcagtgtacggaagctgttcactataggttcagtttgatttattccttgttaattctacaaatttattatttttatgggacatgttgtgtttggggatataaaaaatagtttattatgtttaagggcttcgcagcttagtgagggagacacatgaatgaaataatgtccatatatgatgagaggtaaacacatatcctatagaagcatgccaaaataagctgggggcgttggtacctgcctgtaagcctgtagtcacaactaattggaaggctgaggcaggagggtcccttggcccaggatttgagagactgtagtgtgtgatgtgattatccactgcactccaggctgggcaacataatgagaccccatctttttttttttttttttttttgagacagtctcgctctgtttcccaggctggagtgcagtggtgccatcttgggtcactgcaacctccacctcccgggttcaagcgattctcctgcctcagcctcccgagtagctgagactacaggcacggaccaccatgcacggctaatttctgtatttttagtagtgacgaggtttcaccatgttggccaggctggtctcaaactcctgatctcatggtctgcccgcctcggcctcccaaagtgctggaattacaggcatgagccactgcacctggccttaaatttttctatttttagtagagacagggttcagtagagatgccatgttggccaggatggtctcaagttcctgacctcaggtgatcca

SEQ ID NO: 15298 - DNA, 2445 bp, Homo sapiens
ggtcttgtggtttgatcactcactggttttgagaatagatgagtcatctctagtatagatcttcatggtaggccattcaccttcagtctattactcatagcaaaaactccacggacttttttaagtttaaaacccatgaatctgcttaggttttataatctcagtatttgacatttgctcactatttcatctctatttgttggcccggtttttctgtattttctttgcccaaactgctcattatcaagatgaacatttgggatatactctttttgagaccctcaagggcatattgacatgaatttagttaattttagtcatctattgatgttgaagaattgtgaagacagtcactggtagaggtgattctatggaggctatcccatcccagtggaatgttaatgctttaccaaaatgtgttagctgcagtagacagatgtttctgtcttgggggtttagggcacaacatttctgaggaactctgactcaatctgtcccttctcctttcacagggcagcaaggcgaaccccatccctactcactggagctcagctttgatttttaacctcccttccccacccttccagaacacacacattccattccaaaactgattttataaagacattttaaacataatgatgcaacttggtgtgcactacagcaaatgtacaggtgttttttttttaattgtttccaaaaccgggacctggatttaagatgtaatttttaaaatttctatttctattttttctgcagcagttgggttagaggaggaggagccttttagcctctcataaactgacctctctacttcctcgtgtatttttaagattgattgatgatgtggaaagggctttgcttgtctgctactgaaaactttatccttgcggtttttgtggaaactgcttttggaaagagaaaagaaatgaactttactgacttgacatttttgcacctcccgtttttctaatctgggctatttttatttttgtttttttacagtgagatttttttgatcttcagctacagtaagttattccaatttttttttaacatttttcctgactttccgctgatttcctttttattgttgttactagttactattacttattattattatattaatacttatgatggtgatgatgatgatgataatgacactgatgatttttaaccggattaaaatcgagtttttctgaatgtttctaagaatttctccggcctcctgattgactttggagttttgcatcttgggagagaaagcgaaggcattagtatttttaagtggtttgatcacgtaaaccttttctctcccaaccccacccttgccctcatccccttccccacactgaaaagaattttactggctgttaagtctatgaccttatttttcctgatctttaacttaactgttttagagcatctctggacgtctgtatttttaattttttttatttttgtttttttatttttaatctttcatttgttaaatttttaaactgtgctgcaataaaatgtgtgtggtactacttaacacttatgatcgtgatggcattttccctgaaagccatcttcctcctgtttcccttgaaatcccatcctgcttttcctgtacactacccctcacaaaccacaagctgcagcaacatggatgcccagcctggagcagcagcagccaggatgacctggagccaggggggccttcggaacagatgcacacccttcctgggtgatggtaagaggtgtgaggtccacttggattcattacaaagactaggaaataaacccgtttaacagtttagctgatgtgtataggtcatagcatctggaagtgtttgaaacttttgtgtgtgcatcttgaggtgtttcccaagggggaccacctcagttatttgtaaactaatggaataatatgagttgctaattaacttgggctgattagaacattttggatacttggaaagagcagctgaagtttaaaatgaaagtggcttgttttaatgattagcaacaagaaaacatattggggagtccctttttttagattgttacaaatcagtaaacattttctgtcatttaacatattccttgggtttgtgacatttttggattatattctatttagactttttatctcattaatatttcacaagagtcaaaccataggagatacaacataatattaaaatgctgtctcactggagggcttttaaaaatttgaaaaaaggtaggctttttgacctcacaaagcagggaaatctgtttaacctctacatccaaattaggaactgtctaaggctgaccccttttacagtggtgactcaagacccagctagattttgggaattctaatgtgaattcatagagttctaatgctagattaggaactctaatgtgttctgatgttaagaaggagtgtattctgtgttattcacagga

SEQ ID NO: 15299 - DNA, 1020 bp, Homo sapiens
ggcgctgggtttttcgggaagcgagagggggtgtgggagagaagatgtgggaatccttccccctaactaaccgggccctcatttattctgcttgttttgggggattaggttgaagccgggggcagttttataggcctcagcctctgtataggtttaacctggtgtcctctaggccacgatcgccagggaaaatgtccttttttcgctcttcctgtgttaacggctgctttcctttcattttctacgaccgcgaggactacgggatcatgaaaatgaagatcgtgatgctcattaatatagtcgaagttaacgtagcgccgatgccttctattacctccgttcttcttacatgtaaaaagtgggggaggggaagggggaaggttaccaagtagatgtatcgcgagcctttaaatcctggatcgtgccgcgtggcctacgagaaaggtttaacaaaagattcagcattttactgataactttttattttatttctctctatgagcaaatgatggagctcgaagtagttattttcacttacatttgtaaaaggaaatattgtgatataactatattaatatttacagctgacttttcatctgcaggttacaaaacacttgaaatatataagttagtggaactttgcttgaggtaggtattaactctctttctcagacggaaactgaggcagaaaagtgttggttgctagggtcatattaagtcagtagcagcactagtaaggaatttgaccacgaggtcagtcgagtggtttttacctagttaatggaatacctagttaatatagttctaaaactactgtattgcaatctttgccaagaacctgatgacggaaaccacgaggtaactggaaattcccaaattgcgcttaagaaaaatactacgagacttgagaattttttaacgtaacttcctaagtgtaagatgacaaaatttgactttcgggatattctggcgttaattttcccgtccgcctaaatgtgggcaaaaattcacagctacgtt

SEQ ID NO: 15300 - DNA, 1046 bp, Homo sapiens
cataagaagcagtgatactccctggctcggttattttctccatacaatgcacacatggtacaatgatagaaggcaaaattgccactgtcttcttttttttctcatatatctaaggaagatatatcaggttgtgcctcatgtaccgcttctagtgaaatgtagaggaaggctcaaaggagtcaacatttatatctggaagggacaagtcatgccttgggcctagaataccctgatgagaaaagagaagaggaagggaggccatatctacaacacagcctctcggcactgctgctccttattttaactttgtcttgcattgtcctgtatttatcacagtttctgttgaacagcttttcaagtatttggggagtttatcttgccatcctccccttctggttctctgcacccacctgtcccactgcagttccttccgtgctctgtgactttaagagaagaaggggggaggggtcccggattttatgtttgtttgttttttctccttagcagtaggacttgatattttcaattttggaagaactaaaagatgaataaactgggttttttttgttgtttgtttttgtaaattcacctgtgaccgttcattttcagttcttgaaagcaagcctgcttcctgcctggtaaagtgctaaggtactggagaaaaatgcctttagctagctagttttacaaatgaaactttcatcattctaaactttcatcattagattgagagacactagacatcacagtaaaccaaattcatgttatagcaagctaactttataagagactttttactatggttccctcagagacttttagattggaatagcacttgttccttcatgaaaacaaatcttcagtcatctccttgtaaatagcatggaggacagcagctgcttgaagggaaaccttcagccttcctattggggtagccagatcttcagggctaacaactgttgggaaagggaaaaaaacagcatcactcagttgaacactttgatacttggtatttgtcaggttaggtactggggatgctaaatgaa

SEQ ID NO: 15301 - DNA, 1026 bp, Homo sapiens
tttcatttttgatatttacttagacttaaaactcattgaacaaatgttacttttaaagtctctttagggcaggcataatggctcacacctgtaatcccagcacaattagaggccaaggtgggaggaacacttgaggccaggaactcaagaccagtctgggcaacatagcaagaacctatctctcttttttttattttttattttttaagataatgtctttttaaatagtttattttaaatggttccttcacatagtttccttgagtttattctccttgagggatgatttttgtatcttgcagatcctttttctgtggcttcttagtatgttgtactgcctcagtctttcaaaaaaaaaaccaaaaaacagcttaagttatcttttatgtagtgatttagatcatgaaagttatttgaaatattattgctttgggggaaatacttatatgctaatgattcagtttctccctgacagccaccttttgtggtgacattggatgaggtagagctgatccactttgagcgggtccagtttcacctgaagaactttgatatggtaatcgtctacaaggactacagcaagaaagtgaccatgatcaacgccattcctgtagcctctcttgaccccatcaaggaatggttgaagtaagtaaatctgccatcagtctcccatttagcccatgagccctgttttatagaatttgaatgtggtatgttgtgcataaaatctactgatatacttaaagtgagactgccttttggttgttacagaccaggacttgaaaacttgagatctattagataacggagctgttcactttttcttgaattcccaacaatagcttgtgcatacttaacacaaagaaaatcaaaatctaagatcttttttgttttcagtgttgcccaggctggtctcaaactcctgggctcaagcgatcctcccacgtcggtctcccaacgtaccaggattacaggcacaagccactgcacccagtcaatgtagagcatatttacaatagcttttga

SEQ ID NO: 15302 - DNA, 1049 bp, Homo sapiens
aaaaaattgtagctcctgacgagaggttagaggttagaaggataaaaactatatttattcattgtcaaacattttagtgtccaaaagattcaaagcattgcccagccgtttactaggttagaaaatgaaattgcctcttttaaataatgtgtcttcattctccttttaattctaggatggcccagctactgttctcacttctgtgaagaagaaagtgaagaatgtggggattttcctaaaggtaggaagaagatagataagtagtataggaagtttaggatataaagaagttaaataatattggctaaaataattaaaatttcattttttgattatgactttttccatagaatgaagatgaggaagaagaggaggaggagaaagatgaggcagaggaccttttgggaagaggttctcgggcagcattacttacagaaagaacaagagtaagtttactattttaaattacattgatctcggctgtcatatggctcacgtgttgtgataaattggattttccattcaccagaatgaaatgactgcagaagagaagcgaagagcacatcagaaagaactagcggctcaactcaatgaagaagcaaagaggcgattgactgaacaaaagggagaacagcagattcagaagtaagagttttcactgagcagtgagatcatctgagggttctgtgggactgcagaaatttctcagttgtttttttatcccactccagagctcgcaagtctaatgtgtcctataaaaacccatctctgatgcctaaggaaccacatattcgggaaatgaagatctacatcgataagaaatatgagactgtaataatgcccgtgtttggcattgcaacaccgtttcacattgccacaatcaaggtactgacattcagtgcatcaggtttcatccaaactgttgcttaaaatagtaattgtatttgccataaataatctgcattcatcatgtctcccacttttgactccttcagactctgttcagttactgacatccctcttgtcttgtcattctccttcctctttca

SEQ ID NO: 15303 - DNA, 1109 bp, Homo sapiens
ttacttagccaaccatcataaattcactgcacacagaagtgctttatttataacttcttatttctttacatagaatattaaaagacaaatgcaagggtttgggattttataatggtaatcatttttacttcatcaaggacttttacgtgaaactggccttttttcctgagtgtgtagtaatggagaagtagtttggcgccactaccttgactcatacaaagggactagcagttttaagtgccattactatttcactattggtgagaactaatggtaaaactttttaccaacctgaaggaaaacatttcttactgaaaatcaatgagaaaaggcatataatttctatgtagtgacttctttgcataatatattttgttgtggtagagaaatacaacagaacactcagttgctatcatatatccttattaacaagcagaagccttaaaaatgtggaagagtcttatgtatgcatttatcttgactttataggggaagtcagaattatagctcagaatgaccagtgttttggctttatagagctattgaagagtatctgatggttggagaactcacacatcttgatttcaaaacttactacaacgctgtagtaatcaaaacatcacggtactggcctaaggataggcatatagaagagtggaataaacgtgaaaattcagaaataaatcctcacatttatggtcatttaatttttgacagggatgtcaagataattcaatgagaaatgaatagtcttttcaacaaatggtgttgtaataactagatattcaatgtaaaagaatgaagttgggttagtcctcagaccatacaaaaaaattaattgaaaatgaatcatagacctaactgtgacagctaaagctatgaaacccttgtagaagaagtataaagtaaatctgagtgaccttgaattaggcagaaccttcttagatatgacaccaaaagcacaagaaaatagataggccaggcacagtggctcacacctgtgatcctagcattttgggaggccaaggcaggaggatcacttgaggtcaggagttcaagaccagcctggccaacatggcaaaacctagtctctgctaaaaatacaaaaa

SEQ ID NO: 15304 - DNA, 1050 bp, Homo sapiens
aattagctgggcgtggtggtgggcacctgtagtcccagctactcaggaggctgaggcaggagaatggcgtgaacctggaaggcagagcttgcagtgagccaagatcgcaccactgcactccagcctgggcgacagagtgagactccatctcaaaaaataaataaataaataaaaataaataaaactgcaggcaaggcatggtggcttacacctggaatcccaacactttgggagcctaaggctatcagtcactagttaaaaactcttcatgattctaaattgctataaaaatgttaaatatagtaataaacccagtagttgtccaagataacattctaactttgttttccattatgagcaatatagaacatattctaattattccagcagcatataaagtaagcataaaggcaaaacaaatctcattttcttcaactatgaccctttttcttctaggctatgagaaatataataccatgagggcagacccagccttatgtttcctagaaaaggctggccgaccagatgacaaagcaattgcagcagaacatcgagtgttggataacttctctgacatagtagaagggtaagcattagtatttgttcttttaaaactctaacttgtgccgtgaaataactctagccttgactgaacccaatgggattcttaattgtaattatactcaaaagtgatagatccttagcaaaaataggaccagcagaaaggactccataaactgcataaaccacatgttgccataagatacatctgagggtgaaaatgaatgtcacttgtaaatggcttatttgatgttctatttggtttggtttacaacactcttctgtacagctacagtagctgagaggataactggtctcttgaaagataacagccagcagctctcatacgttgcttctgtggaagagccttaggcgctttcagccctggtttatcatctcccaatggtacctgacacataaaggtacttattttgcctgaaaacatgtcccaatgatgagttgccatgctaatactgagccaccaggtag

SEQ ID NO: 15305 - DNA, 1042 bp, Homo sapiens
ctcaagtgagtgctccttgctactgtgatgggacgtgcaagagtaagctcaagtgagtgctccttgctattgtgatgggacgtgcaagagtaagctcgagtgctccttgctattgtgatgggacgtgcaagagtaagctcaagtgagtgctccttgctattgtgatgggacgtgcaagagcaagctcaagtgagtgctccttgctattgtgatgggacgtgcaagagtaagctcaagtgagtgctccttgctactgggatgggacgggcaagagcaagctcaagtgagtgctccttgctattgggatgggacgggcaagagcaagctcaagattgagtactccttgctattgtgatgggacatttgagggcagagcactcatttctaagaagcattgaggaacttatgtgtatttaccagctacatagttcaaggtgatctattatagaaaataataaggcctttcttttttctgtcctaatgcttataggatttgttaaatggaaaactgaaattagcatattttaagaggaaaacacgaaggcacaggaaagatagttactgtgctgggagttacctttaaaagctgtgactctgcattcatatatttgtcctgattttgtattactgtagtgtgaaagagatttctcactacctcctaccacccacatcagtaaaaagagaactactggagacatagctgtcctgttcttgcatctcttctgtgaattggagatttcagcatctaccattagctttaagcagtgttgacagaaaagtgatggcttgccacataattcttgtcataattgagtgtcctctctttcccttccatgtcctgtatcttctcctttcttactagcttttactccctgggattcttaaggctttgtggtgtaattataataatgctttgtatttgtaccggatttttcagcttttaaaagacagttttatgtttcttatttgagcctcagtaactgtcaggacaggtattatctctctaatgtttacaaataatgaaactaatgctcttgtagtg

SEQ ID NO: 15306 - DNA, 1025 bp, Homo sapiens
cattgctgttgccctcagcaaccacttattcttgaatgtggggccattctagatttatatctctgaactgaggtgcagacttaattctttcattcatggaaaccttattttaattatattattaaaagattagagagggattgttgggtttgggatatgagattatttagtatttatctttgaattgttttatttataatcttttcctaatattattgtgaaataaaaatgatttgtgatatcctttaaatgatagttcagaaatgacttgaagaaataagtgatcagtcctcccctctccccgcccaggcagataaaaggtaggccaagagtagaatttgaatttttttaccgttaggccagagaccaatattgggtatattagttgtaatttttctgaggtaatggagatgtatattaatggaagcatagcaaaaagatactaaagtttattttggcagaattcttggtttttctcacccctttcccaccaaaagaatacattttaaaaagtaggtgtaggttcaataagatttagtctgagcttgattcttgagggattaaagaactagtttctagcccccctgcttcagagctggattttatttaggccatttaactacaagcaagttgaaattgtagtatctttgtttctataggctggctcttcccaaggggcctcttctgggctctctgtagttaaagttctgagtgccagtgaagtggcagctttgtcatcaccagcaagctctgctcctcattcggggggaaagacaggaatggaggaaaaccgcagattggaacaccagaagaagcaagagaaagcaaatcggattgtagcagaggccattgcgagagcccgtgcccgcggtgagcagaacatacctcgagtcttaaatgaggacgagttgcccagcgttcggccagaggaggaaggcgagaagaaacgcaggaagaagagtgctggggagaggctgaaagaggagaagccaaagaagagtaaaacatctggtgcctccaaaaca

SEQ ID NO: 15307 - DNA, 1034 bp, Homo sapiens
gatatttctttttcatatatttgggttttatggtgatatacttccctgtctttgatagcttttcttttttccactagtttcatgaacttaaaaccctagacatggattttgtgaacctactttcagccattcataagacatgttttcaagataggaagctttttaccatctcatgttagaatcaaaggataccatttagtttctgtgaggatcgaatggtttactccagataatgcgagcaagtataattcattaactgttttttgattagctactatatgtgctatgtcctgctggttcttaggggatccacagataaataaaacatagtccccaccatccaagaactttctcccagagaaagaggagctgggccatggtacagagttgtggagggtgtacattgcatacattcataacaaatttttatatatttagtatggcagttttccaggcatcttgagaagtgggcaactttttacaatttgcgcaaaggaaccatttgggccttcagaggatatattacagacttaggtcattataataaaatattaaatataagtgttttaaggtataaacaatggtgtgggtatttaaaggaggtggagggatcaagtcatcacaagttgctcagttgttaaagcgtcagaggttcagggctcacttaatggagtagaagacctttgagggttggtaggattttagctgcgagagattattggcattgggatggagaggacgtgttccaggcagaaagcacagcatcataagcaaagtcacacaggtaggaatcacattaagggaattgtgtagtctagttggactggaatgtaaaatatatgtaagagatggtaagaggaagttgggaatataaattggaaacaatgttgaatcccttgcaattgaccttttttatcttaaatatgagaaagttttcttgagaggggacttcagaacaaaaatcccattatagattaatatgttaactagaataaaggttgcaaaacttcctgggtaaaattgtatgatcactt

SEQ ID NO: 15308 - DNA, 1048 bp, Homo sapiens
ggcacagctcgttttctccttcagggcttgtcgggcctctcggcctgcagcttccgccctaacattgctcctatcccgggcatccacaccccccaccccccgcatcttcccgtcttggccatccccaccctggagggcacccccgctagctccttacctcaagtgcatgtacctcatttccattttggggtctccagttaccagaaatcttccgcctctgctgtatggaccttactggcaccaaccccggcagtatgagcaggtaatgtacccgggtcccccccacccccaccccagtcgcgttttcctctccatcaacccctcacttcctcacctcgccctttcccttttttcatgagtgcagaatctctctagtttcttctttaccccctgaaaatacatgtctttagctgtcgtagttgcctattttgcttttccgatttattcacaaggtcttactttaccagccttatattcccccaaatgaccatacccttgattgaggtgtgagtgctttctctttcagtaattggaaaacagaaacagagtagccacacatttggcagtgagaatggtgaagacagagaaaatggcctaggatcttgatctacttaggaaatctgagtggctccaatttggtcctatgtctttccatcctgatcctttgctgaccctaaattgtgattgcattcactttggatgtttatttttcatttctgtataagatttgagacccttcgtgtctcacgaatgtcttcatggtacagttttaaaatacttctcttttaaaattatgttggtgattttcattttagccctttggattattttattttcaaggtatttctcatttaaattaagctgcttctacccatcttatgtttcagtaacatgtatttatgtctatctgcaactgatcttcttgaaaggatacagtttccaacaacaagatttgttctttgaagtaaataaaatagtttattcttttctgaacctttgagcagctagaggttaagtggtcatgagtggtactttctaaaagtgcaca

SEQ ID NO: 15309 - DNA, 1024 bp, Homo sapiens
gtcaggagttcgagaccagcctggccaacatggtgaaacctcatctctactaaaaatacaaaaattagccgggcatggtggtggacgcctgtaatcccagctacccgggaggctgaggcaggagaatcacttgaacccgggaggcagaggttgcagtgagccgagatcgcactactgcactccagcctgggcaacagagtgagactccatctcaagaaaaaaaaaccagcaacaaaaaagagaaactactttattgatgttttttcctcctgagcccctgctggtcttattgaatgtgtcaccttgtattataattgtttttatttgtcactgttgtcatactgcctactctttaccctcttcccacatacatacacaaatgcactcttacttactgtgagttgagggtagggattatgtcttacttgtttttggatccctaatgctagcagattacttggcatgttacatactcaatacatattgaagtaataagaagcatttgatgttgaacttagaggataataagtaagattttggtaatgcaaagaaagaaattaaagatgtgtataatttgaaggcagcaatattaggctcagattagaaaaaatacgacaatagtaatttgtctttttttggctagcaagtatatgtagacaaatggtagaaaataagacaggaaatataagatattgtcttaagtaattgggagcctttgaaaattttccagcacaagtttgatttggccataccgtgttttaggatattaatctggttgcagaatggattagtagggtgagtagagagattttttatgaggcttttctcttacataagcaactacataagtaagggagatggcagcagaaataggagtcagatatatgaatcctaacttgccacttagtttcatagtcaaacattcaactctctaagcctcagttttctcatctatacactaagaaggttgacagagtctttggcagctccaaaatctttgttatatattgtaagagaatcaatg

SEQ ID NO: 15310 - DNA, 1035 bp, Homo sapiens
aacctccactttccaggttcaagcagttctcctgcctcaacctcccgagtagctgggactacaggcatgtgccaccacacctggctcatttttgtatttttagtagagacagggtttcaccatgttggccaggatggtcttgatctcttgacctcgtgatccgcccaccttggcctcccaaagtgctggattacaggtgtgagccaccgtgcctggcctaaataaataatttcgtaagcatatacaatccacttcccactaagaattagggtcaaagacattctatttgaacacttgcaattacctagatctagttggcctttggttgatagatcctctgcctcggaatttcattgagtttttttcttccttgcctttgggtgtctgcttgccacttcctaagaattcttgtagaaggcagtttcctctacttgcccaagagcactgagtacttctctactatcctattattagcttctatctcttagtgtaacttcaaaacttttaagagcagtgaagttggtcagggacatgtggccacttattattacctaaagaaaacatttgttccctgttcattttattttaggggccagatctaacattgtagtgtctttcaccagatagacttctactgtttcatcaaactcccttcttaactagacctagactttctactccaatcaggctaatctacttactgaatgtgacatatttattcctagttccatacctttgcacatgccctactctccactaattatacttaaaagtccaaaaattttttctttagtaacagacttaggtactgctaagcagttattaacacaatattccttagttttcatatgttggttattcatatgtctatttatatgtatatttatttttatgtatgttactatgtaaatatggtttgcagttgtttttgtgtggaatcttgtctttccgtataagttgtaagctccttgagagcaggatccatgtcattcctttatttttataaattattccccctatcattcctttacagtg

SEQ ID NO: 15311 - DNA, 1719 bp, Homo sapiens
cctcattctttgtacctgaggaacatagattctctgcagctttctcaaggggaaccctctccagcttccctggtgtgacccttcttccccctcctctctcctctccctttccctttggtaggtgcacctgagcacctacatttggcattgcagcctagccaaaaagggctggcagctgtctctggagggcccagtgccactcctctggggtgacctttctgctcagctggtgggtatgggtcccctatctttctagaaccagtatgtggcattcctgtcaaatggcctgcccatgaagccctggaattccagctccacctccactaccactccaagcctggccccaccagtgctgtttggcctaggaactgtggctgggaaggtgcctccaacaatgggatccagggaagccaaggagaagacagcccccctcctatttcagcctcctgcacccaaggcagtgcctgagaagcccatcatagacaagaagtagcaaactgtacattccttcttcctccccctgctccagaaggtgccggtactgaagatgctccagtaattggtgacccaaccctaggaagtagggagaaatgaaggaagggcataggaaaattttcccagtaaatcccctgatggtcacattaaggtaaaggttttggctggtcagtgtgccaagacctctccagcttctcattcatgatgacctctcaaagttgggaaacaagctgatttcttgccaagaggtctcccaggagatatttgggaaatgtgaagttcgtatctttaaggagcatttttggtcagcatggttgatgaactaatgatgagagagttaaggaatgttgctagaacatagggcttgctggtacctatgtgactaagaaagggacatgatgtaagggaaaaggcctcaaattcttgtgaatgtggacattctcgttaatattcttttgggctaatagtgacatagtgtgcagaggtgtaccagggatcatgggggatttcctagcactagtatgcttctagttttagataactccctcctttattccctggccccttgtattttccttatcttcctctttcaagacccctacccattttgcctatccgtaggctggggcttgtgtctttgtcattgtctggttcttaagagtcccagctccaggtggcgtcctccctgcctctccgtcttgtaatgagttgtagtatttactcttaacataggatcatttggaacaggagttctgaggaggagagagtgagggttttgctattgactgacttgaacgatggcttctcctcaagctgtaggctccagagcttcctaacctagtaaaatgtcaagaacagacgggagatattagtgtctttccctctatcattaaaggtgttttaaccaaatatttatgtgtttctccttatttcatgattacatagccagctggggtgtgatatgggcattccccaaaattgagattcccttcccacctacatctcctgccaaagctgaacatatggtgttgaaatatttactttattcagccttgtcctaagacaaccttcagttaatgtaacttctctgtggaaattgttccctgtggagtttgtatttccaaaaggtaggcatttgcccactgtgtccagtcattgtctagattttctctacctagaaccttccaccaccaggcttttctgtgggttttgtttggaggttgg

SEQ ID NO: 15312 - DNA, 1033 bp, Homo sapiens
agcatcctagaatgtgagacttggaaggaaatttaacagctgcctgggccaatgccctcattttagagatgaaaatgctgaagctctgcgggataaatttgctcaaggtcatgtagataggtagaagcagagctgggactagaactccggacacctgagttccactcccgccttgtgtgactccctttatgtgactcaggagaacaaggaccttctttgggtggtctctgtccccaggggctctgccagctggctcagggtgtgattattcctgctaattatacaaggatgagtccacataggaataaatcacaccagggaagtgtttggccttgacacattgtttatgattttagagagaattatagaacgttctcatttatttaaaaattttatttcttaggctgcaggcaacagcaattgatagcaggggaaatggtccatggaaaagacagaaatggaaaaatttgccctttaccaaaaggacaatccaatggagaattggctctgattattctttctctgcaggactcatttcagggaatgacatcgagagcaggaatgggaaatacaaaatggtgtggggttgcctcctgcttctgctcccttggtaaatattgctaataaacacatcactctcttcctctgagtatagatgtggcctcagaatctttcttaccagcatgctccgcatagtctctaccaattgttagctcttgataatggagatataatctgtttgccctccctgccctggggaataataggagaaaagaccctgcagatggctttagaaatctggttagcaagagtcaggtcaggtcccacacagccccatcataaaaagtatcactgacctggttggaccaagactgttcttgctacaggctgctccagcggtggcaacaacaacaccatggagtgtcccttcttcctcacagttttccttcaaacgctggctttgtggagggcattgggcaaaaaaccatagtagggttcttcacacttgttcttgcccatggggccctcagca

SEQ ID NO: 15313 - DNA, 1071 bp, Homo sapiens
aacaacattaatctccttgtacatctcgatcagagctatagggtgacaaggtgcactatcaatggtcagtaattttttttttaatggagactgagtcttgctgtgttgcctagactggtctcgaactcctggcctcaagtgattttcctgccttggcctccttaaatgttggggttacaggcatgagccactgtgcccagcctgcaataatattttgataggaatctttttttctgaggggtaggtatcaataatgagcttaacatattcagcaaactgtagggtaaacagatatgctgtcatccaggctttgttgttccctttatagaacacaggcagagtagatttcgcataattttttttttaagagacaagatctctctccgttgcccagactggagtgcagtggtgtgatcatggctcactgtagccttgatctcccaggttcaagtgatcttcctgcctcaggctcctgagtagctgagactacaggtgcaactaatttttgtgggtttttttgtagagataaagttttgccatgttgcccaggctggtctcaaactcctgggctccagtgatctacacagctaccttggtgtgtcccaaagtgttgggggttataggtgtgagccagcatgcctgtcctgacagttttttttttttttaaagcactttaaatgtattatcccactgcgttctggcatccagggtttctgctgagaaaatggccagtagtctttttttttttcttttccctcagagtgattggacttcagctgatagtgttattgaggatcacttgtacattatgagttgcttctctcttgctgctgtcaagattctctgtctttcaacagtttgattataatgtgtctcagtgtgagtctctttggatttattttacttggagtttattgagattcttggatttgtagattagtgcctttcatcaaatttgggaagtttgcagccatttcttcaaataatctttttgcccctttctctaacccctctttgggaatcgtaatgcatatgttggtctacttaatggtattccacaagttccttggt

SEQ ID NO: 15314 - DNA, 1050 bp, Homo sapiens
gaccaagccatcctgagggcatggacattgtctctgaggaaattggggccacccttaagataccaagaaaagctcctgcccatggtcccactggaaatggactctgctgagcaaagccaccagttgaagagaacagaatccacacctgcattgaatacctgtttctccatgtgtatcgtctctgagattaccttcttgccctttccaacaccttagtgattcctcaatttctcccccattgggaaggccatagggcatactgaaggaactgacctctctccttttcctgtacctttaacctttagtctgtcaaggaaaacccttaggacctctgaatcaagaggactgagtttgtgggtgaaccttgaaggtgctctttctgctacaagggccctgggagatagcatggacgtgcattgagaagccagcctcagaccttagcttgaagcagcttgaggccagacctactgtagcctcagcatcttgctaggaggcatggaagtgatctatcctgccaggaggcctcagagtgatctgtcctgccaggaggtgtgagagtgatctgtcctgtgaggcatttaggggctttcaggaatttagtaaaaggtggagtatgcctttccagtatcttccatcttcctttgtatacttgtccttcctcccatttcctccctttggcccgaggtaggaggatggagggaggctgctactctaccacttcctgtgtgcctctactgtggcctcaaccctggcaattatagctactcccatcccttacctgggcatgtgtgagcccttctcactggattttatacccttgtgtctgtgtacataaatatatatacatatatatatacataaaaactttgtacaaaaggcaagcctcctccttgtggcagctgttgcccatttgtgtgtggtctttgttgtgtgtctgacaacttctcattagcccaacttatgatgtttctagggatataaaacattagtaacatcattgtgtttatttatttaaccacctttagaaagaaaaatgaaaactcacacctg

SEQ ID NO: 15315 - DNA, 1033 bp, Homo sapiens
acagggtcacacattgctgcccaggctggagtacagtggcgtgatcttggctcactgcaacctccaccttttgggttcaagtgattctcctgcctcagcctcctgagtagctgggattacaggtgtgtgccaccacacccagctaatttttatatttttggtagagggggtttcgccatgttggccaggctggtctcaaactcctgacctcaggtgatctgcctgccttgccctcccagagtgctaggattacaggtgtgagccactgcgcccggactatccttgactgttccaagccacaaagtcgaactagttcagatctatagggtgtaaaaataaacctagagtaagtgacagctggtaaggtttctttgcagttcaagaaacagaactgaaatctgtatatcctgaagtctctttcttggagtgggaaagaaatgtgtggtgctggaaagggaggaaaaatataaaacagattcttacatattaatatcctctccccagatctgacaggatggcatctgatgactttgacatagtgattgaggccatgctggaagctccctataaaaaagaagaggtaatattttccacctcactcctggaattgggttaatgagaaagagtagttgtcgatcatcactttcaactttcaacattttatgaatcctctttccctgcttatttattatgtagaataactaatcataaaaggcatagtcttagtaagctttgctggagactatggttaagagccatacttttagagacaacctcagaaaccggagtgggcacataatgtggtgttggtaatctgtgctttgctcaaaactcgaagtgacacagtagaaagtcactgtacctcagacctagcaccaatttcttttttttttcttttgagacagagtctcgctctgttgccaggctggagtgcagtggcacaatcttggctcactgcaacctccgcctcctgggttcaagccattctcatgcctcagcgtcccaagtagctaggattataggcaagcaccac

SEQ ID NO: 15316 - DNA, 1800 bp, Homo sapiens
cccaggactttgggaggctgaggcggatggatcatctgaggtcaggagtttgagaccagcctgtccaacatggtgaaaccccgtctctactaaaaatacaaaaattagccaagcatggtggcacgcacctgtagtcccagctacttgggaggctgaggcaggagaattgcttgaacctgggaggtggaggttgcaagtgagccaagatcacgccattgcactccagcctgggcaatagagcgagactccatctttttttttaaaaaaaaaaaaaaagagaactgttgatctgggccttattttacactagggctctttggccatataccataatattccagaatcttggtttgagggctgtgtctgatggtctgacttttctcacagttggaggtgcagttcatcatcacaggcaccaaccaccactcagagaaggagttctgctcctacctccaatacctggaatacttaagccagaaccgtcctccacctaatgcctatgaactctttgccaagggctatgaagactatctgcagtccccgcttcaggtgggtctggagtgcacttagaggaggaaggtgggatggaaaatgtttcttgagaatatatgcctccaaatcttactaaaactcagaaagcagtggaaagtttttgatattttagtgcattgtcctttgccagaaactggctaactttgtccttttcctcattcatcagccactgatggacaatctggaatctcagacatatgaagtgtttgaaaaggaccccatcaaatactctcagtaccagcaggtactgtgtggtgcccagggtgaggaaagcacagggccagcatgacctggggaggatgggattacaaccatgggatattctctcctccctccaggccatctataaatgtctgctagaccgagtaccagaagaggagaaggataccaatgtccagtgagtgctttcccctcaatctcagggacttgcatacctatatctgtatatgccaagtctgcttgactcttccctttctttcttagggtactgatggtgctgggagcaggacggggacccctggtgaacgcttccctgcgggcagccaagcaggccgaccggcggataaagctgtatgctgtggagaaaaacccaaatgccgtggtgacgtgagtagcaacctgcttgctgggaagttagtcctcattgccaaatttccttaacatctctccttaccttattgtctctgtttcaggctagagaactggcagtttgaagaatggggaagccaagtgaccgtagtctcatcagacatgagggaatgggtggctccagagaaagcagacatcattgtcagtgagcttctgggctcatttgctgacaatgaattgtcgcctgagtgcctggatggagcccagcacttcctaaaaggtgcccccaggttggggtgtaggtggagggtgatgatgggtgagacagcaacctgggaggagggtacagggtttaggggaaagtgggttggacctgggtcacatcatatgagtttgagagccactgcttcactgcctctgtgcccctagcaaatgaagtcatctctccaaaccttagtgttcatatttgtaaaatgaagggagtgggctgggcgcggtggctcatgcctgtaattgcagcactttgggaggccaaggcgggaggtcaggagtttgagaccagcctgggcaacatggcgaaaccccatcactactaaaaatacaaaaattagccaggcgtggcggtgcacgcctgtaatcccagctactcgggaggctgag

SEQ ID NO: 15317 - DNA, 1047 bp, Homo sapiens
aaaaaaaaaaaaagtttttcatttttgtccactactttctgaggagcagcacccttatattgtgccttctctgcccgggctcttagggaccgtttggagggagccattcacctacaggagcaggacatggagaactcaagacaggtcctgaactcctatgaggtccttggggaggagtttgacaggctggtgaaagagtacaccgtactcaagcaggcaacagagaacaagcggtgggccctccaggagttcagcaaggtctaccgttgagctctggcagggccaggagacatggcttctgcatagctgctgcctcctaatcttcctgctagtgggaccaccttcacctggggctgccttcagtacaagggagtgtggaaatgcttacgcttgaaacactgcagtcatttaggcactctcctggtttctctttattttttatgactgggcctcttctggaaaatctagcaaggagatttatataatttttatgcatagctgtgtgtcagtgtcagccctgtattgtatttgattatctcctgaataaagttatgatattatatcttaggattttagtcattttccttgggcaaagattgaaaaagaacattgaaggctatatgggtaaggagcggggaactgagtggatccaaatagaaacagatacatgatgcttatgcaaagagtaagaagtagacatgccagcttgcctacatcaagtcttagagccttcattttggaagagtacagtggattaaatttgggcttgctcttgaagaactataatctccagaggagtgctagatactcaggcaggtagggaactattttctcactatgggtatcagtgtgggagttataataaagcagctgaggctgggagcagtgactcacacctgtaattccagcactttgggaggccaaggcaagaggatcacttgagcccagctgttcgagaccagcctgggcaacgtagcaagacccctgtctctgtgaaaaaaaattttttttttttttttttagacagagtcttactttgttgccagg

SEQ ID NO: 15318 - DNA, 1025 bp, Homo sapiens
actcctgacctcaggtgatctgcccgccttggcctcccaaagtgctgggattacaggcatgagctaccacacttggtctccttaaaccatttctatgacttaagaattaaggtccgggccgggcgcggtggcttacgcctgtaataccatcactttgggaggccgaggcaggtggatcatgaggtcaggcgttcgagaccaacctggccaatatagtgaaaccccgtctctactaaaaatacaaaaaattagctgggtgtagtggcgggtgcctgtaatcccagctacttgggaggctgaggcaggagaattggttgaacctgggaggtggaggttgcagtgagctgagatcgcgccactgcactccggccgaggtgacagtgagagactccgtctcaaaaaaataaaaagaattaaggtccaaatccggaatcaaaggtaagagtgaagataatttatttaataattatgagaaccagatgccctccccccccccgcttttttttttttaaaaactctgtcacccagactggagtgcagtggtacaatcacacctcactgcagcctcgaccttctgggctcaagtgatcctctcacctcagcctctcaagtagctggcactacaggcgcatagtatgcctaactaatattttagaattttttttatagagacagagtctcactatgttgcccaagccggtcttgaactcttgggctcaagcaatcctcctgccttggcctcccaaagtgctaggattgcaggcgtaagccaccatgctcagcccagaatggggccatttttaatagattattagaagaaaacctgtcataaggcaggatttgtgggtctagatacaggataggggcactggaaggttgctttacagggattgtagcgattagggttttcctgtcagtcctctgcccctttgctcagatgctgacagtgaaaccgtgaaggcagcaaaggtgtggaaactcgcagaggtcctggtgggtgagcagcagcagtgccaggatgccaa

SEQ ID NO: 15319 - DNA, 2088 bp, Homo sapiens
gtgagttcctgctaggcaaccaaatttaagctcctcactttttgtgacacatggtgtcagatatggggtcccgcacctatatctggatgaagaggtagaaactctggacctcattaatgagttatttcttggccttcttctaaggactaggagagctccttatctgtctgagaatggggaccagctctgagtggggttgctgcctgtattccctgtttctcaggaacttacatgggtctggggaggctaggtaggtgattgtacgtggttgctcttctccttggctgggggaggtaatgagcagatctctgtgggtgtggagcttgttggggggatgtctaggaagcttcagcttagccacattcccaagtttaggtgcactgagccatatagcccagtgtatgcatgtgtgggtgtgttcatgcacacacacactctctctcttgtctctctgtctctctctcactctttcttactctcttctcaggtcacttgtacacttggtttcctagtagaagctcacttgccacctctcagaggggtcccggattgcatccatcacaatcccaaaactagagttggggggaactggagggagcaaaacactgatttgatactagtcagtttgcttgaaactagttcacctaaagctagatctcttaaaaccaatttactgaaaacttgtttgcttaaagttaatgacttaatgactaatttgccaaaagctcaattcctattttggtgtgtttatatccatttaggtgtcctattcttttttgtcatgctttggatatttcaaggatttatatctattcatccaagagtacttctgagctattatcagcaacataaatttatcaaatttgcagcactttgtaaatgatgagattgcttcctacctttatggatgtctttttctatgttatctaccattcaaaaacttttttaaaaagtttaaagtttctagcaataaatacaattggtacagacattttgtgtatcatttttttgtttcttaatccaatattcctttacaaattaaatgccttgaaaaatataatggagttcaatgtgattttgatgctttggtctaacttctacattcctactgttaaaaaggccagtatatcttaaacaaatgaataggcatgaggcatattcagttgacttacaatgaaaagttatacagacaacagtaataactaaaagggtgaatctgctaaatccttttgaaatgctgcagatttgataaatatttattttagactaattggttttaggtgaattggttttaggcaaattaatttagtaatctttgatctttagtcttcattttctgtcactcagtgagtttcttactggaaatgatgactcctgacaacagaatttccacatttgggggctattctaaggtgactatgccagccaacctgggaaatacataaaagagatctctgagtgagagggaaagaggtcagatttatacaactgagcgccagaggggaaaatgcaccttgttggagtgagaaatgttctgaaactgaattacttcttgtacagctgagatagcttcttctgaactattattaaataagtgaatacaaaggccctatgatgggaaatccagacaagcttgtgtaactttacatccatcccctcagggatatttttttttttttttttttttttgagacagagtctcactctgtcgcccaggctggagtgcagtggcgctatctcggctcactgcaagctccgcctcccggattcacaccattctcctgcctcagcctcccaagtagctgggactacaggcgcccgccaccacacccggctaatttttgtatttttagtagagacggggtttcactgtgttagccaggctggtctcgatctcctgaccttgtgatctgcctgtctcggcctcccaaagtgctgggattacaggcatgagccactgtgcccggctctcagggtttttttttttgacagaatctcgctctcttgcccaggctgaagtgcaatggtgcaatctcagctcactgcaacctccgtctcctgggttcaagtgattctcctgcctcagcc

SEQ ID NO: 15320 - DNA, 1035 bp, Homo sapiens
tgtgcgcgccgcgcccccacccgggcccaggctccgcccgcaggaattcggagaatgcgcgggtgggggggcggggcaggctggccgcgtgcgtgccgactcctgcccgggcgctccaggtgcccgcgggcggggcggctgccgccgcgcggcggaggggtggggttcggggatcgggggacgctccctagcatacgcggagtagtggcggctgtcggggaaatggagcctgggagacaggatggagcgccctgggacccaactgctgtccctccccagtcctgttggctaggtgcgtgcgtgggcatttaatcagagacccagtagtaccagcttctattttccccatcctccggaagtcagggtaaaagtcatgactactgggacaccattacctctggatggataacgaccctgtgttattgccagaaataacttggccttgaattctgcttataacctctcagaattcaggccagaagtagcgccttacttcctgacactgttaaggaaacctggtcgctgtctccctcccctactctgttcaggaagtattgattgattatatgtctcagctatgaggaacattagggtcttgaaagatcttttagtcaaaattcacaggcactgctacacacataaaaaacttcgaatctgattgtgattggaaagaagtggcaggcttaccgcctaagggctgtgggcctctttcacttttctaagcatctcttcttaccactcatgccccactcctggaccccatgctgtagaactctatggctagaaaagtgaataggaagaggaacgcggccagggagggatggttgggtaggaggttcagaggtagcagggcggcaggctataagggcataactcaacccccagcctccacccccattcttttccccacctccaaatccaccgagaggaaagcccagaggagatgatgccaaaccgctttgatcaaggaagactgaatgacagggcccatttagcagtttcattttgaggcccaggagaggtggctagtaaaga

SEQ ID NO: 15321 - DNA, 1025 bp, Homo sapiens
gtaaaagcctcttgcaagaaagagtaagtgcgtgaggcaagagagtttggtaccagaaaggagttagacaactcagccagtgtcccagccggatgcatcttaattactgattttacaaatactgaacccagctggcaagcatttgaatactattatttattatcaccaaaacattcttttgcccacagcatctatgtttaagagcaaactccctgcatgatgtaggttaaataaagaattaaaaagaaaaagctctgcaggagcagtgtaggcccttatttaggaaggaaaagaatacataagtgattcatctataaattgacatagaagtgcttagtgctttcctttaacctttagttttaatttggtttaacctttagtttcaggtttagctgtgcctcccagtgactataatgacaaggaagctgtaaatgtatttgagttaagcttttgcgagaagtaagtatctggcacagaaaaagccatttcttcgatataaagggtggaaagagcaaattaaagactattctttaataaccacatgtaattaaaatgcattgtcagatttatgttttagtacctcagaggcattgatattgcctctttctgaaatgagattgcctattcaaaaagaaaaaagaaaaccctcaatatatagaaaattctcttaacctcctactcttttttttttttttttttttttgaggtggagtctcgccctgttgccaggctggagtgcagtggcaccatctcggctcactgcaacctttgcctcccgggttcaagtgattctcctgcctcaacctcccgagtagctggggttacagatgcccgccactacgcccggttaatttttgtatttttagtagagacagggtttcaccatgttagtcaggctggtctcaaactcctgacctcaggtgatcggcccacctcagccttccacagtgctgggattacaagcgtgagccaccatgcccggctcctcctctccttttaattgtgatgttttaatttacagggta

SEQ ID NO: 15322 - DNA, 1100 bp, Homo sapiens
gctgggattacaggcacgcgccagcatgcgcggctacttttttttgttttgttttttgtatctttagtagagacagggtttcaccatgttggccaggctggtctcgaactgacctcaggtgacccgcccacctcagcctcccaaagtgctgggattataggcgtaagccacgtgcctggcccagctcaccttctttaatgggggtatatgcagctaatgaaattaatgttttgttttgagtcatttatccagcacttaagtagttacctggttagtaaatataatgtgaaatactcgtttattacctgctgatcccaatatctttccatatcttagagtttaggtgagagactatagcaagaggctgggaaatgaagtcagcaatagtgtccatggaaaccaaaaaagaattctttgaatgcccattgtgctagaccacactgtacctagtttttataggcaaattaattcaggaaaacacctatttgttgccctgaatgtgatgttttaaaatggacatagtatggtaacatacaaagtagaaaaacagaagagcaattgaggaacaaattgaactcacaataggaaaatacatttagcattaaaaactagcataaaatattatccttagtctgagaccaggtcatgatagcaagtaaattacaaatactaaattacctttctaatttgcgtcatagaaggttttgtatctataaatgcatcctcatagacttgaggaatgtgttgtttgttagaaattcaatattaaatttgggggcaaatttccccaaattctatttcaagccattgcattttattcaaaattagggaatcaggaatcaaggtggtggctcgcacctgtgatcccagctactcaggaggctgaggcaggaggatggcttgaggccaggagttgaagaccaacctgggcaacatagcaagaccccgcctcttaaaaaaaaaaagattaaggaatcagggtgggtgtccaggttgggaacacaaaatgttacaggaataaccataatatcatccagccgttactagtggagcactgaccatgtgccagcactctataggtgccttacatatattatgta

SEQ ID NO: 15323 - DNA, 1011 bp, Homo sapiens
ggggaggacaaagaagtggctgtgaaagcagtagtaaccacaagcttggtgacccttgtccttttggtcctccagtgcatatgtgtggaggggagagggtagtgatggtgattttatagcctcctggtcaggaagcagcactaaattgtcactggaatgtgtgggtggggaagaggccctgctgagagcagagagatggctgatttatcacacccagcactgttggggctggggggagttcccaagctatggtggcagcagatggcaaggccttctgttaaagagaagacaggggatagaggaggttgatgggagaaacctttaaaaaatgggagcggaggacacaaacaataccaccttgtatttagtcagaaggcagaaagtggttggtgaaggtgacaacccagtgtcatgttttgagactgagaggtttggagaagtcattcacagaagaagagggggtaaaccctcctctcctgtactgcagctaccttcccttccccctcagccttgtgcagtcttcgtattgattgatgagggctgtcggccaggaactgatcgaggcttgttaattgcatttgtcaaatgcagggaaattgggaattagtgaaatcggagaagggggtttggaaaacaaatgactcgtgcctaaggaaattttttgcaggaaagtatctcaggagcccctgcagtcagggagctgctggtgtggactcagactacatggttgaaataggcaggagctgggcggggcacagtggctcaggcttgtaatcccagcaccagcactttgggagacggaggcaggcagatcacttgatgccaggagtttgagaccagtctggccaacatggtgaaacctgtctctactaaaaatacgaaaaattagctgggtgtggtggcaggcacctgtaatcccagctacttgggaggctgaggcagaggttgcagtgagccgagatggtgccattgcactccagcctgggcaacaaaagcaaaactccatctaaa

SEQ ID NO: 15324 - DNA, 1077 bp, Homo sapiens
gtgtgcatagattttggtatatgcaggggtcttgggacaaatccccttcatataccaaaggatgactagttaacccaaggctgaataagataaataacctttttttttttttattgagacggagtctcgctctgtcgcccaggctggagtgcagtggtgccatctctgctcactgcaagctccgcctcccggattcacgccattctcctgcctcagcctcccgagtagctgggactacaggtgcccgccaccacgcccggctaattttttgtatttttagtagagacggggtttcactgtgttagccaggatggtctcaatctcctgacctcatgatccacccgcctcggcctcccaaagtgctgggattgcaggcgtgagccacagctcctggcctgataaataccgtttttaaaagaaccagttggctgggcatggtggctcatgcctgtaatctcagcactttgggaggccgagatgggtggatcaccggagatcaggagttcgagaccagcctgaccaacatggtggaaccttgtctctactaaaaatacaaaattattgggaggccgaggcgggcggatcacgaggccaggagatcgagaccatcctggctaacacggtgaaaccccatctctactaaaaatacaaaaaattagctgggcgtggtggtggtcgcctgtagtcccagctacttgggaggctgaggcaggagaatggcgtgaacccaggaggtggagcttgcagtgagctgagatcgtgccactgcactccagactgggcaacagagcaagactccatctcaaaaaaaaaaaatacaaaattagccggctgtggtggcacatgcctgtaatcccagctactcagggagatgaggcaggagaatctcttgaaccctggaggtgcatgcctgtaatcccagctactcaggaggctgaggcaggagaatcaatcacttgaacctgggaggcagaggttgcagtaagctgagattgtgccattgcactccagcttgggaaacaagaaagaaactttgtctcaaaaatcagtcagtcaatcaataaataaaaagaacca

SEQ ID NO: 15325 - DNA, 1118 bp, Homo sapiens
ctcagcctgccaaagtgttgagattacaggagtgagccattgcgcctagtcctgggctcatttcttttatttctttgctggttataatcacccttacaatcatgctaggtccggttctatcatctctgaaaataagttccttagcctgtttttcctttccagcatttaagaaacttgccagacagttcaactttgtatttaatgtcatttcctcatcagccagttttgaattgcccgtttagtaaagttggagtatagctagtcaccttctaattttcccttccatatgcttaaaaataattattctttcctccttttgattttgcttcattcatttacctgcttactaaatacctagttatcttatagaacaattatagggtacctaccactttttcacttgctttcaaacgagaatagaaagggctgtagggagtatccacttactacccaatggaggatgaaaggaaattaaaaaccggatgtgagagaggagctcactttgttactttggaaattgagatgcttttctctgaaaggtgggaaaagacagttccatacattttacgtgatccagggaagcattttggaaatgttgctttgaacctttagctggcggatttgttctaggtgatggaaacagtgtaaaagagtacagggaccgggtaacaaggaaaatccagggagactgagcatcatttaaacagtgccttcttcaagaggccttcctgatgaccctgtcccattcattgtgagtcagccccttgcctcatattacagttggcccttgagcaacatgggtttgaatcactcaggtccacttatacgcaggtatttttcaacctaattctgattgaaaatacacattcccagaatttgaaacccaaatatacagaggaccaatttatttatttatttatttatttatttttgagatggagttttcctcttgtcacccatgctggagtgcaatggcgcgatctcagttcattgcaacctccacctcctgggttcaagtgatctcctgcctcagcctcccgagtagctgggattacagacacccgccaccctgccagctaacttttgtatttttagtagagacagggtttcaccatgtt

SEQ ID NO: 15326 - DNA, 1017 bp, Homo sapiens
ctagattacaaaagtataatagatgtttataacttaaatatcaatctgtagtgtgaaaattaaaggaagaccagatcccatcatgatcttagttctgcctagatgttagtatcacatagtgttcttgtttcttctgcatttacatgtccttctcagtttttcttccacactacttgatattactgtctaccattaaaagtttaaacggctcatcaaactagctacccctcccttactgcttttagatcagtgttcagtctgaagccatggtttccccagttcccaaatatgatttcttttctttttttttttttgagacggagtcttgctctgtcaccaggctggagtgcagtcagtggcaccatcttggctcactgcagcctccgcctcccgggttcaagcaattctgcttcagcaccctgagtagctgggattacaggcatgcaccacaacgcctggctaatttttgtatttttagtagagatggggtttcaccatgttggtcaggctagtctcaaactcctgacctcgtgatccacccgccttggcctcccaaagtgctgggattacaggtgtgagccaccacactcagcctccaaatatgatttctttaagttaaccttttaccaaaactccagccagaggtaacctgtaggtattacggtttgaactagcagaggtcctgagaccatctaactgttgggtctatttcttggggacagcagctaccaagggggtgccagctggaaacagtgacacagaggggggccagcctggtcggaaacgacgctggggagccagcacagccaccacacagaagaaaccttccatcagtatcaccactgaatcactaaaggtgaggtgggaggagccagggaagggaggatgagacctgttaaggtgggagtagacatgggcccagtgtaacggggtggggggtatctgtgtcccagagcctcatccccgacatcaaacccctggcggggcaggaggctgttgtggatcttcatgctgatg

SEQ ID NO: 15327 - DNA, 1091 bp, Homo sapiens
tgagtattttaagtaattttacatgcatgatcagatttagaaggggcacttggcgaaagtgcagaagataatagggattttagtactggttctattactgatattatgacatagccaggtcactgattctgtgtgcctgcattttatatctgtacatttagtaacagtaaccatggctacctttatgggtcttctgaagatgaatgagaacagtgttagtaaagggttttcaggtccctggaaaaggaatacagtttaattgtgtgtatttaagtcattgcgtttaatttagaggttgtggtagaggtgggggtttgtttttcttttttttcctcatcatttctgacttttacccttctctataccaggctctaatgctagaaaatttacagaaacactcaacaccccatgctgcattccagccaaattcccaggtgagaaagaaggtgtattcaatggagtgggccctttggatatccagacacatggaaggacgtggtgttgtatatttgatgcttaagtcctcatgactgttttcctaagttctcttagtcagaaatgttctcaaaccaggacagttgaattctaatcaacccagttgtatacaagggcctggagtaaagaacagaatcagaggcactgttagtttataataattgaaatggcatgtgtagaaaggtgtggcttccattaattacgtgtagtacagagatctgaagtcatttatctgccatgaatttaggaaaggtagttgatgtctttgagtatagatatgaagtagatcaccaatatggcagtgtagggaaatagttgctgattaagaactcttgttgatgtagattttccaagggttcaatcctgtgtaagtcacccaccattactagtgttaactactaactcagtgcacttactcataaacattactaatacctctttacttaggataagaaacaacctttggaggccttggtcttctccatttccttatctgtaatatgagaaacagactaaacccatgggtttataactgttctcttagggttttgtggagctgctttggggagcttcctaggggaaatacctttttccca

SEQ ID NO: 15328 - DNA, 1023 bp, Homo sapiens
aaccccatctctactaaaaatacaaaaattagctggatgtggtggcgtgcgcctgtagtcccagctactcaggaggctgaggcagaataatcccttgaaccagggaggcggaggttgcagtgagccgagatcgcgccactgcactccagcctggcgacagagtgagactccataaaaaaaaaaaaaaaaaaaaggaggaaggaaggaaggaaggagagaaagaaaggagagaaagaaagaaagaaagaaagggaaagaaagaaagaatacggctttggggtttcatcccacagtcatttattcctttatctataaaatattgattcagcatcccctatatctaggcaatctcacagtcccctaataacatttggcccactctggggaaggtttcccaagtcctgaacacaaagatttaccaagtcctgaggtaactgaacaacaaaatcaccaagtcaggatgctttgcctcactgggcctggctccttctctctaccagctggaaggatccctggagcaagagaagaaggtgcgcatggacctggagcgagcgaagcggaagctggagggcgacctgaagctgacccaggagagcatcatggacctggagaatgacaagcagcagctggatgagcggctgaaaaagtactgtgtcccctccctgctgcccttcctcctccccagcccataacagtacaagcagacccaagacagccatcctctgaggcaacaacctcacgcagcctccacaagtggaggcgcaaaccatgggaaaaggcctcccaggcaagggctttcctcccctagtcccagatatcagggttagttagatggtcctccctggcaaaaagtccattgtatcccatgagtcctttcttcttgttaggcactcagtgggaatgaaaataacagccttcccccttcatacacatctctctttggagaccagttccttgacatggaggaaggctccacatgagagcctcttaggaaagtccctttgtggcttttcacagagagcc

SEQ ID NO: 15329 - DNA, 1024 bp, Homo sapiens
aggagatgaacgagaggctggaggatgaggaggagatgaatgctgagctcactgccaagaagcgcaagctggaagatgagtgctcagagctcaaaagggacatcgatgatctggagctgacactggccaaagtggagaaggagaaacacgcaacagagaacaaggtaagggcagctccctttggctccagcccgggtctcatcaggactctcagaccatactgaccttgacccaggctagccactcggcatccagagagcagcatggaccttgacatggagctccccacagatggcaccaagctggtgacctttgaccctaaaggagatgggattcttggtcggcaggtgaaaaacctgacagaggagatggctgggctggatgagatcattgccaagctgaccaaggagaagaaagctctgcaagaggcccaccaacaggctctggatgaccttcaggccgaggaggacaaggtcaacaccctgactaaggccaaagtcaagctggagcagcaagtggatgatgtgagtagattgagagttgtggggcctagatatgccatgtctatctgtgcccagagctctgtgtgtgtgtgtgtgtgtgtgtgtgtgtgtgtgtgtgtgtgtgtgtgtgtttgtgtttatgtttagaggggggtagggttagaggatgttaacttttctgatatctttctagaaaggagctggggaatgaaaagtcagaggtggtgatcaattctgaattatgtatctaatctcactggtatgatcaataatagagatgagttttcttatttaatttaagtgcaatcccatatatctctgcctttgacacaagatttagagggtcatctcataagaacatgataaatttctttggaaattttgtgaggctccccaagtagaatttttgaaattccaatatttaaggcagaatctgatcattgttccctctgatgcacatatgtctgttgactcacttatcactctgtattttaattatttaagcttctatctcagccata

SEQ ID NO: 15330 - DNA, 1006 bp, Homo sapiens
cacttctccctgatccactatgccggcatcgtggactacaacatcattggctggctgcagaagaacaaggatcctctcaatgagactgtcgtgggcttgtatcagaagtcttccctcaagctgctcagcaccctgtttgccaactatgctggggctgatgcgcgtaagtagggactgaggctcccggtacagaggagcagggattctgccaaggttctgagccaggtcaattgctacaccccaccacttcaatgtcaggttgtaccccaaggtttacagactcagtgggatggaactgggtgaagaaactgaggcagccacattgaaggccctcacccaggggccaaatgccagcaaggatgtaaagaggggctgtgattctttactcacaccctacctccccacactgatgcttcttttgttgactctccttcctgcagctattgagaagggcaaaggcaaggccaagaaaggctcgtcctttcagactgtgtcagctctgcacagggtgagtgggacacagccccagccaacttggctccccatctgcccaaccccacccagccccacccttccctgccttgttcatcccctactcctcccgttccctgtctccttggtgcattcgggaccattttcactctgtcttctcttcccgtcatctcctggcctcttcacttatttacttcccatctcccttctctcctctttcccttctgtctcccaccctctctccttatccctgtctgcccccagggccccttcatctctgtgacttctcgaattctctccatctctcttttccttccttcttctcctctcttcttcctgcatctctttctggcattttctttacttttctctattgcatttttggccacaggaaaatctgaacaagctgatgaccaacttgcgctccacccatccccactttgtacgttgtatcatccctaatgagacaaagtctccaggtgaggccacaaactcaggccaacccactgctggg

SEQ ID NO: 15331 - DNA, 1001 bp, Homo sapiens
aaccaagcaagccttttattccaggcataatagcacccatctgcttaattctttgtatttgtttcttaaccactctcagggcttatagaccagaccactgattctccaaatctccaccactgtgatctgttttaagacagtcattcatccctggaaagatatgtaaatctgaaatatagagctccatatatataactacaccagtgaaacaaacaaacacaccctcagaaacagcagcagaccccagcagagggggctgcagggaaacacaccagtgccagcaaggatggggccccatgggcatatgtataagtacaagggacatatcccaagacccatgacctatactcccataagcagaaataccctccaacacacgctaatttttctcacacaaaagtaggtagaaaaagcttataaacagagaaagtgagaggaaaaagtaaccggtaagaggaagagtgaccaaatgttgaatattaacatatggggagaggatctgctaaggagtgtgtaacaactcacctgccaaatcaactagccctgaaaatggatgggcattgggcccataccaagctgttgctggcagtcaagaggggacagggggatggcagcagtgggggcacgcacatggttgaggggtccactcccctcctcgcagtcacaaaaaacaaacaaacaaacacacacacacccgatggggagaggaccgtaaattattctggacatcagggaagagatatgtaggaggcaaattaggaggaaacttttgggaaaactcatatgatgtcaccatgaaaaacagggtaaacttctgcgaatggccaggtattgggggacaatttctctcagaagcaaccagtcagaaacttataagccatgaaagcgtcatttctaggagactgagttgggaagaaatgcctttatactgagaaagctcttgctacagcaagtctgtagacccagcctcagggtctacaggattatagctcagatacatt

SEQ ID NO: 15332 - DNA, 1184 bp, Homo sapiens
ctccatgatgtcagaggcagctggtgttaccttgagacccatacaggaatcacttgctgctttgccggggtgctgtatcacctacgggccagggcctgggtcgaattggtaggatttctgactctggtagcttgaccttgcctccctggagctcttcccagctcagaacaacagttgtcacaaataactcctgtttgtgagcacctgaggtttgctagagcctgacagtagcaagaggaaggaacctaagacagggcattgaggtcaggatggttggatcaaaaggcaggcagagacggaagaggaggactagaaatggcagttacagaatgtgaaaggagaagggctttgtgagtggggaggagagttgttgaaagtgtaatggctttgggtttaggaatggagactaaagctagaatgcagagggaagggatcggggctgtgtgagtgtaaactcattcagggattgagaaaagggaagggttgtgaaatgccagagggcacagtggaatttggctgtacagaaaggggggaaatgggacagagtcccctagtctgagagacttagctgtctggtgagagactcagggttagtcacatggtcatctgaggagtggctacatctgtctagtttccaattgttttccagcacctagcacagtgtctgtcacacagaaaaggcttaataaatatctactgatcaaacgttgaattagtagggagaggctgggggaaagagttgcccacctaattttcacccactccccccacctaagtctacattaatgggcaaactgggaaatcagaaaccggagggaatggctggagggtagttaaccagtgacagtgagatctgaggcagacaggagagactgggttagggtcacacttggaggcagccaggggaactctcagggctcatgtgcagagtctttgtagtgataattggaggaaaacatgaatgaacagccctaggagcccaagaggaagatgtggaggagggaagagaaaggaggcggtttccagaaaaggttgagagttgtttccaaagagagagttggcaaatgtgaattaaaagtagcatccccaccccattcccaatcatgaaactacaattgaattggtcataaccgtatatatacaatggccgcaaataaggagttcataaatcaataccagaccca

SEQ ID NO: 15333 - DNA, 1068 bp, Homo sapiens
cacacctcagcctctctcctccagcaaggagaaatggcgaagaggcacccaggcaccaagataaacgaaggatgcctcagcgtcagctcatttcagttattaccctgttccgcaatcaagattaaagccctagaccaggccaaagctcattagcttagtaatgaagcacatgcagagatgtacacatagaaaccaagagctatagaaagaagaggagggaagctatagccatggggtgggattcacatagaattctcgcctctacatggtgaggtgagaatggaactgcctgttgccagtgtcttgttgttagtgcctggcagcatgctgggcacatagcaaggaactcagtgtatgtttgctgagggggctcaaacagcactgcagggctgtaaggccccatgggatgcacaattcctagtgtggatgaactgtctacaagggaattatgcttaggaacaaatctgccaaatcatgccccactgtctcacataactataatgttattgtcctttacaaaaagccaaaaggacaaattaaaaggatctaggtaattgtaaaacaaaaggacaagactggttggactctcagtgtagtgggcagtgcatcagtctcatgatctgaagatcctgggtctgagcctcccagagggcagcttttgtaaaaaggcttactttttactccttgtggaggagtggtgactgaagaagaagaaaaaaaagagattgggggaaggaagagtcaaagcagggaactgagaaatgaaactgaaggagatctggctataggtatgagaactaaatgaggcaggttggctggaattagacacgtggaaggactagatccaaattagctactgttaaagagaaaacgagatttcacagaactgtaagcaaacttagaaaattgctaaaacaattcccattacaaaaataatccaggccaggcacagaggctcacacctgtaatcccagcactttggaaggccgaggcaggcaaattgcttgagtccaggagttccagaccagcctgggcaacacggcaaaaccttgtctctattaaaaaaaa

SEQ ID NO: 15334 - DNA, 1033 bp, Homo sapiens
gtgagagatcactcttcttaaggtcccaggctccattccttatctttcttcctcttcagggcaaaactcaaaattcccaacactttatcatacaaagcaattttaggttcagccttcacactagtccaggctctgagccttctgccttgctctcccttggataacttgcttttggagaagtcagatgccatgccatgagggctcctaagctatgctgtgtagaagttcaagtggcaaggaactgaggcttcctgctcacaacagcatcaacttttcagcctcttggaagcggattctgcagccctgatcaagtcaacatcctaactgcaacctcatgatagactgtaaaccagaactactcaggtaagcctctcccaaattcctgataatacatgtttattgtttcttaggccccgaaatttggggtgatttgttatgcagcaatatgtaactaatacacataccttaaaattgctgattgctaactctattatttgggctatcttgaactttcttcttattgtctgtgggtcacatattcattttgcctgataataacattgctgtgtcagcttttctatgcttagcatttccaagatacatcttttgctttcaacctatctgtacctttatactgtctttcataaacagtgtatagttgggtcttgcttttttatccatctgaccatttctgttttttaaatgaagtgtgtaattcatgtacacttaatgtaatgtaaacataatttgtttcaagtctactttcttgctatttgatttttatttgtcatctctgttctttcctctgttcctgtctcctcttgggtcagtcgagtattttttttaaccaaaaattactttatcaataaattatatcacatttttccatgtaatgagaaattttaaaactcatttatgaaaaatattaatgaatataactatatagcatttttggtatttttctaaagaactagaccagggaaatgtattactccttttgtagtaatatacactaaacaataaacaaagttgt

SEQ ID NO: 15335 - DNA, 1025 bp, Homo sapiens
gtatgtatacagtttcaatttggatggttatgccaaattaccttccaaaaagaccacctttggtttccactctcaccagcaatatctgagcacctgtctcccacagcactcaagcatcaagcagtcgtgcatcaagcatccagcaggcccgatccccgcaggccacctacagggaaaggccacagctgcgcccacacctatgagacctgggaggcccagctcaaatggatgggttttgcccacagttggctcctcactcctctgatcttccctctacacagccctgggcccctggccttgaaaattgctgggcgaattgcagaattcttccctgatgcagtacttattatggtgaggcttgggtttctgggtggggaggtgaaaagcaagtagggtggggggacccttgaaactctcacttgcccatctttgtccactcagttggataatcagaaactggtgcctcagcctcgtgtgcccccggtcatcgtcctggagaaccaaggtctccgctgggtccctaaggataagaacttgtgagtaccccactccctctacctcttcttagaagcccaaggctcctgggtctcctctgtccttggccctgccccaagggtctttctctagacccaatctctgttaagtctgtgtctggacccactacttgctgtttgacctccatgggggttactatttcagagtgatgtggagggactgggaagagtcacggcagatggtgggagctctactggaagatcgggcccaccagcaccttgtggactttgactgccaccttgatgacatccggcaggactggaccaaccagcggctcaacactcaaatcacccagtgggttggtcccactaatggaaatggaaatgcctgagccagggccagcggggcccggttccaataaagagacttgggctgatgggcagtggtataactatatttattgtgcctgagaggcaaggtgagggaaaaatctcaacagaagcaagtttggggaaaatctggagtcccca

SEQ ID NO: 15336 - DNA, 1045 bp, Homo sapiens
ttctatcagttacctagctggtagccttaagtaagtcacttagacattctgtgactcagttttttcatctgttaaatgggtacaataaatacatatctctgaaggttgctgtgatgattacatgaaataaatacatggcacagtacctggtatgtaataagtacccaattaaatataactttttttaggaagtgacagtaataggaagaactcagtatgtttgttgaatgattcttacatgatacctcttaacacaggtgattacatggatccaacacctgatccccaagattgaagatggaaatgattttggggtagcaatccaggtaagaaaagggtaactgaagatacttagagtggggagagcctcagggggtgagctagacatgaaccaggaggaggaggaagatagtgtatgaaatggggaggacatgaagtgttgtctttgcctcccgtgtcaccacaggagaaggtgctggagagggtgaatgccgtcaagaccaaagtggaagctttccagacaaccatttccaagtgagggcagctggaggaccagcattgggggcagtaggagcatttctttgggacccccagagctgggcagccctatcaggatgatgggagactttgggaagggtctgagggagtacatctccctgaacactcattcctgtggtattcccttgcttctggcaggtacttctcagaacgtggggatgctgtggccaaggcctccaaggagactcatgtagtgagtggatagtccaccagccttttagctgggtgtgggacgaggaggtgtggaggaagaagtcctccttgtcttgtttgtgactttcccaatgtggagaatattaagctaaaagcattacctagaaaaactggtttgggcttcaacaaccttgacccttttctctgctcagtcctttgggatcctatttcttggtgctaagaaggggttcattctcaagttaacctatttcctataaaaggaaaccagactcatgtcccagcctcccatgggactgactcagctttgcctccc

SEQ ID NO: 15337 - DNA, 1046 bp, Homo sapiens
accttggcaacccgcggggcgtgcagcaacgccctttcctccggaagtgggtgtcagaacctccacgtgctgtccctccccctccccttttcggcccagtagcggcggctcagttgctgccatggagtcagccgggctagagcagctcctacgggagctgctgctaccggacaccgagcgcatccgtcgggtacggagcaggcgtaaccgggccagggcgagcgggaggttgcgggaaaggcccaactctcacccctagcttccccccaggccacggaacagctccagatcgttcttcgggcccccgccgctttgccggctctctgcgacctgctagcctcggcggccgacccccaggtgagacccctgactctcccctccgagcttcccactgtacgccaccggtcaagccccagtattcgcccactgcggtccgctcagcaccttcctgcccggacccccacgtgcttgcttcctcgtcctagatccgccagtttgcggccgtgctgacccgcagacgactgaacacccgctggcgacggctggcggcggagcaacgggagaggtgggctgggcctggggtggggcggggccaggcggagacttttcttgggcaggctgggtaccaaacacctgccacctgtgttccagcctcaagtccctgatcctgacggccctgcagagagaaacagagtaagtacctacccacttctctcgggatcttgacgactttgtctaggtttctgccttccttttcggctccaggctgggacttgtggggcagggacttcagttctagacgcaaggtggagtgaggattttaaggctgttttgaagactaaagttcttgaggaagggtgatgatgatctgccaaacccaagtcagaagaataagactgaaattcaggctaagttagactgaacttaccagattacatgcccacagtgctgttgggctccctctgagctgctgtctcatgtgtcccaacttggcaaagaccctgtgcccacacctcctgaaagtttctgtcctggctgccccattg

SEQ ID NO: 15338 - DNA, 1007 bp, Homo sapiens
ttcgctcttgttgcccaggctggagtgcaatggcacaatctcggctcaccgcaacctccacctcccgggttcaagccattctcccgcctcagcctcccgagtagctgggattacaggcatgcaccaccacgcctggctaattttgtattttttagtagagacggggtttctccatgttggtcaggctggtctcgaactcccaacctcaggtgatctgcctgcctcagcctcccaaagtgctgggattatagccgtgagccaccgcgcccagtggagctgttttaaagaaggcttaactgactgctcaagcttcagttagatattccttcttcctgggtgctcccacaggcccaatactttgtctgtcacagcacctaacatagtgtctgtaattgcttctgttgcttgcatctcccactaagctatatagggaggtcaaatgatgagaagacagatgaagtgtggagaatagaaaagagctggtttagaaaatgagcagcattgagggcccaactgaggttggagaacaacttgtccatagacacatatagtgttgtgattcttttagcatcttggttataggtacttgaatgttgatggatgatttagggttttgcttggcagctgcaatgaaacaatgggagaggggcatcaagaacatacgcaagaatgtggctgaaatggaatgcggaatctaagctgcatggataaggaagattatcggggaacctgccccgatagtcacgtaggttcttttctattttccctaagcgtcggccggtttgagaaataaaaggacagagtacaaaagagagaaattttaaagctgggcatccgggggagacatcacatgtcggtagattctgtaatgccccacaagccgcaaaaccagcaagtttttattagggactttcaaaaggggagggagtgtacgaatagggtgtgggtcacaaagatcacgtacttcacaaggtaatagaatatcaaaggcaaagggaggcagggcg

SEQ ID NO: 15339 - DNA, 1038 bp, Homo sapiens
caacctccacctcccaggctcaagggatcctcccaactcagcctcccaagtagctgggactacaggtacatgccaccacacctggctgattttctgtatttttagtagaggtggggtttcaccatgttgcccaggctggtcttgaactcctgagctcaagtgatccacctgccttggcctcccgaagtgctgggattacaggcgtgagccaccatgcccagccgaatgattcattttcaactgctgtctctgtgtagctgacttcttccatatttttctataagattttacaattaaattcttcctgatttaaatcttgttaccttgtctctatggttctaaaattaaatgcatcatcttctgtcataagccatatcccaatacccatctcgtgtattaatcccatcaatcattcaggtgtctggaatacaattctttagagtcatttaaaattacgtggtccttttataagatctaatttttcacttaaaagctctttctgtttgatttttgtttccatctccattaccctcattctggtctcgggtcttactcatttatatgtttatgtctctgtaatacatccaaccaggttttcctaccgtcatatcccctctaaagtgtagtctaaaccaagacatgacgtacaaaaccataatgtgcaggtcttcctttagcttctttttcattatattactccctaaccccagatccttcattgatttcctcattgcagattactttggcaactgtctttactgtgtgaatcagttttctcattcatgttttttaacatacagtaaaatgcacagttcttaagggtttagttcagtgagtttttgacaatagcatacgttcatgtaattacaaaatctaaacatttgtattcctaccccctcaagagtttcataggttagttttgcttgttttagaactttatataaatggaattattgaatgtacaatttttgtatctggcttctttcattctgcataatgtctactgtaatctgtggtttattccttcttattactgaa

SEQ ID NO: 15340 - DNA, 1038 bp, Homo sapiens; identical to SEQ ID NO: 15339

SEQ ID NO: 15341 - DNA, 1038 bp, Homo sapiens; identical to SEQ ID NO: 15339

SEQ ID NO: 15342 - DNA, 1038 bp, Homo sapiens; identical to SEQ ID NO: 15339

SEQ ID NO: 15343 - DNA, 1116 bp, Homo sapiens
agcaaccctgagcctttccggaacccagtgggggggggggggggggtggagccagacagtgacccggaagtagaagtggcccttgcaggcaagagtgctggagggcggcagcggcgaccggagcggtaggagcagcaatttatccgtgtgcagccccaaactggaaagaagatgctaattaaagtgaaggtgggagcacctccagccttgccaagacgcagtagtactgggctggcagcagtgccttacgggagacgtggggaaggaaaaccacgcctttccctagcctggaggacgctgactgcctcagggctccgcgcgaggggtggtgggaaatagggggacccagaagggctttgagagcggggcccaggtcccacctgacgaccctggggtattttgccatgcctgcttttttgccaggactgtgctatcacccagaatggggtcgcttttgtcgggtctcactgtattcgaacccccgcagtcatagagaaggcctagcagcggcttgactcccccgtctctcagattcttggagtaagcgctgctctccattcttcattcccagggtacctgcttctcccagtccctaacgtaggtcgcctccgagcacagccctaaaatcggggcctcccaagggctagactatgagcctttactggtggttgccaaggtgtggtatctcacccgtcctacaggaaccaaagcggggagtgtgttcagtcagtacctgcctttctgagcctggcatcctggaccagcctcacttccttggctgaggcaggttagttaccgctgccctagttcttgctactagccatggtttccttcatctgcatctctcaactcccgtggtggttcttcaccaatttccagccctcgttagtcctatctgctgtttcctcttttgtgccttcagacagacagagacccccccccccacgcccccctcaaaaaaacaaaactgctgacaagtgaagtctaatgctagtttggcctttttgtagctaagtaaatctatcgttatttcatcagcttcttagcatatttaccgtacataatagtcattcttaaccttctcttccccagtccttccaaactacttcttagcta

SEQ ID NO: 15344 - DNA, 1032 bp, Homo sapiens
ggtatggaaaagtgcttatatttttatcaaaaaattgatttgtccaggtaaaggtctgtgtcaatgataatgtgaacaagtagtacatttaaaatgtttgtcttgtctttttacagtcatgcctattttagagacaccttcataatgtccttgggagagggcctttagtttcttggtatctggattttggaggttttgatgttgtttttgctatctatttatttaatgtaatttaatatgtgagtttcttgacaaattgcatttcatggcaattgcaccttgcctggtctgatataaaacaccacaatcacaaacctttacattgcagtcagtttcaatacagttggtcacacacctcgtgattttctattactcaagataataaggggcttagggtctagaagttctgtttcctagagggttaaaatgctaaacataaaaaaagctgtgctttttttgtgaaactaggagacaagctgcacatctcagacacattgtaagcctaccactgcagcgcattgatttttaagctgcctgaatcttcaggacccctatctattccatcctatccattttgctgattgagtcgatatgtattgcagcctcttacataggagcataagatgacttttggattgttaatactgatttaaatagctgaagttctcctaataaagcattcccaaggagagagaaagtttgtctactgggggtaaaaatatcagatggtgcacattaaaagggagatgagatttgtcggagacagatttcagaatccttttagatgatccaattcaagaaaaccctctataaaatttaataaactgtataagttaactataatattttatactttctttttggtgtcttaaaaatttaaagaagcgaggaacatgccatttggtgagtaccgttggaagctattttaatttctaggaaaagccccaaatatcactccaaatagattttgtttgcagatctcagttcagaatgcacacacacacacacacacacacacacacacacacagag

SEQ ID NO: 15345 - DNA, 1028 bp, Homo sapiens
ttatgaattttaaaagctactcctatcactcaggaaatgccacaggttttaggagatctatgccagggactgtatagtcagaatgccctgtatgtatgaattcttgtgagtcttatgcattagatggtgagctattttaaggcaaggaccttaagtctccttgcattctactcagcacattaatcactcagtaagtccttgttgagaaggatctaatcatcaaaggcagaggcaaaaagacagacattcaaatatttgttgttccaagagaaaaagcctccgtctttacattcttcccatggttatgcagaggtaaaggggacatttcccctttttcctctgaaggttcactgaaaaatcaattcacaaaagcagataaattggagaaaaagcatccaagtttatttatcgtgaacaagcaggagccttccaaatgaagacccaaagatagaggggaaattgtccatttctgtgcttaggttcaacaaagtatggacagctgtagtaaaataaaactggacaaaaagggtaagatctaatgctaacaggttgagtagggaaactcagcaaggcctggctgtctggattcttcttggcctctctgatcatgcattccttccttctcggtgtggggcagggttctctctggaatgggggtcttgtgtcctatgttaaactctaactttccctctgcatttctgtgtaaaactgactaaagataatttctttatggtcagttttacacagaaatgcagaggggaagttagagttataggttttttgggtggctgtagggaagaaggttctggttttaatgacttcccgtagggaagagaaatttcagtttctatggctagcctaggggcagaatgggaccagaagacaggagggcaggaggaggtcacagagaaacttttgcttctgaggccttcattttggggtattgttttccaagtcccagccattggcaaatcatagactataaactgccagagcctaacccagtcctaacatttcaaaaaaaaaaa

SEQ ID NO: 15346 - DNA, 1034 bp, Homo sapiens
ctcttaattttataaatccactttttatattctgatgtctcagttattttcttggaaaagaacttttcaagtcagtttaattttattttgtcttatttagaaacaaaatctgaagcctgtatgttttgttttccagatttgtctgtatttatattaacgttggtgtgtgttgctttcatattataactatcacaagttttgtggcatttagtgaacctaatgtaatttacattctgttatttgtataatctgttattcttattcatcattcattcattcatttcttcattcagtgtttatttagtaatactgtgtacccggcactgtcctgcatgctggggatacaggaagtctctatgttcgtggagtttgtattcttgtaaaagaagagggagatgtgtaacccaaatagagaattttagagaggcataaatacaatgtaagaaataagggcatggtataaaatatcttgggggtatattttagctaggatataggagaaggatcatttgagttgaactctaaaggatgaggacgacgaaagtcacattctagtcatcaggaatagtaaagaaaaacgtccttggatcagaatgagcttagcatgctcagagaaaagaaagaaatgctgtgtgggttggctatccttcagaaagagaatgtggcaggagttgaggtctttaagataatgtacaggccagatcagtaagtcatagtgaggagttaaaattttaccataattacaatttgaagacattggatagttgaatgttacgaactgattaacactgaggaaattagtttacctgctgtgcagaagatgaacaagggaaaggagtggggggcaagagcattattagggggttattgctgtggtcccagctagaaattatggtgtcttggtgtaagtcttgtagtagtagaaatggtgagaggaaagatgttttggaggagcactattagaatttgtaaatggattagaaatggggtaatcaaaagtatcaaacataattaaacattaaatattctttgga

SEQ ID NO: 15347 - DNA, 1057 bp, Homo sapiens
ttttaattttaatgaagtccggctgatcaattttgttcttacatggatctgcttttggtgtatctaaaacatcattatcaagcacaaggtcaccctgattttatcctatgttatcttctaggagttgtagagttttatctttggtgtattttgagttaatttttgtgaaaggtttatgatttgtatttagattagttttttattttattttttattttttggcatgtggatgtcgagttgttccaacactatttgctgaaacaaactatcattgcggtattgaattacctcctctctttagtgaaaaatcagttgactatgttgatgtgggtttgtttctgggctttctttatttctgttctgtccattgatcaagttgtctgttattttaccagtaccacattgtcttgattactattgttttgtaaagttttgagttggatagtgtcagtcttctagctttgttcttttcctttaatattctgggccttttgctttttttgtataaatctttagaatcagttaattgatatctgccaaataactcactggacttttgatgggtattgcattgcatctatagatcaagtagggaagatctgacatgttaacaacagtgagtcttcctctctgagtacatgaaataggtcatttacttagattgtctttgatttctttcattggaatattgtggttcttctcacatagcacatgaacatattttgttagttttatattgaactttttctatttttttggtgttagaacaaccactttttgcacaattgtaagaaacgttaacataagtcttagaactagccccaataattgtgtgataacaaattacggtagcagattatttattcctggttgacataagtgataactgttgttgaattaaatattacttatgctagaaaagcttagaggtatttcatcacaacttgattgttttcaagttatgtaggttgatattattaactaacagtgaattaacgtgttagtttggatgaattgagtttccatgatttttcttacactttaaaatttacttgta

SEQ ID NO: 15348 - DNA, 1027 bp, Homo sapiens
gatattagcattctctgttacctagttttcagcttcctctctgtgcagagtgtgttcctagttattctgcttcaatttttcattttccaaaacgatgttgaatttcttgtttgctgttgtttccctcacccttctccttgtctttctgcttttatactattttgccattttagtgatgtttcagaagggagtggagtttaatatgtgtgctcatctgccatacttagcagcaaaaacaacagctagctagcatttgtggagtgccttactatatgctagactttttctaagtgcttttgtatagattttcatttgatactcaaaccaatcccattaaacgcatactactgttatccttattatacaaatgaggaagcagaataagtaactgaccaatttcacagggctagtaagtgacagaaagatttgaatccaggaactgcttgtggaacctgaggtcttgatacttttagtttattaatatggaccagaagcctacaatacatacttctttagacatctgagttacttaaactaatatgacaccttaaaaatgacttccaataaggcaagtcactagattttcatataaccaaaacaaaaacctagcagcttataaatattcagcatacacaaatacatggaaattataacttatagagtgaagagtaatttttctggtaacagaacaaaactttaatataaacgattatcacttaacaccattctcctaaatatttttttaaaagaattggcatttactgactgaactaggacatagtgttctaacacactaggaatgattaaaatcagaaaactaatatgttttagttgatcttagaattttttttgtttaaaaatttgagagtaggagaaatataatatttgtttagaagtattaaacattataaatagacaaaacttttatttctttaagaaacattctagccaaatacttgaaatttaaaatataaatttagttataatttgtgtcattttaccagtttaaaaaaactatgttcaatac

SEQ ID NO: 15349 - DNA, 1057 bp, Homo sapiens
accttttgttgagttactgtactcctgcctttctaattacagaattccaaacagaatgagtgaattaatgacatgaatttatttcctgcagtgtctagggcagtgtaatgctgcagcaagcttgcaatagcacataagctctcccttcactccttgtcctccatttttgccgggtgacttcacagcagcaagaatggaaggtgcactttactcaccagtgagtaaatcatgtgaatggatattttaaagcacatgccctatacgcagttcacagaactatacttttaaaagctctctgagaacacatgcttggaatatgaaaatgtactgagtactgtatttcttcaggtatcctaggtaaggcaagagtgtataggcataggcaacatttaaatgtgtgttgttgcatttcatttctccaaataattgtttgatatttgactctacagcccttcagggcaggcaaatacttgtaacattagctccatagagatatggttctcaattaccaaaagactgtagaagtcacttttctttgcctgacactgggaaggattctgattgaaggaagcagtctttgttcctctggtctcatgtgacagtctgtatcttcaggtccatacaggttgatgcacaccaaaaagtggattcaaagctgcctattcaagacttggtgatagggaaagatgaggagttaattttcattttcgtttatcagctgcctgtttgattaagatttttggtaggaagagccatctttcagacataatgcctagggtaggttaagggcaaaaattaactctttgaaatataaatgcttcctattaggttggcagatttcactaagctctttttgggaagaaaatgctaaaattcaaaaagagaaacatggaagttattacaagaatgagaagtgtgagggaatgactttaataaataatgaactattaatgacgtatactgaaaatataatgtccagaaaaggagagtgagaactccatcacatgatactgtgggtaactaggatgattttcagactagataacgatgagtatta

SEQ ID NO: 15350 - DNA, 1048 bp, Homo sapiens
ttgcactccaacctgggcaataagagtgaaactccgtcaaaacaaaaaaaaaaaaaaaaagaggaatacaggtagaggcacataaggattcatatcattcagataatttaggtaggaggactccccagtcattgcgtctctcccctcttctccaactttcagaatctaagatcagcagaagcagcaggctgtgcagctccaatactactcccgtgacccctgccctccctgggcccccgaggtcactctcccttaacgcttatctcttgttcctactagtttttcgtctgcctacacacagaggacacctacccttcctgtctacttctgttgctctgctcctttctgattcattgcttctgcttcccacccgtactgcaaagcttagccatttaaggaagccagactccccagaacactgcttaagtgcttacagttatattaaatagaaaaataaaagaatcaatgaagatgctcaaagaggaacgtgtactttgcacatatcatagtggacttgtcctaggagaatcagaactctagccgaactcatgtaatccttaaagctcgtgctgtgattattgattaaaagagaacagctgagacctttgacacttcagaggccagtggtctgtgcagtcagtctggcttctctaacagggaaaggcatgtaaggaaaaggaaatgagacagcctgggacacaagttcaagtatgaacaatactatcacatgttccatagtgcctatcaaacaagtgtatgtcgtcatattagtcgcctccttagcctctggccctcccataatactcaaagccatctggctatctgctcttatttgcaagtaatcaggaaaagtaaagtaagagggttgataatatgagctttgtgaaccccaactatctccatgtgcttcagctctgaccaggagagagcaacgtgggaggtgaggtctattcgaagttgccagacttgaccagttaacagtgcaacggtttgaagaacaatgactctagccctttagaggttaaaggctattgggtagatgtgtagg

SEQ ID NO: 15351 - DNA, 1028 bp, Homo sapiens
cccgagccacataggacacacagttcccagcctacctgactaaatgcagatccaactttcacctggcctaactattgttcagcaatctttcccccacctcatccttttgttatccatagatatgaggttctcaataaatatgtatgagttcacttattaactactggctatgagaataaagttactacatatataccattttgtaaaaatatcgatttgttgtaaaatattatttctagatatatcctcagaaataaactgaacttcaagtcttcttgctatgcattcttttggcccacataagagaaatcagggcctatcaagtgagtaggattgtaccatgttataatttgtggcaaggcgagtgatagcagcaaggacacttcaggccatatgtgcaggagagcttggattacatactccttcctgacctagtccctgaaggggacacgaagggtgctgcattttccttctgaagcctgtagttttactgttaagttttatttatctgaactttctttttccttatcacaaattaaattttactctgtagtttgatgtaaacataacctggttgtttttatatttaactaacaatctaccagcaggaacattttctgacacaggactgcagtaaaaatgagagaaaaaatagggaaaaatttcaaggttaattttatttcttcagacaacatcaagatttttttttttctttgcttatatcattttctgctcagacttttcatcatcttttaactgctttgggagtgaaaactaaccaagctgcttctggctaatttgctgatttttttctccctccgtttctttttgaaaaacatgactagtgtgagctagtacatttaaacgcagtaagccaggaaaagattgctcatgagtagatggattgggttattgaggaaaaaaataacaactgcatgaaagttccctaccccacctatccccactactggcaaattctctttgtatgttaaacaaaggactagcattcttactattgttaagaagta

SEQ ID NO: 15352 - DNA, 1058 bp, Homo sapiens
tgtatttgtgccctgaaatatttaaaacaaaatatttggaaggattttgacatttacactctcatggtatttgtatttgcagttccctgaatgtggtttctacggaatgtatgataagatcctgctttttcgccatgaccctacctctgaaaacatccttcagctggtgaaagcggccagtgatatccaggaaggcgatcttattgaagtggtcttgtcaggtagtatacttttataccttttctttatccgtagattagaagttgtatttgaagaattcttgggcatatgtttttaaggaaacataaaaagcatatctcaaactcagctccaagagaagatgttggagctctgtccacatgaaaaagggaaacaaaaggtttccctttaattggctgtgtccacacccagtactgctccaatcacgtctcttgacttaaggcttcctcccagccccctctcagcctctagcaacatacagatggcgtcattcagcaccttgaatcatttggacagcagcaaaagcaaacaagaaactcaccaacagtgaagctaaattagctgtcagggctgcaattgtacagaatgtgtggaagccaagaaatagcaccagggctaagaagcctttgacttactaaggtcaaaagtccagtagctatgaggtaagccaagaccaaggaggaagccagagcccaggagttagagaaggtcaggtcatgccatgtgacgctagttaactcagtccctgagaaatggctacatttgcctctgctcacattttttatttcttgtttaggatttagcagttagtaataggactgtgcctaaccaaacagaaaaaaaagaatgtatttaacctttttaaaaagcaccagagaacaacagctagagtggagatccttacaatgatactcaatgcaatgataatgtatccaaatttttattgtttatttttgttaaaaagagaataattattgagaaacttggattgccttgctcttttctcctctcatgccttctttgtttaccatctctttgaataaaagaagtccagcagc

SEQ ID NO: 15353 - DNA, 1073 bp, Homo sapiens
tttttctggtttctgtttcttaagattacattcagaaactagacacatagctatgtggtcacagtgtgcaattctttttcatgttcctccttttgaggatataaaatcactaaataaaagcctgtacccaaacttgaagaaatttcagaaatatgtctccaaataatactggattattcactttctcttttcttcctttcatttatactttataatgtggtttctaaatggaactctagtgttaatgctattggtgggcttaaaccaccccatacattttttgttgttacaactatattgctacatacgtgataatcacccagttcaataagtatttgttgtcttttccttgatatacttaaatctctatagtctggtgttagatgattttttaaaaattgtaagggtgattaaaaaggggatggttttatttcctgggcagaagttaataatacaagtttatgattgctgtcttggttctctcaaatgatccagtagacctcaggatctaccgctttcagaacaactttggactgtcccttacagctgaatgctagaaccactccaccaagggagctaagagacattatcactcaattttttaggcattcttgttagaacacttgatcacacgatgtgtccttatcatccacctactcctgggacacaacacttaggttgtgttttggctatattagaaagtgaaagtaccttttaaatttctttgctcattaagggggtgcagtcatgtcactaattattgtggaaaggaagagttcttggaaaatgacttgagaatcatatttaatgagaaggttgcaatattcaactgcctgatgtattccattattgaccagaataatttaatttcaggacttttattgaatcctcaccttttagcaaaagtaaactggcagagtattttttttttttttttttttttttttttttttttgagacggagtctcgctctgtcgcccaggccggactgcggactgcagtggcgcaatctcggctcactgcaagctccgcttcccgggttcacgccattctcctgcctcagcctccccagt

SEQ ID NO: 15354 - DNA, 1050 bp, Homo sapiens
ttgtgtcatggatttgctggttgagaaagctatcaaggagaatcaaaagtcaggacaatagccagattaagactatgatgaacagtgggcaaaggagagggtttcttgaaaggcattgtatagtaagaaccaatatgatattgtgtactcaagggaaaagatagtctcaaggctcactagtctcatgaaacttggaatttaactcagtgcagctcacttattcccctgtctttctcctctccttctccttctcttcgtcgttgctcttctcttctcctctctttctgttcctcccttttcttcttctaatattgttttcactgtgaaatataacatatacccaggaaagtctacaaagctgaaagtatggtttaataaattgttataacatgcaaacccatgcagtcacccccaggtctagaaaaggaatattgccagctctcctgtttcccttttcagttataatctctcccaactcctttcctattctttaaaaatgttaccacctatatgtacatacctaaataatattgtttggtcttgtttttgaattttatataaaaggaatcgtactgtagatgttttaatgacttgcttttacatttactatcatgatttatttacattgttgtttatagttgtagtttgtttattctcattgctatataaaattccaccatgtgcctataccaaaatctattaatatttatccattctgttagtggacatttgggtggtttccagtttgagccaacaacaatgcttctatgagcattgttatttatgtcttttgatgttcctcatgcatgatgttttgtagggtatatggaggagtggaacttctatagcatatgtgtttctccaactttacaagaaaaagccaaatgtttctgaaatggtttttacccatttatatttgtaccagaagggtaggagagtgactgtttttcagttctcaacagcatgtcttgttctcaggctcgatactaaagtattcaggtgggtgtgttcattaattgtagttttattttgtatttccctgattattaa

SEQ ID NO: 15355 - DNA, 1035 bp, Homo sapiens
ggccaggctggtttcaaactcctgacctcaggtgatccgcccccctcggcctcccaaagtgctgggattacaggtgtgagccactgcacccggccgcatacatttgtttttatgggtggttgaaacgtttagaaaatcttcagctcactgcttactgtggttacaggatagcaagaaagataaagagattgggtttaggcattttgaatttggctttaaatgaacccagttgcagatgttaaatggtgatattaagtcagtctaagcattaatataaaatgatgttcaaaagttatagaacagcatataaataattgaaaaacaaaagatcattattttacccctaattactagccttggagtatgggtcaacctttccacatccctcacctttcacatgcaatgagatgctcagtgaatcccaataattatccttttcttagagtctcaagttcttatcctctgtttttattaaaacagctgtgtttccagcttggattatttttacctcctacttaaactgttgcaattcatgggtcatttactccttcagagttaccaactatgtttttaacaagttgagtatgctaatatagagttacaattttgatattaactagacaaaaaaattaaaacttggtgacttctcattgtcagtaaacaaaaaaatcatttcccaatctggtcaattaaaattccccaaaatggtcatagtttaccttaaaatattcttgctagaccttcctaagtatgaaccttgtgtgccatcaaaatgagactgtttattctagtccatatgtacattgtatttcacaatatttggaccttagctctgtttttccctccatctggaatggtctactcataatttctgcccactgaaatacttcttatccttaatccttttccttaagcctgtgggtcctttcagccctgaacactcaggtatgaaccaaatactaccatttgggagggatatatagaggatagtcttgcatggcttttgacctggcctgtctcatgtccggctcattg

SEQ ID NO: 15356 - DNA, 1055 bp, Homo sapiens
ttatgcttccttttaaaataaagtcctttgtttaattttgcgattcagtgtgtaaggagagagtgaatagaatgagaacttaacttgaactctgtctctattcaaacttaaaagtcagtatgttattcagatagaacagaaaacaggctaatatcatagtcaggatctagcaaagcatccagtgcctcactaatagaccttagtgaattgaatgttagtggaaccatggtcactgagtacctaacccacataccaagagctgtgtactctgagttaccacggaattctggctgctgttcattctccttcctttagattgatatctttctgacagtcttaagatgtctatcttagctgtcttctcaatctacacaatctaccttagagaatacaagaacacagtcatgtatttaattatcctcagtgttaccctaaaatctattgtgaacatgtaaaaattcattatatttaccctaacttctattctgaagttcaatgtatctcctgtaattataaagtctcttgaacatttctaagcatactacactcgaatttcaaactcagtgtgttcaaagctgacttcatcttttcccatttctctccatcactgttaatgacttccagagtttaagctagaaagctgcatcatcttaacctcattcccccattacatctcatcctacacaatcagtgggtttgctgagtacaactcattccacctcatctgtgcctctttccttgttgatgttgtctcaattcaagctctgataacatttgaagactatggcaattacatgttaactgctattccttttctcccttccctttctttacctttttattgttgaaaatattctactattccctccacaggattgtcttgtggttccttagcgtgttatacaaggccattcagcatctggccctaattggtttgtcttccccattatccatattcccaggagatgctgtgttcccaaccatactgatctgcttattattcaatgaaaacacctttacttggttgacttcctgccattctcttgtgttattag

SEQ ID NO: 15357 - DNA, 1072 bp, Homo sapiens
ttgtactacaaatgctacatgggtagtgattttttttagttgtattagttttatcaagttagcaaaatatgccagcatgcaaaatgtgagattatctaagtcagactattaaaattatatgccatcttccatttacttgtgtttttggaattgtacatttatttctatcccattgtcttatgcttagagtttatgtaagtattttccaaatgttgaacttcaatacaaaaaatgtaattttgcaacgatttttaaaagtatgttttataacctaataattctgtgaatagtcatattggtagtgtgcttataggtggtaaatactttaaacatgtacagattttgtgtctaagatagtatagctccttaatattcattaacaaatagacatttatttaattaacctctgaataatttagttttttaatttaactttaagcattttctttacagaccagttatgttttagtagcactcaacaacttgacataccttcaacaagaaaacatttgtatctttagaattgtaaatattatccagcattgtagaaaaattggagaacatagaaaacagtcttggcagtgactactagatgctttcctaatttagtctccttttcttcattaattagaaaaaaagacagcaataataacaagttagattggcatgctgcacacatgtaaagactgtatttccttgctgtgctacaggaggttatgttgtagccagaaatgttatatggtcattatggaaaattatcttaacagcaaaggggtgcctttcttctttctcttttcctccatctttctgaccagaacggatatctgatggacaaagctccacagccatattggaccatggtggcagaatgagtaactagagggagactgggccattaacaacttggtataagcttctgccaaccttcagacttcgaattttcaatgtggaagaaaaataacttccgtattgattaaactactgttatttgcaggttatcgatcatctgttatcctgctaaatggggataaaaattgctttctttcttacctatgtctatgtatgatataca

SEQ ID NO: 15358 - DNA, 1028 bp, Homo sapiens
gtgtgtgtgtgtgtgtgtgttttgaatggggttgctttcttgatttggctctcagcttgaatgttattttgtatagaaatgctactgatttttgtatattgattttgtatcctgaaacttgatccaagtcatttatcagttccagaagccttttgatgggatctttagggttttctaggtatagaatcatatcattagcaaagagataatttgacttattctttttctttttctattttgatgccttttatttctttctcttgacttattggtctgactaggacttccagtactatgttgaataagagtggtaagaatgtgcatctttgtcatgttccagttcttaaggtgaatggtttcagcttttgtccattcagtatgacattggctgtgggtttgtcatcagtgtttcttactattttgaggtatgtttcttgatgcctaattttttgagggttttcatcatgaagggatgttgcactctctcgaaagcgttttcttaatctattgagatgattttatggtttttgtttttgattctgtttacgtgggaaatcacatttattgattggcatatgttgtaccaaccttgcatcctgggaataaagtcgactagatcctggtaaatgaagattttatgtattgttggatttagtttgctagtatattgttgaggatttttatatctatattcatcagggatatcgaactgcagttttttttttatattatcagaatgatgcttgatttatagaatgagttaggatagagttctttgcctctattttggggaatagtttcggtgggattggtaccagctcttctttgtgtgtctgatagaatttggctgttaatccatctgtttagggcgttttctgattggtagttttttttttgttgttgttgttgttgttgttttacttcactgattcagttttttaactcatgttctgttcagagtttcagtttcttcctgattcaatcttaggaaggtgtctgttttgaggaatttatctggattttctagt

SEQ ID NO: 15359 - DNA, 1851 bp, Homo sapiens
gttttttaattgcgtgaatagcttgaatttcctctcctgaaacaacctcaaattcagtttgtcaaagtcagaacacataaacttcttcctcaatgggttctgtcaatctaacagtttagcagaggtgattatatagctcagttccaggcatataaatagattatgagaataagatcctggaaactgtttttcactgaacccagctgctgctgtattaggtctgcaataaactgaaaatgacattttccatatatgcaggtgaatcaagaacataaacattctaagagtgttttacatctttcacacacccctttcatcactttaactggattagtaggtggtagcttgggccaatagtttaccacctcatgcagagctgacttgatttccaaacattttattgtctcttttggaaagtaggttaatacacgtgacccaagaggacccagagcaagaaacaagcactcaatggacaagtcatatgaagcagggtaagagcacttaccatcatactcatacccatgggcctacaactgctctttcaagtagatggtgatgataaggcagctattaattgagaattgacttgaagcagctttgctcagatctttgcacatattatctcatttattaatctcaggataatcctacattagttacacttataaccccctttttataaatgagcaagctgaaacacagagagggcaagtcacttgttcgaggtcacatattaaatggcagattcaaaataagaactcagactttctgaatacagagctgcatctactacactctcctgcctctcattttggcaataaagtttttggcagatggtgatcacagaagttgcttaaagtcacaacttttaagtactcttttttctaaagtcaaattgtatagtttttatcctaaaaaattatattatcacttttgtagtttagaagaggaaggtgtgaaaatttgaaatgttatctattctcatttaatttcctactttccgtggagagtattccatacccagattaaatgtcatttccaattgttgctcacacttaccaaagggaaggtctctgctcagttttgagcagaggctccctgtgtaggagtatgacagtcctcagtaaagttttgtcacctatgtttggcaaaacatcctgggcagatgagcgattcatgtggcaagagcactgccaattgaaaaggtgcattagtatgaatattagcacctctaagtgtttgtgaaatagcaaaggtagaaggactagaatattgacaaagcattttcaaaaaattatactacttctaatagcttaacatgttgatagaaaagacgattcagtgtagaagtctgtgatgattcaattctaagttgtatgtaatagagctaaagtctgtaattatattttagaggagtattaaacaatataaacatgatctctgagtcataaatgtcattattacactgagttttaaatataattcatttataaccatataatagacacataatattactgtgtgacaagaaatactcttagatgtagcaagaaaaaatggaaattacaaacatatgtgatttcaaaataattcttaacatttcttcaggggttattacaaagcaaatgaaaggaatttttacaaggtgtagttcagttgcagtttccctcctctgtattcacattattgccacagcttacgaatgacaaacatttgtggactatggcagcaatctgttgggtgtttcaatctattttgagctgaaattgattagcactttatgaaaagtgtacagaaaattaccatgcttatcaaggcaaatcaagccataattctgcctttttttttcta

SEQ ID NO: 15360 - DNA, 1050 bp, Homo sapiens
ccctcttgatgatgtagtgtgattccacctttctccttcaagagttttgtgtctgacttctctttcatttttgggctgagggagctggaaacaatcccctcggttgagcgccaaacccttctcaggggtgactgtagaagttacactcatttcagcctgtagcatgcaaccgtttgcccaaagtacattggtatgtatttggcagaccacagtccagtaattcccgttgtggtgtacctgaaaatcagtttaggaagtgtcattcgtttggcagattcagagtgcaatgtcatccaaaaaagtgaccacgtattccccacaaattattgatttattggctttttgtccaagttgatttccaactgaaaattcaaatctaagtattttagaccgatgattttacaataggagtgttaggatttaggtatcattcttgtactgcctctttaaacagggaataatattaagttgttttcaggttttattaatccaccttggcctttgaatctatggataagaattatgagctaagctgtttgaactcagcatatatccctaattatttaagctccatcagaacctgcccagtaaggggagtactggcataaagatcagtaggaatccacttctcataggtcagttaaaatataatagcaattattgctatatggcagtaataatagcaattattattgctagtgttattatccttaatatagctaacatttatcagctgttactataccagacactcttctaagggtcctacctagacatttaatacatttaatttgcaaaagaacctaagaggtaaacatctattatccttattttgcaggtgaggaaattggggcacagaaagaattgccctggattatataggtagtggcagagttgggattttaaattcaggcatcaagcccaaagtttatgtatttaactaccagactatatttatggaacttaagctttttcaggcggtttaataaatctgaataaacaatggttcctcttcccttttaacttttttcttaatcattttacagtgct

SEQ ID NO: 15361 - DNA, 1023 bp, Homo sapiens
taggaatgtacggactgtagcgcatatttgcttaagatgttcagagtcatggtctgggtgaagcagatatgtgagttatacctattactctatacttggtttctgttgatgaatatactattgaagtcatgttaagaattataggtttggaagtcacaatgttgaatattctggctctgaaaaataatgcaagtcaggggacaaaagccacttgaaaaggaacttgatttaatcattcctgtttagaattttctccatgtggaaaattatgatttttatactttaattaaataattgtttttttttgaaaattacaaaataacacttcgtggtaggctaaataatgaccctccaagatgtctacatcctaatccctggaacctttgaatgttaccttataggtcaaatgggactttgtagatgttgttaaggattttgaaacagggagatgatactgtgttatccaggtgggtccagtccaatcgcataagaccttaaaagtggacagttctcctaactaggtcagacaggtgaatatgaagagcaggagcgattcaaagaatgagagattcagtgcccttttgctgactttgcagatggaagaaatgggccatgagccaaggaattaaataggctgtaagaggaaagcaggaggaggtagagtcatgtagtaggagatgtgacaacagaaacaagatgttggaattattcgaggagtagctcatgagccaaggaacataggaaaagctagaagctgcaaaaggctagaaaagatttcttccttccagaaggaaccacattttgacttttgcctagaaaaactggtttggacttctgatctccgaaacagtaagataataaatttttgtttagtaaagccactaagtttatggtaaattgttacaggaacagtaagaaactaatatgtcacactcattgcagaaaaggtgagaaattcagataagccccaaagtggatcatactactcagagttaaatatagttaatattttggtggatatct

SEQ ID NO: 15362 - DNA, 1041 bp, Homo sapiens
aagagaacattgaaagatcaacaaaagctttacagaagagatggaactggtgtggaggaatgggtagaatttggataggctgaggtgcatgttagaagataaggaagtgtgtgtgtgtgtgtgtgtgtgtgtgtgtgtgtgtatatgtatgtgtagaaagccttctcacctttctgagaatgggtgaggataaatatgacaaaatactgcagaagtaacctcagtgaacactgaaactatgtggaaattgctttgactggaaaatgaagggagtttgtattgtggatcattaaaagataagatggggtagaaaaaataggatcagatcatgaagcacatgaaaggttaagtacatgattttagttaactttgatccaaagagtgtggaagtgctgctacttgtggtttctgagtgaagggagatataataaatgtgataattttggaaaattaatttagttgtagtatataaatgtgattgaaggtaaatggagcttggagatagaaaaaccaattaggagtctgttgtagtaattcataagattgaaagccttgattaaagtcaatagagagataaacttggagaatactttaaagggagattcttttttaaaaccagcccccaccgttttataattttacaagttgaagaagaattaagatgtggttgcaaaattttaggaagcgaaattaaataaatggtggtggtagtcatttaagtggcaaggttacaaaagggagctattttgtgagaaagaataatgtttatgttcttttacgttgaatgtaactggtggttggacatccagtagacagttttttgtttattggagaatttgtttacagtcatttctctgtgggggggaaatcctcaggtaacactgagtttcttcattattattagttaggaaattcagactacgtaacatattacctaatccagaagtaaaattgtttaagcatttctaagaaattagaaattactgtaaaataggaccaataaatgtataaaagtccacctatttccactaagttttacca

SEQ ID NO: 15363 - DNA, 1032 bp, Homo sapiens
ttttttcttattattgtgatctcatatttatttaagacaacaattgtcttaaataaattaaataaagctgtgaaagctttaattatgatagaaaatagaacagatctagcaaacatgacttaactaaatttttgtgctaaaataagcgtatcttttccagattgtttgcctgctaacagttaagcttcagaatataaaagttgatcaacaaagggagggctcatttgagaaaggggaaatgttagatttgttcaaaagtactattttacttacagttatatagggcgtaggaagataaatttcatggcatgagtatgtgtgtttgagcggaatttgaaaatgtaacagtagtctatagtttggcttacacgtggcataattagtatgtttttcattgtgtcagtctagaggattatgcatttatataggactttgtatttgttaagaggtaggtgggttgtattcatagtagtagaaaagtttttctagctgggcatggtggctcatgcctgcaatcctagcactttgggatgcttaggagagaggattgcttgaccccaggagctcaataccaggctaggcagcatggtgagaccatctctacaaaaataaaaaatacaaaaattagctgagtgtggtagtgcatgcctgtggtcccagctactctggagactgaggtaggtggattgcctgagcctaagagttcaagaccagcctggacaacatggtgagaccctgtctctacaaaatttttttttaaattagccaagcttgatggtacgtgcctgtggtcccagctactgggcaggctgaggcggaaggatcacttgaatccaggaggtcaagagccaaggagatcaaggctgtagagagccatgtttgtgtcactgcattctagcctgggtgacagggcaagaccttgtctcacaaataataataaaaattaaaaaataaataaaagtttttcttgccataagaattagaaaaggtatttgtacttctataaatttcagtttttatttaattagtgct

SEQ ID NO: 15364 - DNA, 1043 bp, Homo sapiens
ttaatagacaggatctctgtatgttgcccaggcggatctcaaactcctggcctcaactgatcatctcacctcaacctccaaaagcattaagatttcaagcatgaggctgggtgcagtggttcatgcatgtaatcccagcactttgggaggctgaggcgggcagatcacctgaggtcaagagtttgagatcagcctggccaacatggtgagaccttgtctctactaaaaatacaaaaaaaattagctgggcgtggtggctcatgcctgtagtcccagctacttggggaggctgaggcaggagaatcgcttgaacccaggagacggaggttgcagtgagtcaggatcgcgccactgcactccagcctgggcgacagagggagaccatctcaaaaaaaaaaaaaaaaaaaagatttaaggcatgagccattgtacctggccatgttttttttttgttgttttttgtttttttgtttttttttttttgagtagttcagaaaactaagttgtagacatgttgctctttaaatatattagtatatatttaaacaaagatactctcatgtatgaccacagtacagtcatgaaaatcaagaagtaagtgttgatgcaatactaatatctaagctaaaactcagttttctttcactttttaataatttctatgttttctgtaatttgggaggagcttgaattaatcttttgtaaaaattttgggctggtagcatttttctaactttttaaggtctccatttgtgctgtattttatatcttagtaaaaacatataaatcaatgattaaaaatcacagtatgaacgaagcatctgaaatatggaggctttagttagaatatgagagagcagctaaaaatcttttaagactttctttgatatttgttactctttttcaacatggacaatttaaactgtggattataataatgtattttcctttgataggagctgttattcttatagcctgttgttactcttaagctatattatacctataaaatttaaacttaccaagaaaagattatttcattt

SEQ ID NO: 15365 - DNA, 1054 bp, Homo sapiens
ccctgccgtgcgcacaaacataacagttgcttttgtttaatgtgcgggtggaatatttgatccattccaaccaggcatttacatcttggtatcttgtctcaattgccaaagtttgttttaagtctttaacttttaccatcgctatcttggccttgtccttagatggaggaggaacaatggttcccttgtgagaggttttggaaaaaggcttagaagctggtgcaggcagtgggggatcaaagacatgcattttaaggagtccaatagggtctgtccttgaaacctcagcccccataccataaaactggcataaagaagggaactggcttagaaaagggaagaactttgggggcttgaaataatagcctgtataggattgcattggtttagctgacagctgggggaggggagctgtccctttagtaaaatgaatgtatggttttaggaaattacaaaaactgtttggggcagtctatccttgctctttagtggtccacagaacgttggaccaactacggcataaaagctctacatcggggggccagactcctggttgacactcgggtctttatcgaaatctccctggattaaaaggtcccaatttactaatgcccattctgaggagagtcaggagggacaaggtacttttctgaaatagagagctgtctttgacttggcaagtccccacagggtataacagggcaagcattaaatgcagtagtttgaggtgaaattgacttggtgttaataactagatgcttagcaatagagtgagaaaagaagagtaatagaatagatgaaaaagttaaatttttcttagctttggtttggtagggttttcccctgggactgtggtccatgactggagggggtggcgctttgacttaggtgtgggtgagtccatccctttttcgctgtacgaacagcagtcttggtggttagcagcacaaggtagggtccttcccatgctggctcgagtttttttctttccactctttgatgagaaggtgatcttcaggctggtgctggtttactggaaattctaggggttgta

SEQ ID NO: 15366 - DNA, 1055 bp, Homo sapiens
caggggtctttaagtgattgcttagtgggccaaagaataaggtaactgacccctctctttatcttgaacttgaccagactactttctgtggatgattcaaattccttttcatatgagtctttttatttttgaaggttaagaatctacctggggtagtgaaggcattggaccctgggaagccagtagacttgagatctactgtcctgattcttctatcttactagccaagacagtgtccgtgagcaagacactttacttccagagggggtggcttagttgcctaatttgtaaaataattataattcattattggaagtggagattatagagctggaatattcacttcctgtggtataaatagtgtgaacaaaagttggatggctgtaaagtgcaaggtcttttttgaggaatgttgcatgtttcacttgtggtagagtacagaggaatgatgaaaaataagcttgaaaatgtaggataatggtagaatggagagaaccttgaaaatagcctgttaggacagtagatgagtcattcaaaactttgtcagagaaaagtgagaggacctgctttataattgtaccatgacttcattttctttattaattattctctttctctttttaaatgttcagattttaaggaataaatttgcattccaaccaagttttgctgtttcatctccattcattgatatgctttaattttgttgtagttgggctcagcagatttctactttgtattgtatatgttcgttgagtaaatatatttggtaaaattaagaaaggtaaataacaaataaaaataggttgtggtgctagcagaaaggggcataaagagataagcttagaaaagttaatacctggaacagctttttgtttattaattttagtttgagtataagggtcagagtttggttgataataccttttaggatttgcttatgaggccaaagtgctgctcgtgtcacaggacctagctgagcatcttggacattgttttttaatatgtcaaatcagtgttagtcttgttcagtataataaacatttattgaatgt

SEQ ID NO: 15367 - DNA, 1001 bp, Homo sapiens
aaaaaaaaattagccgggtgtgctggtggcgggcacctatagtcccagctacttgggaggctgaggcaggagaatggcatgaacccgagaggcagagcttgcagtgagccgagattgcgccactgtactccagcctgggtaacagagtgatactccatctcaaaaaaaaaaaaaagtcatagtgccctcagaagactgctagaacactcttgccactctggtttactgttacttctctttaactccttgagtcattaggcccagggattttttcaggaaatgtgtataggagtccctctttcctgagtttatagcctcttgttctgtcccattccacatttctgaattgaaatgacacacatgctcttaaagtatctgagccttccatttttttgatttagtcttcattgtcaccattgtgagtctttcaataactgatgacagacaattcatattaatcatcccatttcatagatatggaaactgaggtaattaatttgcccagggtcacatgagttagtatgtgttagggttggaattatgcattggaatctcctaccgtctggctataaatcctgtgttttgtccgggcgcggtggctcacgcctgtaatcccagcactttgggaggctgaggcggatggatcacgaggtcaggagatagagaccatcctggctaacacagtgaaaccccatctctaaaaatacaaaaaaattagccaggcgaggtggcgggcacctgtagtcccagctactcgggaggctgaggcaggagaatggcgtgaatctgggaggtggagcttgcagtgagttgagattgcgccactgcactccagcctgggcgacagagccagactccatctcaaaataaataaataaataaaaatcctgtgtttaaatgactgttttgttgctgctgtctcgctacctcccaatctactacctttggagaaatagtcactatatcattgggctgccatgaagaggaaggcttttgaagtc

SEQ ID NO: 15368 - DNA, 1023 bp, Homo sapiens
ttaaaattgctttttttgtgttgttgttgttgttgttgagttttccatatactattatctctactgttgtgtttgagaatgtccaaaaagaattgtcaaaaacatttttaatagtcgtatggactgatatattcaaataaaactttttaatgatgttttatttatttgtttttacttttttttttttttaaagaatagagaaggggtcttgctatgttgactaggctggtcttggactcctggccacaagcatgcctccccaagtactgggattacaggtgaaccactgctcccaacctttaatgacattttctgataaggtcttttataatatggcttcttctaacctttcggttttatgttccgtctcttcctcctcctctcctctaccctcttcctctcaccctcacccccaaacacacactcaaaataaagttccagccattctttatttccctaaactctggtaaagttagtgtatcttctccagcccttcacacatactgtttcctctgcttagaacacttcctctcccatttgatctgagttctcttcaggtcaaagcttagctatcatttcctctgggaaaacatttttgagcctgcaagtgtaaatgaggtattcctcctatgtgatgaacttccattattataatatttattaacctgcattacagatgcctgtcctatttactttatctttaacagtaggctgtaatctctgtgagggtagggattgtattgccctatgtatgattgtaccccagaatgaaagaatgaatactagtactcatattatttcaacaaatttgtgtttctcataggttgaaggaactctgtgtgatacagagttgaacataagttcttttattcaggtaacttcaaatctaatggaggagaaataggttacctcataccttgccctactccacatgacctcttaatagtaggaacttcaaaccaaatggtatgatcatacctggtcaaaaccaagctgaaaataaaacctagaaatactgctggc

SEQ ID NO: 15369 - DNA, 1029 bp, Homo sapiens
gaattagtttttctcatgagaaagctgtaaaatacagtattctcaagtagtggtatgtttttactgataataagatgggcaactcttcctaaggtgttttggaaaaactgagctgttttggttttaatttgtgtaaattatgagttaaccattttagtactagaaatatcatcatagagtcctgaaatcctaatcagaaggattgaaatttatagctagcagatattcaaaaggcagctaattcattcctctcatttgacaaatgaggaagctaagaacaagagagagggttatgaagctattagtgacaaggaaggattagaatgtaagtctctaaactcccaggctagtgtcctttataataatttataagaagggagttcttttgttttttttttcttttgtggcctttatagccatcttgctgctcccaggaactttgttaaacaatatgcagatgcttcagtaacaacaagaattgtaaagttaacttttggagttatgtcattttggacagatgaatctgatttatttttaactttcgtggaagatgattcacagctttggaaacgttttcctgatgactgtgggttatcaggtaatggaaacttcattatttatttgctggcaggatcatacaatgaacacggtattttcaagtgagatctgaaagtgctctggcacttaaacatttagtattttatcttaaacatattctagatcatttgactcataactgtcacttgaccctggggtcaaaatttgcatttgtgtttatgtttttagtgatgccaagtaaatactgttttggttgttggggactaatattaaggaaaagaatagagatgttcttaataagatggttttgagttaaatgaccaaattattttgtaatatgtggcattaatgtcgcataattgaaactaagaaaaagtgcatgtcttattatgaggcactcagtagtccagtcattccaaacttaaaagatatcttgtggtgcagttggtacattttcatgttgtgagcaga

SEQ ID NO: 15370 - DNA, 1047 bp, Homo sapiens
tttttttttggagacagagtcttgctgtgtcaccaggctggagtgcagtggcgtggtcttggctcactgcaacctccgcctcctgggttcaagccattctcctgcctcagcctcccgagtagctgggattacaggcacccaccaccacggccagctgatttttgtatttttgatagagacggggtttcaccatgttggccaggatggtctcaatctcctgacctcatgatccgtccacctcggcctcccaaagtgctgggattacaggcatgagccaccgtgcccggcctcatcttaaccattttcaaaggtttattgcagtggtaggcagtacatttatgttgtgcaacctttactaccatcatctccagaactcttttcttcttgcaaaactgaagctatacccattaaacaataactcatttccctccacctcctagctcctggaaaccaccattctactactttctgtctctattattttgactactctaggtaccttacataagtggactcatacatacaaatgcctttttgtgactgccttatttcccttagcattgtgtccttaaggttcatccatattttagctactatgtttcagaatttccttttttttttttcttttttgagaagcagtcttgccctgttgtccagactgaagtgcagtggcgtgatcttggctcactgtaacctcagcttcctgggttcaagtgattgtcacctcagcctcctgagtagctgggattacaggcgcccgccactgtgaccagctaatttttttttttttttttttttttgagacagagtcttcctctgtcgaccaggctggagtgcagtggcgcgatcttgactcactgcaacctccacctcccggctcaagcaattctcctgccttagcctcctgagtagatgggattacaggcgtgtgccatcacacccagctaatttttgtatttttagtagaaataggtttttaccatgttaggcaggatggtctcgatatcctgaccttgtgatccgcctgcctcagcctcccaaattgct

SEQ ID NO: 15371 - DNA, 1040 bp, Homo sapiens
tctagagacagagttttgctaagttgctgaggctggttttgagcttctgggctcaagctatctgccatccttggcctcccaaagtgctaggattacaggtgtcagctactgcacctggctagttgctataatttttaaaaattattttttggctgggcgcagtggctcatgactgtaatcccagcactttgggaggccaaagcgggtggatcacaaggtcaggagtttgagaccagcctggccaatatggtgaaacgccgtttctactaaaaatataaaagttagccaggtgtgctggcacgtgcctgtaatcccagctacttgggaagctgagggcaggagaatcgctttaacccgggaggcggaggttgtagtgagtcgagatcgcgccactgcactctagcctgggcgacagagcgagactctgtctcaaaatatatatatatatatttttattatttttctggaatatttttgccttgccattgtttgaatctgtgaatggggaacccttggatacagagggttgccttagtttgaatcgtataatatgtagccttttcacttagtagcagtgtatttaaggcttctccttgtcttttctatgggttgattatttctttttagtgctgaacaatattccatttatggatgtgctacagtttgttcaccttttggagggtatcttggttactttcaagttttgacaattatgagtaaaggctgtaaacatccatgtgcaggtttttgtgtggacgtataagttttcatgtaatttgagtaaataccagggagtgtgattgttggatcatatggtaagattatatttaattatgtaagaaactgccacatgatcttccaaagtggctgtaccattttgcattcccaccagtaatgagtgagaattattattgctcccctttcagcttttggagttgtagtgatttggattttaaccattttggtagttatgcagtggtatctcactgtttttaatttacattcccctaatgaaaaacagtattgaagccaggcatggt

SEQ ID NO: 15372 - DNA, 1075 bp, Homo sapiens
ttttagtagagacagggtctttctatgttgtctaggctggtcttgagatcatggcctcaagtagtcctcctaccttggcatctcaggagtgctgggattaaaggcatgagccactatgcctggcatgcctcagcctccagagtagctgggattataggtgtgccaccatgcccgactaattttttgaattttagtagggatggggtttcaccatattggccagtctggtctcaaactcccgacctcaggtgatctgcccaccctggcctcccaaaatgctgggattacaggtgtgagccactatgccctgcctaaattttcttttattctattagtgcttgaagttactgagttctgaagttgttgagcttctctctgctttgctattgatttgagcaagttcggagcaccatggccctcatcttcgcattttacgctttttttgcaagtttatcaacaagctcaattaaaccaccaactgttttctgaaactggccagttttgtccgcaaagttcttgcactcttctttgagctctgtggtctgctgggtaacctctgagtccaacacccacagcttgttcaactcatcaaagtgcagtccctcttcagccaggatgtcctttaccatagttgtttcgcatccaagttccctagagaagctctgctctgaaggagtgacggtgacagtcaggaggaggtgtgtcataggaacaagggtcgagaaagaataaagttcgcttgcttgtcacaggtattgttcattcaacacacatttctttgagtgcccactacatgccaacactgctagatgctgggggtacagagatgaatgcaacatggtgcccaccctgctggccccgtggcagcagcttactatggcccaggctgatgtagactggcagcttctccccatcactggtagctggtatgcaggcagcctgcctcggctgttgccatgactacagagactctttacccatgacctgaaatatatttttattaaggttttttttttttaacaaaatggttttaaatttatttaaattaatttcctttttttttttttttaaattg

SEQ ID NO: 15373 - DNA, 1042 bp, Homo sapiens
ttagccaggatggtcttgatctcctgacctcgtgatctgcacaccttggcctcccaaagtgctgggattacaggcgtgaaccaccgcgcccggccgacagtgatttttcataaaggtgttccctttgttctgggatttttagccttcatacatttttactgttaggcatttcctttttcagatgatggtgataatagttaaaaaaattttattgatagtattaagggagtccactaccttgtgtcagattccctgtttctttttgaagcccttgaaatgaagtttagggaccactgatctagaattctctttatgctcctccactacccattaaccccactctgtagtctgccttttcgctttcttctctcctcccttctaaacacttcgtagaacactatgttttctgttcatgattgaccttcaaattgccaaatcctttggccttataaaccgtatgtacttaaccaacactctgttgttaacaaatccttcaaaactgttttcttttgcttccgctctgtttttcctgtcatccacttatcacttttcttcatatgttttctttcttttgttcccagttgttattatgtggggttctggttctattttatgttctcactgtatattcagaatcagatttttagctaccatgtaccatcttaataatacctagcatttatttactctttcctaattgttatttcagtgcttcagtatttcagtattcatttaattcattcagtattcatttaattctcaaaacaactcagtgaggttgatacaggtataattggtgtcttttttttattttttctgacactggcatatcgaggcccaaaggttaagtaatctatgcaactaggaggcagtagaactgggatttaaacttagactgcctgtagaggccatgttcttaaccactactagatttttggcgtccagatgtcccttgtatttctaacttccgtttagtttttctacctcaaattcaatacatccattcagttaatctcaagtgcctgcctctttcccttgacaa

SEQ ID NO: 15374 - DNA, 1986 bp, Homo sapiens
ctactttgaagatagtccctctaatcatggaagaagtaatttaccaaaaaaaaaaaagcatttaaaaagtttctgttttcaggctgggcacggtggcccatgcctataattccagcactttgggaggccaaggcagacacatcactcgaggccaggagttcgagaccagcctggccaatgtggcaaaaccccatctctacaaaaaaacacaaaaattagctgggcgtaattccagctttttaggaggctgaggcataagaatttgcttgaacccgggaggcagaggttgcagtgagctgagattgcaccactgcactccagcctgggcaacagagcaagactcattgtaggtgctcaataaatattttgttgaatgattgtttaccttaagtactcttccaaaatagttgtaaaaaaaaagttataatttaaactgtttgttttcttccctgatagttacatttttgtaccatttaatgccatttacaaagcatttatatacatagaactataggcatgttgtgataactggcattgattataatttgttttataaatgaggaaattgattctgcacgtacttagctgatttgcctaagatcatgagaaaatagtagcacacatgagagtagaaccttcagcttcttattcctaattgtcggttcttcctcccaccataaatggattgttattaaaaaaaagaaaatgtggccgggtgtggcggctcatgcctgtaatcatagcactttgggaggctgaggcgggtggatcagttaaggccagaaattcaagaccagcctgggcaacatggcagaacccccatctctactaaaaatacaaaaattagctgggcgtggtggcacacacctgtaatcccagctactggggaggctgaggcaggagaatcacttgaacccgggatagggaggttgcagtgggccgagataatgccactgtactccagcctgggtgacagaacaagactccatctcaaaaaaaaaaaagaaaaattgttttaaaattataattaccgttttgatggcggctttcagtttgaaagatagcttaatcatttctaaatttctctgataggaaacatttttcctttttttgaatgatgttggggcttggacaacagattattatttttattgaactgctaaaataaggaggcaaaatatagacccagtactttctcagtttgcttaaggcagattataataaaaggagtttcatatatttttacttgtgacaggaagcagtttatgtaacaaaaaaagattactgtgttttaaaaatcacctgataaaatactattttttaatttcttaaatctttgaattctgttgctggtttagtagtacattcagctgttaacgtatgctgcagctcatagatatttttctatttcagagcaatagtatggttacagaaccgacgtgaagccactgtggagcgaacgagaaccacaagcagtgttaggcgagatgaccctggagagtttcgagttggtcgtctcaagcatgaaagagtaaaagttccacgtggcgagtcactgatggaatgggctgagaatgtcatgcaaatacatgcagatcggaaatcagttcttgaggtaatctcatataaaattagatttagggaacaggaatgacacttagggaaccagcccaatgtgtatcttcactgcattaaaaactgtggtaggtaaacatgaagaggggttttcctgttctgtaggcagaagccttctcctctggcagagcatctttttcataagaggatgtcagtccacctccttaggggttaggtcttgtgccattaatgagcaacaaagaagatctccactcttgaggtggcaaagtgcttgttctgcttgagggcttctacccatttcataacaaagttggactaaaatagtagtactcacaagggattcttttttacttttacattaaactgtgctgtttgatattttgggagcac

SEQ ID NO: 15375 - DNA, 1077 bp, Homo sapiens
ttagtattattttcatgtaaaaatgagagagctctctatcatacacatgtattctgttctagcactctttcagtaacgtaggtgtaattatttccattacaaaagaaacagaaaacaggctgggtgcagtggctcatgcctgtagtaatcccagcacttcaggagtctgagacgggcagatcacttgagatcaggagtttgagaccagcctagccaacatggtgaaacctgccgtctctactaaaaatacaaaaattatccagatgtggtgttgggcacctataatcccagctactcgggaggctgacgaaggagaattgcttgaacctgggaggcggaggttgcagtgagctgagatcacgccactgcactccagcctgggcaacagagcaagactccatctcaaaaaaagaaaaaaaaagaaacagaaagcaaaaatgtcgacgcctagagagtcttaagtagctgacatcctttagctaatatatggcagagaggtttggatttcatgtagccttgtttcctagtgtagtggcctttcttggactgcttgttttagtataattgtttttcacccatcttccaaatttttagggacccctcattcagagctcttggaagaagtcgaatgtactccgtcacctcgattagctctcactttgaaagtaacaggtcttggaacgactcgtgaagttgaattaccactcaccaatttcagatcaaccatcttttactatgtacaaaaattgcttcaattgtcctgtaatggcaatgtgaaatcagataaacttaggcgtatttgggagcccacatacacgtaagaaattttaacttaatgttttggtagataatgtcctagtgtagagccaagaagcattgcatttattttggattataggaacagaaaagattttgtttttattctgttggcttacaggaacagataatagtgtttgggactcttggtgtagaatgattaagttttagaagtagaaggacatttacagtctatactagcttcttacgtaattgttgaaaagagcgtcatttgaattctttgtctaagatcgtgtatga

SEQ ID NO: 15376 - DNA, 1065 bp, Homo sapiens
attccgtagtaaataggcattatcttaagtagtcattgtttttaagtaacctaccaggtcacatatctaagccccgtttttcactgattgacttaattctgtttttcctcgtaagatcttttacatgttgtaaaggtttgtttttttggttattgttttttaaatagccccacatggttatccatttatattatgattttgtaattcaggtttagtttatggttgtcctttatcacttgtttttgtcatgcttgtgtctgtgctcatcttgtatgtggtggcagaacgcaacagttgtcccttttgaattttacttttgttttgtaaaaacctaaaatgcaaagttcctttgttatgctttcttaattgtgttgacataaggttgtgggttttgttttcaagatttccttgatagctgccgtgccagtactctattggctgagctcgatgatgatgaggacttacctgagccagatgaagaagatgatgagaatgaagatgacaatcaggaggaccaagaatacgaggaggttatggtagagagagtaccccattctctttacaaagataggatgttaataattgaaatgaagaaaggaaaagctaagtcataatcaaactttgaagcaaggaaatgtggcaccagtataaaaaatgtagttaattaagaaaagcagttttaatctgagcatttatgattctccacttaaagaaaataagttgcttatatttgaaaaattttagaatgtcacatgatgttttaacaggcttaaaagggtgtgaaattaggctgggtatagggctcatgccctgtagtcccacactttgacatttgtagtcctggctacttgggaggctgaggtaaaaaatcacttgggtccaggagttgcaggctgcagtgagctataattgcatcactgcactccagcctgagccacagaatgacacaaacacacacacacgtacacacgtgtatgaacttagtgcagtggctcgtgctgccatgagctataattgcatcactgcactccaacctgagccacagaatgacacacacacacacac

SEQ ID NO: 15377 - DNA, 1049 bp, Homo sapiens
aaccataaagctatttgacactcttatcactaagagaagaagtgtaatagattcataagctttgtaaaatgatattccttgtatgctgttatcacagtcttttggaagtaattccttagttaggtaatgcatgattcttgcaaattaaattttatttggaaagttcagtaacagccttatggcttccatgctataatcaaagggatgtatttgattcagttaagatagaatctgtgtttctatttcttttatttcatcttattagaaaagtaatgctctgtatagaaactagaagaaaattaaaatcatctagtccccacctaccagacaaccagctttgatgtacatcatttgatgtatgtttttgtttttttaacataaaaggattatatccttttccgccagctgttttcactcaatacattgtgaaaatattttcacatatgttgcatgggtttctataacatttgaaatgactgccaaatatttcactgtatgatcatcatttaatattattatcaattttgtatatttaagttagaacttttccattaccataaacatcattatgaatgagctttcttgaactgtattttaatatacttccttaggataaatgcttaaagtaataattattgaattgctttccaaaaacattgcactccatcccaattgttttggaataccctttaccatatatccttgatcatactgcctgtttttctttaaaaaaaaaaaattgggagtaattttaaagacaaagtttatgtgaagatacatttttaaggtgctattttgtgtatagcccattttcatgttttcttcctttttgtgagaatatagcctctcctaattcatagcaagaatttgatatgatgttccatagttttaagagagtcattatatttctgtttctgcttattaaacgtgtgtgtagcaaaatgatgatgattacaccaaagtgttataaattcattgcataaggtgttttctgatttattatttctcatggtggccctgtgcccctctctactgatttgttattatgt

SEQ ID NO: 15378 - DNA, 1036 bp, Homo sapiens
ttagttttattgtttaaaatttatattttaataggtctttttttcctaagagaaaatacatgtcatacttgaaagaaataagattttgaaacaagtattttgtctttatagaaagccgaagtgaattcttagagaagttacaaagagctcgaggccaagtaaagccatctacttcaagtcaacctatactgtcagcaccaggacccactaaacttactgtaggaaattggtcactgacatgtttgaaagaaggagaaattgctattcataattcagatggtcagcaagctacaatattgaaagaagatttacctggttttgtatttgaatctaatagaggaaccaaacattcatttactgcagaaacttccctgggtaagtatgtagatatgtaagtttattgggtacaaataaatgaatatgttaaattgtaacaaagtaagctctgtgaatattcttttttttccccccaaggttcagaatttgtgactggctggactggcaaaagaggcagaaaactgaaatctaagttagaaaaaacaaagcaaaaggtatatctgttggatgtgctttattcttgtcttttatactgatttgttaaattttcagtggtaaagtataagcactgaaaaaaattgagccatagaacataagcagccctaatataatatatttttagtttttctattttctgtgttttcttaaatatttatttacatataatttttatacctatactaaataccaacattaaaacagaatcaaaatggatgttaatatgaaacaaaatgtaaattacttgacttattaattgcacaaaaaaattcaactcattgagattattaatgatactaggatatttttagtgttgtagtgggattgaaaatgacttgtattttacaatctgggttaataccttgtgatacagcaaacttaactgcctggttctaaattcagattattttgatacttagtttaatggccatctcagctgaaattattacttcaagaagatacagtagcagatgcataattg

SEQ ID NO: 15379 - DNA, 1022 bp, Homo sapiens
tagtcttgaactcctgacctcaagcgatccgcctccctcagcctcccaaaatgcagggattacacgcgtgagccgctgcactgggccccatttattttcttagtagttgtagtactttttacttgattttctaaaattatcatgacatgttaacattcatgctagtaaagtgtagaatatagaatagaaaagtgcatttaagaaaattataagtcatttttggtgagctcaatatatttataatagaaaataaatggaattatttcaaaaatgaacatatagtgctgagtcccaattttttgtatttttttattaagtgtatttttttagcagagtgtataaaatgtaacattggatattttactgttcattaatgcatgcattttgatttattttaacttcatttggcttcatataattctatttttacttttcaaggaaagcaagtcttgctctaattcgaaaaatgattcatttttgctctgaagcactgttaaaagaagtttgtgattctgatgttggtcacaatttgcctacaatactagtggaaatcactgcaactgtcctggatcaagaggtccgtttctttttcaaaactctttagcattaatttcctttagctagtagtctgaaataaaatttttgttttaatttcagtaaatcatgttgtgcaaattactgcatttctctactcctggcaactaaacttatttttattttttatttttcaggatgatgatgatggccacttgctggctttgcagatcataagggatttagtagataaaggtggtgatatatttttggatcagctagccagacttggtgtaattagcaaagtgtcaacgttggcaggtccttcctctgatgatgagaatgaagaggaatcaaaaccagaaaaagtgagtggtcttaattatagaggtatcaggaagagttttttttttttttttgaggaaaatctagtttcaatttttgatggtttttgacaggataatgacaatatgaaataattctgtata

SEQ ID NO: 15380 - DNA, 1027 bp, Homo sapiens
aaaaaaatttttttttttttttgaggtggaatcttgctctgtcgcccaggctggagtgcaatggcgctatctcggctcactgcaagctccgcctcccgggtttacgtcattcttctgcctcagcctccctagtagctgggactacaggcacccgccaccgtgcccagctaattttttttgtatttttagtagagacggggtttcaccgtgttagccaggatggtctcgatctcctgacctcgtgatccgcccgtctcggcctcccaaagtgctgggattacaggcgtgagccactgctcccggctgaccaaagttttaagttttcagagggttgatgaatccagaagctctgtgaaataatttttggaacgaagtggagtatccaaaattatcttcttaatttgttattgagcacattgaagttactagtgctctttagtattcttataagcatcattgaaacaatgttctaatttcagtgtatttgttaattagagataattattatttgaagttggatatatcttaaggtttttttccttgaaagcaaaagtttccaaaaaagtatttctttaaaaaatatttgtctgtaggtgattggatgtgtccagttaataaaggagatgataagaaaaagaaagatacaaacaaagatgaagaagaatgtaatgagcccaaaggagatccggaaatggcacccatatacttgaaaaggttattgccagtgtttgcacaaacatttcagcaaactatgctgccttcaataaggtagttattcatactatttgatgtgttagtcaaattacaccaattatatggttttatttatctcccttttccagaagtatttgaggtttattttaatgttaaaaaggtgtggtaagaataaaatttagatgagaagtgggaaagccctatcttttcttctgacgatctgaacgaagagaagttttagaaaagattactagattcttaacaaattttaggtagctctctgaatattaaatctctgtttgataagtattgc

SEQ ID NO: 15381 - DNA, 1049 bp, Homo sapiens
tagggggacagagtctcgctctgttgtgcgggctggagtgcagtggtacaatcttggctcactgcgtcctctgcctcctgggtttgagcgattctcctgtctcagcctcccaagtagttgggattacaggcatgtgccaccacacccgcctaatttttgtgtttttagtagggatggggtttcaccatgttggccatgctggtctcaaactcctgacctcctcccacctcggcctcccagagtgctgggattacaggcgtgagccacggtgcctggacttaaatactttttcttagctgatctcaagtttgctgattatgtactgctctatagttgacctaaatatttaaaacactctcttggctctttatttagatgatgactaatgacgatcttaaaatggttcagtctttagaaaagtttagtattttattggctttaaaaatacgtttctttttttttccttcaaaatttcagcctttgaagtaaattttatggatgatgtaggtcagactctattaaactgggcctctgcttttggaactcaggaaatggtaagctaataaataaaagctggtatttaaattaaggatagaaatattaataaaaagcagctttatgattcgttatcattttacaggtagaatttctttgtgagagaggtgcagatgttaatagaggtcaaaggtcatcatcattacattatgctgcatgttttggaagacctcaagtagcaaaggtaaagtctaggttttaaaattactaatttttaacatttacatggtttaaaaattagaatgatataaaaccttttatttccatgccatctccatccacttcattcccccttactcactgtaagtgtttttaattagttttttctttttagtgtttcctaatacagattcaataaaaacaaatatatatatatgtgttccctccttttcttatacactcacctgtactttgtttttttacttaataatataaattagagatctctccctgttagcatgtagagaacttttttatatctgtatgcatatcct

SEQ ID NO: 15382 - DNA, 1071 bp, Homo sapiens
atggctcactgcagccttgacctcctgggctcaagtgatcctctcacctcaacctcctgagtagctgggactatagcacatgccactactatgcctggctaattttttgtatgttttgtagacatcaggttttgccgtgttgcccaggttagtcttgaacttctgggctcaagcgaactgccaaccttggcctcccaaagtgctgggatcacaggtgtgagctaccacacccatctaaaatgtattattaaaattaatttcatttgtttcacttttctgtttttaatgtgtcactaataaatttggagagcgcattgtttctgtgattcttgaaaatcaggcttgcattctttcgttacatttgttttactattataggtattagaactgatatgtactcgtgagtcaggagcagtctttgaggctggtggtttgaattgtgtgcttaccttcattcgtgacagtggacatctagttcataaagacaccttgcactctgctatggctgtggtatcaagactctgtggcaaaatggagcctcaagattcttctttagaaatttgtgtagaatctctgtctagtttattaaagcatgaagatcatcaggtaaataagttgctgttacatactttccattttcagaaagtgatttttttagtgttcccctgtttataattatgatagactgtaatttgtgcttttcacttgatgaaatcgaggtaattccatcctctttctctaattttatctctgcatgtggtaatctccattttgggaatgaaacttttaagattataagtgtgatatatgtttattcttaaaatttaaatatcataaaaatgtttttacagctgtacttgtactgagtgtaattttgctgacttggtgcaattttgttgacctgattttgttgacttaagatagatctcatttaaataagacggtattttttatttttattattttttttttgagatggagtcttgatctgtcacccagggtggagtgcagtggcatgatcttggctcactggaacctctgcctcccgggttcaagcgattgtcctgcctc

SEQ ID NO: 15383 - DNA, 1173 bp, Homo sapiens
ttttctccatgttggtcaggctggtctctaactcccaacctcaggtgatccgcctgcctcgacctcccaaagtgctgggattacatgcgtgagccaccacgccagcccttctctgttttcttaagtgaaagctggggtttgatttttgaaagctggggtttgaggcctgaagcatttaatgccataaatttttctttatatactactttagttgtatcctacaaagtttgatgttatatatgtatttcaatcagttagtaattttttttttttttttttgagacagggtctggtccatacggagaaaccccatctccagcccaggctggagtgcagtggtgtcatcttggctcactgcagccttgacctcccaggctcaagccatttttccctgcctcagcctcctgactagctgggattacaggcatgtgccaccatacccggcttatttttgtatttattgtagagacagagttttgctgtgttgcccaggctggtctggaactcctgagctaaagccatctgcctgcctcggcctcccaaagtgctaggattacaggcgtgagccactgcacctggccggtcataacatactaaggaaataagcaaattatgggatagtatttatagtatggttctacttgtgaattacgaaaacataaaatgtttaagtatatggaaaaatgaggccaggcgcagtgactcaggtctgtaaccccagtgctttgggaggctgaggcaggaggattgcttgagcccaggagtttggagctcctgaaacatccgggtagcagggagttatgattgcacaactgtactccagcctaagtgacagagtgagacactgtctttttaaaaaacaaaaccaaaaaaggtggggtgcagtggggcatgtctgtaatcgcagcactttgggaggctgaagtgggaggatcatttgaggccaggagtcggagaccagtctgggcaacagagagagaacttatctcttaaaaaaatcaatgtataaaaaatagggcctggcgcagcgactccccacacttgggaggccaaggtgggaggattgcttgagcccaggagtttgagaccagcctgggcaacatagtgagacccccatctctacaaaaaataaaaaaaaagttagccaagcatatggtgtttaaggctgcagtg

SEQ ID NO: 15384 - DNA, 1105 bp, Homo sapiens
aagtggtttttctttttttttttttcaagacaagagtcttgctctgtcacccatgctggagtgtaatagcgtgatctgagctcactgcaacctccacctcccaggttcaagtgattctcctgcctcagccgccccagtaactggaattacatgcacacgccaccatgcctggctactttttgtatttttaagtagagatcgggtttcactatgttggccaggctggtctcgaattcctgacctcaagtgatccgcccgccttggcctcccaaagtgctgggattacaggtgtgaccttttttttttttttttttttttaaattagatggagacaaggtctcactaggttccccaggctgatctagaactcctgagcttaagtgatcctcccgccttggccttccagagtgctgggattacaggcgtgagccaccgtgcctggccaagaaaggggaagtggtttttcctagagctaggaaggatgagtaaggagagataggaagtgggaacaaaacaaacaaatgcttgtagacttgataggaggctatgatccagagagatagagggttttgtgataaaagtagaaagttgaatatatttgagagagatttggaaggcaagatagtcaggatttgtcgaatgattaaatatgagagagggagaaggaagtgtcgtggatgactcaggttacaatggatgatgatgccactcactgagagagaacactggaaagaggaccatgtttgagagattgagatcatgagtttgggtttggatatgttgagtatgaggtacttttgagacatctcagtggagatattaagtaagcagttgtataaatggaaattggaggtgaagcctggattagagaaaaattttagagtcaagcacctgtggaggttaattgtggccatgggatgtgattgagatctagggcagtgatgcttaaactctatggtctcaggacttccttaagctcttaaaaattattgtggatcctgaagaacttttgtttatgttagtatgcttactgctatttgccatattcagaatgaaactgggaagttgtttttttttttttttttttttttttgagatggagtct

SEQ ID NO: 15385 - DNA, 1076 bp, Homo sapiens
ctgttattttttccattttcctttctaggctttattcatatatagtatgatgtaatttttaagagactggggcctcactatgttgcccagtctggcctcgagctcctgggttcaagcgattctcctgcctcggcctcttcagtagctgggactataggctgtgccaccacacctggctttataatgtaattttaaggaaatgaacctaaagttaagtcagatatgatttactatatgaagatacaagagtatttcaagttgaaggggttagccgtgtttggggtagtgtaccagtaacctccaaaaactagacatttggtttaattttgtgactgttttgtttttaaacattagtttgcttttcattctatagccagattttcttgttgttacaagggaaaattgtcctggttccttcttgaaactagtgagggaggcatagtgagatggaaagaatgggctgtggcatcagagacttgggttcagattcttggtctgttgtgttcattagcctctgagagccttactttcttcccctgtaaaatggcagtagtctttttttcttttctgttttttcatatgaagtcttgctctgttgcccaggctggagtgcagtggtgcgatcttggttcactgcaacctccgcctcccaggttcaagtgattctcctgcttcagcctcccgagtagctgggacaacaggtgcgtgccaccatacctggctaatttttgtatttttagtagagatggggtttcaccatgttgaccaggatggtctccatctcttgatctcctgatccacctgccttagcctcccaaagtgctggggttacaggtgtgagccaccatgcccagccagtagtcttttttccagtgggccttcttgtgaggattaaaggagagaatgtatgttaagtgttttgagtaaagtgggctacccactgatgccatcattaataaatatctaattttgaattttattttagcactttattccatgaataaagtgattgatttggaaaggtcttttaaaattcttttaaacaatcaactcccagcaggcaaaaaaagcaagat

SEQ ID NO: 15386 - DNA, 1051 bp, Homo sapiens
ctgtctttgacacagacagctctggtttctagttaagcagcaacctaatcagcttatatactcttgtgcaaaactggttttcatttggtatgatatctgtacgttaaacctggcggataaggaaagttgaaaaactgcattaagcactcttacgtccaaacgtacttaggagtcttttttaattgctaggaggacactatgaaaatttggttctagcagatgtaaaggaagaaaaatttaagcccaagctgttcagtcccggaatttaaaggacttttctccctttacttttcaaatttaagcaaagagacttttaaaaaaccatggcagatgtggacccagatacattgctggaatggctacagatgggacagggagatgaaagggacatgcaactaatagcccttgaacagctatgcatgctgcttttgatgtctgacaacgtggatcgttgttttgaaacgtaagtacattccttcatcatgttcctttgggttactgtagtgacatctgttttcaaccatttgctgacttcagtttgtgtagaaatttctctagtgaattttaacacgtatctttaaaaatattcctgaagagttttgtgtttacacttttccaagaaataaaaattggtaggtgaagaaactctaggactgatgattacgatgacacaaatacatatttgttgaatgaatgggaattagtaggaatattaattttaacccatagcttggttggttcattttcaaaatatgtcatgaactggggaaaatacaaatatttattttcttaaaggtatctatttctgtaccatgaaattgatttatggaataagagatgataataaacatatgttttgaactgcccatttcttcattgatgttgtcatatgacagtacttttgttaaagccgattattggtttgtaaatttcagtttgggaaggtataaattggatcttaaccgtgtagcagaagagtagaaaatttggagtagtagaaacattttgaagtttggggagtttaaacagttttattgggaggttataactt

SEQ ID NO: 15387 - DNA, 1045 bp, Homo sapiens
agtcattcctaaaaccagttattgaaaaatttttcactcctttgcatttgatcttttactctccatttaaattaagtgatactgccgttttttcttcttgtcttgtagaagatttccattaattacctataaaatttctcctttacctgatacatgatttttttattaattaaagtttattgagaaatgaagaacaagaataacccattaattcatgatgaataaaatctgatcagctgggcacaatggctcatacctgtagttccagcgctttgggaggtcaaggtagaaggatcatttgagcccaggagttcaaaaccagcctggggaacatactgagaccttgtctctacaaaaaattttaagaaaattatccgggcatggtggtgtgcacctgtagtcccactactacttgggaggctgaggtgagaggatcacctgaatccaggatgttgaggcaacagtgagccatgattgcgccactgcactccaccctgggcaatggagcaagacactgtctcaaaaatataaataaataaaatctgatcaaacttattaactttttgccttcccaaatcaaaaaagggtacatatttactgcaggaaaaaaaaataggcatcaaaaaaaaagttacatatgaaaaagaatagagattattatattatcagacttttcttttgggtacattagagcaagtgagaagatctgaagtaacagttacaaatcgtatgttaactcataatattcaagctgtaaaatgatttttttaatacacaatcatagtcaaaaattatcactatagtgtattaatttagtgtctcaatattttggttagtaatttattctgaatttattagattgaatttgttatattttagagtattcaccaaagtaaggaaattgcatttcatcattaggcaaaaatcctactgggaagtattttcctttaactgcatgctctttaacttccgttctaaacttggccttagctacactagcaattctgaatactcttagttttaaaacttggcttctaagagttaa

SEQ ID NO: 15388 - DNA, 2004 bp, Homo sapiens
tgtttttataggccaattattaaaagctttctgctttttattttaggtaacagtacttcaatttctaccttaaggacttcctgtctactgggttgtgcagtaatgcaagataacccagactgccttgttcaagctcaggccatctcttgccttcagcagcttcatatgtttgctccacgacatgtcaacttgtctagcctggttagctgcctctgtgtgagtatagaattgtaaacgagctcttagtttcttttatttgaatcttagatttattccagtacacattttaattatactctagactatgtacaaagttatgtgttatatacgtagctatttcccctcagttctagtctttttcgggagtagggggcagctttcatgcaatcagctcctaagtctctcttctattaatttttctcccattgttgtacttgatatttggaatatttattcataaatcaatgaaaacatattgtgtgcttataatgtcccatgtactatataaatgctgtaggacatgcaaaactctatgtggtcacctgtctttttttcttctttttcatctattctaagttctttgcatcccagatggagaaataacacttttccttaatattccagcaacatatgcatcaatatctggcttctaatattgtatctactgaatgtagaaagataaaggccatcaaccagaagttcctttgaagtggttcattgtcattggttttaagacttcccctggccaggcgcagtggctcatgcctgtaatcccagcactttgggaggccaaggtgggcagatcagcctggccaacatggtgaaaccccgtctctactaaaaatacaaaaattagctgggcgtggtggtgggtgcctgtaatcccagctactcaggaggctgagccaggagaatcgcttgaacccgggaggtggaggttgcagtgagccgagatcgtgccattggcactccagcctgggcaacaagagtgaaactccgtctcaggaaaaaaaaaaaaaaaaagatttaccatgtcaccagtttctatctggacttgcctcaaaaactgagttgcatttggaattataaattggcaccatggcttttcaaatttttctactcctgcagtattcgtagcacactcccattagtaacgtgactgttgaaaatcattatatagacctttcattttcaagcttgaggcaaaatatgcagcatttcagagcttgaaagaacctcagaatcttaaaaatctgtcgtgtagattatccctacttttgtagaatggtgtttgcattattaaaaccaatcttctcagtaaaaagataaactgaagaccgaaaagttaaataaagtaacacatctagctcacctaagtggtggctaaatctacattgtgggtttctggactcctccttcagtcctcatttcattattccatactacctttgtagattttatggatagatcttatctcaactctgccacctcctagctgtgcacctttagggaagtcccgtaatctcttctagcctcagctaccttgtctgcaaaacatgaggattacacaaaatgctgcttgtaaaggcaaatgtctcaggcatttagttagtactcaataatggtagttgcctttgctgtcttgacatgtgtcttcaacatacagtatattattatattaattattgatactgatagtcatataaaactatttatttatttattttagaggcacagtctcactttgtcaggctggagtgcggtggtgcaatcatagctcacagtagcctcgaactcctgggctcaagtgatcctcccccttcagcctccgaagtagctcggactacagtaaagtaccaccacacctagctaattttttttcttttttgtagagacagggtcttgctatgttacccaggctggtcttgaacttctggtctcaagccatcctcctgcctcagccccacaaagtgctgggattagaggtgtgagccaccatgccta

SEQ ID NO: 15389 - DNA, 1088 bp, Homo sapiens
aaattagttttgcttgcttctatactttatgtaaatggaatcatacaacatatattcttttatgtctggttttcttcactcaacattatgttcaagagatttgtccatattgttgaatgtaattgtagattttgttgaatctttttaaaaacttgaattttcattctttctatagattaaacaataaacaatttttcaacaaactagatttgattcaaactgttagctgaagtaccaactattacttgcaattcttaatgatgaactatatcattctaaattggatgattgcctctgagttggaagtcctccatttctctttccacatgagtagtagcattcacatttgctgttactttatcacttgcttcaacaaaagaacaagttaatttattttatgtttcttaatgctgctgtaatgtttttaattgtttttctttgtcattacagacctgggcattacattctctatcattgatcattgattctgctggcccactctattatgtgcatgtggaacctaccctttctcttattataatgttgttgttaaatgtgcctcctactcatgctgaagttcaccaaagccttggtcgctgtttgaatgcccttattaccacgttaggtccagagctacaaggtgtgcatagctgcttttgtgatgttttacattaaaaataatacacataaaagtgaattcagttcctagtctgtatgcttggcacgtgataggtgctgtatgttttgttaaatgaatgtataaatgccattcagcctgatttctcttaccttgaaaagacagagtacaatatttagacaattacatatctcctaaagatgccttccttaacagttaaaatgacagacatgaagcagaatcatccaaagagctgtgttctctatttaagaaataaatggctaagtccaaaatttcaaatattacgagctgttcaaattgcatactattacatgattataatacatgaaagtaattcttaactaatacaagtgaggctaagtttattggcaatttctaattccactttttatgaaaatttggtataacctactgatagtcttaggttctt

SEQ ID NO: 15390 - DNA, 1035 bp, Homo sapiens
acgccactgcactccagcctgggcaacaagagactttgtctcaaaaaacaaaaaaagatataaatcacttaccatgaagtttacgcttataaggtatacaattcagggattttgagtatatttgctatactgtacagtcactaccactgtctaattccagagtcttttcattaccccaggaagaagtccattagttgtcatttccatttccctttgccgcagcccctgacgaccatgaatttactttctgtctctatgaatccacctattctggatatttcatgttaaaaaaaaatcattcaatatatggtcataaatgacttgcttctttttaaaaaatcacttttaaaaatcactttttaggcctggcatggtggctcacgcctgtaatcccagcactttaggagaccaaaatgggagaattgcttgagctgagttcaagaccagcctgggcaacatagtgagagctcctctctactaaaaattttttaaaacttagccaggtatggtggtgtgcacttgtagtagtcctagctctttgggaggctgagccaggagcatcacttatgcctaggagactgaggctacagtgagctattatcatgccactgcattccatcctgggtgacagagtgagaccctgtttcaaaaaatatatcattatggcttttatccttcgtggcacacatttcttgctgagaaactttacattatatttgtgtttataagctatttagatctgggacacttacttaaatagcatttgacatgaaacttacatgtttcatgaaagtttatgttgaatcatagcaaataataccctttcttttattgatggtgacagttacttcactgtctttgtagttagttggttagtagcccactgaggacctagtgaagccttgattttaatgttttattcttataagagcaacatggtggatagaaagtgtattaattatgtaggctgggcatggtggctcatgcctgtaatccagcactttgggaaggtgaggtgagtggatcacctgaggt

SEQ ID NO: 15391 - DNA, 1039 bp, Homo sapiens
acagaaagcatgccttttaatgcctaatttgagggcaggtgtcttgaagtttatgtagttccttctaccatttgccctctcaggactattctttgcaaacagaagtcatgtatacctttatagaggtagggagaccctaggtctatttatattagacacttcttttgcttattgtttcaaaaatggttaatgttgaggtataaaggctttctaagtttaggcttttagctatatatggatatttatggtggtttcgacacttcttattagctataggaaatctcacgaatgctacaaaaataatatcacgttttcgtatatgtgtatgaagataatgccatagctttatatctttttatttactttttcagttgtaacaatgaatttctgatgattcttgctttcacctttacccttctctcatgagtaatatttatacaatgattagtccatgttcatattgcctttaaggttattaaacaacaaaattagctggtttatattgggattgaaacaggaacctttgtctctgcttaaaactcttggcaactaagtttaaaataataactgcgctaaaattgttatttgatattccattataaagaagaatttagctgggcgtggtggctcacgcctgtaatcccaacgctttgggaggccaaggcgagtggatcacgaggtcaggagatcgagaccaccctggctagcatggtgaaaccccatctctactaaaaatacaaaaaattagccgggtgtggtggcacgcacctgtagtcccagctacttgggaggctgaggcaggagaatcgcttgaacccaggaggcagaggttgcagtgagcagagatcacgccattgcactccagcctgggcgacagagtgagactctgtctctaaataaatacataaataaataaagcaagcaagcaagcaagcagaatttggtgtgaggaggagttatcctcatatttttccagtgggatttacttactaaataaaaagaacaggaaggtaaaatcttctcatgtattcccccaggg

SEQ ID NO: 15392 - DNA, 1041 bp, Homo sapiens
ggcattttccagctgctttgctccagagcgctctctcgtacgcagacacacacctccccccccttctctctctctctctctctctctctctctctctctctcaatttctctctctctctctctctctctctttctcgttgggggactgggaggctcggctgccggcgcaacaacgccactcagttgcagtttcaaacacttcccttctctggagtattgcagccaggaggaaagaaagaaacagaaaaaggaactgggaggccacaggagcgagctggggcaggacacagtcccgggagctccttgggggcagcggaaatcaatacggatggggggtgcgctggcccaagcagatgggcccaagagccccgtgggcggtgcagcagcagcacaagcaccttgtggctctggcgctctcagcagcgttcccaaagccggagcatctgcatcagtcacggacgtacaggagtgcagaccccagggttcacaggtgaatccccgcgcgtttaaactcacatacagaagcccctcccgactcgggtcccgggacttgggaccggactgccaccctctgggatctagcccagccgcaccccggtttgacagttcagcaaggcctagagaaaggctggctactcagtgcagggcccgggctagaatcctgttacctgggtagaccctggtcagagcgttttctccactaaaccaatcagaagcgtgtggacagctttttacgcagagacttgggtcagtcatgtgtcaaccaggcaagtagaaaggactcccaaagcatttccactttgaatgaatgaaagcgcctgatggaaaacatcagtcctgtgtgaggttctgcatttgactttaagcttaagaaaaaaataaagacctgaaaaggggtcctccattcggtctctacgactccagtaaagtagggctgggagttggaaacttccaaaggaacacataaatgtttttcgtggtagaggtgtttaatctgcatgatggtgtttaagttctctttggagtacactctacaggtag

SEQ ID NO: 15393 - DNA, 1032 bp, Homo sapiens
ccaagtttaagaggccaaagaagaaccccagcaccaataaatgagacatggggttttattaggtgcttatttacaggagagagagtccagtggcagtgggctggccaggagaactgttaccacctgcaaacatcatgctgtttatgtagcattttcacttaacaccctcccctcaacaacctctacctagcaaccttcatttaacccaacactaagggcctcaatgccctttacagcccatattccacgggatggacccagggctcggatatttaccataggcaaataataaatctccgggttgggcatgcctggattccctagctcaaaacacacattcaggtggcatctgccatacagggtccattctaagagtatgcttaaattattactatcaggtgcgttaaccctaccgtgtataggtgaaagtattgaaactttgaaactggccttaagcttactagctgtgtgaccttaggaaaattccttaccctctctgtgcctcagcttccttgtctataaaatggggctcataatagaacatatttcctgttggcttttatgaggcttaatgagtgaatatttgtgaagtgattacaacagtgcctgccacacgatgaccagcatattcatgcttgtttaataaatacagacactgtgataactactgccctggtagaagaagttagtgtcttatctctgaagatttaaataatggaaagctacctatttgcctccttgtatgcgcactgacttgcaaaacagtttcgccatttgacacctggactctgagagcaagagaagcaggaaataggggtttcagacagtgccaagcagagccgaataagaccttggcttagggagcttggatggaagggtggaggaatggaaggcaccttgccgtggggcagcagctgaaggcactttttctcatttcgcatttcccaaggtgcgttctgcctctatacttcacttgactcattgggaaaatggaatgagtagacgagtaatacttgaccctgtgcgagcact

SEQ ID NO: 15394 - DNA, 1067 bp, Homo sapiens
tcagaatactagtttaaagctccttcaaccagatagttttgaaatcacgcttttctcaacaaatcttaaacaatggattttcatttattggaaattttgcaaataaaatgagatctaattagtactttaatttggtgagttaaattttgtataaaatgccactttattataacttgttcaagatcgagtcatactagtgaatctgtctcaaatcatgagcaatgtaaaatacatttctatgaaaatacatgttgcaactgttagcagagaagtggtaacggcagggtgggtgtatccccttctcacctgtgggtctgaaaaatgatcatcattgcctagtggatggtggaggtcactgatgccaagtttttgaaatggtttttacatgcagtcaagctgcggttgatggcattcaagagcattctgtttaggcattggaatggaaatcctggacttttatttttcaactttacctttggacttgatgagataggttttttttttttttttatgaagtcagctcactggtaactcttaacagaaccactgtttccttttccacctgtggcatttggggaccacttttttatactgggttttgactgttacggttctatatatctgtgtatatcttcaaaggatacatatacgtttgttgtctggacatggctgcatacgtgtctagagcacatattctggtctagagccagcctgggccggcctgattcacctctccactcatttcctattgctacagagctaaggagaggcctctgggaatggggatggtgggaggtggggtgggtacactatataatgtcagtggacagagcggtaaatgtgtaaggggacatgtggatttatcagtatatccaagaatagaactataggactatactgtatgtgctgctgtagatgacactactgtgttaaacttgcgtaaacttcaaatattaatctagtcaggaagttttagaaaataaaaagcctgtactaaagtaggcatcctcttgatatgtgtcagtttattgcttggcatgtttgttatatgatcattaaattactct

SEQ ID NO: 15395 - DNA, 1027 bp, Homo sapiens
cttttatttatttttatagagatggggttctgccatgttgcccaggcctcccaaagtactgaaactacaggtgtgagccaccaggccaggccaacaaaaccccttttaaacacaaaatattgaagattcaggcaagaacatgcagtattgctagagaagggcctattgtgctttctttgtttagttttactttttaggttcactatagaacctcaagttgtcttttttttttttttaactaaactttctttcctttcttagtagaaaaatccttgaggggccctttcttagtagaaaaatccttgaggggggaagttttttaaagtaacttactgtaaccataaatcacttgccgttggttcttgttcttcctgtaatccattttatgtacttttgctagagtgtagtagtcccaattccaattctaatcatgtagtctctgtgcttaaaacaaaataatccaaaaatccaaccatgctccttcttcattatctactatacaacactgtaaagactgtaaacttagccagctttgacagccctctacatctgaccacatctgacctttctacacttaatttcccaccactgccttcctttcctcccagtccctgaaatgctagaaactaatttgccaggcataatgagcttccccattgtcttccactcatcaaaaatccatctctaccgccttctagtgcctgttccctgaagtcttcccttctgctccccagaactctgtcgtggctcaatccaggctgcccagtacatggatttattgggctgtttatgctgtccaccgtgtgcttagaaattccttgaatgcagagactgttaagctttgtatatacttttagtgcctagaacagtcccttatacttcataggtgcttgttggcttaatttcatcttcaaaaggaactttgattttgatggatatttgaatgttaaaaaaaaagctagaattttttttgggggggatagaggggaatgacgggggaagatgggtggctgcagcttagtctcta

SEQ ID NO: 15396 - DNA, 1071 bp, Homo sapiens
tccccgtacttagggaggcggaggtgggcagatcacttgagttcaggagtgaaagaccagtctgaacaatgtggtgaaaccccgtctctacaaaaaatacaaaaattagccaagcatggtggtacacacatgtagtcccagctacttgggaggctaaggtgggaggattgcttgagcccaggaggttgaggttgcagtgagcagtctttgcaccgctgcactccagcctgggtgacaaagcaagaccctgtctcaaaaaaaaaaaaaaaaaaatccaatatgcacttatgcacttatgcagttgcttgaatatggtggggaactgtggaggaaaaaaattcaaactttatggtgctgttgcatataactattcaaggcatgagtctttgcagccgcttggaaagaaggggcaccttaattcaactgatgggatttgggcaatttttgcagtaaagagaaattaagtgaccctgttgcaagtgaccctttgggtctgtttagtgtactgttgtagcttccactgatgaatatataattggcatcaatgttttacatgattgtaatttgaatgcttataagtgccagaggtgatcctactgattgggaagagatgctgtattagtctgttttcatactgctgataaagacatacctgaggctgagaaatttacaaaaaaaaagagatttaattggacttagagttccacatggctggggaggcctcacaatcatggcagaaggtgaaaggcacgtttcacatggcggcagacaagagaagaaagcttgcgcagcaaaaatccccctaatataatcatcggatctcatgagacttattcactatcacaagaacagcacaggaaagacctgcccccatgattcaattacctcccactgggtccctcccactacacgtgggaattcaagatgacattttggtggggacagagccaaaccatatcattctgcccctggcctctcccaaatctcatgtcctcacatttcaaaaccagtcatgccttcccaacagtcccccaaagatttaactcatttcggcattaactcaaaagtcca

SEQ ID NO: 15397 - DNA, 1044 bp, Homo sapiens
gccatgagataataatacaagcttggcggttttactttgccccaagagataatccaaggaaggctgtgaaccaaaatttcgggtaaagcagtctccatgacattttgagttttaaaggccaaacctccccagactccaaggagcactggggccaaacagtagcaaaggatcgtgtcacctgttaaccagaccctctgcttagaactgcagcacaaagacctgcatacatgtaacaccattccactttcccattcaacagtaaactccagattccaaacaatgttggggccaaacagcattcattgcaactgcaagagtaaattctaaggagggcctagtattagacctcagaacctctgccaggagcatcccctttgggcaggttgaggtctgcaggacccctggagcaacctcctgtggggtccaatcttggagtgccagatgtctctgaccttaggtgggcaccggtgccacatgcagattttcccctccagagcctactatgagctttagaagaatagccataaactgtaatgagaactggatgctgggtgtgccttttccttagccagttgagtttgataaaggaaaaatttagtgtaagaaaagaagatttaattcccctgaaaaatgggtgagtttgctccaagctgcgccacatgtagggatcagggaccgtgtgcggaaaagataaagagtccacggcaactataaacagatgctgaggcctcacgaggtggctcacacctgtaatggcagcactttgggaggccgaggcggggggattgcctgaggtcaggagtttgagaccagcctggccaacatggtgaagccgcatctctactaaaaatacaaaaattagccgggcatggtggcgggcgcctgtaatcccacctactctggaggctgaggcaggagaactgcttgaacccgggaggcggaggttgcagtgagctgagattgtgccactgcactccagcctgggtgacagagtaagactgtctccaaaaacaaaaaacaaaaaaacagccgctgaaagactga

SEQ ID NO: 15398 - DNA, 1032 bp, Homo sapiens
cccggctaattttttgtatttttagtagagacggggtttcaccgtgttagccaggacggtctcgatctcctgacctcgtgatctgcccaccttggcctcccaaagtgctgggattacaggtgtgagctaccgcgcccagcctagaattgattttacaaaagaaatttgattaatataggattggattgctttaaatgttgttttagctttgctttttaatgtgactatatcatttagtcacatttaatgtgatttaatgtgacttaaataattgaaattatttagactagtgaagatgtataagtcatacccactggaacaaaggtctatgaccttttcccggtgagaaactacctttaagttttccaaagtcttgtgattagattactaaagtgggtgatgatagtttagagttactgattggaacaggaaatgttagttgctatggttttgtttctaatgtactgtatttatatgtaaagcatttcctctctttattataggactttttttttttaagttgctgataatggtctttttatgggccaaaaaaaaaaaaaatctttatttctttcctagcttgctggaaacttagcttatgtttaggagattcctcttaaagaaagagaaaacaacatacagattctatatatggcttcacatctacttgcttttatgtccatggaacccataaaatatttatgttatgcccaggttatgaataacctctgattgttcattcagcccttgaacaaacatttatcttcagcacctgcacagtatcctgtcacattatttgctcaattctgggatggttcatgaagcaactgctttaccaagcaatgtactatggctggaagcaaaggctcagtaggggtgctctgtcaaacacttaaaagtcagtgtttagagacaagttataaacacaaaacagaacagcccattttttagtttttgaggttgtattctattcttgttctctattgcttgagtcatggaaccccctctagaatatagacctgattaatttgt

SEQ ID NO: 15399 - DNA, 1620 bp, Homo sapiens
gttaactccagggccctactgctttagtttgaagaaaactgctctagcctgtttaacatgttagcctttatatttggctgattcagtgagaatgttaggatatctcttaactgtactccttagaatattaactttttctttagtagtttttggttggtaaaggttgaaaataatgaaaactgtgcttaacaagaactaaatggtctataccaggacaggcagagaaagtcatggttgggttaatggcagtgggaacagaccacacattgatattctgcagcagtgtttcagcatgtgattctagtgatttgtgagtagtgatcactataggtcctgtctccattttcttaaagactttgtgattcctccagactatgagtgttgtaacatttatggcacataggagctaagatagatttttttttccccctaaaacagggtcttgctctgttgcccaggctggagttcagtggctggcatgatctttagttcactgtacccttgaactcctgggcttaagtgatcttcccgcctcagcttcccaaatagtggggactacaggcacacaccaccatgcctgattaatttttaaatttttagtagagacagggtctcactaggttgcctaggttggtcttgaactcctggcctcaagcagtcctcctgcctcagctttccaaagtgctcggattacaggtgtgaaccatcggacctggcctctttttttttttaaaagaacaaaccccaaatgctcaaatttagtaatttaagctatgtgttctagaagatgtacttgatagaggatatatactttttataaattggaatgttgaaaaaatagtagttatgatcaatagttatgagaaatagaagttttactaatacaagcgttttggtcagcatgtattatatatgtttctgaaaaactgcaaaataatatggtttataggaaaatattattgagtcagaccacttaaaatgtatgcaatttagtaagcaagcactaacaaacacaatacttggcatcttgagggaataacttggatgtcccagacaggcaggcagctcagcttcactggaagctgcccgaggggacatgaacaaagcatggacaaagttgaatggaaatgtcagcagtaggtgctgatgtaatacagacagtgtgggctgccattgaggcagtgtagggccagtgccacctgccacattggctgagagctgtgctaccctggaggtgcctttctctgaagagggagactgggtacaaatgcgaatttctgattttcttaaaatagagttaaaaggacttctgcctgtatagcagctgagttgagagatgtttcctgcagaaggtgatacagttgacccttgatccacttgggggttaggagtactgcccccaggccctcatcctcaccctgcaggcagttgaaaatctgtgtacaacttttgactccccagaaactttactaatagtctacttttgactggagccttattgataacattaacagtcgattaacatattttgtatgttatatgtattatatactgtattcttatagtaacgtaagctagagggaagaaaatcataaggaggaggaggaggggttggtcttg

SEQ ID NO: 15400 - DNA, 1116 bp, Homo sapiens
aggtagaactaaggcagtggaagagggatgaaggaagggatgtagtaaagagatgtttaggagatagaatagacaggacatagtgactgaataagtaatacatgggctgggcaagggagaaggagaaaacatagaatgtaggaaggaagaacagggttagaggttaggtcataagtctggttccacgtatgttggatttaaagtgcctgtgaggcatctaacctgcccccaccaaactagaatgtaagatctgtaaggctgaggattgtgtctcttcactgctgtctccctaacatgtaggacagtgcttgatacattgagggcactcagttgtttaataagtgaatacatccaggtggctatgtctagttggtaacttgaaattcaaattgggaacttagaataaaaagtctaaattggggatataattaggaattattagttgagaatggctgatatttccaatattagctagcacccaagggaaaccagcatttaaggaccagagcaaagatgattggttaatggggctgagaggggtaggaggcgaatcagaggaggcttcagaagttgagagaagctgacgcagtggctcatgtctataatcctagcactctgagaggctgaggcaagaggatcacttgagcccaggagtttgagaccagtctggggtctgtagagagatcctctctctacaaaaactaaaaattaacagggtgtggtcacacatgcatttagtcctagctacttgggaggctgaggcaggaagattgcttgatcacaggagtttgaggctgtaatgagctatgattgtaccactgcattccagcctgggtgacagagtgagacgcccgtcaccattttttattttttattttttttttgagggagtctcactttatcacccaggttggagtgcagtggcaccatctcaattcactgcaacttctccctcccggatttaagcagtttcttgtgtctcagcttcctgagtagctgggattacaggcatgcaccaccacgcccaactaatttttgtatttttagtagacacagggtttcgctatgttgcccaggctggtctcaaactcctggcctcaagtgatcctcctgcct

SEQ ID NO: 15401 - DNA, 1030 bp, Homo sapiens
ggtgcctgtaatcccagctacttgggaggctgaggcaggaaaatcacttgaacccaggaggcagaggttgcagtgagccgagactgtgccattgcactccagcctgggcgacaagagcgaaactgtctcaaaaaaaaaggaaaatattgttttgtgagaaatttaaaaagcaggcttcaagaatacatagtgttgaaaaatattggccacattttcatctctttagccctacctctatataataggtttttcctcccccaaataaaggacagtaacatattatttagtacacaaatgagccctttgaattggacacattttttttctgatgtgcttgttaaataagaacagtgcatgccagagtgatggcatgattctctttgcacttgatttcagttctaaataatatgtttattgttttcaagaattactttaggtggagtaactacttgttctcctgtactcgtagccttgctcctacctttgtattccttatcttcattaatagcatcactttccagttgtgccggcaagaaacctctgagtcatatccttcatctttatatcagaacagtcattgaggccagttaatttcaccttggaaatgttgtttatcccatctttcatgtgcttggttccatttaagctccttgcttcttcctgcttggatagtagcagtacctctccttagtctctgtctttagtctttctactttccaattcagtcgtcaaattacttatattactaaaatgattaaaccatatagcacgttagtgaaaaggacttccttggacccctttttttggggggtaaggtccaaactccttaggctaacattcaactctgttcataaccttttctgactggcttcatttctcaatatcccctcccccatattctagtctactccccattgcccaagtacgtctacacttgactgtctgttttatgcatgcatttcagtgttttttttccccctcaccttttctttcgcttcaaattcaacttgaatttggcccagatgcttgc

SEQ ID NO: 15402 - DNA, 1055 bp, Homo sapiens
gagaccagcctgaccaacatggtgaaaccccgtctctactaaaaatacaaaattaggtgggtgtggtggtgcatgcctgtaatcccagctacttgggaggctgaggcaggagaatcgcttgaacctgggaggcagaggatgcagtgagctgagactgcaccattgcactccagcctgggcaacaagagagaaactctgtcttaaaaaaaacaaaaataataattttttgatatctcattattagaacaaagttttcatagtgcaatcagagcagttttgaaatgtgaatatactggtaaactttttaaattgaagagttgtggccagtatctcattaagtctattcacactgttgtaaattgataatcgtaccataagcttaataacccactggccacattgaaagtagcaattgtaagaaataaaatatgtataatcacagctcccaaagatagcagagttggtatttgctatgtcacttttatttcccagtcttcagtatttcttaggattttctttgtgtaaatccagttatgtgtacaagggatcactctgtatttattacaaccacatattaatacacaattagctaaattaaaatttcaatttaaaattatttgcaaatcatgcaggttttataaatgtaagatactgttactactaacactgtgattccaaaagagtaaaaggataagacacaatattgcttattttcccacttctgaaattttcattaaagtttttttaagttgaaggggggaaaatcaaattaattgtttagtatgtctgtattttcatctgcacaacttattaaatatttagacaaagaaaaaggttaacattgagagttgttacaacttgtctagtaggttatatgagagacactgttccttatgctggtttgtatacagtggttttcaaacattaatttcattccaaaagatagaaagttataattcaagatcttaagaaataagtgaaataagaaaagtttgttactttggtagtgtcaaagttaaatattggttgaagtcaaatgttggtcatttataata

SEQ ID NO: 15403 - DNA, 1086 bp, Homo sapiens
tttttaaatgatttgtgtaattatctgttttctctgcaagaccaaaactgtgtcatgttgttcactacttcctaagcctataatgcctggtacttcataagcaagcaataaatatttcataaatggaattatatattcattagtaaatgtcatctttgtttttatcctaaagggaggaagaaagggaagattttgatactagcattgagagcaaagacacagagcaaaaggaattagatcaagatatggtcactgaagatgaagatgacccaggatcacataaaagaggcagaaggggtaatactgaaatttctttagggcattcttgtgtatttgtttttaaccaataaagcactttattaattcagctcctctgaaatatattgattgctttcatttgtgattccaggctgtgtttgtttttttaaatgcccacctcatagctgtgatgagttgtaaaaatgtgttatgaagtcctattagtacatttatgattgggtcattatttacacaccatctatactttagaaagaagatacaatattcctatgtcgttaataggacagtttctcataatttcaacttttggttagtcatcaagcttcattgaatttttacatttactacttttttgggccaaatagaaatttgtattctataatgtactcattcagcatgcattggatgcctcctatgtgctagagatataaagatcaataatgctcataatttgtatcatgttgatgaaaatggtaatctctcctgccttaaaattatttcataaattgctagatcaaagcaaatacatcttttaaaagttgttaatacaaatttcttgtgtatttatttaatgaccttatttaatgactatcaaaagaaatccttaattaattctgtgcctataatttgcatgggatctttttttctgtattttttttaaatggttactctaagtagatagaaaatttcctgtatcatggaagctgtattgtctgattacaatgcaattgatttcaacatctaaagcaaacctaatatgatcagagcttttaaaacatactttctaaatattgggtcaaaagagaa

SEQ ID NO: 15404 - DNA, 1051 bp, Homo sapiens
ttatttattattggccacattttacatagttactgaagatcacatagctaataagtgatgtaagagactacgcattgtttcattaaattctcatactactcttttgaggtagatattattttctgcattttacatataaagaaactgaggcttagtttgaagaaacatggctaataaggaattgatgggatacaagttcaagcaatctgatctagatactcattacaattatgctatgttgtttcataatacggtaaagaagttgaaattttgaatatttgtttctctggcattgcctgtaaaattacttgtctttgagaagatctaatttctttggcccttggtctccctgtttttatatcaaacctgagagattttgaccaccaatttaaaaaatcttacatttaatacatcagttcctctctttagtcttatatcatgaactaaaaagcccttcaaagtatgggaacaagagcatcctctttatatagaacagttttgtgtatttgttggatcattgtctagtgttggaattgtatgcacctaattctagattatcatgacaataaatatatctgttgcaggtagtcataaaatactggatataattcaactatattctcttcgttgtgatgtacccaagtgactatcactaagcaaatcctagaatgatatttacagtttcttaagaatgacatatgataaagagttaaagaatatattttagcatattactttatttaacacaattaaaaatacatttcattggtttttcatttcctaaaggcctttttatagcctttgtcttaggaaattataactttctatagatggtataggttgaatgtggtgattgctgcaggatgagagccaacaccttttacaactttgtatctaggactgttgttaattttggagtgctcattaattaaatttgtttggctttatatgtaaaatgaacattgatgaaattttaggtctagtatttttctgcaacagaagaatatgatttctgtcatttgggctagattaggtctggtaggaatgactt

SEQ ID NO: 15405 - DNA, 1017 bp, Homo sapiens
ctgggatacagacgcccgccaccatgcccagctaatttttgtatttttaaaatagagacggggtttcactgtgttggccaggctggtctcgaacttctgacctcaggtgatccacccgccttggcctcccaaagtgctgggattacaggcgtgaaccactgcgcctgaccaggaaatactttaattgtaattaatactttaaaatgaaaatactactgctgatttcattttagatctgacagtttttacatcagagttaaataaaattttacttctgagtttgaactagataatttgccctttaagttctgcacgcttaaatatctggagtcagtgtatggtacgtgttaatgtaggaataattcttgaggcaaaccttttcatatttttaaaacagtatgttcactattttgtttaggatttacctcagtcataggaaatgttaagcatttctaataagagattgatttggcctcctgaataataccttgagctttgccatatatgagatttaggaccagaaacttgattaaacaatacttgagtgtgttgcataaaaattcacagtaaaacagaactgttaggagacatcttgatatcagaatattggtacagaaagatgggacattcctccagtcagatagttttgttgaccttagataattcaggatcatcttccttcatgcctggtctctgaagcaacaggatattgatgagtgtgcattgatgtttgttgccttttgattttacagcctgagttcaagcaaaaatatatttatatctagcttgagtgctaaccaccataggtcccttattaagaccattttaagcaatatgacccctattgtcacctcagataatttagtcaattaaatgataattcttttagctattatatttattagtggtcaacagcattatagggttattgatcaaattctaacaatacaagacataaagctgtatttaattccagatttgaattttgtagttttggaagtcatggtggaaaacaaa

SEQ ID NO: 15406 - DNA, 1036 bp, Homo sapiens
ggcatgcatttagcttgattgctaggtaaggattctgcctatttccagaaatggccaaagtgtccaaatcaaactcattcaacttggcttataaagaataatttcagtaaatcaaaattagtagatggtagattaattatgttccaaatcataaggagctactacattgaaggtagtatttcacagctgatttgacttcagaatgtgggttaagagactcttactaggaaatatagtcagaaatacactcagcctaaagttatgttcttagtataaggaagaaaatgttcctttctcccggtcccttgtcaggaactgtgatttagtaaagttggaacaagttcaggacatctataattttagaagtttcaaaggtgattgtgataaacagcaagggttgagaaccagtagcttacaaataatacttcttaatagttaggtaaaaagtatgtcatctctgccttttaagttttcctgctcttggttcaaatagttatataaattgttcaatatttcaggaacttccagaaccaacaccagtgaaaactagactacctcctgaaatctttggtgatgctctgatggttttggagttccttaatgcatttggggaactttttgatcttcaagatgagtttcctgatggagtaaccctaggcaagtgctttagttatctattgctacattatagttcatcctaaaattagtggctttaaaaaaacaagccaccttgtaaagttctgtgggggcactggagttgggatctctctggtctggctagatgttcaaaatggcttcttctcacacaggtctggtgcctcggtcctcttcatgtggcctttcatttcatcagagtatctcatacttattatgtggcacctgggggctctaagaagcaggaagcagaaactgctagccctcttaaagcctaggcctggaattggcacagccttacttctgccacattccattggtcagagcagtgagaggccaccgtgggattcaacaggattgtggaatagactccacttcttga

SEQ ID NO: 15407 - DNA, 1055 bp, Homo sapiens
ttatcttgcaatttcaaacaccagaatcaaaaagtaagggtttcaaaagaccgagtaagagaaatagcctgaattataagaaataagtccatctattctaatattgttgcttttaattattgttccctctttgtatctctaggctgttatcagattcaaatgaatcttgaaaatgacaaatttattacaaacataaggggaagtttcattttaggcagtctaataatttattttgctaggatcttattgataggaagtagagggaaagctatagatcaagtcagattaaattaatatttattcaagagctgcccaggcgggagtgcagtggtgtgatctcagttcaccccaaccctctcctcccgggttcaaggcttcttctgcctcagcctcctgagtagctggaacaacaggtgcatgccaccacgctcagcatgcatatatgtgtgtgtgtgtgtgtgtgtgtgtgtatgtatatgtatatgtgtttgtatttttagtagagatggagtttcgccattttggccaggctggtctcaaacttctgacgtcaagtaatccacctgactctgactcccaaagtgctgggattacatgtgtgagccactgcactcggcccattttcagtctttatagtattattttgataggtattattttgatcagtggttctaaaactttagcgtgtattaaaaaccaccagaagggcttgctagaacaccagttgctaagtcctaacctcagagttactgcttcagtaggtatggggtaaggtccaagtatttgcatttctaacaagttctcaggagatgccgatgctgccatataaatttcttacatgaattgttattaacttttaaaaatttctaggaaagagagaagttacgtgaagaaaagcgaaagtatgtggaatacttaaaacagtggagtaaacctagagaagatatggaatgtgatgaccttaaggtataaacatgttatgtgatgtttagcacacataggttttacatgtcctatgtggctttgctgatgaaatcattcttatttaatagcag

SEQ ID NO: 15408 - DNA, 1050 bp, Homo sapiens
tttaagaggtaaaatacgcagtttgaaaaataaaataggccgggtgcagtggctcacacctgtaatcccagcactttgggaggccaaggcaggcagatcatgaggtcaggagttcgagaccagcctggccaggacggtgaaaccccatctctactaaaaatacaaaacttagccgggcatggtagtatgcgcctgtaatcccaactacgaaggaggctgaggcaggagaatcgcttgaacatgggaggtggaggttacagtgagccaagatcacgccactgcacgccagcctgggcaacagaacaagactccgtctcaaaaaaaaaaaatgaataatgttcttatcctacttgaaaaataaggtgtaataatagtgtttcagcaaatctttgattgtggtttccagtgatacatattccttagagaattctatagctggtttcctccaaagtcagccattttcagagatttcttgggatattcacaagtagccttagaggatcatattacatgctctgtgctcattttagttgtctatcgtctcccttgaattttgttttttaattatactttaagttctagggtacctgtgcacaatgtgcaggtttgttacataggtatacatgtgccatgttcatttgctgcacccattaactcatcatttacattaggtatttctcttaatgctatccctcccccctccccccaccccacaacaggccctggtgtatgatattccccatcctgtgtccaagtgttctcattgttcaagtcccacctatgagtgagaacatgcggtgtttggttttctgtccttgtgatagtttgctgagaatgatggtttccagcttcattcatgtccctgcaaaggacatgaactcatccttttttgtggctgcatagtattccatggtgtatatgcaccacattttcttaattcagtctatcattgatggacatttgagttggttccaagtctttgctattgtgaatagtgccacaataaacatatgtgtgcatgtgactttatagtagaatgatttataatcc

SEQ ID NO: 15409 - DNA, 1035 bp, Homo sapiens
tatttttagtgaacagtaccataatgtttaaaaaagaaacctgagatcactcttacctacttctcttaattactttgctcctgaaataccagtgttgataagttctgtctttcagaaacttttagttcaagttctcatttggcctgacattaactattatagctataactagcatttgagaattgactgtgatcaggcactgtgctaagtgctttatatgcattttggtcagttctggaagagtgttgtaattctaatttaacaaggaaaaacctgagacttaggaaggttaattggctttgtacaaggtcatctaactagcacattgcctgacagaataatttttaggtgagtgaatgaagcatgacatggtcctgtataagtcttttgatacatctcttctttttttttttttttttttgagttgctgcttttttttttttttttttttttaaagagatggagtcctgttctgttgtctaggctagagtgcagtggtgagatcatagctcactgcagcttcaaacttctgggcttaggcagtcctcctgcttcatcgtcccaagtagctaggactacaggtgcgtgctaccatgcctggctaatttttaatttttttttttttttttttaagtagagacacagtcttgctatatagcccaggctggtgtcaaactcctggcttcccacctcagtctcttgaagtgctgggattacaggcaggagccactgtgcccggccaacttgctactattaaccagaaaaataaattactgtattacttgtccatgtcttccattaaatatagggtttgggatgcaaaatttgtgggatttatagtagtaaatgtgtgtcctttagcatgtctgacagtagttcatatgttttgtttggacaatgtcaaagattgtaacctttaaatggagttagttataaatcagatgagtgtatacataggtacaaatataagtaaacatgcaattattcattaataataataaatacaaagtctctaatttattggaatgcctcttg

SEQ ID NO: 15410 - DNA, 1073 bp, Homo sapiens
ataagtcacacttttgaaccacctgacagtaaatggaaggagaggagacttcactgatggatgaataagtcctgagagaagaggatacattgaagagcagattataaattgataggaagttgctattaatttattttttggccaatgaaatggtctttttttttatttttatttatttttgtttatttttttagatagtctcactcagtcacccaagctggggtgcatgcagttgtaggatctgaatagctggaattacaggtgtgcagcagcaccaccatgcctggcttttttttttttttttttttttttcagagacagagtctcactctgttgcccaggctggagtgcagtggcacaatcatggctcactgcaacttccacctcccgggttcaagcaattcttgtgcctcagcctcccaagtagctgggattagaggtgcatgccactacacccagctaatttttgtatttttagtagagacagggtttcgccatgttggccaagctggtcttgaactcctggcctcaagcaattgatccgcctttctcaccctctcaaagtgctgggattgcaggcgtgcaaatggtctttacaagaagcaaaatgtctacagagcaggtacagatgcagattatctttgcttggcctttcccttgctttggcaatcactatgcttccatataaggggatatttataaaaattggattgtttttgttcttggaatctactttggcttccgcaatgccaggtccctctagggaatgagaagaagagaccataccctggagtctctagaaagctagagatagataaaaactttccaggatattgaagagcatgtcttttagcagaggaaaactgaagatacacaggaggagaaatacaatgcaacgggataaaagaagaggttacaggctggaagagaacccttctgacatcagaatatgaacaattatgaaggatatggacatttgatgttgagaaggaagtcaaagagcctaagtgaagatctcttctttcattttctaatgttaaagcactgagactgggacttgaggaaacgagaaa

SEQ ID NO: 15411 - DNA, 1048 bp, Homo sapiens
gtaactttcaaatttaaaaaccttattcaggttctgtgattcatgaagtgaattttacacaaatgtttataaagtgatcagtgtttaataaatatctagcacacctaatagattgcctttccttaacagcaggatttgccttggatgcatataacggaagtgtttaatggcataaacagaatggaagtttttgtcttgtgtaaaatgagtccagaagtgtgtagtgtagggctggtatgataggtccacaaagttgtcaggaactcaggcttttatttgttttctgcttcatcatcctgttgttgtaacaatcgttttcattgttcaggatggctcaaaatagaggaaagacaagaagccttttcctatgcatttttcacattgaggccggttagtttgaaaatactgttactatgttgaaacaaaagatcacttgtcaaatctgtggtggcttttcatatttaatgtgttgttgtctctgatcttaaaatgttaaccttgctgtaaggaggcaagactatcttacatgtttgtgtcaataggctggacggcacaaagctgagcccacaaacaattgaatacctatttatttgaatatactacttagaattttaaagtttttggtagttttaattaatttggttgattctgcagccacactaattaataaggctttaataagatacttttgaatactaaagaggttaagcagcatattaataatatccagatatttggaaactaattagaaatatgtaggttttaagccatggattttgtgtctagaattttctttctaaagatttttgtggctgggctcagtggctcatgcctataatcccagcacttggagagactgaggcaggaggattgtttgaggccaggagttcaaaacaagcccaagcaacatggcaaaaacgcatctctacaaaaaaaaaaaattagctggggtggtggtattcgcctgtagtcccagctacttaggaggctgaggttagaggattgcttgagactgggaggcggaaatggcagtgaactaagatcacac

SEQ ID NO: 15412 - DNA, 1032 bp, Homo sapiens
aggctgaggtgggaatcgcttgaacccaggaggcggaggttgcaagtgagccaagattgcaccattgcactccagcctgggcgacaaagcgagactgtctccaaaaaaaagaaaacacaggtaagtcttatttggctagtgattatgttactaatattcaaatagaatgaataaagggcattgtagtgccaaataatttagccctacattaataatttgctatgattggcaatcagaatgggctgatgtttacattttagttttctctccaaagatatgcttgcaatttccttcatctccttccagttagtgagtcagttaacaatactgattttgaggagtttgagagcatcctgaccatcatggtgaaaccccatctttactaaaaacacaaaattagcagggcatgatggcgggtgcctataatcccacctacttgggaggctgaggcaggagaattgcttgaactcgggaggtggaggttgcagtgagccaagattgcgccattgcattctgtcctggacaacaagagcgaaactccatctcaaaaaaaaaaatattgattttgttgttataaatgtaccctaaggatggttaaacaaacaaaagaaaaggttatgtttgagctccccaaaaggggtctacaagtaggtggtctagctagaaaataccagctagaagaatttaagaagggagtaataagtataagttttttgtttgtttgtttgtttgtttgtttgtttgtttttgggggggagacagagtctcactctgtcgcccaggctggagtgcagtggtgcaactttggctcaccacaacctctgcttcctgggtcaagcgattctccacctcagcatcccgagtagctgggattacaggggcccaccaccatgccaggctaatttttgtatttttagtagaaacgagatttcaccacgctggtcaggctagtctcgaatttctgacctcaggtgatccacctgcctcggcctcctaaagtgctgggataacaggtgtgagccatctcgccca

SEQ ID NO: 15413 - DNA, 2136 bp, Homo sapiens
tttctttgagacggagtctagctctgtcgcccaggctggagtgcagtggcacgatctcagctcactgcaagctccatctcccgggttcacaccattctcctgccccagcctcccgagtaactgggactacaggcacccgccaccacgcccggctaattttttgtatttttagtagagacagggtttcaccatgttagccaggatgatctcgatctcctgacctcgtgatccgcccgcctcagcctcccaaagtgctgggattacaggcatgagccaccacgcccggcctatgtggtcttctaagaacgccatgcaaacagattttaaggcatctaagtattatttccttttttttttacttcactatgttgcccagatggcctcttgggctcaagggatcctccctcccaccttagcctcctgagtagcttggactacaggcatgggccactgtgccttgttctcattgtcttttttttttgagcaaacacaatcattgtttaacgaaacgctggaagaatggtgaactggaactcaaatacttggatgattcacccatcttctgtcccctcccctggaactggagaattaaatcaggaaaaaagatgtggaaatcatacaacaaaggaacattttggactcattgtgtagtcatcattcagtccaaagatagaattagagtttgagagaatctgaaaaattgagtcaaactataatcataaatttggtaatttttaaaattaaagtgggctttgggcaacccattttcagacttttttttttttttttttttttttttttgagctagggtcccactctgttgcccagggtagagtgcagtggtgtaatcacagctcaccacaacctccatatcctgggtttaagcgattattgtgcctcagcctcctaagtagctgggactacaggcgcctgcaaccatgcctggctaatttttatgtttttagcagagatgggatttcgctacgttggccaagatggtcttgaactcctggcctcaagtgatctaccagcatcggtctctcagggtgctgggatttacaggcatgagccactgtacctagccattttcggacctttttacaagcatctctttttaaataagaattggcatgttgatgtagtctttgaagtagatatcaaaatggttaatttgtggataggtagctgtttttctgcataatttccacctttaacctcttctacttcaccagttctacctatcgttctttgggtctggaaggaatctatgtatctgtcaaaacgtagatatcttccgggtctgtgaaagtctacattttgcaaccacagtaatggctatggaatacatactaattccgtctgggagaaagttgagtgtgtgcaagagaaaagatacttgctacagagaagtggcagagattctaaaattttgactacttggagagtcagcactacccttaaggaacctctgtaatattgtagtacataatcttctatttagctagcgtacagactacttaatagttcaaattctttggaatacaactttagacataaaagtaagctgaaaatctaaaactggataggaaagtaactgccacagtgttcatccatgtgctttacctctgactagactataaaaactattcaagagcctattgacctaagtcctatattaaaattaaaacattagtgttaaactgtcccaagttgttttgggatcctctttgaactttttgtttgttcatttgtttttgagacagggtcttgccctgttgcccaggctggagtgcagtggtgggatctcaggtcgctgcaatttccatttcccgggctcaggcaattctcccacctcagcctccgaagtagctgggactacaggcccattccaccacacctggataatttttgtatcttttgtggagatggggtatcgccatgtcgcccaggctggtctcaaactcctgggctcaagcagtgccagcctcggcctcccaaagtgctgggattacaggcgtgagccactatgcccggcctgaccttttttttttggtcacagggatagcttatgtctatttgtgcgtacagatatttgagtgactgtcatagtagggctctgatgggggatacaaaaat

SEQ ID NO: 15414 - DNA, 1356 bp, Homo sapiens
cagatggaactcaaagtctggttttgactgatgtacctttaaattgcaaaatataaatatttagtttaaatatactttttcttatgtttgtattaatgttataagttgaccagttaccaaacccttgagttctgtgagtctacataaaattttgcattaaaggcacaaaaataacctgataatgctatcagtttttaatgtaaaatttgtgaaatgataggtaatgggcttttgtttttgtttttgttttttaatcagtgacttttttgaacgaaccattctgtgcaacagccttgtgtggagttgtgctgtgacgggtagacctggactgacgtatcaggaagcacttgagtcagaaaaaaaagcaagacagaatcttcagagttttccagaaccactaattattccagttttatacttgaccagccttacccatcgttcgcgcttacatgaaatttgtgatgatatctttgcatatgtcaaggatcgatattttgtcgaagaaactgtggaagtcattaggaacaatggtgcaaggtaaagtacttttaatttttcctcttggtaagtttatattcacattgctcaaaatccaaaacacacaaagtggtgacctaaggaaatcttcccttttactatgctctagctattctgttaacccacagatagccccggtgttagctgtttcttgtatatctttccaaagctaatttatatatatgccaccaaaaacatatacgtgcatgcgtctgtatgtgtatatataacatgtgtcttatgtaacaaacgtgcacaaattccttccctttttaatgcaaaagaacatacatactctagatcccttttcacttaaaagatcttgaaggttagtcctttgttacataagccaccttccttctctttaatttactgtataataaagttctattatatggaagttccatctttaggagtagaaatctttagctaatggtatctactgtgtcctcattatgtcacctaatagtttaaatatgccagtatttatttattggttttagtgttttatttaacaaaaccaggattgagttttatatactccactaagttctccttctttcatactttctcacattgctttattgagctgtaactcacatacaatacacttctcctttctgtagtatacaaatgcagggttagtgctcttccctttcaccgagctcttcagaaataaagtggatttttatatgaacattgaaaatgacacaatctatggcaataaatgaaaaattatcaatgttttcctcaagtctgaagctttgtgattggctagtcactgacatttataataataaactttatatgcattaaaac

SEQ ID NO: 15415 - DNA, 1091 bp, Homo sapiens
ggagtttcggtcttgttgccaggctagagtgcaatggcactatcttggctcattgcaaccccgcctccgggttcaagcgattcccctgcgtcagcctcccgagtagctgggactacaggcatgtgccaccatgcccagctaattttgtatttttagtagagatggggtttctccatgttggttaggctggtctcaaactcccgacctcaggtgatccacccgcctcggcctcccaaagtgctgggattaaaggtgtgagccactgcgcctgacctaagtgatttttagatgaaaagccaaacaagaccagttaccatatattaacattttataattttttataacccatttaaaaaatgtttttatggtcctatttgattctgtgaattagaacatattctttcattttatttatgaagaaactgattacctaacagtataaacctagttggtgatggagccagaatttgaacttaggtcctttgactcttacaactagtgttataattatagtgggaaaaactgaactggaagtcaaagagcataattatgactaagtgaataattgcttctaaaagaaatattgacaggttcatgggttttactagataataagcatcttatataatactactcccataagtggtagtattatactgctttttctccaatttttagaagtgttaacctgtcatgttgtttcacaacatcagtgaaccaatagatacttcttatgtgcttgtatgctattgtatccttgttcttgtctgtgaattcattcttctttaggtgcttcatgcagacatctgtacaccagatttacttctgcaaaatgctgatgctatgaataatgcttttgaatattaataaggcaaaacagaccaggtatgttattttatcaagcaagaaatttgtcattaaaatatatccagcaagatatgaaaagagattagtaggtgagaaatgttttcatgttaaactttttaaaaactactcctcaaacaactataaggagtataatctccttatagagtataaggaaaagtgctgtttataaaatgaaaacaaaccttgtctgattttggaaaaca

SEQ ID NO: 15416 - DNA, 1022 bp, Homo sapiens
caacacagtaagaccctgtcccaaaccaaaaaacaaacttcattttgttaaggatttttgttaaagaatttatgttaattcaggataaagacttcagttatacattacatttagtttttatgagatgctgaaagattagaagaaggtaaatatgaactatgatccagaaggaactggaattctgtttttttttttttttttggagacgagtcttgctgtgtcgcccaggctggagtacaatggtgcaaactccattcactgcaacctccgcctcccaggctcaagtgactctcctgcctcagcctcccgagcagctaggattacaagcacctgctaccatgcccggctaatttttgtatttttagtagaaatccatctctactaattcaccatgttggccaggttggtctcggactcctgacctagtgatccgcccaccttggcctcccaaagtgctgggactacaggcgtgggccaccgtgcccagctggaactggaattcttaaaaggactgaaaaggagataggaaaaagtgagtgaaagaggcttaaagtaagacaaaccattgaatacatttatgggaaattttatagtttgcataaacaaagtataaacttaaggcacagtgaataactatattgataaacataaactagccactattggacaagtagcaaaagtaaaattcaagaaacaaaaccttcataagtcactacttccttttgttacaatcataaaattttctgggtaaactctagatactagtacctctagggagacaggattcagaagatcacttttagacacacctatcttcacttgataaccaaataaatatctgtgagtgagaggtactatctcgaatgaagttaaaaacaaattagaaggaaaaggtcaggttagcatgttttagaactattggtaaactataattcatgggacattatataatcaaaagattaatattttaagcactaagttataaagggtttacacccatgaataaaaagattaccatcact

SEQ ID NO: 15417 - DNA, 1031 bp, Homo sapiens
tggaaaatgagaggagcagatcaaacagaataattgtgaggccatgctgagggcctgtttgaggttggagaacattcctatgtagaagcagcaatccgtaatctttttattttttttcctgaagttctcaatagttaagatataggtctaaaaaggtcaatacactaatcgagaatttaggttttgctcactgatgtggaataaggtcaagaaagctaagaagattggcaagagagagaatgatgaggtttgtggcctgataggaaaggaagtataagtagaaaggggttgtagggcaaaagagggatgttgtgtatttcattttttatttacagatttatttctattaaatacaggccatacaggaactaatgaaaatccatggacaagatcctgtttcatttcaagatgtcaaggttatcttttcctttaatttacgtattaccagataattatgagatagtcatttgtattacatgaaattttatatgaaagcaactaatgaagtactatttgaatcaagtgtttgctttttgttctgaactgatatttaaatcattacgaactgagaccacatttggactatttatgtagtttataattttagtattgtcatcattatgttttcattggaagcattcattcattttaattaagacagtcagggggccgggctcagtggctcatgcttgtaatcccagcacgttgggaggctgaggcgggcggatcatccgaggtcaggagttcaagaccagcctggtcaacatggtgaaaccccgtctctactaaaaatacaaaaattagctgggcatggtggcgcatgcatgtaatcccggctactcgggaggctgaggcaggagaatcgttggagcccaggaggtggaggttgcagtgagctgagattgtgccactgcactccagcctggacaacaagagtgaaactccatctcaaaagaaaaaaaagaaaattaagacagtcagtacagtctatatcctacggcagtctgttcaactgtaaactgattttttac

SEQ ID NO: 15418 - DNA, 1028 bp, Homo sapiens
attcatgtaaccccagcactttgggaggccgagatgggaagatcgcttgaggccaggagtttgagaccagcctgggcaacatagtgaaacaccgtttctacaaaaatagaaagtaaaaaattagcccgggtggttgtgcaccactgtagtcctagctactcgagaggctgaagcagggagggttgtttcagtctaggagtttggggctgcagtgagctatgatcatgacactatactgcagcctgggtgacaagagccagaccctgtcttaaaaaaaattcatttgggctgggcactgtggcttacacctgtaatcccaacacttcgggaggccgaggtaggcagatcacttgaggtcaggagttcaagaccagcctggccaacatggtgaaagtccgtctctactaaaaatacaaaaagtagctgggcgcagtggtgcacacctgtaatcccagctacttgggaggctgaagcgggagaatcgcttgaacccaggaggcagaagttgcggtgagctgagattacgacactgctctccagcctgggcgatagaacgagactacatctcaaaaaaaaaaaaaaaagtcatttgatcccacatccctctccagcttctgttgcatttctctgcactcttcataggaaaacttctcaaagaagttacctgtacttggctgggcgcagtggctcatgcctgtaatcccagcactttgggaggctgaagtgggtggatcacctgaggtcaggagacagaccagcctggccaacgtggtgaaacgctctctctactaaaaatacaaaatttagccgggcattgtggcaagtgtctgtaatcccagctactcaggaggctgaggcaggagaatcacttcaacccaggaggtgaagtttgcagtgagccaagatcgcgccactgccctccagcctgggtgacagtgagactcagtctcggaaaaaaaaaaaaaaaaaaggaaggtacctgtacttgtactttgtgtgctttcttgaccccttaactcttaaaccca

SEQ ID NO: 15419 - DNA, 1082 bp, Homo sapiens
tttacatctttcatggtagtcccacagtttttgcatattctgtttgaatataaatcttttttctctttgcttttctgttttggaggtttctattgagatatcctgaagctcagagattctttcctcagctgtgtcttgtctgtgaatgagcctatcaaagacattttaaaatttctgttccagtgtttttttaactctagcattttttcttgattattttttcctagaatttccatctctctacatacattgtccatctgttcttaaatgttgtctactttttccattagagccccatagcatgttaaccatagttgttttaaattcctggtctgataattctagcatctctgccacatctgactctggtgcttattctgttctgatgcttgttcagtctctttagactatgttttttgtcttgtaattttttgttgaaatctgaacatatgctcagtaaaaggaactctggtaaataggcctttagtggtatggtggtaaggtgtgggggaaggggaggcactccattgtcccatcattaggtttcagtattttgctgagcctgtggccctggattgtgaacttcactagtgtttttcagtctcttcccttaggtgggacagtatgaccttccaaggagccagagttggctatttttcttctcccaggtagattaggctttggtaaaatagtttctactgagggcaggccttttaaagaagaacagaatgttttggtgtgtttcaaataattgtttttcccctccccctccataaagcaagaggatatttttctctattattcactgtgaggacctggtagagctcttggaaataaaactcacaaaagtagggaagttccccataagactggtttctcctggagttgctaactcttagacttgtccacactgagcttccagcagttcaattttagttcaggttttcctacactggcactagattccatcagtcagctgtaattatctgtctctctccagtgggacaccaggaatggggaggggagcatttttcctgtgacttcatgtctctgatgatgctaaaaagaattgttgattttca

SEQ ID NO: 15420 - DNA, 1035 bp, Homo sapiens
tgaaagttttagagtgaaaaatgtaataactgaaataaaaggctatgtagttgtacccaacaaccaagtggagtgggaatgggggtacagaagaatcagtaaactggaagataaaacagtagaaacagcctaaacagcacagaaaacaaacttaggctgggcatggtggcttacacctgtaaccctagcattttgtgaggctgaagctggagattgcttgagccaggagttttgagaccagcctgggcaacatagtgagatcccatctctccaaaaatatacaaaaattaaccaggtgtggtggcaggcaactgtgatcccagctacttgagaagatgagatgggaggattgcttgagtcccggaggtggaggttacagtgagtaaagatcatgtcactgctctccagcctgggtgatagagcagaccctgtctcaaaaaaaaaaaaaaaaagaaaaaaagaaaaagaaaaaaaaggaaaagaaaagaaacctaaaaataatgaacagagcatcagggacctgagggacattaacaaaaaaaaaaaaaagtctagcattctgttatctgagtccaagaaggagaggagaaagagcctgggtctgaaaaagtactggaaatacttgaagaaagtgctgaaaacttcctaaatttggtgagagacataaagctgtagattcaaaaaggtcggtgaaacccaaacaggataaatcaaaagaaatctatagtaacacacatcataatttaatttctgaaagctaaagacaaaaattcttgaaagcatccagagaaaaagtgtaccttatctgtggggggaaactattaaagagatagcaaatttcttatcagaaactgtgggagccaggtgctgaaagaaaaaagaactgtcaactcagaatctgttttttgtttgtttattttgtctgtttgttttgaggtggagtctcactctgtcattcaggctggagtgcagtggcatgatctcggctcattgcaacctccaccacctcctgagttcaagtgattcttgtgcctc

SEQ ID NO: 15421 - DNA, 1031 bp, Homo sapiens
aaggggagacattgccttgagtcagcatacatttttttatacactacattaaatgaatgcatgacatttatttgtttgctttttaaaaataattttaaagaaaactacatagttttttcaatacaatgagctcaagtaagaattcattctaattacatgacagtaagacaatttttgagctttcctcttaaaccaggaaacctggaaacaaacctgattacttgtctagggaggactagggcgggagaaaatgaaagattactttgttaacagacttacctcactagaccatttatagattctttattttctttgcctagactaattgtttcctattccttgtggttgaaccaccagagttttaaatttcaaatcacaaaatgatatgtattattattttattgcaaggtatatacagggatttagaaatgcttaaaacttgacagatgtcactttgagttttccagtagtgagctaataatattttgccagtactatacatattcttatagaacatttgtagttgcaagttcactaattttaactattttttctaatacatttgcctcattattcactattgtggtgcatattaatctaatgacaatataaaacattttagcagccatagttagtaaggagaaaaataagaaggagtagtgaaagattaattgacataaagggcagctgaactctgcttctcttttattgcattttaaagatttattttctgtttttttcctatatggcacatatacttctctcaccttttaaatttatatagtattagatgaagatttctatccagctcttctcaattttataaattattatttatgagctctaattgatagccctttacctgaagaagcaaaaacactgagttttttttctttcacaattagaatttacacttaatagatgctttcaaattaaaattttaatatcttgactgagacatattttacatgcaatacagttaattcatttaaagtgtacatatttttagtatattcacagggttgtacaac

SEQ ID NO: 15422 - DNA, 1047 bp, Homo sapiens
aaagaaatgttcagtgttgatacttcagaaatggctaaatacagctaaggaaaaaagatgaaaagttaccttcattggcagtccagacaaattctaatgttgcttctagtaagtggtataggcaatgcttttcttatgtgcataatatcataaaagccatctagattggttcctctttcatatagttaatgctttttcttctttattcatccttggtaataaatataatctagtgaaattaagtcatcagcttattagaacaatatgtcacaatgtgtgagttacctttaaaattatttatatttttacttattagggtgaattgatgcttgtagataaggtatatttgtttttacagtcttattaactgtggctgatttgaggaaagctctgctacttgtttattgcatttattaacaataacagtagtttatgtggaaagtataaatggaaacttaaatctttttgtgttttccctttcctttttaaattttgttttatgtatcacttccctgtctaatgtagttggataacaaagcaacttttctgataatttcataacaccaatatatttttaaactttttaaaaatgtgatacataggcaccaagagtagaagcacaagttcttctgggatctttggtttgctttcccaacttatattgtgaactgccttctcttcatcccaacattcctgatgttgctgtgtctcagtttacagatgttaaggtaagaaatgagatgctaatttttagcacttaaatgattttataatcataaagtatatgcaataaaatttgtattctttcttttctttttgaaatccacacaattgttaaagaacattagccatatcctccagacacaaaggcttgaatgttcatttggagcatatccttttttgtgtttaaaactgctttagaacctttttcttgttattgaacctactcacatgtctacctgttaggattcattcacttactgaacatttattgaaataccccatgagccagatactatgctactaatgtaaagcttctgagattaa

SEQ ID NO: 15423 - DNA, 1023 bp, Homo sapiens
tgtaagacaggaaaaggaaataaaaggtctacagattgagaagaaataaataaagctatctttgtagatgacatgattatttatgtggaaaatttcaaagtgacaacctcctgaaactaataagcaattatagcaaggttataggatgccagattaatatataaaagtcagtcgctccttccataccagcaatgaacaactggaatgtgaaactgaaagcacagtaccatttacattagcatcaaaaatctccaaaacaattaggtataaatctagcaaaatatttacaagatctatatgaggaaaactatgaaactttgatgaaagaaatcaaagaataaataagttgagaggtctagttcatgtacatggatagaaaaactcactattggcaagatgtcattttttccctacttaatctgtagattcaacacaatctcagttgattttgttcttaacaagttattttgtggatattgacagaatctaaaatttatatagaaaggcagagcatgagcaacatggcaaaacctgtctctacaaaaaatacaaaaactagttggatgtggtgtcatgtgcctgtagtcccagctacttgggagcctgagatgggaggattgcttaagttcaggaggtcaaggctgcagtgagccatgattgtgcccctgcactctctagcctgggtaacacagcaagatcttgtatcagaaaaaaaaaaaaaaaaaaaggaaaggcaaaagagccagaagagtcaacacaatattgaaggaaaagaatgaattcagagaagggacagaacctgacttcaaaatttaatatagtaatcaagaaagtatggtatgggtgagagaatagacaaatagatggaataaaatagagattccagaaagacccacacaactagagtccactgatctttcaaaaaggagcaaaggcaattcaatggagaaaggatggtcttttcaacatggtgctgtaacaattggacatccacatgccaaaaaaagatgaatctagacacct

SEQ ID NO: 15424 - DNA, 1264 bp, Homo sapiens
ccgaaacatcattatgcagtgcatgacaaagcagactttagagcaaggagaattatcaagaataaagaggggtattacataaagatgattaattctggccaggcatagtggctcatgcctgtaatcccagtactttgggaggccaaggagggcagatcacctgaggtcaggagtttgagaccagcctggccaacatggtgaaaccctgtctctactaaaaatacaaaaaaattagccgggcttgttggcacatgcccgttgtcccagctacttgggagacaggagaattgcttgagcccgagaggcagaggttgcagtgagctgagatcgtgccactgcactccagtctgggcaacagagcaagactccatttcaaagaaaaaaaaagatgattaattctccaagaagacgtaataatccttaatgtgtgttcagtaacaacagggtatcaaaatacatgaggcaaaaacagataaacctgcccagagaaatagaagaagtagtggtactgtggttggatatttaacatctttctatcagtaattgacagatccagcaggcagaaaatcagtgaggacataaatgaagtgaatagcactgtcagtcaactggatctaattatgacatctgtaaattgcttaatccagcagagattatactcattcttctcaaactcatgcaaaacattcaccaagaccacattctgggtcataaaacatgccttaaacatttttaggaatagaaatcgtacataatataccctctgactgcaatggatttaactataaatcgatggaaaaaattggaaaactctaaaatacttggagattaaacgacacacttctaaataacgcacagttcaaagatgtttcaagataaattgtagaatattttgaactaaatgaaaatataaaatcaaaatttgtgggcagtgaaagctgtgcttagaggaaaatgtacagaattgaaaatatatattactaaagaagaaagatctaaaaccagtaatctaagcttccaccataggaaactagagaaaaaaaatccaaagtaagtagaagaaaagaaataataagaattaaagcagaaaacaaggaagttgaaaataggaaatcactagagaaaaatcaacaaaaccgaaagttgggtcttagaaaatatcaacaaaaccaataaatctgtagctaagttaaataagaaaataagaagatatcaattattaataccagaaatgaaagaagaaccattaccagtgatcctttta

SEQ ID NO: 15425 - DNA, 1029 bp, Homo sapiens
gcctccagaaattccacagattagaatcaaccaaatatgagttcacaaagattattcagtaaacatggaaacaaattatgtaaatgagttagcaaaaaagagagagaaaatttagattccttaagattttaatccctaatattggaataaatattatggaataaataaataaataaccagactataaaataaccatgtttgaaatgtttgaagaggaaaatgataagctcattaaaatgattaaaaagaatcaaatagaactttgagaaataaaaacataattcctgaaagaaaaaaaaacaatattaagcaacacataagatataaataaagagagaatcagtgacttggattagaaatttgaggaaattacccaggacattgagacgggaaatgtgaaggagagggtaagaaatttgtagaacaggatgagagggtctgatgtgtctagttggaataccagaaggagagaatgaaggagaggcagtatttcaagaatgacagagaatttattaaagctatgagtctatagaaacagaagaacataatataccaaatgagtaagtagaagcccgtacttaaacacactgcagtgacatagcagaatggaaagacaaagaaaagagcataaagactgcaaagagaaaaaatgcataatctgccagagaaaaacagttatgctgaaaacagtgttctcagcactgacaatggaagactgaacagcatgataatatcttcaaagtgctaaggaaaaataactatcattatagaattgtgtactgaccaaactttcaaatggagggtaaaacaaagacaaaagcttaaaatactttgctatggattgaccttcatgaaataacttctaaaagaatatgtcaggaaaaaaaattaccccagaattaaagtccgagatgcaagaaggataaatgatcaaagaaagtcgtaaatgtgtaggtaaatctaaagagatattatctgaatatagtaattttggaattaaaatgaagggtagaatttaaatacagggca

SEQ ID NO: 15426 - DNA, 1059 bp, Homo sapiens
ccagcctgaccaacatgctgaaaccccgtctgtagtaaaaatacaaaaaaaattagccaggcatggtggcatgtgcctgtaatcccagctgctcgggaggctgaggcaggagaatcgcttgaacccaggcggcagaggttgcagtgggcagagatcaagcctggagcgacagagggagcgacagagggagcgacagagggcgactctgtctcaaaaaaaaagaagaaattgttcttttaagtctaaatttttattttatttaaatcaaatctttttttaaaagtacatttttttctgattatagaagtaatttatgcttagtgtggaaagttacatttagggaagcataaagacccattagctgtctaatgagaagtaatcattgttaacatgttggcgtgtatctttgtagtcttttacatagcatgtaatgagtaaaatattcatgctgacttcatagctcatagtgattactttctagttgtactaatgtcaaaacagttttgtctgaaccgaacaagcctatcaaagttaaatccttaaaaatttgttaagaaaggtagctgcatggagttataaaaaggggcagcagattaaattaggatgttctttgggcatatttttaaaattttttaacattacttttttttctttctgagacagtcacccaaactagagtgcagaggtgcaatcccagctcactgtaacctctgcctcctgggttcaagtgattctcctgactcagcctccagtagctgggattacaggcatatgccaccacacccagctaattttgtatttttagtagagatgggatttcaccctgttggccaggcttgtcttgagctcctgacctcaagtgatccacccaccttggcctcccaaagtgctgggtttaacattaatttttccagcctgggcaacatggtgaaactctgtctctaccaaaaaaatacaaaaaaattagctgggtgtggtggcgcatgcccgtagtgccagctacttggaggactgaggtgggaagatctcttgagcccaggaggttgaggcagcagtaag

SEQ ID NO: 15427 - DNA, 1033 bp, Homo sapiens
gagctcctgggctgaagcgatccacctgccttgaccacctcccaaagtactgggattacaggtgtgagccaccacacctggccagaatttataaaactttattaattaaaatcatttttattgtattacaaagtgaaaatattgtatgatttatgagtgagttatggtttgacagcaaataagatttatttggaaaatctatgctttattgcatttgtagttgatttcaaatagctttttatttcatgtagctaagctagaagcataaggttacaaatgtggcacctttgatttttattccgtgaataaatgcatgcatttgtttgctaatacgtccaggatatttttaatgtagtgatagttttctgtttgattctactctgacttctcagaagaaccatgacatctagatctaggatctgttgccgcccctgccacatttctcacagtgactgttccacgtatcgctatgcctggaatggacttgcaaaataaccagaggggaggaggctgtgatagagaattgggctgatacacccaactgaaagtccctttagcctctttttcatatgtggttgaatcaagttttgaagtatcagtgtaaataaggtagttttatggttttaataataagcatctaagagaaggaggcaaggtaaggataataatagaattggtttaacttgcagtacagacaaaaaaagattaaaaaactgcataatgaaaagagtggaaagaaacaatagagtaatggcccttgattaattatcaagctcactgcagactcaaactcctaggcttaagtgattcgcccacctcagcctcctgagtagctgagactataggcatgtgccaccacacccagctaatttttttttttttttgagagacaaggcttgctgtgttgcccaggcttctttgtgatctattaattaagatgtcatataatttctgaaattgagattggtatgattctcaatatgtagttactcaacatattataaagatggatttgattgatttgatatagtta

SEQ ID NO: 15428 - DNA, 1050 bp, Homo sapiens
gtctttcgcctccttggttaggtatattcctaagtattttatttatttatttatttatttgtttatttgcagctataataaaaggggttgagttcttgatttgattctctgcttggttgctgttggtgtatctcctgttttgtttcttaatgagcttatttgaattttctctcttcttggttaatctttctaagggtctatcaattttatttatcttttcaaagaactagctttttctttcatttatcttttgtattttgtttgttgttttaatttagttctgctctgatcttggttatttcctttcttctgctgggtttgggtttggtttgttcttgtttctctagttccttgaggtatgaccttagactgtcagtttgtgctgtttcagtctttttgatgtaggtttttagggctatgaactttcctcttagcaccacctttgctgtatcatagaggttttgatagattgtgtcattattgtcgttcagtttggagaattttttggttcgtttgcttatttgtttgtttttgagacagagtttcactcttgttgcccaggctggagtgcagtggtgcgatctcaactcactgcatactccacctcccgggttcaagcaattctcctgcttcagcctcctgagtagctgggattacaggcatgcaccaccatgcctggctaattttgtatttttagtagagacggggtttctccatgttggtcaagctggtcttgaactcccacactcaggtgatccgcccgcctcagcctcccaaagcgctgggattacaggtgtgagccaccgtgcccagccagaagaatttttaaatttccatcttgattttgtttttgactcaatgctcattcaggagcaggttatttaatttccatatatttgcatggttttgaaggttccctttggagttgatttccagttttattccattgtggtctgagagagtgcttcgatataatttcaattttttaaaatttattgaggctcattttgtggtttatcatatggcctatcttggagaaagttccatgca

SEQ ID NO: 15429 - DNA, 1053 bp, Homo sapiens
aatcctgggttagaagcatatctctgccatatatagaaggtattggtagtccgtaggtaaattgtctctttcccagaaagatgttcctaataccaagtttaggcaactaacaggctcaggtaaaacctcatattttgtatgacttcaaactatgtgtttcagtggtaggttaattgaagtgtgagctcttatttattttaaatggttctggaagcttctttgtacttaggtaggttcactgaactttttgatattttgtaaaaatacatgtttccacatatcatcctggtatatatggttcactcttctgagttccatgcaaacatctggcaaattttgaaatgtcatttctgtgctaaagctacttctgaaaccagagtagcataacaatattttctcaagtatttaaaaatgtaggttttttctaaacataatttctttcttattttggttttcatcttccttttattttgcacagacatcccgcagatgagaccaaagccacattatgtcgtgataaagaaagatgctgaaaccaatgaagcaatctattgtacaaaggagcctttcattaaggctcgtgttattgtcattcgttggctggtttctttctggctggagccaaaaccacatacaggacctcatattcctgggatggaaggtgaagtcttgccaaagaatattcaggtaatgcacaaatgaggcaggcctgttaaagttagaaatggcttttgagatttagtccattgagttcagttgccttaggtggagcgtacacttaaataatagtgctattttatttgtataaatatattttgtaaatgcaaattttaattatagaattaataagtttcttaataaagaaatgaaacgggaagtatagaagataatttcattagtatgtcagtctcagcttcttatttctgtattttaattatacaatactaaaaatattctttattgtacagataaatcttacaagtgaaaagaactgtgatcaaatggtagaaccttgatggccctttttaatttgggggcattcacaaaatgcag

SEQ ID NO: 15430 - DNA, 1048 bp, Homo sapiens
atgatctttagtgttaacagttcagtgtattgcaaccttttacaagcttgtttataattgctaatacttgcatttaagagattctttcttctggaatgattctaattatataatttatttttaggtaaaaagtttagaatggaagaacaaagaaaaccaagaaaggggattttcatttttgttttcacattttaagaaatattacttgccttatatttttccaaacatctgtaaggaaaacagtttatatcatcctatacttggtaggtaatgtttgaaattttctgaaagatcacacttaagagtaaaataatctcttactgtaaagttggcatttgttactgcaggaaactgatcatatttaatacttgtattggttggtatagatatgatacctagattcatactgaaagcaaatttatattaataggaaattttcaatgaggatgagtttttctttttttgtttttttttgttgttgttgttgttgttgttttttttaagagacagggactcactctgtcacccaggaggctggagtgcaatggcataattatagctcactgcagccttgaactgctgagctcaggcagtcctcccatctcagcctccccagtagctaggacaacagtcatgcaccaccacatctggctaattattttttttttagagatgggatctccctatgttgcccaggctggtcttgaactcctggcttcaagtgatcctcctgccttagcctcccaaagtgctgggattataagcatgagccaccacacccagccaacaatgaacagatttttaaaaacacttgttctctggatcttatcaattataaaagttagcccaccagaaatatttgcgattgtaaattaaactgaattcttgtttggcatgatccttagactatattataaattttctttttaaggtccccccatatgggggttcaatcaagtgttagtcttattcaaattctgtgtgaataattacatagccatgtttcatccagtatttatatagattggtgcaaaagtaatggcagttt

SEQ ID NO: 15431 - DNA, 1092 bp, Homo sapiens
gtgatccgcccacctcggcctcccaaagtgctgggattaaagacgtgagccactgtgccctacctatttattttttgtagtactgtattttttttaagagacaggatcttattcagtcaccaggctgaagtgcagtgccatgattgatcatggttcactgaagccttgaaatgggcttaagccatccccctactcagcctcttaagtagctgggaccacaggtgtacaccaccaggcccagctcactttttaaaattattttttgtagagacggggtcttgctttgttgcccaggctggtctcaaacctccggcttcaagccatcctcctaccccaacctcccaaagtgctgggattacaggtgtgagccatcatactcaacctcttttatattttataaaacattctgtggcaggcatgatgccccatgcctgtcatctcagcacttggcagaggctgaaagaggatgatcacttgaggccaggagtttgagaccagcttgagcaacatagtgagactctgtctttaaagacaaaagaaatttttttaagctagcctcacttgttggtatgtgcctgtagtccctgctactcaggaggctgaggcaggaggatcacttaagtccagaaattcaagggtgcagtaagctgtgatcacactgctacactccaattggggtgacagaatgagacacaatctctaaaacatgaaaataaggacagatgtggtggctcatgcctataatcccagcactttgagagcctgaggcaggtggatcgcttgagcatgggagttcgagaccagcctgggcaacatggtgaaaccccatctaggaaaaaaatacaaaaattatccagacgtgatgactccttcatgtcgtcccagctccttgggaggctgatttgggaagatcatctgaacttggtgaggtcaagactgcagcaagccaagatcatgccactgcacttttagcctgagtaaaaaaatgataccctgtctcaacaataaaaaaaaattttaattaaaaaagagagaaattctgcttcctttgggtttaatttactcttctgtttctaggtttttgtttatttg

SEQ ID NO: 15432 - DNA, 1031 bp, Homo sapiens
aaaatatattattacaattaatttccccgtgtcattttatttcttaaaatgtgattacaaggaaatttaaaatcacatatgtagctaatatttgtggcttgcattatatttctaggagacagcactgattgagacagattgctgattatgcatttgctaatctcttccaagagggacccagaaactacagttctccaatctggatctcagagattatgagagaaccaggccactttgactttttttttttaaagcttcatagtaaatagtaaatttaaaaaaaatttttattatactctaagttctagggtacacgtgcacaacgtgcaggtttgttacatgtgtatacatgcatacctcacgtttttcttgctccatgtattttttatgccttgaatgccctttccattcaactccaccactttatgtctagtgttcttcctgtccttaaaagtcttttcagatattatgtactctgtcaggccttttttctttccccacctttgtgctttattgagctttgaaagtactcttgtgtttctaaactgccatatactttgacatctcacttttagtactaacacttctactgttcatatagttattcatttaattttgcatgccctgctcttactgacagtttctttagagcagtactgtctgtgtttgagctttttaatccctaagtacctatttacaaagcctattgttaggtacctatttacagaataaatatatttcagacattataaattcttcttttttttttttttccccaaggtggagtctcactctgtcttcccaggctagagtgcagtggcgcaatcttggctcactgtagcctccacctcctgggttcaagtgattctcgtgcctcagcctcccaagtagctgggattacaggtgcacgccaccacacccagctgatttttgtatttttagtagagatgaggtttcactgtgttggccaggctggtttcgaactcctgacctcaggtatctgcccaccttggcctcccaaagttgggatt

SEQ ID NO: 15433 - DNA, 1022 bp, Homo sapiens
ggaatctcaatgtgttgcccaggctgatctcaaactcctggcctcaaacaaccctcccacttcagcctcctaaagtactgggattacagatgtcaaccaccttgcccagcccaagcctgttttattctaatttcataattctttaaactactctgtgggaaaactagaacacctttcctctttatttcagttgtatgtgcttttattttgatatttgataaactatatttaactagtatttgatgactattattcttataggcagataatagataaatatttagtattctttttttacagatgtattacattggaggctgaatagatctagggttacctgttgtttaaatcctgactctacttcttatgagctaagtttcttagactctctgtacctaaattttctcacctgtaaaatggagataataatggtactaatttcatagtattgctatgtagattataggaattagtttctgtggagtgctgagaatagtgtgcattgtttagaaaacattcgctttgtgttacacattattattttgtctagttctgtgaaaagtcacataggtagtaagtgttacagacaggagtgaaatctgggtattctaattccagtcaagaggaggcagttctattttgcctgtcagtaggttatgcagtcttttccaaggtaaaaatttccatattgtatgaactgaatataatgaagtaaaaataattaattttgttagtaataaaacacatttgagtacatattgtttgctcagcattgtgccaatttttagaaatcctgaggtagacacagtttctattctaaagatgctagactagtcctggaagaaagacaataagacatttgaaacattgttctttccataaaagagaaatgtacagaatccaagggaatagagaggaaaggcatatatccctttccttttggaatggcagaacaaaaaacagtcttggaaaatcacatagataagacatcactaaaaagttactatgccaggtgttgtggc

SEQ ID NO: 15434 - DNA, 1029 bp, Homo sapiens
ttgaatcttatgtctttttcagtttggacagtctagctgacagtttgtcaagttttttgagtgtttcaaagaaccaatttttgtttaatgattttttttggggggtctctatttcttttatgtcctttctaatctttatttccttctttgtgctttaggattagtttgctctttattttcgtatatatgtatgaccacacctggctatttttaatttctttgtagaaatggagtctcactaagttgcccgggctggttgtaaactgctgggctcaattgagactcctgcctcggccttccaaagggttgggattacaggcgtgaaccaacgcacccagccaatggtcttacttcctaaggtggaacattatggttcgattttcagatttctttctcatatagcaatttaaagctatagatttttctgtcagcactggattagctggatgccataagttttggtatgttgtattttcatttacattcatctcaaagattttctaacttctcctgtgatttttctttgaccaattggttatttagttgtgtattgctaaatttccacatatttgtgagttttcttaatttccttatgttattgatttctaatttcattccactgtggccagataacatactttgtcttcagtccttttaaattactgaagtttattttatggccttacatatggtctattttggatagtataccatgtgcatttgaaaagactgtattcttttgttgttagatgggcattcgatagatgtctgttagatctggctgcattatagtattgtttaggtcttctattttcccttctgtctagttctattcattattgaaagtagagtgttgactcttaaattaccattgttgaattgtgtgtatattccttcaattcagttctgttcagtttctgctttgggggttgggagttctgttgttaagtgcatatatgttcacaattgttatatcttcttaaaagattaaccctttaactattataaaatgtccttcttctctagcaa

SEQ ID NO: 15435 - DNA, 1075 bp, Homo sapiens
ttgttgttgttgtgtttggttaaaacatttttttaattctaaattcactgtgtgtgtgtgtgtgtgtttgtgtgtgtatctaatgtctcttctcactgaaggtacacattatagaaatagaccttggagagccaggcgcggtggctcacgcctgtaatcccagcactttgggaggccgaggtgggtggatcagctgaggtcaggagttcgagaccagcctcaacatggagaaaccctgtctctactaaaaatacaaaattagtcgggcatggtggtgcatgcctgtaatcccagctacacgggaggctgaggtgggagaattgcttgaacctgggaggcggaggttgtcgtgagccgagattgtgccattgcactccagcctggacaacaagagtgaaattccgtctcaaaaaaaaaaaaaaaagtagactttggagagaatagcagaataggtgatgaatacgtctactttaataaatggcatcaccatcctcttgtcataggttactaagacaagaaactttcatctttaacaatgtggtagaaaaagataaatttatgttgggactgcagctggagtttgaaatgtctatggggcaacctcacatctccctagcccactactgctcttttctggctttataataatatttgaacctgttccttttttctcggttcttaccatcatttctttagtttaaatttttattgtttcttgcttgaacttttgcagcagcttactagttgatctccctatgcaggtcttttttttttttttttcccctcttgaatctcttacatggccttgtcacaatctatctttctttctttctttctttctttctctttctttctttctctttctttctttttttttttttttttgagacagggtctcactctgtcgcccaggctggagtgcagtggcacgagctcactgcaacctctacttgccgggttcaagcaattcttatgtctcagcctcctgagtagctgggattacaggcatgcaccgccatacccggctagttttggtatttttaatagagatggggtttcgccacgttggccaggc

SEQ ID NO: 15436 - DNA, 1159 bp, Homo sapiens
ggctcgtctgggtgggagggcggccgcccagacttcccgcggtcggcaccccctgctcggccccagcccagaggccgccagcatttgagtccccgcccagccgcggctccgccgtcggggctttcccccgaaaggcccaggcgccacctcgcgaagtcagcttggctggctcctgagcccggctctgccaccccaaagcaaggggccgtacccgcgtccttcctcggcgacccgcgcgctcccctccctctccgttaatattctccgataatttccgaggcaaagatttctatcttttgggcgaatttgtttcatctctcttgaattcagaaatggagccttcaaaagtcttaatgtgtgtttattttttctagcattcaaatgaatgcgaagccacggattgaatcccgtcactctttgggggttagcttctcccgatatttcacacggaaaacaaaactgggtccctcttatttgtacttgtccttaacctttgcagcaactgctgtagatgcggctctgtccattctctaatagattttaccaggggctggtgacagagaactgatttcttttctattagggtttagcacatctttgttgaaggcctgtagaatgaccagggattagatttgcatctcttagacgccctgtgtggtctttgtgcgaagcttgtaactgttaaaaatgacttgttaggaagcgtgtgggctctcatcgctctccttttgacagaatgattgtgaaattcagattggccctgtaggatttagcccacagattccacctgaaccctaagcaattagaccctaatctccctgcaatcatatttgagttaggatttgttgcactttgtttacttcaattaaaagcagtggaataatttttttccagcttttaaagtgaaatctccaggcataaaaccttaggacttcttagaaatgcttttggtagtgatgaggatttcttttccgtgtggtttcctccaagtcctcatgaccatccccttccttctcccatttaagtgactcgttttttcccctgttgctcgccaatgcccaaagcgtcttcacaggggctgaattcgcggcgcaagggaagaactgtgtggagatgacgcccagctggaggggcgcccaagctcaggccgtcgcccagg

SEQ ID NO: 15437 - DNA, 1065 bp, Homo sapiens
atctaccccaatccaaccctttgcaattcaattactgcatattcatataaagataggaatatataagttatattaggttggtgcaaaagtaagtgcggttttggccattaaaagattgggtgttaggcaccattaaaagtaatggccaaaaccacgattacttttgcaccaaatgtataatatgtaagttatatatgtatatatactatatatgcatatatagtgtatagtgtacaaatatatttctaaagcctccactccccagaatagactcgttcagtatttgttaagaagatgatagatgtaaaattactttggaaataaaggcactgcataaatttgagattttataattttcaaacacccttgtcttgagacttttaaggcagcaaagccattttatttcttacaggcatatctttcttttggccatatcttcagaagtactcaaacaagtggaagtggtatatctatgctgagactgagtcacagactagtttaaaatagaatatcactgagcacacaatgaagacagtgcgaaatgctgcagtcatgattctcagctaatttagaaaaaaaaaatgcttcaattagtgcaaacattttttgtctttaaaaaatatgcttgtacatttgtttgggaacattgaaaagcccttccttaccctgttggctaccacagtaactcactcagtattgtggctggtgaatgacagggcctgtttcctcccatttgttaagtgtgtgcagtcctttggctatgagaacagcggcagataggtatctggctcctttgcaatgcagcctagggtttgagccacattcctttctgttgtgtgtgattctgatcggatgttaagcaccaaatatgtcccaagtgttacttcattgtccactctgtcagtgtggcagcaagtttccatcctaataaaagaagttactcagatggatattccagatgtatttaagctgcttttattaggacaatggagaagtccaaccctgtcttctaaatgcaatcaagagtggtgtggctttgcctttgtaattttacaaggggttgta

SEQ ID NO: 15438 - DNA, 1865 bp, Homo sapiens
gtaggcattctgcaatggctgtggcccagagaatggtcatgtagacccatattaaattaagaatttgttaacatacatgagggatccactttgttgagtctatacaaaaagggtttgctgagcaaatgaaataacacaaatatagagaaaaattattatctcactgtgtagaaagtttgccaaacttttcatctgtgttggcttacaatcagtgtgccaattacaaatatgctattgattcataaatcaggatgcatatacttagaaacattttgttagtatttggtttgaatccatgataattagtatttatgagaaagtaataaaactatattcatttaaaaatatatttacccattttggtttttcatggattcagactgggaaattatatatgtgcataagaaatcttggaaaatgaaggcgctaagtagcctttgcaaataagcaaacatacaatttcaaaaaaaaaggtttcaagggagagatggagaagaatatcgtggaactgtgaaagcagcaattttagtagacaggaagaaccattctttaccgagcactttgagcatccttccacttcagttagcaacttccttcacaaacaaaaacagtgatgttctagccatgatccctctgggttgcgcagggtaacgaggggtcactgggtactcctggcactcgttgagcaggcttgcgaagtcggagcaagcctggcctggcgctaagtaaggatagatgcacttctctgcatgaatcttcggcagctcatgttgcagatagggttaaaggttgtagcggccccgtgttccactagcaaaacatcaaaatgttccttctactgagaaggttcagaataccaggtggaataacctctgtggccatgtaggttggttgaactgtctgttttgatcataaccccatgcatggtcttgcatttctttgtgctaatggcagatagcactattatggtgcctgcatgaataatctattattttaaaatataaattctcccattactctgtcagccataaataccttctttgctaacatgctgttcagaatcactataatctggggagggccattttatattctctgttcacatgatctaagcagcatttttgcatgactttggggaataaaacaggaaaaggggggaaatttaaaaaatacaataagcttaatggctttttcacttatcgtttctttaacctctttaatatactatggggggatatgtactaagcttttgtggaaagggggtcctattttgtaaccaaaggaaagtgaaaaatatttctggaacattttgactttcaacctctttaatgactcaaaaaaatatggaataataaaataaaaactcaaagactgccaacttaggcctcacaataacttttctgccaaaaactaaaaatactgctatgcatacaaagggttctaacccactaccaaaaagaaaatttctggcttagtcaaaacaacatacctactatctctacctcaaattctagagtaaaggaaagaagtaaaattataaattattaaaaatgaatttcatgtgtttggtatgtctaacccctaaaagagactgttatccttaaaggcaagaaagaatggctggttacacggtattttattatcttgaatcaaactggtgaataatttctagattactttctgaataaaacataaattattatcctttctggctatttttccagatactctagcaacatatttaaatttgatgcagtttgattgtgtttttaaaaacacaatttttatggatggatctataggacattatgctaagcgaaataagccagacacagaaagaagagtattgcataagtgaaatattg

SEQ ID NO: 15439 - DNA, 1027 bp, Homo sapiens
catgtgcacattgtgcaggttagttacatatatatacatgtgccatgctggtgcgctgcacccactaactcgtcatctagcattaggtatatctcccaatgctatccctcccccctccccccatcccacaacagtccccagagtgtgatattccccttcctgtgtccatgtgatctcattgttcaatttccacctatgagtgagaatatgcggtgtttggttttttgttcttgtgatagtttactgagaatgatgatttccagtttcatccatgtccctacaaaggacatgaactcatcattttttatggctgcatagtattccatggtgtatatgtgccacattttcttaatccagtctatcattgttggacatttgggttggttccaagtctttgctattgtgaataatgctgcaataaacatacgtgagcatgtgtctttatagcagcatgatttatagtcctttgggcatatacccagtaatgggatggctgggtcaaatggataaactgggacacttggtgaaactcttggggtctgtgggtgaagggcatatatagttctttgtattctttcagttcttctctaaatttggatttatttcaaaataaaacatttttaaaagtcatcacaatttttaaaaatcaccaggtaaaaaatgagtcagaagaaacaaaaaagcaaaacgcttaaacctacaaaggttttagatatttgaattataagatttacaaatataaaatattataaaatatttaaacaagcaaatgatggcattttaaaagggcacaaagaacaagagactttcaaaacaggtttgaaaaataagtttatcttgtaaaaataaaaaagttgaagttaaaaactgtgtacacattgagtttacatcttctcaatgtaaacagaagatcaaatgaaatgtaacagtttcccccttttgggggcaaactatttcatacttccccttagtctttgtttttcaaacaatatcatgagcagcttcacataatgtcagtgtcgttgca

SEQ ID NO: 15440 - DNA, 1049 bp, Homo sapiens
attacctcccttctcaggttcttgtgaatgctttaaggccttaatacaattacacattcaaaaattcttggctccttttattactagaggatactggttctcatagttgagcacagggctccagtaatgctctctgaagtccatgttacccaaggtttgcatccatatgcccttctccaggcaacagcaggtccataagtgttgaatgccgtgtgccagggctgctgcttctctgcttcaccgtggcagaatgtaaagatggtgtgaagcttgaggaatcaaaaccaaggtgggctgacaccttgaatcgggtggtcaccattaacagtcctcccattctgttgaatgttattcagcaacctgaatgggcaatccactgtggtcaacagctttgtacagaaaccagcactctttgctcatacccaggtaaagcagtcaggtgtgtgatgttcttttggtgcttatgactaaaaatgctccactggactatttacattatcaggactttaacataaaacaggattcagaagtatttaacttttgcatgagtccattggaagggaaaactgtaagctgtttaatagaatgatttgcattgatttgttttccagcacatgaaagtaagaactccaagttgactgatgataaaattaaagagcttgggaacatgactgatttttttttttttgaagcagggtctcactctgttgcccaggctggagttcaggctggagttcaggctggagcgcagtggtgcaaacatggctcactgcaacctcgacctcccgggctcaagcaatcttcccacctcagcctaccaagtatctgtgactacaggtgcacaccaccaccacacccagctaattttgtttatttttcgtagacatgaggtcttactacgttgccccagctggtcttgaactcctggactcaagctattctcccaccttgaccccccaaaatgctgggattacaggtgtatgccaccgcacctggcctgatttcagatttttaaaattagagtaatattttgtactttggaaagtagc

SEQ ID NO: 15441 - DNA, 1100 bp, Homo sapiens
gcacacgtatgtctattgtggcactattcacaatagcaaagacttggaaccaacccaaatgtccaacaatgctagactggattaagaaaatgtggcatatatacaccatggaatactatgcagccataaaaaatgatgagttcatgtcctttgtagggacatggatgaaattggaaatcatcattctcagcaaactatcacaaggacaaaaaaccaaacaccgcatgttctcactcataggtgggaattgaacaatgagaacacatggacacaggaaggggaacatcacactctggggactgttgtggggtggggggaggggggagggatagcgttaggagatatacctaatgctaagtgacgagttaatggatgcagcacaccagcatggcacatgtatacatatgtaactaacctgcacgttgtgcacatgtaccctaatacttaaagtataataataataataataaagaattatgccaaatctgctgtgccctataaatggaacaacaaagcctggatgacagtacatctgtatacagcatggtttactgaatatcttaagcccacaatgaagacctactgccaagaaaaacagatttctttccaaatattattgctcattgacaatgcacctggtcactcaagagccttaattgaggtgtataaagagattcatgttgttttcatgcctgccaacacaacatttattctgcagcccatggattgaggagtaatttcaatgttcaagtcttgttattaaagaattatattttggaaggctatagctcccatagatagtgattcttctgatggatctgggcaaaataagttgaaaacctagaaagaatttatcattctgaatgccattaagagcatttatgattcatgggaggaggtcaaaatatcaacattgacaggagtttggaaaaaattaattccaattctcatagaagactttgaggggttcaagagcagatttggtagaaatagcaagagaacgagaattagaagtggagggtgaattgctcaatctcaggataaaacctgaatggatagtaagttgcttcttatggatgagcaaagaaagtggtttcttg

SEQ ID NO: 15442 - DNA, 1057 bp, Homo sapiens
tgatttgaaaaaaaaaaagtgactttttcatatttactgtgtttttttttgagatgattaggtgaatctctaaatgggaaatactaagtttcatgtattttgcaagtcattaagcttctcaatctaatgacttatttatgtactagtatcttgaaatgttatagtttgtttgtttttttataaatcagcaaccttactatgtacagcttaccagagtgatatatggattataatcctcaaactttttttattatttagggcaaatagctctgcacttactcttattaactacatcgagttttatttaacacagtgttggcactggtttctttggaaaattagctggcattcttaaaactacattatttataagagtttaactttagaatgtatttgaatttatactaaatgtttacatgtattattttcttatatattcaactttaaataaaaattatacttattttatctcacatgtttagattgcctatatttattttattagtgaggagagatagaactacagatttgtcttttaggaggttatctctgtctttcctccttttattccatctatatcttacatctttaatttcactctttttttaaaaaaacttgctgtggctccccagtgttcaaggatgatcaaagcctccttagttcttcaccatctggtcttacctgtctttccagccccaatgtccctttctagcctcagtgggttgttactcacttccctttttaggccccaaatacctctcgcagtctcctgggatttgacatcctcttacacacttttttaatttttttttaccagttgtctccttgacctggaatgaccttcctcatttcccctcctaacacatttccttaaattcaagacttaatgctatatgctgaaatgtctttctaactcttcaggcatgccccagagctcccactaccaatgcctttattattgctatgttgcatagaacttccagaatattgagaagacagaggacaaacaagtaaactatttcacttgtgatatgtgatattaaggaaatgaatagga

SEQ ID NO: 15443 - DNA, 1034 bp, Homo sapiens
tgtgtttggcattattgtagtcactgaacgtgtgttattgttattgttgttaaagagaagaatcatggtgagtaataattattagataaaactatgaacatgttcagatactgcattgtaaatcaaccctagaagtatatagctgcaactacataccctagaatagtgtatcaatacctggaaaataataggctcttaatgcttgttgactgaaaaagcatttggtgaattcacttaatgaaaaagcaattggtgaattcacttaactgggtggatagaaataattgattctcatcctattatacctcttttattctcagagcttacattcagcataaaccagagcacacaaaactcctgcctctcagctgtgaacaatttgatttattaagtcagttaggatagatttaaacttgaaattgatgagacagttacagttgagcgtttcctggtgtgtgaatgtggaatgaactttagacaataatactaatgctgtgttcagatagagatgtggtagttgtagaaatatctactgcaaaaattaggtttacttagtttgctttactgagttatagcagtgttgaaagcaaagttcaaaatatccttctttagtattactgaagaaacactttaaaaaaatcctaatttccattggaaaaataataggccaaactactgtgaagaggagcctacagaaagggatctgctaatattagatctgaatgatttgtcttttgtccagtggccatctgatttccacatgggaaaataggtacttcaggatgggtggggaaaaggaagaaggaaaggaactaacattttttgaatatttgctatgggctaggcactccactgtgcgctaggacatttatatattctagttaattcattcttcataaccatcaggtattatcactcccctttcatttctgaggactaaaggtttaggaagacaaaaggagaaatagatggtgtccctgtaaagcccactctctctttttaaaaatgatttgtatagtgcctaatgcttaatg

SEQ ID NO: 15444 - DNA, 1075 bp, Homo sapiens
taaaataagaaaaatgaacctaaatttagaaagtctatgatttttttcaaccttttaatcctcattggaggccattcttttttaatttatgcacataaaataccacaggaagagatggtataaatttgtggactgtggagaatgagtgaacatttttgaatcaggatctttaaaaggggtgaaatttgagtatgattaagttaggaaaaagcctcgcttacggcggaagtcagagactctgtatacattatgggcatgtcatggcttttaaaaagttatgttagacttctatacaaattgtgaaggaatttgtataaccccaaacaaaattctgtgtggttctgaacttttcctaagttgaaaagagagagagagagagtaagaaagaaataatgctggttagtattctgatcagggacaagccttactgtcgggtgggccggtcgtttgcactgcctgggtgttttcttggttactaattttctcagaaggaaatgatcctatggcttatgctagccacgtttgtgcatatatgccctgtaattggcatttattaaggagaccttcagtttgatggatgactgtcagagctgagcctgctggctttaaagacagttgactttgcttgaattttgttacattaattcattagaactctgcactgcttcaacccactctttgtttactttcttataattaagatttttgaacaatcgatttttagatacgtggcaggaggccattccacacttggagacttagtctgacagaaaaatatgcaccagaacaaatattcataataaaaacctgtgagtattaaaactgaggtttttgtagtctctttaattgctgcccagttaattagcagcttttaaacataaaattgcttattacttatctttactttgtataattaggtgtcttgttcctctactttctttaaaagtgaatcctataaaagcaacagctgtagaaatattttcagtacaggatatttttagagcttgtatgcattatgatatattaccaacaatgtaagcaaataattaggaaaatgaaaggccatctgactcta

SEQ ID NO: 15445 - DNA, 1113 bp, Homo sapiens
agacttggctaggctttcagacaaagacccttgctatacttaaaaaaatgagagagacagggtcttgttctgtcacccaggctggagtacaatggcacgatcttggctcattgcaacctccacatcccaggctcaaatgatccccccacctcagcctccctagtaactgggactataggcatgcaccaccatccctggctaatttttgtatttttgtaaagatagggttttgccatgttgcccaggctgatctcaaactcctgaccacaaatgatctgcccaccttggcctcccaaagtactaggattacaggcgtgagtcactgcgcctggctgacccttgcttagtgagggaaataactcagaggctttcagtgggaaatcagagaggagaaaatatgtatgaatgtagacacagttgatgctcattatttgcagatatcatatttgtgaatttgcctacttgctgaaatttgtttgtaacccccaagtcaatacttatggttctttctcagtcattcacagacgtgtgcaaagtgatggaaaatttgcatcatctaatgcacatgttcccagctgaacaaggtgatactctgccttcctgtttccgttgtcatactgtaagaaggtcctttttgcagtctatttagtgctatgtgttggggcttttttgttcatgattttactgtttaaaatggcccccaagccattgtgcagaagtgttgtctattgcttttttttttttttgagactgagtctcattctgtcacctgggctggagcgcagtggtgcaatctcggttcacttcaagctttgcctctcaggttcaagtgattctcctgcctcagcctcccgagtagctggggttacaggtgtgtgctaccacacccagctaattttttgtatttttagtagagatggtgtttcaccatgttagccaggctggtctggatgtcctgacctcatgatccacctgcctcgacctcccaaagtgctgggattacaggtatgagccaccgcacccggcccattgtctattgtttctaaaggcaagatgcgccttatgagaaaatctgtgtgtcaggtaagctttgttcaggcttgagttatagtg

SEQ ID NO: 15446 - DNA, 1048 bp, Homo sapiens
caccattattttcatagtttatagctttttgattagatgatctcaatagctacttatcttcctgggatgtttctcaggtcttcactgagcaaaaacattgactgtattgagttttttccagttgccagttactgagtttgggaatgagaggatatcatggtataagttgggtcctgcacctgcaggagcctcccagtactgtgagacctagaaaagggagccaggaatgattttactgaggaagtaaataattatgttgggtattgaagggtgagtaggagttttctgagcaaacaagaacatgtaggcagaggaagtagcacttgtagtggaacggaagcatgaaagcttattgtccactcatagagggacaacaggtttagcatgattgatgtgtagggtctggaggaggggaaggagacagggaacagtaatggagttatagaggtgggttagggcaggtgttggtggttttttttttatggtgtatgaggtatttgtttacaaggggggatgtgtagattctatttaggggagataaattggtgatacagaggctgaattagcataaggggactagtcggaaggttgttgcagttatttagaggagggtagatgaaaacttaagttagggcagtggcagtgggaaagagaaggaggactgtatttgaaggagaatcacatggatttggtggtagattcgatttgggaagtcagtggagaaagagcctcacagagactgtgagctaaggtgtgatactattaggcatgaaagggaatgtcaacagagggactggggaatagttatctatgatttatgtgtctgaggttggaattgttcagtaggtggttgggaaatagatggggtgtccaaaaaagtttgatagtcatcagcatatttatcagccagtgattctcgtgtttgtgtgtttgcatgagtgtgtgtgtgtgtgtgtgtgtgtgtgtgcacgagtgcacacagtaaggtggggtatgtgtatcaggcccacctgaggggattttaaaacaacatccttatctgtaatac

SEQ ID NO: 15447 - DNA, 1018 bp, Homo sapiens
tttgtctattttgcctcttttttgattccctatggattttaagatttttttttttctgttccgtgaagccaaatttttgatagggattgcattgaatctgtagattgctttgggcaatcttgtcattttattgttattaattcttctcatccatgagcataggatttttttccatttgtttgtgtcatctttaatttcttttacagtgttttgtagttttccttgtatagatcttttacctctttaattatatttacttccaggtattttatatgttttatagctatagtaaatgggattgccttcttgatttctttcttggctagataactattagtgtatagaaatgctactgatttttgtatgttggttttgtatcctgaaagtttactacattcatttatcaaatctaacagttctttggtggaatctttaagttttttctagatacaagattatatcatcagaaaatagggacactgtgacttcctcttttccaatctgaatgccttttatttctttctcttggctgattgcttcggttaggacttccagtactatgttggataggagttgtaaaagtgggcatccagaaccagtgttctggttcttagaggaaaggcttttaactttctgctattcagtatgatactagctatgagtttgtcatacatgacctttatttttttgaggtatgttccttatatgcctagttattaagaatttttatcaagaaagtatggtgaattttataaaatgctctttctgcatctattgagatgatcatatggtttttgtccttcattctgttgatgtgatagagcttgatcattgatttgcatatgttgaactattcttgcatccctggaataaatcctgtttgataatggtgtattatctttttgatgtgctgctggtttcagtttgcttgtattttgttgaggatttttatgtctatgttcattagggacattggcttgtagtttactctttttgttctgttcttttctggttttgg

SEQ ID NO: 15448 - DNA, 1026 bp, Homo sapiens
aggggctattagctttcacctaaaaggccatctggcagtctttgatactgtcattaaaagaaagtgggtagacagttatgtagcaggtgtttgccaattagaagaatgctcccaagcaggacatcgtggacacactctccacagaactgtatattttccaactgcaataactgtgtatttaagtgaagaaaagtacattgtagagcttggtgttatgagtctgtttcctgtggaaagtgtggcctgctgtgctggggaagctgctgttttctcttctggtcaagatcttgctcaactgccttaacagggtacagggtgaagcatccacagaatgatcctgtgtgtacatttaacctgttctggggacggcactgtttgttttggcaaaataggaaaattgacaaaatcaacaatttttgtagagattagaactttttctaagaataacaaatctgaagattacttatgagtagcagtaaagatgtcactttgaagtgataagtatactgaataaagaacctccaataaggaaggatcacatttcactttatttagtggcttagagccttttcttcaaggcaatttaaaagtaaatctgcagaggtttaaaaattaatctttatcaaatccttgtgagatgctaataggttaggtattctgcatgtttgaaaacatttgtaaagaagagatgaaagaatcacagagcagtgcttctcaaacttgaacatgaatcctcaaggaataatgataaaatgcagatttccatcgagtaggtctgaggcgttgcattctaacaagctctcaggtgatatcagtgctgctgctgtggcaggcagaccacaatgtaaatggcaatgtcagctaagagcagcgttgtcatgttttgggattcccataggaagaagtccagcagtcacttggaaatgtgcattttggactcaggagactcagttttgggagccatagcatggaataatagctgaagttatgagaatagatgaaattgctcttctttaattatttact

SEQ ID NO: 15449 - DNA, 1027 bp, Homo sapiens
aagaggctgaggcaggaggatcacttgaggccaggagtttgagaccagcctgggcaacatagcaagactccatctcttaaaaaaaaaaagtgttaacctcttggtataacatatcaacatttattgagtgtccagtatgtttaggactttgtattggctctttagggtgcagttattacccatgcctttggagagcttgtagtctaatattagagataaaatacatacctaagtaaattacaaggcagaatgggatatttgtccttagaaagctatgaagtattacaaaggttagaagaggaagatggcaagaggtcacatagtggtagcaggaagagggtgtgtaatcagaaaagagctcagaaaaaagaaacatttcatttaaagaatggttatttcagtaattggaaattgcatgaggaagggaaatctaggtagagaatagtatgggctaagataaaagactacatgcagagctgactagaagaacataaaacggaaatgtgttgtacaagtaaattgtggaggatcttgaatgtcaggttgaggagtgagaagttgagtatttatttggtaagtaatggagagtcattgaaggtggacagagggcagatttgagtcttagtatagttgaatcttaagattaaatggaagcagtctgtaggttgaaagtatatttacgaaaataatccaagtgagagggagtaaaggcaagatggtgaaaggaatagatttgggagatattttaaaagtagactcaataggacttgattagaagttgcaggaaagtaattattccagggcatggcaactatgcacaaaatctgaattctgattgaatcctggattaaagggagagaatagctataaagaacataattgggataatttgtgagatttgaatatagatcatatatcagataactagtacagaattattaaatttcttgagagtgataatggtgtggttatgtaggagattcttcttgatcttaggagatacatcctgaagtatttaggaataaaa

SEQ ID NO: 15450 - DNA, 1049 bp, Homo sapiens
ttttggggtcccaagacttactttcctttcacaagattaagttgcagatatgatagtcccaaccccttgaaactttgtatttcctatgaaccaggataatctcctatataaccacaatataaaactattaaaattaaaatgttaacactgatacattactaccagctaattctcagaccccattcaagttttaccagttgtcccaataatttcctttactgaaaggatttagttcagtcctgcatttatggctatatctatttaccctccttcatcctggaacagttcctcaatctttcctgatctttggaagattcagaccagttatttggtaaaatgttcttcaatttgagtttgtcttgaagtattctcgtaatttgattcaggtcttgcatctttgggaggaatatcacagaagtaatgctgtgttcttattgttacattttacaggtggcacatggttttcatttgttctgttactgatgatattcactttggtcattcattaaggtagtatctgccagggctctccactttaaaattactctttttttacccctttgtaattaataaacattgcaaaatattaggaacccccatgttgatttatttcattactgctgatgttaactttccttacttggttaaggttgtttttgtcactgtaaagttacaggttttcctattgtaattataaatatcttattaggagataccttgaaaatatgtgaataaccagtgtactcagcaaacttttacccactagtttagcatccattgatgattcttttctgatcaattattattatgatgcatgccaaatagtggctttctaattccatcatttctacttttattaattggctttctacttgaggaagagctttctctcctctcccatttacgtatttatatatatataaatttatatacacatatatatatgtaaatacatacagaatacacactgggtgtattcttacattcttattttatacaacaagatacattcctttactatcataatttactttgatgcttaagttttc

SEQ ID NO: 15451 - DNA, 1047 bp, Homo sapiens
ctcctaacagcaggttattaacgctgccagaaaaaaagtgtcccctctaccggtctggtgaagaaacctcatcgctacgggcctgggactgtggcacttctagagattctcgttaccagaaattgacctagcttctcatctggaagctgcctttctagaggttggtgagagagatcacccaggatttcaaaaccaactttaggtttcagagcacagtcattggggtgctgcaggaggctagtgaagtgtacctggaggctagtgaagtgtacctggtgggttggtttgaagatgctaatttgtgtgccatctacggtaagagagttggctctcatgcccaaagacatccagttggctcgccagacacggagtgagcgagcttaagtgaaggcagattttaaggcattttatatgaattctgtaaaatactttggtttaatttgtgactttttggggagaaattatttataatatgttgcatttgtgcttaagtcattccgtcttttgggatgaatgtgaaaagtgactgttcatagacctcagtgacgtaagcactgttgctcaggagtgacaagttgctaatacgcagaagggatgggtgacattttttcattctcatgacgcatgtttctgtaagttaatgacttgttaggtagctattaaggaactagagttgataaataaatgtgtataggttccttttgcaatataactggttattacttgatccaagtgtttaacatttggagctaagtctgaccatacattactgtgatagaatgtgggccttttcaagggtgaagatacaagccttaaccacagtataacttgcagtttccttaaacaaacaaagaaataaaaacctagcatggagtacattatgtgcatttataatagctattttaaatattgtagtgtcaacattcaaaaattaattcttttacattcgcaaatggtggggagtcttgtcattaaggtgtgtataacttagaatccacttggttttctcctaactggactgcatttgttttcatagtagtaaaatgt

SEQ ID NO: 15452 - DNA, 1023 bp, Homo sapiens
ggcaatggtaagtatttgtaatgaacttgaatcaatatgaaaattacactgtgttcagaatattggcataaattaatggagcatttaatacattttggaaatatttctactgaagatggctaaaataatactatatatttaaaagactagcctttagctaaaaaatacacacttaaggccgggcgtggtggctcagcctataatcccagcactttgggaggccgaggcaggcggatcacctgaggtcaggagttggaggccagcctggccaacatggcaaaacctcatctctactaaaagtacaaaaattagtcgggcgtggtggcgggcaactgtaatcccagctactcaggaggatgaggcaggagaagcttgaacccagcagggggaggttgcagtgagccgagatcgcaccactgcaaaaaaaaaaaaaaaatcacttaagtaaattctctgagaaacaatgttgataaatagactaagaaataccataacttatatgtattaaatatttactgtgtgcaaagcactgttttgagcatttgacaaacaagtattttgtcatttaattctcacagcaaccctggagtagatatcatttcatttcacatataaggaaataggcatagaaaaattaacaattgtgtctaagttgtaaaaccagtaagagtttgggtagaatttaaacccagaagatagaactcctacattacatgacttttatcctgctgatcctaaagactacgattaccttactattaggtagataattctatttttccacttagtttgtaaaatttacagatattaaagctccatccatattctccatgtaccagtattcttgctgtatttcttgaagtgcattaactgcccttggtatatttatcagtatcaccaaatctatggaatcacaaagcaacagaataatcatcatgtaggtgtatgaatttatgcctaacacatctaacatacaaagtgtgtgtgtgtactatataacctaatctatgcgtataattttat

SEQ ID NO: 15453 - DNA, 1034 bp, Homo sapiens
acagaagtagcagtaagtggagtagctctgtagtgcaagtatgactggcatgttttagagacagcatggtgaagaccattatcctaagctaacacagaaacggaaaaccaaataccgcatgttctcacttataagtgggagctaaacattgagtacacgtagttataaaaatagaaacaatagacactggggaatacaagactggagagggaggcagcagggtaagagttggatactatgctcactacctgggtgatggattcatttttacctcagacctcagtattacacaatatacctttgtaacctgtacatgtgcccccagattctaaaataaaagttattttaactttttaaaaagaaacagaacattactagagccctagaagttccctttgtgacccctaccagttaccactccctttcctcaaaggtaaccattatcctgacttaacactgtgggttagttttacctctttttggacttcatataagcaagattatacagtatgttatctttagaatctgacctcttttgctcaatgttgtatgtctgagacctcactataatagttgttcattaatttttattgatgattagactgtaatttatctattctattgctgatggacatttgaattttttccagtttttgtatttaatgatcattgctgctatctgcatacatatttgtgcacttctttttagtgcatttaatgtaggcattcatattgggcttatacctaggaatgaaatttctggatcataccgtatacatatgctcagctttagtagaaataaccaaaaagcttttcaaaacgggttgtccatttgatactctcattggtaatatatatgagttccagtttttccacagttactaacatgttagcaagtgtcagtgtttttaattcaagtgtattatattgtacttttaatttgtatttctctgataactttttgtatgtcctaaatgagtcctttgatagttctgagtattacaaaattctccctttcattatattaagctttt

SEQ ID NO: 15454 - DNA, 1047 bp, Homo sapiens
tttacaaatttgtgagaagtttcattatgaacactctgctgacaaattgtgaatttaaagccacatgtttctatgttaaaaaggatcaaaatgtttggttataaatcctcaggattaaaagtattagaaataattttacatattcaggcaagaagagaaaagctatttaagatttcccagaaatattttggaaaagagcagcactgggaaatagaaattaatgtaatcagttgcaagatacttgccttctataattataacaacttaatctgttaggcacctttggctattcaataatcattggatgttgtaatagaatgtaagtggcttttaatgtagctccaaggatatttataaattgtgttattgctgttattgttttaaatgtgagtgaatattaaattataggaagtggtatcaagtgataggaaaatggcattaggttttgaaattttattttgataatttaacacatatggagggtttgctatatgtatgagatattctgttagatgctgtgggagctagagagatatactctttttcactcaaagagagtaaaatatagtgggagagaccctaataactattttggtgaaggatgaatctaattccttatctctgacatcgtaagaagtgattagagacctagtttatgcataagcaattccttagtgtccaattaggttttattggcatgaaaaagaaatattaaaaaacctaatatttatagaactccaaatctcctagaattggataatgtattttctagtaagaaaactatagaaattttaaatatatatatttcctgtagtatcaagactctggctgacattgagagaaatatatgtacatgttgtgtttattttcagttttggtgttggattcctggtattgtcacctaagtgctcattttcaggaaaatcagattctacaataaacacttactgcttaaagttcagtaaacttgtgataacctcataacctctgtagtctaaaagttaaggaattataagatgtcacatgtcaagttaacatccagttcta

SEQ ID NO: 15455 - DNA, 1006 bp, Homo sapiens
gatggggtttcatcatgttggtcaggctggtcttgagtgctgacctcaagtgatcgccctcttcatcttcagcctcccaaagtgctgggattacaggcacgagccaccttgcccggctagtctaccatattcttattttccaaatgtgaccaccctaactttgtcccttgtgctttatatgattgttgcatttcaatacagcatataatattaggaatattatccctttggtgatgtggatttaactgtttgtggaaactagctttaagatccaaatttggaaaatatggagaggccaacccagaagacttttattgtttctttgaaaagttagttttaccttttgcaaaagatcttagtgccgtaacattttaaaaattgtatttccaaaattagctgggcatgcctgtaatcccaactactagggaggctgaggcaggagaatcggttaaacccgggaggcagaggctgcagtgagccaagatcacgctattgcactccagccagggcaacaagagcgaaactccatctcaaaagaaaaaaagaaaaaaatgtattttatgtgccaacgtgactccactattacaatctggtaatcttaaaacaattttacagtgagtacttgccagtgtattccaataaaaataaactcgtttgtcctgtgatgtaaaagtgttgcaggtttatgatggtgctaataactaactggttttcataatgtatggcatgttacagtttacaaaaagttttttttttgttttttgtttgtttgtttgagaaggagtctcactctgttgcccagactggagtgcagtggctcaatcctggctcactgcaacctccaccttctgggttcaagtgattcccctgcctcagcctcccgagtagctgggattacaggcacccaccaccgcacccagctaatttttttatttttagtagaagatggggtttcactatgttagctaggctggtctcaaactcctgaccttaagtgatctgccca

SEQ ID NO: 15456 - DNA, 1051 bp, Homo sapiens
gaatttattttccaaatcggggacagaggcaatatcactgtattcattctaattggttattataaaaacacctagtaatatcaattattgctgctaaaacagttcaaatctttgtgggggggaagtcaccatcccttattttaatgccttatgatttcataggaattaaatagtaatgattttttttaactttaggaaataactgaaatcatgttatggtttggtgaattattaacagaatcttattagaagaatttaggcttccaaagaagctggaagttatttgaaattaaattatagatgtgtaagttactaatagtcacatcacagccttgaaattagatactgagggttttgtttgtttatttattaccaaatccatcaaactctttaaactgactttggtcattgttggctattgtttgtcattcttttaaaggacacaaattaataactctgtgtgtgtgtgttgttttttgtttttagggtccaccaaaatatactaaatctgttctgaaaaagggagataaaaccaactttcccaaaaagggagatgttgttcactgctggtatacaggaacactacaagatgggactgtttttgatactaatattcaaacaagtaagtctaaatggaatcttatgtttttggcttaaagagattctaaatacttgggtggcagacagatgagtagttagcagtacctttttcctgactgtcacctactttcatccagacatactttcccccaagatctacttggaagaggtcttcagttcactgattattggctggctaaagacctcttgttctttggaaagcaaaagataaggaatctcagtctaaacctggttaatgtcccaaagtaaggcattagtatttgaatagaaaaggcaggatagtatgctgttttgtgatataagtataggtcctacccctctaccctttgttaagaatgtaattatttttacagccagaattttattgatggatgatctttgtaaattttttccttcttttaaaatacatagtattgtaattctgaaatca

SEQ ID NO: 15457 - DNA, 1048 bp, Homo sapiens
aggaggctgagcagggaggatcctttgagcctgggagccagagattgtagtgagacaagattgtgtgccactgcactgcctaggtggcagagtaagaccttgtctcaaaaaaaaaaaaaattttttttctttgaccacaaatgtctgctcattgtctactacatcatgccctttcctacctccatattttatttcttccttagagtgtccttttactatccctatttgtcacttctgtgctccctttaagacccagctcctgggctcattgcttcctctggaatttttaccatgtgagactttgctgtatacatacacaactgcatacattcctaagcacatttgtattatttatttctacctttattttaatataaagacttgtctaatagctcttatgggattttaaatcagtcattgtcaatatatttattgtctattatatattaaatagcattgaggaaaattttcatggtatgaatgagtattgtacaggaaagaaaatataagttacgacagaaactcacacttagcaattagaagtcagtataaaagtactcaaacgaaaaatttgataacttcatctttgataactgcttcatatgtagttattaccaacttctggtgattctgcctccaaaatatatcccaaagccattcatgttttgtcatcctcactgttagcaccctggtctaaacctaaactactatagtaacttttttcctaacaagtctctccacttctacttttgcttcccaagtcattttttatatttcagtcacagtgatctatttaaaacacaaatctggctgggcactgtggctcacgcctgtaatcccaacactttgggaggctgaagcaggcagatcacctgaggtcaggaattcgagaccagcctggccaacatgtgaaactccacctgcactaaaaatacaaaaattagccaagtgtggtggttcatgcctgtagtcccagctgctggggaggctgaggcaggagaattgcttgaactcgggaaacagaggttgcagtgagccgagatcacac

SEQ ID NO: 15458 - DNA, 1061 bp, Homo sapiens
agtcagcatggtgaattagcatctaaaatggagttcctctagcctctactcctctacgtactactgtttttaattatctaacttggaaagttacaagaagaaccaacttatcagtcctccaaaactattttgtgataatgagaaaataccttttatggggtgcctgctgataataaatacttgttttctagttgccaagtttccaggacagtgaagatgatgatgatattctgccaaatatggacaaaaatccaacaactccatcatcagttatctttccattggtaaaaactcctcaatgtcagcatgtcagtcctggcatgctaggttctataaataggtaaatattcatgcatatgatatgttaattctctgcatcagagtagtgaggaacatttaaacatttcatgaggaccatagatgccagtaatgggaagaggcattatttaaaaaatcaagaatgtgtagtttctagaagttaaggatggacaagttcatcaaatcggggtgctattcaataaacagcattgtgatataacccacatttacttctggatcaattcgaaatggatcaaggttttacttgtaaaaaactttaaaaaaaaaaaactaaagaaaccttggagaattattttataataccagattagtgatggtctttctaactatactataaaacctacaagccattaatgaaaagatgaataaagtcaactgtgtaaaaatgtttaacaaattttacctggtaccaaccactacaaacaaaagacaacctgagaaaagaatatatgcaacttgtcacaggcaaaaggctaatttccgtaatatatacagcattcctacaaactaacaaggaatgcattgttaatttttgtgcattgctagtgagaaggtaaagtagtgcgatctttgcagcaacaatttgtaagtatcaaaattataaatgcacatgccctttgacttaggaattttacttatagaattgtgaatgtacagcttattcattgtagcattgtttaaatggcagtacctcaaaaatctatcagtagggactaattaaa

SEQ ID NO: 15459 - DNA, 1042 bp, Homo sapiens
ccaacagtcccttaaaatatcaaattttgtcgttctgttcagaatccccagtaacttgtcatctcaatagaaaacactaagcctttaccatggtttaccgagctgtacttagttaatcctggagatctccaacctcaccacttattccctctcacttactcctttcaaattatgccttccatgctgcctacctggatctctgcgctgactctctgtgcttagaagaatctttttgctgatatccatgtgactcattgctcactttattcagttctctcttccaagacgttccctgactgttttgtcttaaaaagcacctcatttatctaatgccttttatttatttttcatagtaattaccaccacctgacattttcatattggtttagatgccattatcctgcttgcctccacccccaaccctaacacacacacaagaatgttggccctaagaggggcagctgtttactttctcactcaatctccactatctaaaacagtgtgtagaactcaacaaatatttgttgaatgaataatgaatgaacattttgatatcttatataagcagtataatagtatggtacaggattattatctccatctgactggtgcgttgatatatctcaggtagttccaaatgtgggagaaggcaaaaagagagtattatttactgttacttccccaagtcctacctataattttttacttttttcagaaagaaacatttaaaaggggcttaaaaacagaagccatatttgtgtcttgggtgagggtaagacaagatggtggatcccctcgccattactactgagacccatggcttataaactatcctacttataattttttatttttatgtatttactttttgagacagagtcttgttccatcacctgttgaggctcactgaagcctcgacctcccaagctcaagtgatcctcccacctctgcctctccagtagctgggactacaggtgtgtaccaccacacccagctaatttttaaacttttttttggaatcttactatgttgcccaggctgg

SEQ ID NO: 15460 - DNA, 1032 bp, Homo sapiens
gggctatagaagcagttgatcattcagcttatgttttcttctggttaaattgcatgcttgttgcaaacatctttagatgttaataaaattatttagaaaatggtcgggcgcggtggcacacgcctgtgatcccacactttgggaggccgaggcgggtggatcttttgagctcaggagttcaagaaaatggtaggccacttcatcctggccttcaaagataaacactgtttacaatttggttcaccgcttccagagtttttctctatgcctgtatgtgttttatttatttacttaaaaatttttttaaacaaatgcaattctatgttgttactttctttttcaatttaatgtttcttggatacttttccatataagtacatatatatctttttattgaatacatagagtaaattgtatggatgtggcgggatttattttgtcctttattggtagacatctgggttgtttcatttcattttatgctgcagtgaacttccctgtgtagtgggtgtgtagactgttgcctgttggtaaataactgaagctatggagtcgggtagaatcggttcctctttctcacttattgtcaagtgaccttgggcagcttacttaaccaccttataccttaatttctcttttttcaaattgggagtaataacagtacttaactctttagagttgctgttagattatatagtggctggcatgtaaatattcagtaaatatcggcaattatggtacatatatatttgcattcttacgcagatgtttctataggaaaaaacaagttagaagtggaatttccgtgtcaatagtatgcatacttgcattttgaaattaatatttaccaatgtgatatgaaaaagaaatctcactgttttagtttgcatctccatttattagtaaaatcaggtgtcacaactcgtttattggccttttgtattctattaatcacctttcatgtcccatgaccattttctgttttgtatattttttaaagttgatttattaggtctctttgaatgttattta

SEQ ID NO: 15461 - DNA, 1048 bp, Homo sapiens
ggaagtatagcctatgggatttagtgattgaatatatgtagggagtgaaggactagacaaaattaaataagtctggggtttctagtttgaacactgggtagacagaggacaggtgagtagagataatatgataataaatgttctggaataaagaatgggcttgggagttaagcagacctgggtttgggttccagctttatccctgcgataatttgggctagttacttagtctatttaaactacatctctttgtccacctatacattgaagatgagaggtacctccctattttgctgtgaggattaaatgaggtaacatatgaggattatgtgacctcatttaatcctagacccatgccttgctcatagtgtttgcaatcaatagcattagttgtaataatagtagtaaagatttgtggaggccagagattatgatttctgtatatcttatgtggtaggtgttgtgatttgtgatttgctttttaaaggtctgaagagagcttgattggaaaattttaaacttctgtgttattgggaacttgggcgcattagtttatttggtattaacatggaaggcctctaatgtgagataagattatagtaatgtcaccactccttacagtggagttgtgattcctctaggagttttcagatttggctagtcagtttttaaataaaataattttatcctatgataagctaatgagttttttttttttttaatgcattcccaaaacgaagttaaacactggcttccacaataatgtcaggtttatgccattacatttagggtcttctccatgaacttcaaagcaaataagatagtaacatactcaaactatcatgaatagaaaatagaccaactaatgaaaactctctagaatgtttttatatggatatttaaaatatgaattttgctatcatggagatacatatattattaaatcttgattaactttataacatagggagtgatgtgctagagccatctcttcatggcctgtgaaagattattcttaaacacaatgaccattacaaattaaatgaca

SEQ ID NO: 15462 - DNA, 1033 bp, Homo sapiens
attttcagtgttttatgattttaggcagcatttttgttgcaggtatccattgcatttagcttgatttctcaaagtgtatatttgttgagtcagaaggatagagtgacttttcaaaagagaggaaaacatcattaaagagagaatagtacattgtgaatgcaaatccttagagagctcatagtggctcctgagaataagtgaagtaggtgatttgatgatgtgatgcttcctagggaatatggctcagaggtctgcacttcataatatctgagatctggaattagtctatctgttaagccaggtgtatagacatggcatttgccaaataagaaatgactttaaaaatatgaggttgttccaaaatagttccccttgttctcaagcagtggctctactgatttattatctggcttcatggagaggagagagtttattatcaagaaacataatgaccttctagctcagtgcactttatttacctgaagtaatactgagatgggggaaaatgtctttggactcttggtttatctcttaattccaaaaaagaggagaaaatagtccttactcatttggatatcattatctcacaaattatagcttattaaggtaagaatgcccatatatggtgtaaactcataattttttttccaaatgaaaagatgactccagaagattaaaacaatgtgacttggaaagtaattagggagggtaaagagggataaaatttttccacttccctctgacaaaataatcaaataaaaacttgggagaatttaacctttgccgtttttatacttgcgtttactcatcatttttaaaagaaaaccatcaactatttccattaagcattacatgtaaattcaaactctctaagatagagtaacaatgtaattgaccacatgagttgtatttttgagtcatatgctgtatacaaaattgcaatttaaaataattgcatggaggggaaaacaaaacaggtgacttaagacatgtggaccttccatcctatgaagagaactgtggagaaacaaat

SEQ ID NO: 15463 - DNA, 1034 bp, Homo sapiens
tttttccatgagtatatgtaacctcctaaattacatgaattctattgaataagcttttatactgtgactgtggggtgtcacactttatgccagatgacagcaatgaataaaacacagaagatctatctatctatctatctatctatctatctatctatctatctatctgtctatctatctatctatcacatttgaaatataatttggtgaatgcagtgataaagtagaatttgggtacagaatagggaaatcatatttcttggattcagcattcatttggaaacttgcgaagtattgccagataagatagccggagtttcttcccactaaacattttgtttgagtcccaaataattttttaaacttgtgattctgtggtatctctgccttgctaaacacaactttccactcttggaaagtaataggttttagtgtttctctgtttactgagcaagtgcttcacataggtgagttactctgctgttgctccccataattgctttttgatgtgttatgttatactgttggccaataaagtgcttgatcaatatgcactacatcccagataatcctgttattttcattggctctactatgctttgtttggcatgtggctttccaagcacttaagattgggaacatctcaaacgtaacatcagaactgaatgcctactgtttttttattttttgattatggccattttggcaggagtaaagtgatatcacattgtggttttgattggcatttccctggtcattagtgatgttgagtattttctcatgtttgttggccatttgtatatcttcttttgagaattgtctcttcttgtccttagccaacttttcgataggattgtttgtttttttgctgattttttttgagtttgttgtcgattctgggtattagtcccttgtcaaatatatatatagtgaagattttctcccactctgtgggttgtctgtttactctgctgactgttccttttgccatgcaaaagctctttaggttaattaagtcccagctatttatcttt

SEQ ID NO: 15464 - DNA, 1061 bp, Homo sapiens
gaatggcacaaattctgttgtcaacccctccaatagagctacatagtagccatatttaacacaactccaaatattgcaaagatgttttaaatgtgttcataactgatgaaagaaatttaaaatagttcatataaaagtataggtaaaatttttaataagtgaatgggggtttatttttagtgtgacatgaaaagttaaccacatgaaatcttttaccagcaaagaaaattacattgtcatcacgtgtgatgaatgttgataggacagatatgtatcattcacaaaggaaatcaggatagctatatataaatgtatgtgcagataacatattaaatccatatcctagattgtttgggtgttttcagccctcataatatgaagtgaatctctctttcacaataaataatatttctgcaagttcaggatttgtttatttctgggatggttggtgggtgtgcgtgtgcgtgtgtgtgtgtgtgtgtgtgtgtgtgagagagagagagagagagagataaatgaagtaaagttgcctgcaaatagtagattcagaacttcctccccaaaatatgcattcccctcttctggtaaatgtctgaagtctaccttgcagcttgttttatttcttttgtttaaaactttgctaatgtgttcagatgtagaattcatttgaataggatatgttttcagcagtttgcagtctaatgaacaacggggcttttggggtcacacagagctggagttgacccttgccagtagctggctgagtggccacagggaaattatttataccctaaggtctcctcaattatctctacaggaaaataaggtaatggtagttacttcagagttggtatgaaaaagaaatgagaaaactataacaatgatcacaatggctggtgtttggaaggtgcttaaaactcaatgtgaacggctttctgagattcttctctaacttcggttttcaatacccgcaataagggaaagaaaatatggtatcagtaggtctccagaggatgctaaagtgttggagaggtgaggaaggggaaatattaggtcctgct

SEQ ID NO: 15465 - DNA, 1070 bp, Homo sapiens
tttaaaaaggactaataggccgggtgcggtgattcacacttgtaatcccagcactttgggaggccgaggtgggtggatcacctggggtcaggagttcaagagcagcctggccaacatggtgaaccctgtctctactaaaaatacaaaaattagccaggtgtggtggtgggcacctgtaatcccagccactcgggaggctgaggcagagaatcgcttgaacctgggaggcagaggttgcagtgagccgaaattgggccactgcactccagcctaggcgacagagcgagcctccgtctcaaaaaaaaaaaaaagactaatacaatttaagtgatcttagaaatgctttattattcacccagtttaccagaatattctactcttcactatatatgagactgttagatcttttgtaggcatatgagttgaatcccttaaagttctttatttagtaacaagatcataccaacagtggtgctctaaaatcattgctgtccggtagaacatacgtgagtgatggagatgttttatatttgtgctgtccaataggacagttgctaaccacatttggtttttgagcacttgatatgaggctagtaagaatgaggaagtaaatttttacttttgtttaattttaattaattttaatttaaatagtcacatatgattagtgactacctagtatatagctcagttttaactgattcatgtcatatttctaatgtttttggacaaatgtatcttgtgaacattttatatatgagctcatacaaatatggaaaatgcatttatagtccattatctaaaaaattgttctatttttatgttatgctttcttaggtgcaaactttagaaattagtgagatttcagttgtcccttttgtgtgtgacaacttctaaaagtagcctaaggaaccatttggcccattactttgtgcttaaagcagacccagtaattcacaggagaagcatatagaagagcgtttggaaactcaagacaggcctcaagcaaaaggtgtctgagataaagaagtacgtgctccaaaactgtactggcaggtaagtaatgagga

SEQ ID NO: 15466 - DNA, 1049 bp, Homo sapiens
aaaatagtagtgacaaggatatcaggattgagaaaaacaagcaaatgaaatggaaatgaaataaataaaatgagctaaaaacaaaattatgaacatttaagacaaaatagaatggatatatgtaattggtgggtgtttgtttgtttgagacaggatttcgctctgctgcccaggctggagtgcagtagtagaatctcagctcactgcaacttccacctcctgggctcaagcaatccttccaccttggcctcccaagtagctgggactacaggggcccgccatcgcgcctggctaatttttgtatttcttgtagagacgtagttttgccatgttgcccaggctggtctcgaactcctgagctcaagcaaaccacctgcctctgcctctcaagatgctgggattacaggcatgagccactatgcccattgtaattggtgtttttgaagaagagataaaaataatagaatgaaaaaaatttatttttttaaattgcagaaataagagactttatataatgaacaggcacaataagttgcaggcaaaattgacactgaatatttaacaatgacatatctattactaaagttaccagatttcaaatatatagcatgaatctttgttagtcaagcagaaaaagtgttacatatgagcataaacacgtcagtttgtcctcatagttctctatcacaatgtttgtccatagaagaatttaagcagtgcttataaagtcttgagggaaaatcttatattcaactgaaaagttgttcatgggtaaaggcatacaacatatatgttttgccctgaacatgcaaaaactcctagactttagtttctctgatcacttcttaaacaactatagtacaaatgtcataaagcattagcagagaacctatattcaaagtactgacaatgagcatgatatttacaactgtagaactaaaatataaataaatgtacggattgagatttcaaagaaacatatacatatttcaaatcttgataatgtaggaatgttataagtataaaagttgaaagaagaaatgctagag

SEQ ID NO: 15467 - DNA, 1046 bp, Homo sapiens
ttggcctctctagcacagttgggacaacttttatggatgatatcctgaaatatgttttccaagttgcttgctttctctttctctctctctgggatgccaggaagtcatagctttggtctctttacataatctcatatttcttagaggttttgttcattcattgttttttcttcacttttgtctcacagttattttggagagagtcttcgagctctgagattctttcctcagcttggtcaattctgctgttattcttgtgattgtattctgaaatttttgaaatgagtttttagctctatgaggtatgttttgttctttctttaaatggccattttcatctttcatcttctgtatcattttatcaaatttcttagaatccttggattgggttttgacttcctcctgaatctcagtgatcttcattcttatccatattctgaattctatttctgtcatttcagccatttcatactggctaagaactattcctggggaactaatgtggtcgtttggaggtaagaaggcactctggctttttgaattgccagagttattgcactggttctttctcatctttgtgggctgatgttccttcagtctttgaagttgctgtcctttggatttttaaaaaatttcatcctctttcatgtccttgggggtttgattgtagttttgtttctggaagattttagtgggccaaggctcagctaaggactcctgggctgcagtctgtatctctggagggctggtttcaggctcccagctttttttctctggcccctagaagttaggaaccttctgcactggggttgttgtggtgtttctggacctctggtaacaacattctgatgtgtggtgtcagccaaggtgcttcactgtgtggtggcaacaggatccatgatggtttgtgtgttccagcagcagcggcagcatggtgaggtgcacactcatcagctgaggctgggcactggcaggcacagttgtgccagcctccataaatatgtttgcattggtggcagtggcagtgtggcacttgtggtaggggg

SEQ ID NO: 15468 - DNA, 1044 bp, Homo sapiens
tatgaacctcaattctttcacgtgtaaaatgggaccaataataaactcctaccttacataggacacggtgaagatttaatgagataagatatttaaagtgtttcaaagtatcacagatataacaaataatgtgtgtgtgtgtgtgtgtgtgtgtgtgtgtgtgtgtgtgttttcacttcctttcttgtttctacctagggatccagtctgcttgtcttccttcctttctccccctttcctcttcctctctccttccaacctttctctttccttccctcctactctcctcccctgatttttctttccttccttcctttctctttcttccctcctgctctcctttcttcctccccctactttctccttctttccttcccttcttactcctccactttgtccttccttcctttctccctccttccctccttctctcctttcttcctcctcccactttctctctttctcttttctctcttttggcacctggcagagagcagaccagctcagatctcatatagtaggccaagtaagaatttttttgttggaaatatataaagcaaatgtttcttacttagaagatatatacaaaaaggaattgccactctctttttgatgagaagccaggactaagtcttgagcacacaaccaacaattatgggggaaaaaaatcttgattatctgagtgtcagaagaaagaaagcagaggccaacaggtttgagctgagtctagttatgtgcttagcgctcttcaggatctagttatttttgcttgccaactcatgttcccctggagctccactcttcggtaatgtgaactagggaaaaggcaaggccaggtgtcagtcccggtatcctcccatgctccaggtgtcagtcctggagagtgggaggggcagtagggttgcgccctaggcactgcagggctactgtaaagcactgcactcccatctgccatcgttgtaccagggagctcctctgatctttatagctttaggaaggaacatccttagaaggaggtggtctccttaatttataattcaccaa

SEQ ID NO: 15469 - DNA, 1034 bp, Homo sapiens
atgatttttttccaagtctttttgtggacacatgtctttatttatcttggataaatttccagtagtagaaccactggttcatatgataaatgtacatttaatgtttttttcagaggtagagtcttgctctgttgcccaggctggagtgcagtggcgtgatcatggctcactgcagcctcaaactcgtgaactcaagcaatcctcccgtctcagtcccccaagtagctgagactacaggtgtgtgccaccacatctagctaattatttttattcttattttaagtagagacagtgtctcactttgttggccaggctggaactcctggcttcaagtgatcctcctaccctggcctcccaaaatgctgggattacaggtgtgagtcactgcacgcaacctactcctgtacttcagaaaaatagatgaatttgtttatttaaaggttgtgacctggcataactactcttcagctacatctcagcttaaatgtccagttttacttatattgtaatttaagacatttggaattagaaacatttgatgtgtcttcatcttaaagaattttgacaactttttttatattgctatgatttattcatatttgttgggtatttctatatgtcatcatttatgactattgtataatgttccattatgtgaatatatcccagtttattcatccagttttttttttttttttttttgagatggcgtctcactgtttctcagactggagtgcagtggcatgatctcggctcactgcaacctccacttcctaggttcaagcgattctcctgcctcagcctcccaagtagctgggattacaggtgactgccaccatgcccggctaatttttgtatttttagtagatacgaggttcacggtgttggccaggctgctctcgaactcctaacctcaagtgatccatctgccttggcctcccaaagtgctgggattacagacatgagccaccacgcccggcccatctagtatttcttgaaaggcatttgctttcttagcatgtttttgccattgt

SEQ ID NO: 15470 - DNA, 1002 bp, Homo sapiens
tggaggggttgtacaagttggactcagtaaaaggtgaagtgtaggtatagtgtgtggttgctttaacattggtaatgcaggtggctgacgtgagatggaataaatgaaggtaggtgaaaattcttgggatttgacacgttgtcatctggaagcctattagaaatgtgttgttagggtataccctgtgcctcctgaattggtgtacatttgaacaagagcccctacgcaatccaagtttggaaagtactgttctaccacttgtggataacaattgtacaaatacttgagttctgtatgccagatgcagaattctgtagtgaatgaaaacttctcaattgaatttatatgctgatagagcagcaatacataataatgtgcattatttgaaaaaaagcaggttaaaagaggtatatgtgctagatgttgaggtcagagaagaaagccatacttaaatttggcttatgaacttaatagaggttacagcatagattctgtggggaagagaattcctggatggaatcagagaaatagcaaagttgtggctgaagagtgagaaagctggccagggtctgtagtagccctgtaggttatagttagatattgtgagatgagaatccatttggaaacttacttttgtagaggtggggtattactatgctgtccaggttagtctgaactcttgggatcaactgattctcctgcagcctcccaagtacctgggacaacaggtgtgcactactgtgcccagcaatgaacttaagttcatttcactgaggcagaggtagaaataaagctattgcaatagtctaggcaagtgatatttgcttgcattaggatagatgggagtggttgagatagtcactaagttttttttttttttttttttttggggggcagggtcttgctctatcacccaagctggagtgcagtggcgcactgcagcctcaacctcttgggctcaagctatccttccacttcagccttctgagtagctgggacatg

SEQ ID NO: 15471 - DNA, 1027 bp, Homo sapiens
actgctgagagcaagatgggtcaccagcagctgtactggagccacccgcgaaaattcggccagggttctcgctcttggtgagaaatagtttgtgattttggggaagcgttgccgtggagcgctaggctgcttaaaatctcaagtagaggaggccacgggcggcacgagggagcacgccgactgggagtcgctggtgccgccattacaggcctgtactgtggcttgggagtcccgggatgcgggtagtagccgtctgagtgcggagtcttgtaatttctatgacctgcaaaaccgctgtctcttttcttacagtcgtgtctgttcaaaccggcacggtctgatccggaaatatggcctcaatatgtgccgccagtgtttccgtcagtacgcgaaggatatcggtttcattaaggtaggcgtctgcaggcgtactccatgttgtttgggcagagaaggttgtgggggttattttttccgcgaaagacaaacggacagatcttccctggagtggtaattctgagcattcgaccaagagcttttcctctttttttagttggtagctggtgacagtgttgatggtttgggcaatcaaattaatagaatggagaaggtgaaggacttagtctttcctactcccttttttacctagatagcttagccagttttaggtgccgtgtattgtgtttggtgaaattcactttagagaagccactaaaattgttttacatttgtttcatttatcaatcttgtaagtacctattctcttttttttttttttagagatagggtctccctctgtcgcccaggttgaagtgcagtggcgttgttacggctcactgcagcctcgaactcctcctggtctcaggcgatcctcttgccttggcgtcccgagtagctgggactaaaggctcttgccaccacgcgcggctgtacctagatattttctaaccaaatatatgtattaaccgctgaccccaagtttttttttttttttttttgagtcggagtcgcactcacccaacctgga

SEQ ID NO: 15472 - DNA, 1078 bp, Homo sapiens
taactctgatcagctacaaggaaaggaggaaagagtaaatgaagaaagtcatctaactgaaaaggaatatatagaacattgtaacacccctacaactgattctgattcatctatagcagttaaagcactacaaatagatagctttggtttagttacatgctttcaacaagagtctcttgatgtttctcaaatgatacttggaaaatctcagcaacctgagtcaaaaatgcaatctgaatttataaaagaaaaaagtgctacttgttcaaatgaggaaaaagataacttaaacgagtcagtaataactgaagagaaagaaacagatggagatcacctatcttcattactgaacaaaactacggttcacaatatacctggattcgacagcataaaagaaaccaatatgcaggatggtagtgtgcaggtcattaaagatcatgtgaccaattgtgcattcagttttcagaattctttgctatatgatttggattaattctatataattttggacttttaaatattaaggttaaaaaatacctgtatctaaaattgattctgttaactgttgtcttaaaactaaaggtattaaagtataaaattaaaatttgcaattttttttaaaaaattgcaattttgattctcatgggggaaattggagataatttttttttttttgcctctggagtttaaagtttccttatggagataagttttgtgattcctgtaatagatgtgtatgttttctatttgagagttaaaacatttgagagttaaaacatttagttttaatacaacctatgtatatatacttctgtgttaaattttgctttgtcattaataaaatttaaaaatattcactaattgtgtttgtcacacaaagtaattctcaagaatgcatttaactggaattataagtacatgtgtggggggtagaatttcaaaactgtttctcagtctcactaagtaggacatatttaagcttgaaatagagcttagaggggaaagaactttactaaccaatattaatctaaacaattacgatacaaattcaccagataaaatgtagtacttttcatca

SEQ ID NO: 15473 - DNA, 1035 bp, Homo sapiens
tattggtagtcaattcagactcttgaataatggatagcagtttaaaaatagatattattactacatatcctttaagaaaggttacaaaggaagaatacaaagattacttatttactgttcgtattgctcattgtaatcataagttcttcctgtgggaataccatcagaggcagccttggttcgcctcttttctgcctacattcactcctttgctggccttctccagtgtcctctggctttaagtatcatctgtgtattgacaccttccacatttatatttccacttcaacctaccttccaaactccagactcaggtatccagttgcctacttatcaccatcccaacctaagtgaactcctgatcttcctccccacgagtgtccctaacctcttctgtagacttctccatgttagttcatgacaccttcatggtctgaacaatgattattccagttgttcaggccaaacactttggggtttctctcacatgttttttcaggaagtcccattaacttcaaattatatccagaatctgctctctctctatacctctacctccacaaccctctaccacagtggtccccaacctttttggcaccagggactgatcttatgggagacagacgccagggggggtgggggtgattttgggatgattcaagcgtattacacttattgtgcactttatttctattattattacattataatatataataaaacaattatacaacttaccataatatagaatcagtaggagccctaagcttgttttcctgaaaccagacggtcccatctggggatgatgggagacagtgacagatcatcagacattagattcttataacgagtgtgcagcctagatcactcacgtgtacagttcacaacaggattcgtgctcctgtgagaatctaatgcccctgctgatctgacaggaggcagaggtcaggatgtaatacaaccgatggggagtggctgtaaatacagatgaagctttgcttgcttgcagcctgctgctcacctcctgctgtgtgg

SEQ ID NO: 15474 - DNA, 1031 bp, Homo sapiens
acaagtgagtaaccctattcttaatggaatgtcatccagaaatacaacctgaaagactaaaattgcagtatcttatctaagcatgataatggtagtactgatagctgataacaattttgttacaagcctttaggaagtaatcagttttaaggagaggctttgattctgatgggaactgaattaaattaagacagagaggcctggcacggtggctcacgcctgtaatcccagcactttgagaggccaaggcaggcagatcacaaggtcaggagattgagaccatgctggctaacgtggtgaaaccctgtctctactaaaaaaatacaaaaaaattagccgggtgtggtggtgagcgcctgtagtctcagctacttgggaggctgaggcagaatagcgtgaacctgggaggcagagcttgcagtgagccgagattgtgccactgcactccagcctgggcgacagagcgagactccatctcaaaaaaaaaaaaaaaaagagagagagaaaattgggattgtcttgaagatgtgtagaaaataaattttcactttctctaagcttttctataggaatctatgccatatggtcgtacataatgttgaaaatgagtacaccatttaagagccaagtactctggttacaaaaccagtgagttcgtatttttccagctaagatgattgcctaattgttttattaacagtacagcaagcccagccttctgtatatcttcttacatgaatatgtacctcttcttgaattttttttttttttttttttgaggcagtcttgctctgttgcccaggctggagtgcagtggcacaatctcagctcactgcaacctccacctcccggattcaagcaattatccggcctcagccttctgagtagctgggattacaagcatgcaccatcacgcctggcttatttttgtatttttagtggtgatggggtttcaccatgttggccaggctggtcttgaactcctgatctcaggtgatccgcctgccttggcctcccaaagtgttgggatt

SEQ ID NO: 15475 - DNA, 1032 bp, Homo sapiens
gtattgcaagcgtttttcacactttggggattgctgtttttcactttttaatagtcttttttgatgagtagcatttttaaattctaattgagtctgatgtatcagtcttttacggtgtttgtgtcctgtttagggacacaaatttacaattttcaaaatgtgttatttcagtcccagttaacacagttaatcaagacaaaaatctctagggtggggcctagatgtttatagtttaaaacccctagagtgatttggggatgtaatcagggtaaagaatcattggtttatttaataaaatacagagtcttgaaagcctctagaataagtgcctagcctagctttgctgctttatttcctgttcttcctccatgtgtaccctgacccaaaccaaatgtgatgacttgctattactgttctcttcctttttagacttgcttttccaatactgttttactttatttcttcctcacagttctttatgttttgttaatgtattcttacttctctgtgtatcttctctccaccctatggtaaattccttgaagatgaggacttcagttatccaactttgtagccttcatattgtttattataatggtgccttattcagtaagcatttttgacagagaatataaagtaacaccatttctttgcaagtatttgttgacatttttttgctgctgaatatttccaaccaaaatcttctgattttgtagagtaaaatgaaaaaaatgaaagaaaaatacaaagaccaggatgaagaagaccgtgaacttatcatgaagttgctgggggtaaataacatctaaaaacattttttcttttgcttttcaaatgggcatctagcccactgcctagcgtatgacaggcattcaatacattcttgttaaaatattcacagtattgaaaatacaacactgactgatgtttcctctatgaattaaagtctgcaggttcaaacaaagaagaaaaagggaagaaggggaagaaaggaaaaacaaaggacgaacctgtgaagaaacagccccagaa

SEQ ID NO: 15476 - DNA, 1388 bp, Homo sapiens
acttaaaagctaaggattttggactataccctttaaagtgatacgaagagaatgtgacataggcaaatgattaaggaagattaatatagaagttaatggccggatgtggtggctcacgcctataatcccagcactttgggaggccaaggcgaatagatcacctgaggtcagaagtttgagaccagcctgaccaacatggtgaaaccccatatctactaaaaatacaaagttaactgggtgtggtggcacaaactccgttttaaaaaaaaaaaattcagagtatgtagactctggaggaagtctgggtgggatgtaatgaggacctgaactaagacgttggcattgggaacagaaagaagaataccacagtaataaaatttacccttccttcttaacctgtgtatttttaatccatttagtcaaccaaccggtcaacagatgttttattgaatgcctaagacctgccaatgctatgttggtacaaagactacaaatcccagtgcctggccatcaaggtgatcaggggcaaaatgtgcctagtgagtaaggatgagtcaggggtgacaatatgttgagcttggatgatggaaagaaagataaatccatgagagatgaaaaacttgcatctttttcccacatgatgattttaagcatctttgtattttctaacttggtgattatcaagtgaagcagaagccatgaccatttatatactgtatatgtgccttccccatggaacttttttagggcactaagaatttcaaattctaagaatgaaatgttttcatgtcttttttattcagggaaatgaaaaagaaaaaacttccaagtgactcaggagatttagaagcgttagagggaaaggataaagaaaaagaaagtactgtacacattgaaactcatcagaacacaagcaaaaatgttgcggctgtgcagccaatgaaacgaggacaaaaggtaaacttcaggatgatctatatggttcacagttaatttgtgaggttcctttttaattttttaaagttgaagtgaaatagaaaatgtaggccaaaaaataatcctgtgtgatttcctttgactaaaaattagttgagtagatacagcatttagggaacacagagatcactattagaagttctttagactttcaagatcatctgcacagaagctctcattttatctggaagagtaataggagattatggcttgccaaagtcacccagctagttaagtagcagagctgatatttattgagaatttagctcagtaatttttagattttggttagagttcttagatattttgctaaaggtggatggtgaagaaagaagtacttatgatagaacatactctttccacactgcccctgcccccacctccccaccccc

SEQ ID NO: 15477 - DNA, 1059 bp, Homo sapiens
tgtcagatgagtggtggcatctcattttacaggtgaggcagtagaccctgttactactattagacagtgttccttttgcagaagaatgagcacctgctatgtgggcgttatataatacgtatttaagtttttatgtgcaaattataataaaagcagcaaaagttatgcaactaattttgctgtcttggtttttggaaatacccaactaaggcagagttgtggttttcattgttgaaagggtagcaatgtccaagaaatttattgtggtaaaggatcttggagatcatttagttcaacctattcatgatacaggttattcttttgtctaagagtaccctttgggaatgatcagacacttttctgttgattttttggagaaatatgggagaaacagtggaatatttttatgacatttttaggaaatcacctggcttggttggtagtcccacactgactttccttatgataattctacagatggaggtgacacgagcagtgatgaggataaagaagaacatgaaactcctgtggaagtagaactcatgactcaggttgaccaagaggatatcactcttcagagtggcagagatgaactaaatgaggagctcattcaggaagaaagctctgaagacgaaggagaatatgaagaggttagaaaagatcaggattctgttggtgaaatgaaggatgaaggggaagagacattaaattatcctgatactaccattgacttgtctcaccttcaaccccaaaggtaattaaaaaataaaattttacatattattgtgtaagctgagaatgatgatgaggtaatccttacaaagataataccaagattgacatcagtacttttacactccattgtcttaatactttttcaacatttgattgggtctctctgcaaagaaattcccaggaccagggtagaaaaatacagtgcatatagagtggccaaactagatccaaatagaaacaagtaaatggttataaatgctaaaaacataacaaaggcaattccatcaaagaaatgtgttttagtctatataatgttttgcagat

SEQ ID NO: 15478 - DNA, 1256 bp, Homo sapiens
ctcgggaggctgaggcaggagaatcgcttgaacccaggagctgagacggtgccattgcactccagcctgggcgacagggcgagactccatctcaaaaaaaaaaagcctcaatacatttaaaactgttgaaattagacaaagtaagttttctgactataatggggtgaaattagaaaccaggagtagagaaaatgttttaaattcgtaagtatgtggaaattaaataccacagttataaataagcaatggaacaaagaggaaatcacaaaagatgccacaaaacactttgagatgaacgaaatgaaaatacagtgtgtcaaaacttatgagatgcaagaagagcagcccttagggggtaatttatagctataaatgcctatatttaaaaagaagaaagatctcaaatcagtaacctaactttgcaccttaagaactagaaaaacaacccaaagcaaggagaaggaagaaaatagtaaatattagagtagaaatgaacaaaacagagaataggaaaaaaatagagaaaatgaacaaaacccaagttggttctttgaaaagataaacaaaattgataaacccttggctagactgaccaagaaaatagaggactcaaatccctaaaatcaggaatgaaatagggaacattacttccgactttacagatattgaaaggattataagggaataccatgaacaattatataccaacagattatgtaacctagatgaaatggacaaattcctagaaagatataaatactaaaactgactcaagaagaaatagagaattgaaataaacctgtaagtacagagattggattaataataaagaaaaacattaaaaaaatactcatcaaagaaaaccctaggccagatggcttcactggtgaattataaagaaggttgaatgccagttcttcacaaactcttccaaaaaataggatcagtgggaacacttcctaacccattctacaaggccagtattacaaaaccaaagataacacaagaaaactacagaccaataccggttataaatatagacaaaaatctttgacaaaatattagcaaactgaatctagcagcatattaaaatgactatatacgatgacaaagcgtaatttatctcaggaatgaaagcttggttcagtatatggaaattaatgtaatataatctactaataaaggacaaaaaacacacatggattatctcaacttatgaagaaaaaccatttgacaaaattcaacatttgtttgtg

SEQ ID NO: 15479 - DNA, 1048 bp, Homo sapiens
gtggtttgttttttaaggaaatagacaaactgaaaggagagctcatagaaatgaacctacaaatagttgacagagccattcaggtagttcgaagtgctttagctaaccagatagattggacagaaattgggttaattgtgaaagaagcccaggctcaaggagaccctgttgcaagtgcaatcaaagaattaaaactacaaacaaaccatgttacaatgctgctaaggtaagtttgactcttagtcaagcagttaatgcttgtctttattttgttattttaattgttcactgtattaaacattttttcttcatattttgaaattctcaaagaaagggaaaaaactaatttagattaaaataaataatgaaacttccagtactgtaaaccatttataattttattgaagaagaaaattgaaaataaaagtgatgtcattgacgttagtgaaatgctattgaatatttttaatagaaatccatacttgttatcagaggaggaagatgatgatgttgatggtgacgtcaatgttgagaaaaatgaaactgaaccaccaaaaggaaaaaagaaaaaacaaaagaataaacagctgcagaagcctcagaaaaataagcccttacttgtagatgttgatctcagcttgtcagcatatgccaatgccaaaaagtaagtcatttaactttacattttaggccaagtgttatctgcaataaattaaggaattaaggacattttaaaaaattttaaatttcacttgtacatgcatactttttttgggtgaaaatacttttttaaatttagttttgttaattatacagtttgttctgatttgttctgtataatttgagaatttgtcaagttagaactaagtagaaaactgaagaataaatattatacttaaaatttaagagaaatatgtttttctaggtattatgatcacaagagatatgctgctaagaaaacacaaaagactgttgaagctgctgagaaggtactgagtatttcttagagtgaatgttagttgtttgtgcctgcgtaatttaatggaca

SEQ ID NO: 15480 - DNA, 1053 bp, Homo sapiens
taaaatgactctgatgtttatatggagcaaaagcatgtgaaaatgttcaggataactctggaaaatactagtaatgatttattactgtctgtgtaacccttcacagattaaaatatgaagctatagtaattaaaactgtaagtttttggagaaggaatagcataaagattccaaaaataatttgaaataatatgggaatttagtttatgaacaaagttcctttcaggtcatggagggaaaggtggatgattcaataaaagctacttggacaacaggctgttcaaaatgaaaccatatatccacatatactggttataaacatgaaatcactatctctaattttcttgaacgcaacattattttgtaagcactttcctgtttttctacatagttgtttagccacggttaattgacacttgattggcactccttttttcctttttttcccccaccattagatattgaaaaagtacttgtttctctgcagaaagcagaagactatatgaaaacaacatccaacttcagtgggaaggtagcaccatgtatacttactatatattgttgtgatttatttgggttttcagaaattaaacgttcattaaaggatcattatatatacattttattttaatttggaaaattgttatctgtaatatgcttattccaggatagtttttttgttttgttttttgagacagtcttgctctgttacccaggctggagtgcagtggcatgatcttggctcattgcaacctctgcttccctggttgaagtgattctcctgtctcagcctcccgagtagctgggactacaggcacgtgccaccatgcctggacagtttttatattttcagtagagatgaggtttcaccgtgttggccaggctggtctcgaactcctgacctcaagtgatccgcctgccttggcctcccaaagtgctgggattatagacatgggccactgcacccggcccaggatagtgttttaaaagtttttgttggtttataagtttttttctgttccctatcttttatagaaagtacaatgtcaggtt

SEQ ID NO: 15481 - DNA, 1047 bp, Homo sapiens
tgatgaaaagtagattatccctatatcttggctattgtgaataatgctgcaatgaacatgaacatatatcttcaggatagtgatgttgttgctagatcacatggtaattctattcttaattttgtgaggagcctttatactgttttgcacaatggctctactaatttacattcccatcaacagcatacaaaagttccctgttctccaccttctccccaatgctttcatattttgggccattctgtatggtttactgtaccgtatgacagtaatgctgtgcagtatgtgctatagccatttttgcatctactggtaccagttctgaaatagcagcggcgccctttctgtttagagtcgccttctggtggtaggaattctggttgctaccatgtgtagcctgcaagcctctagcagctcttttgcagcgacgccgagcgccgggcgcggtggcgcgtgcctgtagtcccagctactcgggaggctgaggctggaggatcccttgagttcaggagttctgggctgtagtgcgctatgccgatcgggtgtccgcactgagttcggcatcaatatggtgacctcccgggagcgggggaccaccaggttgcctaaggaggggtgaaccggcccaggtcggaaacggagcaggtcaaaactcccgtgctgatcagtagtgggattgcgcctgtgaatagccactgcactccagcctgggcaacatagtgagaccctgcctcttttgagttctcaccttataaagtagcctttcttcccatgcatctatcctaagacaaaagaaatgcagaatttacattcttacaggactattttcctcactacactgtgaatcccccctcccaccccacccccattgggaatcttcttgtttttatttttatcttatttcaccattatctagctaaacacttgcacattcatgctgccaagtgtttatggagcaccgattgtacaccaggtactgcggtgagtctcaggggtaccaagaccgaggttcgatgagaatcctgtaatcaattgcagaatgctcct

SEQ ID NO: 15482 - DNA, 1118 bp, Homo sapiens
attgcgtttttctctcgctgcgtgtccggacgccacactatgagcattaagcgcatactgaccaatttctgttaagcaggaacgtggtgttctgatcaaaacacagggagccgcggccgcaaccgcgccgataagcttccggggtcccaaccctgtaaggcagaacggctgcccagctcggatgacgccacactaacgtagcctccagaccgcccagtgtgggtgtgtccaagctcacgtcgcccggcgtggcccccccgctccccaatgacgtaactgccctgcagcttctagtagcttttcgcagcgtctccgaccgccgggcgcggtggcgcgtgcctgtagtcccagctactcgggaggctgaggtgggaggatcgcttgagcccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaatagccactgcactccagcctgagcaacatagcgagaccccgtctcttttgcccccctccctcattaagggtacctttgtaagtaaatagtgtctttgaagttaagaagtttgcctcctttccggttcatacgtattaagaaacatactaatgtgcacatttaaagacgagtcctctcttcctctaaaggaaaaaatatatagagaaagatgttactgaggtttatagttggctttctctctccactcttatatttatccactgttttacgtttccttcagcgcgaaagctcaccagttgacgggatgcttggggatttgcaaccgcctcatcgctgccccctaccggcgcatattcaaaacgtctctgcgaaaagctgttattaccttcggagccaacaggggctgctcgtttacccacagacagtcggaaaaaaatggccgccggatcacagagagcaaaaagtacgttctcttaaagaatttccaagttcttcccgcggccgttcaggatgctgcttgcagttaccaacattattcccctgcact

SEQ ID NO: 15483 - DNA, 1048 bp, Homo sapiens
agtataggatgcatgtaaacattgctgcccagtcacggtgggaatggcagctgggatgggaggaagttgagaacattgttacacaacatgtactgttatttaaacaaataacaatcttagaaaaataaagaagatacggggaagaaaatttttgttcactgttcatttttacagtttgaaagcaactgccacgagcattcgaaggccaatagggacagagcaaatcctcgtttctaaatatgggagcctgggtttgctggctggagctccaggattaacattccaccgccctggacccttactcaattcctccttccacggttctttgctaaacctgagaccagatgggtagcaggccattaaagtacagcagaaagtcatttttctgaagtctgagacttgatctatctgcataacaatattttcagagtttatatttattaactctaaaagagcaatgtgactttaaaatatgtttgtagcagttgtttcttgcctaaataatctttcactgtgtaatgagtgcgtgtgtgggatgcaggacttaactaattcctcaggctaactgaccatgtcttttactaacagacaagaatgacaaaaccttggattgtgtctgtttctccatcagccagtgtaaagtggcacataggctttacttcagaaggggtgtgcaatcttccctgggccacactggaaggagaagaattgcctttgggccatgcgtaaaatacactagtgatagctgatgagtttttaaaaaattgcaaaaaaatcttataatgttttaagagggtttacgaatttgtgttagtccacgttcaaagatgtcctgggccatatgcggcccatgagcagtgggctggacaaacttgctttctgcttctgcgttatattaaacttgcaaggcctttctgtttgcaattaatggaaaatattgtcatgaatactcaataggtggtcttcatttttagaaacctttatacattacctataatacagtaacttattttgttgaattaattcacattttttaattttcacaggt

SEQ ID NO: 15484 - DNA, 1032 bp, Homo sapiens
gaatttaaaagggaaatagtgctaagacacttaaaatgaaattaacagtggttctctacctcaagtctccccactccttttcttgttctccaaggacacttccacatttctaaatgatgtttttgtagtctctcttgagtcattaattttagacaatgtttactgatctcctcttatggtggatgagaatttcatgtctaccctgcctatacttaaccacatttggggcaaatattattcactgctatgcttcctttcttgtatagctctgtttcctggagttcataattgcctcattaatgtttagatttgtttgtttgtttaggtttgtttgtatgtttgtttagcacctttccatgccctttcatagcagttttccataaagtcaggcaaatcagggaacctagcagggttttcctttttcttttcttttcgtttccctttccctttcccttctttctttcctagaatcttccttcctggtgcctttttgtcccccgttccagtttggactggttgatattcaggtattgaccctgctgtcatcctagaactttctttcattgtcatcctagaaattccctttgcctccctcctgtgttggatccttgtttttggattcctcatcttctttcttgatatgctccctgattttaataggagtagctcctttagtagctacgtgagaaaagataatacatatgacttaaactttttaagttattgcatatatggaaacctattatacctttttttgtttattttgtggaagcctattatacatttaattgttaatagtttagctggaaatagaatgtaaaaaataatttgactcagaattttgaactcattttcctccacggtcttctgcctttcataattcctgctgaaaagtctaataccattcatttacttactcagtacataatttttaaatgcctgataatgtgcaggcactattctagatgtgagagtgatagcagtgaatgaaatagacaaatatctttctctcaatgatcctacagtttcaat

SEQ ID NO: 15485 - DNA, 1024 bp, Homo sapiens
aggttgggccaggactggtggctcatacctgtaatcccagcactttgggaggcagaggcagaaggatagcttgagcaggtgttcaagaccagcctgggagacatagcgagaccctgtctctacagaaattttaaaaattagctgggtgtggtggcattcgcctgtggtctcagctacttgagaggctgagagtggaggatcattagaacccaggagctcaaggccacagtgagtgagatcctgtttcaaaaaaaaaaaaaaaaaagaaagaaaaagggttggtttgagagggcagtaggtatatataaaattatagctgtttttattaagtatatataaaattaacttagagttgataatatttgttgctgctttttctattactagaaagttgggggaagaatcaaacaatgcagttttgatttttctttctgttttttcttagcaattgaaagcatgtagtgaagaacaagaagacagagaatgtttgaaccaagctattactgctctcatgaatctccaaggtagcatggaccgaatttacaagcagtattcacctagacgtcgacctgggtaattccaaagtgttgaaaacgtgaatgcctctgcttacttcgctgtctctgatgcctggttttcaaagaagtgtgatttattgtgatagttacattattgaaagttgtgcttgtcatacttttatatacttttatgttggtcttttactctcttttttccttttcctttcctttttttttttttgagaaggagtctctcttgcccaggctggagtgcagtggtgtaatctcagctcactgcaacctgcagccttagcctcctgcgttccaatgattctcctgccttcgcctcccaagtaactggaactacaggagcccaccaccatgcccagctaatttttgtatttttagtagagacggggttttaccgcgtcggccagactggtctcaaactcctgacctcagcctcccaaagtgctcggattacaggtgtgagccgctgcgcccag

SEQ ID NO: 15486 - DNA, 1030 bp, Homo sapiens
gctggaatatagtggcacaatcatagctcactgtaacctcgaactcctgggatcaagtgataataatctgtaccatattggtagaaaatatattcttttaaacctaatgctttttctctttttaaaaaaataggagcaagcatttgatccttatgaaacattatcacaggacattctttcaccagagtttcatgaacatttcaataaattgatggccagacctgcagttgctctacactttcaggtaaacttaaattgaaggttttttttttttttttttttaataaagcaaataaatatctcactattttatccttcaaatatttgtaattctggaatcctcgtaatccttcaaatcttgttcattctaaacctgttttggattatcttctgttttctctctggagttctgtctgttcttattgtagaaatcttttatagtacaacatcatgagtactgaatgaccagaagaatttggcacatactagatctggggtataaagatgaatttggctgggtgcagtgactcatgcctagaatcccagcattttgggaggccaagacaggtggatcacttgaggtcaggagtttgagaccagcctggccaacatggtgaaaccctgtctcgactaaaattgcacaagttagctgggcgtggtggtgagctcctgtaatcccagctactcaggaggctaaggcaggagaatcacttgacccggaaggcggaggttgcagtgagccgagatcgcgccactgcactccagcttgggtggaatagtgagactctgtctcaaaaaataaatagaaaaataaataaaaaataaagatgaatctggagtgtgatttcaggattatgttccctataggaggaagatttggagaaatcttaaaaagttgagataacctcaacctcctatgtactcatactgatttttctatgaggcctacaatttaaaggagataaatactgtattgagggagagtatgcaagttagttggttcaggaatacacttagataaaatgaaaat

SEQ ID NO: 15487 - DNA, 1103 bp, Homo sapiens
taaatttttttatgtgtaaaacataaactgtttgctttagatagatagcagccaacctttttaaaaaactcatttctgtgttagtatataatacaaaatgaggttgagtcatttatattttgggtaaaaagtggagcattttagattttaacttcagagtgtttgtgaggaactcttgatgtaccagcaagtatatttttggtgtttcatgttacgtagcttaactcttttatccatacatatatgtgtatatcaaagtccttcccttgatcctctcagcattagcactgtttggggagttgcctttactgttggcagaattccactttccctgaggccatttggaaatctacctagtagcctgtgggataaccttaactcttagaactttcttcaaaggatggtggtgagaatggggtatactgccaggccctggcctacgggagtttgtagggcctacttttggaggcaatccaaccctgatggctgtacctatgagctatccctgtaaacacaggagacatggtgtctatattgtttaaggactggctctgccctcctgggcccttaatctgtgtctagacttcttggtcagaggtttcctcatctttctgcgcatacactattatctaaagatcttgtaaacatttttgagttgtaatcgtaaagtcagtttctaagcttttctaacacactcaaagggagtttttgaaatctcttcatcagggcttaaggtagaaggacagggtgaaatggttgggaaagcaaaagctgcctcgagatgttttcaaatagtttgtactcattaaatagcttaagaatggaaataaaccctgaagccctgaagggaagaacagtgttgataccaaccaactctacttttctggcctcaaatcctagaaagtattgtgggtttgttgttgttgttgatgttgttaattgcttgtattttctgcttatgggaaggatctcacattaaagttatcttattttaagtttcttttgtccctgggataaaatgagaaaatttaccttttagatatggcaagagatggcaggtcttgggttgctcaggaagcccaattttgaatattaggaaagac

SEQ ID NO: 15488 - DNA, 1028 bp, Homo sapiens
aaaccttttaatttttatttgctcatgaaaagtctttcaaatgtaagatgcatatcaaaaaaaaaaagtacatctgagctgctggccccattatagatttggtcatgaaaataatttaattgtagagtttgaaaaacaggattactggtatcctaatggtactgaaatttggagaattggtctatctgattgttgcctgttgtgtatccttgttaaggctttaaagagaaaaaatcggaacaggaacccatgattttttatattatgcattactgaaaaaaacaaaacttttcagatgttgtaaaagttatggatgagtctggatattgttctctgtacctgatgaggtgaccatcacaggtccttggaatgaggtcagtgagatatgtgtgcataggtaatgaaattatatgtattacacatatttttgtgtcttataaatgaagaaactttactttcccagggtcacacagctcccaaagagttgcccacctcaagatctgactcagaactggtattttttctgtttggttcaaccaaaggttttttgattactatgtgccacacactatgttaggcactgtagatagataagaagatgaataaggcatggctgtcaacctgaaggaggttatagtgtaaaagaagatatagtgataagtattctgatagagctggtactctctcttataccaatgttaagggaatgcttttagcttagtacaattgtttaagaaagcctcagagacaaacccccacttgaaagatgaatgagtaaaataacttacaaaagaggcatattctgcttctctctgaggcctccacagaagtgatatatactttatatgattccaagttgtaatcattagtgtttcatatatttagggatggcaatatatagtagaacatgtagtttggttattttctaaagatgttttgaataaagtccttccttccctgccaaccttaccactgctataggaatattgggtaaaatgcccattgtacggggtcacttgttttttttc

SEQ ID NO: 15489 - DNA, 1079 bp, Homo sapiens
actttatctttcatcgctgatgatacattcacctctatccatgctccttacctttttttttttgaagcttatagtagctgttgaacaagaagaaattcccagacttcaggccctatatgagaaaggcctccagaatggtgtcccgggcctgaggctgatccagcaggaggatataaaaaagaaggagccatattgtagggtaagtgattaacaaagggatgtttttatttagggcttagtcctgagacatggaggctgagggtgagtgtataggaggcaggaataatataaaatcagttagataatcctgtcacagaagtagtgaagtgacagacacaagagggcattgtcacaaactctggacacctgatttctttctctgtgagaaaataccaggtctgaccaacatgaagacaagaggaggcctgagaccacatggcatgtttggaaaacactgagcagtgaggtgtggttgggagcattgggtatgtagggaaatataagagatgagactgaaaaggcagggttaggcccacataaagggtttggcattcatgttaataacattgaagtttatccagtaggcacggggagccattgaacatttttggaggagggcagctgtagtgtctgatctatacgataggcggataaggctggcatgagtttgatcctcctgcctcgacctcccaaagtgctgggattgcagcatttcactttcttaatattgtcttcagattaacagaaattcttaatgttatcaatttatgcatatgtttgtttttttatggttagtgttttttgtgctctagttaaattttctggatgcattcaaagacttggtaagaaaaataaaataaaatagaaaaaaaaagaaatctttgcctagcccagggtctagaagatattctatgtgtttttctaaaagttttattgttttacatttcacatttagatctacagtccatttggaattgatttttatatatggtataagttaggggtcaaggtgtattttttccccaaacagatatccagttgtgtcagcatcacttatcaaaaaaccattattttcccac

SEQ ID NO: 15490 - DNA, 1022 bp, Homo sapiens
cgctgggactacaggctcacgccaccatgcctggctaatttttgtatttttagtagagatgtggtttcactatgttaactaggctggtcttaaactcctgacttcaagtgatctacccacccaaattgctgggattacaggcatgagccaccatgcccagtcattttgttgttgttgttcgttttggtttttttttttgagttaggatctccctccgttgctcaagttggtctcaaactcctgggctcaagtgctcaagtgatcctctcaccttggccacccaaagtgttgaaattacaggtgtgaaccactatgcctggccagaggcatattgtttaatttctgtgtgtttgtatagtttccaaaattcctcttgttattgatttctagtttcattccattgtggtcagagaatatacttgatataatttcatttaaaaaaaattttaaagacctgttttgtggcccaacatattggtctatccttgagaatgatccatgtgctggggagaagaatatatattctgtagctgttggatgaaactctctgtaaatatctgttaggtccatttggtctgtagtgctcagtagtttattctttgtgatgcttttgtgaggagaattgttttcctactttcattttttataattcattgctaatgcatagaatatgattgatttctgtatgttgattttttttaatccagtgacctttctgaactcattttgttctaattgtgtgtgtatgtgtgtgtgtgtgtctatgaattccttaggctttactatatgcaggatcatgtcatctgcaaataagttagttttacttcttttccaatttagatgtcttttaactacttattctgcttgcctgatttccatgggtggaagctccaatactgtgttgaacagaagtagtaaaagtggaccttcttgaattgttcttgatctaatagagaaagcattcaatcttttacccttaagtatgatgttagctgtggattccctttatcagattaaggaag

SEQ ID NO: 15491 - DNA, 1074 bp, Homo sapiens
aaggcgtgagccatcgcacccggcctgcctacgttctaaatggcttgttttgagagttcttttatgtatgagtcctttgggagatatgcagttactagtatttttttccaatttcttagtttttttatcctcttaacagagtctttttgcagagcaaaagttttatgttttgatgaagtccattttatcagttttttttcttttatggatcatgtttttgatgtcaactctaagtcccaagattttgtcctattttttcctaaaagttttaaagtgaatattaggtgatgtaaaaaattttgtgttagtttttttaactataatggtagtgtgtgtttttagagatgccttttagaaataacattgaaatatttacagatgaaataatgtggtgtttaagatttgcatcaaaataatataatacaggaggggatgaaatagagtatagaagaagcaagatttgctgtgagttgataattagtgaagctgggtgatgtatatgtggggcttcattgaactattttgtctaactttgtgtaggtatgaacttttccataaaaagcttaagaaaattatctgttaaaccattcattggtgttaacttgagattaagtgagttgtagagaaagatgtctctttcagcctccgtggttagcttggcctgcaactgtcctccagcattcatctatgactattgttctgttcacctgtctccatagtggatgcttggagatttgtgcttttgtttgtgaaacatatttcaatgattttgtgtcactggataaaacagtgattcttcagatttgagaagagggagtgaagggtggcacatgtagttggaaaaagcatattcagtatgatagttttatgtttgaaaataagaagggtttattgatagttgtagtataatctgcaaagacaatatcttggctgggaatctgtaccaaggtaataattctaagtggaaggtctacctccccaaaagcttttgtgttataattatcaaaaggcagcaaggggccaggcgcagtggctcacgcctgtattcccagcattttgggaggccgaggcggg

SEQ ID NO: 15492 - DNA, 1058 bp, Homo sapiens
tataattagccaggcatggtggctcacgcctgtaatcccagcactttgggaggctggggtgggcggatcacttgaggtcaggagtttgagactagcctggccaacatggtgaaaccctgtctctactaaaaatacagaaattagttgggggtggtggctggtgcctgtaatcccagctactcaggaggctgaggcaggagaattgcttgaacccaggaggctgagattgcagtgagctgagatcgtgccactgcactccagcctgggcaatagagcaactatatatatatgtgtgtgtgtgtgtgtgtgtgtgtgtgcatgtgtgtatatatattatatataatatatgtatatatataattataaattgtatatttacaataagtttacaatttacaataaagctttaaaagaacaacaaaaaattaaatatacctctattgcttgtacgtttttctacttttgatagaaacatggacatattaaatatttcacttttaactctagtataagaaagtcaataatgcaagagtgatgataaagagcaactctcacttggcatcatgatcagggagcaatagggagtgggtgactgcggtgacctaaagcatacaagccttgtctaaagtgaacagctgctctcagccctagctcataagtgccacagagtctacaggcctagacctgctgatccccagcatttgcaagagactcttggtaaccaggattttaaagtaacatttcctggttaagggtagcggccgggcgtggtggctcacacctataatctcagcactttgggaggccgaggtgggcagataacttgaggtcaagagtttgagatcagcctggccaacatggtgaaaccctgtctctactaaaaatacaaaaattagccaggcatggtggtgcacacctgtattcccagctgcttgggaggctgaggcatgagaatcgcttgagccctggaggtggaggttgtggtgagccgagattgtgccactgcactccagcctgggtgacagagcgagactccatctaaaaaaaaaaaaaaaaaa

SEQ ID NO: 15493 - DNA, 1048 bp, Homo sapiens
agtctgttctttaaagctgtaacttttcagagttgtgtgatattcctaacacataatacgtactaggctgggcatggtggtgcgtgcctgtggtcctagctactaaggaaagaggccaaggcaagaggatggcttaagcccagcagttcaaggctatggtgagctatgattaggccactgtattctatctagcctgggtgacagtgagaccctgtcacttataaaataaagatacttaataaatatttgttgagtaggtgaattgagggtatggtaaatgaacattttattttctccatttatggattcagtaaatactcatagagccccagttgtgcctaaaacgatgtttatgcaaagttgtacaccctgtctttcagaagctcagctcttggaagggaggtaagttgaattgccctttggctctcaccccttatagactgggttcccagtgagcagggcatgtgtacccttgcctggtaagaactctttaggtgcttgttgaatggtgaaaataaagtgattggaggcatgtttgagctgaactttgaaatgtttagggaaacgtggaatgagagataaggcatttcaggcagacactctatcctaggaaaaggtgcataagtagaaagcaccctatattgagggaacacaggtaataacccagtgtcttagccaagatgcccagtgggtgctaacaggccagggagagaaggaagggggaagccagggtccggcaggatcaagtcatattctagatttcttctgaaagaagagcacataggaatctaatgattggatgagaaatcaagaacaatttcaaggtttttgactgattgactggaagaatgaggagattgttcactgtgatagagagacccaggtgcaaatgtgggggaaaggagatgaagagctctgttttggacaggttaagtttgagttgtgaacccaaggagacttgtaaagtaggcagttgactacacaagtctggcattcaggggaagtccaggttggagacagagttgggggacataagcatatcgatggt

SEQ ID NO: 15494 - DNA, 1051 bp, Homo sapiens
attatataatgaactagaaagcagagacaaaagtgccaggtaaggtggcattcacttttagagatgctgtgggatatttatttttcttccccataatttctctcccacctgtagacctgggttttcaaggaccattacaatttgatagtataggaatgtaagacaattcaattttgctggcattgttgatttttaaacttctaaggtatttcctattggtatactcagtctattaagagaattaacatttacctgttttcaaactgctaggaagctcacagattctcattacacctcatatgtatttactgctgagcatcatcatgtcccgtttctaaaaagaagcgtttttcttaaagaagtgaaatgatcactttctaattttttttaacattttttagagatgggatcttgctatgttggccaggctggtctcgagttcctggccttaagtgatccttccaccttggcctcctaaagtggtgggattacaggcatgatccatcgagcctggcctgatcacttttcaaatgtttattagttaaccctaaaaataacatgatatcagaggggggaaaggtatttattacaagctgaaagtgtgtttttcgctaatggagagactactttacagaacttctgtgaaggtaaaatccaaatcgcaatgtgaaaggtgacatgtaatgaatatggtggaggtcaactttgtttcagttatggcctctctgttctgacctgtataactactatgtgacaagggaagagctacttgatgagagacagatgaatgaaacttccaggggatttactattattcttgcttctccattttctccagatcactctacaaatcttgtgcccatggataagtgtgtggggtcacttctagataaggaacctaaatggaaagtagcaagctttggataaattggaatgggtgggtaacagggcaacttctctatttaggtttggaatgttcttaaccaacaggatattatctattgagaggagatgcttccaaagccccgcaggggagtgctcccatgggcag

SEQ ID NO: 15495 - DNA, 1062 bp, Homo sapiens
tatcttggactgattctttaaggtcttctgaacaagattccagggtaacctcattttattctttcttggttattattaggggtgaacgggtgggtaggtggtgttttaggctttttttttttttttttaattcttacctatgaaaaaaatattttcttatattttagatttaaatgactaccaagaagtttgctgattgctttcattttggtagtagagtacaagatagttaattattatttctctctagtagagattttttaagaatctgtatatttgagctaataacactgtttatggagagcatattatttgattgtgtgttaaatggcttctaaaaagctggagtcctcaaaagaatatttaatatattttaattatgcttccccaaaatcttttttacttttgtttggtaaaatattaatatgttaatattttatattactgttatgaaaataaagccaattctgtttgagttgacaattatgaattgtatcatataaacttttctctaactctcttactgcttatccctactcatacttgtctttggaaataagcttaaaaattacacagggtacatcttagatagcaacgcccaataggaggcatgtacatgtgtgtttagctgcctggctagctgggtagcaaactatgtagattggggaaatggagaaaggaagggtgtttaatgtttaggcagaatatttctgttctgagaacatacagataattttgttgaggataaaactgtgtatatgtgtgtgtatatatgtatgttttctaataataaaaagataaatattgttttgtattgttatattatcataccatatatagtgagaaatcagatgatgtttaccatatccatccctcttacttaatacagccatattttttattatatggaattgtagccctgttatccttgtatcatggcttataatattggttggttttacttttttaagtatttccatctgttatatttaagacttcattcacaatgatttttaatccaaggtaatttgttaagttattgataaataggtctgtcccaga

SEQ ID NO: 15496 - DNA, 1044 bp, Homo sapiens
gcctatttaattttaatgcgatgatattaatagtactgtgtcctcttcttgatgtggattaaatatctttctacctctaaagtgattttcacattggactatatacaattaaaaggaaccagggaagcttatattaatgcattttcctggccagtcagtggaacttatctgtgaatgggaaccccatgatcccatgaatgggatgggaaccaatcgtatgaatgggatgctttatacattgtccttttttattcagtgaaagtctaatgtataatataaatatcaacctttttgtctcttatgactattaaagagttatactgcaattgtaatcactataatgttactgaataaaattatccattgtttcacattaataattgtcagtcctaaaaaatagtagtaacttaaaattcctagactatgttattgatgtatgtagatcttttggtaaatttgatatttgtgccataaaatagtggattacaaaaggaaagaatatgagactgtcttggtagtaggggtttaatgatgtgaaaatatgaattttgttttggaatgaaacaacaagcatacgcaaataagagttaatttggtatttcaatgatgttagttattttccaagaatatataaaattttctaatcaaataagttaacatttctttctttataaataagatgggagcatgcttttcaaaagtttttgatggctgtcctttgaaaattaattgtgcaacatcctggatacatcctgatacaaaaggtaaaatgtttgaattttatatacatctccaataaaatatttattatgggaaagatctttatgatcagtgacttgaagttgtttattttaaaaatacgactttagagacctaatggtataggaacctgcaacaacctaaataggtcaatagggttttggtttaaaggcgttaaaatttaggagtgtataggagctattcttgattaaaggactaaagagaaatcacaactgattgcatccttaatttagaattttcttttaccgtaaaaggacgttattg

SEQ ID NO: 15497 - DNA, 1276 bp, Homo sapiens
gaggtgaagtctgtgggcctccaatactaaagagaaaagtaacaaagttgatattccattgtaacatcatattctttattttatgcagttctgtagtattccattaatgtagtctattttatctatcttttctcgtatagttttgggttttgtgtcatatttagaaggctttctcgattccagagttatcaaataattttcctattgtttcttcttgtgtttttagtttctttttttaatatttaaaaacctgatatacattatttggtagaaggtaagaagtatggattcaacttgagtttctttctagatgactactcatttgtttcattatttattgaaaatgcaatctttctactcatggatttgatatgccatctttattatataccgaattggcatagatattttagggttgtttctggaaattctattctattctggaaattctattctgttgcatgtctgtttttgtgccagtagcatacttttgattattatatcttgataatatctgttagaactaatcctactcctactctctgcccctccccacaacacacacatatgtaccttgtcacacttctttttcattatgacatttggctattgtgccttcttccccacataaacttaagaatcagcttatgtggttaaaaaaaaacagaaaaattcattgtttttacacagatcttattactttgggagagttgacatatttatgatattcagtcttcttaatcaaaataggcttcttcagagataagatttagttcttttatattccataatattagcccaaaatactaatatcctcatagagtaagttctggttgcttaaagcaccagacaaagcggtagagtagaaggtcactttattaatgacttgtctttaaatttttgtgaaacttcttttgtatttatcaggaatgttttaccactttgcttttgttggtttgatagattttatactatttatttctactctgttttttgtttcagtgttttaaattgaagtggtagcttacatacagtaaaatgctcaaatcttacgaatactccagggtaaatttttaaatatatacactcatataactaccacccagctaaaaatatgagttagaacatgatcagaatctcagaaggttccctcacgagagccttcacaatcagttttcttaaattctatactcgcctgccctctctccgcccaggcgaattactattctgatctctgtcacataaactggcttttacctgatcttgaccttcaggt

SEQ ID NO: 15498 - DNA, 1049 bp, Homo sapiens
agttgctaaaattgctccctcctctttgcctttttttctaagaaattcatcagcctctttgggatttaaatagtctcttatattaccccatgcctacctttcgtgccgtccaactcttttggtatagcacaatatttacatactaggtaaattatgcaatgagaaaaggacattttgactcctaagtagtacctagaaaagaaggtcatatataaatgacacagcctatctatttctgattgttagtgtaatttttgtggttgtatattactgttctgttacttaattgtattttatatgaaagacaaaactgacacagatgtttccacggaatatattgtactttaactaagtggcccaataaaaaatcatggtgttttagactaactgttcctaagttaatgttatttactaacaccgaaacgtaatagtagtgaaatatttttgtacgtctctttttattttaaggtcatcaacattccataattttgtcaaaatagcactaaccaaaaacccaaaaaaaagaccaactgctgaaagacttctgactgtaagtcattgaaattacgaggggtcttcctatagtcataaattagacatatcagtagaacaaaagtatttatgtttttaagataaaaatgttagtgatctcttacagcaggggtcagcaaactttttttttttttttttttttttttttttttttttttggaaacagggtctcactctgtcacccagactggagtgcagtggcatgatctcagctcactgcagcctccacccccaccccctgggatcaagccattcttctgccttagcctcccatgtagctgggattacaggcgcgtgccactaccacctggctaatttttgtatttttagtagagacagggtttcaccgtgttggccaagctggtcttgaactcctgacctcaaatgatccacccgcctcagcctcccaaagtgctgggattacaggcatgagccaccatgcctgaccagcaaattttctataggcgggtcacatagtaaatattttaaactttgtg

SEQ ID NO: 15499 - DNA, 1032 bp, Homo sapiens
aactaaaaaagaaaaaccacattatcatctaaatacacacagggcatttagcaaaatccaacattcattcctgataaaaaaaagttctgaacatggtaggaatagaaaggaacttggtcaacctgataaagcgtacctgtgaaaaacctatgactaactcatacttaatggtaaaagacgggatgttttttcctccaggctcacccaaacagggtgatgaagtctgcctttactactacttttcaacattgtcctagaggtttcagccagtgcaaaaagagaaaataatgaaataaaaggcatctggattagaaagtaggaagtacaactctctttattcacagaccacatcatcatctgtgtagaaaatggaataaaatctacaaagtagctactagaactaataaattaggctagaaagattgtaatattcactatcaatgtacaaaaatcaatcagatttatatatactagcaacggacaatctgaagttaaaataatacaacatataataacataaagaatatgacattcttagggataaatatgacaaaagatgcataaacacctgcatacagaaaactacaaaactcctgaaagaaattaaaaacccaaataaatggagaactataccatgttcacaaaccagaagactcaatactgttgagatgataattcttcacaaattgttctgtagattcagtgcaaccccaatcacaatttgaggaggctttttattaaagaagttgacatgctgattctaaaattgctgtggaaatgtaaaacacctagaatagtcagacaactttgaaaacctgaactatagtgccagaaagcacatcagtgtttgtgagggttgtggggaagaatgggaaaattataaaggagcaccacataaggaaacttttaggagtaattaatatatttgatatcttgattgtgtttagtgaaatatttctgatttttatcagaaaataaattagaaatcttcaggccgggtgtggtggctcacgcctgtaatcccaccacttt

SEQ ID NO: 15500 - DNA, 1032 bp, Homo sapiens
gtgatctcagctcaccgcaacctccacctcccaggttcaagcgattctcctgcctcagcctccctagtagctgggattacaggcatgggccaccacgcccggctaattttgtatttttagtagagatgggatgtctccatgttggtcaggctggtctcgaactcccgacctcaggtgatccacccgcctcagcctcccaaagtgctgggattacaggtgtgagccactgcgcccagcccattgtgatttttaattaagttcagcagttggttgtaggttaccaagtcttatgttatttttttaagcatgaatttgtaagcaaagaaaatgtagctgtttcttatgtcttctctccaccagtatactttgatctttaaatattaagagtctagtccaatgcctaaaaatctgaaggtaataaaaaatagatgtatgtgatgttatttctctgacatttgatatcaaaacatcacctactttcttattttttgatagtaacacagctgaactatatgaatatactgtcctttttgtgtcctgtgtctgacattatgagagactcttggttttcatatttgagtgagagagtgaataacttggaaaaatagcttaacagtagaaaataagagaggaaggattgtccttcaaaaactttaaattatatttcttattaaataaatgttatgttaaatgttgtataaggtcactgcgaaaataaaacatgttttattgggatgatgtgctactgttgtggatatttactattttaaaagtcatctgggtaaaatcttattatttatttttcttactgttcagaggtaggcttattttgtgactgcctaaagagaaaatatggttctaatgatgaatgtgaagctctgaaccatacctgggagcaaaatacatgttatgaaaactgtaaaagaagtaaaaagtactttcaacttggtgaagatagacataaaacagtgccgtcactagtgcaagtatagcaatgcatcactagtgtagtccccagattgacttgtggat

SEQ ID NO: 15501 - DNA, 1042 bp, Homo sapiens
ggcaaacccggagctgccggccggcgcgcgggaggaggacgcgggtgcggtctaggaagtaggtcccgggctccgcgctcaacaaagacggggccgcccccattaggtacggagccggccctgggccccggctggcggggaggcctcgtcgggcagttcgcgggcggccggggagggggaagggccgcagaccgaacggggatacggggcgccgggggcccttccaggcccctttctcttccacggcccctggcgggacggaagggaaggggccgggccgcgagggcgcgggccgctgggggtcgtagcctgcgacgccaaccagcctttgctcgtccctcgtgcagacggagctgcgggcggaggctccatgttgggaagcggcgccgttcgtgcttgttagcgggaatccgggagccgcggggtgagctggcgggggccgggccctaagtgaagatggaggccccgctgcggcctgccgcggacatcctgaggcggaacccgcagcaggactacgaactcgtccagagggtcggcagcggcacctacggggacgtctataaggtaagtgaggctggccgtgcttttttcctgcggtcgactgggtcccgggaatggggccactttcctgcgaagtattggggcgagaggaggatgcttttattgttgcctcttggggagaaagcggccggggtcccttttactcggttctgagcaccctcgactcatggcttgttctaatcgctaccaacaggcagaactaaccacacagttgcaaaccgctgttgcactttttttgtggtttaaaggctttttaatagggcttatttatggtattgaagggaatttgaatctgcttgtggaattacaccgaaggatgctctagtgttagcatggaaaaatgcttcatggaagatagacaggaaagaatattgacattcagacatttgcatttttttaaaaaaatttgtttcaatggatgagtttgactaaaaaagccatatgaaaccctgtctctgagctttaactgtaagcaaactaa

SEQ ID NO: 15502 - DNA, 1045 bp, Homo sapiens
catgcccatagtcacacctacttgggaggctgaggtgggaggattgcttgagcccaggaggttgagactgcagtgagccgtaattgtgccactgcactccagcctgggtgacagagtgagaccctgtctcaaaaataaataacaataaataagtaatacataaaattcactttgaattaatttttctgaagtatgctttagctgcttcatgtactcttagatttgtttacttcattttgttttcactttttagggattgctttttctaaattttgatttaattttgttgtaagttacataggatatttaaaaggttgcaaaatcaaaatgataaaacagaatgcatttagaaaattaattctacccctgtcctcttccaccccatttccttcctccccctgtaaatacccaattttattaatttttgttacatatttcattgcaacactttatgaaaatagatacaaattacatatatatgtaaaatatgtattcatattattctctttcatatgtattgtgttaggtttctgtagctgtaaaacacattacttccaaactcattggcataaaacaataaacatttattatctcagtttctgtggttcaggattttggaagcggcttagccaggtcattctgactcaggatctctcatgaagttggagttcacacacgtcagctggggctgcagttatccgaagcttcgctctggctgaaagatccatttctttctttctttttttttttttggagacagagtctctctctgttgctcaggcttgagtgcagtggcgcgctctcggctcactgcatcctccatctcccaggttcaagtgttctcctgcctcagcctcctgagtagctgggactacaggcatgtgccgccacgcccagctaattatttgtaattttagtagagatagggttttgtcgtcttggcccggctggtctcaaacttctgacatcaggtggtccatccaccttggcctcccaaagtgctgggattacaggtgtgagccactgcgcccggccaaaagatccg

SEQ ID NO: 15503 - DNA, 1053 bp, Homo sapiens
gagtcactgcctccgctagggatcccgagggggtacaaaagcaacaacaataaaaactcgtggagagtaggttccacgacatgcgcatgcgacgaactcccgcactcagcggggcaggtttcgtccttcatcttctcagtcggcaggacctgcttctcgctgaggatgagtgaggacagccgcagctcggcggggacggcccggtagcctagagcgccggcacccgagtcccgccgccggagccgcgcctggagccgcggtgggggaggggcagcggcggcccgcgctgcgtcgagcttcccagaattcccagcggccgcggggaaagtttacgggatgtaggcggcggcggcggtagtggtagcggttattcggcggcccgcggcggaccatggccctggccctggcccggcgtcgctgggctttcctcacggcgtccccgagcagcgtcgcagagcgggccgacttccgggaaggaactgaccagcgactgagcggcggccggcgcgcttagcgccctgaacatgcggcagtccctgcgggcgaccccgggctccggacaggcggcggcggaggcggcggctcgggagggaaggaggcggcggcgccggcggaggtggcggcggagacggccggcgcccggcgcggagccctagggaggcagttcagcgcggcctcgggcctcgtcgagaaggatgctgtcccgaaagaaaaccaaaaacgaagtgtccaagccggccgaggtgcaggggaagtacgtgaagaaggagacgtcgcctctgcttcggagtgagtgtcaggcggggcgtgcccacacctggcccaggcggccaggtgctccggggaccctggcgggggcgccggcgggtctccagggcttctccttcgtccttggtcgcgtgaaatactggttttgagattttcttgtgtctgaagtggtattcgttgattgaaagcccataagagtaagaaacttgggttagtcccccccgcgcctaacccccccaagagcaccccctaaaaataacagacttcctcgccccaccaggcaga

SEQ ID NO: 15504 - DNA, 1069 bp, Homo sapiens
atccataaaagagagataatcataatgccagcctcattataggtgaggactaagggaattactatatgcaaggtgtttagaataaaacctggtatacaacaagtgctatataaatattagctatctatctcatcatcatcattctcttgtcccaacgactgacacatcaccctcatttaatatttgtgcacgtgatcactaagccattaccaaaagcccctaggtaggtgtccgttgagtgggttgtaaaggtaatgcatagaaaggtcattatattaaaaaaaaaaaaaagttagtggggcaaagtgatgaggtgactgtcagagatactgaagagacacttaataagttgtgattaatttactctgaataatgcattgaagtgaagccattttcaaagcataatttggattaaattacttactgttccaaggctcatttcactaaccaggaagtgtatggcgtgggtagagatgagtctgtcctttccaatatctgttcagtcgttgacatatactgctcccaatcagtttcctggcaactcagggttaaggtcctgcatctcaagctcttgccttcacttcattgtttttagtactacaaattttaggatgtctcctagtcaatatagactgcatttatctgtgataacaagaacaacacatttcagcagcaacaatgatcaagtttatttcttgtccattccacttgtccgttgtgggagggacaagaaagccctgcttatcatagtcatagagaaacaaggctaaaggagattccacctcagcatgcttccccgatcacagggtcaggggaaaggaagcacgtcaaaccacatattgactcttgaagcttttacctggaaatggcccatcacactactcatgttttattggtcagaacaagtcacatggccaggcctgggcttaaaagggagagtatgtacaatcttcctgcagggaagtgccccaaatatttggagacaataatacaggcttctgtaggaaagatttgactgaaagcaaaaaacccatctaaaagtggcttaaataattgaggggttattttc

SEQ ID NO: 15505 - DNA, 1057 bp, Homo sapiens
atagatcccctggtctgttgaacagacttcaacttaggctgaataaactcttcacaccatgtttctatatttagaatgagcctattgtttgaaaaactgaaagaatgaccaactgaattctcttcaatgacagttccaatgggcagctccaacagcgaccctcagagccgcccgtaataaatacacaatagaaaacagtgtgcttgaatgcaaatgcaacctcaaggcattctctccagtcacctcagcactcctcctatgtagaaattctcaagtccctgctgccaaggttgtcagctgcctttccagacattgataggcaccttgcctcttagggttaaatgtctgtagatgtgctgaacctggaatgttactagaaacacagggaagacttggtcagagcaatgtcaatagccaagaaatactgaacttgtatctcattttgtgacccataatctctgccttaccttgcagagtggtaaagctggtcttaacctagttcacaggaacctcacacaggtgactgaaaaaattccaagacatgatgaacattctaccaagtgctcttcttacagtaatatcagctgcccattcagaccatgcccttcacagctttcctttgggagtacactggggttggatctaaaagaatctgcccccataggccctatgtgggcactgactttaaccagacttgtttgattgctttggtaggaggtaaagcctcagccctctcttccagagctgtttttagattgaacagtgaaagatcattaagatccataaatggcattcaggttttagtggatgactttgggaagtctcactaaagtatatataggaagattctggtgtgagtattgggaacaagtggccatttcttccatacaggtaatgttgaagaggggactgtgtcctttctgcataaagaagcagtccccctgatctattcaggatggaaggcactttccaaattgcctctagagcagcatgatattctgtgtggtcccagtttttataaagcaaaaagtggctcagataaactacatagatgagc

SEQ ID NO: 15506 - DNA, 1882 bp, Homo sapiens
ggcccatgcctatagtcccagctacatgggaggctgaggcaggagaatcgcttgaacctaggaggtggaggttgcagtgagctgagatcatgtcgctgcactccagcctgggtaacagagtgagactctgtctcaaaaaaaataaaataaaataaaataaaaataaaagtttgcagtttacacaatcaatcctggaagcattttatttacactgtgggtcccactgctgagctaacttgcatttacaaaacacctctagatactgtcataatgtatccagaaattcaattagagagagtgtgtgtttctgggccaacagaggcaaggttagggggcagaggtaatataagtgagctggcccaagccatgcaacttagcctcatagattgaagtcatcacatgaattaaccccaaactggtacccagtgatgtcagagcatgagtccagatgtgctctgtgcgtgcatgggatggcttccaataaagtcaaatgacacagtcacgtgtcagtttaggtcctctaggaaacagacaccagagagaatgagaagtgcaagtgacatattgggggatgcctatgaaagacaaaggggagagggagcaggatgaggtgggaaggcttcagactgtgacacaggtgtgccacctgtgaaaagtgaaggggaaagaagcagcattctcagggagagcctcagaccacagtgccactctgagcaagtggccaggctgatggagcctgacactaaagattgcccattagagaagtctcggccctagtgtcccagccacatggagtgtcccagagagcgcagctttggtgtgagctctgagggagcaagtcctctttgaggttctctgaaagaagatctaagctgtgcacttcttgggctgccttaattatgcttcaagggtcagaagggtccaactcttgtttgaaccgagactcaatcccagcctgcaaatgactttccctgattgattacaacttgctttaaaagtccagagacttttatctcttaatgaaagatatttaaatgagggtgatttattactttgaggtcgcggtgatcacgaaagtatgactgagtatatgtgattgatatgggccataatgcttcattcattcacaattcagcagaccaaattaaagagatgcgtgtttaagtttcaatcctgccatgactgtgatcttgggcaagtcacttctctctcagcttcagctccctcatgtccaaaataagtgggttgcactaaatgagatccagcatcctccagttcaattattctgtcattctccttccttcgagcttgactctgatgaggccgggaataaaaatgaatgatttctcacttgaattttcgatgcactgtgaaacatagttaatcttcctcttctctatttcagtgactgtcacaaagatcaagctagattttccaaagcttacctcttagactcaactcagctaattatcagctgatttggcagatcactgtaggaatcactaaaataactccttatgcaactttaaaaatctagcatagcattttaaatattatatgagatgttatagcttcataaatttcctattccatttactttcatcatacttgaaatcagatcactgaaaaacctatgcaaaacatattctaagtgctattttttggtgggtacagattcacaatgtcactttgtttgcatatcatattttattattattagagcaatggctttatctgaaacatgaaagataaacttttttggctgggtgcagtggctcacgcctgtaatcccagcactttgggaggccgaggtggatggatcacgaggtcaggagatcgaaaccatcctggctaacacggtgaaacctcgtctctactaaaa

SEQ ID NO: 15507 - DNA, 1055 bp, Homo sapiens
tctcacttgtccctgccacactcctgtgtactttcacagaggaattctggatggttgtgagtgttcacaatctgaaagatcactgaaaaaaaaaattaaacaaataaaatgtgagatagaatttgaaatagagtggccttaaaaagggaagacatttgaaaacattggtataagaagctgctactggaaaatttaattttgaaccacagctccgccagacctcttcaaggaagtcagtgagaatagcttcccccttgtattttaagagaagaatttttagcctaaagcttgattttacaggctaaaagaaggataaatgctggaaccctgatcaggtcaggggaaattcattcttaaggaaaaaacaaaagctgccccagaatgatcaagaaagtgtaaaaatcaatatagctatgacagccccaataacaggagttccagtaaaacacaatgctcttccttagatttcagtccagaaactgtaatgctatccttttccaaaccataaaagatagattaattggaaagtactttggatttctagtagaccatttattttgtgcctaatgaagttaaataggataacataacacccactataaaatatatttttctagaatgtcagcctgagtttctgctaatgaggctgtaattttggcacattcaccttttatatacaacatcactgggggtaaataaggaaaacggaaaactaattctcagcacatggaggaatagattcagacagatgcaaatatctctgggttagttctttcttttttttttcctctccactccctttgactttttgtccatttgctaatttgtctaaatctgggacaatatcaagatctgaagattattgagagtctagccttttttttttatccttttggtcttttaaactgtatccaccaagggcttataaattaagttctgatgttttaattacacatgacatcatgtatttcagttacttttttaattatacctatgtctacacaggtacatttgagtttcttatcagagacattgtaagcatttgcatgatttaa

SEQ ID NO: 15508 - DNA, 1044 bp, Homo sapiens
ttttcactcagaccagctgctattcagcaagaatgcactatctaaagttttactctcttattagctacggatttaactgacccattctgattccacaccaccctcaagcaatgggatcaatctggagaaggctggtaccttttttcaaatatccctaaattgtaatggcacgttttctggttgtattttgattagaaaatcatcttaccctctttccagaaaactggaagtggcatttggtctttcagacttttcttttatagaaaacaacatattaagttttgtcttctacttttattagagagtaattaaaaaaacattttccacttaattctaaggttgtatgatcagctcttttccaggtcataggaaggaaattttaagtcttctcctagtcagccaagggctttactgtttggttgagaatagatttcagatacctacttcctcccccaataaatattaacccagaattgtctaagtacacaaagaatcccaagattcatgagtcatggtactgaagtgaaatgccagtttgttcattctgaaccaggacgaaacaatgacctaacagttcaccaagcctttttagcacatagaccattggctgttaatccccttaagtgcctctactcacctaagggtgtatttatttttattgactcaagttgaatataagagccctgagtatgcaccaaggtcatgggcaaggacagtgtgatctgaatagagtcccctataaatcatagggggaaagctgccagagggttagcggggatggaatgagcacacacacttgcatgtaatctgttaatgctgatagcctgaaatgcatggactcaaaacctgcgttcagggttatctttaacagtgtaccggtaatagctttccagaaacagcttgtagttctgctaaagtctaaactttcctcagatgccatttgtattgttcagccaccataaaggggaatgacagtctacaaatgagccttcagagaagataacacagtaaaattgcattcccaaccaccatagttgtgaaggt

SEQ ID NO: 15509 - DNA, 1049 bp, Homo sapiens
tatcagggacttgagcatctgtggattttggcatcctcagggaatcgtggaatcaatcccccacagatactgaggagacaactgtaccggaccttaaacaaaaaggattaaaggattaccttatgcttgggggaaattgttttaaactataatgggaaggcatagcttatatttaagaaagaactttttgaaatagtagagaaagaatgttagtgtttacttaggctgcagttcattagtgatatcccatcaaaacctatgatgagagagagtactataggaaaaagcactggccaggtgtggtggctcacgcctgtaatcccaatgctttggggggccaaggctggaggatcacttgacaccaagagcagcctggatgacatggtgaaaccccatctctaccaaaaatatacacattagccaggtggggtagcatgtgcctgtagtcccagctaccagggaggctgagatgggaagatcacttgagcccaggaggttgaggctgtggtaaactgtgagtgtgccaccacactcagcctgggtgacagagggagaccctatctaaaaaaaaaaaaaaaaaaaaaaaaaaaagaaaagtaaagaaagaaaaaagcatttatttaaaaaagataaagaaaaattttaaaagaaccacatgtaaaatggagaggtaaatggaggtgggggaaggtgtcaaggtcatggttgggttaagcatgaaattctcctaattaacctcaggtcttgcttctggttgtgtcacatgaactgcctggaggaaggagattggtctgttagtgatgggaatgtaattgtgaacaggcaggacaaaattttacctgtgtattgtgtactctctcctgagttgctctgtgctactgacaatgtctgagaattcaaagagacacaacagtccttcagactctcctttaaccagtagatatcagtgtcatatcctgacccaagaaatgacctttataaatttgccacttaacaaaataaaactgttcaaatgatcaatagacacttgccatccagaacagatggtg

SEQ ID NO: 15510 - DNA, 1092 bp, Homo sapiens
tctaggcactgatctaagtaatttctatgtgttaactgagggaattcccacaactccatgaggcaagaaccattactattctcattttacagatgaggaaactgagactaagaaaccaagaaacccaaagtcacagttcacaagtgccaagaccaagctttccccttaaagagccagactctgtattctgtgccttaaccactatacctgccattactgcacagaagagaacctacatatagctttggtcacactcctcctgacaaagttgaggtggcttgctcttatatgggaacaacaagtcactttttttttgagatgtaactcacataccataaaatttacctttttaaagtgtgtaattcaatagttttaattagattcattcacagagttgtgcaaccagcacagaatctaattccagaatatttttatcatcccaaaaagaaacctcaactattaagtcaccactaaaaccccacaactcctggcaaccagtagtgtactttctgactctgtggatttgtgtaatcaggatatttcatataaatggaatcataaaatatgtggccttttgcatctgtcttcttttacttcgcataatgtttttaaagttcatccaccttgtagcatgcctcagtacatcattcttttttatgactaattatcctgtactaatatcctattgtattgcatatagcacattttgtttatccatttatcagttgatggacatttgggttacttccactttttggctattactaataatgctgttatgaacattcatatacaagtttttatgtggacatgttttcaattaccttgagtatcatgatatagtaaaaaatatatttggtctttgtccgtggttcctggctcagagctcctaaaacccttgggatttcctgagttagaagtgtcttgaccagaggtgactcagggtgggcccccaggtcccctcaggatgggagctggtcactgtgaagtccaaatgtgaactcttgcatttctctaatgactagtgatgttgagaatcttttggtcactggaaagaccaaatgtgagctctaggggtgggaactttcagtg

SEQ ID NO: 15511 - DNA, 1041 bp, Homo sapiens
cacaatatagtctatatattcctgtggtaaatgtaacaggcagcatatgttcatgtttttacatttcttttgatttacttctagtacaattagaacattctgtgtgccatgtaaacatttttacagatattaaggaaaatgttacagagaagacagttattcctctttgtacccaggcataatggaaagaactagataacaggagatccaggttatagaaccaatgctgccacttacttgcaggaaactttttgcaagtatcatcacctgtctgtacttcccacctacaaagatataagggagttaaaattacaattgtgaaaggattttgataaggtaaattaaatgtttataatttactaatttcagttcaacacaaccataaacattcatgtcaaacagagtcaatgtctcaccagtcaacaattactgcgtaaaaatctcatcccccaacttggggtacttttctggatccttttcagagcatagggtacagtccaaagctgctctgaaaggtggcctaaaagagtgagactcttcctcatgggtccagagagaatattcagttgaattaagctcaagaaataagaatactatacaaagatttatatattaaacaaaagtattctgtttttctctaagtaagctgaaatagctgataaggctccgtttttttcagattctccaataaagatattgttaccagtttgaagtagcagaaattgtttctcctgtatatgccatgaaaagatgctattaattggagtttcaggtcaaatcacagtttgcataaagtaagagacaattatcacagccatctgttcttgtgtaatgaaaataatgtacagggaacatttgtccttaccatcagtatgataaattgcactttcctcacctaaacaagttggtggacttttcaaagtgtatatacacatacaacttaactttggcctacagaaggatagaagaacctataacaagataaatgtttaagaatcaaatagttataaataaatatcatttgtttatcagttttatcag

SEQ ID NO: 15512 - DNA, 1041 bp, Homo sapiens
tccgaattgcctaagaaacccaaaaatatttttactttttataggctgtgtacctgtcatcctttcttctatgagcccagagaataaggatgctcattttgatgaagtcagaattacctaagttcattaataaactccccattaaattaaaaataaaaaaaacccactaatataacgtaacctttcacacttctagtattttaataatgttgaatggtgcttgcaacaattaaaaccattttttgaataggtaatgcacgtgactggtaaaaaacaactttaaatacagcaagacacatggtaaaaagtaggtctccttcctacctgagccttgcgatcccctacagattccttaccctcactaaaactgcgaaatgacgagcatgcttagcacgaatacacatttttgacacaaagggtagcagatcatacatactgtcttacactttgcttttatcacttcactctagtaaaatattttcaaacctttcaaaggacaccgttggtggttttaatcaccaaggcatttcattatggtaggcatgcatgcaagtatccatacacacttaaaaatcaaattttaaaaaaatggaattttaattaggaagatgacaattacaactcaaaaataagtgtgaaaacttaaactataatttttaaataaaaaaccaaatgctatctttgaaaaaccgaattcaaacaatgtttaacagttattgcagatgttattaaatagtctggttgccaaacagttaatatactgatgcttgtacttggcaaacgtactaagatgttttccatattatgttattgtttgaatgcctcttaaaataactcaaaagggacaaatgtgcagcaggactagaattttatagcattttgttgtagttgatttatactttatccccttgggttttgaagtctaacaaaagcatcccaaatacgctatgcattgtctgactctcctctcacttactttatgattaaagctgacatgatcactatagaacagttccaaggcaatttacataattgtcggaa

SEQ ID NO: 15513 - DNA, 1029 bp, Homo sapiens
tgcggatttcattaaataaaaggaatgtaagttggcttttgtttgaagtgtcaggattttgttgttttgagaaatatgatggtgaaaattaatcctcatggtgctatgtggagagtgtaggggcctgaattgtttgtactgatatgcctggcaaatttagatttccattttgtaagtattatttcaaaaccctagataatatttttttcttatttcttctaaaagtggaaagtaaagaaaatacctggttaatgggggtgtggttctagatagtaagattctaattagtcaagacagaatgtgcttcttagctgaaaaatatttgggcctcatctggctcctttgcatctacagacgaatgttacagggagatggtgccaacaacgaaagaaaaaaaaaccattgttggatatatttgtctttattgcagcattgctgaaaggaagttaatgacttatagtctaaaggttagttcaaaggtaataacttccttgaattcactgtcaatgaaacatgctgtaagatgtgttgtttttttctgtgagcgactacccatttgatttctacactgaacacgtttagtctagtgtgttaactcacatgttccttgattttttttcttcctttctattaagcttacctttaggtgtcagcatttttctgctcatgctcaaaggtcttctgaagctgacacctcactgggtgttgatccacatatccaaagcccatgcagtcgcacagattgtgtgagtgaagtcatagtgttctttgcttctttcttctgtttctgacctctgcagatgtagatgaatgctcagaaaacagatgtcaccctgcagctacctgctacaatactcctggttccttctcctgccgttgtcaacccggatattatggggatggatttcagtgcatacctggtaagtttcagagggccagattaggcacatgaatctcttagctccttcaaggatatttttctatgacagcccactcttgatttagcctggtctggagccttggtggatt

SEQ ID NO: 15514 - DNA, 1047 bp, Homo sapiens
tttgtttcctctgactgtttatgaatagcctgtcttcaagctcagtaattctttcttctgcttgatcatttctgctcttaaaggactctgatgtattctacatatgttagtttagttgcatttttgagctccagaatttctgctggattctttttaattatttctgtttcttaaatttatctggtagaattctgaattccttccctgtgttatcttgaatttctttgagttttctctaagcagctcttttgatttctctgtctgaaaggacacatagctctgtttctccaggattggtctctggtgtcttatttggttcatttggtgaggtcatcttttccaggacactgttgatactgttggatgtttgtctgtgtctgggcgttaaaggtgttctcttctcttactttctcccaaacaaatggagtccgtctctctgttctgagccacctggggctgggggtggagtgacgcaaccaccctcaggggccaccaccactggcactgtgctgtgtcagacatgaagccagcacagtactgggtctctcccaacacttgctgtaaccactccctggctactgcctatgttcacttaaggccctggggctctaaaatcagaggtggctaagccagctgggcctgtgttcttccctttaggatggtgaattcctccaggaccagatagaggagcctcaccccatggccactgctaccacaggcccacagggagtactggcaggctactgctcatgttctcttaaggcccaagggctcttccatcagcttgtagtgaatgctttctggcctgggactcatgcttcaggatagtgggcttgcctctggcccaggtaaggtccagaaatgccatccaagagccaaggcctagaattgtggcccccccaaaacccgcttggtgttctacccttctctggcagagctggtacctatggtgcaagacaaagtcccctttacttttccctctacttttctcaagcagaaggagtctcaccccatagccaccacagctaagaatgtgcttagtctcac

SEQ ID NO: 15515 - DNA, 1050 bp, Homo sapiens
gcagagatctaatttttgcatttttagtagagatggggtttagccgtgttacccaggctggtctcaaactcctgagctcacgttatcctcccacctcggcctcccaaagtgctgagattacaggagtgagccactgtgcccagcctggatgctctttttttctttctcttgcctgatttctccagctaggacttccaagactgcattgggtaagagtggtgaaagagggtgtccttgtcttgtgccagttttcaaggggattacttccaacgtttgcccattcagtatgatgttgactgtgggtttgtcatagatggctcttattgaggtgtgtttcttcagtacctagtatattgagagtttttaacatgaaggggtattttattgaaggccttttctacatctactgagataatcatgtgatttttgtctttagttctgtttatgagataaatcacatttattgatttgcatatgttgaactaaccttgcatcccagggatgaagcctacttgattgtggtagattagctttttgatgtgctactggatttagtttgcatactttgttgaggattttcaatgttgatcaggaatactggcctgaaattttcttcttttgttgtgtctctgccaggttatggtatcaggatgatgctggcttcatagaatgagctggggaggagtcccgcctccttaatttttgggaatagtttcaataggaatggtatcagctcttctttgtatgtctggtagaatttggctgtgaatccatcaggtcctgggctttttttggttggtaggctatttattactgattcaagttcagaacttgttactggtctgttcagggaatcaatttcttcctggttcagtcttggtagtgtgtatgtgtccaggagtttatccatctctttcaggttttctagtttgtataatataggggttaggagtgcttttagttactggggttttcttgcttctcagctctccctgctgacagagctaaaaaacagatgtatgtatgtgtgtgtgtctataaaaataatta

SEQ ID NO: 15516 - DNA, 1028 bp, Homo sapiens
ccaacaaacagaaaagaaaccatatatggttttagacttgttgagtttgaggaggtttccgttcaaaggaaaacagagaaggtagtaaggatatatgggtctggaacttcaaggagtttgggccaaagacataaatttaggattcattagattgtctatggttattgaggttgtgtaggacaggagtgaagaaaaacaagagaaggcagcttaagctgagccttgagggacctccaactctactggctgaagagcctgcaaaagggaacaaaaaggagaagctagaaaggaagggaaaaggccaacagggaatggtgttgcaaagatcaagggaagagagtgtttaagcaggagtgtttcatgctgagaggttaaaataagaatgggatagaaaaatactgaagatcctaagcaaatgcattttctacaattagtaattacaaatgtgcattttccttttatttaggcacatctactatgcttcttactagaataaactgtgcagattggtctgatgtatgtactaagcaaaatgttactgaatttcctatcataaagatgtacaagaaaggcgagaacccagtatcttatgctggaatgttaggaaccgaagatctcctaaaatttatccagctgtaagtattcagcttcattataagatctctgaatgtttaggtctttagaagttctaattctcagactttgctaacacttaaaataggttaaggaagatactagaattgagatcacaaaatgaatatttatgaaagtctgtgtacatttcaacacttttcgggagatagcaattttgtttaatgagtctgattttctttaagaataatatttaattttctatattttgtaagatattatcctatgtaatatattgtttgctatgtttagtatgctttttttttacaaactgaaaatatcttaaaaaattaatttgtaatatagttatatgtttatccagcaacaggatttcatatccagtgaatataacatcgatccaagaagcagaagaatat

SEQ ID NO: 15517 - DNA, 1027 bp, Homo sapiens
ctgtgttctggtctcttgtttcctgcttattcctgtaatggttcctatatttgaaccttcagagttagaggacttgtccctagtctcagtttatttgattcctgtcttcagtgggagtcgcctgtttgaagatttctttgtggccacagcctctatattgtttcctgactctgtggccttacttaccctctgatgctgccttctctttctggtttttatttccatttttttaattgaccaataataactgtacctatttgtggggtacatagtgatgtttcaatacatacaatgtatggtgatcaggtcagggtattgagtgtatccatcatttcaaacatttatcgtttctttgtgttggaaacattcaataacctccagcctgtttctagtatttcttttgcagctttgccttttttgtttatttttcatcttaacttcctattatcagtaatccatactggcccagaatgttgtatggtgttgtgcctgtatctaattcttccccctccctctgtatcactcccgtttacaaaggaaaactagataagggttaggaaagaatttattaccatctgagaatgtaaatcagagacaggtgcaccccagagaaaatcagcaaaatggaatcagaatgaaaaagactagattccacagaagggcaatctgaaaaaagaaaagaagcatgtgttccagcctgggcaacatgacaaaaccccatcactacaaaaaatacaaaaattagccaagatggtggtatgtgcctgtaatcccagctccttgggaggctgaggtgggaggattacttgagcccaggagctggaggttgcagtgagctgagatcttgccagtgcactcctacctgggcaacagagtgagaccctgtctcaaaaaaaaaaaaaaaaaaaagcagcatgtgtgactgaaaatagtgtgtatgttattaatgaataggttgaaggtagagctgaggagtgactaaatgtacaagtgatggtagcttatttagaatataagaaaagaggga

SEQ ID NO: 15518 - DNA, 1044 bp, Homo sapiens
gccagttttcaaagggaatgcttccagtttttgcccattcagtatgatattggctgtgggtttgtcatagatagctcttattattttgagatacatcccatcaatacctaagttgttgagagtttttagcatgaagggttgttgaaggccgggtgcggtggctcacgcctgtaatcccagcactttgggaggccgaggcgggtggatcatgaggtcaggagatcgagaccatcctggctaacaaggtgaaaccccgtctctactaaaaatacagaaaattagccgggcgcggtggcgggcgcctgtagtcccagctactcgggaggctgaggcaggagaatggcgtgaacccgggaagcggagcttgcagtgagccgagattgcgccactgcagtccgcagtctggcctgggcgacagagcgagactccgtctcaaaaaaaagaaaaaagaaaaaaaaaaaaaaaaaaaaaaaagggttgttgaaatttgtcaaaggccttttctgcatctattgagatgatcatgtggttttggtcgttggttctgtttatatgctggattacgtttattgatttatgtatgttgagccagccttgtatcccagggatgaagcccacttgatcatggtggataagctttttgatgtgctgctggatttggtttgccagtattttattgaggatttttgcatcaatgttcatcagggatactggtctaaaattctctttttttgttgtgtctctgccaggctttggtatcaggatgatgctggcctcataaaatgagttagggaggattccctctttttctattgattggaatagtttcagaagcaatggtaccagctcctccttgtacctctggtagaattcggctgtgaatccatctggtcctggactattttttggttggtaagctattaattattgcctcaatttcagagcctgttattggtctattcagagattcaacttcttcctggtttagtcttaggagagtctacgtgtcgaggaatttatctatttcttctagattttctagtt

SEQ ID NO: 15519 - DNA, 1125 bp, Homo sapiens
ttttattgtcttagccaggatggtctcgatctcctgacctcatgatctgcccgcctggacctcccaaagtgctgggattacatgcgtgagccaccacgcccagccattccttagttcttttttttttatgtgctgccattttttaatttttttattattattatactttaagttttagggtacatgtgcacaacatgcaggtttgttacatatatatacatgtgccatgtttgtgtgctgcacccattagttctttaagtaacttttttctgtggttgcattttgactacaagtaattttttttttaaagaaagcagtttaaaggtctttcgttcctttcatgttgggagaataccctctgaatatgttttaatcttccattctagcatagagcagagagaaagagaaaggacagttcactgtatagttcttcactatttccctccaggttcacttccttctcttcgaatagttgagtattattaagaattctcaggattttgtccttcaccatcgggggtaagattaggactcatacctagctttactaaaaatctgttttttctttgctacaacattctggcttgaagttgtgccctttcctaaagtttctgctcatgaattttttttttgctgtatttcaaaactcttttttgttttctttgatagataataaggaggaagattctctgatcttatttcactttatgatgcttactaggaattatgtaatattagttttttttattatactttaagttttagggtacatgtgcacaacgtgcaggtttgttacatatatatacatgtgccatgttggtgtgctgcacccattaactcgtcatttaacattaggtatatctcctaatgctatccctccccgctgcccccaccccacaacaggccccggtgtgtgatgttccccttcttgtgtcaatgtgttcttttgtcaataagtaagaacatgcggtgtttggtttttttgtccttgcaatactttgctgagaatgatggtttccagcttcatccatgtccctacaaaggacatgaactcatcattttttaaggctgcatagtattccatggtgtatatatgccacattttgttaatccagtctatcattg

SEQ ID NO: 15520 - DNA, 1028 bp, Homo sapiens
acctggctttcttcttatcccagctgggtttctttctggattctctagctctgggcttgctcagttagtacagaaagagtttgtcccaacacatacctcagtgtttactgagagaaagtttaagttttctggcctggaatctccaggcctggtatttaggtctatctggggtccattcttggactcttcccctgaattaagtctgatattctctttggtaacagagctagaaaatatgacttgttaaggacacaggtttacatggacttttctaatttaatgttataagcctgttgtccactaagacctttgctgacattggctgtctttttctgcttgggtctcctcttcctctctcacctacaaaaattggtagtttaactcctggaaattcaaaacttacaggtgaaaagttgtgcttatcactttacaaatgttccagtcccaataatatgttaacaaaaggcctttagaaattcctgacaaccatgggccctgatacttgtagactaacgagccaatcgtaatgagtgaagatggtcttttgaggaaggaattccttggaatccctttcctgggacagaggggtagctatcttgatggtgggggttctgtgaagcttagcaaaaagtccaagtaatagatatgacatttgttctcaggaagcttactagttagcagctgtttttccggtggatacctgatgactatctttgacccagaaatgggggtgaagaaacagaaaaagaagtcttttcataaagaatgaatccaaatttgacaccaaatcctggagtggcatatccacattgaacaacttgatgacaaagtggttttgaaacagctggccctagatgtggagaggaccgaggaccctgttatctaaactggttactccgtgaggctcagctcattcagtcctgctttagtagtgtcctgttcttagtgctgtactaatgctgatttatagaacacgaattccacaaatagattattccccatgttcctgctgtgtgccagacacttgt

SEQ ID NO: 15521 - DNA, 1050 bp, Homo sapiens
tattgagcataactaataatttttttaatagtcaaattcaagtcttcatgtcttaaaagtactattcttggaattaataagtgaagtgagtatacacatttctgttggctcccttattataattgtgattagaaaatgatattttaaaatcattttgaaagtttttgtatgtgtacatgtgtgttgtgtatatggtattaaacttggaggaagaatgccaaatgttaggtttaaacgaaacatttattatattgttgttttaggaagtttttaaggtccatttacaaagttaaagtacatcatgataaaaacagaaataagaataatgaggcaatagtaaaataagggtgtgaaaatatgtaatgagatatgtttagttatttgttgttgcatgctagttggacaaatgaatctattctgtgtttgcagattttaaaattcatttttaaggggcaattcataaacattcatgaaacatttgttgttttagattccccaagaacatctgtatttcttgaagaactgaatgaggctgttagacctctgcaggactatggaatttcagttgccaaggtagaaagatatttatgttactaaaatattagtgacgaacatcttacaactttatggcttaagattgaatatcttaaaatacttccatttcatatctttttccaaactggaaatatatttttttcataagaataaacagaagcccagaaagatagtttcaggttattgcataacatactgcatatagaggggacaaaaagctgtttaaaaatttttagcttagaatttaactttatgttataaaccattctattgggcccatggtatcatttttcaaacctatagttaggtttttgttctgttttgttttgcctaatgaatatttcataataggtagccacaattcagctgtttttaaatttttattagcacaaactgaagtaacaaaatggaggtaaacaaataatttttttctgttcttctaagtctttataattgtttatgtttcactttttcgcatttatttttagaacaaag

SEQ ID NO: 15522 - DNA, 1643 bp, Homo sapiens
ttgaaggaatattcttacctctactttgtcaccttctactggctccttaactaaaatctgccatttggctctctggttaacagtcccttcctgtaaagtctaaaatcttaattctaaatccacagtttaattcacaagctagtacttgactttttttctgtatttgacatttttgacaacccctactttaaagatttattcccttgacttcttacattttgctcactcctgaaccaccccccaccttttggcctcttcatttattccttaaatgttattcctcagacctccattttttttttctctcttaatcacaacaccacttctcacgcttgggtaattttaattcagcagttcctaaatccttatctttagccagactcctcaatccatctgcctgttgcacttttcttggttgtcccagagacacctgtgtgtgtcttaaaacattcattctctgcaaaacctactctaatgcctgtgtcccttactttggttaattttagaaccattatattctaagttttctaggctcattcctctcctccaccttcccctatcatttagtgtctaagttttactgattttatctccacctctctgatacatcactctttcatcttcattgctattattaataaatacctacagtactaacctgcctcctatacctagctggtctcctctctgttgctcaatgttaccacagcaggctttctagaagcactctgacagtgttactccctaatatccttcagtgacttcaggaactttcaggagaaagccaaactcctctgtttggtgtacaaggtcttctgatgtgtttcctccaccgaatgttctggtgaaacagacttacacttcttcagaagccacatttggccaggcctcccgccttggtaaatgctgtactctttgcatcaagtatgctagtcatccttccccacttggaaaattcctatgcatcttgcaggcctgacataagcatttcctctgtgaaacctcctttgctccactcaaggagagtcatctaacttccactttcgtgtcaccactgtaattacaacctacctctattgtatgtcacttaaatcgtactgtattgttttatttttcaaaagtctttactagaatgtgagctccttaagggcaggaaaaggaacctttttattttttgcatctccatagcatagtttttggcatatgaatgtttaataaatgtttgttgaataaattgattttaaagtgacatctttattatattagaggtcctacctatattccaaatactttcactcccttcactttacagcaagggtcagtagagtcccaaggatttgtagactttagggggtcaataaagctgaaattgtattcaagatttggtgtggtttttggtgggtcatgaaaggggtctattcggggaaaaaaaggaacttctttcatgggaaaaggcagcatcattgaggaatttcttgaataatcaaataataccttcctaggattataaggtagataaatggattcctgtttaagattctgaagggaaggggagaagtgttataaattatttcatacaacaatttttcttagcttaatgtttgaataaataaaaatgttggtaccagtaccatgctgttttg

SEQ ID NO: 15523 - DNA, 1068 bp, Homo sapiens
gagatttctaaacattgtgaaaagttgaatagattatatatttattctcataatactttcactaatactaaataaaatttggggaacactttttatttttatataatttccaatttacagaaaagtttcaaaaatagtacaaagagctctcttacccagattcactaattgttcatacgtgctttatctttcatgctttctctgtacacacacacacacacacaaatttttcctcaatcatttgaaagtcagttataggcatcatgccccttaaaccctaaatacttcagtgtgtaatactgaataattactaaaaatgattttctcagaaaaaaaaactcccacaattctggaactataatactgtaagccttagaataaataatactttcaagttccaatctaaagttctttttgagttttgttgcccgttttatgcttgatgtgtatagtaatagggtaggctatttattttattaaaattttttttagagacaaggttttgctgtgttgcccaagctggaacttgaacgactgggctgaagtgatcttcccacctcagcctcccaagtagctgggaatacaggtgtctgccaccatacccagtttcatttttgttttttatacccgaagttcatttcctttgtctccctaaaactgaactgtaattttgggaggttttcattagtggaagctcttcatttataaagctatttgaaggggtttaggaatttatatcacatggtaattgtagagaaaaagaagctatatacctcaaaatcgtgccctctttacatatgtcttatcaggtataacatgttgaaatgtcacattagtagtaaagtggggtttatttatatagtggttaagaaatgtcagtttacactgctgtatacttcttcttctgtgtccctaaggcctggtacagtgccaagcacatacttggtatccaataaatatttgttggatgaatgtatgcatatgtattcagtatattttaaatgaataatcacagaagtaagtttaataatttgtcctatttttctctgtcacttcctttttctctaa

SEQ ID NO: 15524 - DNA, 1027 bp, Homo sapiens
aatttttttgttgagttggggtctcactatgttgcccaggctggtcttgaattcttggcctcaagcaatctgcctgtcttggcctccgaaaagtgctgggagtacaggtgtgagccaccaccatacccagcctgatttcatcaaaatatttacaaaaatcttcctctgcttttcattctttctttctgtaatgaaagaacctgattttatgcactcagtttttttgctgttagataatacttattcttgacttcccatctacctcctacttgaagcattcttgctacaaatacatacctcagtgcttatataatctgcctaaacagcttccaggaactagaaagtgagggggaagatgctgtaataagacttctttttttcctactattttcaatatgttcctttttttttttagtttacttgctgctttattggaaagtgttctggcatcagctctttttaaatcatgcagattagaaagatttctcacaatgttttaatttgatcaaaactcggaaacactcacctttaatgtcctatgaagtttaggtagagagtcttgatgtaacagaatttttctgaatcttttacaggaaagatgtaaaaaacaaaacatgctactatcaaagatttacttttttaaaaagcagtttctggtaaacatcgatttaaacagtcatatttacaaattaattttaaaaatctcatcttgtttccttagtaccctatcaatgtatggttagaaatagaggacttgtatgaaggagaattatttagcattcaattcaaatagaatacgatctcatttgaagacttgtaaagtatttgagaatttgggcaagaattggtcagttggtttcactgaatataaatcacagcatgcttgatcattctattgactggctgtaatttaaagtgatgacctaaaactgtatgtctaaacaaggaaaatctgtaagtgatttaggtactggttattttaaggaccatacctttttctaacctgagataattaggggatatactc

SEQ ID NO: 15525 - DNA, 1019 bp, Homo sapiens
caccacacccggcctccttcctttgtttctcctgaaaagttgttttaaaattcctgacacattgttatatttgtggtgcgttagaatcaatggaatacagtcttgtgtagtagctttttaaggtaactgaggataagaaaggtttaataagacattttattttacagacattcagtcccctgaagctgaatatgtagatttgcttcttaatcctgagcgctacactggttacaagggaccagatgcttggaaaatatggaatgtcatctacgaagaaaactgttttaagtatgtgtcattttcatttagaaaaattcctataagatgtggtgatttctctttataaacaaaatcataatgatttaaaattaaaaatcaaattcactttgttaaaagatgtgtttgtacaaggaaacatgactattcattaatccagtttccttctggggaaatatatagacgtgagtttccacagatttttcctttagacctttatgggagtattgtaggcccttgacaaatgttccttgagtcgattataggatctcattttatagttaaggtaacctagagctggagaggtttgcttcatttcccaagatcacacagtggcagtgtagagaaaagaatatacaactcttaattctctttttggtgctctgtacacccttgtctgtggctttaattattttacagttaaattgatttcagagaacaattataataggtatcatttttgagcactcactgtattctaggcattgtggtaagcatgttatatacattttcttcttcagtccttgcaataaccctgtgttgcagtcatcactgtattatagacagagaaactgagacttagagaggttaaatgatttgttcagtgtcaaagatctagtaagtgaaagagcccgctttgtacggggtaaccattaggctggaggcagttgctgatcactgggtatctgagaaatgcttcaggttactcacacgtaagtcttgaggtgctaaactttgtactc

SEQ ID NO: 15526 - DNA, 1033 bp, Homo sapiens
ctgtctcaaaaaaaaaggggatttagcaaattgcaattattactacttattttaagaagactgtgtctaaagataacaatttaacgtgcagctgcagagagtacatttacatatcattctgtgatatgtgacttttcatttagactaaataacttttaaattaaaatttcccattattttattatgaaaaattaaaaatatagcagagttaaaggaattttcccttgaacattcttatacccgtaacctagattccaccaccttttttttttttgagacggagttttgctcttgttgtccacagtctggagtgcaatggcgcgatcttggctcactgcaacctctgcctcccgggttcaagcaattctcctgcctcagcctcccgagtagctgggattacaggcatgcgccaccatgcccagctaattttgtatttttagtagagacggggtttcaccatgttggccaagctggtctcaaacctctgacctcaagtgatccacctgtctcggcctcccagaatgctgggattacaggtgtgagccaccgtgcccggcctagattccaccattttaataaactcactttaccacatgtctgttcatctgtccatccttgtagccatccattagaacatcttatttttcggatgcatttcaaagtaaattgctggcatcagtatacctcctcctaaataagtcattagctagatggatttatgtaagtagaagtatattattaactagagtccaatatttgtttatatgtgcttttaataaaagtattaccatacaatgaaatgtgcaaatcttaagtgtgcatttgctgaatgttgacaaatgcatatacctgtgtaacctaggcttctattaagagatagaatgttagcattatcctgcaaagtttcctcatacccattccattcaaaccacactccttcttcagaggcaaccactgttttgaacattttccatcatagattctaaactaattttgctcatttttaattccatgttttcttgtacacacacag

SEQ ID NO: 15527 - DNA, 1057 bp, Homo sapiens
aggcctgtttcttcctatgatatgagcgggtggcttccaccctcgctgtctaatacagtgggcactagccagccacatttgactatgaaatgggtctagttcgcatcgaatacacactggatttcaaagacaaaaaaagtcaaatatcttatgaataaatttaatgttggttatattttgaaataatattttgcacattcggggttaaataaaaatattttaaaaataaaatgtacctgttatttttactcttttgctgtggctactaaaaatataaatgacatatgctgccctggtctagatgctctctaatatccctttcagctttaagactccgccgggaacacggtggacacgtaattcgtacgatttgattgtctcgcattgagatacggaaggattggccgggagtgagcgggctggggctgggcggggcggcgcggggcgggcaccccccgccccccaaccccgcaggaaaacacaggcccctccggctttcgctctcgctctgggaactggaaggacccccgactcccgcgcagggtctggggttgtgcgcgtcgggttgcgtctccaggccgggggcgtcagggagccgggggcggggacgggcgcgggcgcagcggaccgggcggggccgagccgggaagctggtcggtgcgtcagcctcacgcggcgggaaggaaccggtccgaggccccgggctgccggcgcgggcgccgcggcacgtccacaggctgggtcgcgaggtggcgatcgctgagaggcaggagggccgaggcgggcctgggaggcggcccggaggtggggcgccgctggggccggcccgcacgggcttcatctgagggcgcacggcccgcgaccgagcgtgcggactggcctcccaagcgtggggcgacaagctgccggagctgcaatgggccgcggctggggattcttgtttggcctcctgggcgccgtgtggctgctcagctcgggccacggagaggagcagcccccggagacagcggcacagaggtgcttctgccaggtgagcgatgtgcgcgttggtgctgag

SEQ ID NO: 15528 - DNA, 1031 bp, Homo sapiens
gggctcaggtgatcttcccccctcagcctctggagtagctgcgactttaggcatgtgccatcatgccctactaatttttatattttgtagagatggggttttgccgtgtttcccaggctggtgtcaaacccctgggctctagcgatcgcctgcctcggcttcccagagtgctaggattacaggtatgagtcactgcacctagccttaaatttcatttttaaagagggcttagggtgagttttgtatttgtcctgtttattagtgagctggagattactagataaaagtatatttgactctaagtaaaaatgctttggtgatttaaatgcttatcaacttacatgaatgcagtgggaaaagccataatctaaacctgtttctaaggaaacttaagttttataacattaattcatattgttactagaatcaatttttattaataaatgctatctcctcaccctaccccctttttaaatttcaggttattatcaacccttactttgctaagcaagaaactgaactgttacaagattacccttgaatgtctaccacaaaatgttggtttctataaaaagtttggatatactgtatctgaagaaaactacatgtgtcggaggtttctaaagtaaaaatcttgtaagaaaattgtcaaaggggctaatgctacaaggctacactcttcctagagttgaaatattttgttgctgcagccgagtgacctccataaatactggactgaaaaaacattgtaatactacaagtataatgacatttagaagattactttgggctggtgggacatgctgtgaatttagattacaaatgaatattataaaggggatgatttttaaccaaaggaatatatttttaacttgaatcttttcttgcattgtatttttctaaaagtttggcttcctttcttggtagtcaagagtatgggtaataaggagttatatgtctgctatctgtgttgctcatttaaaaaaagtatacattgaataaggctgtttatcacatgcataaaattaaat

SEQ ID NO: 15529 - DNA, 1081 bp, Homo sapiens
aggcgctggagctaacacctgcagccatagtctcctggtttcccacctgcttgattatagcaaaggttgcgccacccttggcaagccagttctgagttactcctagtggcccagcccatctcttctttgggtacatttgtacgtacacatatttttgtagataaggcctttctaactcgaagtattccgatgtggacaacagcaccagggaaaagggctccagactgatttcacaaaaatgactcccaaaacaatttcatttaacacttaaaacacagaggtgcttttcctgattcatattcctaaattgtacttagtacagtcatgtatcatttaacagtagggatacattatgagaaatgtgtcaccaggtgattttgtcattgtgtgaacattatggagtgtgtgtacttacacaaaccatgatggtatagctgactgcacacctaggctatatggtatagccgattgctcctaggttacaaacctgtacagcattttactgtactgaatactgtagacaactgtaacacaatagtaagtatttgttatctaaacatatctaaatctagaaaaggtacaacttggctgggcgcggtggctcatgcctataatcccagcactttgggaggctgaggcggcggatcatctgaggtcggaagttggagaccagcctgaccaacatggagaaaccccgtctctactaaaaatacaaaattagctgggcatggtggcatatgcctgtaatcccagctactcaggaggctgaggcaggagaattgcttgaacctgggaggtggagcttgcggtgagctgagatcacgccattgcactccagcttgggcaacaagaacgaaactccgtctccaaaaaaaaaaaaaaaaagtacacttgtatagagcagtttccatgaatggggcttgcaggactgggagttgctctgggtgtgaatgggtggtgagtgaatatgaaggcctaggacattactatatgctactatagactttattcaataattttctttcttcaaacctttgcttactgtaactttataactacttttaacatcttgacccttttc

SEQ ID NO: 15530 - DNA, 1041 bp, Homo sapiens
tcaggcagaaaactactgctctagggccttatctcatacatagtaacacctaaaccatgcactgtgacctacaaggctcctgcctggctctctgatgccacctcctgctgatctccatttcctctcctctagccaccttggtctccctcaatggtgctggaactttgttttgttcatcatcatatctctagcactagaacagtgccttcttgcacacagtacatgttcaacaggtatttgttgaattcacgaattcagcacgtctgatgttcttattctgtggtagtgattactctgcaagtagtgctgactaggttggtagtgtgttgagtcttcaggaatgctactgaaaagcccagtatttgaacataagtcacaagcccccacagtccagcttacccatcttctaacactgtcttctacttcgctgtcagaacacctacttttctgtttttatcttttgccatgagtggtattgacacttctgatttttttctggtctcctatttctgcttttattttgtgtaattttttttctatattgttactcatccactagtttctctgggtaaaaaagactagttttaccagcgttgccagtcagtaagagagcttattttttttctgtgggtaaacggaccactcataggatgtccagtatgtaatctttggatcctatccccttctcttggtgggtgcaggttgatagctcctttgatgagaaactgaggtggaattcatgggggagggacaggttttaaagggaaggatgagtatcaggggagatatatgtttctgaggtcacagttggaagcctaattgatggaaaattgagattttattgtaccattatctaagtgcaagataacactgcttacaacaggggcctgcaaagttttcttttcttttctttcttttttcttaagtatggatagtaggtattttgggcttttgggctttgtgggccgccatgcagtctgtgtctaatgttgtggtgcagaagtagacatagacaatgtgtgaacagagtagtgtggctgt

SEQ ID NO: 15531 - DNA, 1035 bp, Homo sapiens
aggtgctgaaaatacaatggtgatcaaaatagacattgcctttgtcttcttagacagtttataatctattaggaaagaaagatagcaccctcctcccccacccaccaacaacaaacaaaatgaatataaattttgatcagtgatatcacaggatactgaaatacaacagtatggggggacataggacattggagggctagggtagctaaaaaaggcttctctgagaatatggaattaatgctaaaacctgaaagatgagagagagttagacattccaggagtggagtagcatgtacaagggcactgcggcaggaaagagcttagttatatgattcttagaactaaaaaaggccagtgtggctggagcaaaggaagagtagcacaggataaatttggaggagtagataggctgtattgtgtggggctttgtagacctgatacggcatttggattttatttaagtgcagttagaagcagttgcaaaggattttcagcaggggaatggcatgaaagcgctgaaaagatgactctggctgttgtatgcaaagtgctgaatggaatgaaggagaccagttaggaggctgtggcagtagtcagtgcaagagatgatggcagcttgaaatagggtggtgccagtggagactggagtggagatttttggaagtggatttgacagtttgctgataaatgtaaggaatgagggaaagcgaaaatcaatgactttcagattcctagcttgagcaactgggttgacggttggtgctagttagtataataagagtagggataagaaaaaaaattgggttacattttagataaattgagttatctgtgggacatcaagaagagatgtgagataggcagtagggtgtataggctggcgtctgagtagaaggttgggctgctgacaccagtgacgaaaataagtgtcttttaaagctatgagaatggatgagacacctggagagccaatgtaaggaaagaagcacacggttcctagaagatgggaagggcagcagagcgtaggaggtggga

SEQ ID NO: 15532 - DNA, 1056 bp, Homo sapiens
caaagtgaagctccttacaaggtagcctcttccttaagactgcattgtttggctccctgagatacagctcaggaaagaaaatcctcctaggtagcccagtgaaaattagattttgctgtattgattaaccatttaactggcagttaacagtatttttatctgatttgaataaatcagtcactgtttgcaaaatatgtatgaaccttttttgtccagctctggtatgagattatttaagaaggaaaatagcaaatatttggatattttgttttcaaagaaaacaagcatttttgttagagcttttctaatttatggtaaatggaccatattaatacattggtctcaataggagatattttttatattgcaaaaaaaggagctgttgaaggtgactgagacaacttgtagttctcgaaagccaggctgtagctaatgaataaataatggtttctatatttattttgcattgcttaggactgtttattatagaatcacagtaataaatagaaatatagagaataaactgcagacagaaatgatgttaatttaaatgactataatcttaatcttttaatgctgatacatttttaattttttatgcagagaaaagaagcccaacaaggtaggaaatgctgtgcgtatggaaaccttacatcttttctgaactgaattcatactgattcctcttatattttgaattccaaatagaaagtgcctctgactttcctgtttggtaaaagtagagctaagtgatgcttttggtttttaggattagatgctttgaatggtaagctatttcgttgcctatcagcaagtaaatagaggagagattcggtagggcagcatttaaaacatccacaaatcaggctagtcaaattagaaaagaactttgtaatttttcagagttgcgtaaaactggaatgacctgccttctgaagccctgacttatgtcactgaaggtattaaagggcagactggatgactacttgccaacagtggctagagaggatcaaagcagcttgcagagtctagataaaaggtggagatggtggtagg

SEQ ID NO: 15533 - DNA, 1050 bp, Homo sapiens
gggacgtgggaactgagtgtccatgtgacggacctgaaccgcgatgtcaccctgagagtgaccggcgaggtgcacattggaggcgtgatgcttaagctggtggagaaactcggtgagtagcatcccagccgcgtccaactaatgacttcccagaattggtagggggaggaaagaggctcacgacgggggaggggcccatttgagaaatcttggcatctcgcaaatgctttttggagatgtaaaatctttcagtatttaagcagatagacctgttcccctttgcgtcttattttgttttgctattctctgaattttcatatgtaatgattcgagcctcccaattataaccttaattgcgtagttacgcgggacgggggatgtgtgccggggaactcgttaattcttaacatttactgacagaacgataaaagaatgaggaaagtgtgttgggagggtgatattacagtgtccgtggttatctatgtcttcagcatacctgaatgttagtgacgtttggtatagagaatgatgcaaaatccatttaagaaaaatctgtgctggaaaatgtgcaactactggcgccagtgtgaagtttctgtggctgttctacgtggtggagtgcattaaaatgttccagtcatccactcttactaggggtggggcagtgcttgacaaacttggtatccatagtccatgctcgatgtaagccgtttcgagcgttcggttttatattaataacaagccaaggaaagaactttgtgttaaaaagcagactttgttaaactaatttgaggttgacggtgtttgcttgagtacaaatatgtattggattgatatccgatttaaaataataaggtatcttacagtatgaagtgtgtgaagagtgtgcagtacacatttttgtgatgaatgaaaccattttcatctggaagagtcagctaaatagatgatttgatcataagagaaatgctcagagaactatcttcctgagctttaaagagccttttgtacataatacagttgtgataagatgattatctgtgtggcatt

SEQ ID NO: 15534 - DNA, 1233 bp, Homo sapiens
atttgctctcagcttgaacgttattggtgtatagaaatgctcctaatttttgtgcattgattttgtatcctgaaacttgactaaagttgtttatcagtctaggagcttttggcagagtcttcggggttttctaggtataaaatcatatcagcgaagagagctagtttgatttcttttcccagttggatgccttttatttatttctcttgcctgattgctctaagttgaatgggagcgatgagactgggcatcctcttcttattccagttctcagaaggaatagttccagcttttgctcatccagtatgatgtctgtgggttggttgtagatggctcttattattttgagatatgttcctttgatacctagtctgttgaggggttttatcatgagggatgttggattttatccgtattcaataaatggtgttgggataactggctagccctatgcagaagaatgaaactggaccccccacctttcaccgtatatgaaaattaactcaagatggattaaagatttaaatgtaagacctcaaactgtaaaaatcctagaagaaaacctaggaaatacccttatcaacatcagccttggcaaagaacttttggctaagtccccaaaggcaattgcaacaaaacagaaattggcaagtggggacctaattaaagcactctgcacagcaaaagacactatcaacagagtaaacagacaacatacagaattggagaaaatatttgcaaactagacatccaacaaagatctgacatccagaatcaataaggaacttaacaagcaaaaaacaaccccattaaaaaatgggtgaaggacatgaacagacacttctcaaaagaagacatacaagcaatcaacaaacgtgaaaaaatgctcatcactaatcatcagagaaatgcaaatcaaaaccacaataagataccatctcacaccagttagaatggctattgtaaagaagtctaataacatgccagtaaggtttcagagaaaagagaacatttatacactgttgtgggaatgtaaattagttcagtcactgtggaaagcagtttggagatttctcaaataacttaaaacagatctaccattcaacccagcatatgggtttatttcccaaaaggaaataaatccttctaccaaaaacacatatggtcatcacagtgctattcacagtagcaaagacagatcaacgtggctgcccatcaacagtggactggata

SEQ ID NO: 15535 - DNA, 1052 bp, Homo sapiens
gcatgcattatttctgttttctctctgcagtgatcagtttggatgacagaaactttaaacttttattctggcattgtccagttctgattttctcagctggaactggtgcatgcacatttaataatttcaaagaagtgagaggtaaatgttttctcctgcattatactgtgtttctctagctgaattgatccgtttgttatcttgctcacccgaaacaagtagttgtgccctacagtgagcaacctcagactaggctgttctaagcattctggagaaaataatcctcatcatacagtttgtggtaactcttccaaaaagtttatgaaaattgaaagatctccctatgcatcagctgtggctgccacattccgttctactaggaaggctagtggccacaactccctctagaacatcagaggataaagtacacttatatattagaaaagacaggcatattctgattatggttcattcacaatttctcagtccagggttcagtcagtgaccatagctctgaggtcttcaggctaactccaagaacccgtgccagatagaaacctactcctactacctttccactcaccttcccattcccccacctttgctaccaaagtgactttaaaagtcgagttttaggtgtttgtttttttaacagtctaggaatttcagtgcaattccgtgaggtggtgctgaccttagatgagaaatacgtggccaggctataaggactacatgtagaattgagatgggacagtgtacgtatggactgtgaggggaaagaaaaggtaaatgtgtgaaaggaaagagattggtgcatggtcatgacagtctgacagcttagacatttcagaggcattgtttatgagaaaggggatagggacacataggtctgatgacaaccaaagccctttgatgatgccatctgtcactcaaggctccccacagcctgcccaacctgactctcctgcctgcttctccactgcctaccttcaacaatcaaactatatttttgttacagcaaactacattccatttgcctttaaatgcttgca

SEQ ID NO: 15536 - DNA, 1028 bp, Homo sapiens
atgttagttcatactttcttttcaacagtaatcttgtttataatccagtgtttctgtgttttaggacataatttaaaaatatactggattttggccaggtgtggcagctcatgcctgtaatcccagcactttgggaggccaagcagggaagattacttgagcccaagagttgaaaaccaacctggacaacatggtgaaacccagactctacaaaaaatgcaaagattagctgggtgtgttggcagacgcctgtggtcccagctactcaggaggctgaggtcggtaggactgcatgattccgggaggtcaaggcttcagtgagccaagattgcaccactgcactccaccttgggtgacagagctggacactgtatccaaaaaaaaaaagtatgtatttacacacacacacacacacacacacacacactggatgttctaataactgctcttttgtatgtgaagcaagccttaggaatcttacgttttacttctttctgttaaacggcatctgttatcttttgaagtactcacactgaacatgcttcatgctgaatactcacgctaaaggcctcagacatgtaaacattcatccttagtctcttttttctctgttttctcattgggagctgaagcatcctagtctgcagaaaatttaacacaccatattccagctttgcatcacctagacagtagacaaaaggaaaagaaattgtcagtaccgtatcacagctagtgcctctgttcattccagtgatagtacatgagccccttccagtggagtcagatcaagccaaaagattttcctgtaaagtctgtagtagaagacaaatttctttttgatccattagattggtatttctatcttctcagctaattaatgagtaaggcatgtggacaatcgagaaaactaatttgagtgtatgtattaaaattgctcttctaaaaacacgtaaaatattaaagatcaaggcagagcaaaaaagaacgtagcaatcatatactagaaaaagaaactaagttttgctaaa

SEQ ID NO: 15537 - DNA, 1026 bp, Homo sapiens
tgtatgagacattactgttttaatgtttgctttgaacataatttaagaaccagatttattttctatagtgataaacccttttttctcagaactccatctttgtactcttcagatgaatatatagacactgtggcatacattttttttcattaaaaacttatggcttcatacaacactagttcaattttttaaataaactttttattatgttacatgtacttcagagaaagctaaagtttctctaaacttgacacggagtactccataatgggtacatttcattagctttattagaaaactagtaaatgcttttgaataggtagtatgacagctattttaaatgtataaacatttgtgtgccaaacaacatatatgaagggatgtgatgccactaactagtgcacattgtttctcaatgtgccattgagacacaaggcacagtaagtcaggattctgaggcattggaagggttttcttcagctgtaattgtttccacagtgcttttcatctgaggggctcaaagtttaagagtgcattcaataacccatgtactagcttcttgaggtaagtaaataaatcttgttctcatgttacatgttaatacaccaaggcaccaaaacatttaaagtgccatgaattagattacatcagaaatcagaaaagcttggattgagctagtcaccgtggttcacgcctgtaatcccaacacttcgggaggccaagatgggaggatctcttgagcccaggatttcaagaccagcttgggcaacatagtgagaccctcttctctgcaaaaactgacaaaaattagccacttgtagtggtgtacacctgtagtcccagctactcaagaggctgaggtgggaggatcacccgagcccagaagttcaaagctgcagtgagctctgatcacaccaatgcactccagcctgggtgacagagccagaccctgtctctaaaaaacaaaaaagaaaagcttgggttgaagccaggccatattcttttatatgctgttcaatgacttga

SEQ ID NO: 15538 - DNA, 1148 bp, Homo sapiens
gtcctaggctaatccatgtagatttgagcctactttggccaagagctgatctcacagcacatacagaatgatgctactatgtagaccctcactcccttgggaaatctgtcatctacctaaaagagagaaaaaagatggaacataggcccacctagtttcatccatccacctacataaccaacatagatgtgaggtccactgcactgatagccagactgcctggggtaaaccttttcagggaggacgagaaactgaaacaggttcatcaagtacaagctagcttcctaatacccactttgatggagacaatctgtagataaatatggaaggatagatggagtcaatctggttagtgacactgagtaaagtccctttaagtgataaaatgataagggcacataatataggacaagaatgaaatttaacatttgagtgcctactcaatgaaaggcagtgttgtaagacagtaatagcatattaagaataatttcaggaacataaaatcaaagtggagccaaataacacatgttataaacaggaaatatcttcctttctttgacttaaaaaacagaattgtaactaaagagtgttggactaggaaaacattatgaagtggcatttgaaagtgaagtcttaaaaattataactttgtggtcttcaccaatattaacacattttccaactgtttttcatcttctttttcctttgtaattcatcttgactcatcttcattgtgcttgagcattccagtttcttgttctatttttgtcttcccgtctactgtgtcagaatgtactacaaatctaatacaaatgtcccatggaatacaaaagattaagacatttactaactcaccagtccacatggatttcagctatttctgacttgttattgattagcttattgtaatttaaattttaaaaatgcagtccaggccgggtgcggtggtgcacacttgtaatcccagcactttgggaggctgaggtgggtggatcacaaggtcaggagtttcaagaccagcctggccaacatagtgaaacaccatctgtactaaaaatacaaaaaaattagccaggtgtggtggtggacacctgtaatcccagctactcgggaggctgaggccagagaatcgcttgaacctgggaggc

SEQ ID NO: 15539 - DNA, 1917 bp, Homo sapiens
tgcagatgtcaagaaaactctaactgctgaagaaaattaatttcaaagaattttgtaaggtagcaggtaaaaagtcatggttctctgtaatgtcattaatgtgcaacagtagtgctagtaaacatcagagtgagggagggagcaagaagagcagggtagggtttaaccccctagaaaaagggtaatgaaaacgtatgtatagaatctacaggctctgagggaataaaacttttttaggttttttttttctgtttaacatagtaatttcaaaataatagagaaacccccagttttttcttccagaacagcagttagtagaggtgcatagctgtattgcatctttttattttgagagcttaacaaaatacatactatgtcattcttacacataaattctttgatagtccgaatggtaaaatagtcaacaagactcaatatgaggtaattatgagtcttacacatattcacatattacacatacttatatattatacatattacacatattcacctctagatatagatataactattaaaattggactattataataagattctgccttttaaatcctattcccaagatttgctttactaattatttggcttgcttcaataatgtaatctgtgtaatcgtcataatttctcgtcgttaagtgctgtcttggctatatcgtgcaaatcataaaacttttcttcattaaatcttctttctgaaatttggtcattgtgattaggtgattctggcttccctcctttcttccttctacttacattaattgcctcagttcttctggataacctttattctgaagctaccgactttgattcacttgctatttgagggtaaaatggggcacaggcttagaattcatgatctgtctgtttctttatgtgaagaactagtgttgtcaattgaaacctattttattttcatccagttgaagcatcttacctagctattcttcttttgaaaagtctagacttcttttctaacatataatgcaaagatctgtttcttttagcattgttttgcatctaggttaggaactaaattagctatgaatttggggactatctgggtgttaacagattatgagattatatttcaagttagttatgcttacattttccatgaaagagctccttacaaaaattaagatgtgtactactttatgtatgctagatttagtcagtttatttgggagtattgttctaacttttggccactacatcattgaaggccatttttaatcatcagccaaccctttacagcatcttgtgtttttttttcacagatttcagacttcaagaatcgttctttaatctcccacaacttctttttccggaaaatgtaatgcagaataaagataatgccctcggtatggtatatgtcaggaatagcattcagaatactataaaaatgatctacttagagttcttctgcttattgaaaaattggatcagttcttctatgagatcccagcttcagtgttaccattacagactattttatgtgtattttcatcccatattttctagtcttaaatggtagtggttctgaaacctgaaaattgactagccacttaatgtgctaaagtatatttgtgtatacttctacaaagaaggaacctgaagaaaagcataaggtcattttcttccttctttattgtcctaaaggctccaaagaggtttgctatttcttttcatttaatacatttagatataaaagggtttctaatagtacaaagaatgtcatcattcttggttatttcaggtatcagtaaatttaccacttagggttgtaggtatgtcatagctgattgctttcaacacagatatttaatgtagtttaggggagtacattcacttttaaaaacagtattcttggatgtaagagatatttttaatctctta

SEQ ID NO: 15540 - DNA, 1095 bp, Homo sapiens
aaaaagatggaggggtgctcaccttctaactagctttccttttcttctctctttggtgactaagaggattcccaccttctagcttttagttattatttaatttttataaatttatctaactttatttctctgaggtccaagaaagattgccagaaattttctcattatagttggcaggttagagatgtgtaagactgcttccctggggttggaatttttcaggttgccagcttttctaaagggaaaagttagtttttctgttgtaggaattagtatgtcatcagcagcagtaaccctcttttgtgatactcttgtgctttcagagttatataatgcagaaagtttctttaagatatagtaaggaaatttattggaaatatttttagtattttaaatctttttcattgctatgtaagactttaacatattaatttttattaaatgttagcactaataaattagcatttgcagttgtgttttgaggttatgcatcttttgctaatactgtgtaagaatttctaactaaaactgtattttaaaaaaagaaaattaaatagtgctttctggcacttgaattttctttaacagtgatctttgtttggatcgatagtaaactctttttttcctctactgtacttatcatagtacccctaattctgtgctttgggttgaaaaagttaagctctgtatgctacaggatgtgtaataaataaagcaaatgactttcaagtgaaaataagaattacatttgaaaagaaagaaccatgtctgtttaattttgtgaaaatgttttaaatatgtttctctggaggatgaaaaaaatttttttctttgtttctctgtgtataggggtgtttgtctttttattaatccttaaattatactattcttttagaaaagaaagccttcatttgtgtatcttggctagctttccgaaagcgtttacataattttaaaacatggtcaaatggtccatacatttcccatttcgttctcgtttaatatttaataatatggaattggttcacgttagttttactaccagatctacaaaatctagtttttgtttcaagcagtaaagtctcaagtttgtgt

SEQ ID NO: 15541 - DNA, 1048 bp, Homo sapiens
aataaagataacccacaaagagataatgactttgtgatttagatactttaatctaaatttagttctctgtgagagttaaaatgaaaattgattttcttcttaccctacctcctgggctagaaaatgtttagcagtttaacaaatgaaagcctactgtttcacttgggatgaaacataaaaatagaaatcaagatgtcaacaagtaatttggtaaacattaatacttaaatctactgctggattagtgtttcactcattttacatcttattgatccaaacatgcatagtaatcagtaaaaaataggttgaactgaatgggtaagtgcagcacatcactctgcccaaaaaatgagtaaactcaattcagtcgtgagaaaactcgtactgagggtgattctacaaaataactgactgaccagcagtcttcaaaagtgtcaaggtcatgaaagacaagtaaatattgaggaatttgtcacagaatagactaaggagacatgacaacaaaatgcaatgtggtaccctagattggatcgtagaacagaaaaagatactagtggaaaaactagagaaacctgaataaagtctgtatattagttgatagtattgtaccactgttaatgtcttagttttgataattatactatagttatgcaagatgctaacattaggagaagctggatgaaggatatgtcatagctccctgtactatttttgctattttctgttaagtctaaaattattccaaaatacaaagtttaagtctagtagaggaattaaaatggaatactaaaaaatattcaattaacccaaaataaaccaagaaaaaggaacagagatacaaaaaacagatgggacaaagagaaaaataaatggaaaaatggcagacctattcacccatatcaataacaacaaatataaatatatttgtatatataagataattaatactccagttaaaaggcaaagtgacagattgtttaagaacgcaagacctgactataaaaatcacagataaattgaaagtaaaagattggaattcttactgttc

SEQ ID NO: 15542 - DNA, 1026 bp, Homo sapiens
ctgcaggcagtgggatcaactattctggtgagtataactgtacaggtagattagaatttgtagatttgtctgaagtttttcttctaaaaccgtttcttcatccatgctagtctttatttgggaggtttcttggcaagctctactgaatctaatgaattaaaatattaattgattttttcccttcccctcctaaaacatctctaaagcagaaaaactcaatattgatcaggtgatttacagaatgaagcttgaaaaaaacgaattatgtggttggaagtaattgtttacataacataattaatgtcagcactaagctttaagttggcaggggatttttttcttcttcttgttagtaacactccatattttttctctctgccactctttgctctctcttacctctctgaacatatgtatacatttgtcacaagcaaggaaactgtgtagtttagcttatatcaaattaaaatatcatttgcatctagttgattaaaagtctatataactgaggaaacttgtgacttctgaataaattagcaattaaagctaacaaatttatataataatagttgtcttttatgtgccagataccatactctggaaattctaaatatattttcctaatcggtagaatcaaatatgtccttatttcactgtaaaatttaaactaaaggttcttacatatcaataaataaggagcagcccagtgtaagagctctaggtatgtttctacagattgccatgtaatactttgttctccttatagtaaaaatagcaagttttatatatctgtgatcttatggtagtgactgaaatatttcataacttctcatcactattggtcagaataatttcaaaagtctacttcatagtatttgaaggatagaccttttatcataaaataatcttattgccattggagaagtctgagttccagatttttttttccttctgttaattcccctaagtattctgcctcaaaaatgtcagttcaccatcacaaacccagtttagccacctgaattt

SEQ ID NO: 15543 - DNA, 1042 bp, Homo sapiens
cagatgatccgcccacctcagcgtccttaagtgctgggattacaggtttgagccaccacgcctagctatgatagttactcttatcttttgagttctcaagatgtatgaagacataacacctgtatctaagaattccagagaaaggaggaagactaaatagaatacagttaagaaaaatactgacagacatgtacagaattatttcagtgaaatcatagaaggtgaagaaaggctttcctgaagaagtaaatgtaaaagctagctaaatgtagaaaataggcacaagcatcccagacagaaggaacagcatatgcaagatacagaagtaagaaccagcacaacacattctgggttttaaggaggagagagtaaatgaagggaatctgaatgtatgtgcatgtacttacatatacacttgcttgtgagtaggcattgggtaatggtggtgagagtgttgtagagttgaaactagggatactgagtttacgtaggaggcttctgaaataaaacaagaaatgattagtgtgaactcaaataatgactgtaggcctgataaacaagggatgaatttgagagtgatttaggagatggaataaacagcatttagtgtccagttgtaagaagtacttgaggaggcagcatcttggatgactcccaggtttctgccttgggtagccacctaaatactgtcagctttccattcactgtgatagggaatgcaggtggaaaaatgggtgtgtgttttgttttgttcaatttttttccaggaagctaagggtttcatgactatttgtggttgaacaccagtaaagaacctctactgcttgggaggtgagaactaaatgagagctgaaaatgcattttgtatttgagagtataggttgtattatgtagtagaaagagcttgaatgaactttgaactcaaactttggttggaatcttggttctcacattactagtagctatgtgcctttaagcaaattatttagtttcactaagacttagcttattcatttgtaaagttgggagaatgatagccttt

SEQ ID NO: 15544 - DNA, 1032 bp, Homo sapiens
ataataataataataataataataataataataataataataacagcaattatctggtacatttgtgtctctgtacaaatgtgccagaatttctctagattatatacttaggaatagactgtttcaaattctctgtctgtctctctcattaccggtgaatctgagcatattttacattatagttttgttaactatttgggtttctccttctgtaaaaatgttgttatattttaatcaggagacagaaaccactcttaatttcaacagagagagtataacataaagaattactggccaggcacggtggctcacgcctgtaatcccagtactttgggaggctgaggtgggcagatcacaaggtcaggagttcgagaccagcctgacaagcatagtgaaactccatctctgctaaaaataaaaattaaaaaaaaaattagccaggcatggtggcaggtgcctgtaatctcagctactcaggaggctaaggcaggagaactgcttgaacctgggccaagatcgcaccactgcactccagcctgggcaatagtgtgagactgtgtcaaaaaaaaaaaaaaactattagcagaggaacaaagtaacagagcaaagagaagtgtgtaaagaatacagaaataatagatacaggtagcagccactatctgtggaactgagatagagcacccaaggaagagacattccctctcaaggttgagattcagacctagttgcagagtgtggcagtggtcacaaagtgctgccccatggggactgttagaaatctgccctcgggatagtcttccccagggaggtgcctagctgtggaactcattgtaagctgcctgagtaggtgctaaaaaagtagtccaaggggagttacatagcaggtgacatttcactatgaaactgccaggaggtctggggtggttggtgccagggaagcagctcatgagaaggtgccacggctgttagcacctggacgctgccaaaaattaaaatctgcatcctgcaggaacccaataaggtaagcacact

SEQ ID NO: 15545 - DNA, 1160 bp, Homo sapiens
ctaaaagttgctattgcttagatcctttctgtaatgggaaagatccttgattgatcattcctttctatacaatggggatacacatggtacctgccttctaggactccttgaaggattaagcaaggtaatgtatataagagacctaacagggcctggcgtgaagtgagccctccagagatactcattctattattagacacaactccagagtgtgtgatgtttggatggcttctctaagctctgatccgccattaagctttcagctgtgccgttctacttgctaaaattggaagggaataggggacaactacagcatatgcactgagccaagtcatatgttaggcaaaagtccataaatgcaaattaaaatcactgtgaacttgtcattagtcttgtcattttctgtgatactagtttgctatataaagcatactctctcatgctctgagtttttttttaataattagtaatgttcaaattaacatcttttttcttcttttcagcatgatctatgttttggtgagctcttagaacaacacacagaagaattggtccagttaagtgcatgcaaaaagccaccaaatgaagggattctatccagcaagatcctgtccaagagtagcctgtggaatctgatcagttactttaaaaaatgactccttattttttaaatgtttccacatttttgcttgtggaaagactgttttcatatgttatactcagataaagattttaaatggtattacgtataaattaatataaaatgattacctctggtgttgacaggtttgaacttgcacttcttaaggaacagccataatcctctgaatgatgcattaattactgactgtcctagtacattggaagcttttgtttataggaacttgtagggctcattttggtttcattgaaacagtatctaattataaattagctgtagatatcaggtgcttctgatgaagtgaaaatgtatatctgactagtgggaaacttcatgggtttcctcatctgtcatgtcgatgattatatatggatacatttacaaaaataaaaagcgggaattttcccttcgcttgaatattatccctgtatattgcatgaatgagagatttcccatatttccatcagagtaataaatatacttgctttaattcttaagc

SEQ ID NO: 15546 - DNA, 1029 bp, Homo sapiens
acaaaacaaaaaaccaaaaaaaaccagtactcagaatgagaaagagaaggagaaagcaaatatagtaaaaatggacatttggaatatctgggtgaaaggttcttgtatcttttctgtaagtctaaaattatgccaagataagtaaaaacaaaacacctattttctttttacagttcttcctatttttcatggatttctgaaaaggcagagactagaagaaacttgtttagctatctcattctgctcatttaggggctctacttttaaaattaagatggtaaaaggaaagcattttacccataagtaaaagaatgcttccctttatggaccacctctcgtaacagatgttttagaagaaagacctgctttcttatctgaacatttactgccctttctgaatgcctaatagactgtgtttattccaggtatatgagtagaccagtgatgagtggcccaggactctatgaccctacaaccatcatgaatgcagatattctagcatattgtcagaaggaaggatggtgcaaattagctttttatcttctagcatttttttactacctatatgggtaagttgaaaaggtaaaatgaaatatgctttcactttgctgctttaaaagtttgcaggcattatggttttcacacctcaaaatccatttgaagaataacttagtgtcttaagtgtgcatggtgcacaccagcaaattcgcacacattcagtgtggcccacactggtgcttgtcaaggcagtaaaccagcctgccatcagaggcagaaggtttggtcagggatgctgcttcataagttttcagacacattcagtcagtaaaggatggtcctcattctccatggcaaagtgatgtcattgaaggatagggatgtgtgagtttgcagaaatttctgcttgtcttcagggtctctccagacattatgtttcattttttccttatcattcttcataagtggtgtgctctgccctttattttctgatttgcttgatttgagtggtatgaatgaaagaagtagttc

SEQ ID NO: 15547 - DNA, 1029 bp, Homo sapiens
gatggtccaagataatctcattcaggaggcttgaaacattaatggtttagtcttgtgaattttaacagttctctgtcatcgtttaacaaaaccaacaactgacacaactccttaagctgtggtttcagtctctgctagttcatattgcatgtttattttggacagtcttttgttaagcatggtgcttgtactggtttaaataaaatgttaacattaaaagacttccagcttttctttttttactcacctctttccccctttggagttactggtatgtacctggctagatttgtgtgagccataaactttatctggacaaactgagaggcaaaataaacaagtcatttggcagcttggtggaaggagaagataatcaagttataaaaatttctaaaacttggtctgatgctaaaatgtagaaaatgtcagtaaacagtagtagggacagacagagctatttcaaacaatgaacgcttgctttcaaagggagaattcgaagttaggagagctgtatacttcgtaagaaatcaaattgaaggtttttttaattgaatatagcttatcactatgtattaaacacccattgacaacccgtcctacctttattaccaactgtactatatggtatatgttcaataggtatctactgaatgaatacaaatcactaataacatagtttttagagtttgccatgtacttgtgattgtgtatgttgtaatagtcacaatttgttatgatggtgaaaggagtagtttatgccttcctgtctttaagaatttcacaaggaaaattggcccaagcatgggaacatttatatcttccttatttatcaaatttggccacttaacctactcaaacagccagctcttaaattttttcaccttcactaaataatacctattgtctttttgtccttttcacttttcagcagcaagaagcatttgtaagcacttagcctctgaacctgggcgcactcttgtaaccacccaatgggttctccttgcctgctgcccagacagagccaattta

SEQ ID NO: 15548 - DNA, 1818 bp, Homo sapiens
atttattgatttgcccatgttgaaccattcttacatccctgggataatcccacttgatcacggtgaatgatctttttaatgtgttgttgcatctggttttctagtattttgttaaggatttttgcatctatgttcatcaagcatattgacctatagtttttttttgttgttgtatacttgtctggttgtggtatcagggtaatgctgttcttgtagaatgagcttggaggtatgttctccccttcaatttttttgaatagtttgagtagaagtggtgttttaaatctttggtagaattcagcagtgaagccctcagatcctgagtttttctttgatgggagactttattactgtttcagtctcattactcattattggtttgttcaggttttctatttcttcatggttgagtcttggtagattgtgtgtgtccaagaatttatccattgcttccaggttttccattttgttatagtgttcataatagtctctaatgattctttgtatttctgtggtatcaatcgcaatgtttctttttgtctctgcttttatttcttttgcacattcttagtagctcctttttatatctctataatcatttaattataatataaaatattattggtctttactcttatggggtttttaacacttttgttgcttatattttttttcccctgtaattgtgaggacaaaaaataatttattaattctaagtataatcagattattttcttgttcttccttcactgtgtaaaaatagtatgcttgactccctttctaacagcagacagtgattcttgactttccccatattcttcccttcctctccagttctgatgacattgcacattattatgtgtgtggtttttgagacattcattagccaaagagaaagttaaaatataccttacatatatgagatgaacaaatttgtaggattaagcaatgtagatccaaaggttggttgattttaaagttcttttaagtgttcatgtatttaatgctttcacttaattgacatttgtgaatgtcagtatgcattataaaggtattaggtttcataactttaacatgtacatatattgaagtcatggcattttatgtgtgttttttttcttttatagagtgagtctttggttgtttgtgatgttgccgaagatttagtggaaaagctgagaaagtttcgttttcgcaaagaaacgaacaacgctgctattataagtaagctaaaagtgattgcctcaaagttacatggtcttaatttgtttttaatcttgtagctacattgaatgaactgaaccgttggaaagcaatgttacttcctctgtttcatttccccaccaccacctttagatcactttaaaaaataagtaacagctaattctaatgtcacagaacagaggtggattgtcccacctcccccatagtccttttatcagctgcctgtacagctctggagaaggcggtcgtcttggtccttgggtaatgaggattcccatctgcagtgacccatccaacccatccttcttgggggactaaaaatagcctggccattcatcctcaaatagaaacctttgcctacacctaaaatgacaaagttcagcattgtgtacatagtgactttgggcattattccagttgtagatttgaactctggtttcaggaagagtacttttaagtggcactggcactatcttctgaaaatggaaaaagtgatttgcatattgctcctcccactgtgagctatatctgacattatgcagatttcccttgtattcataggcagtatttaatatgtaggtagtgatttagaaa

SEQ ID NO: 15549 - DNA, 1055 bp, Homo sapiens
aggcaggaggatagttgttgctcaggagaacagcctgggcaacgtggggagaccctgtttcagaaaagaaaagtccatggagcggaccatttaagattattattattatgtttattttcatgtttttgagacagggtttggctctgctgcctaggctggagtgcagtggcgcaatctcggctcactgcagtctcactctgctggactcaagtgatcccacctcagcctcctgaatagctggaactacaggcttgtgccaccatgccctgctaatttttgtatttttgatagagacgggtttttgccatgttgcccgggctggtcttgaactcctgagctcaagggatctgcctgccttggcttcccagagtgctaggattacaggtgtgagccaccatacccagcccatttaagattattataagccattaattgaatataatcatgcattacattatgatgtttccttcaatgatggaccacatgtatgaaggtggtttataagattacaatggagctgaaaaattcacattgtctggtgatgtcttggtgatcctgacctgtgtaggcctagagtaatgtgtttgtttgtgtcttagttttttcctctcgtctcccccatgtcttagtttttaacaaaatttaaaaattaagaaaattgggccaggcatggtggctcacacctgtaatcccagcactttgggaggccaaggtgggcggattacttgaggttaggagttagaaagagaccagcctggccaacatgttgaaaccccatctctactaaacatgtaaaaattagccagatgtggtggcgcatacctgtagtcacagctacttggaaggctgaggcaggagaatcacttgaacccagaaggtggaggttgcagtgagccgagattgcaccaatgcactgcagcctggttgacagagtgagactccgtctcaacagtaaataaataaataaaaataaaaattaaaattaaaaatagaaaaaggtatagaacaaggatataaaatatttttgcacagctgtacaatgtgtttttgtttta

SEQ ID NO: 15550 - DNA, 1037 bp, Homo sapiens
tgaggtgattggcacagtcaatccagtataagctttggagtttgataggcttagggtttatatttggctctaccactggggatatgaggccttgggggaccacttaacctctcagacttattatttatgatccttgtaataaaagggacaataatttcctgctcagacctccttcttagacaatctgcacagtacacatctccagaaggatagcccacatatctcttgccatcacttcgtctggccacagctgtgctagtagaagtgcaattgaccccaatattgggggatctaatatctctcccatttgtctggaatttggacacagaagccaaattagttcatctgcagaactaaactgcatggtcatgtagagatgatgccacagccacagcagaggaaagctaaagtggggaaggagagagagcatcactgagcagagaaaaccaatctagtgaaagttggaaaagcgggaaaaaaaattaaaaacaaactgaaaaattatcacctcaatattgtcgcatctgcttttgtggctctgctaacaaaaaacctagagaaagaaggatgaagagttggcattctaattcttggagcagattaatggcaaatgaaacattttgcccaagattggaaaaggcccctcaaaaagagtgttcctctctgaagactggattggaattgatatagatggtgtttccaaagagggaggagtattaatgtggtttggtgagatagagactctatatgacatcatttcccccacatatgaaatgttatagcagctgattaaaaatagtagctgggtgtatctaaaatatatgaagaactcttaaactcaacattaaaaaccaaaaccgaaacataatccaattagaaactaaggaaaagacatgcacagacattcagtaaaaggttatacagctggcagataaacacatgaaaagttgttcaatgatcactagccattacagaaatgcaaattaaatctacagtgagatattactacaggcctttcagaaaagccaaaatgaaaa

SEQ ID NO: 15551 - DNA, 1024 bp, Homo sapiens
tagtctgatgggcttccctttgtgggtaacctaacctttctctctgaacattttttctttcatttcaactttggtgaatctgacaattatgtgtcttggagttgctcttctcgaggagtatctttgtggcattctctgtatttcctgaatttgaatgttggcctgccttgctaggttggggaagttctcctggatagtatcctgcagagtgttttccaacttggttccattctccctgtcactttcaggtacaccaaacaaacgtagatttggtcttttcacatagtcccatatttcttggaggctttgtttgtttctttttactcttttttctctaaacttttcttctcgcttcatttcattcatttgatctttgatcactgataccctttcttccagttgattgaattggctactgaggcttgtgcattcgtcacgtagttctcgtgccatggttttcagctccatcaggtcatttgaggagttctctacactggttattctagttagccattcgtctaatcttttttcaaggtttttagctcctttgcgatgcgttcgaacttcctcctttagctcggagaggtttgatcgtctgaagccttcttctctcaactcgtcaaagtcattctccgtccagctttgttccgttgctggtgaggagctgcgttcctttggggggggagaggtgctctgatttttagaattttcagcttttttgctctgttttttccccaatctttatggtttcatctatctttggtctttgatgatggtgacgtacacatggggttttggtatggatgtcctttttgtttgttagttttccttctaacagtcaggaccctcagctgcaggtctgttggagtttgctggaggcccactccagactctgcctgggtatcagcagcggaggctgcagaacagcaaatattggtgaacagcaaatgttgctgcctggtcattcctctggaagcctcgtctcagaggggtacccggccgtgtgaggtgtcagtctgcccct

SEQ ID NO: 15552 - DNA, 1050 bp, Homo sapiens
gagactttaggggccaataaatagggaaaagtcaaagatgtaggatgtcaagaaacttgataggtcaggttttctgacaaagcaggagggcatgggatgcagaacacaagtaaagggattactaaccttagctcagacgagctgccactcttccgcagtaacagaagataaaagatctgtacatactgaatatgtttcatagtggcacgttggggtggttcacatttaatagcttttattttggcttagaagtaggaaagaggatatctgttgttaatagttttgaaaagttgcaaaatacatttgttttcatttaatggggattaaaatactctgtctagtattatagatgtcagaagtcatctattttctaccattattaagcaagggtttcttttttgtgaaaggtgcagttacctttagcagccaaggacgagtaaatccctttaaggtaaactcttccaagtgatgttttatattatttaaatacatttgtatacaaagaaatatttccaaatgatgagatgactctccccagacttggaggcatgaaagactgatctgtgtggaaacagaagaaagcagcacttgggctgagagttgtcttttctacttaccttctaagtacctatggttttgaaagatacctctgtctttcttggggatgtggtatttgggaatatacgtatcattcttaatttggattgtaccaaatgtatttagttctaaagatgagatggcaatacaaacttaacagaaatttcaagaaaaaataagtctcttgggattttatttttcttctttaaacatacagtgctaacactagtttgctctttaggtatcagccagttccaaagaaccagccatgtcaatgaattcagcacgttcaactaatattttagacaatatgggcaaatcatccaagaaatccactgcacttagtcgaactacaaataatgaaaagtctcccattataaagcctctgattccaaagccgaagcctaagcaggtactgtttcagctaccctcatctgcagtaagcagcatggg

SEQ ID NO: 15553 - DNA, 1102 bp, Homo sapiens
tgtagtcccagctactcgggaggctgaggcaggagaatggcttgaacctggaaggcggagcttgcagtgggccgagatcgcgccactgccctccagcctgggtacacagcaagactccatctcgaaaaaaaaaataataataataaataaataaataaatgaaattattattatcttccagcaggtggcatagttttcactgaaactcagttttttcactttatttgtgtaaattttagtcatatcaaatccaatgttttttctttttttagttaggtcttactttatatggttaatgaaattttacgtaataatcttagattatttgcttctgttttgtgttttgcttttgaaagcaaagttgaatccttggtatgtataatatatttgaaatagggttcctttaacaacatgtagctatgtctccaagtgatttttctgttggtgtttaggtaccccttgttacgtggattcagaaggaattgttcgaatgcttaacagaggacttggtaatacgtggactcctatatgtaatacaagagagcactgcaaaggaaaatctgatcactactgggtggttggtatccatgaaaatccccagcaactaaggtgggctattaaaagaagtctaaagttgactctttttaaaaagtatgttgaaattctttttatgaggccctttaagtgtatttgtcttttatcttagtccaattacttgctttccatagtcactaaattaggaatttgttcatattcactctgaagttttcagtcacttgctttacttgaaacatgttgaacaaaatagaaataattaggatgaccttaccatcatttcagccacacagggagaggaattctgattaaacatggcatttcaccttttattactgtcttttattttaataaaataacaataaatataaaagttaaagtgaaaataaaacaatatatattcaattgagaattgaaatatacaattaagctgctttttgagatgttttgcttaattatcgtaataggaggaaggactaatagaagacagagtctcgctctgttgcccaggctggattgtagtggcgtgatctcagctcactgcaag

SEQ ID NO: 15554 - DNA, 1032 bp, Homo sapiens
ctaagaggatgtcttgaattgtctctctttctaggataataacattttttaggttttgctttgaaaattgtgccagtggctgggcacagtggctcatgcctgtaatcccagcactttgagaggctgaggcaggaggattgcttgaggccaggaatccgaaaccaacttgggcaacaaaagaagactccatctctacaaaaaatactaaaaaattagccatgtgtggtggtgcatgcctgtagccctagctacctgggaggctgaggcaggaggattgcttgagcttcagagttgaaagttgcagtgagtaatgatggtgccactgcactgcagcctaggtggcagagcaagaccctgactctaaaaataaaataaaatggtgccagtataatttttttcatgataaagtaatagctggtagtgatacttgaatgttattgaaaagtgaggttagaaaataagcaaactttgtcttgtatcgaatataattagaaataatatagaacagggatataaaaatttgaatttggttgattcccctccaaattcttgaaaaaaaatgaaaagaaaattgaatttggtaataaaatgagtatttagtttgaaattttacaaaatcattatttattaactgtttttctttacagaccctcaatatagtaacctggtctccctgtgggcaatatttagctgcaggtagtattaatggtctaatcatagtttggaatgtggaaaccaaagactgcatggaaaggtatgatttagtgtatcttttgtctcttctttgctcatctctattagttttgtatttgttttattttgaaacatttcaaatttgccatcagattgtcagaatgaaagtataattaaatttatattatttataaattattgtcaaaagtcatttattctttcctaactaaaatttacctaaagaaatgtacaatttatatttttcttgacagtatttttagaacctactttttaatttttagggtgaaacatgagaaaggttatgcaatttgtggtctg

SEQ ID NO: 15555 - DNA, 1029 bp, Homo sapiens
gttaatacaaaaaatattttgctttcaggtatagtaattacatttttacttttctggattattacttgtcagatttgtttggagctctttttcaccatatcatttggggatgtgaactcagggtcagaaaagacgggaaagcatgggtaaagatatctgaagagaatattggaatgaagaatacagacagaagaggggaaataaatgtaaatttaaagaaaaaatattgagagctactttagaggaaatgtgaagtgattgaggcagaaataaaattttaaaattaaacattgaaaaggatttttaaaatgtctttttaggggctgtcattttaggaattgttgctttgaaatttatatgtaagattttctttaatttatagaacatgttttaaataaaaatgaagctactactaaaaatttaaatggccttccaataaaagaagtcccatcacttgaaagaaatgaaggtcgaattgctcagccccaccatggtgtgccatatttcaggtatgtctgtgtgtttctagtgtaagaattttgtattaatatctagacatttaaaaccaaaactaaaaatttttaaccttaatatagtgggggaaaactggtgttaggtgattttcacgtttaaattttaattatttttttgataactagtacattcatgtggttcctaattcaaagggtaggaaaaggtacaagtgagaagacttcttctcagcactgtgacccaaccacatagtttgaacctttcatgaaggcaagtgttactcatttcttgtgaatacttccatggatagttcatgcatatgtagacaaatataacatgtacatttttttcttttttaaaaaatatggacaataggctgggcgcggtggctcacgcctgtaatcccagcactttgggaggccgaggtgggtggatcacaaggtcaagaaatcgagaccatcctgtctaacatggtgaaaccccatctctactaaaactgtaaaaattatccgggcgtggtggtgcacgcctgtagtc

SEQ ID NO: 15556 - DNA, 1073 bp, Homo sapiens
ttcagccccacctcacaacctctggggaggggagaggagctgaaggttgacttgatcaccagtggtcaatgatttaatcactcatgcttatgtaatgaagctgccataaaaaccaaaaaaaaacacctgtgtttggagagcttcttaggtgaatacatgaaggttcctaaacagtggtgctacctgagagagcatggaagctccttgttcctttccacatactttgccctgtgcctctctatccaactctatctgtatccggttgcctattgattatccctatatgactaataggtacctggtgtggggtttttgtttgtttttggttttcttttggctttagaagaaatgttagactacctgcattcctcatcatgggtaaggaaacccttgtgtacatggtccttcacttaacctattttcacctttatttcacgcttttctttttgcagtgttctctgtggtaagcccagagcctcttttattctggactatcacttactggctttctcttcactggtcaagcaagttcctatttaaaacccccaaataggtagcttcttattctctgataatcttcttctcacttttcagtgttacatatttatttcattgcacattttatatttttatttcagaaggccctgaagtgggacaggaaatgaactgtaatcttaattttttaaataatgaaaattcatgtaagttgggttttgtccttttccttgacaggatgtcttcatcacattttgccagtcgacacaggaaggatataagtactgaaatgattagaactaaaattgctcataggaaatcactgtctcagaaagaaaatagacataaggaatacgaacgaaatagacactttggtttgaaagatgtaaacattccaaccttggaaggtagaattcttgttgaattagatgagacatctcaagggcttgttccagaaaagaccaatgttaagccaagtaagtaaaggtctgttgtaattttaagtactttgaagagtgaataatagttggtttaatgcctgtgtgagtaaaaaactctggccagaagagttttgaaat

SEQ ID NO: 15557 - DNA, 1028 bp, Homo sapiens
cctgtaatcctagctactcaggatgctgggtcaggagaatcaattgaacccgggaggcggaggttgcagtgagccgagatgcaccactgcattccagcctgggcaacaagagcgaaactccgtctcaaaacgaaaaaactgtcagaaatctaatgcgtgcaaccaaatacctaagttcagtggtgctcagtgaaagagggtgggagggtggtttggacccatggacatttatcaggtacgttttataccctagttaggagacagcaaggcttcagtgggacctcatctgaggaaccaagagctatgcgccatcagaagagtctgaacacattaccatagggttccgaagagcaaaaggtctggggagtgtttatggaggggggccttcctgaatgagtaaaattcaaacatttagaaaacaggagcaaatagatagcctgagtgttagggagtgataactgattcagcattcatccatccatacgttcaagtggttccatcttgcagaaaggatttgaaatatgttgcaattgagtacagctagagcgaagggtgtgcagaggggaactgtggggatatgtaccaatttggaggaggccttgaggctgaggggtttgctctgtatttgatgggcagtggagaaccactgagcattgactataatttgtaaagattgagcaagtgaaagagggcatgaaggcgtggagtcgagccgtgttggagataggcagagtgttggtgagcgttaactaggattgtgatagtaggaatgaaaagaaaggcctagatagacagacttggactggaaatggaattgaccatcaagggttgattaggcagtggacacgtcaaaaataatcttgaagtagggaaactggagaagattttcctggaaaaataatgaacttgattttgaacttgggtttaagttgcctaagcaactcctagatatctgtctgagagtttacagcttgtttttgtcattcaagtgaagtttagctacagcccaacagccctagcaggtgtag

SEQ ID NO: 15558 - DNA, 1029 bp, Homo sapiens
acttgagatatatcagaaaacttgaatttgaggattggtgtttttcatcacttctggaaaattctcagccattaacttttcaaatattggctcagctttatttcctctctactttccttttggaactcccattaggcatatgttagatcttttcactttacgtttcttaccatctctttcgtattttccgtattcctgtctttaattgctgccccctgcttaattttttcagctccagcttccaatttctcttttgcagtatgaagttgaatttttaatttcatttttttatttctagaagttttaatttctttaaatgttttaagtaagaatgtaatagaatagagcaggatagaataggatccatatctgataatcccaatatgtgaaatatttacagatttggtgctatagtctgttgtttctgctggctcttgatcatggtgctttgcttcctgtgttttgttttgttttgttgtaattttgtttgttttacaatacatttatattacttggaatctcttcagtggaaattctttcagatttgggttaaaagtaggtttcttgaaagaatatttatatttgcttcttccaggtacttcattcacttagtagccaggatcactttaaaaaattgacttgaggttttcaggacatgtaggtggtattaatttaggctgaaaaggccaggcgcagtggctcatgtctgtaatcccagcactttcggaggccgagttgggcagatcacttgaggtcaggagttcgagaccagcctggccaacatggtgaaaccccatctctaccaaaaacataaaaaattagccaggtgtggcggcacatgcctgtaatcccagctactcgggaggctaaggcaggaaaatggcttgaacctgggaggcagaggttgcagtgagccaagatcatgccactgcactccagcctgggcgacagagcgagactccatctcaaaaaaaaaataaaaataaaaataatttagcctgaaaaatcacatgaagattggcttgtgga

SEQ ID NO: 15559 - DNA, 1065 bp, Homo sapiens
ctcagcctcccaaagtgctaggattacagttgtgagccactgcacccagcctggtctcagtcttttgttgagcctgtgcccctgcactgtgaacttcacaagtgcttttcaggtgtttttcctcttaggtgagacaagatagctagaggaggctggagttgggtctttcacttcccccaggtaggttaggccgtgataaagccccagcaagtagggctctggtaaaatagtttctcctgaggcaggccttgttaggaaaaataaaacgctctggtgtatttcaaaatggtttctttttcccctccccctgccagaagcacaatatttatgatctaatatcgtatgtatagttgcaatgtttttggcatttatcttgcttgattttgagcttcctggatctgtggtttggtgtctgacattaatttgggggaaattctcagtcattattgcttcaaatattgttcctattcctttattatccaataacattatccgatatttattgtgaggagctggtagagttcccagaagtaaaactcacaaaagtgtgcccccatccccaccttgactgggtctccctggaatttttaactctgagagctgcccacactgagcctctattaattcatcaattacagttcagttatcctgtcactggttccgcagaggtttctgctccagtaagttgtgattctgcttctgcctgtctctctccaatctttgaggcagcagtttgccctgtgatctcactctctgacagatctaagaagagttctcgatttttcagtttgttcagctttttacttattgtaaggccagcgtggtaacttctaagcttcttatatgccaggtgggaaacaagaagtcctatctaggttttttaaaaattcacacatcatatgtaatttatctaaaattgacacatattacttatatagtaaagaaaaaggctcatttttgcttttgtttttcctgcttgacatatgcagtttcttcctcagtaaagctcaagtcaaaggcttctaaggctagattctatataaggagcaaacaggatttgggaaa

SEQ ID NO: 15560 - DNA, 1036 bp, Homo sapiens
ccaagagctctttcatattaagacctagagctgactttttctaatatctaaagtttaccaatagtaaaagagtttcatggtgataggaaattaaataactgatttaatttagcataaataatataattaaacataaacatagagtaagttagatgggttaaagaatgttgtattctcaattctctaggacattaaattgtatgattggacagatgaagcatattttggctgcagaacagaagaaaacagattttaagccagaagatgaaaacaatgttttgattcaatatactaatgtgagtaaaatcattcagtttgttaatactttgttaacattttcattggtgtatcctactgtgccctagatttttttcttttatacttaaagattaatgagaaactgtatttcctctttagctaagctggtatacattcctgtgtaatgagtgtagaaaaacttttataggcctgtgtaaaagtctgtgcttacgtaagaaaacaagtggagaagattaaaaattccatggatgggaagaatgtggatacagttttgatggaacttggagtacgttttcatcgacttatctatgagcatcttcaacaatattcctacagttgtatgggtggcatgttggccatttgtgatgtagccgaatataggaagtgtgccaaagacttcaaggtatgtgtacacaaaaacatcaaacttgcaaataggcccaggagcataagtcagattattaaaaatcactatttacttataattagtgaaaggtttataacttttgttgatattgtatgagatagattatcacattctacctgaaacagtgttgttccaattattatttttttttattttaaattttaaatttttatttattttttttccaaagagtttcatgatgttgcccaggctggtctcttactcctgggctcaagtgatctgctgcctcagcttcccaaagtgctgggtttacaggaatgagccaccacatctggcccatatatttaatattaaacccatttttgcttt

SEQ ID NO: 15561 - DNA, 1071 bp, Homo sapiens
ctcctgtacttgtggagtttatattcttatggagaagatagacaaatgattagaaagtgcaatgaagaaaagtaaaactgagtaagggactaaaaaattaaaaaaagtgtgtatatataataattttgatatgcccttatttttatttttatttttgagacagaatctcgctctgtcacccaggccagagtgcagtggcatagtcatggctcatggcaactttgaactcctgggctcaagcaatactcctacctcagcctcctgagtagctataactacaggtgcatgccactgcacctagctaattttttctttttttgtagagttggggtcttactttgttgcctagactgtttttgaactcttggctccaagcgatcctccctcctcagcctcccaagaattttttgttttgatttaagctattttcctaaaggtttcttttcccagtaacttatgccgctgctggactgtttgtgtgtgccagtttttctgtaattattgaatattctttaaaaattttaatttcgtggttaaaaacttacactgtagctgagttctgatgcctataaagaaaaaaagtacatcaatattgccttaatttttatgtctttcattaataacaatgattcatattttctacatatgtattgattttgtttttttctcttgtaaagttcatttgttattcaagccttcaattttcttaccagttggtaatcttgtcttttacttgcgggggcagggggggcggagggaaacacctttgttttccattattaagagaaaaaaaaaatcattgttctaaaaagaactctatgtgtcaagcctgtattttctcattagctatgcatattttctttagtctcttaagtcttttacttttagctagaaacataaacatctaggaccttagagttcatctgttattctttacaaaaaggaggaaatggaaatccagagaggtcagctgacattttgaggtcagaatatggagtggcttgattccctttttattttattctgaataaattccagaataaaatcaggaatgtaatctgtagataggac

SEQ ID NO: 15562 - DNA, 1059 bp, Homo sapiens
ctgtactgtcttgattgctgtaactttataataagtcttgaatcgggtagtgtaagtcctaagtcctctaacatttttatataaatcattttgtattatgtcttataatagcttgtctgtttctgaaaaagtctgagattttgattggaattacattgactctgtagttctatttggggagaattcacatattttgatgccattataagcatatgtaaatggtctttttaagatttatatttaatttctagtttaacttacttagtctatagaaatacagttgatttctatatattgctcttatatcctgtgagaacggaaaataaatctctggacccccaaatcactaagccaaagggaaaactcaagttgggaaatgcatcaggcaaacctgcctcccattttattcctaagtaagataggaattccttgtgggcctcaagatctttcccctaaaacagttttattgaatttcaccttggcaatgtaaattgataacttatcttcacagttgcaggacaaaggagagaactcaagtcatccctcagctcacctgagagaaatgcgtatctgattgcttcctctgtcctattgtttatgtaaaaatgtagattcaccgagccagattaaggcacaagtgattattcctctacccacctctgacatgcaaattgtatattcagtgaaagggtggtcaaagactcaaaagaatacgactgtttgtctcttatctgcctgtaacctggaagcaccttctcaccccttcaagttgtcccgcctttccggacagaaccactgtacataacacctattgattgatgtctcatgtctccctaaaatgtgtaaaaccaagctgtgcccctaccaacttaggtgggcatgtgttggcgggacctcctgagactgtgtcataggaatgtccttaaccttagcaaaataaactttccaaattgattgagacttgtctcagatacttttgggttcagacctgcaacctaactaaactcacttattagttctatttgccttttttttttttttgtagattccactggcttt

SEQ ID NO: 15563 - DNA, 1394 bp, Homo sapiens
gtttaaccttccaaagataccccatataagtgtttcaggtgaccctcagtaattaagaatagctaaattatgtttaatatatcttctttaatatcatgaataaatgtgcataatcttaaaatgactatattttaaaattgttaaacttttaaaggtttctttttaaacaggactatttcgttatttagaatgccaacctatttggaatagctcactttctaaggaaacccagcaagttttactattgagtcagaattgtaaggctgaattgtaaagcaacttcagaaattagaagtccaaatctactcatttatcagatgaaaatcttccgtttagatatcagggctaactttatttcacaaaactagttattggaattagaaattaggtctcttggctattggtccatttttgttgttgatatatactaagtttggaagtactcaaagttgaaatctaagtaaaatgttttctttttttcatttgtctttatgatgtactagtattcaagatttgaaggaaagaattagacagcgtaccaacttaccacttgggccaagtatcgatactcatggggagacttttctatcccaagaagtggtggttaatcttttacaagaaaccaaacaagcctttgaaagatgtcatagggtaagagtgattgtaaatgtattttacatatacagttgttccttgatatctgtggggaattgattccagaacctccgaggataccaaaatcgtggatgctcaagtctgctatataaagtgtgtagtatttgcatatattctatgcacatcctcatttatactttaattagtctgtagattacttataattatttatatatattattacattacctagtgcaacgtaaatctctgtaaatagttgtaactttagtgtttaggggatgatgacagtacatattcagtacagatgcaaccattctctttttttttcttgaatattttttgatctgtggctggttgaatctgctgatgcagaacccacagatacagaacttacagttagagagaactgactatgtagttgtattttaagtcttaccttgttttactaagatataaatttactctgattaggaacaactattttttgtaataaaagataggatttttattttggagaacagaataattttaaaattaggaataaatgtgaatataactttaaattaaagttgagcagatcaaatttttgttatgtaggattaaatgaagatgtgaaagggacagttagacttttctcatgaagaaatggtgcatcagggaaagaacaatgttttaagagcatcaacatcaaagggaaagagtgaagatttggctccattaaaacttagattttcctctctaataaacacagtttagca

SEQ ID NO: 15564 - DNA, 1056 bp, Homo sapiens
ccttaatattgttactatacctaaaatgtatattaatctttttctccccctttttcatgaaaagaaccaccaatctttccagcaagctgatggagtttaatttaggtactgataaacagactttcttgtctaagcttatcaaatccattttcatttcctatttggagaactatattgaggtggagactggatatttgaaaagcagaagtgctatgatcctacagcgctattatgattcgaaaaaccatcaaaagagatccattggcacaggagggtgagtatttttgttaaatacttctgttaaaactgaagacattaataacttcattatatttgggcaaattatcaaatgttgactatcattagaattttctgtgaagagttcttttaatccagattgttatattattgatcaaatcttgttcttaaaccacatgttgaaatgacctaacataacatgattgaaatgtaagccgggcgtggtaactcactcctgtaatcgcagcactttgggaggccgagatgggctgatcacctgaggtctggagttcgagaccagcctggccaacgtggtgaaaccccatctctactaaaaacacaaaaattagctgggcgtggtggcagacacctgtaatcccagccattaaggaggctgaagcaggagaatcacttgaacctgggagacggaggttgcagtgagccaagattacgccactgcactccagcctgggcgacacagcaagactccgtgtcaaaaaaaaaaaaaaaagtaaagtagatatttgtcaattaaaaaataatgttttaaaactatcgagcagaacactagtaatataaaaagttccatagtttctttcatttttttttttctcgatagaataagttccaggttattgaccaggaaacgcatcttttttttgttactgttgcaggtgtgaaaaaaatagaaaatagtttgtagtttaagtaccttgaattgatgagttttgttcagagactttagcataaaaaactattaaattaataccttaatgcctacaattatttacagactag

SEQ ID NO: 15565 - DNA, 1043 bp, Homo sapiens
cttaaaactgacgtgactttttttcttgactatatgtagcttgttgcttcatcataattaaaagcataatagttacaattaagtttcaatagttataattaagaagtgcatttatcttttctggtactgctatgaatccagccctacagtggactctactcttgagtaagttttcatccccaagtgaaaagttgatctcttggccttggagggaggaggaaaaaaaatcctgtcactgctcagtttcctgtaactactgccatagcatctaggttgtagtaagagtcacgggaagtatctttttctcctgcttccctttcttagtcccagctggagaactgtggaaaacggaaggcaggatgtagtcaaggatgtttggtttttatgcatcctgattttcatgcactgttaaatagaattatgctttcacttttcatgttaggagaagttaaatgaaaacaaaattaagcttttgaatccatgacatttcattatgttaactctgcttcttttaaaatcttattggtcccatgactctcaatgaaaacaacttcatataacaaaatcaaactgtaatatatttcctcagttgaccgaaatgatttagtaatagatgatttggctattgtaatagtgtatatcctggaagtttctcagaataccttcttagtttcaacttttgttgacagatctttctgaaaagatccatgtacagtgttttaaaatctcctcaggatagacattctgagtaaggattcttatgtggtgtagataaattgtatcttctacatatacaaagtggctgggctcagaaattccttttctttgtttttgagacagggtcttgctctatcgcataggctggagtgcagttgggtaatcactgctcgctgcagcctctaccctcctggcacaatccatctgcccaccttagcctccagagtagctgggactagaggtgcctgcctccatgcccagctgatttttaaaaattttttgcagaaataaggttttaccatgttgcccaggctggtcttgatctc

SEQ ID NO: 15566 - DNA, 1032 bp, Homo sapiens
gttgatttcatgtctttgctgttgtaaatagtgctgcaatgaacatatgcatgcatgtatctttataatataatgatttctattcctttgggtatatacccagtaatgggattgctgggtcacatactatttctggttctaggtctttgaggaattaccacaccattttccacaatggttgaactaatttacactcccaccaacagtgtaaaagtattcctttttctccacaaccttaccagcatctgttgtttttttgactttaataatagctactctgactggtgtgagatggtatctcattgtagttttgattttcatttctctaatgatcagtgatgttgagctttttttcatatgtttgttggccacctgtatgtcttcttttgagaagtgtctgttcatgtccattgcctactttttaatggagttctttgtctttgtcttgtaaatttgtttaaatttctcttgtagactctggatattagacctttgtgagacggatatattgcaaaaattttctcccattctttaggttgtctgttcactctgatgatagtttcttttgctgtgcagaagctctagtttaattagaccccatttgtcaacttttgcttttgttgcaattgcttttggcatttttgtcatgaaacctttgtttgtgcctatgtcctgaatgctattgcctggattatcttccagagtttttatagttttgggttttacatttaagtccttaatccatcttgaggtaatttttatataaggtgtaaggaaagggtccagtttcaattttctgcatatggccagccagctcttccagtatcatttattaaatagggagtcctttccccattgcttgtttttgtgagcttgttgaagatcagatggttgtaggtgtgcggtcttatttctgagttctctattctgttccattggtctatgtgtctgcttttctaccagtaccttgcttttttggttactgtagccttgtagtatagtataaagttgggtagcgtgatgcctccagca

SEQ ID NO: 15567 - DNA, 1028 bp, Homo sapiens
ccagggcggcgcgctctgtttagcatcctaatgtgtgtttccttttctatgcaggctggttacatgtctgggatgctggtgcctgtaggggttgggatagctggagccttgttcatcttgggagccctctacagcattaaggttatgaatcgccgaaggagaaatggcttcaaaaggcataaaagaaaggtatggaaccaacaacagcaaaacctaatcagtttcagaacattctttgcttatctaatttacttaataaagcacacggggtttaatgatgcttgggtggtattgacgtgcccagtggtctggattagctgctgtagctcctgccttggcttcgtttgttagcatgtcttttaaagtgggcctgtttctcagctttgctctgtggcagaaagagtttaatgcttttctgttttctttctctagcagagagaattcaacagcatgcaagatcgagtaatgctcttagccgacagctctgaagatgaattttgaattggactgggttttaattgggatattcaacgatgctactattctaatttttattttggagcagaaaaaaaaaaagaacaacctgccacattgctgctatcaggccgttagtcctagtgtctgctgggtgctgggtagtagatttttcttgtactgagcagaaatggcatgttgtatactaaacgtatcatgcagtatttggttttattctgtagtgaattttccacaaccgtgggctacaactcataaatatgcaacatatatgtttttcagtaggagttgctacattaggcagagtaaatattttgtagttttccacagtgtcttttccttggtttgaattacctgcattgagaataatgattgttgccaccaaggcatgcttgactctgagatataaatcttaacaaagaataacttctcaagatatactctacctacttgaaaccacagggttgtgggccatggtacatactgcatttgcatcaaactagcagtaactcagaatgaaatcattttcattaaga

SEQ ID NO: 15568 - DNA, 2560 bp, Homo sapiens
cattttccacttgtgtaataactattttcacttttatactcagatataaaaccaaggaaaataacctaaagtctgaaaaagaccagaatcgaagtttcctgattcatattttaatgttttgaaatttatactccaggctgggtgcagtggcttgtgcctgtaatcccagcactttgggaggccgaggcggccggattgcctgaagtcagaagttcgagaccagcctgaccaacatggtgaaaccctgtctctacttaaaaatacaaaagagctgggcatggaggtggtgcgcgcctgtaaccctagctactcgggaggctgaggcctaagaatctcttgaacccaggaggcagaggttgtagtgagccgggatcacgccactgcactctagcctgggcgacagagagagagactgtctaaaaaaggaaaagaaaaaaatttatacgccaaaaaagatattctgagataacctgtagttaccactaactttgtgacaaaattataaaaatccacagccatctatgaatctgtaggcagacctgaagtttgaacgactggtgaagacatctgattttctttatagccaagttaggataacaaaatgcaaacaagtcattaatatttactatatgcaagatacagaaagatgaaggaaggagtaagaagttatccttcgtggaactattcaaagcaaaaatgcaaaataccagggaaagctttgaagaaccaagatttgagcaggttcttagaatatagattggattggatttgatttcaagaaagatgaacgtgtaaagcagaagtgggaagccaaaaacttttttccaaattagaattaagcattctttcaatgaacatttggaaatcaaggtagaaaaatatccctagggcctagctgaggagtctgtatgttgttgggttttgatagtaaccagtccaagattttgttattagacgtgggtttctgaatagacaggcatttctgaacagacatgacaggatcaaaacaatgtttgagcaaactgcccttcatctactgtggatatgttgggggatgatggaatatagtgaaagataatgggtgctcatacagcagtctagacttaaggtgattcaactactatatattaaactagattatcttttattttttaattttgaaatctggatgctcaagctctgcctgcacaaccacatgaggaagaaggaacaatgacaacaaaaataacactaaatttaaatttaagagtactacttttaggaaatagacaaaccattatttgggtacaactaaaggcaactggcatggactcaaatattttggggaagaaaaagactaaaagttctaaggaagaaaatgcgaaccttgatagtttgaaatagttaaaaagacagtgtagaaactgcttaggcagtttgattatggactattagatgatacttgggtctgataatggtataaggagaataaagtatttagggatccaatattacgcctgcagctttttccaaatagttcatgggggagggggatgtgtaagtggttaactgaagtctaactagataggtttgttgtaagcttaggatgtttacagttcttcatgttaagttgagcgtgatgggaagggaaagaatgctgatctttaaatttttgtccttagttaagttctgtatttagtgaattaattgcatcctaaaaagtcaaacttgaaaagcacattttaaatggcaaatctattttttacatgtttgtgaagtttttattttttagtaaacagaccatcagaagagaacaatggtacagagcaggggtcagcagatggattttgtaaagcatcaacttgtaaatattttcaagtttattagctgtatggctctggtttctgttccctgttccaaatgttaaagtctactgttgtattctaaaagcagccatggactgaatgtagctgtgttccaataaaacttacacaaaagcaggcagtgggccataatttgcaacacctgattcacagcataattttgtcacaaactgaaagtgttcctcaattaaagtgatttttttttcttgatttttctctgggatttattgtttttcccattccttgctaggatttaactacagaaagacagatagtaactgctctaaatattctaatttcctttatttttttgagataaggtgtcgctctgttgccctggctggagtgcagtggcgtgatcatagctcactgtagcccccaactcctggctggggctcaaacagtcctcctgcctcagcctcccaagtagctgggactacaggcacgcaccacctcacctcgctaacattttgttttgggagatagggtcttactcttttgcccagcctggtcttggaactactgggctcaagcagtcctcccaacttggcctaccaaactggtaggattacaggggtaatccccctcaactgacataaatattctaattttcaaatttccatataatagtatggagagatgaaaacaaaaggaaaagagtagaagataggaacctagcatcatactagtaagtgtgc

SEQ ID NO: 15569 - DNA, 1116 bp, Homo sapiens
cttcaacccgtgaggcagaggttgcagtgagtcgagatcatgtcactgcacttcagcttaagcaacagagcgagactccatctcaaaaaaagaaaagcacgtcactcgatgttctttctttcataagagttgaagaactaggtatatctgcttatattatggcatctatagtagcttagctgctcatatttgggtctctttagaaccagtgtctttcaaagagggttttaactatgctggtgtaaattttaagaatagatacattcaaagaagaattcaacattcatgtgacattcatactttggaactttgggaaagtataggaatgaccatagattggcttagggatagtcaatttacctgtctgtaaatggatccaatttagtattgttcctgtatttttctaagaccaacacttgtgtcattcacagttaaatatatgagttgtggccaggcccggtggctcatgcctgtaatttcagcattttaggaggctgaggtgaacagattgctcaagtccaggagttcaagaccagcctgggcaacatagtgagatgcggtctctacaaaaaatttttaaaagttagccaagcatggtggtgcttgcctgtggtcccagctacttgggaggctgaggtgggaggattgcttgagccatatgctctaatatattttaaaatacatattttaaatatattttgagtggtaaaatgtagcagataatgttacataaaagaagccatggtaatgacatgacattactggttttgagttgtttgtgtagtagttagctattaatactcaggtataatgatttgctatttaaactacacaaatgctcaaagtccagcgataccctgcacccaaattcagtggctagattaccttcttaggaaagcacaacacttcaatggagtgacactggcatgagtccactagagggtgtgtatacatggcctgagttcaaattgttcctgctgtgagtactgcttttcagcttcaagttattcttatcggccacagtactgtttattccacttagtaacagttctgtttacagagcactttaacataaattctgatttttaacatgaaagctgtctgatgttggtattt

SEQ ID NO: 15570 - DNA, 1035 bp, Homo sapiens
ctggcttgacaaggttggaattagtattacatggtaaatacatgtaaaatgtttagaatggtgccaagtatctaggaagtacttgggtatgaggtggtggtggtaacatatgtaatactcttacgtgcatatcattccaagtgagttttaaatgtatacatttattgcattgatatacagacattaagcatctagactctcttgtcttgattctgagaccctactaaaggtcatatccacctctctccaaccttattttttactacttcccttcaagcatcatatgctgcagtcacattgaactatcatggttctcttgtacaagccatatgttttctcatttacttatgttcatactgttctcaccaatttgattgttatcccatctccttgtattcaaatgctaccttttaagtgaagttttctgatagttcaataggtagaactatataggtaatcatcatgtgaatttcatgtttcctcttacatgattctttaccactttttgtattgcactttagccttttatttacatatgtctctcttactgtgttgtgcaatctttacaggcagaaaactgtacctttttcttccttgtaggtttagaacctatcataggccttgggacttagtaggcattcatttgtgtaatgaaaatttataaaaggtatcacaagctaaaaggttatgtttaatggacaaatgcatgccagtaaaaatgtgttttgtcagtgtttgtacattcaagaatgtcctggccagtcacttaaaatgaaatcacttttttaaaaaaagattgtatctctaaataaccaccagagaatggtttttctgcttgttgttacctcatttttcacagatcttcctaataattatcagtggtacaaatgtgggaaaagttcatccagggctaagggttcgtcacctgccagtagtgggatagataagccacgtggctcaataaattattgaacccatagtgtcaccctccaagtatttttcttttttaatcacaataccataatgcctttaggt

SEQ ID NO: 15571 - DNA, 1032 bp, Homo sapiens
attatcaattacataccaatcacaatattaaatatacatactttttcttgttgattccactttttagtctgcttttatgaaacctaacttttttggagttttccttttgggatggtatgtgagcttatgaaatttgagctatttttttatatttatcaagacagtctttgatttgatttaaatatgtacttaaaagtttttccattgtagtgctagctttgagttaaaaagatacctgtgttcagattcaggaaaaaatcagtatatttaaaaacctaacatttgtgcatcagtttacaacattctgagtttttaatgaatgtgtggttatgtgtatgtttttattgcttcactttttatctcttttgacaccttatttttttctaataaaagtatttacttagaagcattcacagtgttaacaaaacagctgcaactttttttttttttgcaattgcagagtggtattcagttaagagaacaattatttcgtataagccacatcagagacgactgaagatgaaaaaactaccatccccgtatataactaatttgtgctgtgcaccaacaagaacctgctttaaatttccatggcaatttacaacccccatactgtaccaggcaaggttagtggctactgaaaataccaccaggacaggactatctaaagacacatttggtagtgtgttaactatacaaaaaaagacactgtacagtttaaaacattttacacagccttacatttcaattttttactttaaaaagagtgagttgtgtacaggggagttaaatgttttatagacaaaaccactaaaaccagtgcattcattatcagcatattcattatcgtcatcctcttcatcttcctcctcatcctcttcctcatcctcttcatctttctcattcttccttttcttgcttttttcagccttgacatctccctttttcgctgcatcaggctttcctttagctcgatatacagcagtatcctttctgtatttttccttcagctttgcagccttcttttcataa

SEQ ID NO: 15572 - DNA, 1050 bp, Homo sapiens
cgggaggcggaggttacagtgagcttagatcgtgccactgcactctagcctgggcagcaagagtgagactcgtctcaaaaaaaaaaaaaacatagaatttgttcaactgtgcagttgtttctgtacacgagtatatattgagaagtggaaatgattgctgtgttgaatgtagcagctttcctaaagatttagttattttatggaaagttacataatttacttatttgtaaccaaagcagactttgaaatttctatgttgtcttttgccctattcaatttttatttatttatttattttttgagacggagtctcgctctgtcctccaggcaggagtgcagtggcatgatcttggctcaccgcaacctctgcctcccaggttcaagcgattctcctgcctcagcctcctgggtagcttgggactacaggtgcatgccaccacgcccggctaatttttgtgcttttagtagagatgggtttcaccatattggcccggctgctctcgaactcctgacctcgtgattcacccgcctcgtctcccaaagtgctgggattacagggatgagccactgcgcccggcaccgtgtcagatttatctgctgattttatggccacatggagtcatagataatggttcgtataattcaaactggaatgacagcgtattttaggattcagattcaagcaaatatgagttacataatggctttcctacaaggatctgtgctccagaagcttaaggtcaataaaagggagaatgtaattacacatgtggaaagttaatctaagtagttatttcaaaatatttaagcaatctatataaccttatttatagacttacatggctcctgataatagatttgtcaaagttctgtatacaatcagatctagtggttcttttaaaagagacaaattgctttagaaagcagagcagaaagaaatttataatggttattaaaggcttttcaaggatagtgagatataatgtgtaaaattagaaggagagaagacattctaattggatgaaaggttgtgagcaagaatacaaggaa

SEQ ID NO: 15573 - DNA, 1052 bp, Homo sapiens
tgactcttcccaaatttgaaactctgttcccagaaagcagcaactgttttatttaatcactgttaggttcccccacctgataggtgctctgttgcagatacttcttctaaatctgtatgcacgtttgtatacaaaatgtgaaataagccaacttaacatctttcgttttcttaggttttttgttgttgttgttcgggtttgttttgtttttgagacaggatcttactctgtcacccaggctggaatgcaatggcatgatcatagctcattgcagcctcaaactcatgcctcctgaacagttgggactacaggtgtgtgccatcaggccccgctaaaacttttttttttttttggtagagatggggttttgttagttgctcaggcttgttttttcaacataacaataattctttcttgaaaattaatgtttcacagatgctgtcttaaccttaaaattttaaaatattccagatacttagcttaataccaaattgatttgtaattgctaataaaatgtagatttagaggaccattaagaatgtgtcatgctcgctttggcagctcacctactaaaattggaaccatacggagattagcatggcccctgtgcaaggatgacataagaagcattccatttaaaaattaaaaaagtaaagaatgtatcggagtgttagtttcttcagacctctttttattctccaatccctttttaagtattttataatatcttaatggtaactatagatgaatattagtaattaccaggcaatgttttgggtataaatgaatgaaattatgaggtaattgtatttttgtaacctgttagttaaatgagcccaaactaataggaatcataattaccaactttttaatgtttctgtgacataaggctatattgaagaatgttttatttctttgataagagtttgaacgataatacataattatcttcccaatgtggtattttagttggaaatctcaaagttagcacattcttacggatttgtgtgcccattcgtgtggtttccagttttaaggacttgatattttta

SEQ ID NO: 15574 - DNA, 1151 bp, Homo sapiens
ctgattatttttggaataaactcccagaagtggaaatataaggctgaaggcctggtgtggtggctgaagcctgtaatcccagcactttgggagaccgaggtgagcagatggcttgagcccaggagtttgggacaacatggtgaaacctcatctctacaaacagtgcaagaaatcagccagcgtggtggcgtgcacctgtgttccccgctaatcaagaggctgaggtgggatgatcacctgagtccaggagatcaaggctccagtgaaccatgattgtgccactgaactccagcctgggtgacagacttcatctcaaatatataggtgtgtgtgtgtgtgtgtatatgtgtatgtatatatatatgaatagattatgtatttaaggctagggatgcttgtatagtccattagaaagcttttttttcttaactgcacttagatttgttgtcctttttattactgccccgccccccccaaaaaatttctggtctgtctttagcttcatttctgaacattttatcctggacctctctttcttcaagtagaaataatcggctgggcgtggtggctcatgcctgtaatctcagcaccttgggaggccgaggcgggtggatcacctgaggtcgagagttcaagaccagcctgaccaacatggagaaaccccgtctctactaaaaatacagaattagccgggcgtggtggcgcatgcctgtaattccagctaattgggaggctgaggcaggagaatcgcttaaacctggaagatggaggttgcggtaagctgagatcgtggaattgcacttcaccctaggcaacaggagcaaaactgtctcaaaaaaaaaaaaaataatcgcagtctttaagttacacataccataaaatatatgagaatttttcttggaccctaggagtgattttttttttccactttttttttttttttcactttaggtgagcatttgtacagtgaaacattttgctacacaaaagtgatgtttaggaatactaacaaattattttcaaggttagttgtgtttaactacttcgtgtttccctgtagtcttctctaaagtttccccttcttgtgtgtattcattctctcagtgcttttgtagcctgataagaccccctgtacgtgtgcctctttgcat

SEQ ID NO: 15575 - DNA, 1073 bp, Homo sapiens
ggtagctatgctggtaacacattttcttagttttcctacatttgagaatgtcttgatttctcctttatttctcaaggttgttttcactagatacaggtttctgcattgacagttgttttcctttagcacttgaaacattttgtgccacttccttgtggcctccatagtttctaaagaaaaatctgctttcatcctaatggttttacccctacaggcaagatatagtttttcacttgctgctttcaatggctttttgtctttattttttattttatttattgttatttatttatttatttgctacagagtctcactctgtcacccaggctggaatgcactgacatgatcttggctcactgcaacctctgcctcctgggttcaagcaattctcgtgcctcagccacctgagtagctgggattacaggtgtgtgccaccacggccagctgctttttgtattttttttttttttttcagtagggacggggtttcaccatgttgaccaggctggtcatgaactcctgacctcaatcgacccacccgctttggcctcccaaagtgctaggattatagacgtgaggcactgcgctcagccttgtctttagttttcagatgtttgactattatgtgtcgatgtaggtttcatcgggtttatgctgtttggggtttgttcagctttttgaatctgtaggtttatgtcttttgccaaacttggggagttttcagccattatttcttccactacttttactaccctacccttttcttcctctccttcttggactctaatgagacaaaatattcacttttttatacttctacaagtcctttgtactctgttaatgtttttcattctgtttttctctgtaattcaggttgaagaattctattttctggcttccaattcactgattcctctgtcccctccattctcctattgattttattcattgagtttattttggttattgtatttttcacttcttaaactttccatttgggtcttgatatcttctatttctttgctgagaccttctgttttttcatttgtttcaagtgtgttcataattgctca

SEQ ID NO: 15576 - DNA, 1084 bp, Homo sapiens
cttttaagcaatggcaaaagggacagaaacaaaatagaaatcaaagaggaaagtgtacagtgcatgtgaacacagctcaaatgttgaaaaaggagccagtttctagatcacgggatcaaagcacaacatcaactctcactgctgtaaccaatggtgggtcaaagtggtaaaagaatggttgtctcagtcaaacacacacactcctagaggttggtttctccttcctctgtgccccagagcctgtctgcttacccttttatggagcttatgacaacatttgattactatttgattctatctgcttctcctaccaggaccatccactccaagaaatttggcttatttttttaatcctcagaatctaaccaagagtctagattctctgtctagttttctctgccccagagaagatactcaatacacatcaaacaaatcacacactaacttgccttgcccttcaccaactgcattgctttggtgagtgaaacaccagatactccaagcttgttatttcttactgtttcaatctgggcttatacacaaatcctcatctctcaatgccagggactatgtagataagacagataatttcagagcctgcagagtctagaaagctggttgtcctgcagctactgtgcttcccttatatagcctttagagaggtagggaggaaaggcagacaaatttctttctaatcattgctacttctgccactttctgtaagctcttatcacataagagcagaaatgccagtttgaacccatcactggagttgaaaactcaattgcagaagactaaaccaggtacttctgaagaagtctagtaatactgtcactgaagtctagtttttttacttttactggttccctctcccaaatcttaacacctagcaaagtgggtccctggaaatccaatgctcactttactgtatatttaatcaaccacagtaaaagaaagaagacatctaacttctcttccctctcacatcttcaggcccagtgcccagccactgcttcccttcccagtttaccccttttctcacaaagatattgggaagaactagaagaccgatgtctcatctcgt

SEQ ID NO: 15577 - DNA, 1055 bp, Homo sapiens
tggcaggcaaccgcctctatttttgtattttattaaagtagcataaaaggcattgcagaaaagctttccctttcttaaggaaaaatattcatttaaatattggcttttcccccccatttcagatgtatcaaaggccattttgaaaaacaaaacaaaatgaaacaagaaacccttagtttttgtttctccccctagcctgagtccatctactcttttggtgctcagtatttcttttctgatacactctttcttggggactaagccaaggaaaccaactaggaagtctgctgcttgtttaaggatgctccacccatgattcatctgggagttaagggcctctcagtaaagcccaaggaaagccccgtaagaggcccagcattcgtgtgttcctgtttaggatgaactctgctctctccatcattccacctcttcagtcatacttaagaatctttcttctcacactactggactcaagttttctcttctcaaggctttgattatttgggatcctactccaccttttcttttttcttctgaaactctccagacctggccaccttgctgtgttctcttctggtctaactttaagaggctgtatcacgatgccctcttgaagaacaagaggtaccacacagatgtgactggggctcacatagtgatgccttgtcaatgtggagtgccagcaggcaccaaatcacatgtttttgctactattacaaaagctttgctcacttttcagtagcgtctctggtcctatttgcaccattaccatctccccacttgctcggtctttacaaccccacttctgttcatgacatatagtaaaaactcctaagttccatctactggccaaattatagtcatttaaaaacctccatacttctaaaaattccatccatttcacaaagaattctgcttcaaatggtaaccatttgatatgtatttttaaaaaattcagatgaaccaaaatagctttagatacaaacattgtggggtgacaatttaagttacttaactcttctactttctcctggtgaaccattttgactaaatac

SEQ ID NO: 15578 - DNA, 1027 bp, Homo sapiens
aagatagtatgttttcaatagtcttagcattattataactacccaaataatattcaatgtcaaattgtttgttaaaattatacttccttctgtaaggatctaatgttattactcctaagctactaaggatagtgttcctagcttcaaagtcaaatacatttttccctacgcccaatcaactacttaacattttccagattttaagttttcttcatatttagaccatgctgtgtttatgcagtgcccccaaacagcttataattggtttttttattgctttacttgcctttgttatattgttagattcttctgatatctcagtaataccatctaccttaaatattttcaacatttatttttaaataaaacaagtattggcttatatttatatatattttacagttactatttcatatctttaaacttgtaacaaaagtgtcctttttaccatttctgtcttcactgaggagttgttttcaatgtttacttatttggaaatattctattagaaaagagttctttgggcaaaaacataacattcttcagacgccatatatagtgttctagcttgctccatggttttatatgctaacttataaaagttctggtatgaacaaaatagcaatagccagtctacaactggatttctaaaacattcaagttcacatacttcaagccatcctgagtgatctttttatcaaggaattctagtgatcatgacgtcatgtatatcaaaatcttagaaatctaaagaaaaccaggcccagattaaagttccaccccctacacacacacaccccagtcagtgtgcaaggggaaaatttaccaggtctttatgttctgctagaagatcttcaacatcagagaagcgcgatgctggctactgtgatgaacaagctgacaacagccagttcacacacaaaaatgtttgagccccttgatgaagtaggtgctatattgctcaggtgggatatcagaacagggggagtctcttcctttatgaagcacaaactctaaagtggtgagg

SEQ ID NO: 15579 - DNA, 1019 bp, Homo sapiens
gctaggcgcagtggctcacgtctgtaatcccagcactttgggaggctgaggtgggtggatcacgaggtcaggagttcgaggccagcctggccaacatggcgaaaccctgtctctaataaaaatacaaaaatcagccaggcatggtggtgggtgcctgtaatcccagctacttgggaggctgaggcaggagaatcacttgaacctgggaggtgaagtttgcagtgagctgagatcatgccattgcaccccagcctgggttacaagagcaagactacatctcaaaaataaataaataagttatttaaaggaaagttcagatgtgatttggaagtaggtttgaaaaagttgtcaataggtgagttcagatggcaattatttcccagtctgtctcttgactgggtacaaatttttggacaattaaagggattccttaggtgtcattttctcattcttggcattttagttaattttcaaaataaattagtataaaaaacaaaattaaaggatctaagggctgggctggatgatcataattgagctaccggagactgagggtgcttggactagattagtgacatttcaagtttttctttaataacaaaacccttggttcacacagatcgcttttgcttaagcagaaatggggacccagtgtcttgcttatctggctcatcagccctatgaagaccccagattagtcatttgcatcagttaggaccttcacttgcaaacaacagaatctgactttggccagttttcaaaattgctaggaaagctgaagaattaagcttcagaaaggaaaccagaatcagggaagctcctgggtttggagacacaggaactaaaagggcagtctcttcaggagttgtcatcaggaccagacttggtgttcctcagtgctgattgccttgcttgggtcacatgtctatcccttggtctgggggtgtgggacattttgattgctcatctgatcaggcaggggatggttagcagaaaagagggatgttaggagaataaaa

SEQ ID NO: 15580 - DNA, 1044 bp, Homo sapiens
atgaaggtgggtgaggagtagattagcttgtgagcggggaagttgtcagttgagaatagggatgaagggaggtggttgggtctgagggaggtggagcctttgaagaggatggaagagaaggctgccaagggcatcccatgggacagctctagggcaaggggaggggagaagtccgagaacgtgaactttaagtggctccaatccatgtaaccatgtgtgttttttctttgtttgtttgtttgtttgattaggacatagcagccctttgtgggatgttgaaaagtcagacaatgggattaatctagggaaggagtctgctccaaagagacctaggtctcagcaggaaagggatgaacatgggggaccctcggcctaggttgtctaaaatatgaagtgatggggggtgacagaaaagaaaaaccccacacaactctatgtgtgctcatgagagtttgtgtagaggtcaactctcttctttaactaaagccataaaaggaaaagttttcaaatgtgctctggctagagggaagaaaattccctacagagactggacactagttgtaatcttctcaataaaaccatcatagttcatccttaggtccaacctaatttacaaattactcttgtcaaatggcttataaatcagtatattttaatttcttatttattctaggtaaggaacctcattggagaggcagtatgataaaagagctcagaaaactttagcgctcctcaaatctgaagaatcagggatattgctgtaatgatgtaggtcttacttgaatgctattttactacttcaaattttgttagggctgagatcaagtctgataagcaccttaacttaggcaaataattatggtaataaaagattatgccacagtgcgcaggcttccaaacttttccaactattttcttgtaaatacatttgtacaggggtagttttcccctaggacagaccataatttaaaaaacttgtattcactgcagtcctataaattactgtttccccttaatgttggaaagtagtgatttattttagca

SEQ ID NO: 15581 - DNA, 1042 bp, Homo sapiens
atgaagaaataggataattcctagcgtagtaacccaaataaagttaattatcttaattatcttaataatcagaagatacaatagcagatttatctactgccatttgctgtgaagccctttgtaccaccaacgctgctctgttgtatctttaaagagcctagtgactgcagatccccttctgccacagttatcatgtgacactaagtcattggcaggcaggggagttcttttgaattctggttgtttttagtttagtgcaaattcgtaagtccagatgaattttatcccagggtgatgaacaaatatggagatgctttcagaactgctatatataatcttcaaaactgttggggggtagttgatgttaggaaaatggagacacctcctcatccagattttcaaaaggtcaaatcctataagatgatatcatgtcctagaaaaattcaagagctcattttaaacagatggtggaagaacattagaaaagaagttatcgctaggagtcaaaaaagtagttcagtaattgtaagacaggccaaattatcctcattattgatttgttgcatctggggaatgccatacctataatgtaccatgactagcatggttggaagtcctccagcgcagccttctgaagaggctggagagatgctggctctttattgaactgtgaggtggagtcacagctggctgaaccaacacaataacctaagtatctatgtggcaggatatctcttttagagtatcacagcgtttaatccttacatttttttctataaaacattttttatgattacttggaaaaagatacaaaagaacataatttggtgtaattatttcaatgaagctaatgagatttcctgccacacagatgaatacagagcattaccttcataactgttataacctgttgtggcagatgacatctggagtatttgtcctggtctgagcaatacattataaaattggtttagaaaaatttgcagcagagattagtatggctagatctgcctggaaaatgacctgtgaaggaaagttaaga

SEQ ID NO: 15582 - DNA, 1036 bp, Homo sapiens
gtggtaaagggtgatattgtggggttgttagaagaaacatttgtcatttagaattattggtgatggcctggatatggttttgtatgaattgaaaaactaaacggaataagagaaggagaaaaacaagtattaaaggtctaagaattgggaggacctaggacatctaattagagagtgcctaaggaggttcagcatagccttgccagcaaagattatttatttactttaagagttaagagtggcagtttggggatagcaccaggagatatcagctgtgatgacttggagaaacactgtaaaccggcagtgtaaacaagagcagggcatgtatgagtagttgagaacagtgaataggagtatgactagacagaagatagtagggatgacaagtttttttggggcacagtccaagttggtctggtgtctggaatgagactggggcctaataaaaaggagcgtccatacaggagctcaagtgggctgtaccttgtagcattctgaggacaggcctgaattctgagaagagaaagaggtaaaagtattgtccagtcttttttaagttggtggctgagcttggtgaggtgtgtttttaaaagactattagtccgttctacttttcttgaagactgaggactgtaagggatataaaggtttcactgaatactgagtgcctgaaaaactgcttgggtgatttgactagtaaaggctggtctgttatcagactgtatagaggtgggaaggctaaactgaggaattatgtctgacagaagggaagaaatgactgcggtggccttctcagaccctgtaggaaaggcctctacctatccagtgaaagtgtctacttagactaagaggtattttagttatctgactcagggcatgttgaataaagctaatttgccagtcctgggtgggggcaaatcctcgagcttgatgtgtagggaagggagggggcctgaataatccttgagaagtagtagaatagcagatggaacactgagaagttatttctttgaggatagatttccacgatgga

SEQ ID NO: 15583 - DNA, 1020 bp, Homo sapiens
tggcattgactgctcccaagaggatatttggcaatatctgaagacagttttagttgtcacagctgggagaggtgctactggcatctcgtaggtaggaactagggatgctgctgaacatcatacaatgtatagatggcccctgcaataaagaattatctggcccaaaagtccatgacgcttaggctgacaaacccagttttggtttgccaccttaaacgttcttctatttatactgtaaatttcctgtaggatattttttctgaatgaaataagcactccaatactaataccattgattctaagatctacaaatatactagtcattctttagagcagtgtttctcaaatttgtgcatcagaatcactgggagggcttgttaaaacataggtgcctgggccccaccacaggagtttcagtagatcaggggtatcctatgcactgtaggcctgataatttgtatttctcaaggtttccaggggatgttgatgctgctggtccaatgtccatactctgtgaaccactgctttagcgaagagcccagggttagttaacctgagggtttatcacacttttccccattagaggccatgcccagaaacttgagatgcaacttccctgggtagccctgcctttcttttccccgtatctcccagccaggtacctggagctgcatctgtggtgattgccaggctggcagcaccttagactcaaaacataccccattcctgagaacagatgaaggctgctagcagggcaaggcaccaatccctctccccccatttatcagccagtaggggcctgaggtccaggcccttggaaatgaagtaacatctaaaggaactatcctagctcctcagagcacctgtatcagaatcacctacggggtttagagtcatgggcccatccttagtaattctgtcagcctgggaatctgcattttatgaaactcttgacatcagtgcttctgtaagtgtggtcctgggaccagcatcatcatcaccacccgcgaacccgttaga

SEQ ID NO: 15584 - DNA, 1043 bp, Homo sapiens
caccttccattttgctattcaactactgcaatctggcttctacctcattactcattagaaactttacctaattgccaggtcttatggtttatgcaatccatggtggcccccgctgcttgctccctgcaggtaggtgtggtccattttagaacaggcaactctagtcccttggtgctgagctcacccacagaaccactcagttaggcttatgaggttagtacccagtccccattagtgcccgccaaagtgctgcaattgtatgggcccaggcccatctcctcttcatcatgaactcacaatgcactttgctccaagtcctccagactcagtaagagttaggtcacccttctcttcaatcctgaaagacacagatagcatactacctctctttaggacactgttcttcatacttcaatgtgcatgtgaatcacctgggaatcttagattctcattcatcagacacggggtggggcatttctaacaagctctcaggcgatgctaatgttgctggttggagtactgtgagtagcaaacttttggatgagcctattttaattacctgtttgggtaatcctggctggcaacttctcctctaagctctgaaacacatgaaaagcctgttagctctccacctggaggtaaaggatagcgctcacaagtacgttcctcataaaaggctgggaaaattgccttaccttcttttctgaaaaccaaaaacataaaacagctgatttctcaatagaccattgtgcctcattaactgtatcattcacctgcctagctttgctttctttatctgcttcttaacttttattactccctagcattccatccatggtccttttctttcttccctgactactctgtccttaaattgtcacattcattcccatggttttccctcttgtagagagactaaccacatccacatccctaatttctgaggtctaaggccatactgtagattcagtacttagaggacaaccaagatcattttccccctagactgtggccctcttcccatatttcctaacttgattaat

SEQ ID NO: 15585 - DNA, 1047 bp, Homo sapiens
gttcttcctttcttcctttctcaaatgtgctcttcctttctctccccattgtgtttaatggcatcactagcatcatttccaagctagaaactatggttataattaacttattgctagtcctcaattcccacatgcattgatcaagaggcctatcagttctacctccaaactatctctatgttagtatatattccccttctccatcttcactgaaaactcccatagtgactctggaatcaatcattcagtgaattgaggttatctcttaacatgtttctgggtctcttgtctctctcttctccagtttgatccccactttacagctacagttatctaaaacacaagtctgaccatgtcattctccttaaaaaccttccctggcccataggattaacccttggcctttccttcacatgataaaagtcaagagtacagttttcaagccagatataatacgagtgcaatattttgatagtatactcccttcatcttttttcaggaagcgaaatgtggtgattttaaagctgttatagtggaagtatcaggacaagcccattacacgggtacagcaagctttataatagaagatgacgacccattgagggatggatttcttctcaagtgacttcttccatgattttaagggctttctttttaaagtaatcattatccttaaggactgttttctctaaattatatgaaaacaaataaattatacatataaactaactctcattctttgtaaaatactaccctgtggctaaatataaagtcattatacctcgtatttgcaactgtatttgtataaatatcacttatgtctagcatacaaaatgccagaaattcagagtctttttctagtgattaacgtatcaggtaaaattaaaacagtagttacttttaaaatattgctctatagtaattactattaatatcatattttgtattaaaggctcttcgaataatatgtggaatttaactgaactttacaagctcattatttttgtcttccatttttttgagtagaataatgccctctctataagc

SEQ ID NO: 15586 - DNA, 1062 bp, Homo sapiens
atgcaggacagcttccttagaagggactcaaagtatgataagaattataaattgcagtaaaactatgtttcttcatctagacaaagacataatttctagcaattagtatacgttgcccaaaaaggtattttaaaaatgataaggattaaaaagttatgtctaagaatgacccatctgcattatttataaatttgaatcaaaatatttattttgcatgtgatctttttttgttacttgcagtttaaaattaatcatcctgatagtgaagaccttgcctttttatatggaactatattaacagatggaaaagatgcttataccaaggaaccaaccaccaacatttgtgtttttgcagatgaacaggtattaaaactgtaatgtttagggacaaaagccaggtaatatggaacacactatgaacattctgtcttcatttattctgaaacaggttgacagaagtcccactggctcaggagtgacagcccgaattgccttacagtatcacaaagggcttctggaactgaaccagatgagagccttcaaaagcagtgcaactggctcagtattcacagggaaagctgtgagggtaagtggcacccttagcttcttatttataaatgtgtcactcatgagactggagaggcctgagttgggtgtttgataaatttcttcactcagctctcagaagagaattttaaagcaggcctgtaaaaacttcttttcaactaggacattggttatccagtgtggtcttggggccccagcgggcccctaaggtcctttccatgggttcagagggtcaaaactgtgttcataataatgacattatttgcttttcactctcattctctcaagagtgtacagtggggttcttcagaggctacgatgtgatatgtgataacccaaccaattgaatgcagaagctagatatgagaacctagttgtcttctgttaagccagacatgaaacaggtttgcaaaaatatcaaacaatgccacttttctcataattttttttgttttggcaaacagttattttcacaaaaatgtgttattcatatgt

SEQ ID NO: 15587 - DNA, 1032 bp, Homo sapiens
caattgacactgaggactactagaggggagagagagggataggggcaaaggccgaaaaactacctattgggtacttatgctcactacctgagtgatgggatcatttgtaccccaaacctcagtatcatgcattatacccatgtaacaaacctgcacatgtaccccctgaatctaaaataaaaataggaattattttaaaaagaccccaaaccccccaaatcaaggcaagaccatccaccagcaaaaagattatgacttgctgaagactccggtgatcattagcattttttcaacaataaagtgtttttaattaaggttaaaaaaaaggttgacctgatatgtatttccagcagtactgtatgagattgcctgtttgtcctaaaaaaaatggatattattattaaaataatttttatcaatttgatggtcaaaaacatattatttaattatttgattacatgtgaagccagttttttttaatgtttattgctatttgcatttacttatgaattcttagttcagatcacttacttggatttctattggagtgtttctcttgataaaagttctttacattttaaggatattaacttttttgttatatacatttatgtatatttatcagtttgttatttgatgtttttaatggtgttgacatattagaaatattatcgtatgtgggtgtgtgttcaaatgtattattgatttcctttctgtttcttccttttgttttacatttaaaaacctcagtttgaggttaaacaaattcacattttttctatttctcttaaatattttatttttttacattttatcatttaatcaattttgagtttgttttggttaatgaatgtagaaacccatgtttttttcaaattaaccaatcatcaacaccatttactaattatttattatcctgtaatttgaattactacctttacaatctactaaatatttgctttcgtttaagtctgtttctaagcttcctactctgttacattgatctgtttagtactatactcattgtatact

SEQ ID NO: 15588 - DNA, 1021 bp, Homo sapiens
taggtgatggggtgacctgtgcagcaaactaccatggcatatgtttacataagtaacagacctgcacatcctgcacatgtactcctgaacttaaaataaaagttgaaatttttttttaaaaaagaaagaaagaagacccaactatatgctgccttcaagaaactcatttcacctataaagatacacatggactgaaaggggtggaaaaagatattccatgcaactagagcaccctgccccttcaaataaaagagcagcagtaactatacttatattagataaaagagtctacaaatcaaagaccttcaaaaaaaaaaaaaaaaagacaaggaaaggcattatataatgacaaaggtttcaattcagcaagacaatataaccattataaatatctatgcactgaacactagtgctccaaaatatataaaacaaacattaatagacctaaagaaagagacagactgcaacacaataatagtagtggactttaatatcccattcgcagtcatgaacagatcatccagacagaacgttaataaagaaacagtaaagttaaactatacactagatctaacaggcctaactgacatttataaacatttcacccaactgcttcagaatacacattcttttcaacagcacatggaacattttccataatagaccatatcttaggctacaaaacatgtttgtacaaattctgaaaaacaaataatatcaagtatcttcttggatcacaatggaataaaactagaaatcaataacaagaggaaccttggaaaatacacaagcatatggaaattaaacaacatgatcctgaatgaccagtgggtcaatgaagaagggaattaaaaaatttattgaaacaaatgaaaatggaaataaaccataccaaaatctatgggattatggcagaagcagtaccaacaggaaagtttattgcaataaatgcctatgtcaaaaaagttgaaagtcttcaaaataaacaccctaatgatgtgccttaagcaacaagaaatgt

SEQ ID NO: 15589 - DNA, 1121 bp, Homo sapiens
tttgccttagaagtgcttttatgtgaattattcacaaaactcctgccattatgaaaattgtttatggaatttcatttgctaaatgcattgtcttaatagtttgatttttattacaaaagtgataattgtcattaagcacattagggtgatgcaattctaattaaaagcaaagaatcttcatcttttagttagcctgcactatattatctagtaagcatatggtttctgttaggctttttgaaatattacaaatagtttataaactcccattagtacctatggagactcctaaggggcatgaagctccactaaaggaaccactcaactagacggcatttgagtcctttctagcttaaagttatgtgaaatcgcttggataaattcacttaatttttaacttttcttagactataggcaataatggagaccagtcccacaagatgacaaccagtcgttgtgtgcggctgatgttaatcagcatggccaatgatttgaaagaagtttggatctcagaacaacctttcttgttagtaacatatttgtggcaatacatgccaacctgggcctggtggataaccaacaagatggggaagaaaaggattgagaactttaagagtggtgtggtaagaccaatttctaagtttcttaatagtatgtaccaatcttgcaggaaggtacagaattttccagtgtttaaaaaactttctggctgggtgcagtggctcatgtctgtaatcccagcactttgggaggccaaggcagatcacttgaggccaggagttcaagaccaacctggccaacatagtgaaaccccatctctactaaaaatacaaaaagtagctgggcatggtggtgcatgcctgtaatcccagctactcgggaggctgaggcatgagaattgcttgaaccgaggaggcggaggttgcagtgagccaggatggtgccactgcactccagcccgggtgatagagcgagactctatttcaaaatcaaaaaacctttctaaccctccaccaatctcatgatataaagaaaaataaataaaaaatattttatccccatgcatatattttggtttactataaattattactagtcttggagagagaagtttcttacaa

SEQ ID NO: 15590 - DNA, 1101 bp, Homo sapiens
tcccaaagtgctgggattacagatgtgagccaccgtacctggccttagttgagatatttacatggaacctttttcttaaggacaagtggtattttcttgaatgtctaagaaacagttgggttttaaaatattgatcatatgtaaatgtgtatatcatgaaatagtggacagtgtgggctttggagctagatatacctgggcttatatcccggctctgccagggttcttgggtgtttattcagtagttatttatggagccttttcaatattccagtctttgctaagcactgaggccacagcaatgaacaaggtagacagggtcctacccttaatggaatctatggtctagtgggacaaattaatctctgtaaacctcagttaccttttctgtaaaactgagataataatacctttccatacagttctggtgaggcttttagtagacaatgtgctaagtacataggaagtaatgtaaaaacgttaagccattagaattggtaactctgttttcctggctggagaagttaggagacatacgttattaagtgactgttctatgttttgctgtagtaaagtccatctgttaaaaaacttgagcaataattataattgacgtttattaaacactgagtatgtactagatactgccctgagtgctttccatgttttaactcatttctcaacaatcctgtgaaggatgtgttcttattcatcacatttccagttgtggaaaattaaggcaccaagttctcacctgggagcatttcagtgctgtgtgtgatggagctggcatttgaaccctggcagtctccagggatggtactgttaacatcacagttaggatttagagctgtttaaaacagtacaatcatttcctgattttaacttttctgatctaaaatcggaaatgtgatgttaagtgatacgatatttgatatttttgataaataacatatattttagtaaataagtcacccaggaactttgcataacagtgactttacgggttcagagagacagtgaatatcatctcctgaagtgctaataagtttttcattggagaaaagaataaaccatttgtcattgctttagtactgtaac

SEQ ID NO: 15591 - DNA, 1066 bp, Homo sapiens
tgtagcctgttatttagccattcccctattaatggaaatttaggttatttccagtcatgtacagatatacttccacatatagagatctattgctatagaatgggctcctagaagtgaaattgctaaagagtatgcacatttaaacattgggtcgataataccaaactgctctccaaaaagtttataccaatttgtgctcccaccaacaatgtatgggaacaaaattttatgcagtaacacattgattgacttattataaagactattacttttataaatagaaaatgaattattaaaaaacagtgtaggagagttcctatttcctcatactcttgccaacactggaattgtcagtgtttaaatattttggtaatctgatcagccaaaacttacatgttgttgaccattttcttttattttgacttgggttttattgtagtagattttaccagtggttttcctcaattagctgcattgggttgtggaaaagtactaatagtttccccgtagaacctaccgtgtcctagatacactgtactttgtaaaagcttaatttctgctaggtctgaggagagtcagtaggatctgttgattttaatatgtctaaattcatgaatacctctagtttatggtttcagcatactggttatgagatttaaatgtgaaataagaatctatgaaagtactagaaaaatgtaagtgctatataatctttgagagaggaaggtctttctaaatatgtcaccaaaatcagaaaccacataggaaatgatggataaatatgactgcacacaaattaaaaagaaaaataccctataatgatataaaagacaaaaggataagctaggaaaagtgtcaaataaggattgtttaaaaacataaagtacttgtagaaattaataagaaaaagcaaaagtcctattagaaaaatgagcaaagaaggtaaacgggtaaataccaaaatgaaaaaaatacacaagtctaatacatgtgcagaaatgctcaatcttgctaatagtcagaaatatctaaattaaagcaataattaaatgctattatttttgcc

SEQ ID NO: 15592 - DNA, 1081 bp, Homo sapiens
agttcagttcacctggtaagaaatgtggccccaaacaaggaaatgctgtgcatcacgtttcagattcctgcctctgtcctctacaagaaccagaccagaaatccaggtgagcagtttctgggaaattaaatgtaaaccttgccattcaattgtaactaattcctcccagttttacaaattttaatgcagtattagttcagtctaatagaaagctactgtgttagttcagtctaatagaaggctatttcattaaaatagtaaatctgcaagaatgttatttcatgtttaagttgactagattaaaaatgcctatattgtttgtttttttaagagtattttcaactgttaatatcttacctaaaataggttttctggatttattacagagaatcatgaagatccacctcttaaaaggcagaggacggctgaagccttttcagacgaaaaaacacaaattgtttcaaacacttaattggaaatgttttctccatctccctaccagacttacatgtagtgaaatagaatttgtattatttaataaaattttagggtttggtttttactattgaacccttgtactttgccttattttacaaattgaggattaccaattaaactttaactgaactaaggctaccaaatacattccctgttatctaaattataacatacaattattttataacaaaatatatctaatttttattggataaatatgaataaatattttctctcagggaaaataatttttgaaagtagggtgattgagtactaactaggaaggtattaacaccactttgtagttgtcctttacgtaactactcctttactgccaattaactatcaccataaaagtaataaaaaatgaaattatttagaacggggcaggcaaactacatcctgcaggccaaatctgtcccaccacctgttttcatatggcctgtggcctaataatgttcttacgttttccattggttgaaaaataatcaaaagaacattttgtgacgtgaaaattttatgacatctattatgtatcagttttaaaaattagaattgtatgaaattaagagtttcagagttc

SEQ ID NO: 15593 - DNA, 1032 bp, Homo sapiens
attgctatttatggatcaggatcttgagttcttgacctgttccaccatccacaattctgataacacttccttctttatgcttcacttttttcatcctaaaataagggatttgagcatatgatctccaattctcttctagctctaacattttatgacaaagctcctttaaaataatttattttacacagtccttagaaaattaagactgagaggccaggcatggtagctcaagcctgtaatcccagcactttgggaggccgaggcgggtggatcacgagatcaggagatcaagaccatcctgactaacacggtgaaaccccatctctactaaaaatacaaaaaaattagccaggcgtggtggcgggcacctgtagtcccagctactcaggacgctgaggcaggagagtcgcgtgaacccagaaggcggagcttgcagtgagccaagatcatgccactgcactccagcctgggcgacagagtgagactctgtctcaaaaaaaaaaaagaaaattaagactgagaaacgtagagtgagtattataactaaataggtggacaattagagtcaaagaccaaatttttgttaagtattacaaagataagaattcttcacatttgaattgaacatttaatattttcaaagtgcatttgcatccatctccttatttgattttcaaagccaccatgcaaaactatttaatacattgcactaagaaataggtttatggcaggagtttacaaagaaaattagtgataagactaggattcaaatctccagaatcctgttttagtttttttccttttaaatatatattaagttgcctagtaaaatattttacaaatatttattttgaaaatataatagggcatttctgggttggccaaaactaagattccaatacagctatggggacagaaataggcaccttcctttccatgtacatctattccatttgatttgatttataaggttgctgataagccttttgggaaaataactgggatagcatcaataattggatctcaagcata

SEQ ID NO: 15594 - DNA, 1045 bp, Homo sapiens
aaatcttcagaattgttgtgctgacacacattatgaaattggcacaaaagaactctttggcatcaatatgtgaggcatgatctaaggatagtcctaaagatacacagataaatgattaagatctttctaagagaggggccatattttctttggtggtaagaatataaggtgataccacctacaggatacggctgaagagggatgatgagcaatagtttatcttcacgtttggcttaaatgtaaattattcctttaattaacgtattaaatgttcactatctgaaatgaactgataatgcaaagattaaaatagccaacccttgaccttaagaaatttataacccattgtgaaagtagatatgtaaacaattaaaatacactgtgataactgctaaaatagagaaggcttgcttcactgagaagctaacaagctgatacttgggatcaagtggcatttgctaggcagactggggtgtgaggaagagaaagacattccaagtggaagattcttacataatggtaaagtcacaaaagaactctgtggcactaatattaaaacattaaaggatggtgtcagaagtagcaaaaataaaaactgcccaaagtcttcctaagaggagtgaccctagattttaaagggaaggctaaatctctaatgcgtgagtatgatggtaaacaaggatgctgtacacctaggcaagtgtttatcttggaaatgataaaaagatcgctaaaattctaaggaaaataagatgatgacatatccacactagaaagcttagcctggtagtaatgggcaagatggactagaatgtggtaataatgtggacaggtagactagatggggcaggagtctagtaaaatagatcaaatgaaaaattaaattttgatgtacataatattcacaagccaaagagctaagtgaagagttcatgaatatacaagagccatgtattacatcatatagcttattaatctcatagaatttcttttcttttttaaattatactttaagttctagggtgcatgtgcacaacgtgcaggt

SEQ ID NO: 15595 - DNA, 1028 bp, Homo sapiens
tttatttccaggatgcatttgcttgttttggtcatggcagcagtgagttggtaatcctaaaccatcacttccagcagtattcatggtatagagctgatctgtgttcatatgttgaattgtgatagtagcaaacatgaacatatgaactattgttgctcttaatagaaatacaatataaatatgggcttgtatattttcttccttacatttaaatataaagtagaatacgcagttttattattttcaagaaaaagaaagagaagctgctgacctttctcccccataaagtttttcaggatgatcaggtcacagtgtgtacgtaagagtcagctaattatggatattgtcatctcggtaactttgtaaaaaaacaaacaaaactggcattgttaattccaaaaagaaaaaaaaaagcagtaaaaaaaaaaagtcatatgcaacaccagacgcaacatggtttaatggaattaatagtttttttttttttttttttaaagaacattgatggggattcactgtaaagttggcagaggctgccaaagacgaaacaactgactttaaaaatgctggaacaatgtgataaaaaataaatttgtaacaaatcttctcctttttagcccttgtcattttagccctttagtttcaactctgcattatatttagtttatatagtgtaaacttttgtttgccattaattcatctttttaggtagaagacattaaaatcacaggtttatgaagaatctctgctcattggaatgaaatgcagtcatttgaaatgagaaaggccaggatccttttttgtaccttaccctgtcttcaagagtaaaggtgaacacttacagctctcctccttgatgtcaattttgtatgttgatcattccaaactgagaagaataaagccacattttagacatatttatagaatcaattaaagctatatgtctaaaattcgtagggcaacttctgagaagaaacaccgtctttttcttttttaatggaaagtgacaatgtgacattagtcatgtt

SEQ ID NO: 15596 - DNA, 1099 bp, Homo sapiens
caggcacggtggcatgcgcttgtggtcccagctactagggagactgagttgggagggtcagttgaacccgggaggtggaggttgcagtgagctaagatcatgccactgtactccagcttggacattggagtgagactctgtctcaaaaaaaaaaaaaaaaaaaaaaaaaagagagagaatattgaagaacaacttatttccactcaaattatttggtttgtatttagtgaacttcaataataaaactattttctggttattatctaaactaaatagactaaacccttgaaaaagatgagaattaactaaggggaccaggaatagataaaactattattttatctattcctggttgaggttgattatgatattctggcatattacagttatttataatgagtgtactttcttaatgagaaaatgggggccaggcgtagtggctcacgcctgtaatcgcagcactttgggaggccaaggcaggcggatcacctgaggttgggaatttgcgaccagcctgaccaacatggagaaactccatctctactaaaaaatacaaaattagccgggcgtggaggcacatgcctgtaatcccagctactcaggaggctgaggcaggagaatcacttgaacccgggaaggggaggttgccatgagcagagattgcatcattgtactccagcctgggcaacaagaggaatcccagctctttgggaggccgaggcgggcggatcacgaggttaggagatcgagaccatcctggctaacatggtgaaaccccgtctctactaaaactacaaaaaattagcagggcgtggtggcgggtgcctgtagtcccagctactcgggagggtgaggcaggagaatggcgtgaacccaggaggcagagcttgcagtgagccgagattacaccactgcactccagcctgggcgacagagcgagactccgtctcgaaaaaaaaaaaaaagaaaatgggtttttaaaagcaagaataataatttgtcaaatgagcaatagaagggtgtactgacagatggaaacattggtttctccataggtgtgggaataggacaagggaatgaagaaatttagttggtactg

SEQ ID NO: 15597 - DNA, 1484 bp, Homo sapiens
accaagcccagcaatttttttttttttttaaattttgtagagacgcgatctcgctgtgttgcctaggctagtctcaaacacctggcttttaaacgatcctcccaccttggcctcccaaagtgctgggattttgggtgggagccaacgtgcccagcaccaaccctccttttgaaaggaagtattgtcttttattctatgatcgttctttatcttcttttgttattataaaggtgctttatttttatgaaattatagtgaaaataaatggtggctatgtttttaatgcctttacctgaagaaaaattgacaaactgctttttttttttctgtaattttactggcacgtaacatcctcaaaagagggaaccactgaaatgcaaactgtagaatactgtatataattcttgcagctcttttttagtatagcctgtcaagctctaggaattcctcatattcaaaaggcctcggttctttccctcctggcattactgccctggaaataagcccttaggaaatgaattactaataaagacattgactttgtcagaacctttggtggcatctgtcctgtggtgagtttggtggcaggaaaataattaaacctctaatgaggagttgatcagttttaaaatattttttcatgtgttgacaagtttcagtaaccaacttggcattagaagataaagcatgagggataacatgcagtgttggaaacactgtgtcatttatcactgtgtgcatttatcactgtgtgtcatttatcagtgtgcatgtgtgtatgtgtgcgtgtgagtatattttctatttcttctgattagatcatagtgtcaaaataacacgaaagccctgaatcatgtaattttgctgcttgaagccatactagtttgtactagtggtggtgacctttggtttttatttgtaaattggagagcatattgttagcttttgggaaagggaaactggagagcttcatgacacaataataataaatacatgttcgttgtctcatttgggaagaataattaatatgttattattatctaaaacttaaacctacctgcctaaacttgttcactagcttaaggctgattttatactgttgtaagttttaaaacgtgaatatttgtatttaatagaaaagtcaaccaatttttcttttagactgcaacttctcttaaacaaataactaaccatagcaatggaagtatatgtacaactctaatgggggttagttgctgttatttagcatgatcatcaccattatcatcattgttattggtatgccccttccctcctccgcagcaagactgttggggcagtaagactactggggttcagatactagctgcagcccttccagtgtgtcatgttggacaaatgacttagcctttctgggtgtcagtttcctcatttgaaaaactgggatattaatagtggctacacctaagatattctgaggattaaaagggataatgtgtgtcagg

SEQ ID NO: 15598 - DNA, 1073 bp, Homo sapiens
caacatggtgaaaccccgtctctactaaaagatacaaaaaattagctgggcgtggtggtgcgtgcctgtaatcccagctactcgggaggctgaggcaggagaatcacttgaacccagtaggcggaggttgcagtgagcagagattgtgccattgcctccagcctgggtgacagggcgagactctgcctaaaaacaaaaacaaaaacaaaaacaaaaaaaccatcttagtttttttttttttttttgagatggagttttgctcttgttgcccaggctggagtgcaatggcgccatctcagctcaccacaacctccgcctcccaggttccagcgattctcctgcctcagcctcccgggtagctgggattacaggcatgcgccaccacacctggctaattttgtatttttagtagagatagagtttctctatgttggtcaggctggtctcgaactcccgacctcaggtgatctgcccacctcggcctcccaaagtgctgggattacaggcatgagccactgtgcccagccataaaaccatcttacttttaaaatttgcatttcatgacttgatattattaatatactaggaaataatttattttattaaatacattatatcaagccttttcctctattctttagtctaattttatttctggaggaataaagttataatttaaaaatgaaaacatggggaaataagatgcaaatatgtagaatttacttactcaactaacattacgtacctactatattctaaaacttctgatacgaacagtttattaaaacgtgcaaggcaggtgtagtgctggttaaaaaaaaagttgcagtataatgtagcaagtgcttgaatggaggtatgtgcagtttcatgggaattttgtgttaagaattttaaggactgacatggctgctcttcctttacaattgcagaacgtatgatttatcttctcagcttttatgatgatctacagttgaaggctgggtgcactggctcacacctgtaatcctagcactttgggaggccgaggtgggcggatcatgaagtcaggagattgagaccatcctggctaa

SEQ ID NO: 15599 - DNA, 1050 bp, Homo sapiens
agttgtcatgatatttccatctttgaggtcagggaaatggtcaatattccatgtccatttacgattgtattcttgctgtctaggatagtgccccctctcatcttcgctgcttagagtacctgctgagggaaaccctcctttcaggcaggaaaggaattctttgtgtatttaaaacagtgctgattcttactatagtatcgcttcttactcattactttttcttttctggtttgcatcttaaatattcttctagagagtctctctctctcttttttttttaatgaagagagtttttgtgtaatgtagtataataaacatagttttaaaggtagagatttatgattatggcttgctctggttagcaggaaaggtgttgctttggacagagcatagtctgtgaaagacccatgagtatcaaaggtggccaaatgctttgaaagactctgggcataaggttccttttctggttttattatcaatcttttcagttgtgactgagagctggcagtgtctggcatgtaggaggtgtggaataagtgtttattgaatgaataaatatgatattcagatataaagatttagtggggtctaaatttattgggtagtatttatttgattagatttggagagcggaaatagtatacaaacattaagtgacttttggtgcagtcttgacaataaaacaaactcagtttcctgtcatatctggggcttagactggacagacatttgctggttcacaagaattgctgctggcattaacctgacactttgcagctctccttgaaatatgccgtagaaaacattgggctggagcccaggacctaaagagcatagtacctttgtgtctgggggatgtgcaagtggaagagtgagctgcgggagagagtgtgatattctagtcctttctcttaccctggcccctcttgccttatagggattcatatcagctcagaggccccagttctggctcatcacaattaatgaaagatgagcgctatataagtttctcctctggtcttctgtgtagtttcccttccactcagatgg

SEQ ID NO: 15600 - DNA, 1029 bp, Homo sapiens
ctcccagagtgctgggattacaggcgtgagccactgtgcccggcctaggtaaacttaatttggaagttgttaggctgggcgcagtagctcacacctgtaatcctacctagcactttgggaggctgaggtgggaggatcgcttgagcccaggagttcaagaccagcctgggaagcatggcaaaactctgtctctacaaaaaatagaaaaattagccaggtgtggaggcatgctcctgtcgtcccagctactctgcaggccaaggtgagagaatcacctgattccgggaggtcaaggctgcagcagtgagccaagatcatgctgctgcactccagcttgggtgacagagtgagaccctgtctcaaaaagaaaaagagaaagagagaaagattgagagagagagagagaaagagaaagagagacagagagacagaaagagagaaagttgtttcccaggacaggatcttcaaatgtttttgtaattgcttacttctatcagagaatataacttcagcactcttgtatttgtcctgttacacaacattaaaacatatacaaacatagagatgtttaaaaaggatgatattgaaaaataagatatagagttctaatactttcgtgcctccatttcgcttgcccattccccagcacacacactggtctggaacacagctttgttttgatatttagattcaaagagagaactttctctttgggttttgagccatgttagttttgcagcattttattttgaaccagcgaaggacatgaagagggccaggcatggtggctcactcctgtaatcccagcactttgggaggctgaggcaggcagatcacttgaagtcaggagttcgagaccagcctggccaacatggtgtaaccccatctctactaaaaatacaaaaaaaattagccaggtgtggtggtaggtgcctgtaatctcagctacttgggaggctgaggcaggagaatctcttgaacccatgcggcggaggttgcagtgagctgagattgcaccactgcactcca

SEQ ID NO: 15601 - DNA, 1029 bp, Homo sapiens
aaaatatcagaacatagcttttatagtgtggaaactatcagaatttacctttgaggtggatgtttatgtgctgaatactgaagaatgggagaaaggggatatgaacaacacaatgagctttagtgtggcttggaggaaaccaggcaacctggtttgctagttcattattgcagacttatttctgtaacagtttgtgaaatcagaaggtattataagaaaaactggaatgtaaccggaaaagatcctcaaaatttagcttaggatatttcaagcttctattttttccatatgaatactttttttaaaaaagagagagagattcataaataagattccaatgtttatacaaaatttttggaaactgaatactgattactgtaaagatgatatatctaccagtcagtaaagatgagctcctgtgagctttgggggagaaaattttgactagagattttgctggtaaaaatgaaaatagtcattatgaggctttggaaagaaaatgtaggaaacactgtagattgaactatgcttgaaatacaaagttgggagacactggtttttagtaatctatttaatctgaagtagatatgtaatgggtgttaacttctgtatctgtaaaggacttcattctgaggaagccagttaaatttttttttttagaattagaaggaatttaaaaacttacactaatttcttggatcttatggtaaacaattaaattaggacttcactgaccactcatagtcagggtattggttttgtgggtagtgaaagaagcatgcatgagaagaatttggacacatgctttaatgtattttttctttaatgctttcatgtcttttttctcattttaaaaaattatggtaaaatatacataacatgaaatttaccatcttaaccatgtttaaatgtgcattaagtgccttgacattgtcatgcaactgtccctaccatccatctccagaaccttttcatcttccccaactgaagctctgtacctgttaaacactgactccctgtttcccccac

SEQ ID NO: 15602 - DNA, 1050 bp, Homo sapiens
ctgctgaaggatacactccacagaaattaaggaagtaaatcaaggaagagcagagatagcaaaaatcagggaaccaacctagcattgtggcaagataacagctttgcagcactatattcagtccagactggagcaggacagaggatatcaggagggagatgtccagggagaaaattgaacgtataggttacccaatgcatttgaccatgtggagaacattgtaaatagtataagtggatttaacccaccaattaaaagagacccttaaaaaggttggtgcaaaagtaattgcaccaacccatagaatactaacgcatagaatgagagaaaatgttggcaaatcatagataaggaacttgtgtccagaacatacggagaaatcttacaactcgatattgaaaagacaacccaatttttaaattgatcaaaggatctggatagacatttctccaaagaagatatacaaatggccagtatgcacatgcaaagatactcaatatcattagcagagaaatgcaaaccagaacactttacacccattaggatggctataatattaataaaaattgtatcttctgaagatctggagaaatcagaacctttatacactgctggtgggaatgtaaaatggtggagctgctttggaaaacagtccagaagttcctcagggagttgtacagttgccatttgacctggcaattccactcctaggtgtatgcccagaagaattgagaacatatgtccacacaggaacttgtacatgagtgttcatagtaacattcatactagccaaaaggtggaaagaatccaagcgttcatcagtagataaacaatgtgggcggtgcgcacggctttcgggcaggaaggtgcgctctggcgaggtaggagcaatgtgggctggaaacgcctggcgcgccgcgctttccggggtgccgtgcggccgcagcgcgcagtcagtactggcccagctgcgcggcattctggagggggagctggaagggatccgcggagctggcacctggaagagtgagcgggtcatcacgtcccgtc

SEQ ID NO: 15603 - DNA, 1035 bp, Homo sapiens
tcatttggctacttttctggttttcttcccattcttttttcatttttctctattatagggtgcttggcctgctgcttgccatcattctgtataattcatctgctatcattctgtataattcatctgtataattcatccagtttcctagtttgggtttttgtttgtttgagacggagtcttgctctatcatccatgctggagtgcagtggtgtgatcacggctcactgcaacctccacctcccgggttcaattgattctcgtgccttagcctccctagtagctgagactacaggtttgcgccaccatgcctggctaatttttgtatttttttaagtagagacgggtttcaccatgttggccaggctggtcttgaactcctggcctcagatgatccatccacctcagcctcccaaggtgctgggataaggggcaggagccatcacgcccggcctactttcctagtttttaagtgctgctacttcctatagtctgataacagaatcccgtactttccctctgagttgtagactgatgtatacaaatgtttgtccttggccatccccagaagtccctcaggcttatatgagtaaaactaagggcatttctttgttttttttccccccattttcttgatttttggatttacttttttttgtttttagttttttttttgtttgtttgtttttttgaggcagagtctccctctgttgctcaggctggagtgcagtggtgcactgtcggctcactgcagccttcacctcccaggttcaagcaattctcctgtcttagcctcccaagtagctgggattacaggcgtgtcccatcacgcccggctaatttttctgtttttagtagagacgggttttcgccaggttggccaggctggtctcaaactcctggcctcaggtgatctgcctgcctaggcctcccaaagtgctgggattacaggcgtgaaccaccgcacctggcctggatttactttctgactcaactccgcttggtcatccaatgcaagaatcagcctggattccttct

SEQ ID NO: 15604 - DNA, 1050 bp, Homo sapiens
atctcatctgctcaaggactgagcagaggtgaagaatgtttttctgggtctaaaatcaatagcaagaggatgaagactttccaattgttaattattaccagtgcaaactataacagtctgaaatgtattaattattaattaccagtgcaaactataacagtctgaaatgtattacatattaccagcttggaaacttttgttgccagacttccacagttcttcttgcttgaaagagggcatgactaatgctttataggtatttccaatattacctcccaagccatcattaggaatattgatggatcttaacctacataacctgcctttttcaaagctctcaatatataaatgtttcacaaataaatgctcaatacaaattctgttgatagaggttggcactttttaaaaaagattgtcccatttctctgtatggtatttctagaataggaatctgatatttttataaagagtgttctcagtagaatgaaacctacatttatttttggaaaaaatagtaatatgtgtaagcacacaagagaggaatagtagttttccccaggggaaaaaaaaactaatttacacattaaagtgtattgatatatagttaaatatcaattaaaattaaccaaatgctttgagattaagtatttgatttattttttaattagttgagtattaaaaaggaagccccttttgatggaagtctttttaaatttacacataaatactttacaactttgtaattagactttaattttctttagacaatggagagtctaatctctccttacaattgatacctgaaacaacaagtttttatgtggtatttattctgttcagagaccctgctctcagagtttagaggcagtttttttgtaaagggggactgcagcaaagatttctgaatgggtacatgacattttcatgtagctgttttatgtggccattttgatgtattaatactttaaaactttatcataaattaataaaacttactcatagttaaataaaattaaaacagaactgagaggtaaaaaagaaaactagaat

SEQ ID NO: 15605 - DNA, 1024 bp, Homo sapiens
gagctgagctatttcgttactgagaaaatgataagtatccatttagaatgttcatgtaatgtttggagagttttgtattatggattcaacttatatataatatatataaggtacataatatgcaattatatatctgatatatattatatataaaataatatacctaagtgtttttttaaactatgggagtgtattataaaatcaataataatatgcaaacagttgtgcctgtgtatttgaactacatacaggtatgttgttattaacagatatatttaacatttatttactatgggagccatttcctaattgaattgcgtaattactagaccagaatgcatatgctactatacattgatttactgcctgtttttacactgccattacctttcatgttatccatgatgttgaacatgggaggcatttttaatggaccaaatttttagaaaaattagtttttggatttttttttaagttctgtatactgttttgaatgaactttatttgcagctattctggatgtcagtttaataattcaggtactgaattttattgcttgctaattgtgcctttccgttgctaaattaagaaatgctatgtgtactgtgatgtaaaaataagacattaactttatcttaagttacatataatcaagcaaatattttaaaaaatgtatgtcagggtgacaggcataaaagtaaattacccttaactctttagcctttatttagaaagaaatgtggaatgggctaaactttctcaccaatttattagaaagctaaatggataaatacttccctttttgtagatatttttctgtgcattgtaagttataggagcaggacatattttttgtacattgtcttgattgtttatactgcaggtaggtatttccagtgaatggaaacgttgaaatttatagatgggacaatgcacatacttcatatgtaaacaaagcatttttctaaataatttggaaaggattggatttagcaccgttaacttttaatacccatttattggc

SEQ ID NO: 15606 - DNA, 1065 bp, Homo sapiens
cagaattgctaaatttactaatgtgggaaagacagaatttgagtttgccattgtaatgcgttttgcattttgaaaattattgtacttaatgagcctaccacactcactttttcctgagtgccgaggcagctatacaactattgtcaccacagactagatttgttctcaaccctggaggtttgaatagggatttaaaaaaaaaatctgcacagaatccacacaagacactggagaagttttctggagcctcgaagcagatgagggtggattatccaagacataaaaaaatacttaataagggcttggtgcagtggctcatgcctgtaatcccagcactttgggaggccgagataggtggatcacatgaggttggcagttcaagaccagcctgaccagcaggagaattgcttgaacccgggaggcggaggttgcggtgagccgagatcgcgccattgcactccagcctgggcaacaagagagaaactccatctcaaaaaaaaaaaaaaaaatcagtagataatgaagaagtactaatgacttggaaactgcctggacgtctatatttattggtttctggagaggcaatcaggaatttcttcctcatgatctggaatgctggggcctgcctgtagctctgacgtgttacaagctataacatgtagccctactctttcttcacagattctttccttaataggaactggaacacagatcctgtttttttaacgtaagattatatcgactagtatggtagcaaatagcacttcccttactgtggtttttgatataaaatatatttttaattataatgtgtatatggtgagttcagttgctaaactgattctttgtaacttaagagttcaaaagagaaacagtaataacactgacattagatgcaaataggtcaaaaccgtagattgagaatgttttaaattatatttttctcatttaatgtgtacattaaatgattatatatgggtcagtttttttttttttttttttttgggacagagtctcactctgtctcccaggctggagtgcagtggcatgatctcactcattgca

SEQ ID NO: 15607 - DNA, 1032 bp, Homo sapiens
gaggatgcctagtgtctaccccaactcttgcattataatcctgttaccactttagatcatcagaagaccctgtgttacacagatgaagagtgatgccccaaggtatcagtccccattctgccttttgtcatggttgacaatgttattaaaagagcactgttctgcataatggtgttttgatagagaacagatcctctgagaagagctggaggactgatgtgacttgaacaggagcaagcccaggtggtaaaccatggagggaggctctggaagaccagagaagttcagggcacaagacccttcagtaacaaacaaaatagttaacctattggcttgtatgtgcttggcagcaccttatgcatttaacttatgtcaacacatttaatcttcacaatcttcctgccccctttgagggagtaggatccattattatctctatcattcagatattggaaatgggagattgagaaacctgcttacaggtaggataataggtggtggagctggacttggggggttgccaaatggcaaactaactctctactttattctacctgttgttatgggtgacaatgttgacaaagagcacattctgcagaacagagatgttttggtagagaacagccctgttttacttgtaacacactgcagaaacccactctccccactgtcatctcagggtaccatgtcgcaaggcaggctgaaaagccaagcacctagccaagccattgctctcattcattcattgtattctgcttggtgttttaactggggccaaatatacatatgtataaatatacacatataattttccttgaagttagtcctaggaacacattccatcccttgacaaataatttgcagactttaggattattttatcttttgtcttgatttctaaattgatgccaaatttagtgtttatttttggtgactatttcattcctggtttttagtacaattaactctccactctcccatttctctgtatgcgttctttaattcctgtaattgtgtgtatacattactata

SEQ ID NO: 15608 - DNA, 1029 bp, Homo sapiens
gctggaattgtaccttttaagttctagagatgataaatctctcatttgttactgagtaagaaatgccacaaatgtataaaagaattcttcattaagcttgttttttctgccgtgactctggagagtaagtcactgtagaagattgtttattttattatcatcagaggccatttcattaaccagctgttctattgacaactgaatagcattcttgactagagaagaggctgtttcaattaagagtgtttcatattgttctgaagttctatcctcaaaaccattatcattagcaaaaacccctacttgctcattttcagctgaaattaagaattgcttagggacatttttagattttgtaacatcaaattcactgatttcagtgtctgtaataataatagcaattggctccattcttttgctttcttctgatttggatttctcttcagtgatcccattttctttaaaatctgattcttggctcaattcagtatcttttggcttagtttcttcagctacaatctctgtactttcatagtcttttccatttggtgcactttctagggtactgttactggcttcttccacaatttgttgatctggaattgcaggtaaaggaggaacatcagaaagtactggctgctgatggtctgtttctgaagtttcaagtgggcttgcttgctggggttgaacatcttgtttttccttgatcgtttcaatttcttcaaggattagagttcccgtttgaatagcagaatgcccattatctaatccaagttctactgaaatcactttctctccagaagttgtgctattgctcacatttgattcacagacctcatcaccatctttccgtgagatgccttcacttagatcctgggttgacttagcctttgttgcctgatcattcaatggggtctgtgtttgtatatccaaaatttcagcttcttcctggactttgatgctgcagtctgagtcttctataattttggaatgattactcctttttggccctcttgggaattttatgca

SEQ ID NO: 15609 - DNA, 1712 bp, Homo sapiens
tatctttttttttttttttaaaccaagaagagatttaataaaacttttttttgagacagagtctcgctttgtcgcccaggctggagtgcaatggcatgatgtcggctcactgcaagctctgcctcccgggttcacgccattctcctgcctcagcctccccagtagctgggactacaggcacccgccaccacgcctggctaattttttgtatttttagtagagacggggtttcaccatgttagccaggatggtttccatctcctgaccttgtgatccgcccgcctcggcctcccaacgtgctgggattacaggtgtgagccaccgcgcccggccataaaacttttaaaaatcctgcaaaatgtgaaatattagctaccctattacagtgtttgtacattaagaagacattttgctttgaagccagattcgttttaggacttttaaggtattatcaagttttaaattggttccaagatttggaaagtacagtccttcctagagcctgattgttatcatcgggctgtggttacgaaaagatagagtgttaacattaccaaaatgaaatcagtgtcttagtaaacacagaactttttaaacacccacctttagtatgtaccgtctgaataattctagcattttcacattgattagtcttttgaaaaatcataaagatgaacaattcataggttaatgcagaaaataatgagtatatcaagagatgaaaacagtgtgcttttgtcaaattcacaaatgtcatcaaattcagaactgcccttttggctgaattagttcagcattgtaggtgtttatatttgtcttgctgaaggactgttttaggagtgttgttgtaaaatctctgtccaattcccaattagcagagtagaacttttggtagtgcgaactcagtagttccatcaatgtgatctttacagttataggaaatgaacatagtttgcccacagttcttttaaaagatctgaataaacatgagtcaatataacatttattctgtattaataatcagtacataaattaattcaacttgaaaccttttttctacagagtactatttaatattatcatctgatccatagtaatttagtactaattttaatgagaaaaaatgaaacttttactttcataatagctcatccacttaacatttttacaaagaactactataaatatgtaacactatgcaggcttttttctacacctagtcacaaatcaaaataagcatactgtttatttaaaaacggaacactttcaaactgctgctgtattcagatcaccaccttccccacaccaaattaattgctctctctgtgtactcccctctgtgccactcatgttgcagcattatccatggctctttgccttaacccaacccggtttctgttgtcactgctccctaggttgagttcttggatggcagggagcctgtctcccttatcaaatagtgttaggtatgagttatgcctaatacgtgtgttgaatcaaattgaatttaattaggacacctgaattttatgtagcttccttctaatttttgtaactaaggagcattacaaattttcttttcaaaatgtaccataaaatataccatggattgaaattttgaattatgtataagagagttcatgttacccaataaaacatcataggaatttgaacctaaagaactctaaatcttaaatgaggattttttttta

SEQ ID NO: 15610 - DNA, 1026 bp, Homo sapiens
agatataccaaatcatgagtagttttattttttaactactagctccacaacatcttacctacatggcttctctttactttttaacattgagtatacctctttttttttttgagacagagtctctctgtgtcgcccaggctggggcgcagtggcgcgatctcggctgactgcaagctccgcctcccgggttcacgccattctcctgcctcagcctcctgagcagctgggactacaggcgcccgccaccacgcccagctaatttttttgtatttttttagtagagacggggtttcaccgtgttagccaggatggtctcgatctcctgacctcgtcatctgcccgccttggcctcccaaagtgctgggattacagatgtggtatatctcatttttaataaaaaaaacagttaaagggagaagagtcagagagacattaaaaaatatttaagaaacagtaagatatacacacatagataaataagcatgcagagacagagactgagctagaactgcattgactaaaaaccccagggttgttaacttggtctagagtgttttcttagacaccttaaaaagtaatttgagattttatgaccagaggtttacatgagttgaaagagaatgatgataaaatataaatcatgtttctaccctcagcgtcaggatttttggggcttcctgggttgattttaattttctaaaaatcactgaaaaagtaatttttcagtggcacagttttcacttttttcctgatccataaaaccagcaaagtggatacattcagtgttctataactacatttaagatccatgatgttagcttttcctctataaatcaacttaactctcttttataatggtgacacttacaaagctaaaaccccaggaaaattaaagttgatgaaagaaataacagattccccggctctatatacctgggaaatagctggttaagcttcaccacaaaggatagatctaaattgtttctgaaatgtttaaatttcaaaccccgcatagtcaaggataat

SEQ ID NO: 15611 - DNA, 1028 bp, Homo sapiens
tacttggcttgattcaggttatggagaagtcaggcatggccactgtgtgggtttgatggtatttctaggtgaggtaggccgcctatggtgtatttttggaactaaaagcctacaccccccagccacccctgaaagtttcattgctgttctctattatttgcagcattggttgcttccttatgttaaggcatcaaagtcttctttaacaatctggatatattttagttaagggtaaatcgtgaatccgttatcggacatcaactccttaatagggaacagaacactgatgggatatgacatggaacagattaattctgagagctggcagtcagtgaaatatcaaggtgtggtcaggaagaaaacagaaaggaacccacgtaacctgctaacaccttttttgtccagtcctaccttgaatgtcttatttgcatgtagtagagatggattctgctcaagttggccgctgtttactgagtacttgcagtgggccaagtatcatactagctgctttcgtagatgaactttgtgtctttaccaaaaaggagatggtactgtcttcatgttacaagcctgaggaaacaggctcattacctgggctgtggtaatacagtcattcgcagtagaatttaagcctagatcgcttatctctcaagtccaatcagtgctgttttgcattatatcttgctcctgtttcagccgggaagggaatgagagaatcgcctgtggctgatttattggcgcctgtggttgcccagagaggccaagcaggactttcagctgccctctatgccttacaaagtggagctgtgagcttccaccctatctcctgaggggaatgtgaaggagccaggctgtctagctggggaggaggtgccttggccgtaaaatatcctggccagggctgtgctgggaagtgttgcataatgtcctccccaccactgaaccaaagtgatttatttgctatggtccgtaggtggtgcctgaccaacttgtccattttagcaataacagggccagaaaagagttgg

SEQ ID NO: 15612 - DNA, 1028 bp, Homo sapiens
ggctgactgaggcagggaagcaggctgctggggcacagggcctcaggatgtggtgttgctgcggggctggcggctactccttgagggcaagaaatttgttttacctctgtgtgtcctcaggcctagcacagcgctgccacataataggaacagaatcaatgtttgtacagacagccacaatacagctatggagtactgatggtgcaccaggctccaggccctggagacagacaagtgaccaagacagatttccctgggctcagggagcatctaggagagagaaggaaatgtaaatgcagggagcagggcacatgaagggagacccaacccaagcgccatttatactggctcttaaaggatgaattagtgttaagtgaaggggggatgagggagggagcctcccagggacggcaggaaagcacagatccagatgcacatcctcttcaaatctctcttgttctgctaccctcagattcaggacattgtggtccaaactcaggaaggtcgtgaaacacgctcagccaaggatgcgttgctgttgtggtgtcagatgaagacggcagggtatgccctgggaaccagctgttagcacatccaccaccagccccttgctccgcacaagcactgccatctccagagggacattagacatcatcacccagaactacagctgcctccctgtaattgatgcaaagtctgtcctgacctgattctttgaggcctggaatacaggattcttttccaaagttgcctgcaggcagactggggggtctgtgtggtgttcacatctgatgggggagcctctgtgtgtggttagctgctgccccctcttggtgacctggctcaagaaaggacagttccatttctctcctggtatattggccctcaatttgtacacttgtttgggactacaaaaaatctaattcttagctcttactgtttctcttggatgcagctaccctcatgttaatgtcaccaactttacctccagctggaaggatggcttggcctttaatgccctgatacac

SEQ ID NO: 15613 - DNA, 1065 bp, Homo sapiens
ctctagaaaaatacctaaatatctagaaatgggccacatccttcctgatacattgtgggaccaggccttcccctggatgccaagagcagcaggacgtgtgctgggatgggggaagacagagggtgggtaacaaaggtgagaggacttattttatttccctttttctaacacataagccatctcagatttgagcttaatcatttaatccactctataatagttgtcatgattacagtctctgtttacaacactgaggggttttaaaatcctgtatcctattctatttagatcagtttttttttgttttttttaaaaaaaagaagagttatctacccagcaatctgtttccctgtctgggggagggggttgcatgcaggctgggggacaagacgggcagctggaggtgccaagatcaatggcctcaaggggtgctcccaactgggtgctttttcccatacaacctagcgctatgcaggtgctgaaggtgacacctctgctcttgagatctggctctgagtaggcctgaggtgcacgcccctctgctctctcctcccctctcccttccctccccagagagaaaacactcacttgccaggtttatccagaagcccccccgcagggcactggcagcacatcaggatgtactcctgcagggcctgctgatggaacatccagtggctcatgctaagggcagggtcacctgttgaagggcaaagggtcagtaagggcccggcagatccagccaagtatcaatgacctaattccactttctcacctgggggaatagtcaaggtttcctgctccccttcctcttccattcattcttggtacaactgctatcttccccatgtcctacgcacagcatgtcccttctcctgaactttgacatgtgtcaaagagcagcaattcaaagtggcactttcactttcttgaaatgcaccctgttaacgtggatggtgatcctcaaccacatctctggcaggcagtgaaccagcctagctgtttagcttaccttcccagactgacctcggtagctgctcccaacttggtccataactctaccct

SEQ ID NO: 15614 - DNA, 1027 bp, Homo sapiens
aagatgtcagtcagtggatctaccattctggggtctgcaggatggtggcactcttctcacagctccactagagagggccccagtagagactgtgtgggggctctgaccccacatttcctgtctgcactgccgtagcagaggtcctccatgagggccctgtcccttcagcaaacttctccctggacatacaggtgtttccatactccatcctctgaaatctaggcagaggttcccaaaccccaattcttgacttctgttcactcccaggctcaataccatgaggaagctgccaaggcttggggctggcaccctctgaagccgcaacctgagctctgcattgggccctttcagccacgactggagtggccgggatgcagggcaccaagtccctaggctgcatacaacctgtggaccctgggcccagcccacaagaccagtttttcctcctaggcctctgggtctgtgatgggaacagctgctgtgaagatctctgacatgccctggagacattttccccattgtcttggggattaacattcggcttctcattacttatgcaaatctctgcagctggcttgaatttcttctcagaaaatgggattttcttttctatcacattgtcaggctacaaattttctgaacttttatgctctgcttctcttataaaactgaatgccttttacagcacccaagtcacctcttgaatgctttgctgcttagaaatttcttcctccagataccctaaatcatctctgtgaagttcaaagttccacttatctctagcgtaggggcaaaatgctgccaatctctttgctgaaacgtaacaggagtcacctttgctctagttctcaacaagttcctcatctccatctgagaccacctcagcctggactttattgtccatatcattatcagcattttgggcaaagccattcaacaagtccttaggaagtttgaaactttcccacatttttctgtcttcttctgagcccttcaaattgttccaacctctgcctgttacctagtt

SEQ ID NO: 15615 - DNA, 1665 bp, Homo sapiens
gtcttttgtgttccttgcagtttctcaactgtatgtggagttccactgttgttccactgggaacaataggatggaattagaatcatcagccagccaaccagagtaatggagtaagggcaagatcaactgtggccccctccccgctttttttttttttttttttttttttttttttttttttttttttttttacagagatgctacttttatagaaagtattatttaagtgtccttgcttgggtactagggagtgttacacaatggttcactggcactaagctcaccatacttatgttggggagcaagacctgatagccagcctttacatgggagtataattctgtcctccatctcataagccccagtacctgagccagaatgattataaccaaccacactgtctctttatcatggatggctttagcagtaggttattttcatcattgccatttgtagctctacagtggtttatagtaatttctcatcttttaagtctctccctcagtgcctgttgttatcaaactcattgctctctcaggcagttgagctctgcatttctcccttatggggagagctgtgttggagagagagaatataacttcaaatgaaaataaagaaaaacagaatttcttgattttgaggtgagaatttgagggcactgcctctgtcagttcctatcacagattctggcacatagtaggttctcagttagtaaattgtggtggagagagagagccagaggaaacagcaggcttgctcagccattaaagaaaacagcaacagtcaatattatgtgctcaactatataagtaagaccttgtgagtgctgtagaggttaaaagacataatagatggtgtctacccttgagggtcttgctctgttgttgggaaagaggattacatctaacaattaacaataatgagataacatgctgagcatcagataagagctttacattgagttaatctcagtttcatttccattaaaatctggttttcttaacaggtagatgttgaaaccaaatataatagttcccttatggcagggaacatgattcttaaggataaaggctctcatagcatttatacttttatgtacacacatttatatattatacttaatatatgaggttttatatatatttgtgtgattattaaatgactgtctgctggcactacactacaataagtaccgtgaaggcagggagaatgtctccttttggttatatttcttccctcagtgcctgcacatagtagggagcatagtgaatatttattaactgaggggaggaatcccccatcaacctggccacattattttgggagatggctcattcctgttgatgcgtttaaggctgacagttcattcggtaacctatgtctatagcatatctgagctgctagagggattgtcgtttaaatgaaatgtaaactatagccctatccacttctcctcattactcattaaggttatattagctagtcagactccaacttgggcaattatctttttaaagtttctacatcttaaattgttgcccatagttgcccaagtctcccttaggctccaggctcagcaattgtaaatgcatttaatttcttataaattatttgcatgctgctgaaaacctccaagggcttttcattgcccatttaggtaaggac

SEQ ID NO: 15616 - DNA, 1044 bp, Homo sapiens
tttgtttgtttgtttgtttgtttttttggtgaaattttggctcgcagttcttgaaagctttctgcttttcaaaattttcatccatatgatcgttgatataaatttgttattaaattattataatgtttctgctttcctggaatgctaatctcattgttttgtctagatgtttttagtttgctgttaaggtgcctaggatttttccttttgattttgggggtaggcaaaggaagttggtttgacactttgtttttaatttaacacatctatttgttgatatttctaaatattactctgcacaatgtaattacaacagcatggagagaaaaagcagatatgttataaacaaattttatagtatatcaaacaactattgtgactgtgtagggtaaaaaggattccattttttcccctctgtgaatgcatctgcttacttctcaatatttaatatggataataaatatattttttaaaatttaagagggagctattcttaagttttgccttagaaaaaaggtttaaaaaaagatgtggactgtgaacaaccaaatacttaggtattcaggactacagaagatgttgaaaaagttatttgaaaagggttctgtggatcctaatataaaaacattcatgtatgttttataatgtcactacaatatataggccttactacatgagaaatgtaagatactgagaagagagttaggaagttaggctaactctaacagaaagtgaaactgatttggcaaatatttttttctattgcttcagtacaaacggaaaacagcttctccaatggccagtaagctttgttaaaggaagtaaccccaaagagtattcttactactaaattcagtacatcgcaaaatcccactgatgttatttttattatattttggagggaagaggttgcattttaaagataaatttgtgggacaggtatattatattgcaagggcttccttttgctttatttctgtttgggaaatttctttaggaaagagtgtaagtatacaggaaatgtatgggttagtgtgttggtca

SEQ ID NO: 15617 - DNA, 1016 bp, Homo sapiens
agaagagagggaaacatttccctgatttttttttttttttttttttgagatggagttttgttcttgttgcccaggctggagtgcaatggtacaatctcggctcactgcaacctccacctcccaggttcaggcgattatcctgcctcagcctcctgagtagctaggattacagcccagctaattttttgtatttttagtagagatggggttttgccatgttggccaagctggtcttgaactcgtgacctcaggtgatccacctgcctcggcctcccaaagtgctgggattacaggtgtgagccactgcacccagcctccctgattattttttaattaaaaaattaatgcaaatatcatgaacaataaagaaagactaagaaactctcttagaaggaaactaaggatcacttcttggtcttttggctaagatcaagtatagtatctgtttttatcagtttcatatctgatatgtcctctatccaaggacaatatattaaatggatttttggaaacaggagatggaataggagcttgctacatccactccacacattgacctgatattgcagtacttccaggaacagtgcacccaaaccttgaaaaaaaatttttttttttttgagacagagtctcactctgtcgcccaggctggagtgcagtggtgccatctctgctcactgcaagctccacctcccaggttcacgtcattctcctgcctcagcctcttgagtagctgggactacaggcacctgccaccacacctggctaatttttttgtatttttagtagagacggggtttcactgtgttagccaggatggtcttgatctcctgacctcgtgatccatctgcctcagcctcccaaagtgctgggattacaggcgtgagccactgcacctggccgaaaaaatacaaattttaatgaaaaaacaaaaaaagaagaaggagactaaggagacaggacaactaaatgcaatgtggaatcttgggcctgaaaagaacattagtgagacaatg

SEQ ID NO: 15618 - DNA, 1048 bp, Homo sapiens
attttataaaggaaaagactatattagaagttgtttatatatttcataggctgtaaccactagtgtgctgtatgacaagacttacaatttctaggaactatttgtatattagattccctgataaaatagttcatgtctttttgtaagaaaaacttctaataaatgtatttgtcagtgggtagtgtagtttatggacatctggcagcaaaatcaccaaatttcaaactaataacccttgtagcatcagatccttacacattttacatgttgttttgagattcatagattcaaatacattcacttccctcagctcatgagagtaaggctcatatttttcatggcatattcagaggtctcaatcgtaaattcttacacaaattccaaaggcaatattttctttagacccagggcatgtattagtatttccggctggagttaggtgagataactctctaaaagtgatggcagaatattaaagaggcaagtagagaaatctcatacttggaagctacttaagtgagcttgtttccaacatcggtgattctaataccaatgatgtcgaatgtttcccactgaggtggccacaggagtctccatgaggagggttgtttttgagttgacatttgaagaaagactggaattctggtggagaaaaaaccacctaagtgagggaaatggcataaagcaaaggccaacgtcttggaagtaaaaatatagttgaaggagagtaatttaaagtacagtgtttatgaaggaagtattcatgaagaaaagtagttggagataagactggaaaaaagcgattaagatcagagttttgagaacacagattagggctttgggtgtttaagggggcagaatcatgtaattactttagcagggtgggaatagctttctttaaaactatttttgaagtctcagccaaattatgaagtctaagcttccatagtctgatgaagaacaagtgaaaagcagaatccaaaggagtagttaagttctggttggcaggagttgggaagacggtggaggaaaggagctccagcctgtg

SEQ ID NO: 15619 - DNA, 1034 bp, Homo sapiens
gtctttttctttactgttccattaaaggccaacactaaattactagaagttgaaattgttcctttgcctgttttaaaactgtgtgacaaggacatacacaattatcaacttttactgaaaataattaaacaaacattaaaaatatgacattataattaggtcagttgacttagacaattaagatatggatatggcctttgaatattaaaataaataaaaaattaggcttcatatgaccaacatagggataattccaagtatgcagtctttcatatcaatattatttcatatcagaaaattcatgttagaagcacctggggctgattacaatagtgaataaacaaaaagatacaaaatgagtaatgaaattgctatagaattggccagaaaaattttctaggaaatatgacttaactggttaacaactggggctgggaatatgatggttacataatttattctcagttcttacttaaaaggtatgtactcatatattgtttcttgatttgagatgttgagcaaagaacctaacctctctgtgtctcatttgcaaactgacattctctggtttgaaccccaaaagcaaattatttctgagggccagatgacaggtatggttctaaagagcagccaaaagtgcagtgctacttaaatgctaaagccaatgataatgatacagagtgggaggaaaggtatgttgcctcctttgcctaacaatgctgcctatagtttgacctccaggaaagttactttgtttgtgggtatgtgaacatgtgtgcatacacttgaactcacatagaatatagatttaataattttttcaagtcagatttttacatttatcacatgttttcaagcatttatagatgagaagctgggaaaatattgaaatttgtaaaatgaaagcatttttctgcacaaacttcctcctgtatctgagtttggctatatagatagatggaaacacagggttttccttgtcattaaccaacattaaaggcaacttcagtttaataggctgtagctgagtgctc

SEQ ID NO: 15620 - DNA, 1050 bp, Homo sapiens
caccctccccatgacgctgaatactctctcatattccctgcaccagctgcctcagatttactttctttgtagaatgtcatcactgtctgaaagtatcttctttgtttacttgcttattgtctgtttccttctgtaaatgccagagcattgggaccttggctgtgttgtcctaggctgtatccccagcctttagaacagggccagcgtggcaatagtatgcactaaaaaatatttgtgaatgaatgaatgaatttgctttaggatattccaaaggcccacattatttttgttcaaagttttatttttaattgacaaataatatatatatttatggggtacaatgtgatattttgatatacgtatacattgtggaatgattatatcaaactaatgaacatatcaatcaccttacattcttaacatttttttgcagtgagaacatttaaaatctactcttttagcaatttaaaaacatacgttattattattactaaccatggtcatgatgctaagcaatagattttgaaaaccttccccactgtctaactgaaactttgtaccctttgatcaatatctccccattccccactccataccacctggtaaccaccattctactctctacatctatggatttgactgttttggattccacgtagacgtgagagcaagtagtatttctgtgcctatttcacttaacatgcctccagattcatccatgttgtggcaaattacagaacttccttctttttttaaaagacgaatactattccattgtgtatatgtatcacattttctttatctattcatctgttgatagacaattagattgatttcgtattttgccaaaggcccacattctgagcatgccaaagatcgacaaactatgaatagagtgaagctggaactttttccttatcctaccagttggatgtggcattttgaagccaagggtcccaactgtactctagactagagctcctctgggtgtggcttccttgattactgccatatttggttctctttcccctcaagacttgttgccatgac

SEQ ID NO: 15621 - DNA, 1063 bp, Homo sapiens
tttgatggctgctgattgatcaaggtggtggtgactgtggcaattgaacaaagaaagacagaaatgaagtttgacatactgattgactcttcctttcacaaaagagttctccatagcatttgatggtgtttgatagcattttacccacagtagaactttcaaaattgtagttaatcttctctaaccctgctacagctttatcaactaagtttatgtaacattctaaatcctttcttgtcatatcaacaatattcatagcatcttcaccaagagtagattccacctcaagaaactactttctttgctaatccctaagaagcaactcctaacttgtgaaagttttataaagagattgcagcaattcagtcatgtcttcaggctccacttcttattctgctttctttgctgtgcagatacatccttcactgaagtcttgaacccctcaaagtcaaccatgaggggtggagtcaacttctttcaaaatactgttaatgatgacattttgacgtcctcccttgaatcacgaatgttatgaacagcatcaagaatagtgaattctttccagaaggttttcaatttactttgcccagatccgtcagaggaatcactatctatggcagctatagccttacaaagtgtatttcttaaataataagaatggaaagtcaaaattacttattgatccatagtctgcagaacggctgttgtgttaacaggcatgaaaacgttattaatctacttatacatctccatcagaactcttagatgaccaagtgtgttgtcaatgagcagttgcattaggaaaggaggcttttttttttctgagcagtaggtctcaacagtgggcttaaaatatgtagtatatcatgctgtaaacagatttgctgtcattcaggctttgttattcaatttatagagcacaggcagagtagatttaccatgattccttaggatcctaatatttttggaatgggaaataagcattggcttcaacttaaagtcaccagctgcattagcccctaactcttgagtcagattgctttttttaaacatttttttattt

SEQ ID NO: 15622 - DNA, 1087 bp, Homo sapiens
cttactagttttctaaaatttacctatggatcaagccagaccagagagtcttatgtacctgaatcaaatcatcttgaggtgatttgtcacttaaaataaatttcagattaatatctttttatcagattatgccaaagaacagaggagaaacaacctaggaaatttagattctgaatttattttgaaatattgttgaagacattggcgactatcatcacacaaacaatgtcctgcccccattatatggacctggaggagaaatttctctcagatttcaacaccaggaaaaactatgtttctcctgagcaattggtttgttgttacttcatgagtttcataaatccatgtttctttttactggaaaattcagaaccaaatttgtagcctacctctgccagctgtacagtactctcattatgcattcttgtgtatttgcccggcttcaacttattttcccttttctttgatttactcatatatttatttaaccctatgtgttgactgtgatttttgtaagctgtttaagcgctttacagaataagactaagaaattagaaacatacatactgatactgatagaacattgtcatcccttggccatgatttcccatctcgtgtcctttttgaaaaatggagttcatattcatagatacttgaaaatttaagaactttttccctgtcctcagagccatctctatattctattttttaaatgaactatattattttctctaatattgccgtaaattctgtggggaaatcgctgaaactctcagagggacaactggattgacaaaattcacaacctttgtcagatgtctgtctccttggccttctgctttgaagtagcagagtctattccagcaagattaataagattaaacaattctaattcctagaaaaggggatgaggtggaaaggaaacatattttattgagtgctagctatatatcagctacatatgctaagtatgtaatatattactttatctttacaaaggaaaacagttctcccagagagaatctttgccttagtaaagaagcttctgagtcataaaaatgatgataggccgggcgtggtggctcac

SEQ ID NO: 15623 - DNA, 1033 bp, Homo sapiens
gggaggctcaggagggcagatcacctgaggtcaggagttcaagaccagtctggccaacatggtaaaatcccgtctctactgaaaatacaaaaaaattagctgggtgtggtggcacatgtctaaagtgccagctacttgggaggctgaggcaggagaatcgcttgaacctcggaggcggaagttgcagtgagcggagatcgcaccactgcactccagcctgggcgacagagtgagactctgtctcgaaggaaaaaaaaagggagaccccagcctggctgttagtgtgttgtgaaagactgagggcctcagatttcaccactgactgaaatcaacaagcagccatagacagcccagaaggtaattgtatccctactgggtctcttcaacctcaggggaatttaaactttttaaggccaaggagtttctgtataatctctcctatgtaccaaagccactcaaaaggacactaaaatactgacattattttgaaaattacctgtacttctacctttcggctgttaactactggtattattttgctacgccatgtagcctttcaaacttttaaaatgctggtctaaccgtatagatgacactgtaaatgttgttttgcaacctattttccaattccttagaataaatttctaggataaaattattaatcagataacaaaagcatttaacactttgacacatactgccaaagctgccttctggatttgtaccaattcatacccctaccagcgttgcacatgaatgtctgttctcacaaacacaaatcaatttaagaattatcaatcttttaatttttgggatctggtatgatagaacatatttttacaagttatagccatttgaatttcttctttcatccattttatcttttgcccattttactactagagtgctttttaataagtagaatttaactgatatccctgtagtcttaactagaacatacttaatataatttcatccttttttcttatatcagaacaatggcttttaatccaatatatttatggaaaaaaaa

SEQ ID NO: 15624 - DNA, 1053 bp, Homo sapiens
acagacacatgaaaaaatgctcatcatcactggccatcagagaaatgcaaatcaaaaccacaatgagataccatctcacaccagttagaatggcgatcattaaaaagtcggaaacaacaggtgctggagaggatgtggagaaataggaacacttttacactgttggtgggaccgtaaactagttcaaccattgtggaagacagtgtggtgattcctcaaggatctagaactagaaataccatttgacccagccatcccattactgggtatatacccaaaggattataaatcatgctgctataaagacacatgcacacgtacattgactgcagcactatttacgatagcaaagacttggaaccaacccaaatcaatgatagactggattaagaaaatgtggcacatatacaccatggaatactatgcagccaaaaaaaggatgagttcatgtcttttgtagggacatggatgaagctggaaaccatcattctgagaaaactatcacaaggacagaaaaccaaacactgcatgttctcactcataagtgggaactgaacaatgagaacaccaggacacagggtggggaacatcacacactggggcctgttgtggggtggggggagaggggagggatagcattaggagatatacctaatgtaaatgacgagttaacgggtgcagcacaccaacatggcacatgtatacatacgtaacaaacctgcatgttgtgcacatgtaccctagaacttaaagtataataaaaaaataaaaaaataaaataaaaatacatttaaaaccttccccccacaccccggaaaaaaaaaaagtgatccgtcctccttggcctctgaaaatgctgggattacaggtgtgagccactgtaccccgccttttatatcaatttagtaaactaaaaacagtttagcagttttttatacaattaaaacatacatttacctcacttgatccggcaattctactcctaggtgtttatccaagagaaatgaaaacataggtctacaaaaagactttatgaatgtttagagcagcttc

SEQ ID NO: 15625 - DNA, 1059 bp, Homo sapiens
cagcctggccaacagggcaaaaccccgtctctattaaaaatacaaaaaatagccaggcgtgatggtgcacatctgtaatcccagctacttgggaggctgaggcatgagaatcacttaaacccaggaagcagaggttgcagtgaaccaagattgtgccactgcactccagcctgggcgacagagtgagactctgtctcaaaaaaaagaaagaaatatcacaggagaaaaaaacttaagtagaataaatacaatcagatacaccatcctctacaccaaaaactgtggaatacacatcctaacaggtgtgcacagaacattcaccaagaaagaacagatgttgggccataaaataaggctcaacaaatttgaaaagactgacatctttcagggtctgaccacctggaattataaatcagttaaaatctttttcacatctccaaataggtggaaactatataacatacttctaaataactcatgtgttaaagagaaaaacaaggaagcggggtgccgggggctcaggcccataatcccagcactttggaaggctgaggcaggtggatcacctgaggtcgggagtttgggaccagcctgaccaacatggagaaaccccatctctactaaaaatacaaaattagctgggcgtggtggtgcatgcctataatcccagctactcgggaggctgaggcaagagaattgcttgaacccgggaggcagaggttgcagtgagcagagatagtgccactgcactccagcctgggcaacaagagcgaaaccccatctcaaaaaaaaaaaaaaaaaaaatgaagggaaattagaaaatacttctaacaaaatggtaacaaaaatacaatgccaaaacttacgggatgcaactaaagaactgtttcgagggaaatttataatttcaaatgcctacatttgaaaagaagagtttaaaaattaagcattcatcttgagaaactaaagcaagtgcaaattatagtcaaagaaagcataaaaagaaatgaattaaatagaaaagagacaataaagacaaatgccctccaacttatttct

SEQ ID NO: 15626 - DNA, 1076 bp, Homo sapiens
taaattcagtaatgactggaaaaccaacaactcagttcacaagtactttaaaaataggtaactgtttaacatttcgtcttcccaacagcctgctgaactgtaaattctaccatctccactttgcagatgaggaaattgagactttgacaagtcaaagagcacagctggaatgcaagtcaagtatgatttgatttaatttgatctttatattttaagaattacgtactgcctttctaggaggcaaaaattagtttgaagtagggatccagattagtggttttccacatgtaggtaaattcaatgtaaagcaacaagccaaaggaccctagatttctcctgtggcttcttaaatacctggaatgtattggccttgttaaaatacttacaaaagtgcagatgactttatagtttagcatttgttaaaaagaaatcaagaaaacaatggacacataatttgttgtgtggagtcagttatctgaaacataggagaagaatatagatcaggaataggaatggaaagctgaactgtggtgacaggtgtatatatgtaagaaactttttgtttgttggtgtatgatttatgacctttgggagatgtacagcagaaaaaaaggagaaatgaagactggagaaacaaaatatgttatatatttgccaataattcacatgctgcctcagtgtcctcagatcccaggctgcacataaggtccatttgcctgagtattattacatacctccttctccagaaaactttcaagttcacagccttgcgttgtccatctttaatacacttagttgttggttttaataattaaggaaacaggacctacctatacctgtgccaacagggggcactatccctctgtaaagaacaaatcaaaaagtattttgtgttgtagctggaggatccaatggtcttgcttttggcaaaaacttgaagaggagggtggtctttacatgtgtggaaaccttgagtggccgagcaaatagcaagagaaattgcttagtggcttttaaaatttgaaatataattttactttttatttttacaatacagtgtacagtatgacatctca

SEQ ID NO: 15627 - DNA, 1034 bp, Homo sapiens
cgcgcaactgaggctgcgcaggcttagggcggggcgtggtgacgcggctgccggaagcgggtctggagcgggcgagacggccagggccggcgagcgcagtgcagcgccgcgcggtgcgggcggccgagtgggggcgtcatggaggatgagcggagcttttcggatatctgcggcggccgcctggcgctgcagcgccgctactactccccgtcctgccgggaattctgcctcagctgccctcggctctcgctgcgttcgctcaccgctgtcacctgcacggtgtggctggcggcctacggactcttcaccctctgcgaggtaatggcaagtcggcccctccccgcgctcgaaggagggggttcggctttgggagggtctttggggtctttggtcgagcccggacctctggtcggcccctcctacagtgataggacaggagggcgggaactcacgggttctggggacgatattccgctgctggacagctctttaaatgacgtttagtgaaatgtgtgctcctggatagtacattccccttccgtggctgtgctctgctccgtgggttcactcagcatacatctagttcttgcgcgacggcctaaaactttaactgccatgtgttctatgtagtataggcgcgcagtaatttaattccaagagttcaaggaactactaagtgggtcttcctcgtccatcccttctgctcctcaaagtagtactgctaacaatactttacgtagacttccacaaactgtctttgcctccacaagtgtgtgtgtttatctgtgtgtatagatagagtgttatagttcttcctaatctctgtttttcaagggagttttttaaccctccctcctcccaaacccttccccaatttcaagtactttctaaaggtttatgaaattttggacgtgtgtgatagctgtgctcaatttccagattcattcctgttttctctgagcctcaattttctacatctctaaaatagaattcatgcctgccataccagcttcatgatattgtgagggttaaat

SEQ ID NO: 15628 - DNA, 1165 bp, Homo sapiens
cggtgaggcgggggtgggccacgccgtggggagcgcagccctgcgcgctttggaaggaagattctcccaccttcctcccagacccgggcccgcgtctcctccctccgcgtcctcagacacgccccctagggctggcttgtcccagccccaggtctccctgctgccactgagagtaaattggacctcgggattcagttccctgggatccttctatggccttccacattttctcatcttttttcactgtggcaaatagagcagaggggcttttgcatctgcggtcctgtaatgtagagtgggtttctttcatagctgtttttgtttgttttatgcatttaaaagcactagtctcaagacaggtctagttttcaccagactgacagaggatccgtagcacagaaaaagggttaaaaacccaaaggagtcataatttgggggtgttggtaaataccagttattggagggtagagagctggcctttaaaacctgattgtggcatttagatgtggtcttgttttgaacgtttttacagctgagactgtttactaccccttaatttcatgattcaggttgctacaagttctgtctggaggagctagagttttccggccctaaatccataggaaaagctgctatagttcttggcctccggatatatagaatttgatggcaaggacaaaactttgttttattgcttttatttaagagtcagagcttgggtgtttgctcaacgaattactcaaggtcataggaattgaatgactggtgagaatgaaattcatgtatttaatatatatttattgtgaggctgctgtgtgctaggtgctggtgaattgtgaggcaccgttctaggtgctggtgaatattgcaaattacagtgaaaaagatacgaacatccccattctagtgggtaggtgataaacaatatataactattaagaggcagtgttaaagaatacaggaaagtaaatcagagtaaaagaataggggatgggacttcagttttattttattatttatcatttttttttttgagacagggtctcactctgtcacccaggctggagtgcagtggcacgatctcggctcactgcaacctccacttcccagattgaagcaattctcctgcctcagcctctggagtaatagggattacagttgcgcc

SEQ ID NO: 15629 - DNA, 1047 bp, Homo sapiens
gggggtgctggggagaccagggccagaaaggaagggacttttgtctccaccaagctggggattcatgagatagcgatcctgggacatagacacatacgcatatcctgcaacagctgcctttggtccaagcaggcagagtcaaatcaggtctaagtggggttagacgttaattcgactttttccaatcgtgtgtgtgtgtcttcctccccagatttcctgtgattataaaaaaaactttagattcagctggccgaaaacagaaaaatagaggaggatctatgtgtccattctgggagggttctgatggtttattcattcctgtaatacatattcattgaacacctactacatgccaggccccgtgctaggtgccaggaatactacaggagtagaaaaaacagacactactcttgccctcatgaagcttaaagtctgatcaaggagacaggcataaccaaataatcactcaagtaactacaaaatcacaactctgggcgagagcaatgctgatcctgaaccccagaagatgctggagagcctgggagagtgaggaggagagtgtcagagggagtggacagagaccaaactgcctgctggcctgccttcttttttaaattcttagcttatttgtaataactttttacactataaaataacacagtgttatagcatatgtccagaatattgaaagagttgttataataccataaaatacatgaatcctgttatgaacgtggcaggtgagacatggtgtctgtctgcccgagctttctgctgcagctctgtatacttgatttgtcggtgatggatgcctttccgctgtctcttataactgactgccaggttcgggcctacctgatatgttgcaaactgcgttctgcctacttgattgctgtgaagcaagaacactcacgggccacagcccttgtccagcaggtgcagcaggccgccaagagcagcggggatgcagtagtgcaagacatctgtgcccagtggcttctgacaagccacccccggggtgcccatggcccaggctccaggaagtga

SEQ ID NO: 15630 - DNA, 1068 bp, Homo sapiens
aacagtgtcagtcctggctcagcatcaagcaggttaaaaattttttttttccatcacatatagttagataagtaaccatatatggttagataagtaatagatgtaattttttttaaaaaaaggagacaatttttaaaaagataaaaatgacatatgacatataatcccatacacagactgattagtgttaaaattctggtgaattttctatgttatgttgtttaatgaaactggggttgtcccatatcataatatgtagaattgtgtatcctgcctgttctgcctttgacactgaaaaattatgaacatttttccacattgttaaatattctttctttatttgtttttttatttttttatcatactttaagttctagggtacatgtgcacaacgtgcaggtttgttacatatgtatacatgtgccatgttggtgtgcacattgttaaatattctttgcaagcaatattttcagtgcctgctgagaactttttgagtttcatttttctctctcgctccctgtgctgtcagcaagatgacgattactttgccaccctgagggaactggaagctacccttcggacgcagagcctttctctggcagtgattcctgaagggaaaatcatgaacaacacctactaccaggaatgcctcttctacctgcacaactatagcaccaacctggccatcatcagcttctacgtgaggcacagctgcctgcgggaagctcttctgcaccttctcaacaaggtgggacatggacacagctcaaaaaggcagtgcctgccttactcctctggcttggaccactcagccttaagcgggacaataaccccctgacacttaaccctgtgttgagctatggggccatctctagcagagtcaagtcaaaacaggggactctgcacaactgttattcagtgagtgtgaaaagtcttagcctagatcccaaatcactgccctcaccagcaaaggcatgtttcattccttctgccaaaacatgcagcagaatcggatagtggttaagagcatgtctctggaatgagatgctcagtgtgagtcttgtgtgg

SEQ ID NO: 15631 - DNA, 1078 bp, Homo sapiens
gcatagccggtgccccgcggggacaggccctgggccgggaagggggccccgcccgctcccagtccccttcccctttgcttttttccagcccctcctccggtccccccagctgagcttcgcgaaccctcgggagttaaagaccagccggcctcttttttggggggggtggggggtgggggagcgggaatgggtggaggccgggggaataaaaaaccgaaatagcttcacatcagaactcagactaaccttgtggtttcaacgcgcactctgctctgtcctgaaatctggaactcattacctcatcaccaagaaactgcacgaaatctctcccccaccgccccaacacccacttgggaaaggaacgagcaaacatccctctaagaaagaaacctacacttgaatgatttaaattaaggtggatggaagttatttccctttctggcgcttgccagatttcaagaaaagctgaaaaatgggagcgggggagggaagcaacagacggctggagggcagcagcagaacaagcgaggggcagcagccgagttaaagtgggggccatccatttcgggcagaggagacaaatgaaagccgaccccgctgggatcacgtaggttcgtggctgcagcaaaagttgggtttcacaaagttgaaaaacagccggtttctcaaacaattgtgatttggaaggtttcgctgggtttgcccagatgtttacgaataaataagaaatgcagttttaaaaaaaagtgtgtgttgggggtggtgagaatgcgctctcttcggcccgccccgtcctttccaaagaaacgtgctcataatggggtgacctaattacatcgcaatggaactcaatcttagccactccgcagcaccgggtttcataacagactcggcggcctcgagtgctgggaagaaacgtgcgagggccgaggggggcggcggagcccgcgtggaaatcggaaagaagcgcagccctgcgacttccgcctgggtcatcacgccagcagtcgggccaaggcgcagggggcgggtgggggactcgttaactttttatttgggtgggcggcatccaaaccta

SEQ ID NO: 15632 - DNA, 1041 bp, Homo sapiens
ctccctgccattggccattgaggtgaaggctggtgtcacctccagccatgactgggaaaggggtcttctttggtctcctctctgccagtctcctgaaagaggggaggggtggaaggagtgcctggaaggtctcttgaagggagcgcccctggctcttcccagcaccaccagccaccccactgacagcctcagagagagggagatgggccatgaaattaacctgggtcccctgacttccttgtctcttccctccccagtgagctggactattatgactcacccagtgtcaacgcccgttgccaaaagatctgtgaccagtgggacaatctgggggccctaactcagaagcgaagggaagctctggaggtgagaggtcccagagggagatctaggcccatatccggcagccctgtggtgccccttcctgcttcttgactctctttgctttgggctaaaagactctatggcttccccagacctcccccaaccctggcctaaatgtggaagattcactttggcacaggatttggactttgccctcatggcgatgcctcctctcttgccctcacatgtctcatcctcccagtttagtgtgctttacagcccaaccccagccatttgagaaccctcctattctacacaccagactctgggacccaggccaggtgactgtgatgtgagatggttcatacagctggcaggaagagcttgttctttctgcctgattgagtcagtgcttctagacctggggctcaccaggaggatcttgataggagtgggggatgattctggacatcactgtactaacccttaccctatttggcactcccagcggaccgagaaactgctggagaccattgaccagctgtacttggagtatgccaagcgggctgcacccttcaacaactggatggagggggccatggaggacctgcaggacaccttcattgtgcacaccattgaggagatccaggtgagccccacctccactccccggaggctggctcccctggggcccctggcccatgctctgtgggtcac

SEQ ID NO: 15633 - DNA, 1060 bp, Homo sapiens
gaacatggagacatccacactagggcaagctgagggcccagcaactcacagtagggcagtgaagggttaggggagtggacgtgcagcctttctgcagacgtctacatgagaagactatggagccagggcagaaattccaataatgtgccgccaatttttttttttttttgaaacggagtctcgctctgtcaccaggctggagtgcagtggcatgatcttggctcactgcaacctctgactccctggttcaagcgattctcctgcctcagcctcccaagtagctgggattacaggcatgcgccaccacgcccagctaatttttgtatttttagtagacatggggtttcaccatgttggccaggatggtctcgatctcctgatgacctcgtgatctgcccgcctcggcctcccaaagtgctgggattacaggcgtgagccaccgtgcccggcccatgtgctgctaaatattttaaaagcaggaaacataatttatatatgcccaaagaatatccacataaggaaagactgaataggagtggataagtaggcttacctgtaatttttttcctaagctttatatattaccattctgttttaaagaagaaagagtagggggaaggaaagaaatgccacctggggacacaaccttggctcccagcccagccttatttattgagatgggccgagcataccagcagcagagggttgggtatgtgagtgagggaggctgggccagcccccatcctgtgcctgtcaacttcacaaggcagctggtgagcgtcgtctaacaatggccctgggaggtcatttcttgttcctgctttcctcctgtggaaacaaatttaagaaacgcaagacctgcttgtgccctgtagatagagggcagtgtgtctgagggtcagagaaggcgctagccactgtcgggttctgtgcagagtgcactggacacactgaccgagggaaggggcccctgcagggctgccggcagccagtgacggtaactggggacattctaaaggcagggtactcctgaggtgcttgggttgtttttttcctggtt

SEQ ID NO: 15634 - DNA, 1025 bp, Homo sapiens
gccccattttcctgacaatctgaagcttgaagggggaaagagaatgctttaaacctccaaccagtgagccccagtggtgagaccagccttccacatctggagctgtcccctgaggatcgagctggggctgggagaaagtcgctctgctccccagtttgggtggccacccaattgggagtagccagtgacttgtggtggctctcactttatcatcccttcctccttttctccctctaggatgatccactcacaaatctgaatacggcttttgacgtggcagagaagtacctggacatccccaagatgctggatgccgaaggtgaaaggcgctttccttctgtgtctcttgcccatcgcccacctgccactcagcggctaagaaggggtggaccccagcagtccggggctggacgggaggaggcctggtcttctgggaccgcatttgaggagcatggggatcacagcctcttggggattcttccatcgttctttgagctttggagagagaggtgttagttgattctgcaaaggtcttaggggctgttcttgcatcgactgcctgaggatggttcttgtctttgccttggagtcaggatagcgggtgctggggtgtggggaaatgtgcccttgttgtccggcacagtttgggatgggaagtttcccttgctgagaggtgcactgtcctcaccctctgagccctgggtggtctctggacagctgagcttagcatctcctctatgccccagctctgactggggctggctgggcatggtgtttttctcatctgtaaccctggcttccttctagcatcttctgaggagggtgctagagaactatggcttggactttctcagtggtggaagtgtccagttctgatctgtctgggaagatcccagccagaggcagtggctccatgttgggtagggaaggaaggagggggcccaagttgagtgttgacttttctgttcctcaccaaggccttgctgtcccagatgctgctagccaggatgcctggatggggacag

SEQ ID NO: 15635 - DNA, 2274 bp, Homo sapiens
gctttggagccagcagcactggtgtggaggcaagctctgctgtctgacttgctgtgtccttgagctggtccttattctgagcctcagtttcttcctctgtaaaaagacaatctgtcttgcagagttgttgccgagactaaatgagatgatggatgtaaaccacccaagctggcatcccatacctggtaggctccctaagtgtgttgttattttgtgtgtggatgggccaaggggtgcttttagcgaaccattcttctccacacagaggtgtggtgagacagacttcctatatacatttctgtagcccagagttgcccaaacttgcctgattataggattcacatggagtacttgttacttgttaaaataccaatctgtgagtcccatcccagaactcctgaaccagaatggtggttgttggggtgaggggtctctacttttaaccttttttataatcgggccagtctgggaaatgccgtttccctcagattgctctgccagttgctgtgtcattccatcttcacgggggcccattggaatgagacaagtatggccccttggaaagtgggagactttgcaggtgagactgaagcttgaaggggctggcctgaggccctgagctccttgtggtggaagcagatttagaactgagatctcccagtgatgtgtgtccattgtgcctgcaaacattccactaaagcatggaaaaggtgaaggtggggatggagagagatggagtgacaggaaggaggtgagggctgagggcctccatgatggccttgggaacctgcagagactaagtgggggatggatggtgggacagagccctgagccccactaggatgcttccccaggtgtgccttctgaaaaccagggccccagtgagcatgtggggccttgggcttcttagaaccactgggaatccacaggtgtcagagcgtaggcgcggtcttaggcagcatggacccagcgggaggggctgggactcctcctcagggctgctggtggagtcctggaagtcctgtgggtaggacttctgccacttctcccctcttcctctgccttttttattgggctgggaagttttctagaagcacaggcagggctggctcccttgttcagatagggaagttgaggaataggtatttccagggtcagctgatgatgccaggaactggggtcccactgccttgtctgcttcctccttctcaaagttggcctggtccattagagaaaaccccttttaggtccttactatgtcatcctttccagtttacccttaagaggcccttaaggaggatttcaacctctgctgggccccacccccagagggtgacttgattggtggtggtgaggtgggctggtgggctggtgggctgtgagcggaggggccctgttacggacagttgtgagagtgtggccggggcacggtgacctgctgccaggccctggggagagtcacgctgactgagcctgtggttgaaagtgtgtgactgccaccgcgggtggaattctggctcctgcatctactgttcgctgtgaccttgagtggctgtgagctcttggcctcggttttctcatctgtaaaatgagatgccttctggggtggttaagattgattgggttgacactggtagaacacttggggcagtgggttgggagtgacatcctgatctctgaagctcttccactcagacctttcaattagatctgcagcctcaggactttggacctttggggactgctgtgaacagcgagctgccccaggtgtctgggcaggcagggagtatgggtgcaaagctgtggcctctctgcctgttcctccttctgttggctcaggtctgaaaatctgggtgtggcctctgcccctcctccccgtctctcctgagtatctcttgtatccacctgcttctccctctcctacactgccaccctggactggctccctttgtctctggctgggaccttttcgtgatcttgtgcttggtctcttttcagccactcttttccatctctgatctgcccttcccatggcatttagaggtctctttctaagatgcaggtggaattatgtaaccagcatctgattggcactcccagcccaactcagcccgccacagccccatttgtttctttcagctaaaataaaatgtcttcggtgacttccactgctctcaggagaaacaacagctgcaggaacccgaacacccatgtggctagttgatctccagtctctggcaccctcttcttccctcctgcactgtgacttttttt

SEQ ID NO: 15636 - DNA, 1035 bp, Homo sapiens
ttaaacttaaaaggggggtagtttatagagccgactgaagttttttttttcagccaaaggcatcctgtattagctcactcaggaatcctaggccctgaaacggagcccttttactcacttcatcagacaggcagaggtaatctaaaacacacacaatgggcttcctcaaagcaggatgacctgggccgcggtgcccaaggcctatgcagggctgggccctatacagcgacatcggtcatctacatcggacatgggaaggtcccctgacttcgaactgacttctttgtaatgtgccagttgcttaaactccccctcttcctgtcatcttcctagtaagagctgaagactgggggctgcagacagtcccccactcacttggcttatttcctgggaccatgggtgctgtgggtggaactgaaaagtgagtgagtaatttggagatccctatggggcaccaggcagaaggctctttaataatttcagggtgaagccttcttgagaatggattttaaattagaagtgagattagggtggtggattggggtcttccctgggggttagaatcgaaggagaaatccctgcttagggagcacctgctttgtgcctgggaggggcaggagtaacagagctgcctaggaactaggcccctgaaaggactgtgagaccaagttcctaggggacagacactgagcaccggcctgaacatcgtatttaatatttctgaatgaatgaatatattaaacgcagtggggagaagaatatagattcccagggctctgacctgggtggcagtgggtgtgccccaggcctttgggcagccaggtaggaagaggtggtctgggaaactgggttatcctggaggcaaactcaacagtgccaagaactggcatttgctgatatgtgccaggcacgaacaaggactaggaaaccagggccagagaggggaagtaaccagctccaagtccagactgtgtttggtggggctgggatgcagccatgtttgggactggcagcttcccctcacttgtccctcct

SEQ ID NO: 15637 - DNA, 1051 bp, Homo sapiens
ttctttttaccccaccagagcaataaagaagtccaattgagtggtttttgtgtgtgtgtgtgtacttaaaaaaacaaaacaaaacaaaataaaccccacaggagaccacatttgtgaggaatgttttcctgatgttctgaggtgttcttgcttttcgccctaggtcttttggatcaccttggatcacctcctaccctgttcttgtgttttatagcaaatccttggatgaagataggttggggtagatgtatttcattaatttttcttataaagatatttttatttgaattcactgttaacatgttttactagttctttcaatatattgctcatctcatttgaatgtattggtggccacttctctgaaggagtagagacagtggcattttcattatcaagataagtgtctagaaagcaagtcaggattgaggcattcttgtttgtatagaggcacccccatttcttcaagaggaaatgagaaatttcttcttcagggaatgtgttgaggacaggagtataactctgatctgaagaggaattggagatccttctgcgaacagacatgagaccataaaaagtgccatgttgtatggttagcttttcattgactttgataatttcttttttctctgccttgttttctctccacccccaaccccacaaattccaaaatggaatcatgtttctcacagtgtggtttgaaagctacctgtatcacaattaactggtgttgctggttaaattcagatacctgggcccacttcccagattgaattagaatattgtgggggacagggggtgggaatcctgagaatctacattttttaaagtcctagatgatttttcatgcatcttacacttgaagccagaatctttgacatcatctttgtatcttgactatgagggcagactgcttccaagctttgccttcccggcaaaccagatcatccttatcattctcagcaggagtggccagctgtagacccctgctgataaattacagttaatgtaacttactttctggatttcaggtgtcatttcatccctctgg

SEQ ID NO: 15638 - DNA, 1050 bp, Homo sapiens
agtcagaagaacaattctcagagctcatacagggtgaggaaacataatctgaccactagagtcctgtgtcaccaactaagggattcactgaagcctccaaaagtgttaaaatttgtaataagaccagtggtcccttaaattaaggctactatggatttaccatagcaaagtttaaaaatggatcttaggccaggtgtggtggctcacacctgtaatcccagcactttgggaggccaaggcaggaggatcaaatgagcccaagagttggaggctgcagtgagctatgatcacgtcactgtactccagcctggatagcagagtgagacagtatctcaaaaataaaaagtatgacaacaatagtgtaaaggacaatagggggaaatggaatacatggttgaaatgttttttaacgtcgacggtagactgaaaagttaaagatgtctatttgagggccaagcatggtggctaatgccaataatctcagcactttgggaggccaaggcaggaggatcacttgatgccaggaattctagactgcagttgagcaacatagcaagaccctgtctctacgaaataaaaatttaaacattagccagatgtggtggcatgtgcctgtagtcctaactactcaggagactgaggcaagaggatcactcaggcccagaagttcacggcttcagtgagctatgattgcactccagcatgggtaacagagtgagaacttgtctcacaataaaataaagatctctatttgtaaaccctagagaaatcactttaaaaaaaaagaatccaaaagaagataggatatcaggataatgtggaaacctgcggttggaggagttgccatggtaatgttaactcccaccttcatctacaggcttttgttgtggaggcttttgttttactgtgtgccaggaccccagaacaaagaataggtgggaaaatagataacaaacagcaatatggtaaatttagacccagtcattaataatttcattaaatgtaaatggtctaaacatttcaatgaaaagactcggattgtcagactgg

SEQ ID NO: 15639 - DNA, 1034 bp, Homo sapiens
aaaaatagaaactatgtaggaggaagaacacatggtttctggtcatactctgtcaagaagtagatatgtaacatattgggcatttaacttaaaaattctaagtcatgttttctttttccactataagattgtactaggtgatataaagttcatgtcacttaaaattcaacgactgtgtaagtagctctttcagcttttcattaagttcatttttggaaatgtgcacatctatgccatcattgggcagttataatttggggatttaaacacctggcagtgattgaccactgtgactttgcttattccctttctctcctcagttaccgagctgatacccagacataccagccttataacaaagactggattaaagagaagatctacgtgctccttcgtcggcaggcccaacaggctgggaaataattgtgttggaagcactgggggggttggggtgggcttggaacacaggtgtgtacagcgtgctgtagtggaagttttgtatcatagtaatcctgtttccactttgttatactctagccaagattgactgtattagatgaaatgtgaggatcttgttcaatcggaaacccccgttacctcctctttttctttctctttctttttttttttttacttaaacatttttatgatgatttagatggaagttgttcttcgtcacttaatgttggttccagtccttcaactgttcatatctactttataacattcacatactaacccttcttcaagatggggtggggggtggaaatgcagtttagccatgtcctcaagataaagtcttggtaaaaataaataaatgtcctttagttatattttctccctgagtgctttttttttttttgtctttgaacattgaattttcttgcaaagcattttttcattttaagtttaaaaaccaatagctgctacacaaagaatttgaagaaagtttaagtagtgcgcaacacattttgctgtgaagctaataacacttttacctcacttttccagcataattaaatgaatcttaatta

SEQ ID NO: 15640 - DNA, 1033 bp, Homo sapiens
agtttgctaatttgtaaaattcagacaaatctagttcataagactccttgtgaggatcaagtgcttgctgagcacagcattattagatatgcagcaactcccttttcaactagattgaagaagtcaggatagagttttatttttaattacaagcatgttcttaaatttgccaggagtagaatgatatgaattttaatgtctacgtgtgagataaattataaatttcaagggagatttaaaaggtgttgaggttttttcaacaatatgaaaattgagcagagtaaaacagttacaagtgacatgttaatgatatacaagtatgtcattaatgacataacataacttttctaactttgtactagactttataaaaaaaaaattttagagacagggtcttgctatattacccaggctggtctcaaactcctgggctcaagtgatcctccttcctcagcctccccaaggagtgatattacaggcatgagcaactgtgcccggctgcattagactttaaaatgtaaactagaaaccatatctagcatactaaactgatttttaatacaatatttgctatattaaagcaacatagggggaaagctttaattattacctagataattcttcccacctacagtatttccagaaatatagaagagaggttaatgataatttatggttttttagtagtttcagagtgttaaaaaccgtaaattatcatagcttgaaaacctgtaactatttgtttgtttctaatgttgaaaattttttggcctctgaaaaactttcagaatcaaatttaggatttaaaactattttccccaggtgactttggttatgtcctttttgttctttgaatattcaggagaaataaggtattgtttccaaagaggtaacccactgccacagcacatcctgtgatttgggccgttactcctcagaccagagactgggtccgtttttggtttgtagatggttgtgtgctcatagtttctattaaatttacatggcagtgacctaggacttttttaaatta

SEQ ID NO: 15641 - DNA, 1032 bp, Homo sapiens
caatggggaagcaccagggtcaggcgcaaggcagaaggagcaagaggaaaacatggacaagaggctctactgtggattcagtggcaaagaatgggaggggcagagtaagcaggtttaggattatcgggtttgaatgacttgattgagctgtagggtgtagagactgcctctactgtctggcaccaggggtaattagggcagctggatagtggtctggagtgtgagagctccctaaaggaggtggttggaggtgtaggttttggattggttgatctgtatatgaaaggtgcacgtgcagggtgagtcctctactatcactagaaattggctggtcccaggagaagtagtctctctagagacagcaatgccccagatgtcaaagcatcagaaaatacagaaaaaaaattaaaagcatgattaattcatactcacaggtctagtttttgtgtagttaagagcaacctaaagaagttgataactcgtgttgcaggtcaggtttcccagaaatcatattctcagatgaagatttgcatgaaggaggtttaatgctcaaactaagccctaaggctccatacctgtggaggaagtgaaagaagcccaactgggcacagaaggtggaacacaatgccagtcacacaaagacctcagtggatcctgggccatgaggagctctaagcacagatgacccttcagaaatgtctccaagtggggaaaggaatcatgctagtcactggatgtgggcttcccactccaccccatgagggcatgaccttaagtgagagagctctttggacacagggcatcctaagaggggcactcagcagccacattgggcaccaagactctcagcagctagaagaagaaggtatagtcccaaaggggaatctgggctgcacaccttagtatccattagaactggaagtaggctgaatcccaggcagggatcccctggagaacacaggtaatttttaaaaaaatcaagctatgtgtctgaggctatgtggtaagacatctcagttttctgctaggaaa

SEQ ID NO: 15642 - DNA, 1022 bp, Homo sapiens
ctgtgctgcacgttctccaaccaaatcagaatgttaaagctcgaaggtatctgacctcccattttttaaattatgaagatgaaattcagaaagggaaggtaacttatccaagattacatggctagctatgatagaaagttagagttggaaaggacgttagaaagtgagggtttgaaaggactttagaagctgcttattcaatgttctctctgccctttcccatcttaggcttctccattttacttttatccatcaataaaatgttaacttcaaaaagaatatggcaattcttgggtaaaagatgctctggaagtgtgagtccgggagtattatgtgactaatgtcttaactaagaataataatatattatggactagttttaatctcttgtttcaccttgaactgttcaggaaggaaaatagcccacggaaattttttaaaaagtctttctctatctgaattgagaaaaggtgacaggcatagttggaacatcttttaggcagtgctggtgaacttcaggctaggccttgttccatgaaataataaaaattttcaaaataatgcagaccattcccttccagggatgctttctctgtaatgttttaaccccaagaaatctttctgtaaaaatctataaaaatctggagtgttccaggatacaatttgcacattctccaatttaactaaaacacaatcgattttttgttttctttttctttggcttagcaaggttttaagatagtctctttctggccacagagggagatgatttgcctctagaataccctttctgtgcttgagagagtcacaagactgcaagctcatggaggatgagagtcaagtagaggtggtgacatctctcccttggccaacatccctctctttctctttccttctgccttcagtggcagtagcaaaagtcctccttctctttaggtagacagtcagccactacaactgtggcttcctgaaatcctcagtggagctgtgtacttggcacagatttgtcttgaagaagggac

SEQ ID NO: 15643 - DNA, 1052 bp, Homo sapiens
tttattgcagcaatgctttggcttatagatacacccagttctgtaaatattctggctgaacaaagggcttcaggtcagtccaggagttctcatgttaaatagtttggttcatttacaacagaagtagcaacgggttataaatgtacctatataatatgacttcgatggggtgtgtagtagacggctcttttttgtttatggtaaatctcggtaaaatttcttctactcttccttttttttctacagttagctttgaataaccagtagcaaagtcctttctgttgctaactactacattgcattcagctgcttaacatttgcttcctgttcccaagatcaccagaggcaactgtagcatttgatgagggtgttggatttcatcaaaagatttttctacatagtttgttccagcttgggagaggtgggttggccttggcccccttgttcaaagctgtcacagttttgaagtcatttcaaaaccttcgataatcttgttccatctgcttttccaccttatcttacatttctgtaccttctccaatacttcctaccttctatgatacaaattgagggtgctctaagaaaatcatttagtaagttaagctactatttttaatacccagcccttcaaggaagttaaaatagcatcttccagaagtagcaccttcttatttatttttttagagaatagggtcttgctatgttgcccagccaggtcacaaactccagaagtagcactttctattatgtatattattttagagaataaattctttctattatctagctgcagagattttatgcacaaggtatgctttttatgtattttattttatttttgagatgggggtctcactctgtcaccctggctggagtgcagtgacacaatcttggctcactgcaacctctgcctcccagggtcaaatgatcctcctacctcagcctcccaatgttggtcatgtgccaccacgcgtgtctaattttttgtatttttggtagagacggggtttcaccacgttgcccaggctggtctcgaactcctgagctcaagt

SEQ ID NO: 15644 - DNA, 1052 bp, Homo sapiens; identical to SEQ ID NO: 15643

SEQ ID NO: 15645 - DNA, 1052 bp, Homo sapiens; identical to SEQ ID NO: 15643

SEQ ID NO: 15646 - DNA, 1052 bp, Homo sapiens; identical to SEQ ID NO: 15643

SEQ ID NO: 15647 - DNA, 1052 bp, Homo sapiens; identical to SEQ ID NO: 15643

SEQ ID NO: 15648 - DNA, 1055 bp, Homo sapiens
ccttgattacttattccattgccctaaacagttgtttagctaggtaaccctaaattgcaaacattactcttaggtgaaaattgatacccctagaggcatagaacttatatctatataccattatttgctgaaacaaaaagaatcagtcaagataagattgccaggaaaagtatctttaaacataggtaaggtttgttatgtcaactttaagccagtgtctttcccattgtaaaaatttctagctgcttgggtataggggcatgtccttacaaatggagatttcctttatagaagtaaatttattttacatagagtttcaaagtagccagctaagtgctagaaagttgtattttggagactataatcttgttagatacttagttcgtttcttgattagattactgacttcaaagtggagccctttcatgaatgggaccaggaaagtatttgcagtttccagggcctaatagatatatattttaaaaatttctttctttttttttttttaaagcaggctttcattatgttacccaggctggtcttgagctcctggacccaagtgatcctcccacttcagcctccctgggactacaggtgcaccacctgttgtcccagtgaggactgcctcagggcctgatattaagtgtctaaaaaccaggcagatttgcagggcagtgcatctggatctttaaaaatcaaggaaaccacttttacgtgaatcttgggtctccacaaagagcaaaatgccatgataccaggccacacaaacctccacagcgcacctcactacaaagacattaagccacacctttcttacctaaatgtttaaaaaataaaataaaatgagtagctgcctatagtaataaccattcaccataaacaactgctgttagtcacctccaatactgtagctcttgtcagtgacttaccagccataacatacacaaaggtctctttcacagtacaaagtaatctctggtactctcaaaagccaacaagtaatgcagtatggaagagagcagagttttagacctgagaggaacctgtccatgact

SEQ ID NO: 15649 - DNA, 1055 bp, Homo sapiens; identical to SEQ ID NO: 15648

SEQ ID NO: 15650 - DNA, 1055 bp, Homo sapiens; identical to SEQ ID NO: 15648

SEQ ID NO: 15651 - DNA, 1055 bp, Homo sapiens; identical to SEQ ID NO: 15648

SEQ ID NO: 15652 - DNA, 1055 bp, Homo sapiens; identical to SEQ ID NO: 15648

SEQ ID NO: 15653 - DNA, 1417 bp, Homo sapiens
ttattcactcagtggcttcctaaattttcataagcatttccatgtattaattatataagtcagtgaacttactgggagagtaaagcctcaagtttaggaatgaacttgggtgaaaacagtcatttgaaatttggttggttcagttaacaaagaaaggtttcaagttcatgttaatcacttaccagaactggtttcctagtatgtgatactcttcttctcagggtctaattcagcttttcttcatggtatcatcatgaagatatatagggaggagactgtctcaaaataccactagaaactaatcaccactagaaacttccacataattttgatggtcccataaggatctttctatctatggaagaaatatgaaaatcctctaagtatgcatttcttttgtaggcagcattgcccactctttgtgtttgtatagctgtgtactcaggaacctgatgtttaatcagatccgagaacatgtgtaccattccccctttgtgttctgtcagggacaagaattgtggatatttccagtgtttgggcccatattataaggcagtcgaacctgttcctgactgatctgcttactgcaagggaagtaatgaaatcttggggaaattatgacaacagagtgaagaggcaaaagaagcttgacatgtattaggttggtgcaaaagtacaattactttcttttgttcttcttttttttgagacgcgtctcactctgtcaccagggtggagtgcagtggcacgatcttgtctcactgcaacctctgcctcccaggttcaagcaattcacctgcctcagcctcctgtgtagctgggattacaggcatttgccaccatgcccgggtaatttttgtatttttagtagagacagggtttcaccacgttgaccaggctggtcttaaactcctgacctcaagtgatccacctgccttggcctcccaaagttttgggattacaggcgtgagccaccccgcccagccataagtaccactactttcaatggcagaaccgcaattacttttgcaccaacctaatagcatggaatctctcctgttgtctgctttctcaactgtaagaagggacttgggctagatgacttcagaggtctcttccatctctaagagttcattctttggctcattttatgattatttatgttattttatgtttcctaccatttggaacttcgttttgtttttatttcctgccattttagactaatagtatgagctgaagaattacaaaggcagtggctacaatctcaaatgtcttcaagggttgaacagtttaccttttatctttagtggaatcttgtttttttctacaggagtccagcttgattatagtatctaaggctctcactttttctttatcaaattgaaagtctcttaatgcgtctcaaaactcagtt

SEQ ID NO: 15654 - DNA, 1417 bp, Homo sapiens; identical to SEQ ID NO: 15653

SEQ ID NO: 15655 - DNA, 1417 bp, Homo sapiens; identical to SEQ ID NO: 15653

SEQ ID NO: 15656 - DNA, 1417 bp, Homo sapiens; identical to SEQ ID NO: 15653

SEQ ID NO: 15657 - DNA, 1417 bp, Homo sapiens; identical to SEQ ID NO: 15653

SEQ ID NO: 15658 - DNA, 1034 bp, Homo sapiens
actacaggcacatgccaccacacctgactaatttttgtatttttctgtagagacagggttttgccatgttgcccaggctggtttcaaacttctgagctcaagcaattcactcacctcggcttcttgaagtgctggcattacaggcatgagcccctgcatcctgcctttttttttcctttgaataatcttcacagatgataaaaatataaattctatataaattttatgatttttttatttctgtgaagaatcttattggtattttgataggcattgcactgagtctggagtttcctttgggtagtatgcacattttaactattttgattctttcaattcataaacatggaatattttctattttttggtgtcctcatcaatttatttcatcagtgctttatagttttcattatagacatctttcatttctttggttaattcctaggtagttaaatttttgttgctactgcaaatggaattactttgtaaatttctttttcagattgttgactgttggcatatagaaatgctacagatttttggatgttgattttgtattctgcaattttactgaatttgtttatcagttccaacagttttattgtggagtctttaggtttttccaaatataaaattatatcatctgtaaacaaggatcatttgacttcttccttttcaatttggatgccctttctttccttctcttgtctggttgctctagctaggacttccagtactatgttgaataacaatggtgaaagtggcatccttgtcatgttctagaccttagaggaaaggctttctgacttttcccattcagtatatactagctgtgagtctgtcatatatggcttttattatgttgaggtatgttccttctatacctagttttttgagtctttattatgaagggatgttaaattttatcaaatgcttttttagcatcaattgaaatgatcatatggttttcatccttcattctgctgatctgatgtatcacattgattgttttgcatgtattggactgtccttgc

SEQ ID NO: 15659 - DNA, 1036 bp, Homo sapiens
ccctggtgaaaatatgacccatttggggaccaggacctttgggccacagagtccggagttgcagtaggcaagaagcacaaaccaccccaatgagtcactgtgagtgacagtaagtgggaccactcctgtttccaggccttggttcccagacccatgtaaagatctgtagttcagtgcacacaattcattctgtgaaatggtagtatattgcctctgaacaagcgcttcagctttagctcagttgcaccatcagtagatatttccaatgctttattaggctggcagcccctagattatgttgtctgatatacagccagtatataccatgttctttggtccccttccaaaacttcttcactgtaaagtggtaccttggtctgatatgatattatacagaaacaccagaccagtgggtcaaatactccaaatgtctttgaatattggtgctcactgaggctcactgccttacctcagtgagataaggcaaattcatatcaagaatatgtgtttattactgtacgaatgaaccactggcccttccaggatgataatgaagaattgtagtcaatttccctctatgtgttcttctagaaattatgccagattaggggatcagcttggtctttattgttagttggctgatggcatgcctctgctgcagaatcccagaggcatacactgtgattctttctctggggcttaccacaaactccacccaacaaccttttctgtcacagacactttcaacatcatagggtctactagggagtatgaccccagtggaagtctgtttgcatcacaacctggacctggtgcagagctctttccttctatggtttccactcaaagatgacatcattatatgttaccaaatataaggaccagagttgtggtcctaggtatcaaatttgctgcctccaggaaccaaagcaatccccaggcattgtgtttccttcttcatgataggagatgcagaaaggaataatttggccttactttggaagggataacccggcatattcctggctcttagaaa

SEQ ID NO: 15660 - DNA, 1050 bp, Homo sapiens
cgccactctagtaaacccaacttctttcttctgttctcctggccctaggagtgttaggtgccttctgtagctactttgttgttggttgagttctccagaagcagatactgaattggagtttcaagtacaagattttgttagggaccaacagctgtgaaaaaaggcaaggaagttggttgtgcagatgagaaatacaagtacaggcgtaccttggacataatataggttcagttccagaccactgcgataacaggaatatcacaataaaatgagtcacacaaaatttttggttcccagtacataaaaaagttatatttacactacactgtaatctgttaagtatgtagcattatgtccaaaaatgcaataccttaattaaaaatcttttattgctgagaaatagtaacaatcctctgagcctttaatgagccatatgtttttgctggtggaggttcttgcctcattgttgacagatgctgactcttcagggtggtggttgctgaagattggggtgactggaaatttcttaaaatacgacaacaattaagtttgctgcatcgattgactcttcctttcacaaatatttatctagcatgtgatgctgtttgataggattttacccacagtagaacttctttcaaaatttgagtcagtcatctcaaattctaccactgctttatcaactaagtttatgtaatatattaagtcctttgttgttatttcaacattgttgacagcatcttcatcaggaatcaattccatttcaaaaaaccattttctttgctcatctataagaagcaactcctcaaccattcaagatttatcatgacattatggcaattcagtcatatcctcaggctccacttttaagtctaattctcttgctatttccacaacatctacagttctttccaccactgaagtcatctgtgaaggttagactcaatgtcttccaaactccttttaatgttaatattttgacctcctcacataaatcaggaatgttcttaatgacatctagaatggtgaatcctttccagaaaggtttca

SEQ ID NO: 15661 - DNA, 1032 bp, Homo sapiens
tttctcttgtctgattgctctagctaggacttccaatacaatgttgaataacagtggtgacagtgggcatccttgtcgtgttccagaccttcaaggaaaggctttcagtttttccccattcatgatgctagctgtgggtctgtcatatatggtggctttttttatgttgaggtatgttccttttataccagttttttttttttatcatgaagggatgttgaatttcatgaaatgccttttcagcatcagttgaaatgatcacatggtttttgcccttcattctgttgatatgatgtaccacgctgattgatttgcatatgttgaaccatccttacatcccagtgataaatcctgcttggtcatgatgaatgatcattttaatatgcttttgaatttggtttgctagtttttttttttttttttttttttaggatttttgcattaatattgattagcgttattggcctgtggttctctttttcttgatgtgtctttggttttggtatctgggtaatactggccttgtagaatgagtttagaagtatccctttctctactttttggaactatttgagcaggattggtattagctcttttttttttttttcaattctgctactagtttttttttttttttttttttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtgtatgtgccacattttcttaatccagtctatca

SEQ ID NO: 15662 - DNA, 1047 bp, Homo sapiens
aaaggagcagcaagaataaagaccctgagatgggtgtatgctttggtctgttagtggatcagcaaggagaccagctgaaatgaacaaagggaagaataaataggacatgaattaggtaaaaaaggagagagcgatagtgatggcaggaggtatattgggtacaaccttgtaaagcattgtacagacttttactatgaataagatgggaagccactggagcattctgagcaaagtaatgatatgatatgactcatattaaaacagaacttccctgatatatgggaattgagtgtcgagtataagaatggatgcaggagacatgttaggaggctaaggcaataatcaaggtgggaaacaatggtgaatttgaccagggtgataatgatggggatggtgagaagtgattagattttgaaggttaaaacaacaggatttgctgacagatcggttgtgtggtatgatgaaaaaaaaaaggaattaaggatgactgtaagcttttttttttttctaggcaacttgaaggatagagttgggattaactgagatggggaaggctgtgtgttaagcaggtttagggaggaggtggtgggaggagggagctaaagaattcactttggacatatttattttcagatgccaattagacatttcaagtgatgatgccatgtaggcagtttttaggttgaatttaggttttacagaagtcccaggcaggagatatacattttggcatcatagaatatatatggtctttaataccatgagatggatgagatcatcaatagaatgagtacaatagaatgagtacagagagagttaaaaagatgtccaaggactgagcactggaactctaacaacacttagtgttagggaagatagggaagatataaaataatagcaaatgaatatgagaagtagcagctactgaagtgatcccatggaaaccaaatgaagaaagcaattcaaagaggaagaagtcatcaactctgtcaaatgcttagttttttgtttgttgtttgtttatttggcaaatgtttttccctttgc

SEQ ID NO: 15663 - DNA, 1070 bp, Homo sapiens
agacattttccccattgtcttggctattaacagtcagctcctctttacttatgcaaatttctgcagcaggcttgaatttctccccaggaaatgtttttcttttctactgtatggtcagactacaaattttctaaacttttatggtctgcttctcttttaaatacaagttccaatttcacaccatctctttcttcatgaatatgtgcatacacttttagaaacagccaggtcaaatcttgaatgcattgctgcttagaaatttattccaccagataccccaaatcatctctctcaagtccaaagttacatagatttctagggcaggggcaaaatgccaccagtgtctttgctaaagcatagcaagagtgacctttactccagttcccaataaattcctcatctccatctgagaccacctcagcctggacttcatagttcatatcactataggcattttggtaaaagccattcaataagtttctaggaagttccaaactttcccatatcttcctgtcttcttctgagccctccaaactgttccaacctctgaatgttacctagttccaaagtcacttccacattcttaggtatctttatagcagagccccactcctggtaccagttttctgtattagtccattctcacactgctataaagaacttcctgaggctgggtaatttataaagaaaggaggtttaattgactcacagttctgaaggcttaacaagaagcatgactgggaggcctcaggaaacttacaatcatggtggaaggtgaaggggaagcaagcactttctttacatggtggcaagagagagagagtgaagggggaagtgctacacacactcttaaaccatcagatctcatgagaatcattatcatgagaacagcaagagggaaatccaccccatgatccaatcatctcccaccaggcctttcctccaattcaacatgagatttgggtggggacacaaatctaaaccatatgttttctgatttttgaaaaaattttataatttttttctatgagtctgtcacatttcttttcaggtttgctcataggtgtttt

SEQ ID NO: 15664 - DNA, 1880 bp, Homo sapiens
gctgtcagtggggtagtgaagtcccccactattattgtttcactgtgtatctctgaagtctactagtatttgttttataaatatgggtactttgacattgggtgcaggtatagttaggatagttaagtcttcttgattgaattgaatgttttatcattaaataatgccatctttttcattttctttttttagctttgttcatttaaagtctgttttatgtgctacaagaatagcaactcatcctcttttttgtttgtttgtttttcatttgcatgatagatgtttttccatttctttacttttagtgtgggaatgccgttccctgtgaggtagatctattgaaggcagcagaatactgttttttaaatccaatttgccactctgtgtcttttgagtagggtatttagaccatttacatgtaagactaatatcgatatgtgaggtttcatttctgtcatagctttcttagctagttgttttgtagtctcaattgtgtaattgttttgtagcatctgagaactttgtacttatgtgttgttttatggtagcagtatcattctttcgtttccatctttagaacttctgtgaatatttcttgtagggcttatctggtggagacaaattcccttaacagttgcttctctaataaaggctttatttctcccttatttatgaagctgtttggcaggatatgaactttttggctgccatttttttttctttaagaaggcaaaaataggcttcagtctcttctggcttgtaaggtttctgctgagaagtctgctgttagtctgatgggacttcctttataggtaatttgggccttttctctagctacctttaaggtttttttttgtattaaccttgggaacggttgtgttgtatagtatctctcaggtgtactctcagtttcttatatctggttcttgacctctctagcaagattagggaaattttcctgaattatttcctcaaatatgttttccaatttgcttgctttttctttgtatttccaaaggctttgttcttttttttgctttatctgggttaatttgaaggaccagccttcaagttctgaaattctttcttctgctttgtgtaatctgttattaaaacttccagctgtattttgaaattcctttagcaaaattttcaatttcagaagttctatttgtttttttcttaatacagctatcttgtctttcataccctgaattatttttctagtgtctttgtattggatttcaactttctcttggatcttactgagtttccttgatatccttattttgaatattttatcatttcaaatttttcagtttggttagtatccattactagagagttggtgcaatcctttggaggtgtcaggacatcctggctttttatactgccagagttcttgctgattccttctcgtctgaggagctgctacttctcatttttgagtttgctatcatttgcatgggatcttttaatttttcaatcctttttccctttagggtatgactgtggtgtatgttgtgtatgatctttttgtttcatttattggtactttcagtgggccaaggctgtatatgggtacgttggttgtggatagcctctgtgtagtgactttcttagatgctgattgttgtagcgatgtattgaacatatgagcggacacactatttcctgtgggattgagagtgcaggtgcataggtcttaggaaacttatctcagactagcactaagcccttctggtagcaggttttttgtttggtggtgcagttcaggctgtagtccagtagatggagatgacacttaagagtaggagacagctcatgcccaggctgatgtcaagtggtagcacctgtgttgacaggaggcatgagagggg

SEQ ID NO: 15665 - DNA, 1112 bp, Homo sapiens
atcttgttttgtttattcatctttcagtggacatttgagttgtttccatcttttggctattgtgaataatgcttctatgaacactgatgtacaaatatctgtttgagtccctgcatccaattcttttgtgtgtgtattcagaagtggtaattctatttttaactttttgaggaaccaccatgctgttttcaatggcagctgtaccattttacatttcaaccagcaatccctgagggctccaatttctccacatcctcaccaatccttgtgattttctgttaatagctatcctaataggtgcaagctgggatcactctggttttgatttgcaatccctaatgactagtgatattaagattttcatgtgcttattggctattagtttagctccttttgaaacatctattcaagtgctctgaacatttttttaaatttaattttttagactggatgtgtgtgtgtgttttattattgtttatttttgttgactttgtcaaatatcgattgtaggtgtgtggctttatttcaggggcctctattatgttccattggtctatgtgtctgtttttgtaccagtactatgctgttttggttactgtagtcttgtaatatagtttcaggttggataatgtgatgcttctgactttattcttttgtttaggattgccttggccaatccatgagtgtggaatgcatttccatttatttgtgtcatctatgatttctttcagcgatgttttgtggttctcattatagagatcttttgcctccttagttggatgatgtattcttaggtattttgttttgtgtctattataaatggaattgcattcttggtttggtttgcagcttgaacattattggtgtatagaaatcctacagatttttatatgctgattttgtatcctgagactttgcttaaattatttattatgtctaggagtctttggcagaatccttagagttttctaggtatagaatcatattgtcactgaagagagatattttgacttccttttttccctatgtgtatgccttttaattctttgtcttgcctaattgctctggctaggactttttgagcagacacttccaaaaagacatacaagcag

SEQ ID NO: 15666 - DNA, 2608 bp, Homo sapiens
ttcatcatgacttttttcttcatcataactgatatttttcagatgcactttgaagacataaaggatgttaaagtagtaactaagcatatttctttttgttcagttacataatcctcagtattaaaataaacagttgctgacattttggaagatgaagaaaaggaaaaacctcactcaccaataccattaccctataaatactgtaacagtgttgtgaattttaatcttattctgtgtgtagatacttcttttttcaataaagaaaaggaattttattttttttaaagttatggaggctgagaagtccagcattgattggctccatctggtgagggccttcttgctggtaggaagtctgcaaagtccctaggcagcacagggtatctcatggcaagggggctgagtgtgcttgctgcatgtagatgcttttaaaactgtactttaatcattcctttcgtacaattttactttattatatctgttgtaagcttttccccatgtttatgtagtttttatagactgttttagtgtccgaatttctgtaaatgattgtatctcagttttctttctgtcttatatttgggatttttcccagtttacattattttatataagactgctgtgattatatctttgtataatgccttttcagtgtttggtatttatttccttaggatagagttccagaagtggaatcactagagtctctgcatttttattgctcttagtccatattgctaagttgttcctcaaaatgttggactagtgatcactcaaacagcgaagtttgaaagtatgtatcaggttttccagaattgctaccactgaattttgtcatttatgtttttagtgttaagtagcaaaagtggtattttagtatttaaagtagttgaagaatttctcatctttttctgcttttatgaaatgtctaattttatgtattgtgtgagatttttgtctttcaacttcttattttgacataatttccggcaaacagaaaagttgtaagaatagtacaaagaattcctatatataccttttaccctacttctctatctgttaccatttttctgtattttagtctttattttctttctctctttcttctgtctctgactcttgctctcctgtcgctgtttctctctttctctctctctctttcgatgttatttgtgtttcaccagtggtgccaataatgtcatttacaacagaagaaaatcctgagttatgggccacatttagttgtcctgtcttttcagtctcctgtaacctggaatagttctttaatcttgcttgtttttcataaccttgatatttgtagttgaagccatgcattttgtggaatgtctctcaatttgggtctgtttgatatattctcatgatgaaattcacctcatgcatttttgtgaggaatgccatagaaaagatgcttacggaggcacatgctgtcagtttgctccgtttctggtgatgttaacattaatcacttggttaagttagtgtctataaggttactccactgtaaagttatttttccttttataagtatcttggaatattttaaggctctgagtatcctgttatttctcaaacttttacccactggctagcctccattgataagtcttgcctgaatcatttattactctgatggttgccaaatggtgattttctgatttcattgttttatgttattagttagcttcctgctataaacagctttcatttctccttcctttctaaaaatatctttgtggactcctggattcttattttcttcagtgtgtatatttctttactatcattcatattgatgcccaaattgtcctaaatcaggccaatgggagctccttcaagctgatcctgtgtccttttgatatgacttaatcatccattgagtgatttctttgctgttgagcacaatcagatattccaggctcatttcaacgctggagccaggcacttctatttcttttagtggagaatagcatttggaaatcaagatctgcgtgctgggtatgttcattgctactggggtgtcattgcttctaggccttttcaactgacagggtcagtaatggagtaaaactcattgtaatcgtgtaacttatgtgggttaagaaattgaactttgctagtaccccagaagctcctttatgtcccctcctgattttaacgcttaatcaccttcatcctcagttttatggtaatcacttgtctttgcagttttagtctgtaaccatgcatccctaaataaatgtttagattgcctattttaaaaatttaatataattggttcaatgtgtgcatttcatgtatgacttcttttatgtctgtgatgttcatcagagttgtttcatttgtagttattttaatttctgtgtagtattatgtttcatgaatatattacaactttaggattcattctaatggtgatagacatttgtgttgttcatagtttttggctattaaaattgcttttataaatattctatttttatgaacctgtaagatgcaatttcaggaatattctaatcgtgtgaatattatattgctttttggtgtatattatgggctgaattgtgtcatcttcttcaaacaaggtata

SEQ ID NO: 15667 - DNA, 1050 bp, Homo sapiens
cattgtagttttttactcttaatctttgagagctgctgaactgtcagcaggtggtgccattgtggtagtgattgtggtagtgaaaagatgaattgggagggaaaaagtaggtattgaggaggtgtgaggaagccactgtgattcgaggtttcttcatcaaatctgtatttttacacaatgatgttttctgttacattattgaaaacaggtattgaaccatcatggtactgggttagaataattatatatcttgtttttacatactgtcttacttaaatgctatgtagttttgtctagtatcattaatttccttgagttttcaggttgttaggtttgtaactgggttcttgtatacatctgcctggggaaacagctagatctagaacttgagataagcagttaaaaatgaatttgaaaatgtgagccattcatattaaccatttatctcattccccccacccatatctccctcccaaaaaatctacttttgatatctagtggatcaaacaaagaaagaggcagaacctataccagaaactgtaaaacctgaggagaaggagaccacaaagaatgtacaacagacagtgagtgctaaaggcccccctgaaaaacggatgagacttcagtgagtactggacaaaagagaagcctggaagactcctcatgctagttatcatacctcagtactgtggctcttgagctttgaagtactttattgtaaccttcttatttgtatggaatgcgcttattttttgaaaggatattaggccggatgtggtggctcacgcctgtaatcccagcactttgggaggccatggcgggtggatcacttgaggtcagaagttcaagaccagcctgaccaatatggtgaaaccccgtctctactaaaaatacaaaaattagccgggcgtggtggcgggcgcccatagtcccagctactcgggaggctgagacaggagacttgcttgaacccgggaggtggaggttgccctgagctgattatcatgctgttgcactccagcttgggcgacagagcgagactttgtctca

SEQ ID NO: 15668 - DNA, 1050 bp, Homo sapiens
ttaataattgaatatggtagcttgagtttgtgaaacctgcatttccatttgttgctagtaggttttgtgagaaaagaccatttaatacacttaaaataacaaaggtaatttcaagccaataatttggattgtgtgatttaggtaattatgaaaaactttagctttaaaactcttacggttgtgcgtgcttatataccaaaactgaagtatctttaaaagacatatgtatcagcttaaatgttagaatttaacttcagttaagagggagagttaacaacacttctgtatatgtgctgtgtttaccttattttgggaattatctttggtatagcagccattaaaaataatgaagtttgggtatattcatggtggataaagatttgtaaaatatgagacaccaaactaagtaggcaatgttttgatttggacttcgtattttaatagataaagtcagacctaaagccaaaaggaaagaagaaccaagctctatttttcagagacaacgtgtggatgctttacttttagacctcagacaaaaatttccacccaaatttgtgcaggtaatgagaatatgtgtggttaatcttgatttgacacttctttatggcatatatattaatttttaattgagaactgtttcagatgtgacctaaaagtacaattttcctcattagttaaaaaatgatctctgtatcaaaggaaaggtttcgaaagacttaatggaagaaatgggtaaatggaatggaattaacactgttttgtgtttcttactgaaacttcacaaactatgaggactgcatgtagataatattctcattcaaaaggttgctgaaagtgtcacaggtggtaacaaaactagaatatgaaactcatgctctttttactctacatgccaccttccagcctgatgtagtagatatctgaacaacctaaatgatagaatagttaacacttgtgtaacaaaaagaacagaacatctgaggtagagtgtttggcataataaacagaggagacaggagtgatgaatagagataccctgtgttggggttt

SEQ ID NO: 15669 - DNA, 1049 bp, Homo sapiens
aaatttagagtttattttccttttacaagcttactgcagtgcatggtattcagtcagcttttgatgaagctatgtcatactgtcgatatcatccttccaaagggtattggtggcacttcaaagatcatgaagagcaaggtaagtagaacatccataccctcctaaaacactttttgatcctctgagaatgaagctgttttctttaggaaaatggctgttgatcttttctaagtgtgtttcactttttcatgggatgatggctttgttgcagctgagattcatgtaactagatgtggtaataatagctttcacataggaacagatgcaagttcactctgttagttaactggtagtctttgttaaggtgattcaaggttttaaaatatttggggccaggtgtggtggctcactcctgtaatcccagcactttggaatgccaaggcaggtggatcacctgagcctaggagttcaagatcagcttgggcaacatagtgaaacctggtctctacaaaaaaaaaaaaaaaaaaaaaaaaaaaaaaggaacataggagagacagtggtgtggaatgagcagagatgatattccttacttacctgactgttgagttatcttggtatctggaactctttattcctccagtcttcaaagcagaggagatgagagagattgctttttagagccctatccccagatggccagtctgttttctgatctttgcatctcatcacctcttgtggctccaggtcctccaagtttccatgtaatctgctactgtcttcatcatattttactgttcgactacctccagaaatgtgcctgtaacagcatacttgtattctccatttccttttctgagaaatagcaagtcagaataaattactgagggaaacagcatttgtatagaattcagacctgtatcttcttaatagtaggtataagcaggaacatttgatgaaggaaagtttgcctttgttgactaaaattggcccaatggctcttttcccctacgataaccaagtgttcggagtaacacttatctggaatcctt

SEQ ID NO: 15670 - DNA, 1196 bp, Homo sapiens
gctccctgtggggtcagggggaaagaccttgatcaaaataaagtggcacaaaatgtaaagtcaagactgtggtgagtaccatgagcatggctgataacgggacatgcctcgagaggagtgctggagaattctctgaggaagttttgtttccgacgtgatctgagagaggcaagagtggagacaaagtggaaagggaaggtggggcaaggaggttccaggcagtgaggccagcaggcccagtgccccgtacagtgtggcctcctgggaggcaaattgcgtgcttggattctcttgcctccatcctttcctgtggttggtggagaaggattcgtaaggggaatggatctctttgtgggccacgtgccttcatttcccagcggttgctctagagttctgcctgcctcttcttcctatttcatcaccgtggaggttctctgcagcttactcagtggggcagcaagtagctcaggacaccaggcaacttttaagctctcataatgctgtgctggagttggagcagaagcttgtgctgtatgaagggccttggttggggtttctggaccatgagcttttagttgcagaaaacagccttggtgaggggttgagttcagggcaagaaaggctttgaaaggcgtgtggggtctgatttccagatgagtatttagtctcttcctctttgatctgtttcctctgatttgagccactattgccttgaaagtaagtaatacattttattgtatcttcccttccccacatccctcccaaccaaacctggtaagagctaggtattgaccacagtttgcgggtggtctgtggcaccgtcattgttcaggttcaagatttgtccttcaggatctctgaggagatgagagaagagcctgcctatttctcctttcctcctcatctcttggaaaaatttccattccttaacctggttcttcaccttgtttcgatgatgtagctcagggtcacttatggatggcacacaaagcagtgatgtcagtggtctggttgagtcaggagaaaaatgtagcttctatcccaggtccagggagcccaggtctttactgtggagtccccttcaatacccctgacagcctcttgtagaaccacactttgttcctcttataatgtaaagattaacatagggccagggaaccacgcaaaatggttccatgcaaaatgtggatacattc

SEQ ID NO: 15671 - DNA, 1075 bp, Homo sapiens
gccctccctgacatgctgaataatcaccagtgcactctcaatgtaatcttcctagcagccttgtcagaagtgattgtcccacttagcagatgagtagaccagcactcggaagggttaagtgactcaggccaaagctgtgcagaagtgatagggctagactagactccgggtcttccttctgatgttcgcattagtgcatgtgccattgcatgttactcccaataatgttcagtgacaattgtcttgcttatgcctggctgaaagtggcagagcattggactaaagaggttatttgacagcatggaattgaaacccacaacagaagaatatccatcctcctcctgaggaaaggaaaaacaattggatgtgagccttcacattgacctctcttcccaccctacccacctctgcatcatctatacagcacctgggccttgtacagcgtggtctcacccaacccttgcaaactccctcttgttcatctgccttcagattgtaatatttatgtagatctggtacagcccgcattctggggcccactgttcattgtgcattcagtgcaatggggcaatgttctgttttatgcacccacctatgttacctacatagtggtttgaaatttcatggtgtgctctgtgataaacaccccaggtctgcctctgagggccatattagggctattgcaggcagtcctctgagttgattttgcccagcagaggttgagaaggttggctctaaaggaagtctctgtctgctaaatggcccagggagaaagaccttgcctccctgcttctcctgccttaatttcaggaaactctctgcagcttaccccgcctccccccagcaccatccttctggtctctgctgtgctaatcacagctcattctggctgcaagcctcatttggggaacgaatgctccaggactcccaaaatgggaggagggaaattaaggacagttggccaaatgagtcagcccaccaccaccaatgagtcatggggaccacccgcctctccaagcctgggaagctttgtggggaagggccctctgtcttgttcagggctcactgggaaaga

SEQ ID NO: 15672 - DNA, 1033 bp, Homo sapiens
attatttctacaaatattttttcttccctttcttcaattacacatatattaggctgtttgaagttgccccacagctcatttatgccattatttttttttcttttctgttttttcctgtgggtttcattttggaatagtttctattgctgtgttttcaagtttatctgtcttttcttctgcaatatctaatctgacattaactccctctgatatgattttcatcttgcacattatagttttcatttctagaagttaaatttgagtcttaaaaatacatatgtatctcccaaatttttactaaacttgaacacagagcatacaaataatgttttaatgttcttgctactaattctaatatcagtttcagttctgggttggtttcaattgattgatttttctccttattataagtcatattttccagcttctttacatgccttgtaattttgggttgggtgcctcacattgtgaattttaccttgctgaatgctgtagatatattttattcctataaatgttcttgaacattgttttgggacatatttaagttatttgaaaacagtttgatgttttcttgtcttgcttttaagatttgttaggtggagccagagcagtacttagtctagggctaagtattccctattagtgaggcaagatctttctactgtactctacccagtaccccgggaatcatacagttttccatattggctggtggaaacagactatttccgcccccttgtgcacaccgagcgctgttacctctaatctttttgggtagttcttttcccagtcctatctagtttcctcacaggcataaatggatcaacgctaagctgaatacttgaaagggaccctctggatctccacattctctgtgcagctctcttttgtttacccttcagttccttgggttctagtcactgtggtctcctcagactcttggcattttctcttcaactcaaacgtggggaatctgcaggtctccacctgtattcctcctccttgtgttccagtctggagactctcttaa

SEQ ID NO: 15673 - DNA, 1001 bp, Homo sapiens
cgtctcgaactcctgacctcagatgatccacccgcctcagcttcccaaagtgctgggattataggcatgagccaccgtgcccagctgcccagacccttttcatcatcccggagagaaactttgtatgcattaaacaatacttttccatcccctgcttcctaccatccctgggaaccaccattctgcattcttagcaccccatatcaggggaaacatacaatatttgttcttctgtgtctggcttatttcacttagcataatgtcttcaatgtttgttcatccatgttgtagcatagtcagaacttgattcctttctatggccattgtatggatagcccactttttgtttacctgtttaactgccgatgggcatttgggttgtttcaccttttggctgtttttgagtccccattttcatttcttttgggttttcactatgcctaggtctccttcatttttggactgtaaaatctagggactaagctaggctcatgcctgtaatcttagcactttgggaggctgaggcaggaggatcccttgagctcaggcattcaagaccagcctggacatatcatgagaccctgtcgctacaaaaaataaaaaaaaaagccgggtgtggtggtgtacacctgtggtcctagctactcgggaggctaaggcaggaagatggcttgagcccgggaggttgaggctgcagtgagctgtgatcacgctactgtactccatgtactccagcctgggtgacagagcaagaccttatctcaaaaaacaaacaaacaaacaaacaaacaaacaaacaaacaaacccaaaaaattagcggctacatttctagataatataggcattctccaccttataaactaaacaaacaaaaaaacccaaacctaatagtattacagaattcaacctctctgcctctccctctattggtagtccattgcgttctgggataaacacactgggaactaggaacccagagactcaattctcccatccccag

SEQ ID NO: 15674 - DNA, 1050 bp, Homo sapiens
agatacccaacatcattagtccttaggtagatgcaaatcaaaaccacagtgagataccactttatttatttaattttatttacttattccctcctaccccccttttggctgaagtgcagtggcgcgatctccgctcccggcaacctccatctccccggctcaagccgtcctcctgcctcaacctcggagtagccggaattacaggcacgagccacaacaccaggctaatttaaaaaatatttttggccttccgccacggccgccatggagagcagcagccatggctctgcgctaccttatggccgtgggcctcaacaagggccacaaggtgaccaagaacgtgagcaagcccaggcacagccgccgccgcgggcgtctgagcaaacgcaccaagtttgtagcgggacatgatccgggaggtgtgtggcttcgcttcgtacgagctgcgcgccatggagtcactgaaggtcttcaaggagaaatgggccctcaagttcatcaagaaaagggtggggacgcacatccgtgccaagaggaagcgggaggagctgagcaaggtactggctgccatgaggaaagccgctgccaagaaagactgagccccctcccctgccctcttcctgaaataaagaacagcttgacggaaaaataaaataaaaataaaaaatatttttgtagagacggggtctcgctttgttgccgcccaggctggtctcgaatttctggcctccagcgatcctcctgccttggcgcagcgttgggatgacaggcgtgagccaccacgcgcggcagcaaatctgagatttaacacagagagccagtatgtgcccagcgtatgtgtatgtagtgcacagaatatgtggaccaccctctataaaggttcatgcatgaggaggtcggctctctctcacagtctagcagttttccacacaaaagcggcacacatttttgcaccggtctccaaaatggtgtctggtttgggagcccgcagcttccggaattacaggctctttcctgcttccagggcaccattccaggcctggcctcaat

SEQ ID NO: 15675 - DNA, 1085 bp, Homo sapiens
tacctaaagtcaggaagaaatttaacaagaagataattaaaaaaaaaaaattcaaatgccactgaaaggggagaaagtctggcaggtaaaaagcagttttgataggcaacttgcctggtaaatttcaagtggtttaatatagctgcattttagttatttgaccttattacattgcatacttttttttaagttcaagagaagcaatagtcttcacttttagtacattactgttggaaacagtgatcattttaattattttttggaacttgtgtagttttcattagtgtttggatgaaatttgttatacttgaaagctatgtatttaattgttttatacaatagttggaaagtgatattgcccccttgtggctacttacaccactggcattcattagtttagttttttccacactgaatagtagtaattagtagtcattggtggcttgtcaccattgggaccatcttcccaccttgtatttcactataagcgggaactaataccatgttgggatcagtattggtgataacaccatgccatgatctgcacaaatttttatgaaacagaagctgaaatctgaagcccttaacctttgagcaagaagctctgtcagattgccttgctatcccacctctcaactcatgtctatcttgattctgatagtgttcctacctttttttttttttttttttttttgagacagtgccttatactgtcacccaggctggagtacagtggcacagacatagttcactgcagcctcagcctcctaggctgagataattttttttttttttttttttttagagatgggttctcactatgttgcccaagctggtttcgaacccctgggctcaagcagtccttccacctcggcgtcccaaagtgcagaagacagaatttgaggcaacagtagccactagaaggtaaaaagagaggctgggcgtggtggctcacacctgtaatcccagcactttgggaggccaaggcgggtggatcacttgagtccagtagtttgagaccatcctggccaacatgctgaaaccctgtctctcctaaaaatacaaaaaattcgctgggcatggtg

SEQ ID NO: 15676 - DNA, 1035 bp, Homo sapiens
tgagcttgttactatttctgtgccattttccattttatgttccttcaccaatttttttcgtgttaagattacctgtgcatttctcttctggtacaagtttcctgatttagtaatttgtaatagatccactgtatgttgctattttcttcagtgtcagaacctgcttagttgctatattggtttatatctacccataataaaaggttttaaggaagataataattttaaaatactaagctggatatttatagtgtagagtaattacttgagaaagttatactttcatttttcacttttggttagcttgatccttctgctcagatttcaccaatttaaattccaagttactaaagttctgtccatgttagatcggttttctttgaaaaaaaaaggatttttgtctttattgtgaaactttttcatgatacatttgtcagtgtgaattctacctataactgaaattattattaaagtagaaagtgttagagcagcgatgataaaataattctgaatgtctgaacatctgtgttgccacttccacatttttattagttcctgaagcatgttttttttttgttttgttttgttttgtttttgagatggagtctcgctctgtcacccagactggagtgcagtagtgtgatcttgcttggctcactgcaacctctgcctcctgggtccaagcaattctcctgccacagcctccagagcagctgggactacaggcgcatgtcaccacgcccggctgatttttgtgtttttagtagagacggggtttcaccatgttggccaggatggtctcaaactcctgacctcaggtgatccactggccctggcctcccaaagtgctgggattacaggcatgagccaccatgcctggccagcatgttgtctttttaaagaggtgtttgtgccactaagatgtatgtaaattcttttttttctttgtttctttcttttttgagatggagtctcactctgttgcccaggctggagtgcaatggtgcgatctcagctcactgcaacctccacctc

SEQ ID NO: 15677 - DNA, 1079 bp, Homo sapiens
cttttcttttctgatttaaaaagcaatgaagctgggtttcctctgaaaaaagtctcgtttgtttattacaaggcacactgtatcatggttccctggtttatatatcaccattactctgtaatgcctgcctctgtgtagatgtgacggaaagactgaccagtgattctttacacattgggaacctttgaagacctctttggtttgtagctgaaggaactttgcacagtagaattgcaaatcactgttgttctgagagtgacttgctctgccctaattggtctgtttgctgctgttgcttcttaatatttcaaagctatgcaaaatgatgtttccatgtgtctttatagcatttcttcacttcagcttacattagaacatctgcttaacccttttgctcttacctagcgtatgcccgcagagctgtcttgcctccaaatgtcatttttatttttgttaattaatggcatgctcttatctcactggtgatcttggggatcatagaattttagagttggatggcaccttaaaataggtaggatataaatacatttgtcagaaaaaaaaaagaaaatgaattcggggacacagttccaacaggtctaatatttcagtataatgaattatctttccaagaagattcaattaattatagagattgtgattgtatcagatgtcgcaaactatggcccactactgtatttgtttttgtaaataacatgttattggaacacagtcatgcccatttgtgtacatattgttatggctgcttttgtgcaatgatagagttgagtagttgcaatagagatcatatgtcctgaaaagcctaaaatattttgttgtctggtccttcacaaaaaacggttgctaatccctaatttcaacaatttaaaaactcatttcggccaggcgcggtagctcacacctgtaatcccagcattttgggaggctgaggtgggcggatcacctgaggtcagcagttcaagaccagcctggccaacatggtgaaaccccttctctattaaaaatacaaaaattagccatagctgggcgtggtggcaggcacctgtaatcccagccat

SEQ ID NO: 15678 - DNA, 1052 bp, Homo sapiens
atgtaaagttacattatctgaactctttttcactggctgtgtatttcttgagtgtaggaatttcaatacaggttgtgtgtctcttatccaacatgcttgacacccagaagtgtttcagatttcaaattttttcagatttggaatgttcaacctgtattcaattttcacctaatgcttactgtatagtagctacttggtaaacatagcaatagccctaacttttccttctttctacagtaccttggccatgtagaagttgatgaatcaagaggaatgcacatctgtgaagatgctgtaaaaagattgaaagctgtatgtatttgatggttgccagtgttgatctatatgctatcaatattttcttaaaagattttgctcagtacattttagtgacccagtaaaaactgtgtttctgttaaaaagatgtgggcttgctaataaggagcatctcagccaagcgcggtggctcactcctgtaatcctagcactttgggaggctgaggcaggaggattacatgaggccaggagtttgagaccagcctgggcaacatttcaagaccctgtctctattaatttcaaaaattttttcttaaataataaaataataattaaaaaatttaaaagcatctcatgttgcccatccagaggtataaattattagatgagccgtttaaatttaggccagatattatcctaaaggtacttttgatttataacccatatgaaacaaatgttgtgaaatctgatagaagaatagtattctaagactaggattaaactgttacagttaacatcttaccctaactgtgataactgggctataaattaggggttttaaatatactgtaaaaaatagcttcctggggaaaactagaggatagaggtctgtgttgatgcctggtgaggtttcctttttggagacttcttactattaccttgactcctactccccaattttcttctctatacacctctaacataaacagtctatttctactgccttttacataaactttagcacacttgaagtagagagccctttcccaggataa

SEQ ID NO: 15679 - DNA, 1030 bp, Homo sapiens
actcacacctgtaattccagctacttgggaggctgagggaggagaattgcttgaacttggaggttcaactccttgagccgagatcgcaccactgcactccagcctgggcggagacagagtgagactttgtctcaaaaagcaacaacaacaacaacaaaaacaaaaaaaaaactagcttgggagaaactgaggcagaaaatccaaagaggaagtgagacgataactataaaacagcgatccccttcaccacctccctagtgtgctcaaagtttcagtctctttactagaaaaccacagctttatgttggagttagtgttggagcttctgggggcaaggatatggctttggtagtagaagcagtaataataatctttatcgagtgccaggctctgtgcattattttatccagttctcacattaaccgtaggagacaggtagtgatagccccttttggtgagtgtgaaaactgaggcacccaaatatttagtgaagggcctgcgttttcgtaggtgacaggctgcagagccaggactcaggtgcctgtgttccctgcgtgagctctgtgtgtcaccactgtgactcttgcacatacagggcagccactaggattgggggtgctttgctgaaaggggggtgctatttatcaacctgctctttgtcccatagacagtgctgaagtaaccccgcctgtcctctctgtgatgggggaggccaccccagtgagcatcgagccgtaagtgcagccctgcccctggccgaggggtgtgggtggccacactggtgcagtgtgtgcaggtgggccctgggagcaacaggagggttccgtggggcctgcagagggctgagagggcctccttgagcttctgtatgtggccctgggctttgctgtccccgccctgcctctgtgtggaagttgcagggaagggcaaggaccggctcagcttgaacttatctctaggagagttgaaaggggggtccagaggctctttcccatctgtaaacctgcagctgcttctcccctctccagcc

SEQ ID NO: 15680 - DNA, 1033 bp, Homo sapiens
tatacattttgatgcaatgttattaggtgctcatttagaactaggttagatactttatgaagtttctttttatcttaaatattctttttgccttttattctcattttattcttatttattttattttatttttttgagatagagtttcgctcttgtcctccaggctggagtgcaatggcgagatctcagctcactgcaacctcctgggttcaagagattctcctgcctcagcctccttagtagctgggattacaggcatgcatcacgaagcctggctaattttcgtatttttagtagaggcggggtttcaccatgttggccaggttagtcttgaactcctgacctcaagtgacctgcccgccttggcctcccaaagtgttaggattgcagaggtgggccaccgcacccggccaattcttactttacatgagtaaagttatgagatacaagtgtgattttgtaacacgcatagatggtgtagtggtgaagtcagggctatcagggtatccatatctattccccaaataatgcacattgtacctattaagtaatttctcatcatccaccctttttgtcttttaaagtcaggtttgtctgatatcttgcttgcttttggttagaatctgcagggtgcatcttctcccatcatttactgttatcttttctgtatccttctacttaaggtgtatctttcaagtggcatacattgggatttgttattatccagtcttttagagaattgatacagtttatatctttctatttatttaaaaattaacataaagtctgggcacagtggctcacatctgtaatcccagcactttgggaagccaaggcaggtggatcacttgaggccagcagttcaagaccagcctgaccaacatggcgaaaccccatttgtacaaaaatagaataaaataaaattaacataaaaagaatacatatttatggcatacaacatgatgctttgatataatcaagctaattaacatacccattacctcaaatcttatttttttgtggtgagaacatt

SEQ ID NO: 15681 - DNA, 1047 bp, Homo sapiens
caagcgattcttgttctcagcctcctgaagagctgggattacaggtgcccaccaccattcctggctaatttttgtatttgtagtagagatggggtttcaccatgttggccaggctggtttccaactcctgatctcaattgatccacccgcttcccaaagtgctgggattacaggcatgagacaccgcgcctggccttatcttgcactttcaacataatcatccctgcttctcatctgccctgcagtgctcttggacctggaagatctccctgtggtctggcccctttgccttggttgttaacctccagcttctttgcaggagtgtatttccccaaaacttgtggctttcacagtagactccgtttccatcctctctctcacaaaggatgttaagtatgcctggccctcacacagtccatgggaaaccttatttttaacattactccattgagtcaataaatatttaccatctgctgtgtgcaagttactaggcaaatttctgtatccttgtccctaaaattcttgtctttaaattcattgtggaatttctttagacttcacactgacttttattactaaggtcacctttataccaactgccttcctcaaaatgcttataatgaaataacagaatcttgagttggaaacagcccaaagaaataatccaatgttgtactcagtgcagaattccctagaatttctaacaggttgtcattcagcttctgctaagccatgttcaaacagcttattccatttggaactgcactgatattaaaaaaaattccttatattgagctgaaatctacctatcttctaagtggtcttagttctgctctaatctctccttccaaaatctttggatcttttgaaaaaagttcctcccaagttcttttataagtgacatgacttttagaccccttcccatctttgtcaacaaaagtagggtgccagaccagtcacagaacactaaatgtcatccatgtttccttcagtagaaaccagcagttttaaaagaggtaagctgtgttcactaaagactgttccagc

SEQ ID NO: 15682 - DNA, 1046 bp, Homo sapiens
ggggtttcactatgttggccaggctggtctcgaactcctgagaactcctgacctcaggtgatccgcccacctcgaactcccaagtgctgggattacaggcgtgagccactgcacccggcccacatggtttattaaatcagtttagaactcagggtgagaagcaaggggaaagagttggagaggtgaacacagaagacacggtgcaagcaggatgcaagtgccacactctctgaatcttgggttccatttgtcctaggtttatatgtcctgcctgtctctgctgctaatagagtggttacacatactagagctgaagttcggtcatgggagcacaaagacaaaaggtgcctgaggccaccacacaaacttgccctatttggagaggccccaggggcacacacacatggccatttgcattagctcagtcattagcctataagatgggttttctttggcagaggacatgagagaccaagagggtgtcaccagtgagtggcttatttaaggcctcatgaacactgaatgcctcatgcatatgtaatgtgtcatatatatttcatgtgtgcctcgtatatttaatgcctcttgaatcttaggtctttctttgtcctcctgtctctctccatctgtttcagtacctgcaggctctactttatctgtagtaagttatttatccccagttttgggcacagtgtctaggctctattacatcaggtcaacacagaacaatcaactggtttatagacttttttggtggtggtagcatctttatccaacaaaaacttatgtagaatatcagtaatacagccgggcctgatggctcacgcctgtaatcctaacactttgggaggctgaggcgggcggatcacctgaggtcaggagttcgagaccagcctagccaacatggtgaaaccccgtctctactaaaaatacaaaaattagccgggcgtggtggcaggtgcctgtaatcccagctacttgggaggctgaggcaggagaatcacttgaacctgggaggcagaggttccaatgaggagagatcatac

SEQ ID NO: 15683 - DNA, 1029 bp, Homo sapiens
tctcgagagtgaaaggtagaaaatatttgcaaatcagaaatctgataagagtctagtatcccaaatatttaaagaactcttacaactcaacaataaaaagacaatccaatttaaaaatggacatttctccaaagaagatatataaatggccaacaagcatacaaaaagatgatcaacatcattagtcatgagggaaatgcaaataaaaaccacagtgagatatttcatacccactagggtggctataatttaaaaaacagaaaataacaagtgctgatgaggaaatagaaaattggatctgggcatggtggcccacatctgtaatcccagcactttgggaggccaagacgggtgggtcacctgagttcaggagttcaagaccagtctggccaacatggtgaaaccctgtctctactaaaaatacaaaaattagcacagagtggtggcacacacctgtagtcccagctacccgggagactgaggcatgagaatcgcttgaacctgggaggcagaggttgcagtgagccaatatcgcaccactgcactccagcctgggcaacatagcaagactccgtctcaaaaaaaaaaaaattggaacctttgtacattactggcagaaatgtaaaatggtgcagccactatggaaaacattctggtagttcctcaaaaagtaaaataactaccatatgacctggcagttccattcaggcatatctcaaaagaaccaaggatgggtaccccaaccaatacttttataggagtgttcataacagcactattcacaataaccagaaagtggaaacagctcaaaaatgtccatcaacagatgaactggcactggctctatcactggatttggtgctgaagccgcttctagctctgcagctggcactcattctggctttagcttggggatgagtgctgtggtgggtgctggagctagctcctgctttgtagctggtgctggcactggctctactgctagtgctagactaggtgtcagaactgtctagctctggagctggatct

SEQ ID NO: 15684 - DNA, 1024 bp, Homo sapiens
aagaacccaaaggctcagcctggccagggccagaggcccctcaaaacggggagtagcagtagcagagagaaccgagtggcctcctctgccagcggccagggcagcctgatctccatgtggtggtggtctcttgtagtttcattccttggttctgaaactctgtggaggaggaagatgggagctgatgagaatcaaagtggaatgaagctctggcttttggaaggagagccacactgtggcgggtcggcggccctcaggagagaccaggaggactgacagcgaagatcgagctcaggttcgccacatagatcccgtgcaggagccacatgggtcctgtgcaggacccctagcagtggtgggctgagcccaggtctaggtttctgtgggggacactgaatctcccagtgttcagtctcccaggactctgctgcctcagccagagcctccatatgcttgaagtgctgattacctacaaatgatttcagatcatgtttgctaaagagaaatctggaagtgtgagatctgtaagaaatgaaagaaatgactcttggagtcaagagatctggaaatcttttaatcagttaaattgtgcagcaatagatttttaactttaactgaccatttaagttttttaataagttttttacaaagaaaagttaaacattaaaaagaattacagctttctgtcttctctatcatggaatgatcttttttattgaatctccagatttgtatttgacagcttggtgggaagggaagcacactctgctgttctggaatcttatgcccagggtttttcacttctccccacatctccctttccacttgccagtgttgtgtagttagaacctgaaccactaacttccaggggcctttggtctgccctaccttaacccaaatgaaagtaaatccctttccccttagccaaaataaggttgggttttctaaaaaaatagtctatattagggaacaacaacagcaaattagacaaaacccagaaagcacaaagcatgaggtggagtta

SEQ ID NO: 15685 - DNA, 1032 bp, Homo sapiens
gtttcagatgagttcttctgtggcctctgtgcaaaatctgaaatctccctccaccttttctgcctagcgaatttcttcccatccttgaaaccccagatcacctcctctggagagccttcccagactcccttaatggctaagcctatctgctgccatggccctgagggcacacttagtactcctgattccaagtgaagaatgcagtgtgcctgcctgccctctggactgagagctcctcaaagacagagataattttctcatttctttattgcactagctaactagtgcaatgcctggtacacctagtgaccgctctgtgtatgtttatttaacaatagtttttatttattgagggctccttatgtgcttggcactttatatttagaaacttttaattctaactctaacctattacataggtattattggctccattttatagattaaaaaaactgaggcttggaggcttaagtagcctgcctgtgtcacgcagctagtaactggccagagccaggatttgaactaggtctgcccaactctagagtttatgttcttcacacagacaataccattaaggcatgactgaagccgtgaatgggcgctaccagtagacagatcctgagaccaagatcatttgaatggccttggtttctaaaggagggtgtgatatgggacaggcggccccccaacctggctgaacctctccagccctgtggacatcccagcctttccttgtcagagctgggcatgtggagcacatgaggacagaccgcaggctgcagagactccttcagacccagagggagctgatgtccaaggagctctggctgtacagtaggcgagggggcccagggaagtgggaaccatggggttggactggtctgcttcccttcccacacctctctacctcctgtctgcaaggataaatgtgccatgatgaaggaattaaccggggatgaggagggggggctgttgcctttctgtgagtatcctcaggagaatgaggatccagagagtccacgtggccctact

SEQ ID NO: 15686 - DNA, 1035 bp, Homo sapiens
ccatgagctgtttgttcattgtaccaaccaaagtttgccagccctaaccctcactgaagacctaattccctgcttggaaaatggtttctaggaatgtgggaacccccactggccagggcttctccctctgcagggcccagtcttgttcacctttctggcctcggcacccagtctgatcaagataaggtgctcactacatgttttcggaatgtattattagcaagcaaggcagaaccagagctaagtgagtcgtggtgtgccgtaggggcttggctcacagggtttggggtcttggatttctagacagtgaaagatcttattttatatatatatttaatttcaatagcttttggagtacaaatggtttttggttacatggataaattgtttagtggtgaagtctaagattttagtgcacccatcaccggagtagtgtacattttacccaatatgtagttttttttccgcaacccttcccactctttcccttctgagtctctaaagtccattgtatcactctgtatgccttttcatacccatagcttagctagcttagctcccacttgtaagtgatgacatgtatttggttttccattcctgagctacttcacttagaataatggcctccagctccatccaagttgctgcaaaaagacattatttcattcttttctatgactgagtaatattccatggtgtatatatatatcacattttctttttcttttctttttctttttttgaggcagagtctcactgtcgcccatgctggagtgcagtagcacgatctcggctcactcctgggtttaagtgattctcctgcctcagcctcccgagtagctgggattacaggcacctgccaccacacctggttaattttttgtatttttagtagagatggggttcaccacattttctttatccactcattggttgatgggcattaagttggttccatatctttgcaatcatgaattgtgctgcagtagacatacacgtgcgggtgtctttttgatagaatgacttctttgcctt

SEQ ID NO: 15687 - DNA, 1022 bp, Homo sapiens
agagggaggtatctccaacactaatagcaatcaaagggtttgtgctatggttataatcagtgtggcagaggaaagtcaaaggaataccatttccaataaactcagaggcgtgaaaaggcaaatcaattttatgaacacccatgaaattggttggttgtgaccactatgggtggaaacactgagcttcagtggaatttcccttaatattaaaccaggaaactagagtccctggttatctctctgtcgtatacagcagctgacatctattcctcctggggattgggcagatcttaaagttgatgtcctaagcttctgactgggatcacagctctggataggggttgggtcaggccatcgcctttagaaaaccagttatttagcctctctttccaatgggatttctctgaaaccttgttcatgatgatgccaacttgtgtctccttgaaaaatcaaaacaatggaattaaacttgggtgttctcctatagatctagcattttatgtcacagtcagggtagacaaatgtgctgttggctcctggcaggctcatgtgcagctctggagatgttctaaagtgggtgcagtcaacagccacccatctgcatactccgcagtggtctggtttaacaattctgacctatcatccctctaaaccttgaaaactctgtggtcttggcgtccaagccatgtcttccagtagactctcacacccagaatcagcaaaacctcttttgtcagaccatatcttgagtttaggcttcaaaaaaatggcatcgtgggttagctttgtggggcggggtgagtaaaactccagtcctgacttttaggggtatggctggtcttgggggcttggcatggtgggaagaaggggccaagatagtggttggcatgaggatatggagaactttggaagcagagccagagactctgaggattgaggcccaggaaagtttggcacgagtaacagctgggtatttaaccaggaacagtcactctatttttctgagccttggcggtatgtca

SEQ ID NO: 15688 - DNA, 1048 bp, Homo sapiens
taacactttataccttggcttacctatcagtcacttggggatttgggatttatgggaaaaggccctactcatgcagggtagagagattttaagagatacagctattagtaatggctttagaatcttttgcatgtagaaagttccttagactaccaactaatgagcaaagtgacttccaagtttaagtgaattctatataaagaatacaagacacccttgaggatataactgaggaaaaaggccctgaaattttagtatccttgctttggtggaaactcaataggtatcaaatgaaataatgaggtcagatatgttacataataccctgatgtttatctctggtaattaagtctgcagaaaaagacttattggaataaatcttttgtctctaaactctgctcatatgaaatagcaccatttggcaaaggccaaattcctggtggatatctcactgaggaagcaaacattttcaagaatgccagagttaaagggagacaacacacaccctaaacaagactgtgaagatactatgaaactattctgttgaaaccataagcatagtatcttttccagggtgagggggtttctgtaactctcttgagtgaagtcgctctttctgcaaccccccacttcacctgcattatggatttgcacataaaggagtttttctgaatcttcccttcttctacagaccaacaatgtttcctctctcctcagaactcccacttgagggagttgccaagacattcctctgtttgcccattagcagagtcagggatatcagagtatttgcaagccagctagagagcctttgatggcttttatgttatgttgaaaacaaaatgttgtgttattgtgcaagaggaagattatgtgtgtgtcatcattttgtgcttggtctcctacgtccaatcctgctctaagttgtcatttcatttcctaacctcctcccctcccagtcaggtatttctgttccatccctgggtttgtagcctccctttttttttcttgagttctgtgcagctctgcatttcagcagacgtttcct

SEQ ID NO: 15689 - DNA, 1050 bp, Homo sapiens
cagtgtttttggtggtatgagttaatcacttctcccttgcccttccagttttaaccagctgtgcctccctacatatgactcctatgaagaggtgcacaggatgctgcagctggccatcagcgagggttgcgagggctttggcatgctctgaccactctcctgtcatccagttggctcccatgctctctggagcttctgggcgcaagttacagacatcataaccactgatcctaacacacataaccatcagccagaagatgccgcatgctcccctgtgtctggaggattttgtcacctacaagccttgtctttacctcacctgctccctgcccatatctaccacaggccactttggcatggtatgtaagctgagctcttcattctgtcatgagaagaggaccatgctgctatcatttatttggtcctttgaagatctcagtagctgagggagatggcacacggggctcagccctgttgggaaactggtgtggagacccttaaatccacactgtgctccaaaactccctctgctgatactccttggagacaccctctttggccctcactacttgaccagactggtacttgagtccttctcatgggtggggtgattgcctcttctcatcaggagccaggagagagggggacagataggaggtggcccataggagcagtcccgctgcacaatggtaggcataggccatggcactggactgcctctaaggactgctaaaaagaatatttttttgtggtgtcagaactggaaaaagcactttcccttcgggcatttctggaaatgattattaatccacaaagaagaactctgtaagctttttcttgaattgtagccagtgagaaaagcagatagactgaagaatatgaaggatagctgagctgtagcctccagagtggggcatgcctaggcatatggctggcttggagactactgatgcttttccctgagtttgttattggcactgaagtatggccggcttgggccactgacttccccattatgtagtctgctaaaagctggggatcctttagcat

SEQ ID NO: 15690 - DNA, 1045 bp, Homo sapiens
tatctgtctcactaactgcctgacaaagctcccaatacaaagtatatacttaataaatatttgttgactgggtaaattgtgcataaaggcaggttataacaatatgagagtttagattaggaagattattatggaaattagaaaaaaagaagcaaataaaatgaacattgtaaggaaacaatcagagattgctattggacgatccatggagaaagataaccccaacttcacaaacccataaagagtaggcaaaaatactgctcttgcctcttggagaaaaactctgaaagccagatcctaacaagttaaggaatgcctcctacagagattagaaatacaaatactccgtaagaaaaagctgagagacagaaggtcagtcctgaagccttagtttcatccatggtcataagcactaatttatttccctctttttttttttttttttttttttttgagaacggagtctcgctttgttgcccaggctggagtgcagtggcgtgatctcggctcactgcaacccccgcctcctgggttcaagtgattcttctgcctcagcctcccaagtagctgggactataggcgcgtgccaccacacccggctaatttttgtatttttagtagaggcgggatttcaccatattggccaggctggtcttgaactcctgacctcatgatctgcccgcctcagcctcccaaagtgctgggattacaggtgtgagacaccatgcccggcctataagcaccaatttcaagcaggattaaagcttcattaaagaagcctaagaaacatgttactttttccagatatttggcagtgacccaaggtcagcattggtttcccactatatacactataaccttcttgtttctgtctttcatttaggggccattaagtttaatgatggcctgagcttacaggaaagttgccgccttattgaagctctgtcctcatgccagctgccattccagtgtgctcacgggagaccttctatgctgccgttagctgacatagaccacttggaacaggaaaaacaggtacattaat

SEQ ID NO: 15691 - DNA, 1032 bp, Homo sapiens
tgaacactaattcatctggatttgtttacgtgtggtcctggttaaaggcaaagggaaggatcagataacttcatgttttttccatttaacatacccaatagattcttgattaggggaagggaaaatgagcaagatacagtccagtattctaaaaacaatcagccttaggggatcatttcaaaagcatctgttttggacttaagtctttgatacttaaccaaattgactacacagtgaaaaattctagtgcctgggttttatagggtagaagaaagacatgcagtcaagtggccaatacttcatgtgaagataagcaatgagatccttcttgctgtctttcttttgactgttctgggcaatatcaaattagtttcagtggcttgattctaggccaagattctggcaacagattgtagtcttaccttgttttcttcaatctcactggatctctctctctttttaccccccttaggctgagggtaaaaagctgggattggtaggctgggtccagaacactgaccggggcacagtgcaaggacaattgcaaggtcccatctccaaggtgcgtcatatgcaggaatggcttgaaacaagaggaagtcctaaatcacacatcgacaaagcaaacttcaacaatgaaaaagtcatcttgaagttggattactcagacttccaaattgtaaaataatggcctgaatttaagttttctaagataaactcagtggtttggtttttattattaatagagatagaactattgtgtgttaatattagcattagtcaataagttattttaatgtcagatttttgaatgttattatatattacctgtatgatggaaggattaccactgtacacaaatctaatcaataaaaacgttagaaccttctgcttagagtacttttaaaaaatcttcagtgaacttccttttgggcgaaatgagaggtctttattcagtaaacatttgtaggaagaggattttgaggtaatttaaagaggtctgaaagaaaaaaagtctgagtcatttcttta

SEQ ID NO: 15692 - DNA, 1034 bp, Homo sapiens
ccctaaaatgttagtagcaggggattctgggagttagtagcagggaattctggtagtgagggagcgggaccgggcatggatgtaaggaggtcatcggtcctcaggttatttccccagaagaggcttcagcgggcagctgcgatccgaagctccctctcccggcgtctggttcttccttcacacacaccttatcacatccactcacgtttccatttccaggaccttgaagtcggggagaggtcgcaatggttaaggatggacaggggtgggtgtggccctttctgactcaggcttgcgggtcctggaataatagcccttcactcttctgctttcctggtttctgacaggtttgagcatggcagaaggaaacaccctgatatcagtggattatgaaatttttgggaaggtgcaaggggtgtttttccgtaagcatactcaggtatgtggcctgcaggctttggggtggtaacctaggttgtgggcataggaacaagggacgtgttcttgacaaatgtgaactagaagccgctggctatttggtagctgcatggcaaagaggtagtttgtagagcaatgagtatgaaaatgctgtgcaatcggtaaaacatggtgtaaatggaagatcaccctgctgttattattagtcagtggtgcctgagcatctagatacacatattaatgagcttctctcttccaagggaaatagagggcttccccagtgctcgccgttgtggcatcatcaaaccaagtcaggtttcttatagaaaggctaacattgattgaagagctggcatttagatgacctgatgtcatgtatataacatatataaatgcttcctctgcagctgctgcactttcttcagacctctttctccaagcttccctcagttctccacttaatttctttctattcttttttggttttgaaagaacatttaccttttccagctgacgtttttcttattaaaaactctttatccattccagaataggtgatgggaacactgaatgtggagcctggtattcttcctaga

SEQ ID NO: 15693 - DNA, 1035 bp, Homo sapiens
gggttttctgttttcttttttttttttctttccttgggaacttttagccaaaccagtttttatttatattttaaaaattaaattattatgcatttctagggaccatcctcaatgggattcccagctgttccttttctcctggaaaggctgtggcagaaactgagggttgaggtttcaggttttacacacatccattgtgaccccacacatgcatcaccccaccttctccagtcctgtctagttagctgtaaaaagatatgagcatttggaagtcctagatattacctcagtactctgtcacctctcctataaaatgaccagattgggaccccacagggctactgaatttctgtaactgtcaagcagccttccatctcaaaggacaaaatcagcaatgaattgaagcttctttctcaactttttgacaggtcaccctaagtaggacctattactaagacaaactgagagggtgctgtcttgtttagttgacctggaactgtcaccttttctttgatattgtaaaacttgagctcttcgttgacaacagtagccttgaccgagcacaatggctcacgcctgtaatcccagcactttgggaggccgaggcgggcaaatcacttgaggtcaggagttcgagaccagcctggccaacatggtgaaaccctgtctctactaaaaacacaaaaattaactgggcatggtggcacacgcctttaatcccagctactcaagaggctgaggcaggagaatcgctttgaacctgggaggcagaggttgcagtgtgctgagatcataccactgcattccagcctgggcgacagagcaagactccacctcaaaaaaaaaaagaagaaaagaaaatagtagtctcagccaggcgtgatggctcacacctgtaatcccagcactttgggaggccaaggtgggtagatcacctgaggtcaggagttcgagaccagcctggcctacgtggcaaaacctcatctctaataaaaatacaaaaattagctgggcgtggtggcatgcacctgtcat

SEQ ID NO: 15694 - DNA, 1078 bp, Homo sapiens
tatagagttgcaaaaggggtcatgacttctcttatccagaaagggtaggtgaaaatcactagggaagtctaaatttataaaactagaggcaagtttagtattttcattttagaagctgggaccagctatagataattgctccccagttctctgcttctccagtattcttgccctgccataatcaccatcatgattagcagtctgtcatagtatcctcaatagaatctttttgagatctatccccagcccatatttttacctggaactgacatcatgcaaattaagtatgacaacaacgttttaatgctttacttcccctgtcctgcaataaattataatgctaaattgtacacataacctttaaagtctgttaaaaggaaaaaataagaggagtcagtctgtgcccctctaggaagttttccttctaggcttacagatctaggtgtggattcatttgctgccaggcaagaggaaaagcacgatacctctgttactgtgtttaggatgactcactggttgtgtggaaggaagtcgatttgacccggctgtctgagaaggaacgtcgtgatgccttgaatgagattgttattctggcactgctgcagcacgacaacattattgcctactacaatcacttcatggacaataccacgctgctgattgagctggaatattgtaatggtaagatagagttcagtgggacttttccagcaagactttcttagactcataattacgttgaggagaagaatataagaagagacatatacagtgataaaaactttaaatgaatttctagagtttaagagaaacttttcaggccttggagaatttttgaagtggtgtacgaaataaggagagggattttcccctgcatacccaaattttctcttgtgattacagttccattttcaaactatcttttctttggttggattttacctttatttttcaaggtttttctttatgaaatgacattagttaaccagagtgtggcttggcagcacttgatacagtatttaataagatcttataggtgatatttatttatattgtcttcagctaaagctatcctatt

SEQ ID NO: 15695 - DNA, 1042 bp, Homo sapiens
ttctttcctatttctgactggtgcctttcccctttttaggagcaacgaaagctactctcttagttatgttcttgtgatgtgacaaaatgtcaagaagataggagaagagaatattttatttcgttgatgcttttgttcccaagtgtgaccctaaacttaagctttgtaggagttgacattctttcatgtcccttccctttactcatgccgaaactatcaactgggacattttgtgcttttggtttaaaagttaattgatattatactttggttttatctaaaaagtaaatgtatttgcctttgacaaaagactgacacaagagcaaataagctttaaaatcgggtgttatgtgctttcctccatttttgagcatattatccaaaatggtctgtataatataaatgagaatgatgcagtttaagtaagccttgttataccattgtcatggacccctgtcataaagccatttcttggtttgtttgggaaagaggcatatgggatttatacagattcacttgtaaatgttggattggggatttttgtgtaaattttctcaaataaaggctagcagaaaccattttaggtgtactgttactcttgagtacttctatgtctggattggtgataattcttccatatttctcttttaaattatggcaaattatacctgatgaattagagaaaaaatattgttattcttcagttactgcagatcgatagtttatatgagctagtaaaagattatcatattttgtatgtaatatatgtaaattatatatatatatataattaagaatccttaattatgcatcctcagaccaaatatggttctgtaagctaggcattttattctctttatcttctctcttttggaaactgttactattaggttcgcacaaaagtaattgtggtttttgcaattaaaattgcaattgcatagaatcactcctacagagagccatctcccctgcctttcattcctaaaagacccccaccccccacccccggtatatgaatcctcaggactcactttttaggcct

SEQ ID NO: 15696 - DNA, 1046 bp, Homo sapiens
atttaggtcatttgttctttttactattgagttttgagaggttttttatatatcctagataaaattcctctgttagatatgtggttgcttgaatttttaacataacttctaccaaggaaaaataagtaaaatttccaacccttgcatggccagtcacttacttaattcctgtccttcagtgttccatctagagaattaagagatatgatgtataaaatagacatcgagggccattaagagagtaaatacttaaaaatacatgttatgaaagcaaagccaataatcactgtaggagtatgagttgcctaagggccaaaactaatgtaaataagagaaagtgtggatataaatgaccattgtttataaacagttatgaaaaatgctgtgacttgaaatctttcccacatctcccaagaaagtaggtaggagtttatcctttccgtaatctctttttaaccctgctgactattacagggcttgtttaatcacagtggcaagaattacatgtatcttacagtaaagaaacagaatactggaatcgttagagaaccctgatgtgttgacctggataaagtacaaaggtggaagagggaatgagttatgctgttaaaatctcaggctattctgttaatgttcctgctactatgaacccaaactttttttttcccccttttgactccttgtgtcttcctctcctgtggcataaaagtagttctgtcgttaacttgtacaacattgccatctgctgttgagaattggtaggtactgcttctgagaacctggctgcagatccttagcataggcagcaaatgttgagaaagtctatctgtagtattacatatactaagttacagaggatgcatccaagtagagaaaataatatgtgggttaagatacatccttaaacttttttttttttggggggggggggacggagtcttgctgcaacgcccaggctggagtgcaatggcactatctcagctcgctgcaaccttcacctcctgggttcaagcaattctcctgcctcagcctcctgagtagctggg

SEQ ID NO: 15697 - DNA, 1196 bp, Homo sapiens
gtcctatacttcagcatcttttcaatgttctgtctcattggactagctacctggcaggtcttctacctgcgacgcttcttcaaggccaagaaattgattgagtaatgaatgaggcatattctcctcccaccttgtacctcagccagcagaacatcgctgggacgtgcctggcctaaggcatcctaccaacagcaccatcaaggcacgttggagctttcttgccagaactgatctcttttggtgtgggaggacatggggtaccacctacacccaacaagtcaatgagggacttctttttaatttggtaggattttgactggttttgcaacaataggtctattattagagtcacctatgacaaaaaataggggttacctagataatgccaaagtcagcatttgtcctgggttcccttgtgtgatctgtttggactatgttttcttttcttctcccacttgctcagcagcttgggcttccattctagttcttttaccaagatttttgtgtgaccatgttgacttcatttggattgccctctttcaatttccttgtgaaaacacccttaactttctctttacccttagctgaaatgtttacatagcttctggtgatatcttttcatgattttatatctcttaaaatggtgatggatgtgacacctcataaaagtgagctttgaactgtagataactcttaaagaaaatgtcattttagacaattaaaatatttgtgctcaactgcttgaacttttttcgtgtatgtgtatttaattctatgcaatattatcacatgtgtagattcatgtgaccaccatcacaagagacagaacagttctgtcacatggatcccttgcactgcccttttacagccgcagccacatccctttcttataccctcaccccaacctgtggctaccactgttctgtcctccatctctgtaattttgtcatttcaagaatgttgtatgaatggaatcatacagaatgtaatcttacgaggctgatcttttttcattcagcataattcccttgaaatccatccaagttgttgcatgtatgaatagtttcttcctttttttcttttaaaaatgttttatatatttagggggtataagtacagatttcttacatgcatatattgcatcgtggtgaagtgggggcagttccttttgattgctgagtagtattccatggtat

SEQ ID NO: 15698 - DNA, 1067 bp, Homo sapiens
ccgaactgtggaccattctcagttgaatttgtactctgtggaattttacctattgtaatctttttctccaacatgatgcctgtcattaagggtatttatttatttatttattgagatggagtctcgcttggttgcccaggctggagtgcagtggcgggatctctgctcactgcaagctccgcctcccgggttcacgccattctcctgcctcagcctcccgagtagctgggactacaggcacccatcaccacgcccagctaattttttgtatttttagtagagacggggtttcaccatgttagccaggatggtctcgatctcctgacctcgtgatctgcctgtcttggcctcccaaagtgctggcggattacatgcgtgaggcaccgcgcccagcccaagggtatttattaaataacaacacatcaatgccctattagacagtagacatagctagttcccctcaaaaacagatgacattattgtgggtttatataaagaatgctttggacacagctgtcgtatagcattttagaacccctatacctcctggaatttccatcatccttggactttatagacattaggaaaggggctttatctttcctgaccttttgcttaacccaagaggggaatccctagcccaaagaaaaccacggtgcttcctttgcctgcttcctgcttcagacgtctgacatgtcctaagcctgcctttacgcatgtagttacaacacagctccaaggttctgcttcttaaccaagaaactcctccccactactttctttaacatctatccccaccctcctgcccttcacccctgctccccagcagcagaccagattgatgtagaggaggaatggctatgacacagtccgaagaccagccctttcttcagtctgcagcaaggctgccttgaaccttgcttagaaatggctgttagctggcagggcacggtggctcacacctgtaatcccagcactttgggaggccaaggtgggtggatcacccaaggtcaggagttggagaccagcctggccaacctggcgaaaaccccatctctactaaaaat

SEQ ID NO: 15699 - DNA, 1051 bp, Homo sapiens
gaggaggcagcagtgtgctatgctgtgaggtttctgtgacctcggcaggccaacaggctgtgctttgcccaaagggctgtggtttcttagcagtcttgtgacagccagccatgatcttactgatacaaaaagtggtattaacagccttagccgggcgcggtggctcactcctgtaatcccagcactttgggaggccaaggcgggtggatcgcctgaggtcaggagttcgataccagcctggtcaacatggtgacaccaagtttctactaaaaatacaaaaattagccaggagtggtggcgtgcgcctgtaatcccagctagtctactcgggaggctgaggcaggagaattgctggaacctggggggcagaggctgcagtgagccgagatcgtgccactgcactccagcctgggcgacagggcaaggctccatctcaaaaaaaaaaaaaaaaaaaaacagccttgaagaataattctggctgtgctgtcagccaaagactgaacaaactgtcccacagaatgttggtttgataaaacactgaagcatatggcattagttctcttgaactgtgtgtgtgtagagagagatattttaaattttttaaagctggaattcagttatttgttaatgcccaaggttaagaaaagtgatttgtttttaattcctaagactttttccccaagaccaacagttgtatatctatctatctatctatctatctatctatctatctggggcatggattcagtgctgtttagtcttgaacaactgttttgtgtttgggaaataacaatagtcaaagatagtttttagttaaaataatttcaaactttcaaggaagagggcaggatggaggaaaaagctgcaagagactaggaatggtgataatagaaatttgatgctgataagaagttatttattatagactaataaaaactgacacttatttgggtgacagggagatggaggtgtacacagaatgaggagaaggacaacagcctttttcatctctgcgagacttgggggcagcacaaaagggttcttcaaatga

SEQ ID NO: 15700 - DNA, 1122 bp, Homo sapiens
actgcactccagcttggaagacaagagtaagaacctgtctcaaaaaattttttttaattaaataaataaaattaaaggttttacctctcaacactgttgcattggggattaagtttccaacacatgaactttgagaggggcacatcgaagccgtagcatatctctttaaaatctccagcacagttttagtacttagtgagttttcaatgagtagttattgaattgacttcagttcatttcagaaaacttccagtgtctctcaggcatcagagggtacagtaccattcagtgtggcttatggtttcaggaaccccagtgcttcagtggcactgtttcccacaacttctaatttcatgcaggcagttgtaaattttataactaggtgaattccaggggattggggctgaacagttttctggggctccttgggtcttttcctttctcctacttgatgatttaagattagaatgcttctttgatccagctgaatcagattgactcttctaacatgaactctattataagaagcatccctgagatttgaacacttaaagttgttttttttttttccttgagctgttgtaactcttttaagggcttagtgggaatagctctatgacattgtactcctactgaactaggccatacattgatcaaaatgtttgaattaaagtggaatattagataaaacttatgttcttttcagtactcagatttatattaagtaaatccaagcttagcacatatccaataatcctaattcatcatggccttccctcaaaatttgacagggcaaccttttcagatgtggaaatacacattttcagccgaagttgttgcctactatctcttgatttatatgccactcaatttcacactgttttgatttttgagttttatttcccaattcaataagcctgtgtggtttcccttctgttctgttcctctgtagtaccagttgcagtatcttgtgtccttgcctgctcagagatgtttgccagcagcatgttcttgttgctttccggcaccccacacagatagaggctttgtctggaatgtttgtgattttagccagagccaggaattttctgcaactgagcagggggaggagttgtggctgtt

SEQ ID NO: 15701 - DNA, 1032 bp, Homo sapiens
aacctttcacttaggaatccactgatgactactgtgtgcatttattatgtcattaaggttgtgaaatgatgactttctaattccgttactccttccatatttattagctgaaattattcttaaggaattaatatcatctgattatcctaaaatttatcattcacattggtaggataaatgcagaatttatttcttctaattgataattgtcagagtaaggaattgttgcccttgtcattttcagtgttgtccaagagtttttgggtttttttttaaagtattttactgaactctttttaattgttggcttcaacttttagaatcattgtgttttaggcagttgtttccattctttatgcccaatttgtccctttggttccttcatattggctcctgtattttttcaacataatcctgttaggttttgatagcatccttgttttctggcacaacaaagtgttctaggcttatcttgtatatgtctatcctctgacctcagaacaactgtttctctaaggaattctagttcctttttgtggggattggtatttggagaccacaagctaggtgtcatttttgaaaatgtaatataccatgcaagccacagaacacatttgtgagcagatgcagcccatagcggctttcagtctttttcatggtgtccgttcacttagttccactttttctttttttgttgagatggagtctcgctttcacccaggctgcagtgcggtggtgcaatcttggctcactgcaggctctgctccccggggttcacaccattctcctgcctcagcctcccaagtagctgggactacaggcgcccgccaccacgcccggctaattttttgtattttttgtattttttgtatttcaccgtgttagccaggatggtctcaatcccctgacctcatgatccgcccgcctctgcctcccaaagtgctgggattacaggcatgagccaccacgcccggccgttccactttttcttatattttgacgactgcttcaaggattctccctatgcatcat

SEQ ID NO: 15702 - DNA, 1031 bp, Homo sapiens
ctgaggtcaggagttcgagaccagcctggtcaacatggtgaaaccctgtctctactaaaaacacaaaaattccctggatgtggtggcgggtacctgtaatcccagctactcgggaggctgagtcaagagaattgctcaaacctggaaggtggaggttgcagtgagccgagatcatgccactgcactccagcttgggcgacagagtaagactctgtttaaaaaaaaaaattgtttttgtttttgtttgttttaatttggaacaaacacagtaggaaaagaaagcaaagattaacagttggagtaagtgcctatagttctcgccctataggcaagaagctaaaactctagagcctcagtttcctcatgtataaaatgaaacaaagggctatgtcatgggtttgttttgaaaattaaatgagataatgcatgtaaagcaattaacatgattcctccgtcaaaaattttttcaaatctgtgattaagtctaagaatcattttctttttggcaaagaaccccatatggacatcacattctccagagtttcctttcagcattttcaggcagcctcttgttcaccccaactgttatccccactgcaggcagctacaatgttaagcagtgccattgactgttttcaacaaatgccctggcaatagggcttttcccattagcaaactccaagtcaggttaaatagcaacatgtcctatgaatagggcttttccggggacctgctaggtaggtcaaatagtaattctcaggggtggagctccaaatcgactttgctccctccaatggctatgagacagttggttttcacagctccacggctgcgaggctgctggatgtcacagccccatggctgcaaggctgtagtagggagaaagggattggaatagggcaagtgaaaacacaaggcccactgttgttactgatatttagccatttctcttgaataaatgctgcttggattgttgcaagccatttgttaaaagttctgaaaaaattcatttggatattttttgccattgt

SEQ ID NO: 15703 - DNA, 1023 bp, Homo sapiens
ggccaggctggtcttgaatcctggcctcaagtgatcccccggcttcggcctcccaaagtgctaggattacaggtgtgagccactgtgtctggcctatctggtcagttttctaagcagaaaagttctttttagcttgtttgttttttaacaagcctacaactaacatcataaagagcaggaaagtcctaaatccagcttctttactggctgttgtgtgatacaactgaggatcctcttcccaagttcttgcagaggaacttgcatgcgtggctgctactattgctgaatgggcccaggaagaggctgtagctcatgtagaggtagcagcttatgtgacctggagcagagtaggtggaagccttgagtcctgtataactgccagagcagtgctgtttgttcacagtgctgcatggtaagaatggtgtctagggaaatcatgtttaagatcctgcaggtcactgtgattttgtgtgtgtgtgtgtgtggcatattgtaatgacaaaggatgtaacttaaagatactagtgttaaaaatgtttatgctccaaataacattgcatcaacaatcacaaagtgaaaccataggctgtaacatggagtaatagacaataactaaaggtagaaggctttaattgatctttctgagtctgcagcagatcaagtagataaaagatgactaagaatatagaataactaagtaacatgtcggatgataaatctgattcatatatatcaaacaccgaacattgacagcagagaagacattttctttttaagtattcataggaaattcttaggaattgatcatatgttagatcataaagcacatgcaataaacatataagttaaaagtgaaaagctgggcacagtggctcatgcctgtaatccagaactttgggagactgaggcaagtgattcccttgagtcctggagttcgaaataagcctgtgcaatgtggcaaaaccctgtctctacacaaaatggaaaaatagaaaaattagcctggcgtagtggcatgtgcct

SEQ ID NO: 15704 - DNA, 1043 bp, Homo sapiens
ctgagtagctgggattacagacacacgccaccagtcccagctaatttttgtatttttagtagagacggggcttcaccatgttggccaggctggtcttaactcctgacctcgggtgatccgcctacctcagcctcccaaagtgctgggattataggtgtgagccactgcctggccctgagctactcctgtaagactgcattcccgggggaatttctgaatgactgagtctaggtcatgagcccacatcctggctgccagcaagtagagggagagagaatctccagctttgatttctgtgatttgatttctgtgatttgatttgatttattccataaatacccctcaggaagggacattcccatccccagctcccaaacagaataggagcattctggatggccttcccaattggtgcctccagacttcatccctctcaccctcccccactctgaagtccaggaggctgatctgtatgggctgcatcagctgaactctcatgcttcctggcttctggctgggtttgcccaatgggcggcaccactggagaagaatggaggtgggaggtgggaggtgggaggggagagggtggggtattgttccccttgctcctttcctttgcagctttgggtctctccagcatccagtcactctgtccctgtcccaccaggtcttcatcattttttgttggtttccctttgtgctgcccacctttacaacttgtcccttcttgaaagatccttcaattgccctattttagggtaacatctgttttctgctgggaccccagaattatacaggagggtttaacagtgagaagcaacaaagctccaatgaatgcccacaacatggtggaacagatgcccattggaagctggcagcatgataaatgctcaagagcaaggaattggaagccaggcctaggaaggtctaaattcttagcccagctcttactacctgtgtgaacttggctgaattcctcaaccatgctgagtttttgttctttttcagaagtaaaagttaatccttaactcagggataggttg

SEQ ID NO: 15705 - DNA, 1602 bp, Homo sapiens
aggtggcgcccccgccgcctagcgcccacccgggcatggaccaagtgcacccccaaaacattccggattcccccatggccaacagcggacccctctgctgcaccatttgccacgaacgtttggaggatacgcatttcgttcagtgcccttccgtccccagccacaaattttgcttcccttgctctagagagagtatcaaggcccagggggccaccggcgaggtgtattgccccagcggagagaaatgccccctagtcgggtcgaatgtaccttgggccttcatgcagggcgaaatcgcgactatcttagctggggatgttaaagtgaaaaaggagagagacccttgaaccactgggcagccacctcctttgccctagaccagctcctctccaatcctgagggcccctcccccaacccaactcgaccctccctcccctcacccccaaggtgtagaattgtgaatataacgaaactgcaaaaagttagtcttatgtatagacattattttcgtcgtatgtttctatattttgaaacaaaggtatgtaacttcttcatttgaaggataagctggtttgtgttaagcagtatagtattggttgggtcatttgcatcatatcgttagcatttatttggtggcagaatgtttgcctaggtacagaattaatagcccttagcaacgactgctgctggtgtgtatttttgtaaatgttatgcactctctgaaaggaaaaacacacacaaaagaaaaagacttttttttttttttttttttttttgccaaggccagtgttgctgcctaaaaaaaaaaaaaaaaaaaaaaaaaaaaaaaaaaaatgctataaaatggtgaaagcttccttctaaactgccccaagtgttgaagtcttcactttattttgttgttttgttttgtttttctgttttgtttgcaaaatggtaagggggtgtcgggggggatggggtgtattttgttgcaagtttgtgaggggaaaatgttttggtttgtttctactgacctgaatgtgttggatctacacgtgttgttttgtttttgctttattgatgcacggatgcttttgaacagtagagcgaaatgctagacatggagaatctgctctgtttgtcctttatacatttctgtagttaacagaacactgtaatgtgccttggagcttagtaacttgtaataaattcaattgatattaactgcgctgagtcagcaattttgtctttctagggctaaggccatgcaactccgacgtaggcgacaccctccctacctccagtatagaacgaaaatcctagtgcttttgaaagccctgggagctggcctgtgggaaaggccctgtgctgccttgctgcccctccccctcggtaccaggctatttaaattcacctcttggggaggcgacagttgctgactaagcgatttcggtttactcttcagcatctctattttcccccggatgcgggcccagctgcaaatggcattgtcaagaatgctttctggtgcctcgccctgtggcggtgaacataggctgacacccagtgcagctggtgacttgacaagtgggcgaaaaagtctaggagaaaagctaggat

SEQ ID NO: 15706 - DNA, 1001 bp, Homo sapiens
acaagaggtcttcggaaagaggtggctgctgggcctgctggtccccatgttcaatgtcggaagtgagagctccaagcagcaggataagtagtagacactcccgtcatttatctctctgtctctgtcttgactcctcctgagcataaaaccatggcagccttgtctccacccatgactcactacaaccttgtgctggtaaggtcctagcatcttcccctcaccttccacccatgagaacagcgtgagctggtggatcatgacaaggaggaaaaatgtccccccaggcatttctaggctcctcacgagccagccaggtggctgctagctgttaggctgcctctgctttctttccgtccccttgggatccctgctttccccctcttcctggctcatccattctccaccgtgtctcattcatcactgctgtctgctagagcccttcctctcagcccccatgttgggagaggggagtggattcttgctgctggtatgagactccctgggacctagaggctggcaaatgtttaaaatcaccacgtgtaagaggcagccaagtcagctctgccaactgctaggggagttgggaaagagtgggtgtgtgtccgcatcccctctgtaggaaaaagaacttagtagcttgctgctccctcaccaccccccaccaggttcaagaccctttttctgggagacagcaatcaatggcctgctttttccaaatgttattccctgtccaccctgccccatctggccggcccagcccagtccaggacctggctggatgcttcctgtccctggaactcttccagcctttctacttgatctccagcccccaggtctttgccagatgatgggaaggcaaggaagaagggacagggaaagataattactgataaatgaaggggatattcgactgtataaccatatggaagtgtgtgtgtgtgtgtgtgtgtgtgtgtgagagagagagagagagagatgggtggtggtgagaagtgttgtta

SEQ ID NO: 15707 - DNA, 1023 bp, Homo sapiens
gcagcaggaacatgcgcaacttcgtcctgttctgcctctacacctccctggcctgcctctactccatggtggccggcgtggcctacatctccgctgtcctttccatctccttcgcccaccccttggccttcctcacgctcctgcccacctccatcagccagttcttctccggtgagtgggccttggcgggcaggttgggctctacacaaagacctcccaccccaaaggttgccgggccccaaaccccaaccccaaaagttgccagatttagcaaataaaaatacagaccgtcccgctaaattaaaatttcagataaacaactcataattttttagtataattatgtcccagatattgtatgagatacactgagaaaatttgctattggctatctgaaatgcaaattaagcggacatgctgtattttattggtaacatccccccttgcccccatcattctcatccatcatgctgtccatatgctcacagagttgtggcatccaggtaatacacctgctctgtgccaggcaggactaggtgctggccattcctccatgtagccccatgaggtacaaccatgctatgacattcctctgcctggtccccagttctgcttacatgtcacccaaggactctgctctccagaggtctcaccaaccaattgcagtaatattgaacttgttgccagcccagcccagcaggaggctaagctctgtcctcctgcctattatgtttgacctcaccagcctgttctccagcctgctgatggctcagagcagagggaacgtgggtgggagaggcaggttttttgttttttttttttaagacagagtctcactccatcacacaggctgaagcgcagtggtgaaagcaatctctgcttactgtaacctctacctcccaggttcaagtgattctcttgcctcaacctcccgagtagctgggattacaggtgcgtgccaccacgccacactaatttttgtatttttagtagagatggtgttttactgtgttggccaggcgg

SEQ ID NO: 15708 - DNA, 1048 bp, Homo sapiens
ttattctggcttatggaaaacctgtgttctgcaggaataatgtttaagaatcactatctcaagccagatatgtgattatcactctacccacagcattgcagggaggtgtagcacttgttatttttcccctggtaagccattgtcaagtggacttccctggaagtgattatgtaagcagtactcagtacatatagttgacttatttcaccagattaaattttaaaaattcaaattttgtcatttttgcgcattgggaggtgataagttgacattaagcatctctgggtcacttcctttctgactctctgcttgtagctgtcactgtggcctgatgacatagctcttttgaacatgtgcctgtcagtcagaatatcattctgggcctgggtcaaattttaagactaaatctacgagtttcattttgtctttcattatctaagaagtagagtcagagaagaaaagggaagtaatgagagctttcttattcagccaacaaagagtcagggaggggagagagatgaaaacagtgagtccagactatagaaactgcaggggcagggctcttccgctggctgagtagtggcccgggacctggaggagaaggctgccttgcctggtgcagttacaggaatgagcccatccagatttcagccatagagaacaacttacaagtacatatgcctgtgatggttgcagatttttctttcctcttttagtttagcaacagagcaggatttctcagagtttaatgtagtgaataagattcccttggcttggtacagttctggctggagtccttgggtttgggaccaaactgtacaatttgaaggaattggtttccctcagcaactgccgcaggggtccagaatgattcattcctcattcccaggtccttcaaagggccgcagtgacgctggggccgtgcagctgtcccctttgtgtctgatgccctggatgcacttttgaccttggaggcacaacctctccaccatgtagaggcctgtaaactattcccagccccttgctgaactggattcataaggcactg

SEQ ID NO: 15709 - DNA, 1021 bp, Homo sapiens
tgcctggtaataaatggtagccattttcagcatcagcatttcatgagccttttcccatgttgctaaaaaaatgctctgaaacattttttatggctgtataatattctatcccaggacatactatcatgttaactatttttctattactagacagtcatactgtttccagattttttgtataaaacgtgagttaaattctaggacaggatatctgtggagctttttcgtttcatttggccacattatagaaaatataatagcatgaatttttcatttagaaagtttgaggcatgatcttaattacttttttttttcccaagatagagtcttgctctgttgcccaggctgtagtgcagtggcgcgatctcagctcactgcaacctctgcctcctaggttcaagcgattctcctgccttagcctcctgagtagttgggattacaggcgcgtaccatgcccggctaatttttgtatttttagtaaagacggggtttcaccgtgttggccaggctgatctcaaactcctgacctcaggtgatccgcccactctggcttcccaaagtgctgggattacaggcatgagccaccacacccggccttaattactttgaaaatgcacttaaatcctcattctgtttttgtgttggagtcagttatataaggcctcatggttcctccctctagaaggctggatggaacttttaggacaagatgcagaaagatacaaagaaacaaaaaggctcttgtgggacaaagcttctaaatgcagaaggaaggagagaatctcactcaccagtgctacatatgagccccattgggaaacatggcccctcaggttggtggctggggattctgaaattggcttaagcaacattggtttgaggttgattgtccttggccagctgtgctgatagtgatggtattctccctcctgcttcctcttccctccgcccccaccccccacccaggtcaccacctatttgcacaaggactacaacaacctgtggattatcaagaaacata

SEQ ID NO: 15710 - DNA, 1076 bp, Homo sapiens
tagagacagggtttcaccgtgttagccaggatagtctcgatctcctgacctcatgatccacctgcctcggcctcccaaagtgctgggattacaggcatgagccaccgcgcccagcctgtatcctcctctttaagttggggaaaatgagtagtacctctctccatcaaagggcagttgtgaggattaaatgagataacaatgtgaagtgcttatgaaagattagccatgtgagtatcatctgaatgagtgaacgatgctgtgtccatgttaaggagtgtttgtgtggctgcagtggatggtgcctgagagggagaagcaggatgctgaagaggttggtggggccatattggggagaggcctgtgttatagtagatttgactttgctccatagacattagggaggcaatcaaaattattatgattatgattagatctctagtttagaaaggtaactttagtggaaatgtgatagctcacaaggaaccagtttggaggcaataattatgacaaaggacagtgaacagaggcaaaaagcatggaatctttactttgcaaagatttgttctttgcaaaaagttgtctctctccaaatgctttatttttatttcccttttagttgctagaaagtgactcagtatgtattagtgcaatttcatgctgctgataaagacatacctgagactgggcaatttacaaaagaaagagatttaattggacttaaagttccacatggctggggaggcctcacaaccccggtggaaggcaaggaggagcaagtcacattttatgtggatggcggcaggcaaagagagagcttgtgcagagaaaatcccattttaaaaatggttttaaaaaccatcagatctctggccaggtgcggtggcttatgccgaggtgggcggatcactttaggtcaggagtttgagaccagcctggccaacatggtgaaaccccatctctactaaaaatacaaaaaaattactcgggcttgatggcacgtgccagtaatcccagccactcaggagactgaggcaggagaatcacttgaaccggggaggtggaggttgcagtgaact

SEQ ID NO: 15711 - DNA, 1069 bp, Homo sapiens
tatgcggggagctggaggtactgagctctgttgggcttggctgttaaggaatattcactctggcagaggaggcagccagagagccagagaatcatagtgtagagtactaggtgctatacgaatagcaaaatggttaagagcactaacattgacccaattgcctgggttaaaactgtgccccactgcctgctagctgtattactccacctctctgtatcttgatttcctcctgtgcaaaaagaggacctagtgacaggatcctctgtgtgctgtagtgacggctagaagagttaatatatgcatcgtacttggaatgatgcgtgacgcatacatagtaagcactcggtaaatgctgccttcgacaagggcagaggtgacacaaaggagagggctgcctgagtccaggggcacctaaggattctccttttactcctgcctgactggtcacttgtgaagaaggagcccccacttaccctgagccctgtacttagccaggagcactatggacactctcccctgaagaataccctgcgccctcagacagtgcttttcctgccgttccaggggtttcacaggccgcctcctccatggagccacgccatggtcccttgaggctaagagcccccaagacagggcacagcacagccgctccaagtctgagaactgccctgtcccctgctgcgcttgcgtttggctttggttccagctgccaaattgaactccgtcttgttgattttcaggcccttctctgccccctggtggttctggctcagcctgactggcgttagtcttgctggtgctttaggggtcaagtttgttggcctctttatcatccttcaagtggggctgaacaccattgcagacctttggtacctgttcggagacctcagtctttcattggtgagcacccaagggtttgctgtggaaatgtttttgctccctgatgttgctgagtaggagctggtggccttctctgtctctactgcaggtggcagagtggctgtgttctgggtcccaggtgggctggaccccccaacctccgcagacagcaggacatcagggagtgggc

SEQ ID NO: 15712 - DNA, 1074 bp, Homo sapiens
aaattagctgggtgtggtggcacgtgcctgtagtcccagctactagggaggctgaggccgaagaatctcttgaacccaggaggcggaggttgcagtgagccgagaccatgccactgcactccaacttgggtgacagagtgagactccgtctcaaaaataaataaataaataaataaataataaaaaggacaatccagtaataaaattggcaagagacttggagaggcacttcacaaaagaagatttttaaatggccaagaaatacgagtcattggtgaaatacaaactaaattagcatacatctaccagaatggccccccaaaaaaattttaacatgaccaagtgtcagagaaggtccagagtaatgaaatgatgctacaatgctggtagcattatatttggtacaacccctttagaaaatagttcggcattatctactgaaatttaacattcaaatttctatgacttaaccgtttccattctgacatttatatccaacataaatgtatgcactgtagccaagacacaagaatattcatagcagcattattcataatagccccaaactggagttaacctaagtatcatcaacaatagatagatagctcatggtggattcatggaataacgtacagcaatgacagtgaacaaactggctgggtgcggtggcccatgcctgtaatcccagtactctgggaggctgaggaaggcggatcacctgagctcaggattttgagaccaacctggccaacatggtgaaaccccgtctctactaaaaatacaaaaattagttgggcgtggtggtgggcgcctgtagtcccagctgctcaggaggctgaggcaggagaatcgcttgaagcgaggaggtggaggttgcagtgagccgagattgcaccattgcactccagcctgggcaacaagagtgagattctgtctcagaaaaaaaaaaaaagaaagaaagttaacaaacctacctacaattacatgggtgcattttttgatgcagattttgatggatgcatcaatcaaaataatgactgaaataagcaagacccaaaagaaaacattcttttt

SEQ ID NO: 15713 - DNA, 1717 bp, Homo sapiens
acatctgagtgttgggtacaaagctgctccgtagagtgatgtgcactcctggtgggtgaggggcaggggcagtggcagtgtgcaaagaattgattactccttgcagagcctgtggcttgcatttcctactgctttctacgtttgaaaattatgacagtctctggctaggtctgggtccagattaggatttaaactgataaaggaaactgttggtaaatcctctgctcagaaagcatttatcatgttcctatttaaggattaggtttattaatttaggcctcttagaagctaacccacttaaatattactcttctgaatgctagttctcttttattcttgatgtcctaagtcaattgaatctggcatctggggctagggtctgcctgtctacatattttttatttttttctgagaaattctgaacacatagatctctttcctaaactgacattttctattttgactgttttcatactataaccaggtaaagggacttctttcagagagctttatactgcctgaccaaagaacaaatctgaaaatcaccattttaaagttattttttcagttgaaccaaagtttaagtgaagaggacttttggcatattatacccaggatcagtttgtctttttgtatccatcaagtattacaggagaaggattgggaacagaatggaaaaacagtgtatgaaagtcatgttacaggccgagtgcggtggctcacacctgtaatcctagcactttgggaggctgaggcaggtggctcacttgaggtcaggaattcaagaccagcctggccaacatggtgaaaccccgtctctactaaaaagacaaaaaattagctgggcgtggtggcgggcacctataatcccacctacttggtaggctgaggcaggagaatcgcttgaacccaggaggcggaggttgcagtgagacgagattgtgccactgcactctagcctgggtgacagagcaaaactgtgtctcaaaaaaaaaagtcatgttacacatttaagtttttgaaattgctccttttatcggtaaagattctcaatccaaattctcctgggtgtgttgtcatcagctgtgatatgtttgtgcacattacgtatagcagaggatgtaagcaatattattgtttgtgaagttttgtttttaatgtcttgagtatgagttatgtttagtcactgtcagcatctgagaactttaataagcccttgagatattccaaagttttattttacttttttaaagaacagaaaaagatgaatgaaagaaccaaggagagatgcagagactatatttagcatgtataggttaaagtaagaaggaggttgtggtaactaaataggagtcctataaaatcaaatacattgtcaaccttttctgcacatctagtttcctaccatagaatcccactggaataccacatagcttttgcactgcagttactatttactaatgtaaacgtagggtttgtaaaagtcacaaacttataagcaatgaacttacctgctagtctttttattttggcttgcatgaagtcactgcaaattcaaatgtcagtaccggcatttaaaatatatctatatcactttgttggtacaaagttatttcaagataagtgtaattttgttacaagtttattttgaagagacaaatctcctgtgatctatgcaggacctctgtactttctaaagaacaaaatgttatgtaga

SEQ ID NO: 15714 - DNA, 1050 bp, Homo sapiens
ctacagtgagcaaacagtgtcacctataataaatttaaaacttttttattgtggtaaatatatataacaaaattaatcatttttcggtacaattcagtggcattacatacatccagtgctgtgcaaccatcaccactatccatttatagaaccttttcatcatctcagaaaataatttttaatattctagttcaagtttggaagcagtagtcttgacctactgcatttcaaaatctaggctctagaaatacttgctccaccaaaattgagttgtgtctccacagtttttagcctttttgctggtttcccctcaaaccaactttttcttttgtgtttcctatctcaggtaatggcatcactattcatgaagttgtccaaacaagaaatacctatcatcgtttctctcctttatcccctgtatttagtcaccagtgcctatggatcatgcttccttaatatctttgaacctgtctacttctccatatctcattgttatttacttgacttagatttctgtccactttcacctggttttaatagccagccagtcataatagtagaggaatcagtcaagcaaaaatgctttggaagaattaaataagcaatgctgaacatcaggaattgtagatatccgtacagagagttccagtaaaattttatgagtccacgaccccttttctaagcagtctggtccatgttggtctcatacctcatatgcaggattcattcattcattaaatatttgtttcataccttgtttgtaacacttctgtctgccttctaaatgtatcctcagtccactttctaccacttgctactgtgttcatccaagtcaccatcttccctcctgtggtgtctctgcttccctctttgcatctattctaaatatagatagctctcagtgtgatcctgatgggagatcatatctatcttctgtttaagaaccctccccaaaggccttctcatcccgcctaaagtcagtgaagacctgtgggcccttgggatctatctgtctgttgacttcctctatcccactcttcccctcactcg

SEQ ID NO: 15715 - DNA, 1042 bp, Homo sapiens
ttagctggaaagagaagaaaataaaattttgtgcggaggggaagggaagggagggttctttttaagatagagttgaatgccaagagtggtaagtaaagaatttgacttgctgaagagaaatctgacttctctttattttctcccccagtttcgctttttcaattttaacacttttttgaaactttaatttagacttacaaaaagagttacaaaagagtacagagagttcctgtataccattcattcagcttccctttatgttaacatcttgcataacagtggaactgtttcttacagctaagaaattaactgtgacacaatactataactaaagtacaggacgtatttggttttcaccagtttttccgcttcaggatccaggtgaggatccacattgtctttagctgttgtagctcctcagtctcctccaatctgggatagttcctgtttttctttgtctttcatgaccttaatacttctgaagggtactggtcccttattttgtagaatgtctccaatttgggtctgtctgttgtgttgttatggtttgattgagtccgtgcgttattgagaaagctaccacagaagtgataccattctcagtgaatcatgcgagagactatgtggttttgatacatattactgatgatgtaaatcttaatcgcttgtctcaggtgtcagcggggattttctactaccaacttactgcttttctctttgtaatcaccatatattgtggcagagatactttgggactgtatatagcattttggattaaactttcacccactaactttagtatgcatctgtgatcttgcctgtggcagttattaccttggtgttcttttttttttttttttttttttttttgagatggagttttgctcttgttgccctggctggagtgcagtggcgccatctcagctcattgcaacctctgcttcctgggttcaagcaattctcctgcctcagcctcctgagtagctgggattacaggcacccaccaccatgcccggctaattttttgtatttcttagtagag

SEQ ID NO: 15716 - DNA, 1028 bp, Homo sapiens
caaaataattagccagtcatcatggcacgtgcctgtagtcccagctactcgggaggctgaggcaggagaatcacttgaacctgggaggtggaggttgcagtgagcagagatcacgcccctgcagtccactccagcttgggtgacagagcgaggctacgtctcaaaaaaaaaacttttttttttttgaggcagagttttgctcttgtcgcccaggctggagtgcaatagcacaatctctgcacactgcatcctctgcctcccgggttcaagcaattcttctgcctcagtctccctagtagctgggactacaggcgcccgccagcacacctggctaatttttgtatttttagtagagacagggtttcaccatgttgggcaggctggtcttgaactcctgaccttgtgatccacccacctcggcctctcaaagtgctgggattacaggcgtgagccactgcgcccagccaaaaaaaaaaaaaaaacttttttttttttgagacggagtgcactccaggctggagtgcagtggcgcaatctcggctcactgcaacctccgcttcccgggttcaagtgattctcctgcctcagcctcctgagtagctgggactacaggcacgtgccatgatgcctggctaattattttgttttctagtagagatggggtttcaccacgttggccaggctggaagaggaattttctctgcacttcctcttattttaaaatatgtctggctaaggtggatccactcactactctctgcttattattttggtagagcctcttgcctgttgctctttttttgcaccccatgtctggtttttcctggaagggtgccaaggcctcagacatagatgtcctgctgaacaggacagactcagtgagacttggctttccagtgttctcattttttcagttctttggtcactaagataagctggtcttaccccatttctcttttcccttaatctaaaatattggtttattagagtaaaaaaaaaaaaaaaaagaccctaccctaggtggatcc

SEQ ID NO: 15717 - DNA, 1055 bp, Homo sapiens
atccaagcactttgggtggctgaggtgggaagatcgcttgagctcaggagttccagagcagcctggggcaacatagtgaaaccccatctctacaaaaaatagaaaaattagccagatgtggtggtgcatgcctgtggttccagctactcaggaggctggggagggaggatcgcttgagcctgggaggcagaggttgcagtgagccaagatcgcaccactgcagtccaactgggtgatagaacaagatcttgtctcaaaaaaaaaagatatttgcctgctctataatgactaggaaggagggaggtgggaaagaatttcctacagttgacagtttcgtgttttcttgagctacgatttcttctttcctatcctctatgctttagaagatgccttgtaactagcagtgcagtgcctcttgtctcaattagacatttgccaccaagggagtatactgattataagaataaaatgaaaaaaaaatattggtatagaccattttctttgcctactaaccagttactttgtctgttttttttttttttttgtaatggtcttacactgtcacctaggctggagtgcagtggcacaatcactatagcctcgacctccccagactcaggtgatcctcacacctcagcctcacagtaactagttactttctaaaagctccacagtttcagccaacccaacttagatacattaactgctccaaatgatgacagatttgttttaaaaatatttgtgatataattctgactttcagcaatacagactcagtaggaaactagatattttttgaggggaaatgccatgtgattttctttggattagacagcctgagtttgaatccttcctccggtaatgatagtgcctacctcataaggcagttgtgaaaattaagtgatcagtgcctgtaaagtgatctcaatggtgtctggctattctaagcagttaaatgcattatcacaataaatgttagcttttttttttttttttttttttggtgataatatttttactgttgatattgttattccccaagacctcaaagttaa

SEQ ID NO: 15718 - DNA, 1034 bp, Homo sapiens
ctcccaagtagctgggactacaggcacccgccaccacgcccagctaacttttttgtgtttttagtagagatggggtttcaccatgttggtcaggctggtcttgaactcctgacctcaggtgatccacctgccttgacctcccagagtgctgggattacaggcgtgagccaccacgcccggcctctagtacctatttttaaggccatgattctctgttgctctaggctttctccccttaacagattgttcatgccacaaacttaaccccacttgagttttaaattgtctaaactgctgtacttgctttctgaggctttctaggatttactgcttaattaagccacatcttttgggtgggtgtcccattatatccttggagagtttattctgtctctcttgccattataagctgtgtttattttatttatttattttttacttactttcccctataagctgtatttaatagaaatataatgtccaaaatacaggagagaacagtctcttcttactctgagttgatcaaaaggattgtgtttacttctggatctgacttaatctgaaggaagctgagtatactacaacctgtcctcacacttgtgtgaggacacatcctcttgaacaagaggataataggcctggaaaccagaaacagaatctagggaagaaaagacttatgggggaacttgacagcattaaacattgaaaaattgtcctgcacaagaagtggtgggaagcagtgcacaccagtggttaaggcgtaggttctggtgccaggttacctgggttcatatcctggctctgccatctactaactgtaagactttgggcaagtttttaaattctcttgccctcagtttcatcatatgtaaaatgtatataaaaatagtacctacttcataaggttcttatgaggattaaatgttaatgtatatgttaactgcttagatcagtgcatttatcaagcacttaaaaatgatttggggttgctctaggtgtcagaacccaagaccaatgactgaaaattatagaga

SEQ ID NO: 15719 - DNA, 1014 bp, Homo sapiens
ctactacactccagcctgggtgacagagtgagatgctgtctctttttaaaaaattatatatatacacacgtgtacacgtatgcacacatataatacatattacagtgaagtacttttcaactgttcacacagaggatggggaggcacgtgagagggatgaaatccggcatgacaggcgaaaagagagacagcatgaccggaatctttccagggcagctcctgataagaggtaggtgttatttaagatgtgtaccaatcatggtggccgggcgcagtggttcacccctgtaatcccagcactttgggaggccaatgcgggcggatcacgaggtcaggagatcgagaccatcctggctaacacgatgaaaccctgtgtctactaaaagtacaaaaaattagccgggcatggtcgtggcaggcgcctgtagtcccagctacttggcaggctgaggcaggagaatggcgtgaacccgggaggtggagcttgcagtgagccgagatcacgccactgcattccagcctgggcgacagagcgagactccatctcacaaaaaaaaaaaaaaaaaaaaaagatatgtaccaatcatgaagagtggcctttttgtaccttttagagcagagttttagtccactaagatcagttttgcttctctccctttcttctttagtttgataacttaataaattagcacttaattttcttgtacttaactactttgtcttagctctagttgactgtctttggaattaatcttccatcacttaagtcagaattgagaatgatgggaatatagaaaacggaatcgagatcagatttttgaaaaggatgtagtagtaaatttggactgttatagtccgttctttttctacctcaaatggtgagataaatggattatgtgcctctttagacaggaaataagctttcatgcttttattgagatcattttatatgcatagtactgcatctagtacaattgaggagaagagcagttttgaaagaagtagaaaatcagc

SEQ ID NO: 15720 - DNA, 1024 bp, Homo sapiens
aaggaaagctgctggcgttgcccatttgtagcggggcctcatgaagtttcctacctggttacttatggggtttccgtttttttcaaattttgacctgcattgatttgcctaatgtttcccctttttacattgggggcatatagaagggggttctttcctgagttactttggtctctactatgggggcattccttgttcatatgacctggctttccgcataggaaataattttggcttctctccctttttactttaggagcccttaatgccatagccaatattttggctttgtgtgtctcagttcccaccagctgacatggttgtataagttccctgactgtggctgcctttcctctgattgcctgcattgcttgctggcgatccacattagcattttcaaaagccagttgcaccaataagatatcagtggcctgggcgtgactaatttgtctcttatttgctttggtttaccgattgataaactcaacacatggctcctgaggcccctgtcgaacatttataaaagatccctgttgaactccgcttttgggaattcagtcccaagccctgagagcacacaaagacacttgagcataggcctggggatcaaaatctagttgttgttgtacatcagcatggggacccctcccctggagcatagcagctgttatgtcttgcctgtctgcctgattctggttggcttgttgttcacacaactcatcatattctgccttccaaaggaggtattggctagggtccaaagttgttttagctagcattgaccagtcccatggggtcatacggaagttgtctgccaagtccttaattattccttttgtaaatgggctagtggctccattttctttaatgctttttcttagctctttataagcgttaaaagaaatgggttcatgttgctgattgccttgtcagtcttgcactaccaggcaggctgaaagctccccttctaatgccgcttgcttaaggcaaggtcccatagctggagtgtgtctcttgtcttttt

SEQ ID NO: 15721 - DNA, 1026 bp, Homo sapiens
gaaaaagagcacacagggtgggctccagagtggacttaattagggctgttgcaaggttctgcaataaatagagtaggcatagtcgctaacaatattgatgggctgagccgaaaaagtttccaaggccaatatcagggccccagtctcagctctttgagtgctagtaaatccagatcaagtgagtgaattatgtagtctccaaaagactgccgcctttccatgtttaccagatccatcagtaaacagtgttaaagcattaggtatgggggagtgaactgtttgtgtaggcaagatcacaggagtacaagataagaaatgaaggagtttgtcagcgggaaggacatgctctatttgttctgtgtaatcagagagtgctatttgcaagtccatcgataagggcaatactgcttctaactgctttttacttaaaggaatcctgatgatattaggatcataacctagcaactgactgcatcatttgcagcctgaatagatgactttactaagtaactggatatagggaactagtgttttagtcctggtatgtgagcaaaaacaaaaaaaccattctagaaagtgcagtcctggggtctgtggttaaccctgtaggggagtgtttggtgggaaagataaacatttgaattgagtagcctggatctatgctatctaggtgcctctgagagatggtttattctatttcctcaatttcccttttgctgcaggggttaaatatctgggagaatctagggctgtattgccctttaagatagaaaacaggttttgcagcttatccgtagatatacccagagtagggcagagctagttgatatcacctagtaatttctgatcatcatttaaggtgtgtaagtttctaatatttaatttaacattttgagatcttactgactgggaagttagtatgtacccacgatatttccaaggagaagacatctatactttctcgggtgcaatgattaaaccttttagctatgtattctttatgacagaggtaaatacatttaaaag

SEQ ID NO: 15722 - DNA, 1037 bp, Homo sapiens
ttcaattctaggaatttatgttaaatacataaaaatatggacaaaagtttttgtaccaagatgtttatcaaatgattatttataacagagaatactaggaatcaattgtaaattttgaacaataggaaattagtaaaataaaatactatataaccctaataatgataatgatgatcatgatagagaaaattcccatgaaaaaataggaaacgaaatcatcaacgaaggtgatctccatacaaatagatatttataagtaagacctgggaaaatgtatccttaaattatgctaataagtttttattttaaaatatttgttgaataatttttctcctgaatttttccatagtttttaaatttgctagaatgaaatatgtcagtgccatattttgactatcatatgccaagtaactggcttcatcattaaaaatttaaattaggccaggcgcggtggctcacgcctgtaatcccagcactttggggggccaaggcaggtggatcacctgaggtcaggagttcgagaccagcctggtcaacgtggcgaaaccctgtctctactaaaaatacaaaaattagccaggcatggtggcacatgcctgtaatcccagctactagcgggggctgaggcaggaggatcgcttgaacctgggaggcagaggttgcagtgagccaagatcgtgccactgcactccagcctgggcaacagagcgagactctgtctcaaaaataaacaaaaaaaattaaattattatttttccctaaatagaaaatatataaccaatgctttgatgccagttgacttttttttagaaatttaaaaccatgccttttaggaagaatgaatagtatttaaatatctttgtttaattcatccttcctctggtaggcgcattttgaagccaccattacaccatctgtttcaacaagatactcaaacctgtgtctctactcctgtcctctcactgtctgtctcagttgtggcgttagtgagtaaaagtgtgtgtttgctttccccttattggcctctaatcatcaaa

SEQ ID NO: 15723 - DNA, 1034 bp, Homo sapiens
tgatagtttcaatttgaaatgattataaataaaaccataaaaattaaaatgctcagtaatagtgctaacgatcaaatattatgaagtcctttgatttcatatgacattttaagggacagattttaatgaacttggtagactcttcaactgataaagtactttatagttcataaaatcaaatatgctgaaagctatctcaagatcatttattattctctcccaagtcagtgcttaaaacttagaaaaatgttgttggtccatatttggttgagttgttattaacagtacagaaggtgttgcatgtagagcatatatcatggtgctatcaatatgcaaatgtttgaaatttcaccattccattaggagtatttacagtagattgattttagcagtgcagtagttataatacctgaaaagaagatcaccttttcatcataataagaaacttggtttagcttgccaccaattatctatctgcttaggtcacagtcacatgcccatttttccccgtcttcctcaacttttccctctctttctttaatagcaggtaagctccttggattagaaactgcattttatttgcaaatgcgttgccagggtctgtcagaaatgtttgatatatagtagacaatcaataaacatttgtagaatgaaagaatgactgttaaactgcatgtatctcaacctcacataagactgtgctcaggaataaatagcattagtccagtagttgtgagaaattccccagaagcacggcaatgtattctttatttcctagaattcctggtcagtgctatatgctatttggtgtttcacagaagctctaaccatcttcactaaatgttaatgtaaattttcctgggatggaaccaccttcagccaaaatagaatgggttgattccctaaataaagctaagtgattacatgggaaaaaactttgattgagagcccctgctcatgggccaaggatgggactcagcagtggaaatttattgggctcaatatgaggcattgtgttgacaccaaggaagaaa

SEQ ID NO: 15724 - DNA, 1733 bp, Homo sapiens
gaatatcattctcattattttaggaggagaaaggaagcattttagttgtaggacctgtaatctaaatgttgtcataagtatttttgaacacattatttggtattattagaaattttattagaaatgaactgaatccttttcaatcttgttaatttctaacagtgggtttacagattttgtatatatacatgtatatgaatatttcatatactatataatagattttaattacagatttatatataatattgtattatataaatctataataaaatatataaaaatatgtacaatcttgaatatatatatttaagtgactgatttttctgagacattccagaagctctgcctgaaggatattaaatatcattagtgccatgctgtttttcagatgacccataatcatttttaagttgtctatcagttggctttgaaaaatagtctggaatctcccagttgaagggttcgattttctttttagtactgttttaggggtggagggacaggtgttagattttgtttttgtcacctcaatagtgcttaggcaaaaacatttgaaatgagcagtaaggggaaaataatctcttccccagccattatttatttcagctacttatggagtagcctatggcaacacagtctttcgaggaaaaaaatagaatataccttcttggttcttttggaacaagtgtaataaatattaatattagggtgttataatataaagaatgccagtgtagagttgtcaggcacaactgttggagataaaccgggcaggaaaagccaccaaagaatgcgactgtcattagcaaataaattaccctcctggaagctggcaagatagtacatgaacctctcaatacccagtagatggctaatcctcctggtaaggaaaccgtgtgagaaactgggctattgatcgaccaggtggataatttctgtggttttgctgtcagtcttttctgccgaactgtagcatgcccataaccagtacttttagagattgcaggtagaaatgcagggtggggcagccacgagtccattttagagttccctcggaattgctttagaaggatgagggtgacagggaatgctctgctctctcactggatctcagaaagaactgaagcaattcatttccccagaaattcccattttcttgggagatactaaagtacatttttagaaatctcaatttgaataaattgataaattaggattaactgtttaaggtttcattaaactagaaagtaatacagtccctactcatccctaagatgactcgtgagagttataacagaatttttattattctggaaaccaaaatgtaatgcatacccacgtattcttctcaaggtgcattcctcaaagcttaggcaaataactgcgtatctctatgtcttcttctgaaatgtgatttaaaaataattgttctaagcaatggcataaacaaaacaaaatacagtgttgtggggatggaaggttgggcgaccctttgccactttcaggcagaggtaacttaacagctcattaaaatctctattttctcgaaaggtgaacaggcttaccaaccttaaatttggtacaaagttacaccagaaagaacgcattagcagtctgccttggggtcaaacaggttctcagccaattaggtttacacccttcaatttactacatcaagagacctcatgagagcagggacccactctcagtaaaaaggattccactgaaat

SEQ ID NO: 15725 - DNA, 1044 bp, Homo sapiens
gcaggaagccaaatcagcctctatgctacttttgataggaaattttattccttggtatagcataataggaactgcagcattaggaaatgaaggcagtatcctttcatagtcatttccctcaaaacaggactgatgaatgaagatgaattcatggaatctacattttcaagtgaaagtcaaaagtattctgaccccatgggtgtcatctactaatgaccaaccaattaacacataaatagagcttaaggttgccttgtacagcctctcaattcagtacaggtttattcacatttgttgggctggaaaatggtgttagaaagattccactcgaattttagttgatatttctgtgatatgagcaatggatgtgaagttggcatctgacagaagttctctcttcttttcacattgggctaacttacaaatgggtaactcaagtgtctgtctttattaggggaaacataatcagttatattcccatgatagaaccaattcacttaatgtcaggttggggactaagaacagtaaatactttggacatttagagttcttcatgggcctggagctacaaggcaagactggagagtgatgtcatgagctggtttgagtgctttacgggtaaagatgtttgcttttggcaaatgaaagataggccacataaagtccaaagagcaagagaagtgttctgtgattggggattcttctacctgatggtatacccattaagagaaaattgtataattgatctgaaaatgcaaaggaagcatagtttatacatccagtaaaagtggtacatgttagcttcagttttgtacagattagattattttaacatcttgtactatattcaggtataaaaaaaaaaaaagagcattggttagtccagtctggggctaggaagaatctcaagtgtatacttgacctgcctatctctgtgaaactaatatcagcaatgcttgttgttataaaaagcatagctctttgtacactaaatgtgtatattgagaaagtcttttttaggcattgtggttgtgtgttgtgttt

SEQ ID NO: 15726 - DNA, 1042 bp, Homo sapiens
tatttagaggagataacacgatatttgactttcaaaggtttagtagaaggtatctgggtgaacaaagacactcaggaaagaaagagcagcactatgaaaatagagtctcataaagcaggctacctgggtgggacagggttttttatggttggaggtaggacatgagagcagaaattaggcaaattatattctgaaaccagatctacagagaccctagatgttaaaatgaaaagttaaaggatatattaatagtaatatttgagatgtagccatagaaggggaattctcaaacgacactgagaagaaatgataaaaaagaataggagggacttctagagagtgttgtcacatgagccaaaggaagggggtaagcctggcgtataggaatgtagtcagcagtatcaaatgctgcagagatcccaaataagacacaaatagaagagtgtccactggcttcaacaatatggaagttatgtaatgataatggtaatataattctgtgaaacaaaatgagctgtaatacttctaagtcattttatcatttggaagtaggtgccctttttttcattcttttttaaccacctcaatttttttcttccaattttatgtatattttttgtatcttgcttgttaatttttatatgtcattctccttgtccttgactctttcccctctgttatttaaaaatctagtcttgtcaaataagaaaaagataattttattctgcaaaattatgcataaaatatttttgtaatcacctattctttattaaatggtatttatctttttacataaatcattaaatgtcttcctttacaatttccttattatggtgagtaaatagacatatttatatttccatataacctgcccatcataaagaactctgtttcctgaaagccctatttgctgtcttctgccccttgtttcactctagtcttatctcttggtagcttgctatcttaattcataatgagtcttcatcaaaattagaatcaaagttagaatttacatttagaaatataaacagcatatgtacat

SEQ ID NO: 15727 - DNA, 1110 bp, Homo sapiens
tggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccctgtctcactcttaataaggacaattgtgattacatttagggatctcctgaataacccatgctaattttttcatctcaagatccttaaaatctgcaaagtctcttttgccttgtaaagttatgtattcacatattccaggaattagaacctgactatctttggggctgattattcaatataccagtgttaccatttagtattttatgactttttaaagagtaatacaggctcacttgatattggcatgaatgagagaactaatctgatatggtaaaaatttcttctgtacaagagtaacaaaaagaaagaagaaagagagaaagaaaggaaagaaagagaaaaaagaaagaagggagaaaaaagaaataaggaagaaaaaagaaaaagaggaaagaaggaaaagagaggaaggagagggaaagaaagagaaatgaaggaaggaaggaaggaaaaggggaaggggaaggagaggacggaagaaagaaagattataggaataaatttaaccaaggagatgaaagatctcgataacaaaactacaaaacactgacgaaagaaattgaagaggacacaaaaaatggaatgacatcccaagctcatggattgcaagaattgatatttttaaatgaccttaccacccaaagcaatctacagatgcagtgcaacacctattaaaatactaatgatattcttcataaaaatagaaaaaaaatcctgaaattcatatagaggcatgaacaacccaaaaacctcaaatagccaaagcattactgagcaagaagaacaaagctcgaggcataacactccctgtcttcaaaatataccacaaagctacattaaccaaaataatgtgatat

SEQ ID NO: 15728 - DNA, 1048 bp, Homo sapiens
ccactatttttgttgtttttattcttaagagggagacttcagtttaggctctatcgcaatcagaactgtatctccagttaaaaagattcattacctaagagcaacttcctgcttccactgtggttgccaggacctcctgtatctttaaagtactcttgaagtatattgatgatggctttaagatctaggggtgatccagcaatgaaattaatagtacaacaaaccagtagatttttttagttttaaacattcaaataatgccatggcattgttgaaaatggagcagaagaggaggaaagatggatgctgttgatttttctgtgggggggagcacgttttattttaaactattcctttcggaaagcttactagttccattgcttaatcccatatttctatttcattgagtagccacgcccagcttcaagcaaatgaacttttattcagcaatgacgtcttcagtgacgctgggttactatgtagcactgtattggcttttatgggattcctctgctacatgtgttgaagggtctgtggaaagacctgtgtaaggcagtagataagaatatgaattttgtttttatgacaaagcagtgactcggctaatgctattgagtagaatttttttggagtaaaattggtagtgtagataaaatattgctgaatgtctcagggtgtatgtgtaggaagaatgtgctgaagagacaggatagccaaatggctaagatagccaaatcagtgtagcacttgctatgtgactttgagaatgttacatattagtaacatttctaaccctcagtttcctctcatgcataaaacatggaaaataactttcaataccttataagactattgtgagaattggctgtgcttagcatagtacctgaaaatcatatgtaatcaatgttgtcattgaagcttttcactcaacaaggtaatgatctggtagttcttttgagttgctgtttagcatgcgtctgtctatacccaaatatgatgtaggctgtatttatattagttataaactcttccagatttatcactgcag

SEQ ID NO: 15729 - DNA, 1027 bp, Homo sapiens
attgtgtggttttgagagattttctttgtattgatttctatttttattccactatggtcagagagtatggttgatataattttaatctttttgaatgtattgagactttctttagggctgagcttatggtcagtgttggagtgtgtttcatgtgcagaagagaggaatgtatattgtgtgtttataggtgtattattctgtagatgtctgttaagtctaattggtagtgttgaatttaagtctagaatttgttagttttttgctttgatgatctgtctaatgctgtcagcatgttgtggaagtccaccactattattgtgtggctatcttagtcttttcttaggtctagaaatatttgttttattaatcttgatgcttcaatgttgggtggtgtgtatatatatataggataggtaagtcttcttgttggatggagccctttgtctttatgtaccatccttctttgtcattttaacattgttggtttaaagtctctttcatctaatataagaattgtgatccctgctctcttttgttttccatttgcaaaataatattatttctccagtcctttattttgtgctcaggggtgttgttacttgtgagatgggtctgttgaaaagagcagatggatggtcctgtccagcttgccaccctgtgcctttaaagttggacatttagatcacttatattcaaggttaatattgatatttgaggttttgatcctgttgtgaagttgttagctggatgctttgtagtttctattgtatggttgctttatagggtctgtgagctatgtacttaagtgagtgtgtttgtgtgtgtacgtgtgtgtttggtgggggtggtgggcaactagctatcattcttttgtttccatgtttagaactccctccaggttctcttgaaaggctggtctagtggtaacaaattcccttagcacttgattgtctggaaaagatattatttctcctttgcttatgaaacttagtttggcagaaaatgaaattgttttttggaatttatt

SEQ ID NO: 15730 - DNA, 1118 bp, Homo sapiens
tttttgtattaaatgtatcttgaaaagttgattataaaattcatttggaagaatgaaaaggcaagaatatccagcaaaatgctgaaaaagaagagaagtgaaaaggttaatgctaccagatattaaaacataatttaaaactggctgggtgcagtggctcatgcctgtaatcccaccactttgggagcctgaggcagatggatcacctgaggtcaggagttcgagaccagcctggccaacatagtgaaaccccatctgtactaaaaatacaaaattagctgggcatggtggcaggcacctgtaatcccagctactcgggaggctgagacaggagaatcacttgaacccgggaagcagagtttgcagtggctgaggtcatgccattgcacgtcagcctggatgacaagagcgaaactccgtctcaaaaaaaaaacaaaaaccctaaaaataatagtaataatataaaacttagagttttattttattattttatttatttatatttttatttttttattacaggcgtgagctaccacacccagcctaaaacttacaattttaaaaaaattgactagaaggactactagaacagaatagaaaatctccccaaataggcccaaatactgaaggaaatttagtttacaatgaagctagaatttgaaatcagtggagatggatataccttttaataaatgtgctgtaacaactggatatttatatggaaaaatataaaaattagatctattctgacaccattcatcagtataattttaaatgggccagaagtttaatgtaaaaactttaattattcaaatactataggaagcaaatgcttttataatgtggctacagattaaatttacatgactactagctaaaattcagaggcaatcagggagtaaagattgactaatttgattgcatagcagttttttaaaatggcaaaacattttcaccataagcaaaataaaaaacaaataatgggtgcagcacaccagcatggcacatggatacatatgtaactaacctgcacattgtgcacatgtaccctaaaacttaaagtataataataataaaataaaaaatggaaaataatcgaaaaaaaatggaaacagtat

SEQ ID NO: 15731 - DNA, 1064 bp, Homo sapiens
aaaacatttgtcaagcaaaaacccgtacacgcatgtacatagcagccaaatgtttacaacagccttaaggataaacaacccgaatgtccatcagctgacgaatggataaataaaatatggtatagtcatacagtggactattatttagcactaagaaatgcagtattaataaattttactacatggatgcaccttgaaaacttcatgcatatgaaaagtcaatcataagggaacacatattatgtggttctgtttatatgaaatgtcctgaacagttaaatctttagatactggtggttgtactatctatatcatcattaagaaatagtgattctggctggtagatgaaataaataactgcatgactacgagagtcaacgtgatgggtgatatgggatttctttttggggtaacaacatgttttaaaattgattgtggtgatggttgtacacctctgtgaatataccaaaagccatcaggttgtacactttaaatggataaattatatggtgtgtgaattttatctcaattaagttgttaaaaactaggagtctcatttaatttatttggttcactttgcatatttaattcattgaataatcctatcaacttaataaaatatattttgaatctgtcccattctgtaatcttggtttaaaatcatcatttgcccagacattaatgcagtggcctggtagctgctggtctctctgtctccactcttacattcatccagttatttatttcatctgccagcaagtgattattttttactgatgatgatacagaagatattaatgctaatgaaaaagtggttaacactcatttcacaatttcttttgccaagcattgttctaagcgctataacatgctaacttactcagtccttaccacaactctttgaggtaggtgctattactatccccattttatagatgaagaaactcaggtacagtgagattagtaattcatccaagatcacttaacatgtaagtggctgttacataaagcagatcaaggcacacttttgcttgaagatctctaatgacttttactccttttcc

SEQ ID NO: 15732 - DNA, 1050 bp, Homo sapiens
tatatagtatgatttcgttgcaatgaaatgccaatgattatgaacaaatacagaaattaattttcttattttttcttaaggtgcaattgtaagctcatattgaaataagagactgcttttattttccaagcctgctgtgactatggctattcaatgtgtacactccaaagaggtatatatctaagtaataccatctcttattccacatcagtgaggcctctgttgggtactcgttaatatttctgtctttgttcatgctgagtttagcttgacagttcaaggaaaagaaaatggctgcagtatgtactgtgtcttctgagatattccctaaacacaccaatcctcataaatatttcaccaaatgtgtttatcataatggtgtttgttaagggaggaaaggagaagtaaatgtaatttcaattaaatacctatcttcaagcaaatattcttcatgcaaaatttggtgataccttctcctgcaagaatggccataattaaaaaatcaaaaagaaaatagatgttggcacggatgtgatgaaaagagaacacttttatactgctggtgggaatgtaaactagtacaaccacaataaaaaacaatacggatattccctaaagaactagaagtagatttaccatttgatctagcagtctcactacggggcatctacccagagggaatttatgaagattatgaaattatatgaaaaaagactcttgcacatgcatgtttatagcagcacaatttgcaattgcaaaaatgtagaaccagcccaaatacccaccaatcaacgagtggataaggaaaatgtggtatatatatatatgtataccatagaatactactcaaccataaaaagcaatgaaataatggcattcacagcaaccctggatggtgttggagaccattattctaagtgaagtaactcaggaatggaaaagcaaacattgtatgttctcacttataagtgggagccaaactatgaggacacaaaggcataagaatgatacagtggactttggggacttggggggaagcatgggaggggg

SEQ ID NO: 15733 - DNA, 1074 bp, Homo sapiens
agataaagattttcaatatttccagtaatgtattcagttggcaacagaccagtattgattgagtggggagtttaaatatttaaagtttgtatttttcctcttccaaaatattgaggggagagacagtgtgtgtgtgtgtgtgtatgtgtgtgtattctgaaatatattctggaaaattcagaaatgttaaatatattatgtgaattcttagattttcttgtttcttcactttatagattatttgtgtagcaaagctgttcttccttaaacttgaatcatgagcacacttagggagatgagtaaggcaaagctccttgtgctaaaatagattcgatttgagcttttaggttactaagtagctttcattaaattcaaagcatatatttgctgtgtttttttttttttaaaaccttatattagagctaccttaaaacaaatgcagatggaaactgtgtacattttgactatttgttgttgcaaatatggatttctgggaggtcgtttctgctttgatggtgtgttgtaatgagtactatctgtcttttctataatgttgcatacaaaatgataatgcctgcctattccctccctcctctgccaaaagatgtccacaacctaacagggttggatactgggttgaatctgtgaatatgttaccttacatggcaaaagggattttatagctggaaaaaattaaggttctagagatgagattatcctgtattatctgggacacaatataatcacgtggtccttaaaagtgaaagagggaagcagagtaggattcaatatgagaaagactcagctgaagattgcttattgaagatggaagagggggaccatgaaccaagggatatgagcagcctctagatcctggaaaagacaaggaaatggattcttccccagagcctccagaaaggaaggtacccttgctaacacttgatttagcccagtaagacgtattgaacttctaacggacagaactgtaacataataaatttgcatcattttaaggcactaagtttgtgggaatttgttacagcatctatgaaaaactaatataccaataaaata

SEQ ID NO: 15734 - DNA, 1045 bp, Homo sapiens
agagttcaacaaaagtacaaattgagaaaaaacttttgtatttacaattataaagtcattgccaactttgaatacagttttactttagtaatatgacaaaaccagatgcaagggattttataaatgagttggcgtgaaggaagtcaaagcagctagcgcagatgaactattgaaatacaaggcaatgtttgcgtgaagtcatgtcgatgagtttgtgtctattgacaatcattgataagacaaaatggcccttttactattaaattaaagaaggataaatgagagagaattgtttccatgtaatcacatataaccctctttgaagtacattatgtagaacacgactgaggagaggaaacaaacagaaatgaaataaactgactttaattgaagctgtttgccatatggaactccacagaatcagcctccatatatcctagcaatgatagcacttgatagttgatttttccatcaaaatatttattgccaatacataaataaatgaatacatacataaaaaggcatataaatgaatgctagtttggaactggttgagtatttggggcaacaatttttctttttaaatccttaaattggggaactaaacttttggatactgtggtgaagaatttcatttatatatgtttatgtcagagaaaaatgtatttctaatcgactgttttctcttttgtaggttttttcatctggtcctgatatacattatgacccacatcgctggttagcagaaagcaaggtaattaatctttaaatcctaaagttattgtaatatttatgatctttaagccatcctatttggtttagctatttattttgttatgtaactgaacatatgaagctataatgcttaattgcaggggaagatatcactgcagtccacttagggaatctccatgtttcttattttaacattttaaagttaaatatgtaggcctagaaagagagaataaaggaaagtaaaactgttgaaatattaagaaccagattatagatatatgtgaacattgacaaaggaacacagaagaag

SEQ ID NO: 15735 - DNA, 1044 bp, Homo sapiens
ggaaaggtgttttccccacatcagtccagctttggagacattctgttagtgacgtatgccccttcccccaaaaacaacaatgaagtgttctgtgtgctaacaacatagcttaaaaaaaagtaaaattatgcagttttataaaacttgataaaaaatagtatttcaaactgtgcagtcaacagaagtttacacagttatcaaaaatgcacacacttcacttggcgtctccagcaccttcagttttatgtgcctggtctgttttggcatctccattttctacagggctattcccctccttgccagcatcagcttttccctttttccctttgggtactttctctcccttctttgcaggggcctttttacgcttgggttctggctttggaggagcaggtttagctgacaacctcatggatcttctgtgtgattcgtccttcaccttggctttatctcctttagcatccccttcagcctttctcttgggcatggtggcggcaggatgtaggtggtggacgcgggatgcagtggtgcacgggctttggttggttaggggttcgttctcgcctcttcttcacactgctcccattttgaagtgttaagatttgacttccctgttggattttggacttgcatggggccagtagcccctttgttttggccaatttctttcatttggaatggctgtatttactcaatgcctgtacccccattgtatctaggaagtaactaacttgcttttgcttttacgggcttatgggcggaagagacttgccttgtctcagatgaaactttggagtatggacttttgagtggactgttgggaaggcatgattggttttgaaatgtgaggacatgagatttggaggggccaggggcggaatgatatggtttggctctgtccccacccagatctcatcttggatccccatgtgttgtgggagggacctggtggaaggtatttgaatcacgggggcaggtctttcctgtgcttgtctcatgatcatgaataagtctcatgagatctgatggttttgtaaagcagag

SEQ ID NO: 15736 - DNA, 1153 bp, Homo sapiens
ggttattagacctacttaaccatggggctttctcttagaaagagcctgcaaaagcagtagtttttccagcctccgattcccatgcccaaatatacgtgcatatgtgtaagtgtgtaccagtctttgtacttaaattgtaaatgttgctctgtctttcacattctcttatctcaattttcagtataagagaaattaaagtcagtaccctatcttttttgtcgtctggagttggtgacaaaaattaatcacaactcaggagtggtcatgagctgtatcactggctttttatgtggtttaggaatactttgtgtttgaaaaatattaggataccttctcagtggaggtgttaatttaaattatggaatttaatgactggatgtatattcaggtttaataatgataatattgagattatataattgtttctattaggtgagttcacattgctcagcttctgtattatcccaataatgaggcttcctactcaaatgctcaaagtattggtgaaatttttgtaagtgttggatgtactgttaaattcagggaaggtaaatattgccccaggctttccaaatacacctccatatgttgcctaagctagaatttccacattgccagaaaatcttcaatggatgacaaattttgacaaagctattctaatatattttcttagtctgttttgtgttacactaaaggaatacctgaggctggatagtttacaaagaaaaaagctttatttagatcgcagttctgtaggctgtaccagaagcatggctctagcatctgctggaattctggggaggagttttgtgctccatccaaacaatgcaaaagaggtcaaatggggagtggggatgtgtaaagggggaccaaattcaagggatgtcctggcgttctgacaacccactcttgtctgaactaatcagttcccttgagaaccagtccagcctcaggagagcaagaactcactcctgctacaagaaggacaccaagccgttcatgagggacctgtctacgtgacccaaacacctcccagtaggccccatctcctaacagccatagtggggataaaatgtcaccatgagatttggtgaggacaaataaactatatccaagccttagcatatttttatttgtatgccattaagtttca

SEQ ID NO: 15737 - DNA, 1031 bp, Homo sapiens
tatatattgggatttaaagatatattttgaaataattatagatttataggatattgtaaaacaagatgcacagagaggtcccatgcacccaatttgcctcaatggtaacattttgcataattgccattcaatatcaaaaccaggaaattggtgttggtacaatctacttagtttatacagatttcaccagctttatatatataactcatttgtatttgtgtgtgtgtgtgtgtgtttgtgtgaagttcagtccatttttatcttgtatagattcttgttaccactaccaccgtcaggatacagaactgttctatcaccacaaggctccctcatgttctttcataggcacacctaccacatgtacagttattaaatgattaatatacagatagcagttgttcaactgaaatgataatttaggataagtgttacaaatctaagcacttacaagcatcttaatataaatgtgtgatttttataaaactatcttactgttacagaatgcaaacaagtctagcacatataagctctaaattgttaagaaacttgtgttctatcctattacatatttcaacttgaaatcatctaggcatgttaggagtttgtagaatatttagtcacttaactggtcacatttttttgagacggagtctcgctctgttgcccaggctggagtgcagtggcgcgatttcggctcactgcaagctctgcctcccaggttcacgccattcttctgcctcagcctcccgagtagctgggattacgggtgtctgccaccatgcctgactaattttttgtatttttagtagagatggggtttcaccgtgttagccaggatggtcttgatctcctgaactggtcacattttttatcgatatttatctaatggcagtatcattaaggaaattttaaatgtctcattctgaatttagacatctaaaaatttaaggaatgtcttataaatattagaaatattaggaatgtaggaaatcaccaattagatgaaacttttgagttattgggtccctgca

SEQ ID NO: 15738 - DNA, 1062 bp, Homo sapiens
cccattaaaatcactctcgtattgatcatcccagcagcctctctaatctttgagaaggaccaatagagtttacaagtaaatgaaagtttaaaagtcaaacacaatcctgtggaaagcaggaggaaaactcagaggatgtactttatttttcttattcttaggacataagccctagaattgagtccttggacaggactgtgtgagccccatggggttcggtaagcagagagtaacacaggcagggtgtcagagccctcaaaccaccaagaggctgaaagcactatcacaacaggacaaccacacatgtactactttgttggaaaatgcgtgtagcaagtgaaaatcctaaaactcctactccagtgtttattcttcacggggtaaagttgtgtgtgtagtataaatcggggcttattttgagccacactttttattcttttaaccagctttaatcccattgactatttttcttcttctgtaaagatggcatttttttttctttcactgtccagtttctggtaatacatatgtgagagctttgtccccgattatttatgttactgattcttgatatgttctctcttttaattttacctattttgaacacttttcatttctagtatttgaagataatacttactaaatatttgtttaatacgttaagtagtgaccacattaatacactgttttggtcctgtgtttaactaggtttatttctcacgtagttcttttaacatttcattattaaatatttagtacaaaaagcgttttttaatataactaaatgtgatcatatgaaatattcagacattctcttacaatacaggcttatttatttatttacatggctgatttttttcctacatctcttccaactctgttctttcatcatgaaccacttctcttacccctaaaaaaaggaactcatgttgacggcctggaaggtatccctttatatttttctgtttgcttttaattacctggactgatgtatatagactatatatacacctttgcatatatatggggactttttggtcatgtattcgtttttagaaaatg

SEQ ID NO: 15739 - DNA, 1045 bp, Homo sapiens
caggtgagtccagcagggaccatctgtggggacccattaacgacacttcacaatcttaaaacaacaaagagcttttatttcatggtgtggtttatgagcattcagaagtaatgtcatctctgcttggagacttttctagcaggacattagggggctatcatcacaggtaacctggagagtacatctgtagataaagatcctgactattttaagtaaagaagaattattggggaaaagaagctttatgtccagtgatcaacagggctggaaagagctggcagtttcagaaaagaagaaacctctcttgacagctttagtatcataccgtggactggaaatggcaaaaatcatccctaaagacaagcgaagtgttttgaagtgactcttcatagtgaagtagcaactctaaatagccaaaatttgcaaccatcgtttactcttttatataaacacgaatctgtttttggcctgatataacagctgggtagatctagtaattaaatgaatgattcagatccaggcgagtatgtttacttaattgaatttttggctcagacatcataatcaaaagtgaaacaaaggaaaaatttcctgggtcatgtgtctaggcttcaaggactaggagtcagcagccctacaaaataggaaaaacagattctacttacttagtgctcttctttctctttatcttagaaatatatatttgagggaaagggatgtactagagttttaaaattggaagaagctattggactccttcatttctacagatttaagtcccatagttaattagtgtccagcctgttttattaatcaacaggggattgagtgtgctctgcccataattcccacttattgctactcagaaagacttcctagagttcacatcttttatgctatgaggctggccaagaagagcaattcttagtttgctaggccacataagctgaaatcttgccagtttttccaggcaacacataatagcttggtcacatcaggtggattcttgtgaagagatgattaataggttgagttaaaaaacaaa

SEQ ID NO: 15740 - DNA, 1046 bp, Homo sapiens
gggggggtgtgtgtgtacgtgtgtgtgtgtatgggttttttgttacttgttttctctgttttctgattgtatctctcaatttttaaaatgttgtttttgtttagatacacagaagtaaaaacaaatggaaatttcatctcaaggatggcattatgaatcttaatggaagagattatatattttccaaagccattggagatgcagaatggtgaagagttgctttttttcttttataaataaaagaaacttaaaaaaaatgtaaagcggacagtttgaaacttggggcatatgccaaccaaaacttcgtttctgcatgtcagaaaagtgcagtagaagcaaagctactggaacaaagatagaccttgacaacatagacactacttactggcaagccatggaactgtagcacctagggtttttgggtgggagggttggggttttgtgtaggaaaaccataattgttgattttaaatacaggtacctgccaccggtaattagcatgtaaagctttgtctatattccttcctccaacttgggttcaatcagaagatacttgttggaatgaactgaagaaacttcccttttgatagattgaactgaaactgcttattgtatgtggttatatttggtaaaagttgcgtgtgagctttttacaaaagggtaagaattgtgttgaattttaattcacttgtataagaaaacaatttaaaactctcataataggtcttaaatatttttacttgctattctccctcagtgatatatacctcttcctttccagctttatgaaacatctatttaagatttaaagttatcagtgatcatagtttggagataaaatttgacccaggaatgaatatttattttaattaggttttcatacttattaaatgtaattaaagacttgggtcttgtctgagttcagtggaattgaaaccacaactttaatttccttacagaaaaacttaatttgtttcttttagtgccacaccttaaaaagaaaccccaaactagctcctcaggaatatagttttattttgcaagca

SEQ ID NO: 15741 - DNA, 1094 bp, Homo sapiens
ccagcagcaaccgcaggcccagcctgctcaaacacaagctccattggtcttacaagttgatggaactggggatacatcatctgaagaagatgaagatgaagaagaagactatgatgatgatgaggaggaagacaaagagaaagatggagctgaagatgggcaggtggaagaagtaagtttctagtaacatacttaaaataatctacttgattatttccttttttagttggtacaacactgataaattatatcctgtttttttcagagactgttaggtgctgtacaacataagattttaaagataaagttagattgttttaactttagtaaggtttttatattctggctatatttatcttcataaaatataactttcatatagctggtaataaaaaatgtataacaaattaaattgtattaatatgtgtagtaaagagtacaggtaattctaactctggcttacgcatttataatgtggcttaaacataagacattggtagataaatagatgtggttaatcttttgcttcagtaatttaaaaagcgtggcaacatttggggagagagcaaactcaagaaccaaatgtcacaaatttattaaatatttaaaaccttttggtccatgttctataccacttccttaaaaacctatgtacccttaatgtctgtgttcttctagaagcatataaatatgcctttgttttcctcactatttcagcttagttactaggctccaaaaactatttgtcccaccacaattttcactgttaattgccttcgttagcctaaaatgcagtctttttgtttcttagtacaaagttcttctaaattatctaagtaattttttttctgaagaaaacatagtttattattgaatattgaatagacacaaatgaatagaaatgtttcaagataaaaatcatcctggtgcccaccatctagttaaaataaaattccattatttaaagtgccttagatgcctctccctaatcccatcattcctaggccatcaaagtacctttgctcatacatttgtgttgattattaattgcttttatattttaccatatatatttatattcctaaatagcatat

SEQ ID NO: 15742 - DNA, 1032 bp, Homo sapiens
tacaggcgcctgccaccatgcaccactaatttatgtatttttagtagagatggggtttcaccatgttggccaggctggtctcgaatgtctgacctcaggtgataagcctgcctcagtctcccaaagctctgggattacaggcgtgagccaccatgctggacccacaaattattattaatttttaaaaacctaacatcttaatttcatcaaatttgttttccctctactgtttttaggaaactgattatgggtagcatttaggggtttggggataataatactatatatttttagacgtaatgagtgttttactaggtttaaataacttctaaagaaaatacaagtgggcaaattagctatgtaataacctacatagaaaacagttgggcaaattacctgtggatatgcagattctacttttgcaaccctggacctggactttttattttttttttttgtggtcacaaataatctttgttatcaataatgtgaaaatattaaaaatgaattcattttaccagtacatagtattactcttagaacataaattagatatcacgtggtatcaagagctgtgctttcttttgagtctagggcctgctttttgactttacagcaaaaagataagaaatgtactcatgacatgtcagacaagacaatgtgaggcactttgtggggagaccattagatgatcccccttgcctgctcttgcagacatagtactagttattccttatcaaaagtttgcatttcattcatattaaatattatctggacagtttcattttttctatttggctcttcccttactgtgccttcctgcattattggcagggttcataatccttgagaacattgtttgatttaaaatattttttatttgaaatgagactgatttctattcaaatccagtggctgggagtaagagtttatttccctagaaacttatgtttctgataaatgggatccatgaaggcaaggactatatataattttttgtgtttccaacacctagcacaaagcttggaatat

SEQ ID NO: 15743 - DNA, 1028 bp, Homo sapiens
gggctcagttctttacatgtattttttccagttctcacaacaacccttcaagtttttgagtaattattcacatttcacaaatgtgaatactgagctggcatcccaaccagatgtatttacttccaaatcttgagcacgttccactctgtctcaatgtcttcagacattctctctgctagtatatcacccaactgaaatgtcagctcctttgccagtttggcttcaactatcccaggcagaattactggtcatttcctcttttgggttcacacagcactttttatatacccataagaacactttgtgttgtattgtaattgcttttgctgtattgtggttgttggtttatttgcctgttgcctctgctagtctctgaacttcttaaaggtagtgacaaagtcttattccttcttttacatttagcttgtcataggacctggcagtgttgtgtagtgtggaaggactgagtttaaatcttgtgtcttttttggctgacattatgtttttcggacatggtttactgcctagtaacaaatagagtatgttcaataaatattgaatgagagaatataatcttagatattattttttctctattaattatttctattattaaagctgaaggataaaaatatcttccttatggggttggtgtgagattaaatgaatgaatcaaacctggagaaatgatggtgcaatagtaacttctgagattcagagaatggttatgagattcgtcatgttgttgcatatataaatggtcattttatttttattgctatagtggtattctatgatatgaatatgatactctttgcttattcattctcctattgataggcatttggggtgtttccaggttttcactattattaataaagctgctgtgaacattcttgaacaagtctatttgtagacatatttttcatttctcttgagaacaaacataggagtagaattgttgggtcataaagtaggtgaatgtttaaatttatcatttaaaccatttttaactgccaaaccatttt

SEQ ID NO: 15744 - DNA, 1200 bp, Homo sapiens
atccacctgccttagcctcccaaagtgctgggattacaggcgtgagccactatgcccagcctaaacatcagatttctgcatgaattgtcattgagtcatgactctcagtgcagcgtggaagaagtgacaggtccagacaggcttcccttactgaacacctaacactgagaaggctctgggctaagtgttgatgcatgtagggaaaagttacggaacactgggcagtgaatgagcacagaaataatgttccttctgcttaatatgatacatttactgcatacttattgtctcagtttctgtgctcagtgccttagctacttcatatcatgtactccttacaacaattgtatgaggaaggtattaatattaatccatattacacatggtggaggagactcagccagaagtgggctttgggaattcaaccaagattgtgtgctaggaaatggcaggagagcttccgcaccaggctgaccggccccaaggtcttggagcagccttcggatgccctgtgctctccttccgtttgcctcactcttcctgctgctgctgctgctgctgctctagtatcctctgctccctcattacccaggaggcagtgggggcaaggaatggaaggtaagtgatgggtggggtgctctttctccactttgctgccctaaaatggccgtgccttcaggtcatggattatattcatgccattcagattctttcacattttatctttagcctcaaagatttcctgattgctcaaaactatttatatgacagtcaatttgctcaactcttcactgatttttccaaaactaattttgagattagtcataattatgttgcccccatctgactgaggatcttatcttgtgactgacaatgcttttgatatattgtgaaagctttaccctttaaggcagcaattcacagtctggcccatagaccttgctgtctcctgagaccctttcaaggcgtctttggggttaaaatcattttcattctaattctaagatgttatttgccttttcactgcattgacatttgcattgatggttaaaaaataacagcagatgaaacttttggccattgtctactcacagtaaaacaaaatgtatatttcacccaataatatccttgatgaggcagtaaaaattattaatttcttaaaattgtgattcttgagtatgtctttttaacattctctgt

SEQ ID NO: 15745 - DNA, 1024 bp, Homo sapiens
caggcctccagggccacggccagctccaccccagcaggaggggccaccagagcagcagccaccacagtaataggcactgggtccagccttgatcagtgacagcgaaggaagttatctgctgggaacacttgcatttgatttaggaccttggatcagtggtcacctcccagaagaggcacggcacaaggaagcattgaattcctaaagctgcttagaatctgatgcctttattttcagggataagtaactcttacctaaactgagctgaatgtttgtttcagtgccatatggaataacaactttcagtggcttttttttttcttttctggaaacatatgtgagacactcagagtaatgtctactgtatccagctatctttcttggatccttttggtcattatttcagtgtgcataagttcttaatgtcaaccatctttaaggtattgtgcatcgacactaaaaactgatcagtgtaaaaaggaaaacccagttgcaagtttaaacgtgttcgaaagtctgaaaatagaacttgccttttaagttaaaaaaaaaaaaagctatcttgaaaatgttttggaactgcgataactgagaaactcttaccagtccacatgcaattagacatattcagcatatttgttattttaaaagggagggttgggaggtttcttattggtgattgtcacacggtataccatactcctctccttcaaagaatgaaaggccttgttaaggagttttttgtgagctttacttctttggaatggaatatacttatgcaaaaccttgtgaactgactccttgcactaacgcgagtttgccccacctactctgtaatttgcttgtttgttttgaatatacagagccttgatccagaagccagaggatggactaagtgggagaaattagaaaacaaaacgaactctggttggggtactacgatcacagacacagacatacttttcctaaagttgaagcatttgttcccaggatttattttactttgcatttctttttgcacaaa

SEQ ID NO: 15746 - DNA, 1045 bp, Homo sapiens
tctcaatcaagggaacagaacatttaagtctagaaactttataaataaattccatatgtcatggaagaatctcaaaactttttcattattttgaaacatagtataaatcaatgggtattttcacttataactaaatcctaaagtaaggaagtttagatggaatatatcacaaaggtttttacaatagggaaatttcatcatgatttgcctcatgatcatactagtaattggggtgtggtaactacatttaaatattccagctgttccatagcatagaacttggtatttccctctgtttttgttaagcatttaagaacgtttcattcctcctcttttggttcttgctctgaattactgtcattgtctttaaaaactattttttacatttattgtttctttaacatatatgtgaataaagacagtcttgaccattctgtttttctttctcttggccctttatcattctccatacctgatgctctaattgtttagtgtttaaaccctcttcaagtaaaccttttagttacttcgtttcctgaacttaagacccacttgtgatcttatcctggggaaagtagtggtagaggagaaagaagaatgaatgccgcaagcagcttcccctttccttgttgaatcactgatctgatcctaagcaacttactaaccatttgacttccctggaatagagtgagaaaaatgattcatgttgggcttaaagatttcttctgagactaatatatgagctgattttatgtattcatgtttataaataagtcataaatttgagatggcaacagagtatataattactaaaatgtttgcttttaagagtttgcttttaattcttttgttttttttgtttgtttgttttgttttgatatgaggtcttgctttgtggcccagtctggagtgaagtagcaagctgtcagttcactgcagctgcagcctcctgggcccaagcaattctgctgcctcagcctcctgagtagctgggattacaggcacacgccaccacgcctggctaatttttgtatttttagtagag

SEQ ID NO: 15747 - DNA, 1083 bp, Homo sapiens
gcttctagtaagtttccttttttctgaagagcacccatttgtgtttcctttagagcaggttcactggggacaaattcagttttttttttgtttttgtttttgttttttgagacggagtctcgctctcgcccaggctggagtgcagtggtgcaatctcggctcactgcaagccccgcctcccaggttcatgccattctcctgcctcagcctcccgagtagctgggactacaggcacccgctaccatgcccggctaatttttttgtatttttagtagagacagggtttcaccatgttatccaggatggtctcaatctcctgacctcgtgatctgcccgcctcggcctcccaaagtgctgggattacaggcgtgaggcaccgcgcccggcccaaattcagttttaatttatgtgaaaatgcctttatttcacttccactttagcaggatactttgtgtttttgttttttgttttgtttattcatttgtttgttttttaagacaaagtcttgctctgtcacccaggatggagtgcagtggcacgatctcggcacaccttaacctctgcctcccaggttcaagcaattctcctgcctcacctaccaagtatttgggattacagatgtccatcaccacacccagctaatttttgtatttttagtagagatgggatttcaccatgttagccaggctggtcttgaactcctgaccttagatgatccacccacctcagcttccaaaagtgctgggattacaggcatgagcccatcgtgcctagcccgttttttgtttttttgagaaaacatctctctctgtcgcccaggctggagtgcagcagcacaatcacagctcactgcagcctcgacctctccaggctcaggtgatcctcccacctcagcctctcaagtagcagggactacaggcgtatgctaccacgcccggctaatttttctatttttttgtggagacaggattttgcgatgttgcccaagttgttcttcaactcctgggctcaagtgattcacccatgacctcccaaagtgttgaggttacaggcgtgagccaccgcacctggccgcaaatggta

SEQ ID NO: 15748 - DNA, 1068 bp, Homo sapiens
tgttctttttttttgagacagagtcttgcactgttgcccagtctggagtgcaatggcatgaccttggcttactgcagcctccacctcccgggttcaagagattctcctgccccagcctcctgagtagctgggataccaggcgcgtaccaccatgcctggctaattttcttctatttttagtagagttggggtttcaccatgttggccaggctggtctcgaactcctgaccttaagtgatctgcccaccttggcctcccacagtgctgggattacaggcgtgagccaccgcacccagcccctcctttgtttttaagtgtcattttatttgctaaagaaatatgcagtatcctttgtgctatacagtttcccacgttttggatcttgctggtcatgaacttgtaatgtcattgagcttgttccattatctgctgtttattctataaactgggagttagttctagagacatgggtagatttggttctgtctttttattgagagtatttcataggtaggtggtggtgtgtactttctgttgctttacattgagagacatgtagtgtctgatttttccacttttactgatgttaagattaattagcgaggtcaggtggtatcaccctgatctcaccattctaaagttcctcattaatcttttgcctaggggttttggcaaccatttatgtttgttgcctggatcttttaattattaggggttgcaaaatggtgactttctaattctaccattcctcctgcatttgttacctgggattcttttataaagaattttctctcatcaagtctttgattaccctgaaatatagtctcatccagagaaagctagataaattcttatttcctttgcactgttgtgaaatgaaaatttggtgcccaagcaatctctgaaagagactaatgagtatgtttttgtttgtttgtatttgttttgttttgctttgtatttgagcattgtaaggatatagtaaaaaccaaaccaaggtgtgtttttctttctctttctcactgagttaacacttctgacaccagatatgttgtgggtatttcccca

SEQ ID NO: 15749 - DNA, 1033 bp, Homo sapiens
ttctgtctctgcttccagccaaagtaaccttacgtaataattgaggaagaaggaaggctctttaggcatttcataatcccggtagcagtagcgaacaaccaaactctgctaaatcaaacgtaaacaaggcgtaaagctgtgcgatggtgattgctgtcgttccctccccaacctagtcctacaaagtcaatgaaatgtacattttcagttgcagaattatctgccagaactttagcatgaattgtcagagacagtatacttagtttttatccaccgatgatgaatgtactgtttgagttcttcgaagtatgtgacttggacataatttatcctgactcttgtatgtaggtcagatactttgattaacaatgaacataaaattttcttcttttggacacaaaaaatacagtccctctatgtccatgggggatagattccccctggggatgccaaaatccacaggtgctcaagtgccttatataaaatggcatagtaatttgcatataacctatgcacattctcctgcatactttaaaccatctgtagattacttatgatacctaatacagtgtaaatgctgtatacatatttgttatacaatattgtgttttaaatgttattttttattgtttttttccccaatattttctatctggaattggttgaattcttggatatgtaaggccaactgtacctcagtgtttacatgtgaaatcttaagaactaaagttcttggaatcagactaccttgtgattccattttccttttcataactttatatagaaaagtatagaatgtatgtttaagctgcccaaaacaggttatataaagaagtatgagtagcttaattttgtatattaagtttgtaaaacatcaaaaatgcatactccattttgactgcagacactactagtattacgtatacaacaaaacagtggtgaacatttatacatgaggaagaatataatggttttattattatcattataggaccttgtgttggagctcatttttggttatcgaggcagagac

SEQ ID NO: 15750 - DNA, 1027 bp, Homo sapiens
caataaatgtttttataacaaatattatgtatttaaagtagttaatttttgtcaaatttccagtatttgtgaataaaaatatttaaatcaatgtttaaaccaatgtgacataagttagacatttttgtatttccttaaaattctgttgacatgttgcctttcttctgtttgctaaaatgctgtattctattcatcatcaatttttatatgttttcctacttttttcccccttgctccttttgaaggcagggagtagtaaggtaagtgttttataaaagaaaatattttattcaaaaatttaccctttattttattctttatggtattttaaggtattttttccctataaaacatttaactacatttgtcaacaaagcattataaaatgaagtaggacaaattctataaaagagttgcatttttagatagcatatatggttgttattataagggtcttcattatgataaattgttttacatatgactgtacaaactactacaatgcaaatgaatagttttggttttctttaagtttcagaggctcgtaaaaacaaacctaaccacacatatatttaagtgaaagactattcaattttaaacctgttaacatgatttaatgcatgtttaatccattcatttaaaaagatgaaaagagggtaactatggtatttgtatgtttaataaaatgacatgtaggtaaagactctttgggttacttttatatctacctttggtgatgtgaaaatgtcttgaaagagtttctgaaacgacagtgtggaaatggctagtctgttttataaattaaaaaaggtatcatggctgggcacggtggctcaggcctgtaattgtggctcaggcctgtaatctcagcacttgggaaggccgaagtgagaggattgctagagcctgggagttcaagaccagcctagacaacatgatgagaccctgtctctacaaaaaataaaagtaaaaataaattagctgggtgtggtggcagccctgtggtcccagctactcaggaggctga

SEQ ID NO: 15751 - DNA, 1259 bp, Homo sapiens
taggtcttatgtttaagtctttaattcaccttgagttaatttttgtataaggtataaggaaggggtccagtttcagttttctacatacgggtagctagtttccccaacaccatttattaaagagggaatcctttctcattgcttgtttttaccaggtttgtcaaagatcagattgttgtagatatgtggcattattcctgaggcctctgttctgttccattggtctatatatctgttttggtaccagtaccatgctgttttggttactgtagcattgtagtatagtttgaagtcagctagcatgatgcctccagctttgttctttttacttaggattgtcttggctatatgggctctttttttagtttcatatgaaatttacagtagttcaattctgtgaggaaagtcattggtagcttgatggggatagcattgaatctactttaaaccaacaaagatcaaaaaagacaaagaagggcattacataatggtaaagggatcaatgcaacaagaagacctaactttcctaaatatatatgcacccaatacaggagcacccagattcataaaccaagttcttagagacctacaaagagacttagactcccacacaaaaatagtgggagactttaacaccccactgtcaatattagatcaacgagacagaaaattaacaaggataatcaggagttgaactcagctctggacaaacggacctaatagacatctacagaactgtccaccccaaatcaacagaatatacattcttctcagcaccacatcacatttattctaaatttgaccacataattggaagtaaaacactcctcagcaaatgcaaaagaacagaaatcataacaaacagtctctcaaaccatagtgcaattgaattggaactgaggatggagagactcactctgaaccatacaactacatggaaactgaacaacctgctcctgaattactactgggtaaataacagaattaaggcagaaataaataagttctttgaaaccaatgagaacaaagaatacagcataccagaatctctgggacacagctaaagcagtctttagagggaaatgtatagcactaaatgcccacaggagaaagtgggaaagatctaaaatcaacatcctaacatcacaattaaaagaactagagaagcaagagcaaacaaattcaaaagctagtagaagacaagaaataaagatcagagcacaactgaaggagagagagacacaaaaaacccttcaaaa

SEQ ID NO: 15752 - DNA, 1026 bp, Homo sapiens
tccccttttaattttgataactagaaaatgtttctaatttttcaatgatctcagctatgaattttaaaggatacttactatattaatcttcccttaaactcaactttctacctgctttatgcctgcacccaaccagcagaataagcattgagtaaaacagggaactgtgataattgacctcactactattctgtttctcttccctcttttgtagcagaactcctcaaaatagttgaggcgcccttctctgtgtgttcacatgacagtagctccataacccactccaattaggcttttttccctacttgtccatttaacctgctgccaatctgttgatcacttcctggttctcagtgtattcacctcacagcagtttgtgacacaatttatcattcccttttttttttctgaaatactttattcacttgtctctggaacccgtgcgtgtctgtttcttctctctacttcactgactccctttttctgtttcctttgctagtgctatctcttcttcctgcactctgcatttaggactgctccagcgcttctccccggacttttcttttcatatgtacactcacactttagattcagtcggtcactgtccagtcagaagatgagactacaaggcttatttgaacagtgggaatttaataaaaagaattgctaactagcaaaaagtgattacctactgaaaaagccttagaggtagccaccatagaaagcagcaaccctagtactaagggagagtgaacaagttaaaggtgattcagacctgtttggaaatggtgtggctgccaccagaacattcagtgagcttgtggcgaaaaagcttgccagagggtgcagccctcagtggaacagtgagagtagtcacttggtgaaggagaagcttgccagaggcagcaggccagagctgaatggtcagaaccactgcttgaagagcttaacctagggcaaaatcattgaactgtgaggactcctgccagagaatcttcctgaagtccgcaaattgcagctaaattg

SEQ ID NO: 15753 - DNA, 1155 bp, Homo sapiens
gtcttacttctgagatctctattctattcccttggtctatgtgtctgtttttgtactagtggccatgatgttttggttactgtagccttgtagtatagcttgaagtgggattagcatgatgcctccagctttgtttttatggcttagcattgtcttggctatatgggctcttttttggttccatatgaattctaaagtagtttttttctaattctgtgaagaatgtcaatggtagtttattgggaatagcattgaatctataaattaccttgagcagtgatatagtttggctgtgtccccactcagatctcatcttgaattcctacatgttgtgggagggacctggtgggaggtaattgaatcatgggggcaggtctttcccgtgctgttctcgtgatagtgagtctaatgacttctgatggtttcatgtgtctggcatttcacctccttccactcactctatcctgccaccctgtgaagaaggtgcctgcttctcctttggcttctgccatgattgttaagtttcctgggacttcctcagcaatgtggaactgtgagtcagttaaatctctttcctttataaattgcttagtctcaggtatttcttcatagcagtgtgagaacggactaatacagtaaagtggtaccagtagagtgggatgctgctgaaaagatacctgaaaatgtggaagcaactttgaaactgggtaacaggcagaggttggaacagtttggagggctcagaagcagataggaaaatgtaagaaagtttggaacttcttagagacttgtagaatggctttgaccaaaatgctgatgatgacacaggcaatgaaatccaggctgaggtggtctcagatggagatgaggaacttgttgggaactggagcaaaggtgactcttcttatgttttagcaaagagactggtggcattttccctcagccctggagatttgtggaactttgaacttgagggagatgatttagggtatctagtagaagaaatttctaagcaacaaattattcttgaggtgactttggtgttgtttaaagtattcagtttttaaagggaaccagagcataaaagttcaggaaatttgcagcctgactgtgacagaaaagaatatctcattttctgaggtgaaattcaagcca

SEQ ID NO: 15754 - DNA, 1043 bp, Homo sapiens
tacaagttgtgtgaccttgggctggtaatttaccctcactgtaaataaggagaataagaataaatatattatttaggatataggatcctatatatgaattgatatttctcaaatgtttataaggatagcacataataagcatgtaaatgttaattggtattttattttcattagttttgctaaacattattgtgctttaaagcttacaaaataatttgagactttttcttatctgatcctcacaagaacattgtgaggtacacggtgtctttatattggccatgtaacacacatgagaaaactgaaaaacacggtagctttcctaagattacaaaagacattcaggagtaggcagaaaaagtaaaattctctctttttaatgatattataagtatattgaagaaatatagacaagtaaaaagattattaaaaggaaaagaatacaattctataaaggtaatttactaattgagtacttattgaacaatgcagactgaagtgttataagactggctgagcaagtagacatggctagagttgtctacaagggagaaggaagaagagtacatgtcttgaaggatgggtaggaactaggtacataaaaagacaaatatttcatgtagaaaacaacatggacaattgaagaaaatgtgagtatagatcaaggacttacatatttcttctgtctcacatctaagatataaaaggtacaaaattaacttcaatttaggaagattggaattattgacacaggatattttgggtgctaccttgccagctggagacctccatggcgggcgcaatgcccctgtcccgggctgcactgggctccaggctcgccaggaggtaccctgcccacttggcctggcaggctgcgcttggcttatactctggctggatcccacacttgctgcaggatccatgctcagcctgtggctgggccgggtgtgctgtgacctgcttctgccttgggcgttggcgtctggttgaagggaatgtggtggcacctaaaaaacttggggactctagcggccctgaagccc

SEQ ID NO: 15755 - DNA, 1051 bp, Homo sapiens
aaatacagggtgcaatttgtggaaaagtaatatagatatggtcaattgatttttgacaaaagtgcttggggaagtcaatggagaaaagatagtcttttcaatacatggtgctggaaagttaggaatcttacataaagacagcaaaaaacaaacaaacaaacaactataacctacattacactttatacaaaaattaactcaaaatagattgtagctttaaatgtaagacaaactataaaagttttagaaaatatcagaggaaatctttattacctttggttaagcaaaagcatggtccataaaacaaaagtcaatgaactagatagacttcataaaaattaaaaaatgtttgctctgtgagagaaacagagaatgcaaagaaaagctacagtctgggagaaaatatttgcaagtcccatgtaggacaaagggacttgtattgagaatatatgaaatactttgaaaactcaaaaatataaaggcaacctaatgaaaatggctagaagacttgaacagatcattataagaccaattagtccatgtgagtagtcatcagggaaattcaaattaagaacactgacactaccaaatattagtaggaatgtggagcaactggaactttcttacattgctggtgagagtgtaacatggtacaactactgtggaaaactgacagtttcttataaatctaaacacggacccaccctatcctttttctctaacttgactttgaatacctctgttctattgtatgaagattttgtagttaaactatgaggacctgcatagtttttctccccagtttttttttttttttttttaagagatggtgacttgccctgtcactcagactggagtatagtggcatgatcacagctcactgcagccttgaactcctggcctcaggtgatcttcatgcctcagccttctgaataactgggactacgggcatgtaccatcacacctggctagttgttttattttttgtagaggtggggtcttgctgtgttgcccaggctggtcttgaactcctagcctgaagtgatcctcc

SEQ ID NO: 15756 - DNA, 1030 bp, Homo sapiens
ttgagatgtgtgagataaatgtaaaggaacattgatatatttgcatgtaagaatggagatttatgaggaagatgatagctcactttatgtttgtttaacatgttatttccttatagttatgataaatttagagattaaatacttaaagcaacttaatatgtaattgtgggatttgatgacagtgcttatatctaattaatttccattactcagcaatattaataggaagaagaactttaaaaaaatctgttctttccatatatttcagatgatagtgtcacaatatggatgggtaataatcttgttaaatgttttagaatgggaatataccctcagatgattacatctgtcatttgtctcccaaattaatccataaatgttgagtttttactatatgttcagcaatatactaggcattatgtggatgaaacttaactgtaagatattaagttaacctgaaggatacctgaacaacactcatgctttcattctcattaagaaaattggaccaatcggaagagaatcttcagattccaactgtccaaaagcaatacattcagctcctatccaatattaatcctgctgcttgtgtactggatcccactcttttttccctgtttcagaaacgttcttatcttaacctacatcagcattttttctctgtactgaatggtctcttgtcaacaaatgatgtgaaaaacaactgaatatctattatgaggaaaaaatgaaccccagcatatacctcaccatatataaaatttaaaaggtgagaggtaaaactataaaatttctagaaaaagcataggaaatagaacacaaaaagcatgaattataaaaagtaaaattataaattgaacctcattaaaataacttatcagacctccaggtaagtgaagacaatggcaggtatgtagtaagtaacctcccaaaatctcttctccagactttctgtgcaaaccatagccccagcattacttaaacagagaataccaaaactgcaaaatgactgtaagtaaaaagagaaaaa

SEQ ID NO: 15757 - DNA, 1087 bp, Homo sapiens
aggagtgagtttagataaaggatctaataaatggattcctgtggcactccaacattttaatgtaggggagatgaagaactgacaaaaatgtggccagagaaacacgagaaaaaccaagagtataagatcatggaagtcaagtgaagagagtatttcagggagaaaggaattatcagctgtgtccaataagatgaggactgcttcaccttagcgaagttttgctataattatattgtaatcataagactccccaaaagactgtgtatgcccaggggaaaaggaagagcaggaagaagatgagaaaatgagtcatgtcattattggtacacaaaactagcctctttcaagattcgttccaatgtataactattatgtattcataacatttcttaaaaacagatttgttccagcagtttctgctttacttggttattaaaaaaatgacacatagctggcagccctggatcgttgcttctgaaaagtgtggtcttcagactagcaacggcatcacctggaaagttactaaaaaatacgaattatctgggctcattccagatctaccaaattagaaactctaagtgtagagcccagtaatcagttgtgtggttttgttttttgttttttgttttctgttttttgcttttttgagacagagtctcgctctcgtcacccaggctggagtgcagtggcatgaactcggctctctgcaacctttgcctccgggttcgagcgattatcttgcctcagcctctcaagtagctgggactacaggcacctgccaccacaccaagctaatttttgtatttttagtagaggtggggttttaccatgttggccaggctggtcttgaactcctgacctctggtgatctgcctgccttggcctcccaaaatgctaggatcacaggcatgagccactatgcccggccccagtaataagttttttatcacctccaggtgatgttaatataatctaaagtttgagaacactgctccagattcctgattctcaaccctggctgcttaatagaaagttaaaagaaaacaaacaaaataaaaccaccaatggccaagccttacccaaagaa

SEQ ID NO: 15758 - DNA, 1029 bp, Homo sapiens
agagtagagtttaccccagtgtcttgtctttttccctaatcctttcaagtctcccttcttttccatatgctaggtctcccaaagtaccaggcatagtagctttacctagctggagcagccttaactgaagccctgctccagataatttagtctgttaggttgaattcagctggtggagtaaatgtgaaggattttgaggtcttctcgtggtacacttgtattgtttttactccttgggggttatgagagcagtatagcactaaggtcttctgaaactagatatgatttatttggtgaggtaaattacatcttgttcttctagcagtaattagaagctgtgttatatgtcacaccgcttaaatttcataattgtgtttcagtaaactgtaaggaaggtaatgctttgactttcttttggtatagttgcacaacttatacaaaacaacaaacatactcgaatttctcatcgttgaatatacatgcttatgattttatccaaatgacacatctttaatgtataacaatgaaaataagtttcctgaaaagtttcaatgagggagtaaaatctgaatcatacagcatcttgaaattggtggcacaaatttaatatgatactgagaatataatttaggaatcagtgaaagggctctggacattttatttcaaatagtaatgacagatcattcatgtttgtgaaatatattgagctaatattaaaacctcaatattttttcagttcagtgtttgacttgtgagtatagaaacaactctagtaatttttaaattatgccacagcagaagatgtaatattcacaaatgtgatgcatagtgaaaaccaatgttgctgtaaccttagctttagtaataaaaagtcagtgctgttttcatcatctgttttgtttccacctttgcctgaaacttatgtaaaacttattggtcaaatattacttagtctgaggatagaactgttccagaatgagcagatcattgtcctcaggttttgaaaatgtgagtgcaatgttggtggta

SEQ ID NO: 15759 - DNA, 1045 bp, Homo sapiens
ctgggcaacatagtgagaccctgtctctgtttaaaaagaaaaaaaaattgaggccaaattgtttcttatcctacagaaacactaaaggcagattccatagtttagatactctcagcaaaacttttgcccccaattatttccttttttaaaatttttattttattttattttttaaaggaagggtagagggaggtaggagagaagagcaaagaaaatgatgtttatttcactaaagaaaccatcaattgtgtcatcccaggtagttttgggcatcgccttcctaggtgaatttgggtgggaaggtggggctgccttcccggcttgctgagatgtttcggtgaccaacaggtgtcctcctgagctcggctgggtgtctgtgcccctgactcctgggttgagctcctttttatagtcatttgtaaatgaggccacaaaataaagaggcagatttcatgtggcccacactccttagattcacggtaaacattacggatttctctgtccacttgtattagtctacgtcccctgccctctggctgtcactagactggatttacatttttttgtatcttaatatatgtaagcgtctttccattagaatccaaagaccttgaaactctgtggaattgtgcataattttcatgtatttcctgtcttgggggaccaggcaacgctgacagatgttaaaatgagctggtatattcccagctttagttgactctgtccagagctccccagccccacagtgggcataggcagggtacttctcaggtgacatcagctctggagagctctgtgtgccacagcaatggccagtgatgggtttccacggtgacaactaagttctcaagaaaagattgtgtaggccgggcgcggtggctcacgcctgtaatcccagcactttgggaggccgaggcgggcagatcacgaggtcaggagactatcctggctaacgcggtgaaaccccgtctctactaaaaatacaaaaaattagccgggcgccgtggcgggcgcctgtagtcccagctacttggaaggctgaggt

SEQ ID NO: 15760 - DNA, 1612 bp, Homo sapiens
ttgtgaacaattttgagtctcattagaggtgtcttaattttaaaaattaagttgggaactagcaagtgagattgaagaggctatatctttggttctgacctggattttctttactcaattactcttcaaattatactgatttgagatgtgattattattatttttcctaagtagattggataatgagagaaatgcaaaggcatgctagactaatagtgatctgagtttctgctacctcacttgtccttccatttcccctcccccagccagagcaccgccccagcccctgcttcctggtctacctggtgagccacctaacctagcgaaggcagctgcttccctgtctttccagcgtcagcccagctatgaccactgcagcgccagggatcctggccaacttgcgcattgtaatcacgtgatgcagtgctcaccatcctgcagcagtttcccatgttagttcccagcccttccttatatgcctcatttaaatgtaagatttaaattgtaccgtctaccctgagaacccactgtgtagccaccctcatctcctcagggtcaaacctgctcacagtacctttatcagaattgcccctcaactgcttgaaacacatttctttcatctccctgtcttttttcctgtagggaagaagggaagaaggtaaactacctaaaagggagatggtgatgttttctccccgcatcctgcttcatcacttttcccctttgcttttacatacacacgtgtcatgctcaagtgctgtctgtgcattgactcatggctcgtgcctttggtatgagcctcattactgggtgagcttcgccaaatgagcttttggtgttgctgcaaatacaatggcgtctcttttgttttagggcctggagtgacattgtgatggagaagtgcacagttgaccatattgagccggtcaggagggtagatttaagagaggcagcaacagcagcctctcgtataagcagcagagtcttccctgacaccttacttatttcccccaggatctgagctcattcgccatggcaggaaccactaagattgtttggttatcccgttacttctgtcttccagccagactgtaatctccttgaggctggagttttcttatctctatctccagcaccttgcaggttacccagcacacggtaggagatcaatgaaggtttgtaaaatatatccatgtaacttactgttatggactgaattgcatctccaccgcccccccagccgcctccaaaatttatatgttgaagccttcaccaccaccgccccgcatgtgactgaatttggagatagagccgttaaagaggtaattaagatgaaatgaggacataaaggaggagtttttataaggactggtgtctttgtaagaagagataccaggaatgtacatgtactgaggaaaggccacgtgaggacacagtgagaagtcggtcacctgcaagccagggagacagcctcaggagaacccaaacgtgccacctctttgctctttgatgtcggacttctagcctccagaactgtgagaacatcagtttttgttctttaaaccacccagtcttagtattttgttctggcagcctgaactgacttaatata

SEQ ID NO: 15761 - DNA, 1026 bp, Homo sapiens
gctaggtttacagcagtgagagatgtagtagcaaacaacagtggccatgaagaagcagcggctcagtccgaaactggggaaatcactgaaatgaaaggtgcagagtttcacaaagaaggaaggggcaggagccccctcatagaagaataggaggccaatttcagcaaaaaatttcagggctctggggttttgtattagcatgcctctttctcctcaaattaggattattttatttttattttattttaatttttttttgagacagagtcttgcgctgttgcccaggctggagtgtagtgacgtgatcttggctcactgcaacttatgcttcccagattcaagtgattctactgcctcagcctcccgagtagctgggactacaggcgtgcgccaccatgcgcggctaatttttgtattcttagtaaagacagagttttcaccatgttggccaggctggtctcaaactcctgacctcaggtgatctgcccgcctcagcctcccaaactgttgggattacaggcgtgagccaccgctcgcagcttaatttttgtttctaatgtcagtccctcctgcccaccccaaataacatctattgcttttgttaccaaaataatatgtctttgttatagaaaatagacaatctaaagatataattactcctaattttaccatccacatgtaatacctatacctttttttttaattgaagtgagactcataaaattaatgattttacagtgtacagttcagaggcatttaatagttgcagcattgtgcaaccatcacttctttttttttgaaacagagtttcgctctgtcacccaggctggagtgcagtggtgcgatctcagctcactgcaacctccgcctcccgggttcaagcgattctcctgcctcagcctcccaaagtagctgggattagagacgcgtgccaccacacccgggtaatttttttgtatttttagtagagacggggtttcaccatgttggtcaggttggtctcgaactcctgacctcaggtgatcc

SEQ ID NO: 15762 - DNA, 1056 bp, Homo sapiens
ctgcctcttgaattttcctgcctcctcaggtctttctcttcaccccagtacaacccagtatccaaagtcagcaactcagaattgtctttgattcttcccttgactcaggtaccaacatcctattgattttgtctcagaagtgtcctcttgggcccaggcccctggtggcctttcctgttggcccagtctgggccctcagcacctcatcttcacactccctgcaatagcttctctgtctggtgtttctgcctccgttctccattccagcccgtctttgatgtaaccattgtttagtccaaaacctaggttgagttgacattgcccatgaaatagaatacagatgcatcgggtcggcggcttcatctggccacggtgcaggaaggcagggagaacccggatttgagtggtcagctccaccagtcactgctgcgcacaaccaggctatatcacctgtctgtgcattagtgtccttgtctgtatctgaggataaaaacactgcctttctcatagggttgatgcaaggattaaatgagtgaacatttaaaatccttagaacacagcctgacacataaaaggtgcttgataacggttagccaagattatgttttataattatttcttggcattctcccctctgggctgtgagctgcttcctgtattgtgcctggctgtagctttttaataaccaattgctgaatcaatgaatgagagaaagaaaaaggggccgggtgtgttggctcacacctgtaatcccagtactgtgggaggctgagatgggtggatcacctgaggtcgggagtttgagaccagcctggtcaacatggtgaaactccatctctactaaaaatacaaaaattagctgggcatggtggtgggcacctgtaatcccagctacttgggtggctgaagcaagagaatcacttgaatctggcaggtggaggttgcagtgagctgagatcacgccattgcactccagcctgggcaacatgagtgaaactccgcctcaaaaaaaaaaaaagagaagaagaagaagaaagaaaagaaaaagggagggaa

SEQ ID NO: 15763 - DNA, 1549 bp, Homo sapiens
aaatacatgttgagaattagtgtcttaatcatagaatattgcagcagaaaagaacctaaaatcacccagtttagagtccttaggtgggacaccacatgaacagcttcctggggttgttaggactttagttttgagtatacatgaagttgcccgtggtcaataagtttgggaaacgcagctcattataacttctttgtagtaagccaaaattaagatatttcctacattttatcaaacagacattaaaaaaatcacagcacactgatcaacatattccaaggaacaccaatttgggaacaagtaatctaaaataaagattaccactccgtaatgggttatgaaatcaatgtaggggttacaactatctttttgttttacaaaaaataatacagtagaataagaaataccagagtgcattgcacagaggaggctattattttgtgaaacctttgtttcagttatgtatggtatatttgtgtgaactcagtcagaatgaagcctatttgttactataaatggtggccaaaaatacgctggagaagactggtctgattcagttcctcaattttacaactgaaaacacagaggagacccatgtggtcctaagatcacacggggagttagtaacagattgagtctgagtctgttcttcatcctcagtccccttcaccactgcttttgctaaatccatagaccatcctgtttaaaaagcaacactcagggaaacaacgcaaacgtccatcagcaggtggtggatgaacaaaacgtgtcttgtacagacaatggaatattactcagccttggaaaagaatgaaattctgacacaggccacaacatagatgaactttgaacattatgcagagtgaaaaaagccagatacaaaaggacaaatatcatatgattccacttatatgaagttttcctagaatagacaaataacatagagacagaaagtggattagtggttaccagggcctgggggaaggtgggaatggggagttagtatttaatgtgtacagagtttgggatgatgaagaagttctggaaataaatagtagggatggttgcacaacagtgtgaatacaccaaatgccactgaactgtatgtacacctaaaaaattgtttaagtggcaaatttcatattttgtgtattttatcacacattccaaaatgaatctaggcgcaaaagaagaagaggaaacagaacaacgtagcatttcttgtagacagacctcatttcacattccagcagccgtttattccttcagcctaccccttggtgggcccaggtcctgaggattctgaggcaaacaggacaggctccctggccttaggaatccatggaaccgactgtggccaagtgtggccttgattctggaatccctggcaggtgatgactgctggcatttccacaggtgatgcattttacagcagcgagtgatgcttagccaatgacctttcatgtgctaatagctctgatttttccaattgcagcatttggataaacccacaatttgcttttggaatgccaaggaaaaacatcgttta

SEQ ID NO: 15764 - DNA, 1049 bp, Homo sapiens
gctaaatattgagatgtgtagacccgtgcctctgttttccttttttgcttttttttgagacggagtcttgctctctctccaggctggagtgcagcggtgcaatcttggctcactgcaacctccgcctcctgggttcaagggattcttctgcctcagccgcctgagagtagctgggactacaggcaggcgccaccacacccagctaatttttgtatttttcgtagagatggggttttaccttgttggccaggctggtctcaatctcttgaactcatgatccgcccgcctcggcctcccaaagtgctgggattacaggcgtgagccaccgcgcccggcccatgcctctgttttctaaagtgcccttttgaatgtatgttaggatgttcttccacacctgctttgttgataccaaatttgtgaattgtttttaatcgaagtgcagagctcagcgtggagtacttcaaaccaagtgacttaaacaacagaaacttactgtctcaaggttctggaggctggaagtccgagaccaatgtgtcggcagggttggttccttctgtgggctgtgagggagggtctgttccacccctctctcctagcttctggtggtttactggcattttgctggaatgcttttggccttccttggcctgtcgaaacatcactctgatttctgccttcaccttcacttggcattcgttttctccatgtggtgtctatgtccaaattttcccttcttgtaaggacacactggtcgtattggcttagaggcccatctttctcccgtaataattcatcctatttaactaattacattttcaatggccctgttcccaaataaggtcatgttcagatgtactgggggctagatcttcaatgtaggaattttggggaggcataaatcaccccatagcaacccttttcttaagggagacattttgctgatgaatatatggagaagcagaaagtaaggaaatatttaaagaacaaaatggtggggtggggggcaggggtgtcaaagggattcgcctgaagttgctcctagtagccaa

SEQ ID NO: 15765 - DNA, 1048 bp, Homo sapiens
ttctgcacaaactgaaattgttacaggctatccctccctggccagggcagaacaggcctgggcagaggtggtgcctgctccactttgacatggggcctgcctccttatccccgttctttaggcactgccccagagccacgtgtaagtcccccactgttgctaatagggggctttcttcctcacaagtggtgagaagggggaaaaaacacaaccagacactactgtcctagatcagtggataccaaactttgttgacccggcttcccagtaagaagtgtatgttacttggtgatcagtaaacatgtatatacacaactatgcaaatacaaatttcactatatgttactgcagatatatggtagtccattctatttggttctagtttgttacattctgttccattaaaacagtgctgcttatgatccattccgttcatttcatgacccatgaatgtatctggcccacggtttgaataacaatgtttaaagtataggctgggcgtagtggctcatgcctgtatttccagcactttgggaggccaaggcagacggatcacctgaggtcaggagttcgagaccagcctggccaatatggcgaaaccccgtctctactaaaaatacaaaaaaaaaagaaaatagtcgggcatagtggcgggcacctgtaatcccagcctctcgggagactgaggcgggagaatcgcttgaacccgggaggcggaggttgcagtgagctgagattgcgccactgcattccagcctgggcacgacagagtgagactccatttccacaaaaagaaaaaaaaaaattactttttttttttttttttacatttttgctaaccatttcttcctacaatatgggctcttgtttgcttttctttttgtgcattgattttttatttttaatagagagttgatttttattcccccaggtggtttttaattttaaaagaaacttgggctcatccataattttttttactcatttttccatgtaatttttctcagttttttttctgggggtgttagtgtatatatacacacaaaaa

SEQ ID NO: 15766 - DNA, 1033 bp, Homo sapiens
tcagtgcatattgttattagtgtggtgttttttgttttatatcttgtaggtttgctggagattttttttttttttaccccatgagacagcgcatagtttttaaatttgaaactttggttcctgttttaatttcctgtgggttaccctgacctagtaaataacaacagtggtcttcaggatgaggttgactgttaagtcttaaactcttggaaagtttggttgtatggtgctcttgttacaataaatgaattcctgttataataaatgtagttaatatcaactctatatagtggctcaggtaagattttgtttcagtcagctgttgtcaaattggaagcctcactgacactgttgtcctatttgcaatttttatgtgcgtttagactgactctgaaacataatagtaaccattgatgatgcacttacaaggaattctacagagaatatttttagtaataccatacttttctaatactgtaatcgagttttcatgtttcaaagcttactgtgctttttaggaagatgaattctgttttttcaagttttgcaggatagtaaattattatggtagtttcggtggcatatttttttttcctgcctgattgctatcctttatgacttggggaaattgcaggggaattattatgtacatactgtggcatgtagattccaagaatgaaattctgggataatcaattccgttttttattttgtcagtcacggtcctggcagaagacagatggcacactcagaaagaagaaactgtggggagaggatgagttctcagtggtaggcagggatgcgagaaactagcaaagccgggggtgcactcccccaggatgaggatggcaggctacccccagggaacttccatccccccgggacctgaacgggtgaaggagaagagcagataatagatgccagaggagaaagtagctgggctaatgggtgtctggtgggggtcatggtctttgatagcagggtgcagctcactcactgcagcccagcacagagggagtcagggggttaactt

SEQ ID NO: 15767 - DNA, 1055 bp, Homo sapiens
tggaactgtagtgatcagcagctcttcaccctgttggtataaaatgcgggatttatagggatgcagtgagtggttggagagtacggggtcccagcacaaaacgcacacatgatccaagggtactgaactcccataaccctctcttcgtgacaatgccactttttctcctaaaaccatattgctggcagtgtttgtttaaaacaaaaggaaacatggagaatagcgtgttagttcctctgggaagctactgacaaataagcaaattaaaaagaaagagagcagcatgttgtcatagcaacagtgcaattaaattactttactgtcagccatgatataattttcctgtttggaagctcaggagacataaaactttcatttagagctaaagttgacttcagtggctgggtagttctgttttatactctactgtgggcatatgctggtcatcagaaaattttctgatgggatctgaggaaactttaagaaagacaagtggtgctataattcgttcataaagaagttaaaagcaggatcagaccagactctgttgtatccccaagccaaaagatgctagcttgttttttgtctgaaatgtgtcagggtaacctccttatttgacagaaagaaatattccctgtgagtgaacccaagacgtctggagcatcctgcctggtctgtactgcaatgcctcatgaagttttctctccttaagagttgggcatcttggccaggcgcggtggctcacgcctgtaatcccagcactttgggaggccgaggcgggtggatcacgagatcaagagattgagaccatcctggccaacatggtgaaaccccgtcttactaaaaatacaaaaattaaccagtcatggtggcacacgcctgtagtcccagctacttgggaggctgaggcaggagaatctcttgaacctgggaggcaggggttgcagtgagcggattttgcaccactgcactccagcctgggcaacagagtgagactctgtctcaaaaaaaaaaaaaaaaaaaaccggttgggcctctcaccacagctccccctt

SEQ ID NO: 15768 - DNA, 1048 bp, Homo sapiens
ttgccccggcttattactgccccaagaaggtaaatcacaaatcacctttcagtttcatcctttttaacgtaaggtgaatggtatgaaaaatttagcaggttcaggtctctgcagggaggatgggttacatagggttcaggtaattgggaggagggttttccaggagagactggtgttagtgaatggagtcgttggggagttcttcagtcacaaagcattatgcagatgcagttgttgttgttattctgaatcgaggcagggaggagggaaagggcccagcaggttgggacagtgcaaaggcctctgggggagttggcctgaaggctgagagataagactttggggaagggcagggttggggaggaagggaagccggagcctcggccactttctcatacttaattcaggggttccttttgtgcattcagacctgtgcccatcctctctcctaaagaggtcagcatccagcccctcttcatggcttggacacgtgaacccaccattgccatcatgtctgccttgctacagcctagttagcatcacctgaaaccataaataacatcaaagaaaagagcctattactaacccactgcagagtcccactgttgcccattgacaggttgacaggggttgaacgcactgctttgcagtgtacttttcatggcatctgtgtgaagagaccaccaaacaggctttgtgtgagcaacaaggctgtttatttcacctgggtgcaggtgggctgagtccgaaaagagtcagcgaagggagataagggtggggccgttttataggatttgggtaggtaaaggaaaattacagtcaaagggcgtttgttctctggcgggcaggagtcggggtcgcaaggtgctcagtgggggtgctttttgagccaggaaaaggactttcacaaggtaatgtcatcacttaaggcaagaaccggccatttacacttcttctgtggtggaatgtcatcagttaaggtggggcagggcatattcacttcttttgtgattcttcagttacttcaggccatctgggcctatacgtg

SEQ ID NO: 15769 - DNA, 1146 bp, Homo sapiens
attccctgcatttgccgtcaattggaagaggatgcaaaagaggagaaataagtggagcttcattttagtttgtggcaaagtcatacttgtcagcaaaatggcggcccccgggaggtctggatgtattggttactcacatctcagtttgccttaagcggatcaacttgaatgccttagacgaccaagttgtaatttcggaaggcacagatactaatggaaaagagatgaaaaggaagaaaatgaagtggaagctgcagactagaggcattcagtcgttgctggaggctggaataccaggaagttcctggaggggcagccctgtgtttgctggctgactcctccctacccacctgctcagtgacgatcacactgtgacttatgtggggggcagctggtagatactttgtgtgtgcatgtgcataagtgaataaagctaatgagatggagatgggaatgaccctgatattctgttcaaataatcagcctgtcttaaaggacactgttttatgtaaacctaaaaactggaaacaatgtttgaattaattttacaatacaatccagagtgatgtcctagcttactgcatctagaaagctcttgagttgagatttaaatggaaaattccaagtgtcttctccctcagtcaatgattaagaacaaatcttcatcaattggagaggatgtaacatagcctctcagtacctgaaatgataaatagctcaagttggaggtattagatcacacctcacattctttgcaactctgaaccctgtgagtttcagggagtctcttttgagtgcagacagtggtacaaaacataaccttgtgggacccccttgaaaagttcttctggattgtattagtccgttctcatgctgctaataaagacatactcaagctaggcgcggtggctcacgcctgtaatcccagcactttgggaggagggtggatcacgaggtcaagagattgagaccatcctacccaatgtgttgaaaacccgtctctactaaaaatacaaaaattagctgggagtggtggcgggtgcctgtagtcccagctacttgggaggctgaggcaggagaatcgcttgaacctgggaggcggaggttgcagtgagccaagatcgtgcgactgcactccagcctggc

SEQ ID NO: 15770 - DNA, 1031 bp, Homo sapiens
gatgctttaccgctgggatgattggaatatgagttggggaaccttctggacactcatgaacgcctgcattggtcaggcatgcacttttgtaatggaacaggagaagaagcctttgggaaaaggcagggggtgatgaatttggttactgttttcttttctttgagatggagtctcactctgtcacccaggctggagtgcagtggtgtgatctcagctcactgcaacttccgcctcccgggttcaagtgattctcatgcctcagccactaaagtagctgggatttacaggcgcacaccaccacgcttggctaatttttgtatttttagtagggccggtgtttcaccatgttggccagggtggtcttgaactcttgacctcaagtgatctgctggcctcggcctcccaaagtgccgggattacggtgtgagccaccgtgcctagtctgggtactcttttcagtctacagtctctgaactctgacaacttcctgtcgctctgagtgtgactgtgcttgtggttcctctgagagtcgaggtggagctacccaccccctctccacactggtctcatgtgtgatcggagctgtgtgctggggagatgcacagtcaggttagagggcagcttgggtcctggagctgcaatggacacacacccctctctgcttagctgtggctgccctcagtgcatatgcagggctggctccctggcagatctgactttctctggttctgtggctgtcataagatttattcagaatccctcttatgagttttggaactgaagctgttctcaaaccagtcgcagattctacttgttaagagaagcaatgtatacagaatatcggcagttaggaggcatgcgtgggttccagtcccagtctcactggcagtgagaccttgagcaagtcactcaacttccctgagcctcagggttttcatgtgcatcatggaggaattctccttcctgcctcctgcttttctctaatcttcccccatggtgagaggcctctcccaggaggaggtctgcctgct
